United States Patent 11,739,335 (NUCLEIC ACIDS ENCODING CRISPR-ASSOCIATED PROTEINS AND USES THEREOF) - sequence listing, part 11

SEQ ID NO: 8341 - RNA, 4890 nt, Artificial Sequence
  Cas9 variant
augaauuucaaaauucugccuaucgcuauagacuugggagugaaaaauacuggcguauucucugcauucuaccaaaagggaaccucgcuugaaagguuagacaacaaaaauggcaagguauaugaauuaucaaaagacagcuacacauuauuaaugaacaaccguacagccagacgccaccaaagacgaggcauugauagaaaacagcuaguaaaaagguuguuuaaacuaauauggaccgaacaacuaaauuuagaaugggauaaagauacccaacaagccauuagcuuucuuuucaacagaagaggauucucauucauaaccgauggauauucacccgaauaccuaaauauaguacccgaacaaguuaaagccauauuaauggacauauuugacgacuacaacggcgaagaugacuuagauuccuaucugaaacuagcgacagaacaagaaagcaagauuucagaaauauacaacaagcugaugcagaaaauacuagaguucaaacucaugaaacucugcacagauauaaaggacgauaaaguuucaacgaaaacacugaaggaaaucacgucuuacgaauuugaauuauuagcggacuaucucgcuaacuauucagaaucccuaaaaacgcaaaaauuuucuuacacagacaagcaaggcaauuuaaaggaauugucguauuaucaucaugacaaguacaacauacaagaauuuuugaagaggcacgccacaauuaacgacagaaucuuagauacucuucucacugacgaucuugacauauggaauuucaauuucgaaaaguuugacuuugauaaaaacgaagaaaaacugcaaaaccaagaagauaaagaccacauacaagcccaccuucaccacuucguauucgcagucaacaaaauaaaaucagaaauggcaaguggcggacgacacagaucucaauauuuccaagagauaaccaacguacuugaugaaaacaaucaccaagaagguuaucuuaaaaacuucugcgaaaaccuucauaauaagaaauacucaaaccucucagugaaaaaccuagucaaucucauaggcaacuuaucaaaucuagaacuaaaaccguugaggaaauacuuuaaugacaaaauacacgccaaagcagaccauugggaugaacaaaaauucacugaaacauacugucacuggauauuaggugaauggcgaguuggaguaaaagaccaagauaaaaaggauggagcaaaauauucguauaaagauuuaugcaaugaauuaaagcaaaaagugacaaaagccggacucguugauuuccuccuagaguuagacccuuguagaacaauacccccauauuuagauaacaacaacagaaagccaccaaaaugccaaagccuaauauuaaacccaaaauuuuuagacaaucaauauccaaacuggcaacaauacuugcaagaauuaaagaaauuacaaucuauccaaaauuacuuagacuccuucgaaacagaucuaaaaguccuaaagaguuccaaagaccaaccuuauuucguagaauauaaaagcucaaaccaacaaaucgcgucaggucaacgggauuauaaagacuuagaugcacgcauacuacaauucauauuugacagggugaaagcaucugacgaacuauuacuaaacgagauauacuuccaagcuaagaaauuaaaacaaaaagcaucaucggaacucgagaaauuagaguccucaaagaaauuagaugaaguaaucgcaaauucacaacuaagucaaauauuaaaaucacaacauacuaacggaauuuuugaacagggaacguuucuucaccuaguuugcaaauauuacaaacaacgucaacgggcuagagacagucgauuauacauuaugccagaguacagauacgacaagaaacuucauaaauacaacaacacaggaagauuugaugacgacaaucaacuacuaacuuacuguaaucacaaaccuaggcaaaaacgauaccaacuguuaaacgaccuagcaggcguccuucaaguaucaccaaauuuucuaaaagacaagauuggcucagacgaugaucuauucauaagcaaauggcuuguugaacauauaagagguuuuaaaaaggcgugcgaagauagccucaaaauucagaaagauaaucgcggguuacuuaaucacaagauaaacauugcgagaaacacaaagggcaaaugcgaaaaagaaauuuucaaucuaauaugcaaaauugaaggaucagaggacaagaaagggaauuauaaacacggacucgcauacgaacucggaguacuacuuuuuggggaaccaaaugaggcuuccaaaccugaauuugacaggaaaauaaagaaauuuaacagcauauacucuuucgcacaaauacaacagaucgccuuugcagaaagaaaagguaaugcaaacacaugcgcagugugcuccgcagauaacgcacaccgcaugcaacaaauuaaaauaacagaaccaguagaagacaauaaagacaaaauaauacugagugccaaagcacaaagacucccagccauaccaacaagaauaguagacggagcagucaaaaagauggcaacuauuuuagccaaaaauauaguagaugacaauuggcaaaacauaaaacagguacuuagcgcaaagcaucaacuacacauacccauaaucacagaaaguaaugcauucgaauuugaaccagcccucgcggacgucaaaggaaaaagccuaaaagacagacgaaagaaagcacuagaaagaauuucaccagagaauaucuucaaagacaaaaauaacagaauaaaagaguucgcaaaaggaauaucagcauacucuggagcgaauuugacugauggagauuuugacggggcaaaagaagaacuagaucauauaaucccucgaagccacaagaaauauggaacacuaaaugaugaagccaaccuaauuuguguaacccgcggugacaacaaaaauaaaggaaacagaaucuucugcuuaagagauuuagcagauaauuauaaauuaaaacaauucgaaacaacagaugacuuagaaauugaaaagaaaaucgccgacacaauuugggaugcuaauaagaaagauuuuaaauucgguaacuaucgaaguuuuauuaaccucacgccacaagaacaaaaagcauucaggcaugcucuauucuuagcugacgaaaaccccauaaaacaggcgguaauucgagcaauaaacaaccgaaaccgcacauuuguaaacggaacucaaagauacuuugcagagguacucgccaacaauauauauuuaagagccaagaaagaaaaccuuaacacagacaaaauuuccuucgacuacuucggaauaccgacaaucggaaacggaagaggcauagcagaaauaagacaauuauacgaaaaaguugacucagacauacaagcguaugcaaaaggagauaaaccacaagccucauacagccaccuaauagacgcaauguuagcguucuguauagcggcagacgaacacaggaacgacggaucaaucggacuagaaauagauaaaaacuacucgcuauacccacuagauaaaaauaccggggaaguuuucaccaaagacauauuuucucaaauuaaaauaaccgacaacgaguucucagauaagaaauuaguacgaaagaaagcaauagaagguuucaauacccauagacaaaugacgagagacggaauuuaugcagaaaauuacuuaccaauccucauacacaaagaauuaaacgaagugagaaaaggcuauaccuggaaaaauagcgaagaaauuaaaauuuucaaaggaaagaaauacgacauccaacaacuuaacaauuugguuuacugccugaaauuuguagauaaacccauuuccauagauauacagauauccacauuggaagaacuuagaaacauccuaacuacaaauaacauagcagcaacggcagaauauuauuauauaaauuuaaaaacccaaaagcuacacgaauauuacauagaaaauuauaauacagccuuaggcuauaagaaauauucaaaagaaauggaguucuuaagaucauuagccuacagauccgaacgugugaaaauaaaaucaauagacgauguaaaacaaguucuggacaaagacucaaauuucauaaucgguaaaauaacauugccauucaagaaagaauggcaacgucuauaccgugaauggcaaaauacaacaauuaaagacgauuacgaauuucucaaaucguucuucaauguaaaaucuaucacuaaacuacauaagaaaguacgaaaagauuuuagcuuaccgauauccacaaacgaaggaaaauuucuuguuaaaaggaaaacuugggacaacaauuuuauuuaccaaauuuuaaacgauucagacagccgagcggacggcacuaaaccauucaucccggcauucgauaucagcaaaaaugaaauaguugaagccauaauagauucguucacaagcaaaaacauauuuuggcuaccgaaaaauauagaauugcaaaaaguugacaacaaaaauaucuucgcuauagacacgagcaaaugguuugaagucgaaacaccaagugaccuaagagauauaggaauagcaacaauucaauacaaaauugacaacaauucaagacccaaaguacgaguuaaauuagauuacguaauagacgaugauucaaaaaucaauuauuucaugaaucacucgcucuuaaaaucucguuacccugacaaaguauuagaaauacuaaaacaauccaccauaaucgaguucgaaucaucuggauuuaacaaaaccaucaaagaaauguuaggaaugaaguuagcugggauauacaaugaaacaaguaauaacuga

SEQ ID NO: 8342 - RNA, 3162 nt, Artificial Sequence
  Cas9 variant
augaaacgaaauuauauccuuggacuagacaucggaauaacaucgguuggguaugggauaaucgacuacgaaacaagagacguaauagacgcaggaguacgguuauucaaagaagcuaauguggaaaacaacgaaggaagacgcucaaaaaggggagcacgcagacuaaaacgaagacgacgacaccgaauacaaagagugaaaaaacuauuauucgacuauaaucuccuaacagaccacucagaauuaucaggaauaaauccauacgaagcaagaguaaaaggauuaucacaaaaacuuagcgaagaagaauucucugcagcccuucugcaccuagccaagcgcagaggaguccacaacgucaacgaaguggaagaagacacggguaacgaacuaagcacaaaagaacagaucaguagaaacagcaaagcacuagaagaaaaauacguagcggaacuccaacuggaacgccuaaaaaaagacggagaaguacgcggaucaauaaauagauucaaaacaucggauuacguaaaagaagccaaacaacugcuaaaaguacaaaaagccuaccaccagcuggaucaaagcuuuauagauacauacauagaccuuuuagaaacacgacgaacauacuacgaaggaccaggcgagggauccccguucggcuggaaagauauaaaagaaugguacgaaauguuaaugggacauugcacauauuucccagaagaacuucgcucagugaaguacgcuuacaacgcugaucuguacaaugcacuuaacgauuugaauaaucuagucaucacaagagacgaaaaugaaaaauuagaauauuaugaaaaauuccaaaucauagaaaauguauuuaaacaaaaaaaaaaaccaacacuaaaacaaauagccaaagaaauacuaguuaacgaagaagauauaaaagguuacagaguuacauccacgggaaaaccagaauucacuaaccucaaagucuaccacgacaucaaggacaucacagccagaaaagaaauaauugagaacgcagaacuuuuagaucagauugcaaaaauccuaaccauauaccaaucaucagaagacauucaagaagaacucacuaaucucaacucagaacugacccaagaagaaauagaacaaauaucaaaucucaaagguuacacuggcacacacaaccuaucccuuaaagcaauaaaucuaaucuuagaugaguuauggcauaccaacgacaaucaaauagcuaucuuuaaucgacucaaguuagucccaaaaaaaguagaccuaagccaacaaaaagaaauacccacaacucucguugacgacuuuauacuaucacccguagugaaaagaucuuuuauacaaucuauaaaaguaauaaaugccauuauaaaaaaauacggacuaccaaacgacauaauaauagaacuagcaagagagaaaaacaguaaagacgcacaaaaaaugauaaaugagaugcaaaaaagaaauagacaaacaaacgaaagaauagaagaaauaauuagaaccacaggaaaagaaaaugcgaaauauuuaauagaaaaaaucaaacugcacgacaugcaagaaggaaaaugccuauauagucuugaagcaauaccccuagaagauuuauuaaauaaccccuucaacuacgaaguagaccauaucauaccuaggucugucaguuuugacaacucauuuaacaacaagguacuuguaaaacaagaagagaacaguaaaaaagguaacagaacaccauuccaauaucuuuccuccuccgacuccaaaauaaguuacgagacauucaaaaaacauauauuaaaccuggcaaaaggaaaaggaagaauaaguaaaacaaagaaagaauauuuacuugaagaaagagauauaaaucgcuucagcguucaaaaagacuucauuaacagaaaccuaguagacaccagauaugcaaccagaggucucaugaaccuauuaagaagcuauuuuagaguaaauaaucuugacgugaaaguaaaaaguauaaauggagguuuuacuaguuuccuacgaagaaaauggaaguucaaaaaagaacgaaauaaaggauauaaacaucacgccgaagaugcucuaauaaucgcaaacgcagacuucauauucaaagaauggaaaaagcucgauaaagcaaagaaaguaauggagaaucaaauguuugaagaaaaacaagcagaaaguaugccugaaaucgaaacagaacaagaauacaaagaaauauuuauaacaccccaccaaaucaaacacauaaaagacuucaaagacuauaaauauagccacagaguagauaaaaaaccaaaucgggaauugauuaacgacacacucuacagcacacgaaaagaugacaaaggaaauacucuaauaguaaacaacuuaaacggcuuauaugauaaagauaacgacaaauuaaaaaaacugauaaacaaauccccagaaaaacuacuaauguaccaucacgacccacaaaccuaucaaaaacuaaaacuuaucauggaacaauauggagaugaaaaaaacccauuauacaaauacuacgaagagaccggcaacuaccuaacaaaauacucuaaaaaagacaauggacccguuauaaaaaaaaucaaauauuauggaaauaaacuaaaugcacauuuggacauaacagacgacuacccaaacucacgcaacaaaguaguuaaacucucacuaaaaccauaucgauucgauguauaccucgacaacggaguauauaaauucgucacggucaaaaaccuagaugucaucaaaaaagaaaacuacuacgaaguaaacucaaaaugcuacgaagaagcaaaaaaacuuaaaaaaauaucuaaucaagccgaauucauagcaagcuucuauaauaaugaccuaauaaaaaucaacggagaacuauaccgcguaauagguguuaacaacgaccuucuaaaucggauagagguaaacaugaucgauauuacauacagagaauacuuagaaaacaugaaugacaaaagaccucccaggauaauuaaaacgauugccucuaaaacccaguccauaaaaaaauauucaacagauauccuuggaaaucuauaugaaguaaaaucaaaaaaacacccucaaauaauaaaaaaaggauga

SEQ ID NO: 8343 - RNA, 4230 nt, Artificial Sequence
  Cas9 variant
auguuauuuaauaaaugcauaaucauuucuauuaaccuagauuucuccaauaaagaaaaauguaugacaaaacccuacucaauagguuuggauauaggaacaaauucaguagggugggcaguaaucacagauaacuauaaagugccaucaaagaaaaugaaaguauuaggaaacacauccaagaaauacauuaagaaaaauuuauuaggagugcuucuguuugacucaggaauaaccgcggaaggacgcagacuaaaaagaacagcacgacggcgcuacacaagacgaagaaaccgaauacuauaccuacaagaaaucuucucuaccgaaauggcaacucuagacgaugcauucuuucaaagauuagacgacucauuucucguuccagaugacaaaagagacucaaaauacccaaucuuugguaacuuaguagaagaaaaaguauaccaugacgaguucccaacuauauaccaccuuagaaaauaucuagccgacuccacuaagaaagcagacuuacgccuagucuaucuagcauuagcucacaugaucaaauaccgaggacacuuucuaauagaaggggaguucaauagcaaaaauaacgacauccagaaaaauuuucaagacuuuuuagacacauauaacgcuaucuuugaaucagacuuaucacuagaaaacucuaaacaacuugaagaaauaguuaaagacaaaauaagcaaacuagagaagaaagaucgaauacucaaauuauuucccggagagaaaaauucuggaauauuuagcgaguuccuaaaacuuauuguaggaaaucaagcagauuuucguaaauguuucaaccuugacgaaaaggcuucacuucacuuuagcaaagaaagcuacgacgaagauuuagaaacacuacuuggauacauaggagacgacuauuccgacguuuuucuaaaagccaagaaacuguaugaugcgauccuucuaucaggauuucuuacgguaaccgauaacgaaacugaagcgccguuaaguucagccaugauuaaaagauauaaugaacacaaagaagaccuggcccuacuaaaagaauauauaagaaacauaucccuaaaaacauacaacgaaguauuuaaagacgauacgaaaaacggcuacgcaggauauauagauggaaaaacaaaccaagaagacuuuuauguauaccucaaaaacuuacucgccgaguucgaaggcgcagauuacuuucucgagaaaaucgaccgagaagauuuucuacggaaacagcgaacauucgacaacggaagcauaccuuaucaaauacaccuacaagaaaugagagcuauauuggacaaacaagccaaauucuauccauuccuagcgaagaacaaagaacgaaucgagaaaauuuuaaccuucagaauaccauacuauguaggucccuuagcaagaggaaauagugauuucgcauggagcauacggaaaagaaacgagaaaaucacaccauggaacuuugaagauguaauagauaaagaaucaucagcugaagcauucaucaauagaaugacaucauuugaccuauaccuuccugaagaaaaaguccuaccaaaacauagcuuacuuuacgaaacauucaacgucuacaacgaacuaacaaaaguuagguuuauagcagaaucuaugcgggacuaucaguuccuagacagcaaacagaagaaagacauaguuagacucuacuuuaaagacaaaagaaaagucaccgacaaagacaucauugaauacuuacaugcuaucuauggauaugacggaauagaauuaaaaggaauagaaaaacaauucaauucaagccucucaacauaccacgaccuacugaacaucauaaacgacaaagaguuccuagaugauaguucaaaugaagcaaucauagaagaaauaauucacacguuaacaauauucgaagacagagaaaugauaaaacaaagacuaucuaaauucgaaaauauauucgacaaauccguacugaagaaacuaucuagaagacauuacacaggaugggguaaauuaucagcaaaauuaaucaacggaauacgugaugaaaaaucugguaacacgauucucgacuacuuaauagacgaugguauaucaaaucguaauuucaugcagcuaauacacgacgaugcgcucagcuuuaaaaagaaaauacaaaaagcacaaauaauuggugaugaagacaaaggaaacauuaaagaaguaguaaaaucauuacccgggucuccugcuaucaagaaaggaauacuccaaucaauaaaaaucguagacgaacuuguaaaagucaugggcgguagaaaacccgaaaguauuguggucgaaauggcacgagaaaaucaguauacgaaccaaggaaaaucgaacucacaacaaagacuaaaacgccuagagaaaagccuuaaagaauuagguucaaaaauacuuaaagaaaauauaccagcaaaauuaaguaaaauagauaacaacgcacuacaaaaugauagacuauacuuauacuauuuacaaaacggaaaagacauguauacaggagacgaucuagauauagaccguuuaagcaacuacgauauagaucauaucauaccacaagcauuccuaaaagacaacucaauugacaauaaaguccugguaucuucggcgucaaauagaggaaaaagcgacgacuuuccauccuuggaagugguuaagaaacgaaaaacuuucugguaucaauugcuaaaaucuaaauuaauaucgcaaagaaaauucgauaaccuaacuaaagccgaacggggugggcuauuaccagaggauaaagccggauuuauucagcgacagcuagucgaaacuagacaaauaacuaaacauguagcacgacuacuagacgaaaaauucaacaacaagaaagaugaaaauaauagagccguaagaacaguaaaaaucaucacuuuaaaaucaacccuagugucacaauucagaaaagacuucgaacuuuauaaaguacgagaaaucaaugauuuccaccaugcacacgacgccuacuuaaaugcuguuaucgcaucagcacuacuaaagaaauacccgaaacucgaaccagaguucguuuauggugacuauccgaaauacaacaguuucagagaacgaaaaucagcaacagaaaaaguuuauuuuuauaguaacauuaugaacauauucaagaaauccauaucacuggcagauggccgaguuauagaacgaccacucaucgaagucaaugaagaaacuggagagucaguuuggaauaaagaaucagacuuagcaacaguacguagaguacucucauacccccaaguaaacgucgucaagaaaguugaagaacaaaaucacggauuagacagaggaaaacccaaagggcuauuuaacgcaaaccuauccucuaaacccaaaccaaacagcaacgaaaaucuaguaggugcuaaagaauaucuagacccaaagaaauacggcggcuacgcaggaauuaguaauuccuuugcgguucuaguaaaaggaacuauagagaaaggcgcuaagaagaaaauuacuaauguacuugaauuucaaggcaucucaauacuagacagaaucaauuaucgaaaagauaaacugaacuuccucuuagagaaagguuauaaagacauagaauuaaucaucgaacuaccaaaauauuccuuauucgaacuaagugauggaagcagacgaaugcuagcaagcaucuuaucgacaaauaacaaaagaggagaaauucauaaagggaaccaaaucuuccuaucgcaaaaauucguaaaacuccuauaucaugcaaaacgaauaucaaauacgauaaacgagaaucacagaaaguacguggagaaccauaagaaagaguuugaggaauuguucuacuacauccuagaauuuaacgaaaauuauguuggugccaagaaaaacggaaaacuauuaaauucagcauuccaaucuuggcaaaaccacaguauagaugaacuaugcaguucauuuauagguccaacgggaucagaacgcaaaggacuuuuugaacuaacaagcagaggcuccgcagcugauuucgaauuuuuagguguaaaaauaccacguuauagggacuauacacccagcucccuuuuaaaagacgcaacguugauccaccaaucaguaacuggauuauaugagacacgaauagauuuggcaaaacuaggagaaggauga

SEQ ID NO: 8344 - RNA, 3306 nt, Artificial Sequence
  Cas9 variant
augugguaugcaagucuuaugagcgcgcaccaccuuaggguugggauagauguuggaacacauucaguaggucuagcaacguuaagaguagacgaccauggaacaccaauagaacuauuaagugcauuaagucacauacaugauucaggcguaggaaaagaaggaaagaaagaucacgauacgaggaagaaauuaaguggaauagcaaggcgagccagaagauuacuacaccaccgaagaacacagcuacaacaauuagacgaaguucuaagagaucuaggcuuccccauuccaacuccaggcgaauuuuuagauuuaaacgaacaaacagacccauaccgaguauggcgaguucgugcuagauuaguagaagaaaaacuaccagaagaacugcgagggccugccauaucgauggcaguucggcauauugcgagacauagaggauggagaaauccguauaguaaaguagaaagccuucuaaguccugcugaagaaucaccauucaugaaagccuugagagaacgaauauuagcaacuacaggagaagugcuagaugauggaauaacaccggggcaagcaauggcacaaguugcuuuaacucauaacauuaguaugagaggaccagaaggaaucuugggaaaauuacaccaaucagauaaugcaaacgaaauacguaaaauaugugcaaggcagggaguaaguccggauguaugcaaacaauuacuucgcgcuguguuuaaagcagacaguccgagaggaagcgcgguuucacgaguagcuccugauccacuaccaggacaaggaaguuuuagacgagcgccaaaaugcgaucccgaguuccaaagauuuagaauuauaaguauuguugcgaaucuaaggaucagugaaacaaaaggagaaaauagaccauuaacagcagaugagagacggcacguagugacuuucuuaacggaagauucucaagccgaucuaacauggguagaugucgcugaaaaauuaggaguacauagaagagaucuacguggaacagcaguucauaccgacgauggagaaagaucugcugcaagaccaccgauugaugcaaccgacagaauaaugagacaaacaaaaauaaguuccuuaaaaacauggugggaagaagcugauucagaacaaagaggugcaaugaucagguaucuuuaugaagauccgacugacagcgagugugcggaaauaauagcugagcuuccagaagaagaucaagcaaaauuagauagcuuacauuugccagcugguagggcagcguacucucgagaaaguuuaacagcgcugucagaucauauguuagcgacaacagaugauuugcaugaagcaaggaaaagguuguucggcguagaugauucgugggcaccuccugcugaagcaauaaaugcaccaguaggaaauccaucaguugauagaacucuaaaaauuguuggaagauaucuaagcgcaguugaaaguaugugggggacaccagaaguaauacacguagagcaugugagagauggguuuacaagugaaaggauggcugacgaacgagacaaagcaaauaggcggagauacaaugacaaccaggaagcaaugaagaaaauacaacgugauuacggaaaagaaggauauauuucucgaggagauauagucagacucgacgcuuuagagcugcaaggaugcgcuugccucuauuguggaacuacaauaggguaccauacaugucaauuagaucacauaguaccucaagcaggacccggaagcaauaauagaagggguaauuuaguagcuguuugcgaaagauguaacagaagcaaaagcaauacuccauucgcgguaugggcgcaaaaaugcggcauuccacauguaggggugaaagaagcaaucggacgagugcgugguuggagaaaacaaacuccaaacacauccucugaagauuuaacaaggcuaaagaaagaaguaaucgcucgauuaagaagaacacaggaagauccagaaauagacgagagaucaauggaaucaguugcguggauggcuaacgaauuacaucaccgaauagcagcggcauaucccgaaacaacaguuaugguauacagaggaaguauaacugcugccgcuagaaaagcagcagguaucgauucaagaauuaauuuaauaggagaaaaaggcagaaaagacagaauagaucgaagacaucaugcaguagaugcaucaguaguagccuuaauggaggcuagugucgcaaaaacuuuagcugaacguaguagccuaagaggagaacaacgucuaacaggaaaggaacaaacauggaaacaauauacagguagcacuguaggggcacgugaacacuuugagauguggcgagggcacaugcuacaucuaaccgaauuguucaacgaaagauuagcagaggauaaaguguacguaacacaaaauauaagauuaagacuuucggacggaaacgcccauacaguaaauccauccaaauuggugagccacaggcuaggagauggguuaacagugcaacaaauagaucgagcuuguacuccagcacuuuggugugcauuaacaagagaaaaagauuuugacgagaaaaacggauugccagcccgagaagauagagcaauuagaguccauggacaugaaauaaaaucuucagauuauauacaaguuuucagcaaaagaaagaaaacggauuccgauagggaugaaacaccauucggcgccauugcgguuagaggagguuuuguggaaauuggaccaucaauacaucacgcucgcauuuauagaguagaagggaagaaaccaguauaugcuauguuaagggucuucacacacgaucuauuaagucaacgacauggcgauuuguuuuccgcaguaauucccccgcaaagcauaucaaugagaugugcagaacccaaauuaagaaaagcaauaacaacagggaaugcaacauauuuagggugggucguaguaggagacgaauuagaaauuaacguagacucauucacaaaauaugcuauaggacgguuccuagaagacuuuccuaauacgacaagauggagaaucuguggauaugauacaaacagcaaauugacacuaaaaccuauaguauuagcagcagaagguuuagaaaauccaagcagugcaguuaaugaaaucgucgaauuaaaaggcuggcgcguagcaauuaauguacuuaccaaaguacacccgacaguaguaagaagagaugcucuagguagaccaagauacucaucaagaucaaaccuaccgacuucauggaccaucgaauga

SEQ ID NO: 8345 - RNA, 4167 nt, Artificial Sequence
  Cas9 variant
augacaaaaccauacagcauaggguuagauauuggaaccaacucaguagguugggcaguuaccacugacaacuacaaaguaccaucgaagaaaaugaaaguacuugguaacacaucgaagaaauauauaaagaaaaauuuacuagguguacuacucuucgauuccgguauaacggcugaaggcagaaggcuaaaaagaacagcccguagaagauacacacgcagaagaaauagaauccuauauuuacaagaaaucuuuucaacagaaauggcaacuuuagaugaugccuucuuccaacgauuagacgacucauucuuaguaccagacgauaaaagagauaguaaauauccaauuuucggaaacuuaguagaagaaaaagcauaucaugaugaauuucccacaaucuaucaccuaagaaaauaucuggccgauagcacaaagaaagcagaccuacggcuaguauauuuggcccucgcacauaugauuaaauacagaggacauuuccucauagaaggagaguucaacuccaaaaauaacgauauccagaaaaacuuccaagacuuucucgauacauauaaugccauauuugaaagcgauuuaagucuagaaaacucgaaacaauuagaagaaauuguaaaagauaaaauaucaaaacucgaaaagaaggauagaauacucaaacuauuucccggagagaaaaacagugguauauucucugaauuuuuaaaacuaauuguuggaaaccaagcagauuuucgaaaaugcuuuaaucuugaugaaaaagccucacuacauuuuucaaaagaaucauaugacgaagaccuggaaacauuacuaggcuauauaggggaugacuacucagauguuuuccugaaagcuaagaaacucuacgaugcaauucuauuaucagguuuccucacagugacugacaaugaaacagaagcaccccucuccuccgcgaugauaaaaagauacaaugaacacaaggaagauuuggcacuauuaaaagaguauauccgaaauauaucuuuaaaaacauauaaugaaguauuuaaggaugauacuaagaauggauaugcaggauauauagacgggaaaacaaaccaagaagauuuuuauguauaccugaagaaacuacuagccgaguucgaaggagcugauuacuuuuuagagaaaauagauagagaagauuucuuaaggaaacaaagaacuuuugacaacggaucaauacccuaucaaauacaucugcaagaaaugagggcuauccuagacaaacaagccaaauuuuaucccuucuuagcuaaaaacaaagaaagaauugaaaagauacuaacguucagaauacccuacuacgucgggccgcuugcacgagguaauuccgauuuugcauggaguauucgaaaacggaaugagaaaauuaccccauggaacuucgaagacguaauugauaaagaaucauccgccgaagcauucauaaacagaaugacaaguuuugauuuguaucuaccagaagaaaaaguccuuccgaaacacaguuuauuauacgaaacauuuaauguauauaacgaacuaacaaaagucagauucauagcagaaaguaugagagauuaccaauucuuagacaguaagcaaaagaaagacauaguacgccucuauuucaaagacaaacgcaaagucacagacaaagacauaauagaauaccuacacgccauauauggcuaugauggaauagaacucaaagguauagaaaaacaauucaacucaucauuaucgacguaccaugauuuacuuaacauuaucaaugauaaagaauuuuuagaugauucuucaaaugaggcaauuaucgaggaaauuauacacacgcucacaaucuuugaagacagagaaaugauaaaacaacgacuauccaaauuugaaaauauauuugauaaaucaguccuaaagaaacuaucaagacgacauuacacaggguggggaaaacucagugcaaaauuaauaaacggaauaagagaugagaaaucaggaaauacaauauuagacuauuuaauugacgacggcauaucaaauagaaauuucaugcaacuuauccaugacgaugccuugucauucaaaaagaaaauucaaaaagcucaaauuauaggagaugaagauaaagguaacauuaaagaaguuguaaaaucccugccaggaaguccugcaauaaagaaaggaauacuacaaucaauaaaaauaguagacgaauuaguuaaagucaugggcggaagaaaaccggaaucaauagucguagaaauggccagagaaaaccaauauacaaaucaagguaaaucaaauagucagcagagauuaaaaagauuagaaaaaucauuaaaagaauuaggaucaaaaauucucaaagaaaacauuccagcaaaacuauccaaaaucgauaauaacgcacuacaaaacgaccggcuuuacuuauauuaucuucaaaauggaaaagacauguacacgggugacgacuuggauauagauaggcuuuccaauuacgauauagaucauauaauaccacaagccuuuuugaaagacaauagcauagacaauaaaguccuaguaucaagugcaucaaaucggggaaaaucagaugacguccccagucuagaaguuguuaaaaagcgaaagacauucugguaucaacuguuaaaguccaaacugauuagucaacgaaaauucgacaaccucacgaaagcggaaagaggaggacuaucaccagaagacaaggcuggcuucauccaaagacaguuaguagaaaccagacaaauaacaaaacacgucgccagacuguuagacgaaaaauucaacaacaagaaagacgaaaacaaucgagcaguaagaaccguaaaaauaauaaccuuaaaaucaacacucguuucccaauuccgaaaagauuucgaacuauauaaaguacgagaaauuaaugacuuucaucaugcucacgaugcuuaucugaacgccgucguagcaagcgcauuacuuaagaaauacccuaaacuagaaccagaauuuguauacggcgauuacccaaaauacaauuccuuccgagaacgcaaaucagcaaccgaaaaaguauacuuuuauuccaacaucaugaacauauuuaagaaauccauaucucuagccgacggacgaguuauugaacgaccgcuaauagaaguuaaugaagaaacaggagaaaguguguggaauaaagagucugacuuagcgaccguaagaaggguccuaaguuauccacaaguaaauguaguaaagaaaguagaagaacaaaaccauggacuagaccgcggaaaacccaaaggacuauuuaaugcaaaccugaguagcaaaccaaaaccaaacucaaacgaaaaccucguuggcgcaaaagaauaccuagaucccaagaaauacggcggcuacgcugguauauccaauagcuuuacaguccuaguaaaagguacaauagagaaaggagccaaaaagaaaauaacaaacguauuagaguuccaaggaauaucuauacuagaccgaaucaacuacagaaaagauaaacucaauuucuuacuggaaaaaggguauaaagacaucgaauuaaucauugaacugccuaaauacagccuuuuugaacucucggacggcucaagacguauguuagcaagcauacuguccacgaacaauaaacguggggaaauacacaaaggaaaccaaauauuucuuucacaaaaauucguaaaauuacuauaccacgcaaaaagaauaagcaauacaauaaaugaaaaccauagaaaauacguagaaaaucauaagaaagaauuugaagaacucuuuuacuacauuuuggaguucaacgaaaacuauguuggagcaaagaaaaacggcaaacuucuaaacucugcauuucaaagcuggcagaaucacaguauagacgaacuauguucaaguuucauagggccaacugggagcgaaagaaaaggacuauuugaacuuacaucaagaggauccgcagcggauuucgaauuuuuagguguaaaaauaccacguuauagagacuacacaccaucaaguuugcugaaagaugcuacauuaauacaccaaagugucacuggauuauaugaaacuagaaucgauuuagccaaacuaggagaaggcuga

SEQ ID NO: 8346 - RNA, 3249 nt, Artificial Sequence
  Cas9 variant
auggcagcauucaaaccgaauagcauaaauuacauuuuaggauuagauauuggaauugccucaguaggaugggcgaugguugaaauagaugaagaagaaaauccuauuagauugauagaccuuggagugcgaguauucgaacgagcagagguaccuaaaacgggggauaguuuagcaauggcacgacgguuagcaaggucuguaagaagacuaacaagaaggagagcacauagacuacuaagaacgagacgacuacucaaaagagaaggaguauuacaagcugcaaacuucgaugaaaacggccucauaaagagcuuaccaaauacuccguggcaacugagagcagccgccuuagaccgaaaacugacaccucuugaauggucagcuguacuauuacaccuaauaaaacacagagguuauuuaagucaacgaaagaaugaaggagaaacagcagauaaagaacuaggagcguuacuaaaaggcguggcgggaaaugcccacgcucugcaaacuggcgauuucagaacaccggcagagcuugcauuaaauaaauuugaaaaagaaucaggucauauaagaaaccaaagaagugauuacucacauacguuuucacgaaaagaucuacaagcggaacuaauauuauuauucgaaaaacagaaagaauuuggcaauccccauguaucaggcggauuaaaagaaggaauagaaacauuacuaaugacacagagaccagcacugucaggugacgcaguucagaaaauguugggucacugcacuuucgaaccagcagaaccaaaagcugccaaaaauacauacacagcagaacgcuuuauuuggcuaacaaaacuuaauaauuuacguauacucgaacaaggaucagagagaccacuaacugauacagaacgggcgacucuaauggaugaaccauacagaaaaagcaaacugacauacgcgcaagcaagaaaauuacuugguuuagaagacaccgcauuuuucaagggacuaagauauggaaaagauaaugcagaagcgucaacccuaauggaaaugaaggcauaccaugcaauuucaagagcacuugaaaaagaaggacuuaaagacaaaaagucaccccuaaaucuuagcccagaacuucaagacgaaaucgggacagcauuuaguuuguuuaaaacagacgaagauauaacuggaagauuaaaagauagaauacaaccagaaauauuggaagcacuacucaaacauaucucuuucgauaaauuuguacaaaucagucuaaaagcauuaagacguauagugccauuaauggaacaaggaaagcgauacgacgaggccugugcagagauauauggagaucacuauggcaagaaaaauaccgaagagaaaauauaucuucccccaaucccagcagaugaaauacgcaauccaguaguuuuaagagcucuuucacaagcaaggaaaguaauuaauggaguuguuagacgauacggaucaccagcuagaauccauauagaaacugcaagagaaguaggcaaaucauuuaaagauaggaaagaaaucgagaaaagacaagaagaaaaccgaaaagauagggaaaaagcagcagcaaaauuuagagaauacuuuccuaauuuuguaggagaaccaaaaucaaaagauauacuaaaacuccgucuauacgaacaacaacauggaaaaugcuuauauaguggaaaagaaauaaauuuaggucgacuaaaugagaaaggguacguggaaauagaucaugcuuuacccuucucaagaaccugggacgauagcuuuaauaauaaaguacugguacuuggaucggaaaaucaaaauaaagguaaccaaaccccguaugaauacuuuaauggcaaagauaauaguagagaauggcaagaguucaaagcacgaguagaaacauccagauucccaagaucaaagaaacaaagaauauuacuacagaaauucgacgaagacggauuuaaagaaagaaauuuaaacgauacuagauauguaaacagguuuuuaugucaauuuguggcagaccgaaugagacuaacaggaaaaggaaagaaaagagucuucgcaaguaauggucaaaucaccaauuuauugagaggauuuuggggccuuagaaaaguuagagcagaaaaugauagacaucaugcguuagacgcagugguuguggcuugcagcacuguugcaaugcagcagaaaauaaccagauuuguacgauauaaagaaaugaaugcauucgauggcaaaacaauagacaaagaaacaggugaaguuuuacaucagaaaacacauuuuccccaacccugggaguucuuugcacaagaaguuaugauaagaguauucggaaaaccugacgggaaaccagaguucgaagaagccgauacauuagaaaaacugagaacucuccuagcggaaaaacuuagcucaagaccagaagcaguacacgaauauguuacgccguuauucgucucaagagcuccaaaucgcaaaaugucaggacaaggacacauggaaaccguaaaaagcgcaaaaagacuagacgaaggcguaagcguacugagaguaccauuaacacaauuaaaauuaaaagaucucgagaaaauggucaacagagaaagagaacccaaauuguaugaagcacuaaaagcacgacuagaagcgcauaaagaugacccagcaaaagcauuugcggaacccuuuuacaaauaugauaaagcagguaaucgaacacaacaaguaaaagcaguacgaguagaacaagugcagaaaacaggaguuuggguacgaaaucacaauggcauugcugacaaugcaacaaugguacgcguagacguauucgaaaaaggagauaaauacuaccuagucccuauuuacaguuggcagguugcaaaaggaaucuuaccagauagggcuguaguacaaggaaaagacgaagaagacuggcagcuaauugaugauucuuuuaauuuuaaauuuagccuucacccaaacgaccuaguugaaguaauaaccaagaaagcaagaauguuuggauauuuugcgagcugucaccgugguaccggaaauauuaauauaagaauacaugauuuagaccacaaaauagguaaaaauggaauccuagaaggaauagggguaaaaacggcauuaucuuuucaaaaauaucaaauagaugaacuaggaaaagaaauacgacccuguagauuaaagaaacgcccuccuguaagauga

SEQ ID NO: 8347 - RNA, 4005 nt, Artificial Sequence
  Cas9 variant
augaagaaacccuacacaaucggccuggacaucggaacuaacagcguaggaugggcaguauuaacugaucaauacgaccuggucaagaggaaaaugaaaauagcaggagacucagaaaagaaacaaauaaagaaaaauuuuuggggagucagacuauucgaugaaggucagacagcggcagaccgcagaauggcaagaacagccagaagaagaauagagagaagaagaaauagaauaagcuauuuacaaggaauuuucgcagaagaaaugucuaaaacagaugcaaauuucuuuugcagacuaagcgauucauuuuauguagauaacgagaaaagaaacucacgacauccauucuuugcuacuauagaagaagaaguagaauaccacaaaaacuauccaacaauauaucauuuacgugaggagcuagugaacagcagcgaaaaagcugauuuaagacucguauacuuagcauuagcgcauauuauuaaguacagaggaaauuuucuaauugaaggagcacuugauacacaaaacacaucuguagauggcaucuauaaacaauuuauacaaacauacaaccaaguguucgcaucggggaucgaagacggcagccuaaagaaacuugaagacaacaaagacguagcaaaaauccuaguagaaaaagugacgcgaaaagaaaaacuagaaagaauacucaagcuauauccaggagaaaaaucagcggggauguucgcucaauucauaucacuaauuguaggaaguaaaggaaauuuucaaaaaccauucgauuuaaucgaaaaaucagauauagaaugcgcaaaagacagcuaugaagaagaccucgaaucauuacuugcccugaucggagacgaauaugcagaacuauucguagcugccaaaaaugcauacucagccguaguacuaucuucaauaauaaccgucgccgagaccgaaacaaacgcaaaacuaucagcaucuaugauagagagauuugacacccaugaggaagaucuuggcgaauuaaaggcuuuuauaaaauuacaucucccaaaacauuacgaagaaauauuuucuaacacggaaaaacauggcuaugcaggauacauagacggaaaaacuaaacaagcagacuuuuacaaguauaugaaaaugacauuagaaaacauagaaggagcggauuacuuuauagcuaaaaucgagaaggaaaacuuucucagaaaacaacgaacauucgauaauggcgccauuccacaccagcugcacuuagaagaauuagaagcgauacugcaccagcaagcaaaauacuacccauucuuaaaggaaaauuaugauaaaauaaagucguuaguaacuuuccgaauaccauacuucgucgggccacuagcaaacggacaauccgaauuugcauggcuaacaagaaaagcggauggagaaauuagaccauggaauauagaagaaaaaguagauuuugguaaaucugccguagauuuuauugaaaagaugacgaauaaagauaccuaccuaccuaaagaaaauguauuaccuaaacauaguuuguguuaucaaaaauauuuaguauacaacgaauuaacuaaaguaagguauaucaaugaucaagguaaaaccucauauuucucaggacaagaaaaagaacaaauuuucaaugaucuauuuaaacaaaaacgcaaggucaaaaagaaagaccuagaauuauucuuacgaaauaugucgcacguugaaucuccaaccauagagggacuagaagacaguuuuaauucuaguuauagcacuuaccaugaccuucuaaaaguaggaauaaaacaggaaauacuagacaauccagugaauacagaaaugcuagagaauauagugaaaauauuaacuguuuuugaagauaaacgaaugauaaaagaacaacuacaacaauucuccgauguacuagacggaguuguauuaaagaaacuugaacgucgacacuauacgggauggggaagacucucagcaaaacugcugauggggauaagagauaaacaaucccacuugacuauccuggauuauuuaaugaacgacgauggccuaaacagaaaucuaaugcagcugauaaacgauucgaaucuaucuuuuaaaagcauaauagaaaaagaacaaguaacaacagcagacaaagacauacaaaguauagucgcagacuuagcagguucgccagcaaucaagaaaggaauacuacaaagucuuaaaauaguagacgagcuaguauccgugaugggcuacccaccgcagacgaucguaguagaaauggcucgagaaaaccaaacuacugguaaagguaaaaacaacagcagaccaagguacaaaucauuagaaaaagcuauaaaagaguucggaucccaaauacuaaaagaacauccuacggacaaccaagaacuaagaaauaauaggcucuauuuauacuaccuucagaacggaaaggacauguacacaggccaagacuuagauauacacaaucugucaaauuacgacauagaccacaucguuccacaaucuuuuauaacagacaauucaauagauaaccuaguacucacaagcucagccgggaacagagagaaaggcgacgacguaccaccgcuagaaauagucagaaagagaaaaguguucugggaaaaacuauaucaaggaaaucuuaugagcaagagaaaauucgacuacuuaacaaaagcagaaagagguggccugaccgaagccgacaaagcccguuuuauacauaggcagcuaguagaaacuagacaaauaacuaaaaauguagcaaacauacugcaccaaagauucaauuacgaaaaagacgaccacgguaauacaaugaaacaaguacgcaucgugaccuuaaaaucagcauugguaucacaauuucgaaaacaauuccaauuguauaagguucgggauguaaacgacuaucaucacgcacacgacgcauaucugaacggcgucguggccaauacucuauuaaagguuuacccacaauuagaaccugaguuuguguauggagacuaucaucaauuugacugguuuaaagcaaauaaagcaaccgcuaagaaacaauucuacacaaacauaaugcuauucuuugcacaaaaagaccggauaauagaugaaaauggugaaauacuaugggauaagaaauaccuggauacaguaaagaaaguuaugucguacagacaaaugaacaucguaaagaaaacagaaauccaaaaaggcgaguucuccaaagcuacuauaaaaccaaaaggaaacucuagcaaacuaauccccagaaaaacaaacugggauccaaugaaauauggaggccuagacaguccaaauauggcauacgcuguaguuauagaauacgccaaagggaaaaauaaauuaguauuugaaaagaaaauaauaaggguaacaauaauggaaagaaaagcguucgaaaaagaugaaaaagccuuuuuagaagaacaaggauauagacagccaaaaguucuagcaaaacuuccuaaauauacauuauacgaaugcgaagaaggaagaagaagaauguuagcaagugcaaaugaagcacaaaaaggcaaccaacaaguuuuaccaaaucauuuggucacauuacuacaccacgcugccaauugcgaggugagugacggcaaaucuuuggacuauauagaaagcaaucgcgagauguuugcggaguuacucgcacacguaagugaauuugcaaaacgauauacgcuugcagaagcaaaccuaaacaaaauuaaucaauuauucgaacaaaacaaagaaggcgacauaaaagcaauagcgcaaucauuuguagacuuaauggcuuucaacgcuaugggggcuccagccaguuuuaaauucuuugaaaccacuauagagagaaaaagguauaauaacuuaaaagaauuacuaaauucuacaauaauuuaccaaaguaucaccggauuauacgaaaguagaaaaagauuggaugauuga

SEQ ID NO: 8348 - RNA, 4038 nt, Artificial Sequence
  Cas9 variant
augaagaaaccauauaguauuggauuagauauaggaacaaacagcguaggaugggcagucgucacagacgauuauaaaguacccgcaaagaaaaugaaaguucuaggaaacaccgacaaaucucacaucgaaaagaaccuacuaggagcguuacuauucgauucagguaacacagcagaagaucgaagacuaaaaagaaccgcacgacgucgguacacaagacgcagaaaccgaauuuuauaucugcaagaaaucuuuucagaagaaauggguaaagucgacgauagcuucuuccaucgcuuagaagauaguuuccuaguuacagaagacaaaagaggagaaagacauccaauauucggcaaccucgaagaagaagugaaauaucacgaaaauuuuccaacaauuuaucaucuccgccaauaccuagccgacaaucccgaaaaaguagacuuaagauuaguauaccuagcccucgcccacauaauaaaauuuagaggacacuuccucauagaagguaaauuugacacuagaaauaacgacguccaaagacuguuucaagaauuucuagcaguuuacgauaacacauuugaaaacaguucacuacaagaacaaaauguucaaguagaagaaauacuuaccgauaagaucucaaaaagcgcaaagaaagauagaguacucaaacucuuuccaaaugagaaaagcaacggaagauucgcagaguuccuaaaacuaauaguaggaaaccaagcggacuucaagaaacacuucgaacuagaagaaaaagcuccccugcaauuuaguaaagauacauaugaagaagaauuggaaguacuacuggcacaaauaggugacaauuaugcggaacucuuccuaucugcuaaaaagcuauaugauuccauacucuuauccggaauacucacagucacagacgucgguacaaaagcaccguuaucagcgucuaugauacaaagauacaacgaacaccagauggaucuggcgcaauuaaaacaauuuauccgacaaaagcuaagcgacaaauacaaugaagucuucagugauguaucgaaagacggauaugcaggauacaucgaugguaaaacuaaccaagaagcauucuacaaguaccuaaaaggcuuauuaaacaaaauugaagguaguggauauuuucuagauaagaucgaacgagaagacuuuuuaagaaaacaacguacauucgauaauggcaguauuccgcaucaaauacaccuucaagaaaugagagccauuauaaggaggcaagcagaauuuuacccguuuuuagcagauaaucaagacagaauagagaaacuacuaacauuccgaauaccauacuacguuggacccuuagcacgaggaaaaucugauuuugcuuggcuaagcagaaaaagugcugacaaaauaacgccauggaauuuugaugaaauaguagacaaggaauccucggccgaggcauucauuaaucggaugacaaauuacgauuuguauuugccaaaccaaaagguauugccuaagcauucucuacuauaugaaaaauucacaguauacaacgaacuaacuaaaguuaaauacaaaacagagcaagguaaaaccgcauucuuugacgcaaacaugaaacaggaaauauucgacggaguauuuaaaguauacagaaaagucacaaaagacaagcuaauggacuucuuagaaaaggaauuugaugaguuccgaauagucgaccuuacaggccuggauaaagaaaacaaaguauuuaacgcaaguuacggaacguaucaugauuuauguaaaauacuugacaaagacuuccuugacaauucgaaaaacgagaaaauuuuagaagauauaguucuaacauuaacauuauuugaagaccgcgaaaugauacguaaaagauuagaaaacuacagcgacuuacuuacuaaagaacaagucaaaaagcuggaaagacgacacuacaccgguuggggaagacucagugcagaacuaauacacgggauaaggaacaaagaauccagaaaaacaaucuuggacuaccuaauugaugaugggaauagcaaccgcaacuuuaugcaacugauaaaugacgacgcauuaucauuuaaagaagaaaucgcaaaagcccagguaauaggcgaaaccgauaaccuaaaucaaguaguuagugacaucgcuggaucccccgcaauaaagaaagguauucuacaaucucuuaaaaucguagacgaauuaguaaaaauaaugggacaucaaccagaaaauauagucguagaaauggccagggaaaaccaauucacaaaucagggacggcgaaacagccaacaacgacuaaaaggacuaaccgacucaaucaaagaguucgguucacaaauacuuaaagaacaccccguagaaaauucucaacuucaaaaugaccggcuguuccuauauuaucuacaaaacggcagagacauguauacgggagaagaacucgauauagacuacuugagccaguacgacaucgaccauauuauaccucaagccuucauaaaagauaauucaauagauaauagaguauuaaccucuucaaaagaaaauagaggcaaaagugaugauguaccaaguaaagacgugguacggaaaaugaaaaguuauuggaguaaacuuuuaucagcuaaauuaauaacacaaagaaaauuugauaauuugacaaaagccgaaagagguggacuaacagaugaugauaaagccggauucaucaaaagacaacuuguagaaacccgacaaauaacgaaacauguggcaagaauacuagacgaacgauuuaauacagaaacagaugaaaacaauaagaaaauucgacaaguuaaaauuguaacauugaaaagcaaucuaguuaguaauuuucgaaaagaauuugaauuauacaaaguacgcgaaauaaaugauuaucaucacgcucaugaugcauaccuuaaugcagucauaggaaaagcgcuacuuggaguauacccccagcucgaaccggaauuugucuauggagacuacccacacuuccauggacauaaagaaaacaaggcaacagcaaagaaauucuuuuauaguaauauaaugaauuucuuuaaaaaggaugacguaagaacagacaaaaauggcgaaauaauauggaagaaagacgaacacauuaguaacauaaagaaaguauuaaguuacccacaagucaacauaguaaagaaaguugaagaacaaacagggggauuuucaaaagaaaguauauuaccaaaaggcaacagcgauaaacuaauaccaagaaaaaccaagaaauuuuauugggacacaaagaaauauggagguuuugauucacccauaguugcauauagcauauuaguaaucgcagacauugaaaaaggaaaaucaaagaaacucaaaacggugaaagcguuagucggcguuaccauaauggagaaaaugacauuugaaagagauccaguagcauuccuugaaagaaaaggcuaccggaacguucaagaagaaaacauaauaaaauuacccaaauacagccuauucaaauuagaaaacggcaggaaaagacuacuugcaagcgccagggaacugcaaaaaggcaaugaaauaguacuaccuaaccacuuaggaaccuuauuauaccaugccaaaaauauccacaaaguugacgaaccaaaacaucuagacuauguugacaaacauaaagaugaauuuaaagaauuauuagauguuguaucaaacuuuucaaagaaauauacauuagcagaaggaaauuuggagaaaauaaaagaauuauacgcacaaaauaacggcgaagacuuaaaagaacuagcaagcucauuuauaaauuuguugaccuuuacagcaauaggagcgccugcaaccuucaaauucuuugacaaaaacauugaucguaaaagauacacaaguacaaccgaaauacucaacgcuacacuaauacaccaaaguaucacaggacuauacgagacaagaauugacuuaaauaaacuagguggagacuga

SEQ ID NO: 8349 - RNA, 3171 nt, Artificial Sequence
  Cas9 variant
augcaaacaacuaauuuaagcuacauucuuggauuagaucuaggaaucgcaucaguaggcugggcaguaguugaaauuaaugaaaacgaagauccaauaggucuaauagauguaggaguuagaauauuugaaagagcugaaguucccaaaacaggagaaucacuagcguuaucgcgaaggcuugcuagaaguacaaggagacuaaucagacgacgcgcacauagacucuuacuugcuaaacgcuuucuaaaaagagaaggaauacuauccacaaucgaucuugaaaaaggccuaccaaaucaggcaugggaguuaagaguagcugguuuagaacgaagacuaagugcgauagaauggggagcaguacuacuacaucucauaaaacauagaggauauuuaucaaaaaggaaaaaugagucacaaacuaauaacaaagaacuuggagcauuacuaagcgggguagcacaaaaccaccaacuucuucaaagugaugacuacagaacaccagcggaacuugcacuaaagaaauuugcaaaagaagaaggacacauccggaaccaaagaggcgcauacacacauacauucaaucgacuagaucuacuagcagaauuaaauuuacuuuuugcucaacaacaucaauuugguaacccacacuguaaagaacauauacaacaauacaugacggagcuacuuauguggcaaaaaccagcauuauccggugaggcaauauuaaaaaugcuaggcaaaugcacucaugagaaaaaugaguucaaagcagcuaaacauacuuacagcgcugaacgauuuguuuggcugacaaaauuaaacaauuuaagaauacuagaagauggagcagaacgagcucuaaacgaagaggaacgacaacuauuaauaaaccauccauaugaaaaaucaaaauuaaccuaugcacaaguaagaaaauuacuaggauuaagcgaacaggcaaucuuuaaacacuuaagauacucuaaagaaaaugcagaaucggcuacauucauggaauuaaaagccuggcaugcaauacgcaaggcauuagaaaaccaaggacuaaaggacacuuggcaagacuuagcaaagaaaccagaccuacuagacgaaauaggcacagccuucucccuguacaaaacagaugaggauauacaacaguaucuaacaaauaaagucccaaauucaguuauaaacgcuuuauuagugaguuuaaacuucgauaaauuuauugaacuaagccucaaaagucuaagaaaaauucucccucuaauggaacaaggaaagagguacgaucaagcaugcagagaaauauacggacaucauuacggagaggcaaaucagaaaaccucucaacuacucccagcuauuccugcucaggaaauucgaaauccuguagucuuaagaacauuaucacaagcaagaaaagucauuaaugcuauaauacgccaguacggcagccccgcacguguacacaucgagacgggaagagaacuuggaaaaucauucaaagaaagaagagaaauucaaaaacaacaagaagauaaccgaacuaagagggaaucagccgugcaaaaauucaaggaacuauuuagcgauuuuuccagugaaccaaaaucaaaagacaucuugaaauuccgauuauacgagcaacaacacgguaaaugucuauauucagggaaagaaauaaacauacauagacuaaaugaaaaaggguacgucgaaauagaucaugcccuaccuuucucaaggaccugggacgauagcuuuaacaauaaaguccuagucuuagcuucugaaaaccaaaauaaaggaaaccaaaccccuuaugaauggcuacaaggcaagauaaauucagaaagguggaaaaacuucguagccuuaguauuaggaucacaauguucagcagcuaagaaacaaagacuauuaacacagguaaucgaugacaauaaauucauagacaggaaccuaaaugauacuagauacaucgccagauuuuuaucuaauuacauucaagaaaaccuacuauuagucggcaaaaacaagaaaaacguauuuacaccgaacgggcagaucacagccuuacuuagaucaagauggggacucaucaaagccagagaaaacaauaaccgccaccacgccuuagacgcuauuguugucgcuugcgcaacacccagcaugcagcagaaaauaacaagauucaucagauuuaaagaaguucauccauauaaaauagaaaacagauaugaaaugguggaucaagaaucaggagaaauaauaucuccacauuucccagaaccaugggccuacuucagacaagaaguaaauauaagaguauucgauaaccauccagacaccguacuaaaagaaauguuaccagaccgcccucaagccaaucaccaauucguacaaccuuuauuuguuucacgagcaccaacucguaaaaugucaggacagggacacauggaaaccauuaaaagcgcaaaaagauuggcagagggaauuaguguacuaagaauaccccuaacacaauuaaaaccaaaucuacuagaaaacaugguaaacaaagaaagagaaccugcauuauacgcaggucucaaagcacgucuggcagaguucaaucaagauccagcaaaagccuuugcuacaccuuuuuauaaacaaggaggacaacagguaaaagcaauaagaguugaacaaguccaaaaauccgggguacucguaagagaaaacaacgguguugcagauaacgccucuauaguucgaacugauguauucaucaaaaacaacaaauucuuuuuaguuccuauauauacauggcaaguagcaaaagguauacuaccuaacaaagcaauaguagcacacaaaaacgaagacgaaugggaagaaauggaugaaggagcgaaauuuaaauuuuccuuauuucccaaugaucuuguagaacuaaagacuaagaaagaauacuucuuuggauacuauauaggacuagauagagcuacgggaaauauaucacuaaaagaacacgacggcgaaauaaguaaaggaaaagauggagucuaucgaguaggcguuaaauuagccuuaucauuugaaaaauaucaaguugacgaauuaggaaagaauagacaaauauguagaccacaacaacggcaaccagugcgauga

SEQ ID NO: 8350 - RNA, 3249 nt, Artificial Sequence
  Cas9 variant
auggccgcauucaaaccaaauccaauaaauuacauauuagguuuagauauagguaucgcuaguguaggaugggcaaugguagaaauagacgaagaugaaaauccuauauguuuaaucgaccuagguguaagaguauucgaacgugcugaaguuccaaaaacaggugauaguuuagcaauggcacgcagauuagcaagaagcguaaggcgauuaacuagaaggagagcccacagauuauuaagagcaagaagacuauuaaaaagagaaggaguacuacaagcagcggauuuugacgaaaauggacugauaaaaucacuaccuaauacaccauggcaacuaagagcugcagcacuggauagaaaacuaacccccuuggaauggucagcaguauuacuucaucucauaaaacaccgaggauaucuaagucaaaggaaaaaugaaggagaaacugcugauaaagaauuaggagcacugcuaaaaggagucgcagauaaugcacacgcauuacaaacuggagauuucagaacaccagcggaacuagcucucaacaaauucgaaaaggaaucaggacacauacgaaaucaaagaggagacuauagccacacguuuagucggaaagaccuacaagcagaacugauucuacucuuugaaaaacaaaaggaauuugguaauccacacguuucaggcggacuaaaagaaggaauagaaacauuacuaaugacacaaaggccugcguuauccggugacgcaguacaaaagaugcucgggcauugcacguuugaaccggcagaaccaaaagcagcuaaaaacacauauacagcagaacguuucauauggcugaccaaacuaaauaaucuuagaauauuagaacaaggaucagaaaggccauuaacagacacugaacgagcaacucuaauggaugaaccauaccggaagaguaaauugacauacgcacaagcaagaaaacuacuagguuuagaagacacagcauuuuucaaaggacuaagguauggaaaggacaacgccgaggcuucaacucuaauggaaaugaaagcauaccaugcgauaagcagagcauuagaaaaagaaggcuugaaagauaagaaaaguccacuaaauuuaaguccggaauuacaagaugaaauuggaacggccuuuagcuuauucaaaacugaugaagacauuacaggaaggcuaaaagacagaauacagccagaaauauuagaggcacuguuaaaacacauaaguuuugacaaauucguacagauaucccugaaagcacuuagacgaauuguaccuuuaauggaacaagguaaaagauacgaugaagcaugugcagaaauauauggugaccacuacggaaagaaaaauacagaagagaaaauauauuugccuccaauuccagcagacgaaauaaggaauccggucguauuaagagcacuaagucaagcacguaaaguaauuaauggaguaguacgucgauacggaucaccagcacgaauacacauugaaacagcuagagaaguuggcaagagcuuuaaagaucgcaaagaaauagagaaaagacaagaagaaaacaggaaagaucgggaaaaagcggcggcgaaauuuagagaauauuuuccuaauuucgucggggaaccuaaaucaaaagauauacucaaacuaagauuauaugaacaacagcacggaaaaugucucuacaguggaaaagaaauaaaucuugggcgacuaaaugaaaaaggauauguggaaauagaucaugcauuaccuuuuucgaggaccugggaugauaguuucaacaacaaaguuuuaguacuugguagugaaaaucaaaauaaagguaaccaaacaccauacgaauauuuuaacggcaaagacaacucacgugaauggcaagaguucaaagcacgaguggaaacauccagauuuccaagaagcaagaaacaaagaauacuuuuacagaaauucgacgaagauggguucaaagaaagaaacuuaaaugacacaagguacguuaauagauuccuuugucaauuugucgccgauagaaugagacugaccgguaaaggaaagaaaaggguauucgcuucuaauggacaaauuacaaaucuacugaggggauuuuggggauuacguaaagucagggcugaaaaugaucgacaccaugcacuagaugcaguagucguagcaugcaguacuguugcuaugcaacagaaaauuacaagauucguaagauacaaagaaaugaaugccuuugauggaaaaacuauugacaaagaaacaggcgaaguauuacaccagaaaacacauuuuccacaaccaugggaguucuucgcgcaagaaguaaugaucagaguuuuuggaaaaccugacggcaagccugaauuugaagaagcagauacuccagaaaaacuacgaacacuacuagcagaaaaauuaaguucacgaccugaagcaguucacgaauauguaacaccauuauuuguaucccgagcuccgaauagaaaaaugucaggacaaggucacauggaaacuguaaaaucagcgaaacgauuagaugaaggaguaaguguacuuagaguuccguuaacccaauuaaaacucaaagauuuagagaaaauggucaauagagaaagagaacccaaacuauacgaggcuuuaaaagcacggcuagaagcucacaaagaugacccagcaaaagcauucgcagaaccauucuacaaguaugacaaagccggaaaucggacgcaacaaguaaaagcaguaagaguugaacaaguacagaaaacaggcgucuggguaagaaaucauaacgggauagcugauaaugcgaccauggugaggguggauguguuugaaaaaggagauaaguauuaucugguaccuauauauucuuggcaaguagcaaaagguauacuaccagauagagcaguaguccaagggaaagacgaagaagauuggcaacucauagaugacaguuucaauuuuaaguuuucauugcauccuaaugacuuaguggaaguuauaaccaagaaagcuaggauguucggauacuuugcauccugccacaggggcacggggaauauaaacauaagaauccaugaucuagaucauaaaauaggcaaaaauggaauauuagaaggaauaggagucaaaacagcacuuaguuuccaaaaauaucaaauagacgaauuaggaaaagaaauacgaccuugucgacuuaagaaaaggccuccugugagauga

SEQ ID NO: 8351 - RNA, 3255 nt, Artificial Sequence
  Cas9 variant
augaaauaucacguaggaauagauguugggacauucaguguaggacucgcggcuaucgaaguggaugaugcgggcaugccaaucaaaacuuuaucauuagucagucauauucaugauagugggcuggaccccgaugagaucaaaucggcaguuaccagacuagcgagcucuggcauagcaagaagaacuagaagacuguauagaagaaaaagaaggagacugcaacaacuagacaaauuuauacaaagacaagguuggccaguaauugaauuagaggacuauagugauccucuauauccauggaaaguuagagcagaacuagcugcuucauauauagcagaugaaaaggaacgaggagaaaaacucagcguagcccuaagacacauugccagacauaggggauggagaaauccauacgcuaagguaucaucguuauauuuaccagauggaccaucagacgcauuuaaagcaauaagggaagaaauaaaacgugcaaguggacaaccuguuccggagacugcaacaguagggcaaaugguaacgcuaugugaauuaggaacacuaaaacuaagaggugaaggaggaguuuuaucugcaagauuacaacaaagugacuaugcacgagaaauucaagaaauauguaggaugcaagagauuggacaagaacuauauagaaaaauaauagauguaguauucgcggcugaaucgccaaaaggaucagcaucgagucgaguugggaaagacccguuacaaccagguaaaaacagggcucuaaaagcaagugacgcauuucaacgguacaggauugcggcuuuaauaggaaaucuaaggguuagaguagacggagagaaaaggauccuaagugucgaagagaaaaauuugguauucgaucaucugguaaaucucacaccaaagaaagaacccgaauggguaaccauagcagaaaucuuaggaauagacagaggacagcuaauagguacagcuacaaugacggaugacggugagcgcgcaggcgcacguccacccacccaugacacaaauagaucaauuguaaauaguaggauagccccacuuguagacugguggaaaacugccucggcucuagaacaacacgcaaugguaaaagcacuuucgaacgcagaaguagaugauuuugacucacccgaaggugcgaaagugcaagcauucuucgcugaccuugaugaugauguacaugcgaaacuugauagcuuacaccuuccaguuggcagagcugcuuauucugaagauacccuagugagauuaacacguagaauguuaucagauggaguagaucuauacacagcgagacuacaagaauuuggaaucgaaccaaguuggacaccuccaacaccaagaauuggagaaccuguuggaaauccagccguugauagaguuuuaaaaacgguaagucgaugguuagaaagcgcuacaaaaacauggggagccccagaaagggugauuauugaacacguuagagaagguuucguuacagaaaaacgagcaagagaaauggauggagacaugagaagacgagccgcacgcaacgcaaaauuauuucaagaaaugcaagagaaauuaaacgugcaagggaaaccaagcagagcagacuuauggagauaucaaucggugcaaagacaaaauugucaaugcgcauacugcgguagccccauaacauucuccaauucugaaauggaucauauaguuccaagagcaggacaagguagcacaaauacacgcgagaaucuaguagcaguaugucacagaugcaaccaaaguaaaggaaauacaccauuugcaauaugggcgaaaaacacaucaauagaaggaguuagcgugaaagaagcaguugaaagaacaagacacuggguuacagauacaggcaugagauccacagauuucaagaaauucacaaaggcaguaguagaaagauuucaacgagcaacaauggacgaagaaaucgaugcacggagcauggagucuguagcauggauggcaaaugaauuaagaucgagaguugcacaacacuuugcaucacaugguacaaccguaagaguuuaccgagggucuuuaacagcagaagcacguagggcaucaggaauauccggcaaacuaaaauucuuugauggagucggaaaaagcagguuggaccgaagacaucaugcaauugaugcugcaguaauagcuuuuaccagugauuauguagcugaaacauuagcuguaagaaguaaucuaaaacaaagucaagcucaccgacaagaagccccacaauggagagaauuuacaggaaaagaugcagagcacagggccgcuuggagaguauggugccagaaaauggaaaagcuaagugcauuacugacagaggauuuaagagacgauagaguagucgugauguccaauguucgcuuaagacuaggcaacggaucagcacauaaagaaacuauagguaaauuaagcaaaguaaaguuaaguagccaauuaagcgugagugauauagauaaagcaucuucggaagcguuauggugugcuuuaaccagagaaccaggauuugauccuaaagaaggacuaccagcaaaucccgagagacauauacgaguaaauggaacacacguuuaugcgggugauaauauaggauuauucccuguauccgccggguccauagcauuacgaggugguuaugcagaacuuggaucgagcuuccaucaugcgagaguauauaaaauuacauccgguaaaaagccagcguuugcgauguugaggguauacacaaucgaucuuuuaccauaucggaaccaagaucuauucucaguagaacuaaaaccacaaacuaugagcaugagacaagcagaaaagaaacuuagggaugcacuagcaacuggaaacgcagaauauuuaggcuggcuuguggucgaugaugaacuuguaguggauaccaguaaaauagcuacagaucaaguuaaagcgguagaagcagagcuuggaacaauacgaagguggcgaguugauggauucuuuaguccuaguaaacuaagguuaagacccuugcaaaugagcaaggaagggauaaagaaagaaucagcaccagaacugaguaaaauuaucgacagaccuggaugguuaccagcuguuaauaaauuguuuagugacgggaacguaacuguagucagaagggauucacuaggccguguuagauuagagagcacagcacaccuaccaguaaccuggaaaguacaauga

SEQ ID NO: 8352 - RNA, 2955 nt, Artificial Sequence
  Cas9 variant
auggcaagaaucuuagcauucgauauaggaaucucauccaucggaugggcauuuucggaaaaugacgaacuaaaagauugcgggguacgcauauucaccaaaguagaaaacccaaaaacuggcgaaucguuagcacucccgcgcagacuagcacgaucugcacgcaaacgacuagcaagaagaaaggcacgccuaaaccaccucaaacauuuaauagcaaaugaauucaaauugaacuaugaagauuaucaaucauucgacgaaagcuuagcaaaggccuacaaaggcucauuaauaucgccguaugaacucagauuuagagcauuaaacgaacuauuaucaaaacaagacuucgcaagaguaaucuuacauauagccaaaagaagaggcuacgaugauaucaagaacucagaugauaaagagaaaggagcaauucucaaggccaucaaacaaaacgaagaaaagcuagcaaacuaucaaucaguaggcgaauaccuguacaaagaauacuuccaaaaauuuaaagaaaauuccaaagaguucacaaauguaagaaacaagaaagagagcuacgaaagauguauagcucaaaguuuccugaaagacgaauuaaaauuaauauucaaaaaacaaagggaguucggauuuaguuucucuaaaaaauucgaagaagaaguccuaucaguagccuucuacaaaagagcauuaaaagacuuuagccaucucguaggaaauugcagcuuuuuuacggaugaaaaacgagcacccaaaaacucaccucuugcuuucauguuuguagcacuaaccagaauaauaaacuuacuaaauaaccuaaaaaacaccgaaggaauauuauauaccaaagacgacuuaaacgcacuccuaaaugaaguacuaaaaaauggaacguuaacuuauaagcaaaccaaaaaauuacuuggauuaucagaugacuacgaauucaaaggagaaaaaggaacguauuucaucgaauucaaaaaauauaaagaauuuauuaaagcgcuuggcgaacauaacuuaagccaagaugaccuuaacgaaauagcaaaagacauaacguuaauuaaggaugaaauaaaacuaaaaaaagcauuagccaaauacgauuuaaaucaaaaccaaauagauucucucagcaagcuggaauuuaaagaucauuuaaacaucagcuucaaagcuuuaaaacucguaacgccauuaaugcuagaaggcaaaaaauacgaugaagcaugcaacgaacuuaacuuaaaaguagccauaaaugaagacaaaaaagacuuuuuaccugccuuuaacgaaacauauuauaaagacgaagucacgaaucccguuguauuacgagccaucaaagaauaucguaaaguacuuaaugcauuauuaaaaaaauacggaaaaguccauaaaauaaauauagaacuagcucgggaaguaggaaaaaaucauucccaaagagcuaaaauagaaaaagaacaaaaugaaaauuacaaagccaaaaaagacgcagaacuagaaugugaaaaacuaggauuaaagauuaacagcaagaacauucucaaacuccgcuuauuuaaagaacaaaaagaauuuugcgcauauucaggugaaaaaauaaaaauauccgacuuacaagaugaaaaaaugcucgaaauagaucacaucuauccauacucaagaagcuuugacgauucguacaugaacaaaguauuaguauucacaaaacaaaaucaagaaaaauuaaaccaaacacccuuugaagcguuuggaaacgacagugcaaaauggcaaaaaauagaaguccuagcuaaaaaucuaccgacaaaaaagcaaaaaagaauucuagauaaaaacuacaaagacaaagaacaaaaaaauuuuaaggauagaaaccuuaacgacacaagauauauagcccgacuaguacuuaauuauaccaaagauuaccuagacuucuugccacucagcgaugacgaaaacacaaaacuaaacgacacacaaaagggaucaaaaguccacguagaagcaaaaucgggcaugcuaacaucagcuuugagacacacauggggauucucugccaaagacagaaacaaccaccuacaccaugcaauagaugcagucauaauagcauaugcaaacaacucuaucguaaaagcauucagugauuuuaaaaaagaacaagaauccaacuccgcugaguuguaugcaaaaaaaaucuccgaauuagacuacaaaaacaaacgaaaauucuuugaaccauucucaggcuucagacaaaagguuuuagauaagaucgacgaaaucuuuguaucaaaaccagaaagaaaaaaaccaucaggagcacuacaugaagaaacauuucgaaaagaagaagaauucuaccaaucguacggcggaaaagaaggaguacuaaaagccuuagagcugggaaaaauaagaaaaguuaauggaaaaauugucaaaaacggcgacauguuucgaguagacaucuucaaacacaaaaaaaccaauaaauucuacgccguuccaaucuauacgauggacuuugcucuaaaaguucuuccuaacaaagccguugcaagaucaaaaaaaggcgagauaaaagauuggauucuaauggaugaaaacuacgaauucuguuucucacuauacaaagauagccucauauuaauucaaacaaaagauaugcaagaaccagaauuuguguacuacaaugcauucacaucaucaacaguaucacuaaucguaaguaaacaugacaacaaauucgagacacuaaguaaaaaucaaaaaauccuuuucaaaaaugcaaacgaaaaagaaguaauagcaaaaagcauaggcauacaaaaucuaaaaguauucgaaaaauauaucguauccgcuuugggagaaguuaccaaagccgaauuccgucaaagagaagacuucaaaaaauga

SEQ ID NO: 8353 - RNA, 3366 nt, Artificial Sequence
  Cas9 variant
augucagauuuaguauuaggucuagauauaggcauaggaagcgucggaguaggaauacuaaacaaagucacuggagaaauaauacauaaaaauucaagaauauuucccgcagcacaagcugaaaacaaccucguuagaagaacaaauagacaaggccgaagacucgccagacgaaagaaacauagaaggguuagacuuaauagacuauucgaggaaucaggucuaauaacagauuuuacuaaaaucaguauaaaccuaaacccauaucaauuaagaguaaaaggacuaaccgaugaacuaagcaaugaagaacuauucauagcacuuaaaaauaugguaaaacauaggggaaucucauaucuagaugaugcaagcgaugacggcaacucauccguaggagacuacgcacaaauuguaaaagaaaacaguaaacaauuagagacaaaaacgcccgggcaaauacaauuagaacgauaccaaacuuacggacaauuaagaggugacuucacuguagagaaagauggaaagaaacauagauuaauaaacguauuuccaaccucugcguaucgaagugaagcacuaagaauacugcaaacgcaacaagaguucaacccucagauaacagaugaauuuauaaaccgauaucuagaaauacuuacgggaaaacgaaaauacuaccauggacccggaaacgaaaaaucuagaacagacuauggaagguacagaacaucaggagaaacgcucgauaacaucuucggaauacuuauugggaaaugcacauucuacccagacgaauuuagagcagcaaaagcuaguuacacugcacaagaauuuaaccuuuuaaaugaucugaauaaucuaacagugccaacagaaacuaagaaacugagcaaagaacagaaaaaccaaauaauaaauuacgucaaaaacgaaaaagcuaugggaccagcuaaauuauuuaaauacauagcaaaauuacuaaguugcgacguagccgacauaaaagguuauagaaucgacaaaagcggaaaagcagaaauacacacauuugaagcauauagaaaaaugaaaacacuggaaacccuggacauugaacaaauggauagggaaaccuuagacaaauuagcguauguucugacacugaauaccgagcgagaagguauacaagaagcucuagaacacgaguuugcugauggauccuuuagccaaaaacaaguagacgagcuaguacaauucagaaaagcaaauucaucaaucuuuggcaaaggauggcauaacuucucgguaaaacucaugauggaacucaucccagaauuauaugaaaccagugaagaacaaaugaccauccuaacaagacuagguaaacagaaaaccaccagcucaucaaacaaaacaaaauacauagacgaaaaacuacuaacugaagaaauauauaauccaguaguagcaaaaagcgucaggcaagcaauaaaaaucguaaaugcagcuauaaaggaauauggcgacuucgauaacauugucauagaaauggcgcgagaaacuaacgaagacgacgagaaaaaggcaauacagaaaauucaaaaggcaaauaaagaugaaaaggaugcagcaaugcuaaaagcagcaaaccaauauaacggcaaagcagaacuuccucauuccgucuuucacggccacaaacaacuagccacaaaaauaagacuauggcaucaacaaggagagcgaugucuuuacaccggaaaaacuaucucaauacacgaucuuauaaacaauagcaaccaauuugagguugaccauauuuuaccacuuuccauaacuuucgaugacucacuagcuaacaaaguucuaguauaugcaaccgcaaaccaagaaaaagggcaacgaacaccauaccaagcguuagacagcauggaugacgcguggaguuucagggaacugaaagcauucguuagggagaguaagacauuaucaaauaaaaagaaagaauauuuauuaaccgaagaagauauaucaaaauuugaugugagaaagaaauucauagaaaggaaucuaguagauacuagguaugcaagucgaguagucuuaaacgcauuacaagaacacuuucgugcccauaaaauugauacaaaagucuccguaguucgcggacaauucacaucacaacugcgaagacacuggggcaucgagaaaacacgagauacuuaccaccaucaugcagucgaugcacuuauaaucgcagcaaguucacaacuuaaucucuggaagaaacagaaaaauacauuagucucauacucagaagaucaacucuuggauaucgaaacuggagaauuaauaucagaugaugaauacaaagaaagcguguucaaagccccauaccaacacuuuguagauacauuaaaaucaaaagaauuugaagacucgaucuuauuuucuuaucaaguugauucaaaauuuaaccgcaaaauaucagacgcuacaauuuacgcaacccgacaagcgaaaguagggaaagacaaagcagaugaaacauauguacucggaaaaauaaaagacauauacacucaagauggauacgacgcauuuaugaaaauauauaagaaagacaaaaguaaauuccuaauguacagacaugacccccaaacauuugaaaaaguaauagaacccauacuugaaaauuacccaaacaaacaaauaaaugaaaaaggaaaagaaguaccuugcaauccauuccucaaauauaaagaagaacauggauauaucagaaaauauucaaagaaaggaaauggacccgaaauaaaaucacuaaaauacuaugacucaaaauugggaaaccauauagauauaacaccuaaagacaguaauaacaaaguuguauuacagaguguaucaccuuggagggccgauguauacuucaacaaaacaaccggaaaauacgaaauacucggacuaaaauacgccgaucuucaauucgaaaaagguacuggcacauacaaaauaagccaagaaaaauauaaugauauaaagaagaaagaaggaguugauucagacucagaauuuaaauucaccuuauauaaaaacgaucuacucuuaguaaaagacacagaaacaaaagaacagcaacuuuucagauuucuaucaagaaccaugccaaaacaaaaacauuacguugaacuaaaacccuaugauaaacaaaaauucgaaggaggcgaagcacuaauuaaaguacuaggcaacguggcaaacucaggccaaugcaagaaagggcuaggaaaaucaaacauaucaauauauaaaguucgaacagacguccucggcaaccaacacauaauuaaaaacgaaggggacaaaccaaaacuagacuuuuga

SEQ ID NO: 8354 - RNA, 2556 nt, Artificial Sequence
  Cas9 variant
augacaaacggaaaaauauuaggauuagacauuggcguugcaucaguaggaguaggaauaauagaagcuaaaacaggaaaaguaauucacgcaaacucacgucuguucucagcggcgaacgcagaaaacaacgcugaaagaaggggauucaggggggcucgaagauuaacaagaagaaaaaaacaccgaguaaaaaggguaagagauuuauucgaaaaauacgacauauuaacagacuucagaaaccuaaaccuuaauccauacgagcuaagaguaaaaggacuuacugaacaacuaacaaaugaagaauuauucgcagcgcucagaacaauagccaaaagaagaggaauaucauaccucgacgacgcagaagacgacuccaccggcucaucagauuaugcaaaaucgaucgaugaaaacagaagacuauuaaagucaaugacaccuggucaaauacaacuagaaagauuagaaaaauauggacaacucagaggaaacuuuacuguauaugacgaaaacggagaagcacauaggcuaaucaauguauuuuccacauccgacuacaaaaaugaagccagaaaaauacuagaaacacaaagcaacuacaacaaacaaauaacagacgaauuuauagaagacuacauagaaauacuaacucaaaagcgaaaauacuaccaugguccggguaacgaaaaaucuagaacagauuacggaagauucagaacggaugguacaacacucgaaaacauauuugguauucuaauaggaaaaugcaguuucuacccggaagaauauagagcaagcaaagcaucauauacugcccaagaauucaacuuccuaaacgauuuaaacaaccuaaaagugccaaccgaaacuggcaaauuaucaaccgaacaaaaagaauaccuaguaaauuucgcuaaaaacucgaaaaccuuaggugcguccaaauuacuaaaagaaauagccaaauuagucgacggggacguaaaagauaucaguggauacagagaggacucaaaaggaaaaccggacuuacacacauucgaaccauacagaaaauuaaaauuuaacuuaacgacagucgacauagacaacuuaagcagagacauauuagacaaacuagcugauauucuaacacuaaacacagaaagagaaggaauagaagacgccauaaaccaaaaccucccggaacaauuuacaaaagaacaaaucucugaaauaguccaaauacgaaaaagccaaagcucagcauuuaauaaaggauggcacucguucagcgccaaacuaaugaacgaacugauacccgaauuauaugccacaucagaagaacaaaugaccauuuuaaccagacuugaaaaauuuaaagcaacaaaaaaaaguaguaaaaacacuaaaacaauagacgaaaaggaaauaacugacgaaauauacaauccaguuguagcaaaaagcguaaggcaaacaauaaaaauuauaaaugcagcaguuaaaaaauauggagauuuugacaaaauagucauagaaaugccuagggacaaaaacgcagacgacgaaaaaaaauucauugauaaaaaaaacaaagaaaauaaaaaagaaaaagacgacucccuaaagagagcagccuaucucuauaauggaacagacaaauuaccagaugacguauuccauggaaacaaacaacuagcaacaaaaauaagacuaugguaccaacaaggagaacgauguuuauacucaggaaaaccaauuuuaauacaagacuuaguucauaacagcaacaacuucgaaauagaccacauauuaccccuaagccuaucauucgaugauucacuagcaaauaaaguacuaguuuaugcaugggcaaaucaagaaaaagaacaaaaaacuccauaccaaguaaucgauagcauggaugcagcauggucuuucagagaaaugaaagacuauguacucaaacaaaagggcauaggaaaaaaaaaacgugaauaucuucuaaccacggagaauaucgacaagauagaaguaaaaaaaaaauuuauagaacgcaaucuaguagauacgagauacgcaucacgagugguauuaaacucacuacagacagcccuuaaagaauuagggaaagauacaaaagucucaguagucagaggacaauucacaucacaacuaaggagaaaauggaaaauagauaaaaguagagaaaccuaccaucaucacgcaguagacgcauuaauuauagcggcuaguagccaauuaaaauuauggcaaaaacaugaaaaccuaauguuugaaaauuauggggaaaaucaaguuguuaacaaagagacaggggaaaucuuaucaaucuccgaugacgaauauaaggaaucaguuuuucaaccaccauaucaaggauuuguuaauacaaucucaucuaaagcauuugaagacgaaauacuguucucauaccaaguagacucaaaauucaaucgaaaaguaagcgaugcuacaauauacaguacgcguaaagcaaaacuagggaaagauaaaaaggaagaaaccuacguccuaggaaaauga

SEQ ID NO: 8355 - RNA, 2598 nt, Artificial Sequence
  Cas9 variant
augagacauaaaaucggauuggacauaggaaucacauccguaggaugggccguuauaaacuuagacauacccaggauagaagauuuaggugucagaauauucgauagagccgaaaauccacaaacuggagagucauuagcauuaccacgaagacuugcuagaagugcccguagaaggcuacgaagaaggaaacaccgcuuagaaagaauaagaagacuacuaaucagagaaggaauacuaacuaaagaagaacuggacaaauuauucgaggaaaaacacgaaaucgaugucuggcaauuaagaguagaagcacuagauagaaaacuaaacaaugaugaacuugcaaggguauuacuccaccuagcaaagcgaagagguuucaaaucuaaucgaaaaucagaaagaaacaauaaagaaaacuccacaauguuaaagcacauagaagagaaucgagcuuuacugagcggcuauagaacaguagcagaaaugauaguaaaagaccccaaauuugccuuucauaaacgaaauaaaggagaaaauuacacgaacacuauagcaagagaugaccuagaaagagaaaucaaauuaauauuuacuaaacaacgagaauacggaaauauagucugcacagaaacguucgaaaacgaauacauuaugauaugggcuagccaaagaccauucgcauccaaaaacgacauugagaaaaaaguaggauuuugcacauuugaaccaaaagaaaaaagagcaccaaaagccacauacacauuccaauccuuuguugcaugggaacauaucaauaaauuacgcuuagucuacccaacuggaacaagagguuugaccgacgaagaaagaagacuauuauauaaacaagcauuucacaaaaauaagauaacauaccaugauauacgaacucuauuacauuuaccagacgacaccuacuucaaagguaucguauacgacagaggugccccacuaaaacaaucagaaacaauuagauuucuugaacuugacgcauaccaucagauacgaaaagcuguagacaaagucuauggcaaagggaaauccucaucauuuuuaccgauagauuucgauacuuuuggauaugcguugaccuuguuuaaagacgacgccgacauaaggucauacuuacguaacgaauacgaacaaaaugguaaaagaaugcccaaccuagccaacaaagucuaugacaaugaaccaauugaagaguuauuaaauuuaucauucacuaaauuuggccacuuaucacuaaaagcacuuagaaauauccucccauacauggaacaaggggaaguauacucaguagcaugugaaagagcaggcuacacauuuacagguccuaaaaaaaaacaaaaaacacuacuucuaccaaauauaccucccauagcaaauccaguaguaaugagagcacucacacaagcacgaaaaguaguaaacgcaaucauaaaaaaauacggaucccccgucucaauacauauugaauuagcaagagauuuaucacaaaccuuugacgagagaagaaaaacaaaaagagaacaagaugaaaauaggaaaaaaaacgaaacugccauacgacaauuaauggaauacggauuaacaauaaaucccaccggacaugacauagucaaauucaaacuauggucugaacaaaauggacgaugcgccuacucauuacaaccaaucgaaaucgaaaggcugcuugagcccgguuacguagaaguugaucauguaauaccauauuccaggagccucgacgacucguauacaaauaaaguuuuaguuuuaacuaaagaaaacagagaaaaagguaacagaauaccagcagaauaucuaggagucggaacagaacgauggcaacaauucaaaacauuuguacuaacuaauaaacaauucagcaaaaaaaaacgugauagacuacuacgacuucacuaugacgaaaacgaagaagcugaauggaagaacagaaacuuaaaugacacccgcuacauuucccgauucuucgcgaacuucauacgagaacaucuaaaauucgcugaaagcgacgacaaacaaaaaguguacacaguaaacggaagagucaccgcacacuuaagaucacgaugggacuucaacaaaaaccgagaagaaagugaucuacaucaugcaguugaugcagcaauuguugcauguacgucaccaagcgauauagcacgagucacagccuucuaccagcgucgagaacaaugcaaagaaagugcaaaaaaagcagaaccacacuuuccacaaccuuggccucauuuugcagaugaauuaagagcgcguuuaucaaaaaauccaaaagaaaguauaaaagcuuuaaaucuagguaacuacgacgaucaaaaguuagaaucacuacagccaguauucguaucacguaugccaaaaagaagcgucacgggagcagcacaucaagaaacauuaagaagguacauaggcauagacgaaagaucaggaaaaauacaaacaguaguaaaaacaaaauuaucagaaauaaaacuagacgaaacuggucacuucccaauguauggaaaagaaucagauccaccugcaucagccuga

SEQ ID NO: 8356 - RNA, 2886 nt, Artificial Sequence
  Cas9 variant
auggcaagaaucuuagcuuucgacauaggaauaucuucuauaggaugggcauucagcgaaaaugacgaacuaaaagauugugguguaagaauauucacuaaagcagaaaacccaaaaaccggcgaauccuuagcacucccacgaagacucgccagaucagcucguaaaagacuagcaagaagaaaagcaagacuaaaccaccuaaaacaucugauagcaaacgaguucaaacuaaauuaugaagauuaucaaagcuuugacgaaucacuagcaaaagccuauaaaggaagucuaauaucaccauacgagcugcgcuucagagcgcuaaaugaacucuuaaguaaacaagacuuugcccgcgucauccuacauauagcuaaaagacguggauaugacgauauaaaaaacaacggagaugaagaaaaaggcaaaauacuaaaagcuauaaaacagaacgaagaaaaacuaguuaauuaccagagcguaggagaauaucucuauaaagaauauuuucaaaaauucaaagaaaauuccaaagaauucauaaacguaagaaacaaaaaagaaagcuaugaacgaugcauaacacaaucauuucuaaaauacgaguuaaaacuaauauuccaaaaacaaagagaauucggauuuucauuuuccaaaaaauucgaagaagagguauuaagcguagcauucuauaaacgagcacuuaaggacuuuucucaccucgucggaaacugcuccuuuuuuuccgacgaaaaacgcgcgcccaaaaacucuccccuagccuuuauguuuguagcacugacacguaucauaaaccucuuaaacaaucucaaaaauaccgaaggaauacucuacacaaaagacgacuuaaacgcuuuauuaaaugagguacuaaaaaauggaacccuuacauauaaacaaacaaaaaaacuauuaggauuaucagaugauuacgaauucaaaggagaaaagggcacuuacuucauagaauuuaaaaaauauaaagaauucauaaaagcacuaggcgaacacaaucuaagucaagacgauuuaaacgaaauagcaaaagacauuacucuaauaaaagacgaaauaaagcuuaaaaaagcgcucgcaaaauacgaccugaaccaaaaucagauagauaguuuauccaaacuagaauuuaaagaucauuuaaacauaggcuucaaagcgcuaaaacuaaucacgccucuaaugcuagaaggaaaaaaauacgacgaagcaugcaacgaacucaaccuaaaaguagcaauaaacgaggacaagaaagacuuccuuccagcauuuaacgaaacauauuauaaagacgaaguaacuaacccaguuguauuaagggcaauaaaagaauacagaaaaguacuaaaugcguuacuuaaaaaauacggcaaaguacauaagaucaacauagaacuagcaagagaaguggggaaaaaucacagucaacgagcaaaaauagaaaaagaacaaaaugaaaauuauaaagcaaaaaaagaugcagaacucgaaugcgaaaaacugggccuaaagaucaauucaaaaaauauccuaaaauuaagauuauucaaagaacaaaaagaauuuugcgcauauaguggagaaaaaaucaagcuauccgaucugcaagacgaaaaaauguuagaaauugaccauauauacccuuauucuagguccuucgacgacucguauaugaacaaaguacuaguauuuacaaaacagaaucaagaaaaauuaaauaaaacaccauucgaagcauuugguaacgacaacgucaaauggcaaaaaauagaaguccuagcaaagaacuuaccagaaaaaaaacaaaaacgaauacuagauaaaaacuauaaagacaaagaacaaaaagauuuuaaagauagaaacuuaaacgacacaagauauauugccagacuaguucuaaauuacacaaaagacuaccucgacuuucuuccacuaucagacgaugaaaacacuaaacuaaaagguucaaaaguacacguagaggcuaaaagcggaaugcuaacaucagcccucagacacaccuggggauucaguacaaaagaucgaaacaaccaccuucaccaugcaauagacgcagcuauaauagcauacgcaaauaauuccauaguaaaagauuucucagacuucaaaaaagaacaggaaagcaacagcgcagaauuguacgcaaaaaaaaucucagaacuagacuacaaaaauaaaagaaaguucuuugaaccauucaguggauuucgccaaaaaguacuagauaaaauagaugaaaucuucgugaguaaaccagaacgaaaaaaaccaaguggggccuuacacgaggaaaccuucagaaaagaagaagaauucuaucaaucguacggcggaaaagaaggaguccuaaaagcacuugaacuuggaaaaaucagaaaagucaacggaaaaaucguaaaaaacggagauauguuuagaguagauauauucaaacauaaaaaaacaaacaaauucuacgccguaccaauuuacacaauggacuuugcgcucaaagucuuacccaacaaagcagucgcuagaucuaaaaaaggagaaauaaaagacuggauacuuauggaugaaaacuacgaauuuugcuucucauuauauaaagacucccuaauacuaauacagacaaaagauaugcaagaacccgaacuuguauauuuuaacgcguucacgucgucaaccguaagucuaauuguaucaaaacaugacaacaaauuugagacacuaagcaaaaauuuaaaaguuuucgaaaaauacauuguaucagcucuaggagaagucaccaaagcagaauucagacaaagagaagacuucaaaaacgaacucagauga

SEQ ID NO: 8357 - RNA, 2955 nt, Artificial Sequence
  Cas9 variant
auggcgaaaauacuagccuucgauaucggaaucagcagcauaggaugggcuuucagcgagaacgaugaauuaaaggauugcgguguacgaauauuuacaaaggcagaaaacccaaagacaggagaaucacucgcauuaccacgaagaaucgcaagaagcgccagaaaaagacuagcccgaagaaaagcuagauugaaucacuuaaaacaucucauugcgaaugaauucaaacuaaacuacgaagacuaccaaucauuugacgaaauacuugcaaaagcauauaaaggaagcuuaauuucuccauacgaacuacguuuccgagcacuaaacgaacuccuaagcaaacaagacuucgccagagucauccuacacauagcaaaaagacguggauacgaugacaucaaaaacaacggagacgaagaaaaagguaagauacuaaaagccaucaaacaaaacgaagaaaaauuagccaauuaccaauccguaggugaauaccuauacaaagaauacuuccaaaaauuuaaagaaaacagcaaagaauucauaaacguuagaaacaaaaaagaaaguuacgaaagaugcauugcacaauccuucuugaaagaugaacucaaacuuauauuuaagaaacaaagagaauuuggcuucucauuuucaaaaaaauuugaagaagagguccucucugucgcguucuauaaaagagcgcuuaaggauuuuucacaucuuguaggaaauugcucuuucuucacugaugaaaagcgagccccaaaaaacucaccacucgcauucauguuuguugcacucacaagaauaauaaaccuacuaaauaaccuuaaaaacaccuuauacacaaaggaugaucuaaaugcacuucuaaacgaaguuuuaaagaauggcaccuuaacauauaaacaaacaaaaaaauuauugggucucagcgaugauuaugaauucaaaggugaaaagggaaacuacuuuauugaauucaaaaaauauaaagaauucauaaaagcacuaggagaacacagucucagccaagacgaucuaaaugaaauagcaaaagacauuacucucaucaaagaugagauaaaacuaaaaaaggcacuagccaaguacgauuuaaaugaaaaucaaauagacaaccuaagcaaacuagaauuuaaagaccaucuaaacauaaguuuuaaagcucuaaaacuaaucaccccacuaaugcuagaaggcaaaaaauaugacgaagcauguaacgaacuuacacucaagguagcaauuaacgaagauaaaaaagacuucuuaccagcuuucaaugaaacuuacuacaaagaugaaguaacaaauccaguaguauugagagccauaaaagaauaccgaaaaguccuaaacgcauuacucaaaaaauacggaaaaguacacaaaauaaacauagaacuggcaagagaaguaggcaaaaaucacucccaaagagcaaaaauagaaaaagaacaaaacgaaaauuacaaagccaaaaaagaugcagagcucgaaugcgaaaaacuaggucucaaaaucaacucaaaaaauauauuaaaacuuagauuauuuaaagaacaaaaagaauucugcgucuacagcggagaaaaaauaaaacuaucagaccuacaggaugaaaaaaugcucgaaauagaucacauauauccauacucccgaagcuuugacgacuccuacaugaacaaagugcuuguuuuuacaaaacaaaaucaagagaaauuaaaccaaaccccauucgaagcuuucggaaacgauagcgcuaaauggcaaaaaauagaaguguuagcaaagaauuuaccaacaaaaaagcaaaagagaauucucgacaaaaauuacaaagacaaagaacagaaagacuuuaaagacagaaauuuaaaugauacacgauacauagccagauuaguacuaaacuauacaaaggacuacuuagauuuucucccacuaagugacgacgaaaacacaaaauuaaacgauacccagaaaggaucaaaagugcauguagaagccaaaucaggaaugcuaaccucagcauuacgacacacauggggcuucucaacuaaagaccgaaacaaccauuuacaucaugcuauagacgcaguaauaauagcauaugccaauaacagcauaguaaaagcauuuucagauuuuaaaaaagaacaggaauccaacacagcagaauuauaugccaaaaaaaucucagaacucgacuauaaaaacaaaagaaaauucuuugaaccauucagcgguuuuagacaaaaagucuuagauaaaauagaugaaauauucgucucuaagccagaaagaaaaaaaccaucuggagcccuccacgaagaaacauuccgaaaagaagaagaauucuaucagagcuacgguggcaaagaaggcguuuugaaagcacucgaauuaggaaaaauccgaaaaguaaacgggaaaauaguaaaaaauggagacauguuuagagucgacauuuuuaaacacaaaaaaacaaacaaauucuacgcagucccgauauacacuauggacuucgcauuaaaaguacuccccaauaaagcaguagcgagaucuaagaaaggagaaauaaaagacuggauacucauggaugaaaauuaugaauuuugcuucucauuauacaaagauucacuuauacuaauacaaacaaaggacaugcaagaaccugaauuuguauauuacaaugccuucacaucaagcacaguaucucuaaucgucuccaaacacgauaacaaauucgaaacacuauccaaaaaccagaaaauacuauucaaaaaugccaacgaaaaggaagucauagcuaaaagcaucggcauacaaaacuuaaaagucuucgaaaaauauauaguaucagcacuaggggaaguaacgaaagcagaauuccgucaaagagaagaauucaagaacgaacuacgcuga

SEQ ID NO: 8358 - RNA, 2955 nt, Artificial Sequence
  Cas9 variant
auggccagaauacuagcauucgacauaggcaucaguucaauuggaugggcguuuagcgaaaacgaugaacuaaaagauugcggugucagaaucuucacaaaagcggaaaacccaaaaacaggagagucacuggcacuaccacgcagauuagccagaagugcccguaaaaggcuagcaagacgaaaagcgagacuaaacagauuaaaacaccucauagcaaacgaauucaaacugaauuacgaagacuaccaaaguuuugacgaaagccuugcaaaagccuauaaggggucacucauaagcccauacgaauuacgauuccgcgcauuaaacgaguuauugucaaagcaagauuucgcaaggguuauauuacauauagcgaaacgccgaggauaugacgacaucaaaaacucugacgauaaagaaaaaggagcuauacuaaaagcuaucaaacaaaacgaagaaaaacuugcuaacuaccaaucaguaggcgaauaccuauacaaagaauacuuccaaaaauuuaaggaaaacucuaaagaauucacaaacgugcgcaauaagaaagaaucuuaugaacgaugcauagcacaaagcuuuuugaaagaugaacuuaaacucauuuucaaaaaacagagagaauucggauucucauucucgaaaaaauucgaagaagaaguccuaucaguagcauuuuauaaaagagcacuaaaggacuucucccaccuagucggaaacugcucauucuuuacagacgaaaaaagagcgccuaaaaacucaccacuagcauuuauguucgucgcccucacaaggauaauaaacuuacuaaauaacuugaaaaacacagaagguauacuauacacgaaagaugaucuaaaugcacuuuuaaaugaauuuuuaaaaaacggcacacuaacauacaaacaaacgaaaaaauuguuaggacuaagcgacgauuaugaauucaaaggagaaaaaggaaccuauuuuauagaauuuaaaaaauauaaagaauuuauaaaagcauuaggagaacauaacuuaagccaagacgaucuaaacgaaauagcgaaagacauaacacuaaucaaagacgaaauaaaauuaaaaaaagcccuugcaaaauaugaccucaaucaaaaccaaaucgacagccugagcaaguuagaauucaaagaucauuuaaacauaucuuucaaagcacuaaagcuaauaacaccccucauguuagaaggcaaaaaauacgaugaagcauguaaugaacucaaucuaaaagucgcaauaaacgaagacaaaaaagauuuucuuccugcauuuaacgaaacauacuauaaggacgaaguaacaaaucccguaguauuaagagcaauaaaagaguaccggaaaguacucaacgcacucuuaaaaaaauacggcaaaguucacaaaauaaacaucgaacuagcacgagaagucggcaaaaacuacucccaacgagcaaaaaucgaaaaagaacaaaaugaaaauuauaaggcaaaaaaagacgccgaauuagaaugcgaaaaacucggacuaaaaaucaacucaaaaaauauauuaaaauuacgauuauucaaggaacagaaagaauuuugugccuacucaggagaaaaaauaaaaauaucagaccuccaagacgaaaaaaugcuugaaauagaccacauauacccauacagccgaucauucgaugacagcuauaugaauaagguacucguauuuacaaaacaaaaccaagaaaaauuaaaccaaaccccauuugaggcauuugguaaugauucugcuaaauggcaaaaaauagagguacuggcaaaaaacuuaccaacaaaaaaacaaaaaagaauacuagacaaaaacuauaaagauaaagaacaaaaagacuuuaaagacagaaauuuaaaugacacaagauauauagcacgauuaguguuaaacuauacaaaagauuaccuagacuuccuaccacuaagcgaugacgaaaauacaaaacuaaacgacacacauaaaggcagcaaaguacacgucgaagcaaaaagcggcauguuaacaucagcauuacgacauacaugggguuuuucaacaaaagacagaaacaaccacuuacggcacgcuauagacgcaguaaucaucgcauacgcaaauaauaguaucguaaaagcuuucagugacuuuaagaaagaacaagaaagcaacucagcagaacuauaugcaaaaaaaauaagcgaacuugacuacaaaaauaaacgaaaauucuucgaaccauucagugguuucagacagaaaguccuggacaagauugaugaaauauuugucucaaaaccagaaagaaaaaaaccaaguggcgcacuacaugaagagacauucagaaaagaagaagaauucuaucaaaguuauggcggaaaagaaggaguacuaaaagcauuggaauuagguaaaaucaggaaagugaacggaaaaauuguaaaaaauggagauauguuccguguugacauauuuaaacacaagaaaacuaacaaauuuuacgcaguaccgauauauacgauggacuucgcacucaaaguauuaccuaauaaagcuguagcaagaucgaaaaaaggagaaaucaaagacuggauacuuauggacgagaauuacgaauuuuguuuuucauuauauaaggauaguuuaauucuaauccaaacuaaagacaugcaggagccagaauucguauacuauaacgcuuuuacaucuucuacuguuucacuaaucguaaguaaacaugauaacaaauucgaaacacugagcaaaaaucagaaaauacucuucaaaaaugcuaaugaaaaggaaguuauugcaaaaaguauaggcauccaaaaccuaaaagucuuugaaaaauauauagucagugcacuaggugaaguuacaaaagcagaguuucgacaaagagaagauuucaaaaaauga

SEQ ID NO: 8359 - RNA, 2955 nt, Artificial Sequence
  Cas9 variant
auggcuagaauccuggcuuucgacauuggcauauccaguauaggaugggcguucucagagaaugacgaauuaaaagacuguggcguaagaauauucacaaagguagaaaauccaaaaacaggagaaagccuugcucucccccgucgacuagcaagaucugcucgaaaaagauuagcacgacgaaaagcaagacuaaaccaccuaaaacaccugauagcaaaugaauuuaaacuaaauuaugaagacuaccaaucguuugacgaaucacuagccaaggcauacaagggaucccucauaucaccauacgaacuaagauuccgcgcuuuaaaugaacugcuaucaaaacaagauuucgcacgggucauucuccauauagcaaaacgaagagguuaugacgauaucaaaaauucugaugauaaagaaaaaggagcaauacuaaaagcaauaaaacaaaaugaagaaaaacuagcaaacuaucaaucuguuggugaauauuuauacaaagaauacuuucaaaaauucaaagaaaacagcaaagaauuuacaaaugucaggaauaagaaagaaucauacgaaagaugcauugcccaaucauuuuuaaaagacgaauuaaaacuaauauuuaaaaaacaaagagaauuuggauucagcuucucaaaaaaauucgaggaggaagucuuaagcguugccuuuuacaaaagagcucucaaagacuuuucacauuuaguagggaacugcuccuuuuucacugacgagaaaagagccccaaaaaacucaccacuagcauuuauguucgucacccuaacaagaauaauaaaccuucucaacaaucuaaaaaauacagaaggcauccuauacacaaaagacgacuugaaugcucuucuaaaugagguauuaaaaaaugguacuuuaacuuacaaacaaaccaaaaaauuauuaggacucagugacgacuaugaauuuaaaggagaaaagggaaccuacuucaucgaauuuaaaaaauauaaagaauucauaaaagcgcugggagaacacaaucuaucccaggaugacuuaaacgaaauagcaaaagacauuacacucauaaaagacgaaauaaaacuaaaaaaagcacuagccaaauacgaccuaaaccaaaaucagauagacucccucucaaaauuagaauuuaaagaucacuuaaacauaagcuuuaaggcacucaaacuaauaacaccacuaauguuagaaggaaaaaaauaugacgaagcaugcaacgaacuuaaccucaaagucgcaauuaacgaagauaagaaggauuuccuuccagccuucaacgaaacauacuacaaagaugaagugacuaacccagugguucucagagccauuaaagaauacagaaaagucuuaaaugcauuauuaaaaaaauacggaaaaguccacaaaaucaauaucgaacuagcuagagaaguaggcaaaaaucauucacagcgagccaaaauagaaaaagaacaaaacgaaaacuauaaagcaaaaaaagacgcagagcucgagugugaaaaacucggauuaaaaauaaacaguaaaaauauacuaaagcucagacuauucaaagaacaaaaagaauucugugcuuacucuggagaaaaaauaaaaauaucagaccuccaagacgaaaaaauguuagaaaucgaucacaucuauccauauucaagaucuuuugaugauucuuacaugaacaaaguucucguauuuacaaaacaaaaccaagaaaaauuaaacaaaaccccguucgaagcauucggaaaugacucagccaaauggcaaaagauagaaguacuagccaaaaaucuacccacaaaaaaacaaaaaagaauacucgacaaaaauuacaaagacaaagaacaaaaagauuucaaagacagaaacuuaaaugacacaagauauauagcuaggcuaguccuaaacuauacaaaagauuaccucgacuuucuaccccuaucagaugacgaaaacacuaaacuaaaugacacacaaaaaggaucuaaaguccacguggaagccaaaucaggaaugcuaacaagugcauuaagacacacgugggguuucucaaccaaagaccgaaauaaucauuuacaucacgcaaucgacgcaguaauaauagcauacgcaaacaacucaauaguaaaagcuuucagcgacuucaagaaggaacaagaaagcaauagugcagaacuguaugcuaaaaaaauaucugaacuagacuacaaaaacaaaagaaaauucuuugaaccauucaguggauuuagacagaaagugcucgacaaaauagacgaaauauucguuuccaagcccgaacgaaagaaacccagcggggccuuacacgaagaaacguuccgaaaagaagaagaguuuuaucaaucauaugggggcaaagaaggaguauuaaaagcccuagaacuaggcaagauucguaaaguaaaugggaaaauaguaaaaaauggagauauguuucguguagacaucuuuaaacauaaaaaaacaaacaaauuuuaugccgucccuaucuacacaauggacuucgcacuuaaagucuuacccaacaaagccguagcucgaucaaaaaaaggcgaaaucaaagauuggauucuaauggacgagaacuacgaauuuuguuucagucuauacaaagacagcuuaauacuaauccaaacaaaagauaugcaagaaccagaauucguauauuacaaugcuuucacaucauccacaguaagcuuaaucgucuccaaacacgacaauaaauuugaaacauuaucuaaaaaucaaaaaauacucuuuaaaaaugcaaacgaaaaagaaguaauagccaaaucaauaggaauccagaaucuaaaaguauucgaaaaauacauaguuuccgcacuaggagaggucacaaaagcagaauucaggcaaagagaagacuucaaaaaauga

SEQ ID NO: 8360 - RNA, 2955 nt, Artificial Sequence
  Cas9 variant
auggcucgcauacucgccuuugauauaggaaucucgucaauaggcugggcauuuuccgaaaacgacgagcuaaaagauugcggaguacgaauauucacaaaagcagaaaauccaaaaaccggagaaucacuagcacuaccaaggcgacucgcaagaucagcacgaaaaaggcuagccagacgaaaggcaagacuaaaccacuuaaaacaccuaauugccaaugaauucaaacuaaacuacgaagauuaucaaucauuugacgaaagccucgcaaaagcuuacaagggaagccuaauaucaccuuacgaacuacguuucagagcacuaaacgaacuacuaaguaaacaagauuucgcacgaguaauauuacacauagcuaaacgaagaggcuaugaugauauuaaaaauucagacgacaaagaaaaaggagccauauuaaaagcaauaaagcaaaacgaagaaaaacuagcaaacuaccaaaguguuggugaguacuuauacaaagaauacuuccaaaaauuuaaagaaaauagcaaagaauuuacuaacguccgaaauaaaaaagagucauacgaaagauguauagcacaaucauucuuaaaagaugagcuaaaacuaauauuuaaaaaacagcgcgaauucggauucucuuuuucuaaaaaauucgaagaagagguccuaagcguagcauuuuacaaacgagcacuaaaagacuucagucacuuaguugggaacuguuccuuuuucaccgaugaaaaacgagccccaaaaaauucaccauuagcauuuauguuuguugcacuaacaagaaucaucaaccuacuaaauaaccuuaagaauacagaagggauccuauauaccaaagacgacuuaaaugcucuacuaaacgaaguguuaaaaaacggaacacuaacauauaaacaaaccaaaaaacuacucggacugucagacgacuaugaauucaagggagaaaaaggaacauauuuuaucgaguuuaaaaaauacaaagaauucauaaaggcucuaggagaucauagcuuaagucaagaugaucucaacgaaauagcuaaagauauuacacuaaucaaagacgagaucaaacuaaaaaaagcucucgcaaaauaugaccucaaucaaaaccaaauagacucauuaucaaaauuagaauuuaaagaccacuuaaauauaucauuuaaagcuuuaaaauuaauaacuccccuaauguuggaagguaaaaaauacgacgaagcauguaacgaauuaaaucucaaagucgcaauuaaugaagauaaaaaagacuuccuaccagcauuuaaugaaacguauuauaaagaugaaguaacaaacccaguaguauuaagagcuauaaaagaauaccgcaaaauucuaaacgcauuacuuaaaaaauacggaaaaguacacaaaaucaacauagaauuagcuagagaagugggaaaaaaucacucccaaagagcaaagauagaaaaagagcaaaacgaaaacuacaaagcaaaaaaagaugccgaaauugaaugcgaaaaauuaggacuaaaaauaaacucaaagaacauauuaaaacuuagacuauucaaagagcaaaaagaauuuugcgcauauucaggagaaaaaauaaaauuauccgaccuacaggaugaaaaaaugcuggaaauugaccauauauauccguacucaagaagcuuugacgauagcuauaugaacaaaguacuaguauuuacuaagcaaaaccaagagaaacucaauaaaacaccauuugaagcauucgguaacgauucuacuaaauggcaaaaaauagaaguuuuggcaaaaaacuuaccugaaaaaaaacaaaaacgcauacuagauaaaaacuacaaagacaaagaacaaaaagacuucaaagauagaaaccugaaugauacacgauacauagcacgacuaguacuaaacuauacuaaagauuauuuagauuuuuuaccccuaagcgaugaugaaaauacaaaacuaaaugacacacaaaaaggcaguaaaguucauguggaagcgaaauccgguaugcucacgagugcccuccgccauacauggggauuuucagcaaaggacagaaacaaccaccuacaccacgcaauagacgcagcaauuauugcauacgcaaacaacuccauuguaaaagcauucagugacuucaaaaaagaacaagaauccaauaguguggaauuauacgcaaaaaaaauaagcgaacucgauuauaaaaauaaaagaaaauucuuugaaccauuuagcggauuuagacagaagguccuagacaaaauugacgaaaucuucguaucaaaacccgaacgcaaaaaaccuaguggggcacuucacgaagaaacauucagaaaagaggaagaauucuaucaauccuacgguggcaaagaaggaguauugaaagcguuagaacucggcaaaauaagaaaaguaaacggaaaaauaguaaaaaauggcgacauguuucgcguagauaucuuuaaacacaaaaaaacaaacaaauuuuacgcagugccaaucuacacgauggacuucgccuugaaagucuuaccuaacaaagcaguagcaaggucaaaaaaaggugaaaucaaagacuggauucuaauggacgaaaauuacgaauuuugcuucagccucuacaaagauagcuuaauucuuauucaaacuaaagacaugcaggagccugaacucguauacuuuaaugcauucacaucaucaaccguaucauuaauaguuucaaaacacgacaauaaauucgaaacacuuucaaaaaaccaaaaaauccuauucaagaaugcuaacgaaaaagaaguuauagcaaaaagcauaggaauacaaaaucuaaaaguauuugaaaaauauauaguaucagcacuuggcgaagucacuaaagcagaauucagacaaagagaagauuuuaaaaaauga

SEQ ID NO: 8361 - RNA, 2955 nt, Artificial Sequence
  Cas9 variant
auggcaaggauuuuagcauucgauauaggcaucucaagcauaggaugggcauucuccgaaaaugacgaacuuaaagauugcggcguacgaauauuuacaaaaguggaaaacccaaaaaccggagaaucacucgcacuaccccgacgauuagcacgauccgcaagaaaacgccuagcaagacgaaaagccagacugaaccauuuaaaacaucuaauugcaaacgaauucaaauuaaauuacgaggauuaucaauccuucgacgaauccuuagccaaagcuuacaaaggcucacuaauuucaccguacgaacuccgauucagggccuugaacgaacuauugaguaaacaagacuucgcaagaguaauauugcacauagccaaacgacgagguuacgacgacauaaaaaauucagacgauaaagagaaaggcgcaauauuaaaagcaauaaagcagaacgaagaaaaacuggcuaacuaucaaucagucggagaauaccuauacaaagaguacuuucaaaaauuuaaagaaaauucaaaagaauucacaaacguaagaaauaagaaagaaagcuacgaacgcugcauagcccaaucauuuuuaaaagaugaauuaaaacucauauucaaaaaacaaagagaauucggcuuuucuuucagcaagaaauuugaagaagaaguccuaucagucgccuuuuauaaacgagcacuaaaagauuuuagccaucuagugggcaacugcucguuuuucacagacgagaaacgagcgccaaaaaacucacccuuagcauuuauguucguagcauuaacaagaauaauaaaucuacuaaauaaucuaaaaaacacagaaggaaucuuauacacaaaagaugaccugaacgcccuuuuaaacgaaguuuugaaaaacgggacuuuaacauacaagcaaacaaaaaaacuacuaggccugucagaugauuacgaauuuaaaggcgaaaaaggaacauacuucaucgaauucaaaaaauacaaagaguuuauaaaagcccuaggggaacacaaccuaucucaagaugaccugaacgaaaucgcaaaagacauaacauuaaucaaagaugagauaaaauuaaaaaaggcucuugccaaguacgacuuaaaucaaaaucaaaucgauucuuuaagcaaacuagaauucaaagaccaucuaaacauaucuuucaaagcccuaaaacuuauuacaccacuaaugcucgaaggcaaaaaauacgacgaggcaugcaaugaacucaacuuaaaaguugccauaaaugaagacaagaaagauuuucugcccgcguucaaugaaacauacuauaaagaugaagucacaaacccaguaguacuacgugcaauaaaggaauaccgcaaaguccuaaacgcacuccucaaaaaauacggaaaaguacauaaaauaaauauagaacuugcgagagaaguagggaaaaaucauucacaaagggcaaaaauagaaaaagaacaaaaugaaaacuacaaggcaaaaaaagaugcagaacuggaaugcgagaaauuaggauuaaaaaucaauucaaaaaauauucuaaaauuacgccuauuuaaagaacaaaaggaauuuugcgccuauagcggggaaaaaauaaaaauaucggaucuacaagacgaaaaaaugcuagagauugaucauauauacccauauucacgaaguuuugacgauucauacaugaacaaaguacucguauuuaccaaacaaaaccaagaaaaauuaaacaaaacuccuuucgaagcauucgggaacgacagcgcuaaauggcaaaaaauagaaguacuagcaaaaaaucuaccuacaaaaaaacaaaaacgaauacuagacaagaacuacaaagauaaagagcaaaaggauuucaaagacagaaaucuaaacgacacccgauauauagcacgccuaguguuaaacuacacaaaggacuaccuagacuuucuaccacuaucagacgacgaaaauacaaaauuaaaugauacacaaaaaggcucaaaaguacacguggaagcaaaaucgggaaugcuaacaagcgcauuaagacauacuuggggauucucaacaaaagaucgaaacaaccaucuccaccacgcuauagacgcaguaaucauagcauacgcaaauaauuccauuguaaaagccuucuccgauuuuaaaaaagaacaagaaaguaauucagccgaacuguaugcaaaaaaaauaucagaacuagacuacaaaaacaaaagaaaauucuuugaaccauucagugguuucagacaaaaaguccuagacaaaauagacgaaauauucgucaguaagccagaaagaaaaaaacccagcggcgcuuuacaugaagaaacauucagaaaagaagaagaauuuuaucaaucguacggaggcaaagaaggaguccugaaagcacuugaacugggaaaaauaagaaaagucaaugguaaaauaguaaaaaauggagauauguucagaguagauauauucaaacacaagaaaacuaacaaauuuuacgccgugcccauauacacaauggauuucgcacuuaaaguacuuccaaauaaagcaguugcaagaucaaaaaaaggcgaaauaaaagacuggauacuaauggacgaaaacuaugaguuuuguuuuucauuauauaaagacucauuaauacuaauccaaacaaaagacaugcaagaacccgaauuugucuacuacaaugcauucacaucaagcacagucaguuuaauaguaaguaaacacgacaauaaguuugaaacucuaagcaaaaaucaaaaaauacuguucaaaaacgcaaaugaaaaagaaguuauagccaaaucaauaggaauacaaaauuuaaaaguauucgaaaaguacaucguuagcgcacuaggagagguaacaaaagccgaauucagacaaagagaagauuuuaaaaaauga

SEQ ID NO: 8362 - RNA, 2955 nt, Artificial Sequence
  Cas9 variant
auggcaagaauacuugcauuugauauagguauaucaagcaucgggugggcauuuagugaaaaugaugaacuaaaggacugcggaguacggauauuuacaaaagcagagaacccuaaaacaggagaaucauuagcauuaccacgcagauuagcaagaucugcaagaaaaagacuagcgcgucgaaaagcaagacugaaccaccuuaaacauuuaaucgccaacgaauuuaaacuaaauuacgaagacuaucaauccuuugaugaaagucuagcaaaagccuacaaaggaucccuaauuucaccauaugaauuaagauucagagcauugaacgaacuucuuucgaaacaagauuuugcacgaguuauauuacauauagccaaaagacgaggauaugaugauauaaaaaacucggacgacaaggaaaaaggagccauccucaaagcaauaaaacaaaacgaagaaaaacuagccaacuaccaaagcgucggagaauaucuuuacaaagaauauuuucaaaaauuuaaagaaaauucaaaagaguuuacaaacgucagaaacaaaaaagaaucuuaugaaagaugcauagcacaaucuuuucuaaaagacgaacucaaacuuaucuucaaaaaacaacgagaguuuggauucucguucucaaaaaaauucgaagaagaaguuuuaucagucgcguucuauaaacgcgcauuaaaagauuuuucacauuugguaggcaacugcagcuucuucaccgacgaaaaacgcgccccaaagaauagcccucuagccuucauguucguagcacuuacaagaauaauaaaucuucuuaacaaucuuaaaaacacagaaggaauuuuauauacaaaagaugaccuaaaugcgcuacuuaacgaaguacuuaaaaacgguacauuaacauacaaacaaacuaaaaaacuucuaggucuaucagaugauuacgaauuuaaaggagaaaaagggacguacuuuauagaauucaaaaaauauaaagaauucauuaaagccuuaggagaucauucccucucacaagacgauuuaaacgagauagcaaaagacaucacacuaauaaaagacgaaauaaaauugaaaaaagcgcucgcaaaauacgaucuaaaccaaaaucaaaucgacagucuaaguaaacuagaauucaaagaucaccuuaacauauccuuuaaagccuuaaaacuaaucacuccucuaaugcuugagggaaaaaaguacgaugaagcuugcaacgaauugaauuuaaaagucgccauuaacgaagacaaaaaagauuuccuaccagccuucaaugaaacauauuacaaagaugaaguaacaaaccccguggucuuacgagcaauaaaagaauacagaaaaguacuaaacgcacuauuaaaaaaauauggaaaaguccauaaaauaaacauagaacuggccagagagguaggaaaaaauuauucacaaagagcaaaaaucgaaaaggagcaaaaugaaaauuauaaagcaaaaaaggaugccgaauuagaaugugaaaaauuaggccucaaaauaaauucuaaaaacauccuuaaauuaagacuauuuaaagaacaaaaagaguucugugcauacaguggagaaaaaaucaaaauaucagaccugcaagaugaaaagauguuagaaaucgaccacauauauccuuacucaagaucauucgaugacuuuuauaugaauaaaguacugguuuuuacaaaacaaaaucaagaaaaauuaaaucaaaccccuuucgaagcuuucggaaacgacagcgcuaaauggcaaaaaaucgaaguauuagcaaaaaacuugccaacaaaaaaacaaaaaagaauacuagacaaaaauuacaaagauaaagaacaaaaagacuuuaaagauagaaaccuaaacgacacaagauauaucgcaagauuaguacuaaauuacacaaaagauuaccuagauuucuuaccuuuaucagaugaugaaaacacaaaguuaaacgacacgcaaaaaggcagcaaaguacauguagaagccaaaagcggaauguuaacuucagcccuccgacacaccuggggauuuuccgcaaaagaccgaaacaaucaccuacaucaugcuauagacgcaguaauaauugcauaugcaaacaauucaauuguaaaagccuucucagacuucaaaaaagaacaagaaaguaacucagcugaacuauaugcaaaaaaaauaucagaacucgacuauaaaaacaagcgcaaauuuuucgaaccauuuucaggauuucggcaaaaaguacuggauaaaauugaugaaauauuuguaucgaaaccagaacgcaaaaagccaucaggagcacuccacgaagaaacauuucgaaaggaagaagaguuuuaucaaagcuacggcggcaaagaaggaguuuuaaaagcucuagaacuaggcaaaauacgaaaagucaauggaaaaaucguaaaaaauggagauauguuuaggguagauaucuucaaacacaaaaaaacaaacaaauucuaugcugucccaauuuacaccauggacuuugcucucaaaguacuaccgaauaaagcagucgcgagauccaaaaaaggagaaaucaaagauuggauacuaauggacgaaaacuacgaauucuguuuuucauuauauaaagauucacuuauacuaauacaaaccaaagacaugcaagaacccgaguuuguauauuacaacgcuuucacaucaucaacgguaucacuaauaguaucuaaacacgauaacaaauucgaaacacuaucuaaaaaccaaaaaauacuauucaaaaacgccaacgagaaagaaguuaucgcgaaaaguaucggaauacaaaauuuaaaaguauuugaaaaauauauugugagugcauuaggcgaaguaacaaaagcagaauucagacaacgcgaagacuucaaaaaguga

SEQ ID NO: 8363 - RNA, 2955 nt, Artificial Sequence
  Cas9 variant
auggcuaggauucuagcauuugacauaggaauauccucaauuggaugggcguuuucugaaaaugacgaauuaaaggacuguggcguucgaauauucaccaaagcggaaaauccaaaaacgggagaaagucuugcucuaccccgaaggcuagccagaucagcacgcaaaagacuagcccgaagaaaagcuagauugaaucaucuaaaacaucuaauagcaaaugaauucaaacuaaacuaugaagauuaccaaucauuugaugaaucacuagcaaaagccuauaaaggaucccucauaucaccuuacgaacuaagauucagagcuuuaaaugaauuacuaagcaaacaagauuucgcuagaguaauucuacacauugcaaaacggagagguuacgacgauaucaaaaacucagacgauaaagaaaaaggcgcaaucuugaaagcuauaaaacaaaacgaagaaaaacuagcgaacuaucaaaguguaggcgaauaccucuacaaagaauauuuccaaaaauucaaagaaaacucaaaggaguucacaaacguacgaaauaaaaaagaaucauacgaaagaugcauagcacaaucauuucuaaaagacgaauuaaaacuuauuuuuaagaaacagagagaauuuggcuucucguucagcaaaaaauuugaagaagaaguacuaucaguagccuuuuacaaacgagcacuaaaagacuucagucaucuaguuggcaauugcucauucuucacugacgaaaaacgagcacccaaaaacucaccuuuagcuuuuauguucguggccuuaacgcgaauuauaaaccuucuaaauaauuuaaaaaacacagaagguauacuauacacgaaagacgaccuaaacgcacuccucaaugaauuucucaaaaacggaacacuaacuuacaagcaaacaaaaaagcucuugggccucagcgacgauuacgaauuuaaaggcgaaaaaggaacuuauuucaucgaauucaagaaauacaaagaauuuaucaaagcacucggagaacacaaucucucacaagaugacuuaaaugaaauagccaaagauauaacauuaauaaaggaugaaauuaaacuaaaaaaagcucucgcaaaauacgaccuaaaccagaaucaaauagacucauuaucaaaacuagaauucaaagaccaccuaaacauaucauucaaagcacuuaaacucauaaccccucuaaugcuagaaggcaaaaaauaugaugaggcuuguaacgaauuaaacuuaaaaauagccauaaacgaagacaaaaaagacuuucuaccagcauuuaacgaaacauauuacaaagacgaaguaacaaauccaguaguucuacgagcaauuaaagaauauagaaaaguguuaaacgcauuauuaaaaaaauacgggaaaguucacaaaauaaauauagaauuagcucgagaagucgggaagaaccauagccaaagagcuaaaauagaaaaggaacaaaaugaaaauuauaaagcaaagaaggaugcagaacuagaaugugaaaaauuaggacuaaaaaucaacagcaaaaacauauuaaaacuaagauuauucaaagagcaaaaagaauucugcgcauauuccggugaaaaaauaaaaauaagugaucuacaagaugagaaaaugcuugaaauugaucacauauacccuuauagucggaguuucgaugacucauauaugaacaaaguacuaguauuuacaaaacaaaaccaggaaaaacuuaaucaaacaccuuucgaagcauuugguaacgauucagccaaauggcaaaaaaucgaaguauuagcaaaaaacuuaccaacaaaaaaacaaaaaagaauuuuagacaaaaacuacaaagauaaagaacaaaaaaacuuuaaagacaggaaucuaaaugacacaagguacauagcaagacuaguauuaaacuacacaaaagauuacuuagauuucuuaccauuaucugaugacgaaaauaccaaauugaacgacacacaaaaaggaucaaaaguccacguagaagcaaaaucuggaauguuaacaucagcuuuacgccacaccuggggauucucagcaaaagacagaaacaaccauuuacaccaugcaauagacgcuguaauaaucgcauaugcaaacaacagcauaguaaaagcauucucagacuuuaaaaaagaacaagaaucuaauagcgcagaauuauacgcaaaaaaaauaucagaacuagacuacaaaaacaaaaggaaauuuuucgaaccauuuuccgguuuccgacaaaaaguacuagacaagaucgacgaaauauucguaucuaaacccgaaagaaaaaaaccaaguggggcucuacaugaagaaacauuuagaaaagaagaagaauucuaucaaaguuacggaggaaaagaagggguacuaaaagcacuagaacuaggcaaaauccguaaagugaauggaaaaauaguaaaaaacggagauauguuccgaguagacauauuuaaacacaaaaaaacuaauaaauucuacgcagugccaauauauacaauggacuuugcauuaaaaguacucccaaacaaagcaguagcucguucaaaaaaaggcgaaauaaaagacuggauauuaauggacgaaaacuaugaauuuuguuuuagcuuauacaaagauucccucauucuaauccaaacaaaagacaugcaagaaccagaauucgucuauuauaaugcauucacaucaucgacuguaagucuaauaguaagcaaacaugacaauaaauucgaaacccuaucaaaaaaccagaaaauccuauucaaaaaugccaacgaaaaagaaguaauagcaaaaagcauagggauccaaaacuuaaaagucuucgaaaaauacauaguaucagcccuaggagaaguuacaaaagcugaguuucgucaaagagaagacuucaaaaaauga

SEQ ID NO: 8364 - RNA, 2955 nt, Artificial Sequence
  Cas9 variant
auggugaggauacuagcuuucgauauagguauaucaagcauuggaugggccuucucagaaaaugacgaacuaaaagacuguggagucagaaucuucacuaaaguagaaaacccaaaaacaggcgaaucauuagccuuaccaagacgacuagcaagaucagccagaaaacgucuagcacggaggaaagcaagauuaaaccacuuaaaacaccuaauugcuaacgaauucaaacuaaacuacgaagacuaucaauccuuugacgaaucacuugcaaaagcauauaaaggcucauuaaucagcccauacgaauuaagauucagagcccuaaacgaauuauuaagcaaacaagauuucgcaagaguaauucugcauauagccaaacgaagaggauacgaugauauaaaaaauucagaugauaaagagaaaggagcaauauuaaaagccauuaaacaaaacgaagaaaaacuugcaaauuaucaaagcguaggcgaauaccuauacaaagaauauuuccaaaaauucaaagaaaauucuaaagaauucaccaacguaagaaacaaaaaagaaucauaugaacgaugcaucgcucaauccuuccuuaaagacgaacuaaagcuaauuuuuaaaaaacagagagaauucggauuuucauucagcaaaaaauuugaagaagaaguacuaucgguagccuucuauaaacgugcacuaaaagacuuuagccaucuaguaggcaacugcucauucuucacagacgaaaaacgagcaccaaaaaauucgccuuuggcguucauguuuguggcuuuaacacgcauaaucaauuuauuaaauaaucucaaaaacacugaagggauacuauauacaaaagacgacuuaaaugcauuauuaaacgagguauuaaaaaauggcacacucacguacaagcaaacaaaaaaacucuuaggauugucugaugauuacgaauucaaaggggaaaaaggaaccuacuucauugaauucaaaaaauauaaggaauuuaucaaagcacucggagaacauaaccuaagucaagacgaccuaaaugaaauagccaaagauauaaccuugauuaaagaugagaucaaauuaaaaaaagcguuggccaaauacgauuuaaaucaaaaucaaauagacagcuuaaguaaacuugaauucaaagaccaucuaaacaucucguucaaggcuuuaaaauuaauuacaccauuaauguuagaaggcaaaaaauacgacgaagcaugcaaugaacuuaacuuaaaaguagccauaaacgaagacaaaaaagacuucuuaccagcguucaaugaaaccuacuacaaagacgaggucacuaauccagucguguuaagggcaauaaaggaauacaggaaaguauuaaacgcacuucuaaaaaaauacgggaagguacauaaaauaaacauagaacuagcucgagaaguagguaaaaaccacagccaaagagcaaaaauagaaaaagaacaaaaugaaaacuauaaggcaaaaaaagaugccgaacuagagugugaaaaauugggacugaaaauaaacucaaaaaacauuuuaaagcucagacucuucaaagaacagaaagaauuuugcgcauauuccggagaaaagauaaaaauauccgaccuacaagacgaaaaaaugcuagaaauugaccacaucuauccauauucaaggaguuucgacgacaguuacaugaauaaaguacuagucuucacuaaacaaaaccaagaaaaacuuaauaaaacuccauucgaggcauuugggaacgacagcgcuaaauggcaaaaaaucgaaguauuagcaaaaaaccuaccaacaaaaaaacaaaagagaauauuagauaaaaacuauaaagauaaagaacaaaaagacuucaaggaucggaacuuaaacgacacucgcuacauagcacgcuuaguacuaaauuacacuaaagacuaccuagacuuucuaccccuauccgaugacgaaaauaccaaacuaaacgauacacaaaagggcucaaaaguacacguagaagcaaaaaguggaaugcuaaccuccgcuuuaagacacacauggggauucucaaccaaagaucgaaacaaucaucuacaccaugcaaucgacgccguaauaaucgcauacgcuaauaacucaauaguaaaggcauuuuccgacuucaagaaggaacaagaaucaaauagcgccgaacuauaugcaaaaaaaaucuccgaauuagauuacaaaaacaaaagaaaguuuuucgaaccauucaguggauucagacaaaaagucuuagauaaaauagaugaaauauucgucagcaaaccagaacgaaaaaaaccuaguggagcauuacaugaagaaacauuccgcaaagaagaagaauuuuaccaaucuuacggcgguaaagaagguguacuuaaggcacucgaacuagguaaaauuaggaaaguaaacggaaagaucgucaaaaacggagacauguuuagaguagacauauuuaaacacaagaaaacaaacaaguuuuaugcugucccaauuuacacaauggauuuugcauuaaaaguacugcccaacaaagcaguugcaagaagcaaaaaaggagaaaucaaagacuggauacugauggaugaaaauuacgaauuuugcuuuagucuauacaaagacucauuaauacuaauacaaacaaaagauaugcaagaaccagaauucguauacuauaaugcguuuacaaguucaacagucucacuaaucguuagcaagcaugacaacaaauuugaaacacugagcaaaaaucaaaaaauauuauucaaaaacgcaaaugaaaaagaaguaauagccaaaaguauaggaauacaaaaccuaaaaguauucgaaaaauauaucguaucagcacucggagaaguaacaaaggccgaauuuagacaaagagaagacuucaaaaaauga

SEQ ID NO: 8365 - RNA, 2955 nt, Artificial Sequence
  Cas9 variant
auggcucgaauccuugcauuugauaucggaauaucuaguaucggaugggcauucucagaaaaugaugagcuaaaagacuguggaguaagaauauucaccaaagccgaaaauccaaaaacaggagaaagucuagccuuaccucggaggcuagcaagaucagcuaggaaaagacuugcaagaagaaaggccagacuaaaccacuuaaagcacuuaauugcaaaugaauuuaaauuaaauuaugaagacuaucaaaguuucgacgaaucacuagcaaaagcauacaaaggcucccuaauaaguccauacgaauuaagauuccgagcccuaaacgaacuacuaucaaaacaggacuuugcucgaguaauccuacacauagcaaaacgaagaggauaugacgauauaaaaaacucagacgacaaagaaaaaggugcaauacuaaaagccauaaaacaaaaugaagaaaaauuagcaaacuaucaauccguaggcgaguaucuuuauaaagaauacuuucaaaaguucaaagaaaauaguaaagaauucacuaauguaagaaacaaaaaagaaucauaugaacgcugcauagcacaaucuuucuuaaaagaugaacuaaaacuaauauucaagaagcaaagagaauucggauucagcuuuagcaaaaaauucgaagaagaagucuuaucuguagcuuucuauaaaagagcacucaaagacuuuagccauuuaguuggcaacugcuccuuuuucacagaugagaaacgcgcucccaaaaauucaccccuagcauucauguuugucgcuuuaacaagaaucauuaaccuguugaacaaccuaaaaaacacagaaggaauucucuacacgaaagacgacuugaacgcacuacuuaacgagguacuaaaaaacggaacucugacuuacaaacaaacaaaaaaauuguuaggacuaucagaugauuaugaauucaaaggggaaaaaggaacauacuuuauagaauucaaaaaauacaaggaauuuauaaaagcacuuggggaccacucuuuaagccaagacgaucuaaacgaaauagccaaggacauuacacuuauaaaagacgaaaucaaauugaaaaaagcacucgcaaaguacgacuuaaaucaaaaccagauugacucauuaucaaaauuagaauuuaaagaccaccuaaacaucucauucaaagcacugaaacucauuacaccacuaaugcuugaaggaaaaaaguaugaugaagcgugcaacgaauuaaaucuaaaaguagcaauaaaugaagacaaaaaagauuuccuaccagcauucaacgaaacguacuauaaagacgaaguaacaaacccaguaguucuuagagcaauaaaggaauaucgaaaaguguuaaacgcacuacuaaaaaaauauggcaaaguucauaaaauaaauauagaguuagcuagagaaguagguaaaaacuacagucaacgcgccaagauagaaaaagaacaaaacgaaaacuauaaagcuaaaaaagaugcagaacucgaaugcgaaaaauuaggauuaaaaauaaauucuaaaaauauacuaaaauuacgauuauuuaaagagcaaaaagaauucugugccuacucaggagaaaaaaucaaaauuucagaccuacaagacgaaaaaauguuagaaauagaccacauauaccccuacucaagaagcuuugaugacaguuauaugaacaaaguccuugucuuuacuaaacaaaaccaggaaaaacuaaaucagacgccauuugaagccuucgggaacgauucagcaaaauggcaaaaaauugaaguacuagcuaagaaucugcccaccaaaaaacaaaaacgaaucuuagacaagaacuacaaagauaaagaacaaaaagauuucaaagaccgaaaucuaaacgauacaagauauaucgcaagacuaguuuuaaacuauacgaaagacuaccuggauuucuuaccacuaucagacgaugaaaacacaaaacuaaacgacacccaaaaagguucgaaaguacacguagaagcaaaaucuggaauguuaacaucagcgcucaggcacacuugggguuucucagcaaaagacagaaacaaucacuuacaccaugccauugacgcuguuaucauagcauacgcaaacaacucaauagugaaagcguucagcgacuucaaaaaggaacaggaguccaacagcgccgaacuauaugcaaaaaaaauaucagaacuugauuacaaaaacaaaagaaaauucuuugaaccauucagcggguucagacaaaagguacuagacaaaauagaugaaauauucgucagcaaaccagaacgcaaaaaaccgucuggagcacuacacgaagaaacauuccgcaaagaggaagaauucuaccaaucuuacggcgguaaagaggguguacucaaagcucuagaacuaggaaaaauacgcaaaguuaacggcaaaauaguaaaaaauggagauauguuuagaguugacauauucaaacauaaaaaaacaaacaaauuuuacgcaguuccaauauauacaauggacuuugcacuaaaaguguuaccaaacaaagcuguugcaagaucgaaaaaaggcgaaauaaaggauuggauucuaauggacgaaaauuacgaauucugcuuuagucuauauaaagacagccuaauccugauucaaaccaaagacaugcaagaaccagaauuuguauauuauaacgcguuuaccaguaguacaguaucccugauaguaagcaagcacgauaacaaauucgaaacacuaucaaaaaaccaaaaaauacuauucaaaaacgcaaaugaaaaagaagucauagcaaagucaauaggaauccaaaacuuaaaaguauucgaaaaauacauagugucagcacucggagaaguaacaaaggcugaauuuagacaaagagaagauuucaaaaaauga

SEQ ID NO: 8366 - RNA, 2958 nt, Artificial Sequence
  Cas9 variant
auggcaaaaauuuuagccuuugacauaggaauauccuccauaggaugggcauucguagaaaacgaugagcuaaaagacuguggagucagaauauucacaaaagcagaaaacccaaaaacuggagaaucucuugcucuccccagacgauuagcucguucagcucgaaaaagacuagcgagaagaaaagcacgauuaaaucacuuaaaacaucuaauugcuaaugaauucaaacucaacuacgaagauuaccaaagcuuugaugaaagucuugcaaaagccuauaaaggaacgcuaauaucaccuuacgagcuaagauuuaaagcguuaaacgaauugcuaucgaaacaagacuuagcuagaguuauauuacauauagcaaaaagaaggggcuacgauaauaucaaaaacucagaugacaaggaaaaaggcgcaauacuaaaagccguaaaagaaaaugaagaaaaauuagcaaacuacaaaagcguaggagaauaccuauauaaagaauacuuucaaaaauuuaaagaaaacagcaaagaauuuauaaauguacgaaacaaaaaagaaucauaugaaagauguauagcacaaaguuucuuaaaagacgaauuaaaacucauauuccaaaaacaaagagaguucggcuuuaauuucucaaaaaaauucgaagaagaaguccucucagucgcauucuacaagcgggcccucaaagacuucucacauuuagucgggaacugcucguuuuucguagacgaaaaacgagccccuaaaaacucuccuuuagccuucgaauucguagcacuaacccgaauuguaaaccucuuaaacaaccuaaacaaaaauaacucguacaucaaagaugaucuaaaugcccuuuuaucagagguccuaaaaaauggaacauuaacauauaaacagacaaaaaagauacuaggauuauccgacgauuaugaauuuaagggacaaaaaggcaacuacuuuauagaauucaaaaaauauaaagaguucauaaaagcgcuaugcgaacauaaccuaaaccaagacgaucuaaacgaaauagcaaaagacauaacucuaguuaaagacgaaacuaaauuaaagaaagcacuugccaaauacgaccugaaccaaaaucaaauagaaaaccuaucaaaaaucgaauucaaagaucaucuaaauauaucauuuaaagcuuuaaaacuaauagucccguuaaugcgagaaggaaaaaaauacgaugaagucugcaacgaacuuaaccuaaaaacagccauuaacgaagauaaaaaagaauuccuaccagcauucaacgaaacauacuauaaagacgaaguaaacaacccaguaguacugagagcaauaaaagaauaccgaaaaguacucaacucauuacuuaaaaaauauggaaaagugcacaaaauaaauauugaauuagcaagagaaguugguaaaaaucaucgagaacgaucaaaaaucgaaaaagaacaaaacgaaaacuucaaagcaaaaaaagacgcagaauuagaaugcgaaaaacuaggauuaaaaauaaauuccaaaaacaucuuaaaacuacgacuauucaaggagcaaaaggaauuuugcguguauucaggagaaaagauaaaaaucucagaucugcaagacgaaaaaauguuagaaauugaccacauauauccauacagcagaucauucgacgacucauauaugaauaaaguauuaguauucacaaaacaaaaucaagagaaacuaaacaagacaccuuucgaagcauuuggaaaagacgacguaaaauggcagaaaauagaaacauuagcaaaaaauuuaccagcgaagaaacaaaaacgaauacucgacaaaaauuacaaagacaaagaacaaaaagacuuuaaagacaggaaccucaaugauacaagauauauagcaagacuaguauuaaacuacacaaaagacuauuuggaauuccugccccucucagaugaugaaaauauaaaacuaaacgacacacagaaaggaagcaaaguucacgucgaggcaaaaagcggaaugcuuacaagcguccucagacauaccugggguuuuucaacuaaagacagaaacaaucauuuacaccacgcaauugacgccguuauaauugcauaugcuaacgcuagugucguaaaagccuuuagcgauuuuaaaaaagagcaagaaaacuacacugcagaacuauacgcaaaaaaaauaaacgaacucgacuuuaaaaacaagagaaaauucuucgaaccuuucagcaacuucagacaaaaaguauuagaaaaaauagacgaaauauucguuucaaaaccugaaagaaaaaaaccgucaggcgcauuacacgaagaaaccuuuuauaaagaagaagaauuuuauaaagaguacggaggaaaagaaggcguauuaaaagcacuagaauuagggaagauaagaaaaguaaauggaaagauaguauccaacgccaacauguucagagucgacaucuucaaauacaagaaaaccaacaaauuuuacgccgucccaauauacacaauggacuucgccuuagguauauuaccaaacaaagcaguaguagguggcaaagacaaacaaggaauaauaaaggauuggcuauugauggaugaaaauuaugaauucugcuucagcuuauacaaggauucucucauauuacuacaaacaaaagacaugcaagaaccagaacucguauacuuuaaauccuucaagucauccacagcgggauuaguaguaucaaaacacgauaacaaauucgaaaaccuaaacgaaaaccaaaaaaaauuauucaaaucagccaaugaaaaaaaaguagucgccgaaggcauaggaauccaaaaccuaaaaguauucgaaaaauauaucgucucugcauuaggugaaaucaccaaagccgaaauuaaagaaagagagaauuucaaaaaaaaauga

SEQ ID NO: 8367 - RNA, 2961 nt, Artificial Sequence
  Cas9 variant
augccuagugauccagcagaagcuaaaccacuagaauuauuagauccauaugcauuaagagcacaaggguuagaccaagcacugccauuaacacauuuuggacgcgcgcuauuucaucuuaaucaaaggagaggcuuuaaaaguaauagaaaaacagaccgaggggacaaugaaaacggaaaaauuaaagacgcuagccagagauuggacugggcgaugcaugaagcaaaagcucgaacauauggagaguucuugcauuuaagaaggcaaaaagcaccagaucccaggcagguaccgacaguuaggaccaggcuaagcguaggaaaaagaggagggccggacgcaaaagaggaagcuggguaugacuuuuauccggauagacgacaccuagaagaagaauuucacgaauuauggucugcacaagcccaauuucauccugaauuaacacaagauuugagagauuugguauuugagaaaauauuuuaucaacguccucuaaaggagccaaaaguaggacuuugucuauucacaagugaagaacguuuagcaaaagcgcacccacucacucaaaggagaguauuguacgaaacuguaaaucaacuacgaauaacugccgauggcagaucugucagaccauuaaguagagaacaaagagaucagauaauucuggcauuagauacuaagaaaccaacaaagagcuuaaacaguaugguuguuacauuacaagcgcuuggaaaaguuuuaaaacuaagagaaggugaaagauuuacacuagaaucaggaguccgagaggcaauagcaugcgauccuguacgggcugcaaugcuggcaacauuuggaccacgguggucagcacucgacuggccugaacaauggcaagucauaagcaggguaaggaaauugcaagaugacaaagauuuugcagaacuuguagaauggcuaauagaauuauacgguguagacaaagaagcagcugucaaaauagcuaauacacaccuucccgaaggauacggccgacuaggauuaacagcgacaacaagaauacuagauagauuaaaaucaaauguauucacauaugcacaagcaguugccgcuugcggauggcaccauucggaucaaagaacuggagaaugucuugaucguuuaccuuacuacggagccguauuagaucgacaugucauaccaggaaccuaugacgaaaaugacgacgauauaacgcgauucgguagaauaacaaacccaacuguucacauuggacuaaaccaauuaagaagauuaguaaauaaaauaauagaaguuuauggaaaaccgaaucagauaguaguggaauuagcacgagaacuaaaacaaagugaacaacagaaaaaugacgcaauaaaacuaauaagagauacaaccacugcagcuaaacaacgaucagaaaagcucgaagaacuuggaauuacugauaaugguagaaacagaauguuacuaagacuaugggaagaccuuaacccugaugaugcuaugaggagauucugcccauauacaggacaaaggauaucagcagcaaugauauucgacggaagcugcgauguagaucauauacuaccuuauucacggacacuagaugacgguuuugcaaauagaacucuauguuuaagagaagcaaaccgagagaaaaggaaucaaacccccugggaggcuuggggcggcacacccaacugggaagcaauagaaacuaaucuuaaaaacuuaccugaaaauaaaagauggcgauucgccccagaugcaauggcccgauuugaaggagaaaaugauuucuuagaucgagcucucguagauacacaauauuuggcaagaauaaguagaacguaucuugacaccuuauucacagaaggaggucauguuuggguaguuccagggagacuaacagaaaugcuacgacgucauugggguuuaaauucgcucuugacagauaaagauagaggagcaguaaaauccaagaauagaacagaucacaggcaccauaguauagaugcagcaguaguagcagcaacagaucggagcuuacuuaacagaauuucaagagcagcgggucaaggugaaguggcaggccaaagugcagaauuaauagccagagaaacaccacccccaugggaaggauuuaggaaugaccuaaaaucucaacuaggacguauaauaguuagccaucgugccgaucauggcagaauagacagacaagccagaaaacaagggagagauagcacagcuggccaauuacaucaagaaaccgcuuauagcauuguagacgauacaaggguagcgaguaggauagacuuccuuaguguaaaaccagcacagcuauuggaucaaccaggccguagcggacaaguaagagaccuucaauuaagaaaagcauugagaguggcaacgggagaccuaacuggaaaagauuaugaaaaagcauugagagauuucgcagccaaaccugguccauacaaagguauacguaggguuaggaucauaaaaccucuucaggaacaagcaagagucccuguaccaguauuagaccccauaaaagcauaccaaggagguaguaaccacguauuugagauauggcacuugccagacgguaaaguagagccacagguaauaaccucauuugaagcccacgcauuagaaguugagaaaagaccacacccagcagcaaaaaggcuucuuagaguacauaaaggagauaugguagcguuaaaaagagaaggaagaacaguaguuggccauguacaacaaaugcauauuaaaaauggccuauuuauaguaccacacaaugaagcaaaugcagacgcuagaaauuccgacaggacagauccuuucaaauggauacaaauugcugcacaaccagcuauagccgcaggcauaagaagagucgcagucgaugaaauagguagacuucgugacggaggugcaaaaacuauauga

SEQ ID NO: 8368 - RNA, 2964 nt, Artificial Sequence
  Cas9 variant
auggcaagaauccuagcauucgacauaggaauauccucaauaggaugggcauucucagaaaacgaugagcucaaagacugcggagucagaauauuuacgaaagcagaaaacccaaaaacaggagaaucauuagcgcuaccaagaagauugagucgaucagcaagaaaaagacuugcccgaaggaaagcaagacuaaaccaucucaaacacuuaauugcgaacgaguuuaaacuaaauuacgaagauuaucaaaguuuugacgaaucacuugcgaaagcuuacaaagguagucuaauaaguccauacgaauuaagauucagagcacuaaacgaauuucucagcaaacaagauuuugcuagagugauacuacauauagcaaaacgcagaggauacgaugacauaaaaaacaauggugacgaggaaaaaggagaaaucuuaaaagccauaaaacaaaaugaagaaaaacuuguuucauaucaaaguguaggagaguauuuauacaaagaauacuuccaaaaauucaaagaaaacucaaaagaauucaucaacguacgcaauaaaaaagaaucauacgaaagaugcauagcacaaaguuuccuaaaagaugagcugaaacucaucuuccaaaaacaaagagaguucgguuucucauucaguaaaaaauuugaagaagaaguucucaguguagcuuucuauaaacgcgcccuaaaagauuucucgcacuugguggguaacugcucuuuuuucaccgacgagaaacgugccccgaaaaauucaccccuggcauucauguucguagcauuaacucgcauaauaaaucuauuaaauaaccuuaaaaacacggaagggauacuauauacaaaagacgaucugaauacgcuacuaaaugagguacuaaaaaauggaacauuaaccuacaagcagacgaaaaaauuauuaggucuaagcaaugauuacgaguucaaaggagaaaaagguacauauuucaucgaauuccaaaaauacaaggaauucgugaaggcacuaggagaacacaacuuaucacaagacgaccuaaaugaaauagcaaaagacaucacacuuauuaaagacgaaaucaaacuaaaaaaagcccuggcaaaauacgaccuaaaucaaaaccaaaucgauucccucaguaaauuggaauuuaaagaucaccuaaacauaucguuuaaagcccuuaaauuaauaacaccgcuuauguuagaagggaaaaaauaugaugaagcuuguaacgaauuaaaccucaaaguagcuauaaacgaagauaaaaaagauuuccuaccugccuuuaaugaaacauacuacaaagacgaaguaaccaacccggucguacuaagagcaauaaaagaauacagaaaagucuuaaacgcgcuauuaaaaaaauacgguaaaguacacaagaucaauauugaacuugcaagagaaguaggcaaaaaccauucccaaagagcgaaaauugaaaaagaacaaaacgaaaacuauaaagcuaaaaaagaugcagagcuagagugugaaaaacucggauugaaaauaaauucuaagaacauauugaaacucagacuauucaaagaacagaaagaauucugcguauauaguggcgaaaaaauaaaaauaucagaccuacaagacgaaaaaauguuagaaauagaccacaucuacccauacucaagguccuucgacgacaguuauaugaacaagguauuaguauuuacaaaacaaaaccaagaaaaauuaaacaaaacaccauucgaaacuuucggaaacgauagaguaaaauggcagaaaauugaaguacucgcuaaaaaucuaccaacuaaaaaacaaaaaagaauucuagauaaaaacuauaaagauaaagaacaaaaagauuucaaagacagaaaccuaaacgacaccagauacauagcaagacucguacuaaauuacacuaaagauuacuuagacuuccugccgcuuagcgacgacgaaaacacaaagcuaaacgacacccaaaaggguucaaaaguucacguagaagcaaaaaguggcaugcuaacuagcacccuuagacauacaugggguuucucaaccaaagacagagauaaccaccuacaucacgcuauugacgcagcaauuaucgcauacgcaaacaacaguaucguaaaagccuucagcgacuucaaaaaagaacaagaaucaaacacagcagaacucuacgcaaaaaaaauaucagaauuagacuacaaaaauaaaagaaaguuuuucgaacccuuuucagguuuuagacaaaaacuacuugauaaaauagacgaaauauucguaagcaaaccugaacguaaaaaaccaucaggagcacuccacgaagaaacauuuaggaaagaagaagaguucuaccaaaguuauggaggcaaagagggcgucuuaaaagcuuuagaguuagguaaaauaagaaaaguuaauggaaaaaugguaaaaaauggugauauguuuagaguugauauauucaaacacaaaaaaacaaacaaauucuacgcaguaccaaucuauacaauggacuucgcauuaaaaguucucccaaacaaagcagucguacaagguaaagacaaaaaaaguggacuaauaaaggauuggaucuuaauggacgaaaacuacgaauuuugcuucucacuauacaaagauucauuaauacuaauccaaacaaaagacaugcaagaacccgaacuaguauacuaugaaagacuggacagcagcaacgcaucucucacaguaucaaaacaugauaacaaauucgaaacacucaguaaaaaccaaaaaauacuauuuaaaaacgcgaacgaaaaagaagucaucgcaaaaaguauagggauccagaaucuaaaagucuuugaaaaauauauaguauccgcccuaggcgagguaaccaaagcagaauuuagacaaagagaagacuucaaaaaauga

SEQ ID NO: 8369 - RNA, 2964 nt, Artificial Sequence
  Cas9 variant
auggccagaaucuuagcauuugauauagggauaagcucgauaggaugggcauuuucggaaaaugacgaauuaaaagauugcggaguaagaauauuuacaaaagcugaaaacccaaaaaccggcgaaagcuuagcauuaccaaggcgauuagcaagaucggcacguaaaagacuugcaagaagaaaagcaagacugaaucaccuaaaacacuugauugcaaacgaauuuaaacucaacuacgaagauuaucaaucauucgacgaaucauuagccaaagcauauaaaggaagucuaauaucaccguacgaauuacgauucagagcuuuaaaugaacuacuaucaaaacaggauuucgccagaguaauauuacacaucgcuaaaagaaggggcuaugaugacauaaaaaacucagaugacaaagaaaaaggcgcaaucuuaaaagcaauaaaacaaaaugaagaaaaauuagcuaacuaucaaucaguaggggaauaccuauauaaagaauauuuccaaaaguuuaaagaaaauuccaaagaauucaccaacgugcgaaacaaaaaagaaucauacgaaagguguauugcccaaucauuccuaaaagaugaacuaaaauugauauucaaaaaacaaagggaauuuggauucuccuucucaaaaaaguucgaagaagagguucuaucgguugcuuuuuacaagagagcucuaaaagauuucucccaccuaguaggaaauugcagcuucuuuacagacgaaaagcgagcaccaaaaaauucaccuuuagcguuuauguuuguagcuuuaacaagaauuauaaaccucuugaacaauuuaaaaaacacagaaggaauacuauacaccaaagacgaccuaaaugcguuacugaacgaaguauuaaagaacggaacucuaacguacaaacaaacaaaaaaacuguuaggacuuagcgacgauuacgaauucaaaggcgaaaaaggaacauauuucauagaauuuaaaaaauacaaagaauuuauaaaagcauuaggagaucacagucugagucaagaugaccuaaacgaaauagcuaaggacauuacucuaauaaaagacgaaauuaaacuuaaaaaagcacuugcaaaauaugaucuaaaccaaaaucaaauagauucauugagcaaacuagaguucaaagaccacuuaaauauaucguucaaagcauuaaaauuaauuacaccacuaauguuagaaggaaaaaaauacgaugaagcgugcaacgaacuaaaucucaaaguugccauaaaugaagauaaaaaggacuuccuaccagccuuuaaugaaaccuauuauaaagacgaaguaacaaacccagugguauuaagagcgauaaaagaauaucgcaagguauuaaacgcacucuugaaaaaauacggaaaaguucacaaaauuaacaucgaauuagcaagagagguaggaaaaaauuacucacaaagagcaaaaauagaaaaagaacaaaacgaaaauuacaaagcuaaaaaagacgccgaacucgaaugugaaaaauuaggacucaaaauaaauucaaaaaacauacuuaaacuuagacuguucaaagaacaaaaagaauucugcgcauacucaggggaaaaaauaaaaaucuccgacuuacaagacgaaaaaaugcuagagauagaccacauauacccuuacagcagguccuuugaugauagcuacaugaacaaaguacuaguauuuaccaaacaaaaucaagaaaaauuaaaucaaacacccuuugaagcauucggcaaugauagcgccaaauggcaaaaaauagaaguacuagcaaaaaacuugccuacaaaaaaacaaaagagaauacuagauaaaaauuacaaagacaaggaacaaaaagacuucaaagaucggaaccuaaaugacacuagguacauugcaagauuagugcuaaacuacaccaaagacuaccuagacuuucuaccucuaagcgacgacgaaaacacuaaacuaaacgauacacaaaaaggaagcaaaguacauguagaagcaaagagcggaaugcuaacaagcgcgcucagacacacauggggauucagcgccaaagacagaaacaaucauuugcaccaugcuauagacgcaguuaucauagcauaugcaaacaauucuauuguaaaagccuucagcgacuucaaaaaagaacaagaaagcaauagcgcagaacuuuacgcaaaaaaaaucagcgagcucgauuauaaaaacaaaagaaaauuuuuugaaccuuucuccggguucagacaaaaaguacuagauaagauagaugaaauauuuguaucaaaaccggaaagaaaaaaaccaucaggagcacuacaugaagaaacauuccgcaaagaagaagaauucuaccaaucauauggaggaaaagagggaguauuaaaagcucuugaauuagguaaaauaagaaaaguaaacggaaaaauaguaaaaaacggagauauguucagaguugauauauucaaacacaaaaaaacaaacaaauucuacgcaguacccauauauacaauggacuucgcacuaaagguccuuccaaauaaagcaguagcaaggucaaaaaaaggggaaauaaaagauuggauauuaauggacgaaaauuacgaauuuuguuucucacuuuauaaagacucauuaauacuaauucaaaccaaagacaugcaagaacccgaguuagucuauuucaacgccuuuacaaguaguacuguaucccuaauagugucaaaacacgacaauaaauucgaaacucuaaguaaaaaucaaaaaaucuuauuuaaaaacgcaaacgaaaaagagguuauagcgaaaucaauaggaauucaaaaucuaaaaguauucgagaaauauaucguaagcgcacuaggagaaguuacuaaagcagaauuuagacaaagagaggauuucaaaaacgaacucagauga

SEQ ID NO: 8370 - RNA, 2964 nt, Artificial Sequence
  Cas9 variant
auggcaagaauacucgccuucgacaucggaaucucuuccauaggaugggcauucuccgaaaacgacgaauuaaaagacugcggaguacgaauauucacuaaagcagaaaacccaaaaacaggagaaucacuugcucuacccagaagacuugcaagaagcgcaagaaaacgacucgcgaggagaaaagcgagacuaaaccauuuaaagcauuuaauagccaaugaauuuaaacuuaauuacgaagauuaccaaucuuuugacgaaucacucgcaaaagcauacaagggaagcuuaauuucaccauacgagcucagauuccgagcgcuaaacgaguuacuaaguaaacaagauuucgcacgaguaauacuacauaucgccaaacgaagaggcuacgaugauaucaaaaacaauggagacgaagaaaaaagugaaauacuaaaggcuaucaaacaaaacgaagaaaaacucguaaauuaccaaagcguaggagaauaccuuuacaaagaauacuuccaaaaauucaaagagaacucaaaagaauucaucaacguuagaaacaaaaaagaaagcuacgaacguugcauagcacagagcuuccucaaagaugaacuaaaacugauuuuucagaaacaacgagaauucggcuucagcuuuaguaaaaaauucgaagaggagguacucucaguagcauuuuauaaacgagcacuuaaggacuucagccaucuagugggaaacugcucauucuucaccgacgaaaaaagagcacccaaaaauucaccauuggucuuuauguuuguagcguuaacaagaauuaucaacuuauuaaacaauuuaaagaauacagaaggaauacuauacacaaaagacgacuuaaacgcacuccuaaaugagguuuuaaaaaauggaacauuaacguacaagcaaaccaaaaaacuguuaggucuaucagaugacuacgaauucaaaggcgaaaaagggacauauuucauagaauuuaaaaaauacaaagaauuuauuaaagcauuagacgaacauucucuaagucaagacgaucucaaugaaauugccaaagacauaacucucauuaaagacgaaauaaaacuuaagaaagccuuagcaaaauacgaucuuaaggaaaaucaaaucgacucauuauccaaauuagaauuuaaagaucaucuuaacauaucauuuaaagcauuaaaauuaauaacaccacucauguuagaaggaaaaaaguacgacgaggcaugcaacgaauuaaaucuaaaaguagccaucaacgaagacaaaaaagacuuccucccagcauuuaacgaaacuuacuacaaagacgaagucacuaauccagucguacuacgagccauaaaggaauaccgaaaaauacuaaaugcacucuuaaaaaaauauggaaaaguacauaaaauaaauauagaacucgccagagaagugggaaaaaaucauucucaaagggccaaaauugagaaagagcagaacgaaaauuacaaagccaaaaaagaugcagaauuagaaugcgaaaaauuaggcuuaaaaaucaacucaaaaaacauacuaaaauuaagacuauuuaaagaacaaaaagaauuuuguguuuacucaggagaaaaaaucaaacuuagugauuugcaagacgaaaaaaugcucgaaauagaccacaucuacccauauaguagaucauucgaugacucauacaugaacaaaguacuaguauuugcgaaacaaaaccaagaaaaacuaaacaaaacgccauuugaagcguuuggaaaugacagcacaaaauggcaaaaaauagaaguacuaaccaagaauuuacccacaaaaaaacaaaaacguauccuagauaaaaacuacaaagacaaagaacaaaaagauuucaaagaucgaaaccucaacgacacucgauacaucgcaagauuaguauuaaauuacacaaaagacuacuuagauuuccucccauuaucagaugacgagaauacaaaacuaaacgacacacaaaaagggucuaaaguccauguagaagcaaagagcgguauguuaacaucagcuuuacgacauacauggggauucucaacuaaagacagaaacaaucauuuacaucaugcuaucgaugcaguaaucauagccuaugcaaacaacucaauuguaaaggcauucagugauuuuaagaaagaacaagagagcaauagcgccgaacuauaugccaaaaaaaucucggaauuagacuacaaaaacaaacguaaauucuuugaaccauucucgggcuucaggcaaaaagugcucgacaagauagaugaaauauuuguaucaaaaccagaaagaaaaaaacccaguggagcacuacacgaggagacauuuagaaaagaagaagaauuuuaccaaaguuacggaggcaaagaagguguucuaaaagcucucgagcucggaaaaauacgaaaaguuaacggcaaaauuguaaaaaauggugauauguuuagaguagacauauuuaaacacaaaaaaacaaacaaauucuacgcaguccccaucuacaccauggacuucgcacucaaaguauuacccaauaaagcaguagcacguagcaaaaagggagaaauaaaagauuggauauuaauggacgaaaacuaugaauucuguuuuucauuauacaaagacucauuaauacuuauacaaacuaaagacaugcaagagccugaguuaguauacuucaacgcauucacaucaucgacagucucauuaauugucucaaaacaugauaauaaauuugagacauuauccaagaaucagaaaauacuauuuaaaaaugccaacgaaaaagaaguaauagcaaaaucaaucggaauacaaaacuuaaaaguauucgaaaaguacauaguauccgcacuuggagaagucaccaaggcugaauucaggcaaagagaagauuucaaaaacgaauuaagauga

SEQ ID NO: 8371 - RNA, 2964 nt, Artificial Sequence
  Cas9 variant
auggcaagaauauuggcauucgacauaggaauaagcucaauaggaugggccuucuccgagaaugaugaauuaaaagauugcggagucagaaucuuuacaaaagccgaaaacccaaagacaggggagucauuggccuuaccaaggagauuagcaagaucagcaagaaaacgacuagcgaggagaaaagcacgauugaaccaccuuaaacaucuaauugcaaaugaauucaaauuaaacuacgaagacuaucaguccuucgacgaaucccucgcaaaagcauacaagggcucacucauaaguccauacgaauuaagauucagagcacuaaaugagcuacuaucaaagcaagacuucgcacgagucauucuccacauagccaaaagaagagguuacgacgauaucaaaaacagugacgacaaggaaaagggagcaauuuuaaaagcaauaaaacaaaaugaagagaaacucgcgaauuaccaaucaguaggugaauaccuauacaaagaauauuuucagaaauuuaaagaaaacaguaaagaauucacaaacguccgaaacaaaaaagaaucauacgaaagauguaucgcacaaaguuuucucaaagacgaauuaaagcucaucuuuaaaaaacaaagagaauuugguuuuaguuucagcaaaaaauuugaagaagaaguccuaaguguagcuuucuacaagagagcccuaaaagacuucagccauuuagucggaaacuguucauuuuucacagaugaaaaaagagcaccgaaaaauuccccccuagcguucauguuuguagcauuaacaagaaucaucaauuuauuaaacaaucuaaaaaacacagaaggaauauuauacacaaaagaugaccuaaacacccuucuaaaugagguacuuaaaaacggaacauuaacauacaagcagacaaaaaaguuacuaggacugucagaugauuaugaauucaaaggagaaaagggcacguauuuuaucgaauucaaaaaauauaaagaauucauaaaagcacugggagagcacaaucucucacaggaugaucucaacgaaauagcaaaagauauuacacuaauaaaagaugaaauaaaacuaaaaaaagcucuagcaaaauacgaccuuaaccaaaaucaaaucgacagcuugagcaaacuagaauucaaagaucacuuaaacauaagcuucaaagccuuaaaauuaguaacgccauuaaugcucgaaggaaaaaaauacgaugaagcauguaaugaacucaaucuaaaaguagccaucaacgaagauaaaaaagauuuccuaccagcauuuaacgaaacauacuauaaagaugaaguaacaaacccaguaguccuucgagcuauaaaagaauauagaaaaguauuaaaugcuuuauuaaaaaaauacggaaaaguacauaaaauuaacauagaacuugcacgagaggucggaaaaaaccacucucaaagagccaaaauagaaaaagaacaaaacgaaaacuauaaagcaaaaaaagacgcagaacucgaaugugaaaaacuuggacuuaaaauaaacaguaaaaacauacuaaaacuaagguuguucaaagaacagaaagaauuuugcgcauacucaggagaaaaaauaaaaauaucagaccuacaagaugagaaaauguuagaaauagaccauauauaucccuauaguagaagcuucgacgauucuuacaugaauaaaguauuaguauucacgaaacaaaaccaggaaaaacuaaaucaaacaccauucgaagcauucgguaaugacucagcaaaauggcaaaaaaucgaaguccuagcgaaaaaccuuccaacaaagaaacaaaaaagaauccucgauaaaaacuauaaagauaaagaacaaaaaaacuuuaaagacagaaaucuaaacgacacaagauauauagcaagacuaguguuaaauuauacaaaagauuaccuagacuuucucccauugucagacgacgaaaauacaaaacuuaacgacacccaaaaaggaucuaaaguacacguagaagcaaaaaguggaauguuaaccuccgcacuaagacauacaugggguuucucagcuaaagacagaaauaaucaucuacaccacgcaauagacgccguuauuauagcauacgcaaacaauucuaucgucaaagccuucucagacuucaaaaaagagcaagaaagcaauucagcagaauuauaugcaaaaaaaaucucagaacuugauuauaagaauaaacgcaaauucuucgaaccguuuucaggcuuucgacaaaaggucuuggacaaaaucgacgaaauauuuguauccaaaccagagagaaaaaaaccaucaggagcacuacaugaagaaacauuuagaaaagaggaagaauucuaucaaagcuauggagguaaggaaggaguacuaaaagcauuagaauuaggaaaaauaagaaaaguaaacgguaaaauugugaaaaauggugacauguucagaguagacauauucaaacauaaaaagaccaacaaauuuuacgccguuccaauauacacaauggauuucgcauuaaaaguuuuaccgaacaaagcaguugcgcggucuaaaaaaggagaaaucaaagacuggauacuaauggaugaaaacuacgaauucugcuuuucauuauauaaagacagucucaucuuaauccaaacuaaagacaugcaagaaccagaacucguauauuucaacgccuuuacgagcagcacaguuaguuuaaucguaucaaaacacgauaacaaauuugaaacauuaucaaaaaaucagaaaauacucuucaaaaacgccaaugaaaaagaaguaauagcuaaaucaauagguauccaaaacuuaaaaguauucgaaaaauauauaguuagugcucugggcgaagugacaaaagcagaauucagacaacgagaagacuuuaaaaacgaauuacgauga

SEQ ID NO: 8372 - RNA, 2964 nt, Artificial Sequence
  Cas9 variant
auggcacgaauauuagcauucgacauaggaauaagcucaauaggaugggcauucagugaaaacgaugaacuaaaagacuguggaguccgaauauucacuaaggcagaaaacccaaaaacaggagaaucucuagcacugccaagaagacuagcgcgcucagcaagaaaacgacuagcaagaagaaaagcucgauuaaaucacuuaaaacaccucauagccaaugaguuuaaacuaaacuacgaagacuaucaaaguuuugacgaaucacuagcaaaagcauacaaaggauccuuaauaagcccauacgaacucagauucagagcccuaaacgaacuacuaucaaaacaagacuucgcacgaguaaucuuacauauugcaaaacgaaggggcuaugaugauauuaagaacagcgacgauaaggagaaaggcgcaauacuuaaagcaauaaagcaaaacgaagaaaagcuagcaaacuaucaaucagucggagaauaucuauacaaagaauauuuccaaaaauucaaagagaacuccaaagaauuuacaaacguaagaaacaaaaaagagucauaugaaagaugcauagcacagagcuuucuuaaagacgaacuaaaacuaauuuucaaaaaacaaagagaauucggcuucuccuucucaaaaaaauuugaagaagaaguacuaucggucgccuuuuacaaacgagcauuaaaagacuucucacaccucguaggaaacugcagcuuuuuuacugacgaaaaaagagcgccaaaaaacucacccuuagcauuuauguucguugcauugacaagaaucaucaaucuauuaaauaauuuaaaaaacacagaaggaauauuguacacaaaagacgaccuuaacgcucucuuaaaugagguccuuaaaaacucaacccuaacuuacaaacaaacaaaaaaacuacuuggacuaucugacgauuacgaauucaaaggcgaaaaaggcacauauuuuauugaauucaaaaaauacaaagaguucauaaaagccuuaggagaucauagccuaucccaagacgaccuaaaugaaauagccaaagacauaaccuuaauuaaagaugaaauaaaacuaaaaaaggcguuagcaaaauaugaccuaaaccaaaaucaaaucgauaguuuaagcaagcucgaauucaaagaccaucuaaauauaagcuucaaagcacugaaacuaauaacgccucuaaugcuagaaggaaaaaaauacgaugaagcuuguaaugaauuaaaccugaaaguagcuauaaaugaagacaaaaaagacuucuuaccagcauuuaaugaaacauauuauaaagacgaaguaacaaaucccgucguacuaagggccaucaaggaauaccguaagguccuaaaugcuuuacuuaaaaaauauggaaaaguacauaaaauaaacauagaacuagccagagaaguaggaaaaaacuacucgcaaagagcaaaaaucgagaaggaacaaaacgaaaauuacaaagccaaaaaagacgcagaauuagaaugcgaaaaacuaggccuaaaaaucaacucaaaaaauauauuaaaacuaagacuguuuaaagaacaaaaagaauucugcgcuuacuccggagaaaaaaucaaaaucucagaccugcaagaugaaaaaaugcuagaaaucgaucacaucuacccguacagcaggucuuucgaugauagcuauaugaacaagguacucgucuucacuaagcaaaaucaagaaaaacuaaauaaaaccccauucgaagccuucggaaaugauagcgccaaauggcaaaaaaucgaaguucuagcaaaaaaccuaccaacaaaaaaacaaaaacguauacuagacaaaaauuauaaggacaaagaacaaaaagauuucaaagaucgaaaucuaaacgacaccagauauaucgcuagacuuguccuaaacuacacaaaagauuaucuggacuuccuaccuuuaucggacgacgaaaacacuaaauuaaaugauacucaaaaaggcucuaaaguacacguagaagcaaaaucaggaaugcuaacauccgcguuaagacacaccugggguuucucggccaaagauagaaauaaucacuuacaucaugcaauagacgccgugauaauagcauacgcaaacaacucaauaguaaaagcuuucagcgacuucaaaaaagaacaagagucaaacuccgcugaauuauacgcuaaaaaaaucuccgaacuagacuauaaaaauaaaagaaaauucuucgaaccauucucaggauucagacaaaagguuuuagacaaaauagaugaaaucuuugucuccaaaccagaaagaaaaaaaccaucgggcgcacuucacgaagaaacuuuuagaaaagaagaagaauucuaccaaaguuauggggguaaagaagggguuuuaaaagcacucgaacuuggcaaaaucagaaaaguaaauggaaagauagucaagaauggagacauguuuagaguggauaucuuuaagcacaaaaaaaccaacaaauucuacgcaguccccauauauacaauggacuuugcauuaaaaguccucccaaacaaagcaguagcacgcagcaaaaaaggggaaaucaaagauuggauuuugauggaugaaaauuacgaauucugcuucucccucuauaaagacucacucauauuaauacaaacaaaagacaugcaagaacccgaacucguuuacuucaacgcuuucacaagcucaacagucucucuaauaguaucaaagcacgacaauaaauucgaaacacuauccaagaaucaaaaaauacuauucaaaaaugcaaacgaaaaagaaguaauagcaaaaucaaucggcauacaaaacuuaaaaguauuugaaaaauauauaguauccgcacugggugaaguaacaaaagcggaauucagacaaagagaagauuucaaaaacgaauuaagauga

SEQ ID NO: 8373 - RNA, 2964 nt, Artificial Sequence
  Cas9 variant
auggccagaauacucgcauuugacauaggaauaaguucgauagggugggcauuuucagaaaaugacgaauuaaaagauugcggcguaagaaucuuuacaaaggcagaaaaucccaaaacaggagaaucccuagcauuaccacgcagauuagcaagaucagcuagaaaacgacuagcaagaagaaaagcaagacugaaccaccugaaacaccuaaucgcaaaugaauuuaaacuuaauuacgaagacuaccaaucuuucgaugaaucacuagcgaaagcauacaaaggcucauuaauuagcccauaugaacuacgauuuagagcacuaaacgaacuacuuucgaaacaagacuucgcccgaguaauucuacacauagccaaaagacgaggauacgacgauauuaaaaacucagacgauaaagaaaaaggagcaauacuuaaggccauaaaacaaaacgaggaaaaacuagcaaauuaucaaagcguuggagaauaucuauacaaagaauacuuccaaaaguucaaagaaaacuccaaagaguucacaaaugucagaaacaagaaagaaucauacgaacgauguauagcacaaucauuucucaaagaugaauuaaaauuaaucuucaagaaacaaagagaguucggauuuuccuuuucaaagaaauucgaagaagaaguacuaucaguagccuucuacaaacgagcguuaaaagacuuuucucacuuagucggaaacugcucauuuuucacugacgagaaaagagcgcccaaaaacucaccacuagcguucauguuuguggcacuuacaagaauuauaaaucuauuaaacaaccugaaaaacacagaaggaauauuauacacaaaagacgacuuaaacgcccuucuuaacgaaguacuuaaaaacggaacauuaacauauaaacaaacaaagaaauuauuaggacucucagacgauuaugaauuuaaaggagaaaaaggcacauauuucaucgaauuuaagaaauauaaagaguucauuaaagcucuaggagaccacucauuaagccaagacgauuuaaacgaaaucgcuaaagacaucacacugauaaaagacgaaauuaaacuaaagaaagcacuggcuaaauaugacuugaaccaaaaccaaauagacagccucucaaaacucgaauuuaaagaccaccuaaauauaucuuucaaagcauuaaaauuaauaacaccccuaaugcuugaaggaaagaaauacgaugaagccugcaacgaacucaacuuaaaagucgccaucaaugaagacaaaaaggauuuucuuccagcuuuuaacgaaaccuacuacaaagaugaaguaacaaacccggucgucuuacgagcaauaaaagaauaucgaaaaguccugaacgcacuauuaaagaaauauggaaaaguacacaaaauaaauauagaacuagcccgagagguaggcaaaaacuacucucaacgagcaaaaauagaaaaagaacaaaacgaaaauuauaaagcaaagaaagacgcagaauuagaaugugaaaaacuaggauuaaaaauaaacagcaaaaacaucuugaaacuacgacuauucaaagaacaaaaagaguucugcgcauacucaggugagaaaauaaaaauaucagaccuccaagaugagaaaauguuagaaauagaucauauuuaccccuacagucgcagcuucgacgacagcuauaugaacaaaguacucguauuuaccaaacaaaaucaagaaaaguuaaaucagacaccuuuugaagccuucggaaaugacagugcgaaauggcaaaagauagaaguacuagcuaaaaauuuaccaacaaagaaacaaaaacguauacuagacaaaaacuauaaagacaaagaacaaaaagacuucaaagacagaaauuuaaacgacacaagauauauagcuagauuaguauuaaacuauaccaaagacuaccuagacuuucugccacuaucagacgaugaaaacacgaaacuaaacgacacacaaaaagguagcaaaguucacguagaagccaaaucaggcaugcuaacuucagcacuaagacauacauggggauucucggccaaagacaggaacaaucaucuccaucacgccauagacgcaguuauaauagcauacgcaaacaauuccauaguaaaagcauuuucagacuucaagaaagaacaagaaagcaauagugcggaacuuuacgccaagaaaauaagugaauuagauuauaaaaauaaaagaaaauucuuugaaccauuuucaggauucagacaaaaagucuuagauaaaaucgacgagauauuuguaagcaaaccugaaagaaagaaaccgucaggggcauuacacgaagaaacauuccgaaaagaagaagaguuuuaccaaaguuauggaggcaaagaaggaguauuaaaagcacuagaacuaggaaaaauaagaaaagucaacggaaaaaucguuaaaaacggcgauauguucagaguagacauuuuuaaacacaagaaaacaaauaaauuuuaugccguacccauauauaccauggacuuugcacuuaaaguauuaccgaacaaagcuguugcacgauccaagaaaggagaaauaaaagauuggauuuuaauggaugaaaacuaugaguucuguuuuagccuauauaaagauagucuaauauugauacaaaccaaagacaugcaagaaccagaguucguauacuauaaugcauuuacaagcuccaccgucucacuaaucguaaguaaacacgacaacaaauuugaaacacuaagcaaaaaucagaaaauauuauuuaaaaaugcuaaugaaaaagaaguaaucgccaaaucaauagguauacaaaacuugaaagucuucgaaaaauacauaguaagugcucucggagaaguuaccaaagcagaauuucgacaacgagaagauuucaaaaacgaacuccgauga

SEQ ID NO: 8374 - RNA, 2979 nt, Artificial Sequence
  Cas9 variant
augagaauauucagcgauggaaggaauccaaaagacggaucaagccuagcggucacaaggagggcagcgagagcaaugcgucgaagaagagacagacuuuuaaaaagaaaaacaagaaugcaagcuaaauuaguagaacauggguuuuucccagcagaugcagguaaacgaaaagcauuggaacaacuaaauccauacgcacuucgagcuaagggucuacaggaggcuuuauuaccgggagaguucgcuagagcauuauuucacauuaaccaaagacgugguuucaagaguaauagaaagaccgauaagaaagacaacgauucaggaguauuaaagaaagcaauuggucaacuaagacaacaaauggcugaacaaggaagucgaacagucggagaauacuuauggacacgucuccaacaaggacagggagugagagcuagguauagagaaaaaccauauaccacagaagaaggaaagaaacguauagauaaaagcuaugacuuguauauagacagagcaaugauagaacaagaauuugaugcauugugggcagcacaagcagcauucaauccuacucuauuccacgaagcagcccgugcugaucuaaaagauacauuacuacaccaaagacccuuacgcccugucaaaccaggaagguguacuuuacuacccgaagaagaaagggcaccauuagcuuugccaucaacacaaagauuucguauacaccaagaaguaaaucaucugagacuauuagaugaaaauuuaagagaaguagcauuaacauuggcacaaagagaugcaguugucacagcauuagagacgaaagcaaaacuuaguuuugagcaaauuagaaaauuacucaaacuaucuggaagcguacaguuuaaucuagaagaugcaaaacgaaccgaauuaaaaggcaacgcaaccagugcagccuuagcucgaaaagaauuauuuggagcagccuggaguggauucgaugaagcguuacaagaugaaauaguguggcagcuaguaacugaggaaggagaaggagcuuugauugcaugguugcaaacucacacugggguagaugaagccagagcccaagcuauaguggacguaagccuccccgaagguuacggaaaucuaaguagaaaagcucuagcgcgcauaguuccagcacuacgugcugcgguaauuacuuacgauaaagcgguacaagcagcaggauuugaucaucacagccaacuaggguuugaauaugaugcaagugaaguugaggacuuaguacacccggaaacaggagaaauaagaagugucuuuaaacaacuaccauauuacgguaaagcauuacaaagacauguagcuuuugguucaggaaaaccugaagacccagaugaaaaacguuacgggaaaauagcaaacccgaccguacacauagggcuaaaccaaguacgaaugguaguuaaugcgcuaauuagaagauauggacgcccaacagaaguaguaauagaguuagcgcgugauuuaaaacaaagucgcgaacaaaaaguagaggcucagagaagacaagcagauaaucagagacgcaaugcaagaauuagaagaagcauugcagaaguacucgggauuggagaagaaaggguacgagggagugauauacagaaauggauauguugggaagaauuaaguuuugaugcugcagauaggagguguccauacucaggaguccaaauaagugcagcgauguuacuaagcgacgaaguugaaguagaacauauucucccguuuaguaaaacauuagaugauagccuuaacaauagaacaguagcaaugagacaagcaaauaggauaaaaagaaauaggacaccaugggaugcaagagcagaauuugaggcucaaggcuggucauaugaagacauauuacagcgugcugaaagaaugccauuaagaaaaagauaucguuuugcgccugaugguuaugaacgaugguuaggagaugauaaagacuuuuuggcacgagcuuugaacgauacacgauauuugagucgaguggcugcggaauauuuaagauugguauguccaggaacgagaguaauaccggggcagcuaacagcuuuauugagggguaaauuuggucuaaaugauguacuugguuuagacggagagaaaaauagaaaugaucacaggcaccaugcgguagaugcauguguuauagguguuacagaucaagggcuaaugcaaagauuugccacagcaagugcacaagcgagaggagauggacuaacacggcuaguagaugguaugccaaugccauggccaacuuacagagaccauguagagagagcaguccgacauauaugggugagccacagaccagaccauggauuugaaggagcaaugauggaagaaacaucauacggaauaaggaaagacggaucaauaaaacagagacgaaaagcugacggaagugcaggccgugaaauaucaaaucuaaucaggauacaugaagccacucaaccauuaagacacgguguaucagcagaugggcaaccauuagcauacaaaggauacgucggaggaucuaauuacuguauagagauaacaguaaaugacaaaggaaaaugggaaggcgaaguaauaucuacauuuagggcuuauggaguagucagagcuggaggaauggguagauuaaggaauccucacgaaggacaaaacggaagaaaauugaucaugagauuggugauuggagacuccguaaggcuagaaguagauggcgcagaaaggacaaugcgaauaguaaaaauaagugguuccaauggacaaaucuuuauggcacccauacaugaagcaaacguagacgcacgaaacacagauaaacaagaugcguucacauacacaaguaaauaugcaggaaguuuacagaaagcaaaaacgcgaagaguaacaauaucaccuauaggagaaguaagagacccuggauucaaaggauga

SEQ ID NO: 8375 - RNA, 2985 nt, Artificial Sequence
  Cas9 variant
augacacucggauuagaucuggguacaaauuccauaggaugggcacuuauagauuuugacgacaaucaacaacccagaaauuuaauagcuugcggcucgagaauauuucaagaagcuguagaagcaaaaaccggaaccccuaaaaaucaugcacgaagaacggcacgggcagccagaaaauuggucgcccgaagaaagcaacgccgaaccaaacuguuaaaucuccuaauaagacacgguuuauuaccacaagauguugccgaaagaaaugcacuguuacuugauaaccaagccaauaacccauaucaacucaggaaacgcggauuggaugaaaaacuagaaccuuuugccuucggcagagcccucuaucauuuagcacacagaagagguuuccaaucaaaccgcaaagcugcaagcgacgaagauggcaaaguaaaaacggccauaucaacacuaagagccgaaaugcaaggucgaacccuaggugcauuccuugcagaucaaccaacccaaagacgcagauauacugauagagcaauguauguagaagaauuugaacaacuauggaguaaacaagcaaguuucacccaagaacaguuaacacaagcccuaaaaguagcuauccauaacuccauauucuuucaaagaccauuaaaaucucaaaaacauuugguuggaaaaugcacauucgaaccuacaagaaaaagagcggcuaaagcaauacuacuaacacaaagauuucgaauauuacaagacgugaaucaucuagcagugaaaaauccaauaacaagagaauuucgcccauuaacacaagacgaaagaaauaaauuagcugaagcguuagacaaacaaaagucaaugacauggggcgcaguaagaaaaguaaucggauggaauaagaaagacuccuuacaugaaggagaaacuuuuaaccuugaagaaggcaagaaagacaaacuaauuggaaauagaacagcaugugauuuaagaggagcucuaggagaccgaugggacgcuuuaacugcacaacaacaagaugaucucguaacagauuuacuaacaauugacaacacagauggcuuccuaaaaagaaugaaaacucauugggaauuugacgaugcgaccgcagaaguaauagcaaaaauugaacuggaaccgggauacgcacgacugagugcaaaagcgaugagagcuauacuuccuuauuuagaacaaggaaugauauauagcgaugccugcaaagcagcaggguaugaucauaguaaccccaaucagcgaacaauaacugauaaauugggucugccaucgaauguaagaaacccaguaguacaaaaggccuuauuugaaacucgaaaaguagucaaugccauaguuagaaaauaugggaaaccagcaguuauaagaguugaaauggccagagacaugaaacuuaguaaaagacaaaaagaagaauuacaaaaagaacaaaauaaacaaaagaaagcaaaugaacuagcagaaggcauacugcgaaaagaauuuggaauccaacaaccagcaagggcagauauacaaaaauacaaucuuugguuagaaugcaaagaaguaugcccuuacacggggacgacaauaaguagagaaauguuguucucaccugaaguagauguggaacacauacucccauacucuagaaguuuagaugauucauacaugaauaaaacauugugcauggcaacauuuaauaggcaagucaaauuaaacaauacaccuuaugaaauuggacaaggagacccucuggccuaugcagaaaucuuccaaagaauaaaaacacucccuuuuccaaaaagaagaagauuugagcaaaaggaaaucgaaaccgacaaauucauugaaagacaacuaaacgauacaagauauauuuguguagaaguuagagacuuccuucaacaacucggcgcaccaguagaaguuucaaaaggagaagcaacagcaaaauuaagaggacguuggaaacucaauacauuacuaucaccugauggaucuaacgagaaauaucgaggugaucaucgacaccacgcaauagacgcaguaguaauugcacuaacaaaucguucuuuauuucauaaacuaaguagauuaucggcacaaucaauaagucuugacaaaucacgauucgacguaccaccgccaugggacggauucuaugaugacguuuacgagaaaauagacaaaguuaucguaucacacgccccugcacguaaaauuggaggagcguuacacgaagauacagcuuauggacauuuuaaagaagaaguagcagauccaaaaacaggaaaagucagcauagaagauagauucguuuaccgaaagccacuagcaacacuuacggccaaugaaguaggaaaaauaagagacgcuaaaguaagagaauuuguagaagccagauuggcucaguucggaaauaauuccaaaaccgcauucggcgaucccaauaauccccuauuacaugcugacggaaaaacaccuauaagaaccguaagacuuguuacuaauuucaauaaagcaaccacucaugcaauucaaaagggacaaggccgagacuacaaguucuuuaaguacgguaauaaucaucacguagagauaauagagcacguagaaaccgggaaaagaaaaggcauauuuguaacugcaauggaagcagcaagaagaguacgaggcguagccaacacggagaaaagugauauaguacaaagaaaccauggugaagaauggagauucguuaugucacuaagcaucaaugaucuaguaaguauacaagaagccgaucaaguacgaauuaugaggguccaacucuucgaugcaagcaaugguaacauaauauuccgggaccagaaaagugcaaugcuagacgacaaauuaucacguuaucaaacaaaagcgcaccuucuaguaugccagaaaauuacaacagauccacuaggaaaucuagcuccuuguaaugauuga

SEQ ID NO: 8376 - RNA, 2988 nt, Artificial Sequence
  Cas9 variant
augaguaaaguccuaggauuggacauaggggcuaauucaauaggaugggcucugauagaugacgaagaaaaugauaucauuggggcugguguaagggucuuuaaagaaggaguaaauuuaaaaggaguuaaagaagaauccaaaaacguggaaaggagagcagccagacuagcuagaagacaacauaaaagaagaagucaaagaagaaaccgauuaguagcccuauuaaaaacguuagaaauguucccagaaaauaaugaagauauaagugauuauuaugcacaagaccccuacgaauuacgaaagaaaggccuuuacgaaaaacuaaccauguaugaguucggaagagugcuauugcauauaugccgacguagaggauuuaaaagcuccagaaaaacagauauuucagaagaaggaaaaauauucgaaggcaaagaugguauaguggguauaaaucaaacgagagacucuaucagagaaggaggauucaaaacaauaggagaauauuuagccagcuuagauccccauguuauuagacgaagaaaccgcuucacucuacgagauauguaugaagaagaguucaauuuaaugugggaaaaacaacaaucauucuacccacuacaauuaagcaaugaguucaaagaagcaauagcagaaguaauauuaucacaaaggaaauugaaaucucaaaaagcucuaguaggaaauugcggccuagaaccuaauaagaaaacagcaccaaaaaguucuccugcauuucaauacuucaggauacuagaacaacucuccagaauacuaauaagcauuccucauacaggaagauauaaugauccacucaaugaagaagaaagaagaaugcuaauugacaaacuaucgguaacagaaaaacuaaaauucucagacaugagaaagauguugaaucuacccggagaaagugacaucaauaucgaagaagaaggagggcgauugcuaggcaauacaacauaugcucgacuuauaaaagucuuuggcaagaaacgaugggcuggcuucucagaagaagaaaaagaacaaauauggcauacauuucacuucgcagauaaucaugaaugguuaaaagaauaugcauuaaagaaauggaguauaaccccugacgaaauaaaagaacuuggaaaaguugcccucgaaaaagaauacgcaagauucaguaagaaaucacuaaagaaaauuauuccacaauuagaggaaggacucacauuagacaaagcuaaaauugaggcaggauauacgccugaauaugagauagagaaaaguuuaagcgccuauuuaccauuaccagaaaauaucagaaacccgauaguacaacaagcauuauacgaauuaagacaugugguaaaugcuguuauaagaacauacggaaaaccagacauagcuagaguugaauuagccagagaaaugaagaaaccaaaacaaaaacgagagaaaaugagaagcgaacuaagaaaaagacaaaugaaauucgaagaaauaaaaucaaucuuaaaagaacgauuaggcuucauagacccaaaaagagaugaaauccauaaauacauguuaugggaagaaugcagggaaacaugccccuacacaggcagaaaaauuucauuaagugcauuauacgguggagauuucgaaguggaacauauaaucccauauaaaaggagcuuggacgacagucuauucaauaaaaccguaugcuugagagaagaaaaucaaauaaaaggugacagaacaccauaugaagcauauagcggugaccgacaaaaauaugaagaaauaauauuaagaguucagaaaacaagcaugccgagaggaaagaaaaacuuguuugcaauaaaagagcuuaaagaugauuuugcacacagacaacuuagugacacugcauauauuaguagagagacacgaaaauauuuaggaaguacaauaaagaaaguacaagccguaaaagguggaagcacagcaaaacuucgauacuauuggggacuaaacagcauauuaggaguuagagacauaaaaaugcgagacgaucacagacaccacgcaguagaugcacuuguaauugcaaacacaacauaugcauucguaaauacguuaucaagauaucacucaauggacguagagccccaugaaaguagauucccgcucccaugggagcaauuucggaaugaugcagaaucaguaguacgaaauauauucguuucacauagacuuggaaagaaagcuacagggcaauuacaugaagaaacauauuauggaaaaaucagaaauaccgauggagaaccauauuuuguaguaagaaagaaacuuggcacucugacugcaaaacaaauagcuaauauaguagacccaguaguuaaaacccaaguuuucgaaagauuggaagagaaaggaaucgacauagaaucaaguaacaaaauuccagcugaugcauucguugaaacauuauacaugccagacagaaaaaccccaauaaaaaguguuagaguaaaaguaccaaguacaacaaugauacaacuauauaaagauaaagaacuauauguugauccagguucaaaucaccauauaguaauauuugagaacgaagagggcaaaagagauggcauagucguaagccucuuugaagcagcacaaagguuaagaagaaaugaaccggucauacagaaaaccuggaaaccagaauggcacuucguaaugaguuugaguauagacgaacuaauccuacuagauguagacgagaaaaauauagauuggggugacacaggccuugcguuaagauacaguaaagcauuguaccguguacagaaaauggacguaaauaaaauaauuacguugagacaucauuuaguagcaagauuaaaagaugacgaaggcaaagaguucggucgagaacacaggauaccaaguacucuaagaggauuaaaagucaaaauagaccauauagguagauuacgacgagcauacgauuga

SEQ ID NO: 8377 - RNA, 2988 nt, Artificial Sequence
  Cas9 variant
augaaaguuaucggcuucgacaucggaauaaacagcauaggaugggcauuugucgaaaaugacgaacucaaagacugcggaguucgaauauucacaaaagcugaaaauccaaaaaacaaagagucucuagcauuaccaagaagaaacgcacggagcucccgcaaaagauuaaaaagaagaaaauuacgacuaaucgccaugaaacacaucuuagcuaaagaacuaaaucuuaacuacaaggacuacaucgccaaugauggagaauuaccaaaagcuuacgaaggcaaauuaauaagcccauacgaacuucgauacaaagcccuaaaccaaaaauuagaagcaaaagaccuuguacggguuauacuacacauagccaaacaucgcgguuacaugaacaaaaacgacaaaaaauccaacgacgcagaaaaaggaaaaauacuuagcgcacuaaaaaacaacgcauuaaaacuagaaaaguaccaaucaguaggagaauacuucuauaaagaauuuuuccaaaaauacaaagaaaacacaaaagauuucauaaaaauuagaaauauaaaagauaauuauaauaacugcguucucgcuucagaucuagaaaaagaauuaaaacucauacuagaaaaacaaaaagaguucggauacucauacucaaaugacuucauugaagaagugauacaaguggcauucuuccaaagaccccuaaaagacuucucacaccuagugggcacauguaccuucuucgaagaagaaaaaagagcuugcaaaaauuccuacagugcaugggaauuugucgcccuaacaaaaauaguaaacgaacuaaaaucucuagaaaaaauaaguggcgaauuaauuuccacccaaacaauaaacgaaauauuaaacuacauucuagauaaaggaagcauaaccuauaaaaaauucagaucauacaucaaccuguaugaaucuauaaaauucaaaagucucaaauacgacaaggauaacgccgaaucagcaaagcucaucgacuucagaaaauuagucgaguuuaaaaaagcauuaggagaacauuauuucaaccgucaagaauuagaccaaaucaguacauacauuacccugauaaaagacaaugucaaacuaaaaacagcucuagaaaaauacaacuuguccaaugaacagauaaacaauuuacuggaaauagaguuuaacgaucauauaaaccucagcuuuaaagcgcugaguaugauucuaccacuaaugaaagaaggaaaaaaauacgaugaagccugugaaauagcaaaccuuaaaccaaagaccacaaaccaaaaacaagacuuucuaccagcauucuguaacagcaucuuugugcacgaacucucaaaccccauaguuaaccgagcaauaagcgaauaccgaaaaguccuaaacgcauuacuaaaaaaauauggcaaaguucacaaaauucacuuagaauuagcccgagacauuggacuuucaaaaaaagcccgagaaaaaauagaaaaagaacaaaaagaaaaucaagcaauaaauacgugggcccuaaacgaaugugaaaacaugggcauaaaagcuaaugcaaaaaacauacuuaaauuaaagcuuuggaaagagcaaaaagaaauauguauauacucaggaaaaaaaauauccaucgaacaucuaaaagacgaaaaagcccuagaaguagaccauauauacccauauagcagaagcuucgacgacucauauaugaacaaaguguuaguuuucaccaaagaaaaccaagaaaaacuaaauaaaacuccauucgaagcauucggcaaaaacaucgaaaaauggaacaaaauacaaacccuugcucagauucucccauacaaaaaaaaaaauaaaauuuuagacgagaauuucaaagacaaccaacaacaagacuucaucucaagaaacuuaaaugauacaagauacauagccacucuaauagcaaaauauacaaaagaauaccuaaauuuucugccccucaacgaaaacgaaaacaucaaccuaaaaucgggagaaaaaggaagcaaaauucauauucaaaccguuaacggaaugcuaacaagcguucuaagacacacaugggguuucgacaaaaaagacagaaauaaccacuuacaccaugcauuagaugcaauaauaguggcauacucuaccaauagucuuauuaaagcauucagcgacuucaaaaaaaaccaagaacuacucaaagcaaaauuauaugccaaagaauuaacaaacgacaacuauauccaucaagcaaaauuuuuugaaccauuugaaggauuuagagaaaaaauacuuaacaaaaucgacgaaaucuuuguaagcaaaccaccaagaaaacgagcaagaggcgcacuacauaaagaaaccuucuauuccgaaaaaaaaaugauaaaaaaguacaacucaaaagaaggacucaacauagcccuagauuguggcaaaaucagaaaaaucgggacaaaauacguggaaaaugacacuauggugcgggucgacaucuuuaaaaaacagaauaaauucuacgccauaccaauauauacaauggacuuugcguuaggcauucuccccaacaaaauaguaguaauaggcaaagauaaaaacaacaaccccaaacaauggcaagaaaucgaugagucauacgaauucugcuucucacuauacaaaaacgacuuaauacugcuacaaaaaaaagacaugcaagaagcagaauucgcuuauuauaacggauucgacaucgacaguucgcgaaucaauauaaaaaaacacgauaacaaauucgaaaaccuaaccucaaaccaaaaacucuuauucacuaacaaagaaaaaaacagaacagggauccaaaaucuuaaaauauuugaaaaauacauuguaacaccucuuggaaauaaaaucaaagcagauuuccaaccuagacaaaauauaagccuuaaaagcagcaagaaaaauggauuauga

SEQ ID NO: 8378 - RNA, 2988 nt, Artificial Sequence
  Cas9 variant
augaaaauucucggauuugacauagguauuaauucaaucggcugggcuuucguugaaaaugacgaacuaaaagauuguggcguaagaauauucacaaaagcugaaaacccaaaaaacaaagaaagcuuagcccuaccacgaagaaacgcucgcucaaaccgaagaagacucaaaaggcgcaaaucuagacucauagccaucaaacacauacucgcuaaagaacugaaccuaaacuacaaagacuacaucgcgaacgacggggaacucccaaaagcauacgaaggaaaacuaacgaacguauacgaacuacgauauaaagcacuaaaccaaaaacuagaagcaaaagaccuagcacgaguaauacuccauauagcaaaacauagaggcuauaugaacaaaaaugaaaaaaaaucaaacgauuccgaaaaaggaaaaauauuauccgccuuaaaaaauaacgcacucaaguuagaaaaauaccaaucaguaggugaauauuuuuauaaagaauucuuccaaaaauauaaagaaaacacuaaaaauuucauaaaaauccgaaacacaaaagauaauuacaauaauugcguuuuggcuucagaccucgaaaaagaacuaaaacuaauucucgaaaaacaaaaagaauuuggauacucauauaacgacgacuucauaaaggaaauuaucaacauagcauuuuuccaacguccacugaaagauuuuucccaccuaguuggaagcuguacuuucuucgaagaagaaaaacgcgccugcaaaaacucuuacagcgcaugggaauuuguugcguuaucaaaaaucauaaacgaacucaaacgauuagaaaaaauaagcggagaacuuaucuccgcacaaacgauuaacgaaauccuuaaccauauacuagacaaaggaaacauaacauacaaaaaauucagauccuguauaaaucuacacgaaagcauagaauucaaaucuuuaaauuaugauaaagacaacgcagaaucagccaaacuaguugauuuuaaaaagcuaauagaauucaaaaaggcacuaggcgaacacuccuuuaacagacaagagcuugacgaaauagcaacucacaucacucugaucaaagacaaugauaaauuaaaaacagcccucgaaaaauauaaccuaaacaaugaacaaauuaaugcacuccuugagauugaauuuaacgaccauauaaacuuaucuuucaaagcacuaaaucuuauucuuccccugaugagagaaggcaaacgauacgaugaagcuugcgaaauagucaacuuaaaaucaaaaaccucaaaucaaaaacaagaccuauuacccgcauucugcgacucaaucuucucucaagaacuaucaaacccaguggucaacagagcuauauccgaauauagaaaaguauuaaacgcccuucucaaaaaauacggaaaaguucauaaaauccaccuugaauuagcacgcgacgucggacuaucaaaaaaagccagggagaaaauugagaaagaacaaaaagaaaauaaagaaauuaaugacugggcauuagacgaaugcgagaaauucggacucaaagccaacaauaaaaauauccuaaaacuaaaacuauggaaagaacaaaaggaaauuugcgcuuauuccggaaaaaaaauaucaaucgaacaucugaaggacgaaaaagcccuugaagucgaucacauauaucccuauucuagaucauucgacgacagcuauaugaacaaaguacugguauucaccaaggaaaaucaagaaaaauuaaacaaaacuccuuucgaagccuucggaaaaaacauagaaagauggaacaaaauacaagcacuugcacagaacuugccauacaaaaaaaaaaacaaaauacuugaugaaaacuucaaagauaaacaacaacaggacuuuaucucccgcaaccuaaacgacacccgauacauagcaacacucaucgcaaaauauacaaaagaauaccucaauuuccucccccuaaacgaaaacgaaaauacaaaccuaaaaagcggagaaaaagguucaaaaauucacguacaaacaauaaauggaauguuaacaucaguacuacgacacaccuggggauuugacaaaaaagacagaaauaaccaccuacaccaugcacuagaugcaaucauaguagccuacagcacaaauucuaucaucaaagcauuuucggauuucaaaaaaaaccaagaacucuuaaaagccaaauuauacgcuaaagaacucaccuccgauaauuacaagcaucaagccaaauucuucgaaccauucgaaggauuccgugaaaaaauuuuaaauaaaauagaugaaauauucgucucuaaaccaccacguaaaagagccagaggcacacuacacaaagagaccuucuaccccgaagaaacaaugaucaaaaaauacaauucaaaagaaggauuaaacaucgcacuaaacuguggaaaaaucagaaaaauaggcacuaaauacguagaaaacgacacgaugguaagauuagacaucuucaaaaaacaaaauaaauuuuacgcaauuccaauuuauacaauggacuucgcacuaggcaucuuaccaaacaagauaguaauagcuggaaaagacaaaaacaauaacccuaaacaauggcaagaaauagacgaaagcuacgaauucugcuucucacuuuauaaaaaugaccuaauauuacuacaaaagaaagauaugcaagaagccgaguucgcauacuacaauagcuuugacauagacucauccagaaucaacauaaaaaaacacgauaacaaauuugaaaauuuaaccgauaaccagaaacuacuauuuaccaaccaagaaaaaaacagaacaggaauucaaaaccuaaaaauauuugagaaauauauaguaaccccacuaggagacaaaaucaaagcagacuuucaaccacgacaaaacauuucacuaaaaacaaguaaaaaauaugggcuauga

SEQ ID NO: 8379 - RNA, 2991 nt, Artificial Sequence
  Cas9 variant
augauggguaauuucacacuaggacuugaccucggaacaaauucaauagggugggcccuuauagacuuugaugacaaucagcaaccgcaaaauuuaauagcaugugguagucguauauuucaagaagcaguugaagcaaaaacaggaacuccgaaaaaccaugcucguagggcagcaagagcagcaagaaagcuaguagcaagaagaaaacaaagacgcaccaaacuacuaaaucuauuagucugucacgaucuacuaccacaagacgaagcugaaagaaacgcauuacuacuagacaaccaagcaaauaacccauaucaacuuagaaaacgaggguuagaugaaaaacuagaaccauucgcuuuuggcagagcauuauaccaucuagcucauaggcguggauuccaaucaaauagaaaagcagcuucagaugaagacggaaaagucaaaacugcuauuucggcacuccgugcagaaaugcaaggucacacacucggagcauucuuggcugaucaaccuacccaaaggcgaagauacaccgauagagcaauguacgcagaagaauuugaacaauuaugguccaaacaaacaauauucgcuccugaacaguuaacacaagcucuuaaaguugaaauuaaaaacucaauauuuuuccagcgaccccuaaaaucacaaaaacacuugguaggcaaaugcacauucgaaccaacacgaaaaagagcagccaaagcaauucucuuagcucaacauuuucguauacugcaagaugucaaccaccucgcagucaaaaacccuaucacaagagaauuuagaccauuaacccaagacgaaagaaacaaacuagcugaagcgcuagacaaacagaaaggaaugaacuggucagcaguaagaaaaguaaucggcuggaacaagaaagacucccuacacgagggagaaacauuuaauuuagaagaaggaaagaaagauaaacuuauaggaaauagaacagcaugugaccuaagaggagcuuuaggagacaggugggacgcauuuacagcaccucagcaagaugaucugguuacagauuuacuaaccauagacaacccugacggauuccuaaaaagaaugaaaacccauugggguuucgaugacgccacagcugaagcacuagcaacaacggaacucgaaccuggcuaugcaagacuaucaaguaaagcuaugagagcaauacuuccacauuuagaacaggguaugaucuauucugaugcaugcaaagcagcaggauacgaccacaguaauccaaaccaacgaacaauaacagacaaacuugguuuaccaucuaauguacgaaauccagugguccaaaaagcauuauuugaaacacgaaaaguaguaaacgcaauaguaagaaaauacggcaaaccugccgucauuagaguagaaauggcuagagacaugaaauuaucaaaaagacaaaaagaggaauuacagaaagaacaaaauaaacaaaagaaagcaaaugaauuagcagaaggcauacuucgaaaagaguucgguauccaacaaccagcacgaacagauauccaaaaauauaaucuuugguuagaaugcaaagaagucuguccauacacaggaacaguaauaaguagagaaauguuauauucuccagaagucgaugucgaacauauucuuccauacucaaggucauuagaugacucauauaugaacaaaacgcucugcauggccaccuacaacagacaaacaaaacuaaauaacacaccauacgaaauaggacagggagacccaguggcuuacgcagaaauauuucaaagaauaaaaacacugccauuccccaaaagacguagauuugaacaaaaagaaauagaaaccgacaaguuuauugaaagacaacucaaugauacaagauacaucuguguagaaguuagagauuuucuccaacaacuuggcgcuccaguugaaguuucaaaaggggaagcaacagcaaaguuaagaggcagauggaaacuaaauacacuuuugaguccaggaggagggaaugagaaaaaccgagcagaccauagacaccaugcaaucgaugccguugucauagcacuaaccaaucgaucauuguuucauaaacuaucaagacuaagcgcucaaagcauuucauucgacaaaucaagauuugacguaccaccgcccugggacgauuucuaugaugauguauaugagaaaauagacaaaguuauagucucacaugcaccaacaagaaaaaucucaggagccuuacacgaagcuacugcauacggccauuucaaagaagaaaucgcugaccccaagaccggaaaauucucaauagaagacagauuuguuuacagaaaaccauuaacaacccuaacggcaaacgaagucggaaaaauaagggacgcuaaaguaagagaacuugucgaggccagacucgcacaauucgguaauaacucaaaagcagcauucggagacccaaaugaaccacuacuucacgcugacggcaaaacuccaauacgaacaauacggcuaacaaccaauuuuaauaaaacaaccacacacgcuauacaaaaaggucaggaucgagacuacaaauucuuuaaauauggaaauaaucaucauguagaaauaauugagcauguagaaacaggaaagagaaaaggaauuuucgucacugcuauggaagcagcucgcagagcaagaggagucgcgaacacagagaaaaguaacaucguacaaagaaaucauggugauggauggaaauucgucaugucucuagcaguuaaugacaugguuagaacagaagacacacaagcaauauaucgaguccaaaaauuagauggcaguaauaacagauuuacuuuaagaagucauaaugcagcaacacuggacgauaaacaaacaggaguggacaaaacaccaaaccucuucaaagguaccaaaaucauugucgacccacuaggaaaucuaacacaauguaacgauuga

SEQ ID NO: 8380 - RNA, 2994 nt, Artificial Sequence
  Cas9 variant
augaaaguucuaguagaugcaggauugaugccaucggauccagcagcagccaaagcccuugagacacuagauccauaugagcucagagccacaggacucgauguaauguuaccucuuacacaccuugguagagcaguauuucaucuaaaccaacggagaggguuuaaaaguaauagaaaaacagaucgaggagauaacgaaucagguaaaauaaaagacgcaacuaaaagacuaacaugggcaaugcaagaagcaggggcucgcacauauggcgaguucuuacacaugagacgagccagagcgucugacccaagacaaguaccgaguguacgaacacggcuaucgguggccucacgaggaggcccagauaguaaagaagaagcagguuaugauuucuauccggaaagagcacauuuagaagacgaauuucaugcccuuuggucagcccaagcagccuuucacccagauuuaacuugugaacuaagagauguuguguuugaaaagauauucuaccagagaccauugaaagaaccaaaaguaggauuauguuuauuuacagcagaagaaagacuuccaaaagcacauccgcuuacgggaagaagaguauuauacgaaacaguuaaccaauugagagugaccgcagacggacgaacuacaagaccguuaacucuggaagaacgcgauaugauugucuaugcuuuagauaauaagaaaccaguaaagagcuuaucaucaaugcacuuaaaacucguggcauuagguaagcuaguaaaauuaaaagauggagaaagguucacacuugaaagcggaguccgugacgcaauagccugugauccuauacgugcuacaaugggacauccugacggauuuggacccgcauggucacgauuagauuggcaagcacaaugggcuuuaauagaaaaacuccggcagguacaaucggacgacgacuucgcaagucuaguagcaugguuaggagcaacacacaacuuaucagaagaucaugcgaaacgagucgcaaauuuacaccuaccagagggauauggucgcuuaggucuaacugcaacagaagcuauauuauguaacuuaaaagcggaagucuguaccuacagccaagcaguagaacgcuggggaaaacaccauucaaaccaaagaacaggugaaugcuuagaagcucuaccuuauuauggagaaguacucgaccgacauguaauaccaggaacauauaacgaagaugaugacgacguaacuagauauggaagaauaacuaauccuacaguucauauaggauuaaaucagcuucgucgcuuaguuaauagaauaaucgccacuuaugguaaaccagaucaaauaguaguagaacuagcuagggaacuuaaacaaucagaagcucaaaaaucagaagcauuaaagaaaauaagagauacaacagcagacgcaauaagaagaggaagacaacucgaagaaauaggucagaaaaauaccggcgcaaauagacuuuuauuaagguuaugggaagauuuaggaccagcaguagguccacgcugcuguccauauaccggaaaaccaauaucgguaacuauguuauucgauggugccugcgauguagaccacauacuaccuuauucacgcacauuagaugacucuuucgccaacaggacaauauguuuaagagaagcaaacagacaaaaaggagacagaacacccugggaagccuggggcggaucagaccaaugggaugcaauagaagcaaauuuaaaagacuugccagagaacaaaagaaaacgauuugcaccagaugcuauggaacgauuugaaggagagagagacuuuuuagauagagcauuaguugacacacaauaucuagcacgcauaaguagagcuuaucuagacacacuauuuacagaagguggacauguauggguuguacccgggagaaugacagaaauguuaagaagacacuggggauuaaacgcucuccuaagugauaaagauagaggggcaggcaaaguuaaaaaucgcacagaccaucgacaccacgcuauagacgcagcaguaauagccgcaacagaccacagucuaguaaacagaauauccaaagcagcuggccaaggcgaaucagccggacaaucagcagaauuaauugcucgagauacuccugaaccuugggaagguuuccguaacgauauuucagcacaaauagcuagaauuguaguuagccauagagcagaccaugggagaauagauguugaaggaagaaaacauggcaaagauagcaccgcaggaagauuacauaaugauacagcguacggaauaguagacgaccacacuguagugucaagaacaccucuuuuaagccuuaaaccaggagacauagaaguaacuacaaaagguaaaaauauaagagacacucaauuacaaaaagcucuaucaguagcuacaacaggaaaagauggaaaaggauucgaagaagcacuucguaacuuugcugaaaaagaagggccguaccaaggaauuagaagaguaagguuaauagaaacacuacaaucaucagcuagaguagaaguagguagugaugaagacggccagccauuaaaagcauacaaaggggacaguaaucacugcuaugaucuauggaaauuaccggauggaaaggucguuccacauguaguauccacuuacgaagcgcacgcggguaccgacaagagaccucauccagcagcaaaaagaauacuaagaguuuuuaagaaagacauggucgcuauugaacaagaugaccaaacugcaauauuuuacguacaaaaauuagacagagcaaauggucucuuuuuagcaccccaccucgaagcaaacgcagacgcaagacacagaaauccaaaugaugcauuuaaauuccuacaaaugggugcugguuccguaguaagaaauaaauuaagacgaguguaugucgaugaaauuggcaggauuaaagacccagguccaccgaaacacuga

SEQ ID NO: 8381 - RNA, 2994 nt, Artificial Sequence
  Cas9 variant
augaaaauucuaggauucgacauagguauuaacucaauagguugggcauucguagaaaaugaugaacuaaaagauuguggagucagaauauuuacagaagcagaaaacccguccaacaaagaaucucucgcacuuccccgaaggaacgccaggucaucaagaagaagauuaaaaagaagaaaagcccggcuaguagcaauaaaacgcauacuugcaaaagaacuaaaacucaauuucaaagacuauguagccgcagauggagaacuaccuaaagcauacgaagggaaacuaacgaguaucuaugaacuaagauauaaagcccuuauacaacaacuagaaacuaaagaucucgcacgaguaaucuuacauaucgcaaaacauaggggauacaugaacaaaaacgaaaagaaaucaaacgacacuaagaaaggaaaaauucuaagugcacucaaaaacaacgcacuaaaacuagaaaacuaucaauccguaggcgaauacuucuauaaagaguucuuccaaaaauauaaagaaaauaccaaaaacuucaucaaaauacgcaauaccaaagacaacuacaacaauugcguauugucauccgauuuagaaaaagaacugaaauuaauacuggaaaaacaaaaagaauuuggauacaacuauucagaagacuucauaaacgaaauacuaaaaguagcauucuuccaaagaccacuaaaagauuuuucacaccuaguuggagccugcacauucuucgaagaagaaaaacgagcauguaaaaacaguuacucagcaugggaauuuguagcucucaccaaaauuauaaacgaaauaaaaucacuugagaaaauauccggagaaaucguaccaacccagacaauaaacgaaauacucaacuuaauccucgauaaaggaagcauuacauauaagaaauucagaucauguaucaaucuucaugaaagcauuucuuuuaaaucgcuaaaauacgacaaagaaaacgccgaaaacgcaaaacuaaucgacuucagaaaacuugucgaguucaagaaagcacuaggaguccauagcuuauccagacaagaacuagaccaaauuucaacacacauuacccucauaaaagauaacguaaaacuuaaaaccguccuagaaaaauacaacuuaucaaacgaacaaaucaauaaucuacuagaaaucgaguucaacgacuacauaaacuugucguucaaagccuuaggaaugauucuaccacuaaugagagaaggaaaacgcuauuacgaagcaugcgaaaucacuaaccuaaaaccaaaaaccguagacgaaaaagaagacuuucucccagcauuuugugauucaauauucgcacaugaauuaaguaauccagucguuaacagagccaucuccgaauacagaaaaguauuaaaugcucuacuuaagaaauacggaaaaguccacaaaauacaucuagaacuagcgagagauguaggccuauccaagaaagcuagagagaaaauagaagaucaacagaaaaauaacaaagcgaucaacgacugggcucuaaaagaaugcgaaaacauaggaauaaaagcaagugcgaaaaacauacuaaaacucaaacuauggaaagaacaaaaagaaauaugcauuuauagcggcaacaaaaucagcauagaacaucuaaaggaugaaaaagcacuagaaguagaucacauauaucccuacagccguucuuucgacgacucauucauaaacaaaguccuaguauuuacuaaagaaaaccaagaaaaacuaaacaaaacccccuuugaagcauucgguaaaaauauugaaaaauggaguaaaauccaaacacuagcacaaaaucuuccauacaaaaagaaaaacaaaauccuagacgaaaacuucaaagacaaacaacaacaagacuucauuucccgaaaucuaaaugauacacgauauauaaccacauuaaucgcaaaauauacaaaggaauaccuuaauuuccuaccacucucagaaaacgaaaacaccaauuuaaaaucuggagaaaaaggaagcaaaauacacauucaaacuaucucgggaaugcuaacaucaguccuccgucauacguggggauucgacaagaaagaucguaacaaucaucuucaucaugcauuagaugcaauaaucguagcauacucaacuucaagcaucauaaaagcauucagugauuucaagaaaaaccaagaauuauuaaaagcaagauuuuacgcaaaagaacuuacaagugauaacuauaaacaucaaguaaaauuuuucgaaccauucaaagguuuccgcgagaaaauacuuuccaaaaucgaugaaauauucgucucaacacccccacgaaaacgcgcaagaggggcgcuacacgaagaaacguuuuauagugaagacaaaaugauaaagaaauacaauucuaaagaagguuuacaaauagcauuauccugcggaagaguaagaaaaauaggcaccaaauacgucgaaaacgauacaaugguuagagucgacaucuucaagaaacaaaacaaauuuuacgccauaccaauuuacguaauggacuucgcgcuaggaauauuaccaaacaaaauaguuauaaccggaaaagacaaaaauaauaaccccaaacaauggcaaacaauagacgaaucauacgaauuuuguuuuucccuuuacaaaaacgacuuaauacuacuacaaaagaaaaauaugcaagaaccagaguucgcuuacuacaacaguuucgacauagauagaucacgaauaaaaauaaagaaacacgacaauaaauucgaaaauuuaacaucaaaccaaaaauuacuauucacaaauaaagacaaagguaaaaaccgaacaggaauacagaaucuaaaaauauuugaaaaauauauagucacuccucuaggagauaaaauaaaagcggacuuucagccacgagaaaacauuucauuaaaaacauccaagaaacacggcuuauga

SEQ ID NO: 8382 - RNA, 2994 nt, Artificial Sequence
  Cas9 variant
augggaaauuauacacuaggacuugauauaggaaguaauucaauaggcugggcauuaguagaagacgcaguggaagcaccaagaauagucgacaugggcguucgcguauuucccgaaggaguagauagggacacaaagggacuagagaaaaguaaaaaugcaacgagaagggaagcaagaggagccaggagaacacaucaaagaagaagacagagaaaacaacgauuaguccgagcccuuagacaaguaggauugcucccgugugauaaagccgaaguacgaaguuuauuccaaacagaucccuaugaaauaagaaaaagaggacuagaccauagacuggaacuauacgaaauaggacgagcguucuaccaucuaagccaaaggagaggcuucaaaagcaauagaaaaagcggagcuuugaaggaagauggaacagucaagaaagaagcaggagaacuacaacggaaaauagacgaagcagguugccguacaaucggagaauauuuugcaggauuagaucccgaacaacaacguauaagaggaagauauacuuucagaucgauguaucaaaaagaauuugacuuauuaugggcuaaacaaguagaauuuuauccaaaagucuuaacugaagaccuaaggaguaaaguacgagaugaaauuauuuucuuucaaagaccauugaaaucugcaaaggacuuaaucggagauugcgaauuagaaccaacagaaaagagaugcccacgagccgacugguaugcaagaagauuuagguuauuacaagacauaaauaauuuaauuauacaaaaccccgacgguacggaacaaaaacuuucgccagaccaaagagcagccuuacuaggagaacuuggacaaagagaaaaauuaacauuugauaauaucagagcuaaauuaggucuacuagaaacucaaaaauucaaugcggaauaucgaauaggccguaaaggaaagaaaguggaagcuauaaaaggagaugucuucguuuggacaaugagaggaaaaaguguguuuggaccuaaggcaugggaugcaauggcagaugaaagaaaaguuucauuaaacgaauuauuuguagaacuggaagaugaugauuuagcuaggaaauuagaaacggaauauggauugacagauaaacaaguucaagcagcaaugaaagcaagucuuccacaaggauauaugaguuuuaguagaaaagcaguccuuaagcuguuaccauuuauggaagcaggagcacuaacgcaugaagcgauagaucaagccggauauagaaaagaggaaccuacucaaacagacgcuauagcaaggguuagcuuuccaccggauuuaagaaauccaauaguacaaaaagcauuauuugaaguacgaaaagugguaaaugcgcuaguccgagaauauggaaaaccaacuagaauaaaaauagaaauggcaagagacguacaaggaaguaaaagacaaagagaagaauuacacuggagaaaugaggauaauaggaagaaaaaugaagagguaagggauagacuaaggacugauauucacauagaugauccaucaagagacgacguuauuaaauauaaacuuuggcaagaaucuggaaaaauguguccauauacaggaagacaaauaugucaagaggcguuauuugguccaaauccggaauuucaaguggaacauauacuucccuaugauagaaguuuagaugauucauauaugaaucuuacuuuaugugagguucaugaaaauauucauggaaaacgcaaccaaacaccauuugaagcauacggauccggagcggagagauaugaacagaucaaacaaagaauaaaagucuuaccauggcccaaacgccaaaaguuccuucaacaagaaauaaaucuagauucucacauaagcagagagcuaaaugacacuagauacauauguagagaaacaguugcguauuuaaaacaauuggggguacacguaagaggaacaagaggaaaaauaaccgcagaacuaaggcaccaguggggacuagaugguauauuuagugagcuugggguaagaagagaugaugaucacagacgacacgcgguggaugcauuggucguagcaguaacggacaaugaacaccuaaggaggcuugccguaucaaaguauguauuagcugguccaagguuugaaacaccguggucugcauuuagagaugaagcgcgagguaauguaaaacguaugaaugugucacacagaguaugucguaaaguaagcggugcacuacaugaagaaacgaauuacggaccaaccggaguaagggaccaagcagggcaagauauuuaugccuaccgaaagaaauuagaagaucuaacgacgccaaugguugagaaaauuguagauccagucguuagagauauuguaagacaaaggcuuuuaaugaaaggaaucgauccugcagcagcagauagaaaaaucccaaaagauguuuggaaggaaccacuauauaugaggagaacuaaaagugauaaaaugauacaaauacggagaguacgaauacacgaugucaaaaacucaauuauaguuuugacagaugaaucaggaagaccauacagagcuguugaaccaggcggaaaccaccauguugaaguauucgaauacguucauggaacaaaaacaggcacgagagaggcagaaguagucacuauguuugaagcgguaagaagaucacgugcaagagcgccaguaguuagaagggaccauggaccaggaacgcgauuugucugcagcuuagcaauaaaugacaugguaaugaugccggauaaaagcggaaagauggacuuauuuaggauucaaaagaugagugcuaguaaacaggucuauuuuagacaccauacagcugccagaaucgacagcgaaagaacucuaauuagaaaacaagcacauuuauucaauggauauaaagucuccguagacccaacaggagcaauauguagggcaaaugauuga

SEQ ID NO: 8383 - RNA, 3000 nt, Artificial Sequence
  Cas9 variant
augaaaauccuaggcuucgacaucggaauaaacaguauaggaugggcauuuguagaagacaaucaacuacaagacugcgggguuagacuauuuaccaaagcagaagauccaaaaacaaaagaaagucuagcacuaccaagaagaaaugcucgcuccaauagacgacgauuaggaagaagaagaucucgcuugauagcacugaaacacaucauuagcaaaggacucaaacucaauuaucaagauuauauagccaaugauggagaauuaccaaaagccuacgaaggcagauuaauaagcccauaugaacuacgauauaaagcacuuaaugaaaaaauugaaccuaaagaccuagcacgaguaauccuacacauagccaaacacagaggcuacaugaauaaaaaugaaaagaagagcucagacaacgagaaaggcaagauccucucggcacuaaaaacaaacgcucugaagcuagaaaaauaucaaagcguaggagaauauuucuacaaagaauucuuucaaaaguacagagaaaacacaaaagacuucauaaacauaagaaauaaagaaggaaguuaugaaaacuguguucuggcaagugaucucgaaaaagaauuaaaacucaucuuggaaaaacaaaaagaauggggcuauucauauaaugacaacuuuauaaaagaaauacuaaaaguugcauucuuccaaagaccacuaaaagacuucucauaccuaguaggagccugcacguucuuugaggacgaaaaacgugcaugcaaaaacuccuacucugcaugggaauuuguagcauuaacaaaaauaauaaacgaauuaaaaucauuagaaaaagaaagcggggaauuaguaucaucccagauaauaaaugaaaucuuaaaccacauacucgacaaaggaucuauuacuuacaaaaaauuuagagaauauauuaaacuacaugaaucaaugaaguuuaaaucauuaaaauacgauaaagacaacgucgaauccacaaaacuaaucgaauuucgaaaauuaguugaauucaaaaaagcccuaggugaacauagccuaucucgcgaagaacuugaccaaauugcaacauacauaacgcuaauaaaagauaacgaaaaacucaagauaacacuagaaaaguacucuuugaauaacgagcaaauaaaaaaccuacuggaaaucgauuucaacgaucauauaaaccuauccuucaaagcacucaaucuuauucuaccacuaaugaaagaagggaagagauacgacgaagccugcaaacucuuaaacuuaaaaacaaaaucaaacaaccaaaaauuugacuuccuaccugcauucugugauaguaucuucgcacaagaauuaaccaauccuauagucaacagagcaauaagcgaauacagaaaaguacuaaaugcauuacucaaaaaauacgguaaaaugcacaaaauacacauagaacuagcaagagacaucggauuaucaaaaaaacucagagccaaaauagaaaaagaacaaaaagagaacuacgaaaauaacauaugggcacuuaaugaaugcgaaaaauucggucuaaaagcaaaugcuaaaaacauucuaaaauuaaaacuauggaaagaacaaaaggaauuuugcaucuacucaggaaaaaaaauaucgaucgaacauuuaagagacgaaaaagcuuuagaaguagaccacauauaucccuauucacgaucauucgacgacucauuuuuaaacaaaguacuaguauucacaaaagaaaaccaagaaaaauuaaacaagacaccauucgaggcauucggcgccaaugaagaaagauggagcaaaauacaggcccuggcccaaaacuugccuuacaaaaagaaaaacaaaauacuagacgaggccuucaaaggaaaacaacaacaagacuucauaucaagaaaucuaaaugacacaagauacaucagcacacuaaucguuaaauauacaaaagaauaccuagacuuucuaccucucgacgagaaagaagacguaaacuuaaaaucuggugaaaaaggaagcaaaauacauguacaaacaauaaacggaaugcugacaagcguauuacgacacacauggggcuucgcacaaaaagaccgaaauaaucaccuacaccacgcucuggaugcuacaauaguggcauauagcacaaacgcuauaauaaaagcauuuucugauuucaaaaaagaacaagaacuacuuaaagcaaaacuguacgcaaaagaacucacauccgacaguuacaaacaccaagccaaauuuuuugaaccauucgaaggauuuagagaacaaauucucaaucaaauaaauaaguuauucguuaguaaaccaccaagaaaaagagcacggggagcacuccacaaagaaacauucuacucaaaagaugaaaugauuaaaaaauacaauucacaagaaggaguagaaauugccuuaaacugcggcaaaauacgaaaaauaggaacaaaguacgucgaaaaugauacaauggucagaauagacauauuuaaaaaacaaaacaaauuuuacgcaauaccgauuuauacaauggacuucgccuuaggaguacuuccaaacaaaauaguaauaauaggaaaagauaaaaaaggaaauccaaaacaguggcaagaaauagacgaaucauacgaauucuguuuuucacuacacaaggaugacuuaguacucauucaaaaaaaagauaugcaagaaccagaauucgcauacuauaacggcuucgacauaucaaacucuucuaucuguguagaaaaacaugacaauaaauuugaaaaucuuaccgauaaccaaagauuacucuuuacuaacgccgagggaaacgucaaagcaaaaaaaaucgggauccaaggcuuaaggauauucgaaaaauacauaauaacgccauuaggcgaaaaaauaaaagcagacuucaaaccuagagaagacauagcccucaaaacaucaaaaaaacauggucuuuga

SEQ ID NO: 8384 - RNA, 3003 nt, Artificial Sequence
  Cas9 variant
augaaaauauuagguuucgauauaggaauaaacagcaucgguugggcauucguagaaaaugacgaauugaaagauuguggcgucagaauauuuacgaaagcugagaaccccaaaaauaaagaaucgcuugcccuucccagacgaaacgcacguagcuccagacgacgacuaaaacgacggaaagccagacuaaucgcuauaaaacgcauucucgcgaaagaacuuaaauuaaacuuuaaagauuacguugccgcagacggagaauuaccaaaagcauacgaaggcucauuggcuuccguuuaugaacuuagauauaaagcccuaacacaaaaacuagagacaaaagacuuagcucgaguaauacuacacauagccaaacaccgaggauauaugaacaaaaacgaaaagaaaagcaaugacgcaaaaaaaggaaaaaucuuaagcgcucucaaaaacaacgcucuaaaauuagaaaauuaccaguccguuggagaauacuucuacaaagaauucuuucagaaauauaaagaaaacacuaaaaacuucaucaaaauaagaaacacuaaagacaacuacaacaauuguguucugucuucagaucuagaaaaggaauuaaaauucauacuagaaaaacaaaaagaauuuggauauaaguacucagaaggauuuauuaacgaaauacuuaaaguagcauucuuccagagaccacuaaaggacuuuucacaucuuguaggggcaugcacauucuuugaagaagaaaaucgagcauguaaaaacucauacagugcaugggaguuuguagcauuaacuaaaauaauaaaugaaauaaaaagccuggaaaaaaucuccggagaaauaguaucaacucaaacaauaaaugaaguccuaaacuuaauacuagacaaagguaguauuaccuauaaaaaauuccgauccugcauaaacuuacaugaaucaauauccuucaaaucacucaaguaugauaaagaaaacgcagaaaaugcgaaacucauagacuuucgcaaacuaguagaauucaaaaaagcacuaggcguacacucacucaguagacaagaauuagaucaaauaucaacccaugucacacuaauaaaagacaacguaaaauuaaagacuguucucgaaaaauacaaccuuucaaacgaacaaauuaacaaucuacuugaaauagaauuuaacgauuacauaaaucuaagcuucaaagcccuuggaaugauucucccucuaaugagagaaggaaaaagauacgaugaagcaugugaaauaaccaaucuaaaaccaaaaacgguagaugagaaaaaagauuuccuaccagcuuucugugacuccaucuuugcacaugaacucucaaacccgguugucaacagagcaauuuccgaauacagaaaaguccuaaacgcacuacucaaaaaauacgacaaaguccacaaaauacauuuagaacuagcaagagacgugggccucagcaaaaaagcaagagaaaaaauagaaaaagaacaaaaagaaaaccaagccgucaaugcaugggcacuuaaggaaugcgaaaauauuggauuaaaagcaagcgcaaaaaacauacuaaaauuaaaacuuuggaaagaacaaaaagaaauaugcauauacucagguaacaaaauaucuaucgaacacuuaaaagacgaaaaggcucuagaggucgaccacaucuauccauauagcagaagcuuugacgacucauuuaugaacaaaguacuuguauucacaaaagaaaaccaggaaaagcuuaacaaaacaccauuugaggcauucggcaaaaacauagaaaaauggucaaaaauccaaacacuagcucaaaaccuccccuacaaaaaaaaaaauaaaauacuagacgaaaacuuuaaagacaaacaacaagaagauuucauaucuagaaacuuaaaugacaccagauacauagcaacacucauaacaaaauauacuaaagaauaucuaaauuucuuaccucuaaacgaaaaugaaaauacgaaccuaaaaucaggcgaaaaagguaguaaaauacauguacaaacagucaacggcaugcuaacaucaguacucaggcacacauggggauucgacaaaaaagacagaaacaaucacuuacaucacgcacuugacgcuauuauuguugccuacucaaccaauucaauaauaaaagcauuuagcgacuucaaaaagaaucaagaacuucuaaaagcacgauucuacgccaaagagcuaaccuccgacaacuauaaacaccaaguuaaauucuuugaaccauucaaaggcuucagagagaaaauacuaucaaaaauagaugaaauuuucguaucuaaaccgccacgaaaaagagccagaggcgcauuacauaaagaaacuuuuuacucagaagacgaaaugauaaaaaaauacaauucaaaagaaggacuucaaauagcauugucauguggccgggucagaaaaaucggaacaaaauacguagaaaacgacacaaugguacguguagacaucuuuaaaaaacaaaacaaauucuacgcaauaccuauuuacgccauggauuucgcacucggaauucuaccaaacaaaauagucgucguuggcaaggacaaaaauaauaaucccaaacaauggcaaaccauugaugaauccuaugaauucugcuuuucccuauacaaaaacgaccuuauaaugcuucaaaaaaaagauaugcaagaagcugaauucgcuuacuacaacggauucgauauaucaacaucaucgaucugcguagaaaaacacgacuccaaauuugaaaacuuaacaaguaaucaaaaacugcuguuuaguaacgccaaagaagguucagucaaagucgaaaauuuagguauacaaaaccuaaaaaucuucgaaaaguauaucauaacaccacucggagauaaaauuaaagcagauuuccaacccagagaaaacaucucauuaaaaacaagcaaaaaaaacggacucuga

SEQ ID NO: 8385 - RNA, 3003 nt, Artificial Sequence
  Cas9 variant
auggcacgcgcccaaagaagacuaaucuccagaagagcaaauagaaugaauaagcuaagaagauugcucaaacaagaaaacguccuacaagcuaacgauuacgacgaaaaaggauuaauuaucggacuuccaaaccaagcaugggaauugagggcacaagggcuagacagaaaacuugaaccgaaagagugggcagcaguucuaauaaaccucguaaaacauagaggauaccuaucucaaagaaaaaacgaaagucaaacugccgacaaagaacuaggugcauuacuauccggaaugaaucauaaccaucaacuucuacaaagucagucgaaccaauauagaacaccagcagaacucgcuaucaaacaauucgccacucaagacggacauaucagaaaucaaagaggagcauauacacacacauucaacagacuagaucuacaaaaugaacuuaaucaauuauuugaugcccaaacuagacuugggaauccucacgucuccggaagcuuaaaaacagcaauaaaugaucuacuaaugaaucagaaagcagcauuaaguggugacgcaauccucgaaauguuaggccgaugcacauucgaaccaucagaauacaaagccgcaaaaaacacauacagugccgaaagauuugucuggcuaggaaaacuaacgaaucucaggauacaagacaacggcuuggaauccgcacuaucaagagaacagagagaauuacuuuuaaacgaaccuuauaacaaaacuaaacuaacauaucaacaaguaagaaaacuccuaagauuacccgaaacagcauucuuuaaaggauuacguuacggaaaagacaaugcggaaucagccaccuuuauggaaaugaaaucauaccacgcaauaagaaaaucccuagaaaacaaaagccuaaaaagcgaaugggaaaaauuaaaaacccaaccaaaacuccuugaucuuauuggaacagcauuuucaauauacaaaaccgacgaugaaauugcagguugcuuaaaaaaccaacuaccagaaaacguaauuaucgcauuacaagaacaacuaaacuucaguaacuucauggaauuguccuuaaaagcguuagaaaaauuguuaccauuaauggaacaagguuuacgauaugacgaagcaugcacgcaaauauacggaaaucgacacgaaaaaauagccgauaaaacagaaaaauuccuaccaaacauaccugccgacaaauuaagaaauccaguaguccugagaaccuuaacccaagcaagaaaaguaauaaacgcaaucauaagaagauauggaaguccagccagaguacacauagaaacaggacgagaaguaggaaaaucauuuuccgacagggacaaacuaaaaaaacaacaagaagaaaaccaagaacaaagaagaagagcaauugacgaauggaaacaauuuuuccccaaugcagcucacgaaccgaaagcaguagauauacuaaaauuacgacuauaucaacuucagcaaggaaaaugccucuacucaggauuaccuauagauguaagacgccuaccagaaaaaggcuacguagaaauagaccaugcucuaccuuucucacgcacaugggaugacagcuucaacaauaaaauucucguauuagccagcgaaaaccaaaacaaaggaaaccaaacuccauaugaauauuuacgaggcgcagauaacuccgagaguuggagauuauucguagaaaacguucaaaacugucaauucagcccaaauaaaaaacagaaaauuauggccaaacaacuagaugaaaaagguuuucuagaacguaaccuaaaugauacccgauacguaucccgauuccugugucaauucauaagugaacaccuacaccuaacuggaaaaggaaaaaagcgcguauuugcaucaaauggacaaauaacagcacuucugcgugggagauggggauuaaguaaaaaucgagaagaaaaugaccgucaucacgcaguagaugccguagucguagcuugcucaacagucgcaaugcaacagaaaauaacacaguucguacgcuaucaaaaaggaaaugucuucacaggugaaagaauagacaaggaaacaggugaaguaauaagcauucauuuucccacaccuugggaacauuuucgagaagaaguaaugauaagaguauucgacgacaacccacugagaacacugccagagaaauuaccuaaccgaccagaggcacuucacgaauauguaaugccccuauuuguaucaagaaugcccacaagaaaaaugacuggacagggacacaaagaaacaaucaaaucagcuaaaagacucgacgaaaaaauuagcguauugagagucccccucacacaacuuaaguuaaacgaccuagaaaacaugguaaaccgagaaagggaacccgcacuauacgaagcacuaaaagcucgacuugaacaauuuaaaaaugauccagccaaagcauucgcagaaccauucuucaaacaaggaggacaacagguaaaagcaguccgaguagaaauaguucaaaaaagcggaaugcuucuaagaaaaauaaauggaguugcggacaacgggaguaugguuaggguagacguauucgaaaaaagcggaaaauuuuaucuaguuccuauuuacgccuggcaaguagccgaaggaauacuccccaacuacgcaguaguagcacauaaagacgaaagugacuggauacuaauggaugaaucauaucauuuuaaauucgccuuauauaaaaacgaccuuuuagaaguacaaaccaagaaaggugggauaaugggauauuuugcaaguuuagauagagcaacaggagccaucaccauaagagagcacgaucgagacaaaaaaaaauguaaagacggagaacacagaucaauaggaguaaaaauggcaucaagcuucaaaaaacuacaaguugacgaacugggaaagaacauucacgaaacacgaucacgcaagaggccaaauaucggauga

SEQ ID NO: 8386 - RNA, 3012 nt, Artificial Sequence
  Cas9 variant
augagaauucucggauuugacauaggcaucaacuccauagggugggcauucgucgaaaacgaugaacuaaaagauugcggagugcgaaucuuuacaaaagcagaaaauccaaaaaacaaagaaagucucgcauuacccaggagaaaugcaagaucauccagaagacgccuuaaaaggcguaaagcaaggcuaauagccauuaaaagaauuuuagcaaaagaacucaaauuaaacuacaaagacuacguagccgcagauggcgaacuuccuaaagccuaugaaggaucccuugcauccguauacgaacuuagauacaaagcauugacucagaaucucgagaccaaagaucuagcaagaguaauauuacacaucgcaaaacaucgaggauauaugaauaaaaacgaaaaaaaaucuaaugacgccaaaaagggaaaaauccuauccgcuuuaaaaaacaacgccuuaaaauuagaaaacuaccaaucaguuggagaauauuucuacaaagaauucuuccaaaaauauaaaaaaaacaccaaaaacuucauuaaaauuagaaacacgaaggauaacuauaacaacugcguacuaagcucagaucucgaaaaagaguuaaaauuaauacuagaaaaacaaaaagaauucggcuacaacuacucagaagacuucauuaacgaaauacucaaaguugccuucuuucagagaccccuuaaggauuucucacaccuagucggagcaugcacauucuuugaggaagaaaaaagagcaugcaaaaacucuuacucagcaugggaauuugucgcauuaacaaaaaucaucaacgaaaucaaaucacucgaaaaaaucagcggagaaauagucccaacucaaacaauuaaugaaguucuaaauuugauauuagacaaaggcagcauaacauacaaaaaauucagaucaugcaucaaucuacacgaaucaauauccuucaaaagucuuaaauaugauaaagaaaacgcagaaaacgcaaaacuaauugacuucagaaaauuaguagaauuuaaaaaagcacucggaguacacucacuaucacggcaagaacuagaccaaauaucaacacauauaacucuuauuaaagacaacguaaaauuaaaaacgguucuagaaaaauacaaucuuucaaacgaacaaauaaacaacuuacuugaaauagaauucaaugacuacauuaaccucuccuuuaaggcccuaggaaugauacuuccauugaugcgagaaggaaaaagauacgacgaagcaugcgagauagcaaacuuaaagccaaaaacagucgacgaaaaaaaagauuuucucccagccuuuugcgauucaauauucgcacaugaacuaucuaacccagucgucaacagggcaauuagcgaauaucgcaaaguauuaaacgccuugcuuaagaaauacggaaaaguacacaagauacaccuagaacuagccagggauguaggauuaucaaaaaaagcaagagaaaaaauagaaaaagaacaaaaagaaaaucaagcaguaaaugccugggcucuaaaagaaugugaaaauauuggacuaaaagccucggcaaaaaauauacucaaacucaaguuauggaaagaacaaaaagaaauaugcauauacucaggaaauaaaauaucaauugaacaccuaaaagaugaaaaagcucuagaagucgaccauauuuacccauacuccagauccuuugaugacaguuucauaaauaagguauuagucuucaccaaagaaaaccaagaaaaacucaauaagacuccauucgaagccuuuggcaaaaacauagaaaaauggucaaaaauacagacacucgcucaaaaucuacccuacaaaaaaaaaaauaaaauccuagacgaaaauuuuaaagauaaacaacaagaagacuucauaagccgaaaucuuaaugacacacgauacauagcgacacuaauagcaaaauacaccaaagaauaccuaaauuuucuauuauuaucagaaaacgaaaaugcuaaucuaaagucaggcgaaaaaggaucaaaaauacacguucaaacaaucucaggcauguuaacuaguguccucagacauaccuggggauucgacaaaaaagaccgaaauaaccacuuacaccacgccuuagaugcaauaauaguugcuuauucaacuaauuccauaaucaaagccuuuucugacuucaggaaaaaucaagaauuacuaaaagccagauucuacgcaaaagaacucaccuccgauaacuauaaacaccaaguaaaauucuucgagccuuucaaauccuuuagagaaaaaauccucuccaaaauagacgaaauuuuuguaaguaaacccccaaggaaaagagcaagaagagcauuacacaaagauacguuucauucagaaaacaaaaucaucgacaaauguaguuauaacucuaaagaaggccuucaaauugcacucucguguggccgaguaagaaaaaucgguacuaaauacguugaaaaugacaccauaguaagaguggauauauuuaaaaaacaaaacaaauuuuaugccauaccaauuuaugcgauggacuucgcacugggaauacucccaaauaaaaucguaauaaccggaaaagacaaaaauaauaaccccaaacaauggcaaacaauugaugaaaguuacgaauucugcuuuucacuuuacaaaaacgaccuaauacuacuacagaaaaaaaauaugcaagaaccagaauucgcuuacuacaacgacuucuccaucuccacaucuuccauaugcguugaaaagcacgacaacaaauucgagaaccuaacuucaaaucaaaaacuacucuucuccaacgcgaaagaagguagcguaaaaguugaaagccuaggaauucaaaaccuaaaagucuucgaaaaauauauaauaaccccacucggagacaaaauuaaagccgacuuccaacccagagaaaauaucagucuaaaaacaucgaaaaaauauggccuaagauga

SEQ ID NO: 8387 - RNA, 3012 nt, Artificial Sequence
  Cas9 variant
augauagaugaaucacuuaccuuuggaauagaucuuggaauagguagcugcggcugggccgugcuuagaagaccaagcgcauuuggccguaaaggagucauugaaggcauggguucauggugcuuugacguaccugaaacgucaaaagaaagaacaccgacuaaccaaauaagaagaucaaaucguuugcuaagaagaguaaucagaagaagacggaaucgaauggccgcuaucaggagauuguuacacgcagcuggauuauuaccuaguacugacucagaugcuuuaaaaaggcccggacaugauccaugggagcuaagagcacgaggauuagauaaaccacuaaagccgguagaauuugccguaguauuaggccauauugcuaaaagaagagguuucaagagcgcugcaaaaagaaaagcgacaaauauaucuagugacgauaagaaaauguuaacagcauuagaagcuacgcgcgaaagauugggaagauauagaacaguaggagaaauguuugcacgagacccagacuucgcgucgagacgaagaaaccgagaaggaaaauacgauagaaccacagcuagagaugauuuggagcaugaaguacaugcuuuguucgccgcacaaagaaggcuaggacagggauuugcaagcccagaguuggaagaagcauuuacagcaagugcauuucaccaaagaccaaugcaagauucugaacgguuaguaggguucugcccauuugaaagaacagagaaaagagccgcgaaauuaacaccuagcuucgaacgauuuagacuauuagcaagacuuuuaaauuuaagaauaaccacaccagacggugaaagaccauuaacgguggaugaaauagcacuuguuacaagagauuugggaaaaaccgcaaaauuaaguauuaaaagaguacgaacauuaauuggauuagaggacaaccaaagauuuaccacaauccgcccagaagaugaagacagagacauaguagcacgaacggguggagcgaugacugguacugcgacauuaagaaaagcacuaggagaagcacuauggacggauaugcaagaaagaccagaacaacuugacgcaauaguacaaguacuaucauuuuucgaagccaaugaaacuaucacagaaaaacuaagagaaauaggacugacauuagcuguauuagauguguuauuaacagcuuuagacgcgggcguguuugcuaaauuuaaaggagcagcgcauauuuccacaaaagcugcaagaaaccugcuaccacauuuagaacaaggaagaagguaugaugaggcauguacaauggcagguuaugaucacgcagcauccagauugucacaucauggucagauaguagcaaaaacccaauuuaaugcgcuggugacagaaaucggagaaucaauagcaaauccuauagcacgaaaggcuuugauagaaggauuaaaacaaauaugggcgaugagaaaucacuggggauuacccgggucaauacauguagaacuagcuagggacgugggaaacucaauagagaaaagaagagaaauagaaaaacacauugagaaaaauaccgcauuaagagcacgagaaaggcgggaagugcaugaucucuuagauuuagaagauguaaauggggauacucuauugcgauauagauuauggaaagaacaaggaggaaaaugucuauauaccgguaaagcaauucacauccggcaaauagccgcgacugacaauagcguacaaguagaucauaucuuaccauggagcagauuuggggacgacucauuuaacaacaagacauuaugccuagcaucugccaaucaacagaaaaagagaucaacaccuuacgaauggcucucgggacaaacaggagaugcguggaaugccuuuguacaaagaaucgaaacgaacaaagaauuaagaggauuuaagaaaagaaauuaucuuuuaaagaaugcaaaagaagcagaagaaaaauuucggucucgaaauuuaaaugauacaagauacgccgcaagacuauuugcagaagcaguaaaauugcuauacgccuuuggagaaagacaagaaaaaggaggaaauagaaggguauuuacaagaccaggggcauuaacagccgcacucagacaagcauggggaguagaaucacugaagaaacaggacgguaaaagaauaaaugacgaucggcaucaugcacuugaugcacuaacagucgcagcaguagaugaggcagaaauacaaagacuaacaaaauccuuucacgagugggaacagcaaggacuaggcaggccauuaagaaggguagaaccaccuugggaguccuuuagagcagacguagaggcgacuuacccagaaguauucguugcgagaccagagagaagaagggcaaggggugaaggacaugcggcuacgauacgacaaguaaaagaaagagaaugcacgccaaucguauuugaacgaaaagcagugucuagccucaaagaagcugaucuagaacgaauaaaagacggugaaaggaaugaagcuauaguagaagcgauaagaucauggauagcaacgggaaggccggcugaugcaccgccuagaaguccaagaggggauauaaucacaaaaaucagacuagcaacaacgauaaaagcagcaguaccuguacgaggaggaacagcugguagaggagaaauggucagggcagauguauuuaguaaaccaaaccgaagagggaaagacgaaugguaucuaguaccagucuauccacaucaaauuaugaauagaaaagcguggccaaaaccuccaaugagaucuauugucgcaaacaaagacgaagaugaguggacagaaguagguccagaacaucaauuuagauuuagucuguauccaaggucaaacauagagaucaucagaccaagcggagaaguuauagaaggauacuuuguaggcuuacauagaaauaccggugcccucauucccacgccaguggguccugauaguuauguaauagcuuga

SEQ ID NO: 8388 - RNA, 3024 nt, Artificial Sequence
  Cas9 variant
augaaaguacuaggcuucgacaucggaaucaacagcaucggcugggcuuuuguagaaaacaacgaauuaaaggacugcggugucagauuauucacuaaagcagaaaacccaaaaaccaaagagucccuugcacuaccacgacgaaaugccagaucgaguaggguacgccuacgacgacgaagaucuagauuauuaucucuaaagcauauaauaucaaaggaauuuggacuacauuacgaagacuauauagcauuagacggaaaucuacccaaagccuauacgggaaaaauagaauccauauacaaacuucgauaugaagcccuaagccaagcaauaucaaaagaagacuuagcaagaguuauacuacacauugccaaacacagaggauacaugaacaaaaaccaaaaaacaucucaagacuccgaaaaaggagcaauccuaucagccauuaaggaaaacuccaacaagauaaaacauuaccaaacugccggcgaauacuucuauaaagaacuauucgaaaacuuaagagauggaacaaaagaauuuaaaaauauaagaaacaaagccaugaaaaaugaaaaaacaggcaacauggaauccaccuacuauaauacaauacuagcaagugaucuagaaaaggaacuaaaacuaauccuagaaaagcaacaggcuuaccacaacuacucagacacauuuauaaaggaaguacucgaaauagcuuucuaccaacgcccacuaaaagauuuuucacaccucgucggaagcugcacauucuacgaaaaugaaaaaagggcaugcaaaaauucauauagcgccugggaauuuauagcauuaggaaaaauaaucaacacacuugaaucaaucaaaaaagacacuggagaaauauuuucaaacgaaauaaucacgcaaauacuaaaagaaguccuggauaaaggaucccucucauacacuaaacuucgaaaaaugauaaacuuggacgaaaaaguuaaauuuaaaggacucaaauaugacaaagaaggaguagaaaaaaccaauuuaauagaauuuaaaaaacugaaagaguucaaaaaagcauuaggagaacacaacuuagaacgaaaaacacucgaugaaauagccacacauauaacucuuacaaaagacgaaaaucaauuaaaaaaacaacuagagcaauacgcauuaucucaaaaccaaauagacgcacucgcagaacuggauuuuaacgaccacauaaaucucucauucaaagcacuauacgaaauauugccucuaauggaaaaaggcaaaagauacgaugaagcaugcaacgaauuaggacugaaagcaaaaacauccaaucaaaaauccgaauuccuaccugcauucugcgacucuauauucgcacaggaacucaccaacccaauaguaaauagagcaauaagcgaguaccgcaaaguauuaaacagacuccugaaaaaauacggcaaaaugcacaaaauacacauagaacuggcacgcgaugcaggauuaucuaaagaggcacgaaacaaaaucgaaaaagaacaaaaagaaaauaaagauauaaacgauaaagcagaaaaaacauguaaggaauucggacuuaaaccaaacgccaaaaauauccuaaaaauuaaauuguggcgggaacaaggagagauaugcgcuuacagugguaaaaaaauaaccaucgaugaccuaaaagaagacaaagcacucgaaguagaccauauauauccauacuccagaucauaugacgauaguuacaacaauaaaguacuaguauuuauaaaagaaaaucaguuaaaacuuaaccagaccccguacgaagcguuuggaucaaaccaagaaaaauggaguaaaauacaaguacuagcccaaaaauuaccauauaaaaaaaaaaacagaauacuagaugagaacuucaaaaacaaagaucaaauagaguucauaucaagaaacuuaaacgacacccgauaugcaaccucacuaauagcaaaauacacaaaagaauaccuagaauuucuacccuuauccgacgacgaagauauuucccuaaaaucaggagaaaaaggaucaaaaacacauguacaaacaaugaacggaaugcuaacauccguccugagacacgcuuggggauuuucucaaaaagaucgaaacaaccaucuucaccaugcacuagacgcaauuauaauugccuacuccacuaacaguaucauaaaagccuuuagcgauuuuaaaaaaaaccaagaaauacuuaaagcuaaacucuacgccaaaaaacuaacauccgaagaauauaagaaccaauccaaauucaccggauucgaaaaauauagaucaaagauacuagaaaaacucgacucuaucuucgucucaaaaccaccuaauaaaaauaccaaaggagcacuacacgaacaaaccuucuacucuuaccaagacauauuagaagaauacaaaacucaagaaggauuaaaaagagcacuagaauguggaaaaguuagaaaaauaggaacaaaauauguaguaaacgacagaaugguaagacuagacauauuuaaaaaagacaauaaauuuuauggaauccccauauacacaauggacuuugcacuaggaguauuaccuaauaaaguaguuaccauaggaaccgacaaagacaaaaucaaaaaagaauggaaaacaauagacgaaaccuacgaauucuguuucagccuauacaaaggcgaucuaguucucauacaaaaaaaagagaugcaagaaucagaauucgcauacuauaacggauucgauauaaguucagcaaguauaucucuagaaaaacaugacaacaaauucgaaaaccuaaccgaaaaccaaaaacuacuguucccaaaagcaaaagaaggagauguugaaguacgcggaaucggaauacaaggacuuaaaguauuuaaaaaauacaugguaacuccacucggcgaaauacaggagaccagaacagaagcuagacaaaacauacaaccgcgaaaaaaacacggccuuagauga

SEQ ID NO: 8389 - RNA, 3033 nt, Artificial Sequence
  Cas9 variant
augagcgauucaaguuauguacucggccuagacuuaggaacaaauuccaucggaugggcaugcguaagacuuaacaagggaaaaccagauggguuacuugcacaagguguacgaauauucgaagcuggauuagaaauagaugcguaugguagagggacaccauuaaauacagaaaggcgcaacgcaagacaaaggcgacguuuacaugauagaagaaagagaagaauauuaaaaguuagacgcauucuacaagaagcaggaauguuaccagccaauaaaccagaccauaaggacgcagaauggaaaaugcuuuuagcacgaaacccauaucgauuacgugcaaaggccuuagacgaacaaaucgaucuaaaagaaauaggacuuuguauauaucaauuugcacauagaagaggauuuuuauccaauucaaaaauacucaagaaagacgaugacagaggaaaacuaaaagacgcaacaaaagcguucgcagaagauauggaacaaaaaggagcaagaaccuggggugaauauuuaagccacuuagauccucaugaacagagaauaagaacaaauuacaccuuaagagaaugguacacaucagaauuugaccuaauuugggaaaaacaacaaucguucuacccacacguguugaccgacgaccuauauaaacgaguuaaagaagcucucuuuuaccaacguccacuuaaaagucaagcacacuuauugggacaaugcgaauuagagccaggacgaaaacgagcucccuucgcauuacugauggcgcaagaguucagguuacuacagagcuuaaaccaccuuagagucguaagcagcacaggugacgaacggcuacuaacagaugaagaaagaaaacaagcauuggcucuacugcgaagcagaggaaaucaaaaauucacaacauugaggaaaguccuaaauuuaagagguacuaaauuuaaucuagaacgaggcggagagaaaacaauacaaggaaauaacacagcagcugcguuaggaaacuuauucggagaggcuugggaucauuuuagcucugaacaaaagaaucaaauuguugaagauagauugacgauaggagauacagaugcauuaauaagacgcaugaagaaaacuuggggccucgauucaguaaccgcagaaauguucucagaaacagaauuagaagauggauacugcggauucagucgaaaagcauuagaaaaacuacucccacuauuagaaaggggacaugcccuuauggaagcuguacaagcagccuacccagauuaucagaaaaaucuaccaagaacagauacacuuccaccacuagaaaaccugcgaaacccuaucguacaacgaacacuuucagaauuaagaagaguaguaaaugccauaaucaaagaauacggaaaaagcgacaaaauaagaauagaauuagcaagagacaugaaacaaacagcuaaaaacagagaaaaaucaugggacaggaugagagugagagaaagacaaagaaaagaagcagcaaagaaaauacucgaagaaacaggaaacccagcaccacgcagacacgaaauagaaaaaguauuauuagcugaagaauguaacugggaauguccauauacaggaaaacgaauuugcaugaacacauuauuaggagaugcaccacaauuugacauugaacacauaauuccauuuaguagaaguuuugauaauucauucaguaauaaaacauuaugugacguaaacuacaacagaaacguaaaaggaaauaagacuccauacgaaagcgcuagugaaacugaacacgaagaaauggucuguagagucaaaagauucacaggagacuauaaagaaauaaaauuagacagauucaauacacgcgaaacagacucacgcgcugacuuuauagaagaauuuuccacaagccaauuaaacgauacuagauacgcaaguagacuagccggagaauaccuagguaaauuauauggaucagaauggagaaagcacauacaaauagcaaaaggaggaacaacuaaauaucuacgugaugcaugggacuuaaaucgcauucuaucagauggaggaacuaaaagucgcgaugaucauagacaucaugcagucgacgcaguuguagucgcguuaacaacuccucaaacagugaaagcacugucugacgcaaaccaaagagcaccggaacaccgaagguaugcguucagugacaugcccuugccuugggaaacauuucgacaagauguagaacaagcaauaaauagcauuaccgugagccacaaaguaugcagaaaagcgaauggccaauuacacaaggaaacauucuacggcuuaauaaaagacagaaaaacgggagacacacgaacuguacuaagaaaaccguuacacgaacuuaccgauaaagaaauaaagcgggcagaaauuguagacucuucaauaagaaaauuaauagaacaaaaacugaaagacuuagaccaaccgccaaaaacagcauuuaaagauagaaauaaucauccauucauaaucgacaaaaauggcaauaaaagauuuauacauaaagucagaguuuaucaagaugcaaaaccagucaaaaucgcagaaaacagacaugucaaacuagguggcaaucaucaccuugaaauauucgaaguuauagauaagaaaggaaacccaacauggaaaugcgaaguaauaucacuauucgauacuaggcaaaggguaaaagagaaaagaccagucauugucagacaagaccaaaauggaaauccacuaaaauuuagccuaucaaucggggaagcuguucaacuagauuggaauggagguagggaaacugcaguaguacaaaagauguccaaaacaccaaauacaguagaauacguuuuuagaaaacauaacgacgcucgaaaagcugccgacauaccauauaaagaaacaauaacuguaaaaucggauuccgcucucuuugccucaaauuugcagaaaauagucauaacuccaacaggauuaauaagacgagcaaaugacuga

SEQ ID NO: 8390 - RNA, 3033 nt, Artificial Sequence
  Cas9 variant
augaaaaauagaaaugugauaggaaucgacguaggaacaaauaguauagggugggcauugguagaagaaaacgagaacggucuuccacaaaguuuaaaagcagcaggaguacgaauauuucaagaagcuguggaagccaaaacccgaacuccaaagaaucacaagaggagacaagcaagauuagcaaggagagugcuagcuaggcgcgcaagacgaaaacagagauuacaaaaucuauuguuaaaacauggguuauuaccaggagguguaaccgauccaguacaaagggaagcagcauuuacaacucuuggcgauccauaccaacuaagagccaagggucuaaaucuuccccuaggauugcaugaauuuggaagaguacuauuucaacuuggcgcaaggagagguuuucuaucaaaccguaaaacucgauacgggcacuuaaacaaauuagaugaauuagcagacuuaauagaagccgaagacgcagcucccaaaacaggagaugcagaagaaggaaucauaagaaaagaaaucggagaacuucgucaagcaaugagugcggcagguagcagaacccuaggagaguaccuagcaggacuagcaaaagaggaaagaaaaagauguagacacacugaaagagcaaugcucgaagaagaguucgaaaggcuuuggaugguccaagcaagauuucauccagaauuaucugaugaacuuaaaguacaaguucacacugucauuuucuuucaacguccacugaaaucaaauagagcaucacuagguaaguguagucucgaacccucacgaagaaaagcagcacgugccuggccagaagcccaacgcuuucgacuacuacaggauuugaauaauuuagaaauacuagacccaaggacaggggaauuaagaagacuucgggauacagaacgagcaauacuguuaaacgcgcuugaacaacagaaaaguaugacauggaaugcuguaagaaagaaauuaggguuacaucaaggagaaaaauuuaauuuagaaacaggagcaaaagcagaaacagggcugaaaggucuacaaacucuagcaagucuucaugcaauauuacagggaugguucgaugaauugggagauaaaagagaccuauugaucgaagaucuuauaacuauagaagacucagcugguuuauauagacgucugcgagaacacuggggguucgauagagaaacagcauuuagauuagccacgcuagaauuagaaccaggauacgcuucauugucauuaaaagcaauacgaaaacuacuaccacauaugggagcaggacauagguauucagaagcuagacaacaaguaggcuaugguuaugaaacaggacaacgagaucuucaagaaagauuaggagaaccuccagacccgcguaauccuguagucgauaaagcacuacaugaauugagaagaguuauaaaugcacuaauacauagauuuggacgaccagacguaguaagaguugaacuugcgagagauuuaaaauuagcaaaacgagauaaagaaagauuagagaaacaaaacagagagaaucaaagauuaaauagaaaagcugaagcugcgcucgcagaguuaggacuaggacaaccaucucgagacgauuuaauuaaauaucgucuaugggaagaaaguaaaggacuaugcccuuauacaggaagagaaauuggauuaucaacauuauucucaccagaagucgacguagaacacauaauacccuauucacgaugcuuagaugauucauauaugaauaaaacccuauguaugacagaagaaaacagaaugcaaaaagggaacagaacaccaugggaagcguauggaggcgauccagcccgauaugaacagauauuacaaugugcgagauauuuuccgauggcgaaaagaaaaagauucuuggagcaaggaagugacuucguggaucaauuuauucaaagacagcugaacgauacgcgauacauagcaaaauuggcgaaagaauaccucgcagcagucuguacaaacgugcaaguuacaaaaggaggaacgacagcaaugcugagacaucacugggguuuaaauagacuacugggagaggaugauggacaaaaagaaaggggcgaccaucgacaucaugcacuagaugcagcuguaauagcuguaacaagccguagucuauaucaaagacuagcuagaauagcacaucaaagaggucacgcaccaagccaacgaggauucuacaucgauccaccauggcaaggcuaccaagcugaucuggcacaaacuuuagcaggaaucgucguuagccacgcaacuaacagaaaacucacaggugcauugcaugaagagacggcauauggacacauaccucacguuggauucguuuacagaaaaacgcuaaauaaagacuuuaaacuaggugauauugaagcaauauaugauccuucacuccaagaauugguaaaggcacauuuagaacaccauggaaaugauccaaaaagagccuuugcagaaggaauacaaugcuaccacaaagacggccacacacccaucaaaagggucagaauaagagcaaaacaaguaagcgaaaagggaacuuuuaguauaagcgauagagcggguagggccuauaaacaccauaaaacggguagcaaccaucauguagaaauauugagacacagagcaaccgggaaaauagaaccaguuuaucuuacaacaaaagaagcaacugaaagggcaagaagaggaggagaaccuguaauacaacgugaccacggaccagaaugggaguucaucauaagucuguguauaaacgauaugguacgacuuggugaaggaggacaaguagcauauuuuaggguacagaaaauagaagcaacaaacaaccggguaacacugagaagccaccuagcggcaacauuagaugacgaagauaugaagguaacaacuucaguaccaaaauuagcaguaaugccuggauuucaaaaaguacucguuacagcgguaggagaaguucuagaauuacaugacuga

SEQ ID NO: 8391 - RNA, 3033 nt, Artificial Sequence
  Cas9 variant
augaaaagaauggcagcaguuggccucaugccagcagaucccacagaagcaaaagcauuagaacuauuagaucccuaugccuuaagagcugcaggauuagaccaagcccugccauuaacacauuuugguagagcacuauuucauuugaaccaaagaagaggauuuaaaagcaaucgaaaaaccgacaaaggagauaacgaaucaggaaaaauaaaagaugcaacuaaaagauuagacgaggagauggcuauuaaaaacgcaaggacauauggagaauuucuacauaugagaagaacuucagcaacugacccgaaaaauguaccaacaguacguacuagacuuucaaucgcuaggagggacaacgcagaaaaagaagaggcuggauaugacuuuuauccagauaggaggcaucuggcagaagaauuugacaaauuauggaaagcacaagccgguuauaguccagauguccuaacagaugaacuacgagacgagauaagugugaucaucuuccaucagaggccacuaaaaacacccgaaguaggacuauguuuauuuucaggcagccauggaguaccaaagaaagacaagagaauaccaucggcacacccauuaaaucaaagacgaauacuauuugaaacuauaaacaauuugagaguagcagcaagaggugaaccagcuagaggccuaacacgggaugaacgagaugcaauaguacaugcgcuagacaacaaagcgcauacaaaaagccugagugguauguccaugaaauugaaagccuuaggaaaagugauaaagcuaaggccagaacaaucauucacauuacaaacagcgaauagggaaacuauagcaugugaucccguacgagcaagucuuagucaucccgauagauuuggcccaagguggaguaugcuugaugcugaugcacaaugggaugugguucaaagaaucagagcaguccaauccgaagcugaacacgaugcccuaguaaaaugguuaauggcaacacacggacuagaucgagaccacgcagaaucaacagccaaggcgccucuuccugaagguuauggaaggcucggauuaacugcaacaaaacgaauacuugcagcacuagaagcagauguaauaccauauagcgacgcaguuaaagcaugcgguuggcaucacagcgauggaagaacaggagaagugcuuaccgaauuaccauauuauggacaaauucuggauagacauguaauccccggcacauauaacgaaucagaugacgauguaaccagauauggcaggaucacaaauccaacaguacauauaggacuaaaucaauuacguagguugguaaauaaaaucauuaccguguauggaaaaccugaugaaaucguaguagaauuagcacgagacuuaaagcucucagaagaucaaaaacgugacguacaacgagauauuaagaaaaauacagaugcagccauagcuagaggagcaaaacuaucagaaaugggaguucccgauaccggagcaaaccguaugguccugcgucuaugggaauccuuaggagaugauguaaugacacgaaacugcccuuauaguggaaaaagaauaucugcaacuaugcuauuugauggaaguugugauguggaccauaucuuaccuuauucuagaacccuggaugauggauucgcaaauagaacacuaugucuaaaagaauuuaaucgacagaaaacagauaaaacuccaugggaggcauggggagauaccccggcgugggcaacaauagaagcuaauuugaaaaaccuuccugcgaacaaagcauggagauuugcaccagaugcaauggaaagauuugagggagaaaacgacuuuacuucaagagcacuaaaagaugcccaauaccuuaguagaauagcaagaacuuacuuggaugcacuauaugauggugcugauggaaaaucacacgucuggguaguaccaggacgacuaaccgaaaugcuaagaagacauuggggauuaaauucauuacuacccgauaaagauggagcagugaaagccaaaaaccgaacugaccauagacaucaugcaauagaugccgcugucguagcggcgacagaucgcucacuuauacaaagaauaaguaaaauggccaggaaagaugaagugaauggugcugaagaaguugcucggagcguaccaccaccuugggagggauuucgcacagacauagaaacgcaacuagauagaauaauaauaucacauagagcagaucacggaagaauagauccagcugcuagaaaggauggucaugacaguacgucaggccaacuacacaacgacacugcauaugggcugggugaaggaaacucaguuguaaguagaaaacccuuacuuagucuaaaaucuaaugauauugaaguaacaacuaaaggugcuaauauaagagacguagauuuacaacgucaccuagaaagaauaacaagaggacuagauggcaaagcacuagaagcagcauuggcagaauuugcagcaacagccaaacuuccagaugggacagacaacccuuacuacggucuucgacgaguaagacuagaagaaacguuacaacaaggagcuagaguggaaguuaaagauagaaauggaaaacccuuuaaagccuacaaaggugacucgaaucauuguuaugaaauauggagaaugccugacggaaaaguaguaccccagguaauuacaacuuaugaagcacaucaaauagacguugagaagaaaccacauccggcagcuaaaagacuucuaagaauuuuuaaaagagacaugguugcaaucgaacaagaugacaaagcaauaaucggauacguccagucaaugcauguagccaaugguuuauuuauugccccgcauacagaagcuaacgcagaugccagaagcagagauaaaucagacagcuuuagguuaauacagaugucagcagguccacuuguaaaagcaaacgcacgaagaguuuaugucgacgagaugggaagacuaagagauccaggugcaccaagcuga

SEQ ID NO: 8392 - RNA, 3039 nt, Artificial Sequence
  Cas9 variant
auggcgaauaugagauacagacuagcuuuagaccucggaucaacaucauuaggaugggccauggucagauuagaugcccaaaaugaaacaugcgcaguaauaaaagccgguguucgaaucuuuucagauggucgaaacccgaaagacgguaguucacuagcaguauccagacgagaagcacgugcaaugagaagacggcgagacagauuacuaaaaagaaaaaccagaaugauggcaacgcuaaugaaacaugguuucuuuccacaagaugaagcagccagacaagcgcuaguaaauaaagaaccauuugcacucagagcuaaagguuuggaucacgcauuauuaccagaagaauuugcacgcgcucuauuucacaucaaccaacgccguggauuuaaaucuaauagaaaaacagauaagaaagaaaccgauaguucugccuuaaagaaagcgauuggacaacucagagaagcaaugcaggcaagcggauguagaacugugggugaaugguuaugcgcacgccaccaacaaggauuaucaguaagagcaagguauagagaaaaccgaauuacaaaagaugacgguaaaacaaaaaucgaaaaaucauacgacuuauauauagauagagcaaugauagaagcggaguucgacgcucuuugggcaaaacaaagugaacuaaacccggaacuuuuccaugaaacagcaagagcagaacuuaaagacugucuccuacaucaacgaccauuaaaacccguaaaaccgggaagauguacacuauuaccagacgaagaaagggcaccacuugcauugccaucacaacaaagauuuaggauauaccaagaagucaacaaccuucgucuauuacgagaaggacuuaacgaagaaccacugacacuuacucaacgagaucaacucauucaagcacuugaaaccaauccaaaacguucuuuuacacaaauacaaaaacugcugggauuuucaggacaauucaaucuccaagaugauaaaagaacugaacuaaaagggaacucaacaucagcaauguuaucaaagaaagaauuuuucgguagucaauggcugaguuuugacgaaacacaccaagacgaaauagugaugcaauuagucagugaggagaacgaagcccgauugauagcauggcuccaagcagaaacaggaguagaugaaauaacugcagaaagaauagcaaauacaccauuagcagaaggguaugguucccuaucagcaaaagccuuagagaaaauauuaccagcucuccgagccgaugucauaacuuaugacaaagcuguuuuagcugccggauucgaccaucauucucacauaucucaugccgcuacaggagagauucuacccgaucuaccauauuaugggcaauaucuucaaagacauguuggauucggaacaggaaaaccagaagacccagccgagaaaagauaugggaaaauugcuaauccaacaguacacauaggauuaaaucaggucagaacgguaguaaaugcuuuaauaaaacgauauggacauccuucugaaguuguagucgaauuagcgcgagacuuaaaacaaagucaagaacaaaggaaagaagaacaagcucaacaagcuaaaaaccaaagaagaaacgaaagaaugaggcaagacauugcuggucuucuaaauacaucgacagaaagaguacgggcauuggauuuacagaaaaugauccuuugggaggaacuaaguuuuaaugucgcagaccguagaugucccuauucuggaguacaaauaagugcccaaauguuauuuuccgaccaggucgaaaucgaacacauacugccauuuagucaaacauuagacgauucuuuaaacaacaaaacaguugcaaugagacaggcuaacagaauuaaaggaaaccgaacaccagcagaagcagcagcagacuuugcagcacagggcuggccuguagaagauaugcuacaucgugcaagucugaugccaaaaggcaaaagguaucgauucgcacaagauggaauggcucaaugguuaagagaagacaaaggauuucuagcucgagcucuaaaugauacgcgacacuuaagcaggguagcaagagaauaccuaucucuaguaugcccacaagguacuaggguaauaccaggaagaaugaccgcaaugcugagagcuaaauuuggccuaaaugauauacuuggauuaaauggugaaaagaaucgcaaugaucaccgccaccacgcagucgacgcauguguaauagcugugacagaucaaucaauguuacaaaaauuugcaaaagcaucagcaagcgccagagaaaaacaacuaaauaagcuaguagaaaguaugccacuuccuugggauucauauagagaucacguccaaagagcuguagaacgaauauggguaucccacaaaccagaccauggucaugaaggggcaaugcacaacgauacagcauacggacugcuaggcggugggcacguccaaguuagaaaaaggauggaugggguaagaacucgagaaacugcugcccuaaaaguuauagaauuugccgacagacaagcacacccuagacauggacuucuuccaaacggagaaccaaugccuuauaaaggauauaaaggcgauucaaacuacuguauggaaauuguaagaaaugauaaagguaaaugggaaggagaaguaguaucaacuuuugaggcuuaccagcucguucgacaacauggauuagcaaggcuuagacauccagcccuuucaguaucuggaagaccauuaguuaugagauuauuacgaaacgauacccucagaguaauacacaauggagaacaaagaacagucagaauauguaaaaugacugcugaaggaguaauugcauuagcugauacuacagaauccaacguagacgcacguacacgaacgaaagacuuaagcuacauauuuaaaacagcaggaaguuuacaaaaaucuaaagguagaagaguagcuauaagcccaucuggagaaaugaaagauccuggauucuuugauuga

SEQ ID NO: 8393 - RNA, 3051 nt, Artificial Sequence
  Cas9 variant
auggaaguauuuguagauguuucagcuaggcaguugggaauagauuuaggaauagggacuugugguugggcgcuacuagcagaagauagccuaaucgcucuugguacaaggacauuugauguuccagagacagauaaagaaagaauaccgacaaaccaaauacgaaggcaagcgagaggaaugcgaaggguuauagauagaagaaggcaacgcaugaaugcaguaagacgucuacuagcagaucaugguuuauuggcggacgguggaaaacugggauuagcuaccgucagauuagacccuuggcaagccagagcagaaggccuugaccgacuauugagcgcaggagagcuagcuguggcacucgggcacauagcaaaacauagaggauuuagaucaaauagcaaaagagaucgaggugcgaacgcuccaaaagaaagcucggcaaugcuaggcgcaauugcacaaacaggugagcgauuacaacauuggcgaacaguaggugaaauguuuuggaaagacgaauuuuaucaaacacgaaggagaaauagagauggcgauuauaguagaacaguacaaagacuugacuuggaaacagaaguacaucgacuucuagccgcacaaagacguuuaggaaacccauuagcaacauuugauuuagaacagagcuuuauagacgucgcguucuuucaaagaccgcucgcugacucagacgacaaagugggacccugcccauuugaaccuucggaaaaacgcgcagcaaggcacucaccaucguuugaaagauuuagacuacuuagccgucuggcagcucuuagacuaucuagcggagcaggagaacgaccucuuagcgaugccgaauuugcugcagccugcgcagauuuuggaagauugcaaggauucagcuucaaaagauuaagacaacaucuaaaauuagauccaucaauacgauuugcgggaauagcaccagaugaagaaggcaaacgagauguaguugcucggagcggcgaagcuacuccagggagugcagcgcuccgucacugucuaggagacacaguaugggacaauaugcucggaacuagaccagcuuuauuagaugcuaucgcagcaauacuaacauucagagacgaugcugacagaauagcagaaggucuagcugguuuaggaauagaggaaccaauuuuagaugcauuaauggacgguguaagaaaugguucuuucgguaaauuuaaagggccuggacauaucucggcgaaagcgugucgagcuuuacuaccacacuuagcaagaggacgaguguauuccgaugcaugcgcagaugcgggauaugaccauaguagacaaacagaaacaaauuuagacgacauaagaaauccaguagcaagaaaagcacuaggagaagcauuaaaacaaauuaaaauaauaauacacacacacggaaggccuacagccauacauguggaaauggcaagagacauaggaaaaagugcagaugaaagagaugaaauuaaaaagggaauagacaaaagaaauucagaaaaagauagagcaagacaacaauuccacgaaaugguaggcacaccggcagcaggggccgaagauuuacugagguuugaauuauggaaagaacaaaauggauggugcuuauacacaggacgagaaauaccaauugaugcucuaguuagcagcgacaauagaauacaaguagaucauauacuaccguggaguagaagcggugacgauucauacauuaauaaaacuuuauguuuuacggaagcuaaccaacauaagaaaggaaugacuccuugggaauggcuccaugaugauccggaaagaugggaaaaauuugcaagaacaguugaaggauguaaaacaaugaaagguagaaagaaaagaaaccuucugcuaagagauucaagcagauuagaaaaagaguuucggucgaggaacuugaacgauacuagguaugccuguagacuacuacuugguauacuaaaacacaccuauccagauauagugguagcagcgaggccaggcccacuaacagauagauuaaggagggccuggggauuacaaucuuuaaagaaacaugaggaugggacuagaaaagaugaugauagacaccacgcucuagaugccgcaguuguugcagcaacuucacaaucaaugcuacaacgacugaccacucuauuccaaaaagcagaaagggaaggaggaaggcgagauuucguaggacuagaacccccauggccaggauuuagagcagacuuagaggcaaaauuagaggggguaguuguuucaagggccgaaagacggagagcaagaggcgccggacacaaagacaccauaagagcuauuggcgaaggcgaugcaggcccugucguuuaugaaagaaaaccaguagccgcccugacagaaaaagauuuagaucgaguuaaagacccggaaaggaauaaaguacuaauugaaaauuuaagacaauggauagcggcaggaaaaccaaaggauccagauaaagcaccgagaucacccaaaggggauccuaugacuaaaguaaaauugguuacuacagaugauguacguauauuggucagaggcggaacugccgaccgaggagauauggcacgaguagauguauuuagacaagccgaucccaaagguagauggagauucuuucuuguaccgguguauccccaucaaguuuuugacccaacagauuggccacaaccuccuaauagagcaguaguagccuauaaaccagaaaaagaauggacagugaugggaccagaccaugaguuccuauggucauuguauccauuuaguuggauagcaguagaaaaagcugacggaacacggauagaaggguauuuuagaggcaugcaucgaaguacaggugcuauaucaauuucuccucaucacucaaaaucguuagccucaacaggaauaggagccaaaacccuugcuagcuuuagaaaguucgcaauggauagaaugggaaaccuaagcgaaauagaacgagaagucagaacuuggcauggaguugcuuguacuuga

SEQ ID NO: 8394 - RNA, 3054 nt, Artificial Sequence
  Cas9 variant
augcgaguagauagcuuaggacgaugccucucugacgaagaaugggcaagagugauauaccauuuaugcaaacauagaggauuccauuggauaagccgggcagaagcaaaacaaacugaaggagauucaaaaagcgaagguggcaaaguaaaacaagguuuggcuggcacagccaaguuaauggacgaaaagggcuacaggucggccgcagaaaugguauuagcugaauuuccggaagcucaacgaaauaagcagggagaauaucgaaaagcccuaucuagagaacuauuagcaaaagaacuagccuuacuauuugcacgacaaagaguauucggaaacagacacgcuacagauaccuuagaaacagcaauacuaggaaacucagacaagaaaagugggcuauuuuggcagcaaaaacccgcacuagcaggagccgauuuauuaaaaaugcugggcacauguaccuuugagaaaaacgaauaucgagcaccaaaagcauccuuuaccgcagaaagacaugucugguuaacaagauuaaauaauuuaagaauaguaacugaugggauaacaagacaauuaacagaacaagaaagacaauuagucuugccacugccuuaccgccaggcuggugauuuaacauacaaacaacuaggaauggcauuaacaaaagcaggauuauuagaagcugggugcuucaaauucauaggacuugccuacccaacugaagcacaaaaagcagaaggcaaaaccaaagaccccgaaagcgcgacccuaguaaaaauaccagcauggcaagaacucaggcaaacacuaaauaaggcuaguuuaaacgacgaaugggaaaaacuuucuggugaugcauuaugcggacaacccgaaaucuuugacaaaaucgcguggauccuaucaguauacaaagacgacgaugaaguacgaaccgaacuagcaaaauuaguucuacccaauccggaaggacugacagaagcacucuuaaauauaagguuugauaaauuucaugcucucucacuaaaagcauuaagagcaaucguaccacacauggaaaaagguuugagguaugaugaggcuuguguacaagcaggauaucaccacucacaauuacauaaaauuggagaaggagaacauaaguauuuaccuccccuuuaugauggaagagauggagacggacggaugaucuucgccgaagaugccgauaucccaagaaauccuguuguguuaagaucacuaaaccaagcaaggaagguaguaaacgcaauaauaagaagauacggcucaccaagcgcaguucauauagaaauggcaagagaccucucucgaccauuugacgagagaaacaaaauaaagaaagaucaagaugaauaccaagcaagaaaccaaagagacagagaacaauuuauagaacuauucggucacccacccaaaggauuagaauuugaaaaauggagauuguaucgagaacaaaauggacaaugugccuauagccagaaacccuuagcaaguaguggagauguagcagaaauuuuccuugauggauccacagaaaucgaucaugcccuacccuacaguagaaguuuugaugauaguaaaaauaacaaaguauuaguacuuacgagagaaaacagagauaaaggaaauagaacacccuaugaauaucuaggaggagcugaaaauucagaaagauggcagagauuuuucucauuuguugaaaguaauaaagcauaucgacuugcaaaacgaacaagauuauuacgcaaagacuuuggggcaaaagaauccgaagaauuuagagaacgaaaccucaaugacacaagauacguauguagauuuuucaaaaacuacguagaacaacacuugaaacuugcggaaggaagcgaagcuaaacggugcgucguaguauccggacaauuaacaaauuuucuuagaaccagauggggccuacuaaagauucgaagugauagcgauagacaucaugcuuuagacgcugcaguaguagcagcauguucacauuccaugguacaacgauugucgaacuauucaagaacaagagaacuggaacaaguaagagacggauuugugaauaucgaaacuggagaaauaguaaauccugcgaugcaucaacaacuacgagaacauuucccagaccccuggcccuauuuuagacaugaauuagaagcaagauuaaaaaucgacagcccggcuuuacuaagagaagaaauggcacgauuaucaaguuauacagaagaagaacucgcagcuuuaaaacccuuauuugugagcagagccccgcagagaagaaacggcggugcagcacacaaagauaccauuuacggacaaccagagaaauuaaagaaaaauggaucagucucacaaaaagucgccuuagcuucuuuagcacuaaaagacauagacuuacuagcugauccacacagaaacgcaaaacucuacggcgcgauaagagaaagauuggaagcccaugggggaaaaggggacaaagcguuuccugcaacaaauccucuaagaaaaccugauaaagaaggcaaucccaccggaccaauaguaaggaccguaacaaaagucauugauaaacuaucuggcauaccgguaagagggggaauugcuaaaaaugacacuaugcucaggguagacguuuucacaaaagccggaagauuucaccuaguaccaguauauguacaucaccgaguaacaggacuaccaaaucaagcaauuacccgagguaaagaugaaaaucaaugggcaauaauugaugauacauuugaauggagauuuagcuuauauccaaaugauuuaguucaaauaagacuuaaagacgaaacgcaccuagguuacuacgcaucaacggaccgaaguaccagcaguauaagcauuugggcacacgaucgaaaucaaagcgucggaaaagauggauuaauuagaucgauuggugugacaacugcaaaagauauagagaaauuucauguagauacacuuggcaauguauauccagccccaccagagaaaaggagagggcuugcuuga

SEQ ID NO: 8395 - RNA, 3066 nt, Artificial Sequence
  Cas9 variant
augagaagaagaagagauagauuuaaacagagacaagcagcuuugcuaaagcaucuagcuggugucggacuauuuccugcagaugaagcagccagaagggaacuggccggacuagauccauaugaauuaagggccagggcauuacacgaagcacuaccacuaaaccauauagguagagcccuauuucaucuaaaucaaagaagaggauucaagucaaauagaaagacagacagaggaaaggcagaugacgaagguaaaauuagacuagguguggcuaggcuacaagaagcaaugcacgaaaaagguagcgcaacgcuuggagaauuucuacaugggagacgagcugcagcaacagacccaaaucaaaucccaagugucagaacccgauuaagagcagaaaguggagaaggagcaagaggagauggauacgauuuuuauccagauagaagaaugcuugaggacgaauuugaagcaauaugggagagccaacagguucaucauccugcuguacuaacugaugaaauaaaacagcgauucuuugaaguuauuuucuaucaacguccgcucaaacaaccugaaauagguacauguacucuaguagcaggagaaagaagacuaccgaaggcucauccucuuuuucagaaaagaagacuauuggaagaacugaacgcacuaagaauuguauggccaggaguacaagcagaacuacuaagcagagaacaaagagauuuagcguaccuaaaacuuaaagauaaaagagcuguccguuuugagaguuugagaaaagcauuaaaauuggaucccgaugcaagauuuaauaaagaaucagaaaauagaagcgaauugaaaggugaugaaguagcugcagaauuaggugcaaaaucgagauucggagggagauggggacauacagcgccggcugaucagugggaaauuguaucgcguauucaagccuuggaaagugacgaugacgaagcucaauuuuguguaugguuaagugaaagauauggacucgacagcgaacaggcaagagcgguagcagccgcuagauuaccucagggauuugguagauuugggcuaacugcuacuacgaggcuuauaaaggcguuacaagaugaaguaaucguuuacagugaagcaguacagaaaacaggauuagggcaccauagugauuucagaaauggugaaguuuuagcggaguuaccauauuauggaaucgcacuagagagacauauaaugccaggaacaggggauccaggugauagugaugaaaugagaguagguagaguaaccaacccaacuguucacauaggacuaaaucaacuuaggaggguugucaaucgucuaauaaaacguuaugguccaccacgccaaaucgcaguagaacuugcuagagaauuaaaauuagaugaccaacacaaaagagaaauaaauggacgaaacagacaaaauagagaggcggcagaaagaagaucucaaaaguuagucgacauuggaauagcggacaaaggagcaaauagagcauuacuaaaauugugggaagaacuaaauccggacaacgcucuugauagacgaugcgucuauacgggucggcagauaaguauagaaaugcuauuuucuggggcaguugaaguagaucacauauuaccguuugcggcuacauuagaugauucaaaugcaaauaaguuguuaugucuuagagaagcuaacagaaacaaacgaaggagaucaccuuuugaagcauuugggcaaggggcagauugggaagaaauagcagcucgggcagcaagauuaccucgggagaaaagauggagauuugaaccugaugcaauggcgagauuugauacagaagaaaaauucuuagcaagacaacuuguagacacucaguaucuuucaagacuagccagagaauacuugggcguauuguuuccagauaaaggugaaggaucaggucgagucugggugaguccaggaaggcugacggaaauguuaagaagaaguuggggacugaaucaucuauuaccggaccauaaccuuggcggaggagcggaucaaccuaaaaauagaagggaccauagacaccaugcgauagaugcaaucguaguggcuguaacggauagacauuuauuacaagcaauugcaagagaagccggacaaaggggacaugaagcggcuaaucgaaugacagcagauuuaccaguuccauggccugacuucgaucgggauguagggcagguaauaagacaaguugucguaucacaucgagcugaccaugggaccguauccaaagcaggcgcagcaaaagggcaagauucaacugcaggacgauugcauaacgacacagcuuauggguuaacaggucaaacugaugaaaaaggaaauacaauuguagugagaaggguaccauugacagcauuaaagaaaccaacaaguauagaagcaguuagagaugaugagcuaaggaaagcauuaucaguauggacgagaggauaugaugggaaggccuucgaagcaagguuaaguagguuuccggaauuagguccacugcaguuccgaggcauuaggcgcguacgagugguagaaccacugacaguaauaccuauaagagauaguaguggaagaguauacaagggauauaaaggugacagcaauuacagauacgauguaugggaguuaaaagauggaaaauggguagccgaaguugugaguauguuugaugcacaucaaucuaguuggacaagcccaguaagaagagaaaaucccacagcaaggaaagugcuuagcuuacaacaaaaugauauaguagcaauagaaccggaagguaaagagagagaacuuaugagaguagcacaacugcgacaggguggacaaauaacacuagcggccugucaugaagcaggagaucugaaaagacgcgaugcagaaaguaaugaaguagauccauuuaaauauuucaguccgaccgcugggggccuaaaaagaguaagagcacgacaagugagaguagaugagcuaggaagaguauuggauccgggcagucgugauagagaaagaggagcggcguga

SEQ ID NO: 8396 - RNA, 3066 nt, Artificial Sequence
  Cas9 variant
augaaauacacacucggccuagacguaggaauagcaucuguaggaugggccguaaucgacaaagauaacaauaaaauaauagauuuagguguaagauguuucgacaaagcagaagaaucaaaaaccggagaaucucuagcuacugccagaagaauagcccgaggaaugagaagaagaauuucacguagaucacaaaggcuaagauuaguaaagaaacuauuuguacaauacgaaauaaucaaagacuccuccgaauuuaacagaauuuuugacacuucaagagacggauggaaagauccaugggaacucagauacaaugcgcuuucacgaauauuaaaaccuuacgaguuaguucaaguacucacacacauaacaaaacgcagaggguucaaaucaaaccgaaaagaagaccucaguaccacaaaagaaggaguaguaauaaccucaauuaaaaacaacucagaaaugcuaagaacuaaaaacuaccgaacaauaggagaaaugauauucauggaaacaccagaaaacucaaacaaaaggaacaaaguagacgaauauauacauacaauagcuagagaagauuuacuaaacgaaauaaaauacauauucagcauacaaagaaaacuugguucaccguucguaacugaaaaauuagaacaugacuuccuuaacaucugggaguuccaaagaccuuuugcaaguggagacucuauauuaaguaaaguaggaaaaugcacuuuauuaaaagaagaacuaagagcuccuacuucauguuacaccucagaauauuucggccuucuucaaucaauaaacaaucuaguauuaguagaagacaauaacacauuaacacuaaacaaugaucaacgcgcaaaaauaauugaauaugcccacuuuaaaaaugaaauaaaauacagugaaauaagaaaauugcuggacauagaaccagaaauccuauucaaagcacacaauuuaacccacaaaaauccgagcgguaauaacgaauccaagaaauucuacgaaaugaaaagcuaccacaaauuaaaaucaacacuaccaacggauauauggggaaaacuucacagcaacaaagaaucucuagacaauuuauuuuacugucucacgguauacaaaaacgauaaugaaauaaaagacuaucuacaagcuaauaauuuagacuaucucauagaauacaucgcaaaauuaccaacauucaacaaauuuaaacauuugucuuuaguagcuaugaaaagaauaauaccuuucauggaaaaaggauacaaauauagugaugccugcaacauggcagaacuagauuucacaggaaguucaaaauuagagaaaugcaauaaacugacgguugaaccaaucauagaaaacguaacaaauccagucguaaucagggcauuaacacaagcacguaaagucauaaacgcaaucauacaaaaauauggacuaccauacauggugaacauagaacuggcaagagaagcaggaaugacaagacaagaccgagacaacuuaaagaaagaacacgaaaauaacagaaaagccagagagaaaauaucggacuuaauucgacaaaacggcagaguagcaucagguuuagauauccuaaaauggcgacuuugggaagaucagggcggccgaugugcuuauucggggaaaccaauacccgucugugauuuauuaaacgauucacuaacccaaauugaccacauauaccccuacagcagaucaauggaugacucauacaugaacaaaguucuagucuuaacugaugaaaaccaaaauaaaagaagcuacacacccuaugaaguauggggcucaaccgaaaaaugggaagauuuugaagcgagaauauauucaaugcaccuaccacaaucuaaagagaaaagauuacucaaccguaauuucauuacuaaagacuuagacucauucauaagccgaaacuuaaaugacacaagguacauaagcagauuccuaaagaacuauaucgaauccuaccuccaauuuucaaaugacucacccaaaucauguguaguaugcguaaacggacaauguacagcccaacuaagaucgcgauggggacuaaacaagaacagagaagaaucagaccuacaucacgcacuagacgcagcuguaaucgcaugcgcggauaggaaaauaauaaaggaaauaacuaauuauuauaacgaacgagaaaaucauaacuacaaaguaaaguacccacuacccuggcauaguuuuagacaagaucuaauggaaacacuugcgggcguauucauaaguagggcuccaagaagaaaaaucacaggaccagcccaugaugaaaccauaagauccccuaaacauuucaacaaaggacuuacaagugugaaaauaccacucacuacagugacucuagaaaaauuagaaacaauggucaaaaacacaaagggaggcauuucagauaaagccguuuacaauguauuaaagaaccgcuuaauagaacauaacaacaaaccauuaaaggcuuucgccgagaaaauauacaaaccucuuaaaaaugggacaaauggagcaauaauacguucaauaagaguagaaacaccaaguuacacaggaguauuuaggaaugaagggaaaggcauuagcgacaauaguuuaaugguucgaguugacgucuuuaaaaagaaagacaaauacuauuuagucccaaucuacgucgcucacaugauaaagaaagaacuaccaagcaaagcuauuguacccuuaaaaccagaaucccaaugggaacuaauagacucuacgcacgaauuucuguucucucuauaccaaaaugacuaccuagucauaaaaaccaagaaaggcauaacagagggauauuaccgauccugccacagaggcacaggaucccuaagccuuaugccucauuucgcaaauaacaaaaacguaaaaauugacauuggcguuaggacagcaauauccauagaaaaauacaauguagauauccuaggaaauaaaucaauugugaaaggagaaccaagacgaggaauggaaaaauacaauucauucaaaagcaauuga

SEQ ID NO: 8397 - RNA, 3072 nt, Artificial Sequence
  Cas9 variant
augaaaauccugggauucgacauaggaguugcuucaauaggaugggcauuuguagaaggugacgaaauacgagauugugguguacgaauauucaccaaagcggaaaauccuaaaacaggcgaaucacuagcccuaccaagaagagaagcccgagguguuagaaggagauuagcgaggcgaagaguuagauuaaacacaauuaagaaaauaauuuguaaagaauuugacuuaagauuaagcgacuauauagcagacgauggagaauuaccaaaagccuaccaaaccaauaaagauaccaaaucgccauacgaauuaagauauaaagcucuaaaugaaagacuaagcaaagaagaacuagcuagagucauacuacacaucgcaaaacacagagguuauggaaacaaacaugcaaaagacggagacgacaaagacaguggaaaagucaagaaagcaauaggagaaaacaaaacgcuauuagagcaaaaaggauacgaaucaguaggugaauauugcuucagggaauuuuucaaaaguauaaaagauaaagauggagaaacacacaauauaccaagccaaaauauuagaaauaagaaagguaacuacgauagaugcgucucacaaaaacaauuagaagacgaacuaaaauuaauauuugcgaaacaaagaaaacuaggauucaacaaagaguucgaagacgcgauccuagaaguggcauuuuaucaaagaccgcuaaaagacuucgacgacaaaauaggagacugcauauucuuugacaacgagaaaagagccccaaaagaaucaauaagugccauagaauuuguggcauuaacccgaauuauuaauaccuuaaaauaccuaaguaaaacaaccggagaaguauacgaaaaagaaaucaucaauaaaauauggcaaaagauacuugaaaauggaaaaaugacauacgcugaacuucgcaaaauauuagcgcuugauagcagcguauucuucaaagacaaagauuuagauuauacauuaggcauaaaagaagcugagaaaauaaaauucauagaguucaagaaacuaaucaaauucaagaaagcacuaggaaguuucgacggacugucacgagaaauucuagacaauauagcaaugcaaauagcaauaacaaaagacagacaaagacuauuagaaaaacuugaaguuuuuccauuaaauaaagaacaaaaagaaaaucucucgcaacuaaacuuuucaaaauacauagacuuaucauuaaaagcccuaaaccaaauauuaccauuuaugcgugaaggucgaagguaugacgaagcaaaagacgacgcaaaacuacaagaaaaagccaaaaacacaaagaaagaagaguuccuuccuccacugaaagaguucgacuuaaaccuaacaaacccuguaguagcaagagcguuagcugaauuuagaaaaguacuaaaugcuuuauuaaagaaauacggaaaaguacauaaaauacaccuagaguucgcacgagacaugagauuagacuuugaugaaagggaaagauuaauaagcauccaaaaugacaauuucaacaaacgccaauuagcagaagauuucuguaaagaacacggccuagaaccaaguaacgccaacauacuuaaaauuaaauuauggcaagaacaacaauggcauugcauguauagcggagaauuaauaggcauaccagacuuaaaagauccuacuaaacuccaaguugaccauauauacccguacagcagaucauuugacgacaguuacacgaacaaaguccuaguaagagcagaauggaaccaagaaaaaggaaaccauaccccauucgaagcauucggaggcgauaaaaauaaaugggauaaaauagucgcccuugcagaaaaauuaccuccaaguaagaaauugaauagauccgagaaaucaaagaaagauaaacuuuuagaugagaaauucaacgauaaagaacuaggauuuuuagcaagaaacaucguagacacgggauacauagcacgucuaguagccaaauauauagauauguacuuagaauuucuacccuuagaagaaaaugagaacacaucauuggccagaggagaaaaaggaaguaagaaacacauaggaauagucaauggacgucuaacaagcgagguaagacacaauuggggucucgacccuaaagaccgcgacaaccaccuccaucaugcuauugaugcaauuguaauugcauacaugaaugauaaacgcauuaaagcguuugcagauuucagaagacucaaagaacuaaaaauaaaacgauacgguagagaaauuacagaagaugaauaccaagaaaagaagaaagaacugucaugugcaccauuugacgacuucagaaauagaacccuagaaaacauagauaaaauauucgucagccguccuccaaggaaaagagcaagggggacucuacacgaagagacauucuacagcauagaugacaagaaacuucuaaaagcauauggaggaaaagaagguaugcaaagagcucuaucgcuagguaaaauaagacaaauaggcacaaaaauagucaaaaacggaacaaugguaaggguagacauuuuuaaagacaaacguggaagauuuuacggaguaccaauauauaccauggauuucgcucucggaguauuaccgaauaaagcugcaguuucgggaaaagacaaaaauggacuaauaaaagaaugggcugagauggauaguggauacgaguucugcuucucacuauucaaagacgaccugauacuuguacaacgaaaagaaaugcaagaaccagaacuauguuacuuuguaaguuuugauucaagcaacgcccaaauugauguuagaucccacaauaaccacuuuucaguauuaaacgaaaaccaaaaauuacuauucaaaagugcaacacaagcugaaguuauaggagaaagcauuggaauacaaaaucuaaaaguauuugaaaaauggcacguaagcccacugggagaaguuaggaaagccgaauuuucaccacgaggugaagcaaaacuaaagacaaguaagaaacgaaagaaauga

SEQ ID NO: 8398 - RNA, 3072 nt, Artificial Sequence
  Cas9 variant
augaaaauauacucauuugauauaggagucgcaucaauaggaugggcuuucauagaaaacgaaguacuacaagauuguggcaucagaaucuucacgaaagcugaaaaucccaaaaauggagccucacuagcccuaccaaggcgagaagcacgagguguaagaaaaagguuagcgagaaggcguggaagauugaacacaaucaaacaacuacucugcaaagaauuuggauuacaacuagaggacuaccucucaaaugauggcgaauuaccaaaagcauauacagcaucaaaagcaaauccgcucaaaucaccuuaugaacuacgaaccuuagcucugagucaaaaacuagacucaaaagaucuaguuagagucauacuacauauugcaaaacacagaggcuacggaaacaaacaugccaaagauuccaaagacacagagagcggaaaaguaaagaaagcaauugaguucaauagaaaaacucuagccgaaaaaggauacagaagugucggcgaauaccuauaccgugaguucuuucaacaaucaagaauuucccaaaacaacggagcaacagaauuuauuaacguaagaaacaaagcaggcaauuaugaacacugcgucgcccaagauaugcuaaaagaagaacucgaaucaauacucaacgcacaaagacaauuuggguuuaguuuaaaacaggauuuugaguccaaacuucuaacuaaaaucuucgaacaacggccgcucaaaucuuucgccgauaaaguaggaaacuguuguuucauugcaggagagaaaagagcaccaaaagauagccccagcgcaaucgaguucaucgccuuaucuagaacaauuaacacauuaaucaaccugucaaaagaaaguggagaaauauacaacagagcaauaauauuacaaauaguagaaucaacuuuaaagaaaggugaaauaucauauaaagaauuaagggaaaucauaagacuugacgaacgcuugagguuuaaagacccaagauuagacuacaguagagaaaucaaagaagcagaaaaagugaaauuucuggaauuuaaacaacuaaaaggauucaagaaagcucuaggagagagcuuuacaacacuagcuauaagccaacuagacgaaauugcagaacacauagcuuuaaucaaagacagagugaaacuaaaugaaaaacuugaaucuuacgcccugaccaaagaacagagagaagcccucucuaaucugaguuuuucugcacauauuaaccugagcuuacaagcauuaaaacaaauacuacccuucaugagaggcgauaauggagaacaaugucuagauuacgacgaaagcguugaaaaagcaggacuaaaagcacuauccaaagacacacuaaaaggacagauguuaccaccacugaaugaauuugaaccauaucuuucaaacccaguaguagcaagagcauuagcugaauauagaaaagucuugaacguacuccuaaaacaauacgggagcccacauaaaauucauauagaauaugcgcgcgaagcgaaauuaagcuccacagaaagacaaaaauaugaaaaagaacaaaaagacaacuacgcagcaaaucaagcagcacacaagaaaugucaagaacuaggacuagaaccuaguucaacuaaccucuuaaaacuaaaauuauggcaagaacaaggaggacugugcuuauacucgggagcaaaaauaacaauauccuaucuacaagauccgacagcccuucagguagaucacauauacccauauagccgcucuuucgaugacucauacaugaacaaaugccuaguauuaaccaaagccaaucaagaaaaagguaacagaacaccuuucgaagcauucggcacagauucagcaaaauggggagugauaacaacucuagcacaaaaacuaccccauaagaaacgaagaagaauacuaaauacagcuuucaacgauaaagaagcuggguuuaaacuucggaacuuaaacgacaccucauauauagcaagauuaguagcagauuacacagaaacuuaccuagaguuccuuccauuaguagaauccgaaaacacaacacuaucaaaaggacaaaaaggauccaagaaacacauagcaauagugaacgguguacugacuucaacuaugcgguacuaucucggguucgccuccaaagauagagacaaccacuuacaccacgcucuggaugcagucauuauuggauucaugaacgacaguguaauaaaagccuucucagacuuuaagaaaacccaagaaacaagcaaagccgcauauuaugcacacacauuaucaaaacaagaauacaagaaacagcgagccuuuauacaauuacccucuggugaaaauuuuagaguaucaguauuagaaaaagucgaaaguguuuucguaucaaaaccaccccgcaaaagaguacgaggagcauuacaugaagcaacauuuuauaguccaaaugaccccaaacugcugaaaaauuauggagguacaaaaggagucgaaagagcccuagcucuugguaaaaugagaaaaguaggggcaaaaauaguauccaacggagcaaugguacgcguugauauauucaggcauaaaucuucuggaaaauucuacggcguuccuguuuacacaauggauuucgcucuuggcaucuuaccaaacaaagcuguagucgucgguaaagaccaaaaugguguuauaaaagacugguuagagauggacagcuccuaugaauuuauauucucacuauauaaagacgacguaauauuaguacaaaagaaagaaaugcaaagaccagaacuauguuacuuugucagcuuugauaccucaggagcaucaauaaaaguugcaaaacaugacaauaacuuuucaacucuaacagaaaaucaaaaacugcuauuuucuaacgccacaaaagaagaagucguuggaaaaagcauagguauacaaaacuuaaaaguuuucgaaaaauggcaaguaucaguacuaggugaagugaaaagaacccaaaguuacccaagagaaaauauuagccuugcaagcaaagccaagaaauga

SEQ ID NO: 8399 - RNA, 3075 nt, Artificial Sequence
  Cas9 variant
augauaagaacacuagguaucgacauaggaauagccucaauagguugggcaguaauagaaggagaauacacugacaaaggucuagaaaauaaagaaauaguggcaucgggaguaagaguuuuuacuaaagcggaaaacccaaagaacaaagaaagccuagccuuaccaagaacgcuagcgcgaucugcuagacgacgaaacgcaagaaaaaaaggaagaauccaacaaguaaaacauuaucuaaguaaagcacugggacuagacuuagaguguuucguacaaggagagaaacucgcuacccucuuccaaacuucuaaagauuuuuugaguccuugggaguuaagagaaagagcauuguacagaguacuagauaaagaggaguuagcuagaguuauacuccacauagccaaacgaagaggauaugacgacauaacauacgguguugaagacaaugauagcgguaaaaucaaaaaagcaauagcagaaaauucuaaaagaaucaaagaggaacaauguaaaacuauuggagaaaugauguauaaacuauacuuccaaaagucacucaacgugcggaacaaaaaagaaaguuauaacagaugcguagguagauccgaauuacgagaagaacuaaaaacaauuuuccaaauccaacaagaacucaaaucuccauggguaaaugaggaacuaauauauaaacuccucggcaacccagaugcacagagcaaacaggaaagagaaggauuaauauuuuaucaacgaccacucaaagguuucggcgacaaaauaggaaaauguagccacaucaaaaaaggggaaaauucaccauaucgagcaugcaaacacgcacccuccgcagaagaauuuguagcauuaacaaaaaguauaaauuuucugaaaaacuuaacaaacagacauggacugugcuucagccaagaagacaugugcguauauuuagguaaaauacugcaagaagcacaaaaaaacgaaaaaggacucacauacucaaaacuaaaacuauuauuagacuuaccuagcgauuuugaauuucuaggcuuagacuauagugguaaaaaccccgaaaaagcaguauuccuuaguuuaccaucaacauucaaacuuaauaagaucacgcaagaucguaaaacucaagauaaaaucgcaaauauucuaggcgcuaacaaagauugggaagcaauacuaaaggaauuagaaucacuacaauugaguaaagaacaaauacagacaauaaaagaugccaaacuaaacuucaguaagcacaucaacuuaagccuagaagcauuauaccacuuacuaccucuaaugagagaaggaaaaagauaugaugaaggaguagaaauuuuacaggaaagaggcauauuuagcaaaccacagccaaaaaacaggcaauuauuaccaccacuaagcgaauuagccaaagaagaaagcuauuuugauauuccaaauccaguacuuagaagagcacuuagugaauuuagaaaaguaguuaacgcacuacuugaaaaauauggaggauuucauuauuuccauauugaauuaacacgagacguaugcaaggcaaaaucugcuagaaugcaacuugaaaaaauaaacaaaaaaaacaaaucagagaaugacgcagcgucacaacuuuuagaaguauuaggcuuaccgaacacauauaacaacagacuaaaauguaaguuauggaaacaacaagaagaauacugucuauauucaggcgaaaaaauaacaauugaccaccuuaaagaccaaagagcucuucaaaucgaucaugcauuuccauuaagcagaucauuagaugacagccagucaaacaaaguacuaugcuuaacaucaucaaaccaagaaaaaagcaauaaaacgccauaugaauggcuaggaagcgacgaaaaaaaaugggauauguacgugggacgaguauacagcaguaauuuuaguccaucgaaaaagcgcaaauuaacccagaaaaacuuuaaagaacguaacgaagaagauuucuuagcaagaaaucuaguugacaccggauauauaggccgaguuacuaaagaauauauaaaacauucacugaguuuuuugccucucccagacgguaaaaaagaacauauccggauaauaucagguagcaugaccaguacaaugagauccuucugggguguacaagaaaagaauagagaucaucaccuacaccacgcacaagaugcaauaauaauagcauguauagaaccuucaaugauccaaaaauauacaacguaccuaaaagauaaagaaacacacagacugaaaucgcaucaaaaagcccaaauacuaagagaaggggaccauaaacuaucacuuagauggccuaugucaaauuucaaagauaaaauacaggaaucuauacaaaacauaauaccuucucaccacguaucacauaaaguaaccggagaauugcaucaagaaacgguacgaacaaaagaauucuacuaccaagcuuucggcggagaagaaggaguaaaaaaagcuuuaaaauuuggcaagauacgagaaauaaaccaaggcauaguagacaacggagccaugguaagagucgacauauuuaaaucaaaggacaaaggaaaguuuuaugcuguuccuauauauacauacgauuuugcaauuggaaaacuaccaaacaaagcaauuguacaaggcaaaaaaaacggaauaauuaaagacuggcuagaaauggacgaaaacuacgaauuuugcuuuagccuauuuaaaaacgacugcauuaaaauucaaacaaaagaaaugcaagaagcaguacuagcgauauauaaaucaacaaacucagcaaaagcaacaauagaauuagaacauuuaagcaaauaugcacuaaaaaacgaagacgaagaaaaaauguucacagauacagacaaagagaaaaacaaaacaaugacacgcgaaagcugcggaauacaaggauuaaaaguauuccaaaaaguaaaacuaagcguccuuggugaaguguuagaacauaaaccaagaaauagacagaacaucgccuuaaagacgacaccuaaacacguuuga

SEQ ID NO: 8400 - RNA, 3078 nt, Artificial Sequence
  Cas9 variant
augggagguuauaugccucaacuaaugcgguaucgauuagcgcuugauaucgguucaacaaguauaggaugggcaaugauucgguuaagcaugcaaaaugaaccaauagcaauuauaagaaugggcguaagaauauuuuccgaugggaggaauccaaaagauggaucguccuuagcagucacaagacgcguagcaagacaaaugagacgaagaagagacaggcuguuaaaaagaaaaacaagacucuuaaaugcauuaguacagaaaaaguucuucccagaagaugcagaugcaagaaaagcgcucgucguccuaaaucccuaugaacuuagaaaagaaggacucuacagacaacuaucugggccagaguucggcagagcauuauuccacauaagucaaagaaggggauuucuaaguaauaggaaaacagauaagaaagauaacgauaguucuguuuuaaagaaagcuauugucgaucuaaggcaacaauuagaagucgaaaauugccaaacaaucggugaauggcuauuuaaacaacaacaaucuggaaaaucaguuagagccagacugcgcggaaaaacacaaaaggauaaagcguaugauuuuuauauagacagagcuaugauagcacaugaauuugacacacuauggguaucacaagcgaaauaugauccuuuauuguuuaaugaagaugcaagagcaaucuuaagagacauuuuauuauaccaacgaccacuuaaaccuguaaaacccggaagaugcacauuaauaccagaugaaucaagagcacccuuagcauuaccacuaacccaacaagcuagaauauaccaagaacuaaaucaccuacgcauaacaacuccugcccucggagcacaagcacuuacaguggcacaaagaaauacaauagcagcauuacuagaaaaaucugaugucaccuucguaaaaauagcaaaggcacuaggauuaacaaguacaacagaauuuaacuuacaagauaucaagagagacagacuaaaaggaaaugccacagccaucauacuagcaaggaaucaauauuucggcagaagauggcaugacuucaaugcagaccuacaaaaccuuauaguugauaagcuaguaaaugaagggucagagaccgcccugauagaauggcuaaaagccaacacugacguagaugaaucagcagcagaaagaguuucagguguaacauugccggaagguuaugguaguuuaucaguugcagcucuuaggagacuacuuccagcccuaaaagaagacguuguaguauauucugaagcgguaaaaagagcuggauucgauucucauucugcacuuucccuaaucgaacaaacaggagaacuuuaucaagaauuacccuacuauggagagguauuacaaagacauguaggauuuggaaguggagauccaaacgauaguccagaaagaagguuugggaaaauagcuaauccaacuguucacaucggauuaaaugaacuacgaaaaauaauaaaugcauuaauaaagagguacggaaacccagcugaaguaguaguugaauuagcaagagauuugaaauugaguagagaaaaacgcaaagaaauacaggaagaacaaaagcaacgacaagaucguaacgagaaaagaaucaaagaugcaugugaaauacuuggaauugauccacuuguaauagaccgugggaaaagaagagaaauaagccagaaaaugcaauuaugggaugaacuaaaccccaaagaugcagcuaauagacgaugccccuauacaggagaccaaaucucaauagaaaaacuucuaagcgcagaaguagaaauagaacacauacucccuuuuucaaaaaccuuggaugauucacuaaauaauaaaacaguugcaaugagacgagcaaacagagauaaaggaaaucgaaccccauaugaagcauuuggagaaucuuuaaacccagauuacgauuacgaugcuauucuacaaagagccagucuaaugccuagagagaaaaggaagcgauuugcauccgacggauaccaacaaugguuaagagaugacaaagacuuuuuaagcagagcacucaaugauacggcauacuuaucccgaaucgcuaaagaauaccuuacauuaauaugcccuccaaauucagucagagcaauaccaggcagaaugacugcacagcuaagagcuauguucggacucaaucgccuauugucagaagggggcauuaaaaauagagaagaucauagacaucacgcuauugacgccgcaguuaucggaguaacugaccagggauuguugcaaaaauuuaguagagcaucagcccgaacaagagaacugcaauuaaguagauuaguagacgauaugccucuaccgugggauacauauagagaacacguaacucgcgcauuagaacauuuaguaguuagucauaaaccagaccauggauaucaagguaaaaugcacgaagauacagccuggggacuaagggauaaugggcaaguaacuagaaggguaagaagcgaagacggaggaccaagacaaagauuacuagaaaacaaaaacguaguuaaaaucaauaguacacgagauuuuagccgacacggaauagaugaacaaggacagguaaacgcauacaaaggauacgucggaggaucaaacuacuguauugaaauauggaucgacgaaaagggaaaauggaacuccgauguaguuuccacauuucaagcauaccaaauagucagggaauuaggggaaaaagcagcuuggcaaaaauugagaaacccauuauugagucuuagcgcaaagccguuaguuaugagauuaauaauagacgaugugguaaaaaugcagauagccggucaaaacaaaauaaugagaguaguuaaaauugcacaaaauggacaaaucuucuuugcagaacacaaugaagcaaauguagacgcaagagacaaagauaaaaauaauccauuuaaauauauaagcaaaacagcagggaguuuacagaaggcgggagguauacauauggcaauaucuccaauuggagaugcgagaccaguuagauauggaagauga

SEQ ID NO: 8401 - RNA, 3084 nt, Artificial Sequence
  Cas9 variant
augaaauacacccuaggauuagauguaggcacaaacagcaucgguugggcagugcuugaguuaaacacaaauggagaaccacaaaggauugaaaaacuaggaucccgaauuuuuacagacggaagacacccaaaagacggaacaaccuuagcauccaaaagacgccaaaaacgacaugaaagacguagaagagauagacuacaccagagaaagaaauuagucuuaaaucaauuagucucaaugggacuauuuccacaaucagaacaagagcaacaagauuuaaaaucauuggauguauuaacauuaagggcaaauggaguaucuaaacaacuaucagcguacgaacuaggaagagucuucuacuaccuaaaccucaaacgaggauucaaaaguaacaggaaaggaggcagugaagaagacaaagcaaacaaaauaagcgaacguaucaagaaacuacaagaacaauuaaaagaaaaugauuucaaaaccgugggacaguaucuacaugauagauauauaaaaggacuaagcaccaaagccacgauagaaaacgacuuucacuuacucagacaauuaauugaagacgaguucgacuucauaguagaaacccaauccaaauucuucccagaaauaagcgaugaacaauggaacacacucagaaaucguauguuucaccaaagaccacucaaaccaguugaaacaggaaccugcagucuuuuugaagauaagaaacgaacauauaaauauaugccaucauuugaagaauaucgguuccuuacagaauuauuuaaucucaguuaccaagaugaaaacuuucacucacauuccuuaagcucagaacagauauucaaaguauuccaugaauuaaagaacaccagagaagcaacauauacaaaaauaaagaaauuacuaaaacuucccucugaucuaucauucucaauugaaagaaguaaaucaaaagacaaaauuaaaauuucuacaacaaaccacuucuucagcaaauccuuacuauucgccgaagaaugggcuucauuggaucucaaacucaaagacgaagucgccgaaauauacuucucagacaugagcguagaagaaaucaagaaaggccuacuacaauugaaaaucgacucugagauuauagaaaaccuacuagaagaaaaaguacccaauguacaagaagcuacaugcagcuacucaaaagaagcucuacagaaaauaguuagucucauacucgaagaagagagacauccaacacucauaguagaugaccucuucaaaaaugaaaaagaggaaacaaguuuaauagauaggcuagauuacuacggagcaagcaucccagacagcaugcaaccgauaccacaacauaucaaagauaauaauuuaacacuuaaugaagaugaaaaacgauaugggaaaauagcuaauccgacaguacaugcugcucuaaaucaaauaagacaaguuguaaaugauuuaauagaacaauacggaaaaccgacgaauauccacauagaguucgcgagagaucuaaagaaaagcaaagaagaacgagauuucgacaacagaaagaagaagaaaaacgaagaacucaacgaacaaguaagagauuucauagaaaaacacaaccaaaaaccgucagcauucaacuucgaaaggguuaaauuaugguucgaauuagacgccaugaauaaucagguuugugcauacaguggaaaaacuaucagcgcaagaaugguauuaucagaugaaguacagguagaccacauacuacccuucaguagaaccuuagacgauagucuagcaaauaaagucuuaguacuagcaucagagaacgucaagaaaagaaaucguacaccuuaugaggcuuucggacaagauacagaaaaaugggcaucaauacaagaacuggcaaaaagacuacccuaucacaaacaauggagauucgcggaagacgcuauaaagaaauucgaagaaaaagaccaauuucuacaaagacauuuaaacgacacacgauauauaucaaaaauagcaaagaaauaucuuggcaguauaaccgacccuuacaaaauaguagcaucccggggacaaaugacaucaaucauacgcggaaaacuaggauuaaaccaauucauucaaaaaccggauggcacuaaaaaucgagaagaccaucgacaucacgcaaucgacgcccucacaguugcacuaaccagcagauccuacuuaaaaaggaucagugacgcaucagcaaggaaccaagacccaaacaggauuccuaucccagaaccauggaaaggauuuauaaaagaugcggacguaaaauucaaugaaauaauaguaucacacaaaguagaucacgggaaaaacggaccauucauggaagaaacauguuucggucugaucaaaaauccaaacaaauaugaagaagaaaaugacuuuaaauugauaacaacaaaaagccucgauaguguaaaagaucccucuacaauaagaucacagagcuuacaaaaucuagcagaaaagagcggaguaauaucacuagccaaaucagguguaaagaaacuacgagucuacgacguaacaaaagaaaaccccgcagacauaggacuaauagaaagcggucucgcaaaaauaacccacggcaaagauaaacaacauguaaagcauuaucaaaaaggcgacauaaauuauuuagcaaucuggugucuaccgcaaaacauaacacuaaaaucagauaaccauaagaaaagaaaaacugauuauaucuucacagcgauaaaaacauucgaucuaaacaguaaaaacccaaacgaucugagaccccaccccgccgcaaaacugguuacaaaaguauacaaaggagacacaguagcacuagaagugaauaaccaacuaaacuacuauauaguaaaaucaauaagagcugcuaacaagaaacuauauuucuuaaaaauaaaucaaucaucugaauuagcaaacgaaacccaauucaucccugccuacacaaaauuaguagacuauaaauuuagaaaaguaucugucaguccaaccggaguuauaacagacaacggcccccuauuaaaauga

SEQ ID NO: 8402 - RNA, 3090 nt, Artificial Sequence
  Cas9 variant
augcgaagccuaagguauagacuagcucuagauuuaggaaguacgucacuaggaugggcauuguuucgauuagaugcuuguaauagaccaacagcagucauaaaagcuggaguaagaauuuucagugaugggaggaauccaaaagacgguuccucauuagcaguaacuagacgcgcugcucgugccaugcgaagaagacgggauagacuucuaaaaagaaaaacgcgaaugcaagcgaaauuaguagaacauggguucuuuccagccgaugcaggaaaaagaaaggcguuagaacaacuaaaucccuaugcgcuaagagcaaaaggguuacaagaagcccuccuacccggagaauuugcaagagcacuauuccauaucaaucagaggagagguuucaaaucuaauagaaaaacugauaagaaagacaacgauagcggaguauuaaagaaagcaauaggacaauuaagacaacaaauggcagaacaaggaagcagaacgguuggcgaauaccuauggacaagacuacaacaaggacaaggagugagggccagauaucgagagaaaccauacacgacagaagaagguaagaaacguaucgauaaaucuuaugaccuauauauagaucgagcuaugauagaacaagaguuugaugcacuuugggcggcucaagcagcauucaacccaacucuuuuucacgaagcagcgagagcugaccuuaaagacacguuauuacaucaaagaccccuucgaccggugaaacccgguagaugcacuuugcuaccagaagaagaaagagcuccccuagcacuaccaucaacgcaaagguuucgaauacaccaagaaguaaaccacuuaagacuacuagaugaaaauuuaagagaaguagcauuaacauuggcacagagagacgcaguuguaaccgcucucgaaacaaaagcaaaauuaucguuugaacagauuaggaaauuauugaaauuaaguggaagcguacaauucaaccucgaagaugcaaaaagaacagaauuaaaaggaaaugcgacaucagccgcacuugcgagaaaagaauuauuuggagcagccuggucaggauuugacgaagcguugcaagacgaaauaguguggcaguuaguaacggaagaaggggaaggagcacuuauagcauggcuacaaacccacacagguguagacgaagccagagcccaagccauagucgacguuaguuugccagaagguuacgguaaucuuagcagaaaagcacuagcaaggauaguaccugcauuaagagcagcaguaaucacuuacgacaaagcgguacaagcagcagguuucgaccaucauagucaauuaggauuugaauaugacgcaagugaagucgaagaccucguacauccugaaaccggugaaauaaggucgguauuuaaacaacugccuuauuauggaaaggcuuugcaaaggcacguagcauucggaaguggcaagccagaagauccagacgagaaaagauauggaaaaaucgccaaccccacaguacauauugggcuaaaccaaguaagaaugguuguaaacgcacuuauuagaagauacggaagaccaacagaagugguaaucgaauuagcgagggauuuaaagcaaucccgcgaacaaaagguugaagcucaaagaagacaggccgacaaccagagaagaaacgcacgaaucagaagaaguauagccgaaguacuuggaauuggagaagaaagaguaagaggaucagacauacaaaaauggauuuguugggaagaacuaucguucgaugcugcagauaggagguguccauauucuggaguacaaaucucagcagcaauguuacucucugacgaagucgaaguagaacauauccuuccuuuuagcaaaacguuagacgauucucucaauaaucggacagucgcaaugcgccaagcuaauagaauaaaacgcaacagaacgccuugggaugcaagggcagaauuugaagcacaaggguggucauaugaagauauucuucaaagagcagaaagaaugccacuaaggaaaagauauagauuugccccugaugguuaugaaagaugguugggagaugauaaagauuuucuugcuagagcucuaaacgauacaagauauuuaucuagaguagcagcggaauaucucagguugguauguccgggaacuaggguaauuccaggacaacuaacugcacuacuaagaggcaaguucggccuuaaugauguauuaggacuagacggggagaagaauagaaaugaccauagacaucaugcaguugaugccuguguaauaggaguaaccgaucagggucuaaugcaaagauuugcgacagcuagugcucaagcuagaggcgacggcuuaaccagacugguugacggaaugccuaugccauggcccaccuaucgugaccauguagaacgagcaguaaggcauauauggguuagucacaggcccgaucauggauuugaaggagcuaugauggaagaaacaucauaugggauuaggaaagauggaaguauaaaacaaagaagaaaagcugauggaagugcuggcagggaaauaagcaauuuaauaagaauacacgaagcaacacagccuuuaagacacggugucucagcagacgggcaaccauuagcauacaaaggauauguuggaggaagcaacuauugcauagaaauaacagugaaugacaaaggaaaaugggaaggcgaaguaauauccacauuuagagcuuacggaguagugcgugccggagggauggguagauuacgaaacccacacgagggccaaaaugggaggaaauuaauuaugagauuagugauaggagacucaguaagauuagagguggauggcgcugaaagaacaaugaggauuguuaaaauaucgggaucaaaugggcaaauauuuauggcacccauucacgaagccaauguagaugcccguaauacagauaaacaagacgccuucacauauaccucaaaguaugcaggaucauugcagaaagcaaaaacuagaaggguaacuauaagccccauuggcgaaguuagagacccgggauuuaaaggguga

SEQ ID NO: 8403 - RNA, 3090 nt, Artificial Sequence
  Cas9 variant
augaaauaucgacuggcacuagauuuagguaguacuucauuaggaugggcuauaguacaauuaaacgcaaaagaugaaccaugugcaauaguacgugcgggggugcgaauuuucccggauggacguaauccaaaagauggaagcuccuuagccguaaccagacguaaugcaagagccaugagaagaagacgagaccggcuucuaaaacguaaagcgagaaugcaacgacuuuuaauagaacaugauuuauuuccggcggaugaagcagcaagaaaggcuuuagaaaccuuaaacccauaugaauuaagagccaaaggguuggaugcggcacucacuccggcggaguucgcucgggcauuauuccauuuaaaccaaagacgcggauuuaaaucaaacagaagaacagaucguaaagauaacgacaguggagccuuaaaagcugcaauaggaggauuaagagcacaauuggauacagcgggagcagacgguagagcaagaaccguaggagaauuacuauggagacgaaugagcgauccgaauguauuaacaguaagagcaagauaccgagaacaaagaauaacuaaagaugauggaaaaacacgaguugacaaauccuaugaucuauacguggauagagcaaugguagaggcagaguucgaugcucugugggcaaagcaagcagaauuaagcccgacacaguuuggugaagcugcacgagcaacucuaaaagauugcuuacuccaccagcgcaaucuaagaccaguaagaccaggucguuguacucuagaaccagacgaaccacgugcuccccuagcgcucccgucacaacaaagauuuagaauuuugcaagaaguaaaucauuuacgucugcuuggagguagacuguuagaagaaucacugucaguagaacaaagagauaaacucguagccgcauuagaagauggauccaaaucauuuaaaacagccauaccuaagcuacuuggauuaccuggaacgguccaauuuaauuuagcugaugcuaaaaggacagaacuaaaagguaaugcaacaucaaugcuauuagguaagaaagacuuuuucgguccugccuggcauggauucuccgaagcacgucaggacgaaauaguaaugagaauccaagaagaggaaucagaagcuagauuaguagacugguuggcaacaucgacaggagucgaugaagcgcaugcuuugaaaauagcaaaugcugcauuaccugaaggauauggaucuuugagugccaaagcccuagcaaaaauucuaccagcaaugagagcggaaguaauaacguaugauaaagcggucuuagcugcaggauaugaucaccacucacacauaagucaugcugcuucuacaggagaaaucuuaccagagcugccauauuauggagaauaucuacaaagacauguuggauuuggcacaggagaacuaaaugauacuccggagaaaagauucggaagaauugccaauccuaccguacacauuggcuugaaucaaguccgaguaguaguaaaugcacuaauaaaaagguauggccacccaacagaaguuauaguugaaguagcaagagauuuaaaacagagucaagaccaaagaagagaaacacaggaacaacaagcuaaaaaucagaaaagaaaugaaagacugagaaaagaugcagcugcuauuuuaggaauugcagaugaacgaguaagacuagccgacauccaaaaacuaauacuuugggaagaauugaguuucgauauagcagacagaagauguccauauaguggcguccaacuaucugccgcuaugguauuaucggaacaaguagaaaucgaacauauauuacccuucaguaugacauuagaugauucucuaaauaauaaaacaguagcaaugcgauugguuaauagacuaaaaggcaauagaacaccuugggacgcacgagaagcauuugccgggcaaggcugggauuacgaugguauucuaaugagagcggaacgaaugccgagagcaaaacggcaacgauuugcaccagacggacuagagaaauggcucaaagaggauaaagauuuucucgcaagggcuuugaaugauacgcgacauuuaaguagaguagccagagaauauuugaguuugguaugucccgcuucuacaagaguuauaccgggacaaaugacagcaauguuaagagcgaaauuuggauuaaacgauauauuaggacuuaauggagagaaaaacagaaacgaucaucgucaccaugcuguagaugcauguguaguagcgguaacagaucaaggauuauuacaaagguuugcacaagccagugccgaugcuaggggaaaaggauuagauagauuaguagaaacaaugccagauccgugggacagcuaccgagaacacguacaaagggcagugaauaguauuuggguaucacacaaaccagaucacgguuuugaaggagcgaugcaugaagacacaacauacagacccccgcaccuagaucccaaaaauauguggagaacacgagguauaggaggugggaaaccaaacgaaaaagaagcagauagcaaagcaauggugggcuuuaccggaccugaacauuuacaacgccaccacagagacaaagccggacaacaacuuccauacaaagguuauguagcaagcccaaaauuuuguauggacaucguacgaaacgauaaaggccgaugggagggugaaguaguaagcacauuugaagcauacagauuaguaagugaguucggaagagacgcagcacuagcacauauccaauccaaaucaagaaguauuucgggaaaaccuuugguaaugagguugcaagguggagauauggucagauuugaugaugaugaagguaggccuguaguacuccgaguugucaauaugacugggaauggacaaaucuucuuugcgccacauaaugaagcuaauggggacgcaagaaauagggauaaacaagaucaauuuguauaccuuucuaaauacgcugguucacuacaaaaagcgagaggaagaaggguaaccguaaguccugccggggaauugcgugauccaggauuuaaagaauga

SEQ ID NO: 8404 - RNA, 3090 nt, Artificial Sequence
  Cas9 variant
augagaucccuaagauaccgauuagcguuagaccuaggaucaacaucuuuaggcugggcauuguuucgguuagaugcauguaaccgacccacagcagucauaaaagcggguguacggauauucagugaugguagaaacccgaaagauggaucuaguuuggcaguuacucgacgcgcagcacgagcaaugagaagaagaagagacagguuauuaaaacggaaaacgagaaugcaagcaaaacucguagaacauggauuuuucccagcugacgcugguaaaagaaaagcacucgaacagcuaaaucccuacgcccuaagagcuaaggguuuacaagaggcacuucuaccaggugaguucgcgagagcguuguuucauauaaaucaaaggcgagguuuuaagucaaauagaaaaacagacaagaaagacaaugauaguggggcucuaaagaaagcaauugggcaauuacgacaacaaauggcagaacaagguagcagaacaguuggagaauaucuauggacuagacuacagcaaggacagggagugagggccagauauagggaaaaaccguauacuacagaggaaggaaagaaaagaauugauaaaaguuacgaccuauacauugauagagcgaugauagaacaagaguuugaugcacuaugggcagcacaagcggcuuucaauccaacgcuguuucacgaggcagcgagagcagacuugaaagauacauuguuacaucaaagaccccuaagaccagugaaaccaggaagguguacauuauugccagaggaggaaagagcaccauuggcauuaccgucaacacaaagguucaggauacaucaagaagugaaccaucugcgacuauuagacgaaaaccucagagaaguugcacucacacuagcacaaagagaugcuguaguaacugcacuagaaacaaaagcaaaacuaaguuuugagcaaaucagaaaacuacuuaaauuaucaggaagugugcaauucaauuuagaagacgcaaaaagaacagaacuaaaaggaaacgcaacgucagcagccuuagccagaaaagaacuauuuggagcugcuuggaguggauuugaugaagcacuccaagacgagauaguauggcagcuaguaacagaagaaggagaaggugcacuaaucgcuugguuacaaacucacacaggugucgacgaggcgcgagcacaagcaauaguagauguaagucuaccagaaggauacggaaaucuaaguagaaaagcauuagcacgaauaguaccagcgcucagggcagcaguaauaacauaugacaaagccguacaagcggcaggauuugaccaccacucacaauugggauucgaguaugaugccucagaaguagaagacuuaguacacccagaaacaggagaaauaagaagcguauucaaacaacuaccauauuauggcaaagcguuacaaagacacguugcuuucgguaguggcaaaccagaagacccagaugaaaaacgauacggaaaaauagcaaaccccacuguacauaucggcuuaaaucaaguaaggauggucguaaaugcauugauucgaagauacgguagaccaacugagguaguaauagaacuagcuagagaucuuaaacaaucaagagagcaaaaaguagaagcccagcguagacaggcagauaaccaaagaagaaaugcuagaauuagaagaucaauagcggaaguccugggaauaggagaggaacgaguaagaggaagugauauacaaaaauggauaugcugggaggaauuaaguuuugacgcagcagauagacgauguccauauagcgguguacaaaucagcgcugcaauguuauuaagcgacgaaguagaaguagaacauauuuuacccuuuaguaaaacucuagaugacucccugaauaaccguacuguagcaaugagacaagcaaauagaauaaaacgaaacagaacaccaugggacgcaagggcagaguucgaagcucaaggguggucauaugaagauauacuacaaagggcagaaagaaugccacuuagaaaaagguaucgcuuugcgccggacggauacgaaagaugguuaggagacgauaaagauuuucuagcacgagcccuaaaugauacacgauaucuaagcagaguagcagccgaauaucuacgacucguaugucccgguacaagaguaauaccaggacaguuaacggcucuauuaagaggcaaauuuggacuaaacgacguauuaggacucgacggugagaaaaaucgaaacgaccauagacaccacgcgguagaugcaugcguuauaggaguaaccgaucaaggcuuaaugcaaagauucgccacagcuucagcacaagcacgaggagacggauuaacgagauuaguugacggaaugccaaugcccuggccaacuuaccgagaccacgucgaaagagccgucagacacauuugggucucucaccgcccagaccauggauuugaaggagcaaugauggaagaaacgagcuauggcauacgaaaagacggaucaauuaaacaaagaagaaaagcagauggaagcgcaggaagagaaauaucuaaucuuauaagaauacaugaagcuacucaaccuuuaagacauggagugucagcagauggucaaccucuagcauauaaaggauauguaggcggaaguaauuauuguauugaaauaacaguuaacgauaaaggaaaaugggagggugaagucauuaguacguuucgagcuuauggaauaguuagagccgguggaauggggagacuccggaacccucaugaagggcaaaaugggagaaaauuaauaaugaggcuuguaauaggagacucggucagacuagaaguagacggugcagaacgaacaaugagaaucguaaaaauaagcggaaguaacggucaaauauucauggcaccaauacacgaagcaaacguagaugcucgcaacacugacaaacaagaugcauuuacguacacaucaaaauaugcaggaucuuugcaaaaagcuaaaacaaggagaguaacaaucucaccuauuggagaaguacgagacccaggauuuaaaggguga

SEQ ID NO: 8405 - RNA, 3096 nt, Artificial Sequence
  Cas9 variant
augccagcaauauauagacuagcauuagaucuuggaagcacaucgcucggaugggcaguauuacgacuagaaccugcggcucuagaaccgaucgcaauuaucaaagcggguguacgaaucuuuucagauggccgcaaucccaaagacggagccagccuagccguuacaagaagggcagcaagggcaaugagaagacgccgugauagauuacuaaaaagaaaagcuagaaugcaagauaaauuaguaaaacauggauucuuuccuucagacauggacgaacgcaaagcauuggaaaggcuagacccauaugcacuucgugcaaaaggucuaagagaggcuuuaacuccaggggaguuugccagagcacucuuucauauaaaucaaagacgaggguucaaaucaaauaggaaaacagauaagaaagauaaugauagcggcgcgcuaaagaaagcaauuucacaccuaagacaacagauggaagcugggggucacagaacuguaggagaucaucucuggaguagacuccagcaaggauugggaguaagagcgcgauacagagaaacacccuuuacgaaugaugagggaaagaaaagaauugacaaaagcuaugauuuauacauagauagagcaaugaucgagcaggaguucgaugcauuaugggcagcacaagcagcauuuaauccggcccuguuucacgaaguagcaagagcagauuuaaaagauacuuuauuacaccaacggcgacuuagaccaguaaaaccuggcagauguacccuauuaccugaagaagaacgugcacccuuagcccuaccaucaacacaaagguuucgaauuuaucaggaaguaaaucauuuacgacuauuaggugaagauuuaagagaaguagcucuuacucuagcacaaagggaugcaguggcaaacgcucuagaaucaaaagcccguuuaacauuugaacaaauaagaaaauuacuaaaacugucaggaaguguucaauucaaucuagaagaugcaaaaagaaccgaauuaaaaggaaacgccacaagugcugcguuagcacgaaaagaauuauuuggagcagcgugggguggguucggagaagccuuacaagaugaaauaguauggcagcuaguaacagaagaaggagaaggugcauugauagcaugguuacaagcccauacugguguagaugaagcaagagcacaagcaauagcagaugcaucacuaccagaaggguacggaucauuaaguagaaaagcucuugcuagaauaguaccugcgcuccgagcaggagugguaacauacgauaaagcggugcaagcugcagguuuugaucaccacucgcaacuagguuucgaauacgacgcgggagaaguagaagauuggguucauccagauacaggagaaauaagaccaguguuuaaacaacucccauauuauggaaaaccucuacaaaggcauguagcauuuggaucagguaaaccagaagauccagaugaaagacgguauggaaaaauagcaaacccaacaguacauauagguuuaaaucagguaaggacaguagucaaugcccuaauaagaagauauggaagaccaacagagguaguaauagaacucgcaagagaucuaaaacaaaguagagagcagaaaguagaagcccaaagaaaacaggcagaaaaccaaagacgaaaugcaaggauuagaaaaucaauugcagagguauuagguauaggagaagaacaaguuagaggugcagauauacaaaaauggauauguugggaagaacuuuccuucgacguagcugaaagaagauguccauacucaggaguucaaauaagcgcaaggauguuauuaagcgaugaaguagaaguagaacacauauuaccauuuucuaaaacauuagacgacagcuuaaauaaucgaacuguugcaaugagacaagcaaauagaauaaaaagaaauagaacaccuuggacagcaagagaugauuucgaagcacaaggcuggaguuacgaaggcauacuacaaagagcggaaagaaugccccuaagaaaacgauaucgauuugcuccugaugguuacgaacgaugguuaggcgaugacaaagauuucuuagcaagagcuuuaaacgauacucgauauuuaucaagaguagcagcagaauaucuucguuuaguaugcccgggaaguggcacaagggugauuccuggacaaaugacugcaagguuaagaggaaaauuugguuuaaacggaguauuaggaccagauggagagaaaaacaggaaugaucauagacaucaugcaguagaugcauguguuauaggagucacagaccaagguuuaaugcaaagauuugcgaacgcaagugcacaagcccgagaagauggccuaacgagauuaguagacgauaugccgaggccauggccuacuuauagagcacacguagaaagagccguaaggcauauauggguaagucaucgaccagaucauggauuugaaggugcaaugauggaagaaacaucauauggaauaggaaaggacgggucgaucaaacaacguagaaaagccgauggaucaccaggaagagaaauuacuaacuuaauucguauucacgaagcgacucaaccgcagagacauggugcuggaccagacggacaaccacuaccauacaaagguuauguaggagguagcaauuacuguauugaaauaacuaggaaugacaagggaaagugggaaggagaaguuauaaguacuuucagagcguacggaauagugcgaacaagugggcuugggcaacuaagacauccgagaguaggacaaaauggaagggaauuaguuaugaggcuaguaauuggugauaguguaagauuagaaauugauggaauagaaagaacaaugaggauagugaaaauaucaggaaguaacggacaaaucuucauggcaccaauacacgaagcgaauguggaugcaagaaacagugauaaacaagacgcuuuugcauauacaucaaaauacgcagguaguuuacagaaaacaaaagcaagauucguaacaauuucacccauaggagaaguaagagaucuuggauucaaaggcuga

SEQ ID NO: 8406 - RNA, 3099 nt, Artificial Sequence
  Cas9 variant
augaagaaaagaauauuaggccuggacaucggaauugcaagcguaggcugggccuuaguagaguucgacgacgaguuccaagauaacaaaaagaaaggaacaaucauuaaaaguggagucagaauauuuacgagagcagaaacaccgaaagaaagagaaagucuagcaaaaccacgacgcgaagccagaagccaacgaagacgaauacguagaaggguggaaagauuaaacaguauaagagaacuauuugugaaaaacggaguaguagaagaauggagcguaucuaagaaaaacccaaacaacauauacauaacacuaaaccaaauaaaaacaccuuggcaauuaagaauggaaucacuagauagaaaauuaacaaacgaacaauuugcaguaguccuaacacacuuagcaaaacacagaggauauaaaucauuaagaaaagaugacaaagcaggaaaaguacuagaagcaauaagccaaaacaagaaacgauugaacgacagcgacuaucgaacauuaggagaaauguucugcaaaaaugaaaguuauaaagaacauaaacgaaauaaaggaggagaauauauuaacaguguagcacgagaauuaauugaagaagaagucgagaaaauuuucgucaaacaaagagaaaaagguaauaacuuugccgaugucaauacagaaagagaauaccuaaagauagccuucucacagaaaccugcgggaucaauaaguaaaaugguaggcuuuugcacuuuugaaaacggagagaaaagagcaccuagggauucauacagcgccgaauuauuuaaaguacuuugcacaauaaacaacacaacuuuuacugacaugaaaacgggagaaaucagaucuuucuccaaagaagaaauaggaaaaaccuuagaaacagucaaaaacguaaaagauguaaaauacgcaaaaauaagaaaagaucuaggcuuagaagacucaguuaaauucaguggagucgauuacagggaaaacgcaaaaucaaaaggagaaggagaaauauucguuaguaugaaaacauaccacgaaauaaaaaguaaaauagaaaaacuauccaaagaaaaaugggauaaccugaaagguaacacugaauuguuagacuccauagugaacaucauugcaaaucuuaaagacgacgagagcauuaagaaagaguuccagaaacuaaaaauugacgaagauauaauagacguauuauuaaacuucgaauuuaagaaauucauaaaccuaucguuuaaagcacuacgaaaaaucauacccuuucaauuccaaggccaaaaauacauuaccgcuucaacaucagcaggauacagccuuaaacaagaaggaauaaagaauaagcuaguaccuccagccaaagaaaauauuaauguagcggucguagcaagagcauuugcgcaaacaagaaaaguaauuaacgccgucauacgaaaauacggacaauucgaccaaaucaacauagaacuagcuacugaacugaaaaacucaaaauucgauagaagcaagaucgaagaagggcagaagaaauuucaaucccaaaaagacaaaaucuuuaaagaaguacaagaacuaagaggaggaaugacacccagcucaagucuacuauuaaaauaccgcuuauggagagaacaagaugaacgcugcguauacagcgggagaaaaauuagcuucgaggauuuacuagauacagguuuccucgacauagaccauauuaucccauauaguaaauccauggaugacagcuuuaauaauaaagugcuauguuuggcugaagagaaucguaauaagaaaaacgacauuccauuuaacuacuaccaaaggauagauagggauuggaacuuauuaauauccauaaucacaaguaugaaaaacaugaaaauugcgaagaaaagcagacuucucaaacaagaacuaucugacauagaaggauucauagaaagaaacauaaaugacacuagauaugcaacucgauacauuaaagacuuccuagaaaacaauuuagaguucaaagaaaaugaauuuauuaaaguaaaaguacaagcaaggaguggcggacugacauccgucuuaucauacaacuggggaaugagcaaagauagagaagaaucguauuuccaccaugcaaaagacgcuaucaucguggcauguucaacgcaagguaugguacaauacauaucaaaaauaucacaacaauacgaaaacgacaaagacaaaaugaagaaaauaaaagacaaaacugaaaacugcauaccaaaaccuugggauuccuucagggcagauguggaagaaaguauagaaggaauauucgucucauucgcaccaagacauaaaguaacagguucagcacauaaagaaacaauauauagcaagaaacacuuagaaaaagaaagauauguaacugucaagaaaucgcucgacaaaauaaaacucucagauuuagaaaacauaccgugcaaugaaaauugugguauaauaagaguacuaaaagaaagauuagaaaaauucaaaaacgacuccuuaaaggcuuuugcagauccuguccauaugccgacaaaaugccccaacaagaaaggacccguaauaagaucaguaaaaauaaaagaaucuaauaaaacaggcauagaaguacgcaaaggacuggcagagcguggugaaaugguaagaguagacguauucauaaaagacaagaaauacuacuuagucccaauauauguaagcgauuucaaaaauaaagaccuuccuaacaaagccaucgcugcauuaaaacuagaaaacgaauggaucaugaucgacaaaacauauucguuuaaauuuaguuuguucaaagaugaucuaauaaaaauuaagaagaagaaagaagaaauauucgguuacuucggcggcguccaccgaucaacaggaacaauaaaaaucaaaagcagacacaaaccaaaagaaauagaugaaggaauaggaagccguuguuuauuagacuucagaaaauuccaaguagaugucuugggcaacuacacggaaguuaaacacgaaaaacguaugccagcauacauaacgcgaaaagauaagaaacacuga

SEQ ID NO: 8407 - RNA, 3105 nt, Artificial Sequence
  Cas9 variant
augaaaauacuaggauucgacauaggaauagcgucaauaggaugggcauucguagaaaacggcgaguuacgagauuguggaguccgaauauucaccaaagcagaaaacccuaaaacuggagacucauuagcaaugccuaggagagaagcaagaaguguacgaaggcgccuagcgcgacgaaaagggcgacuagaaacucuaaaaagacuacucgcaaaagagugggauuuauguuaugaagacuacauagcagcugauggagaacuuccuaaagccuucauggguaaaaaccuaaccaacccauauguauuacgauaugaagcacuacaaagacuauuaggcaaagaagaauuagcuagaguaauacuacacauagccaaacauagagguuacggaaacaaaaaugcuaaaauaacaaaaucagaagaaaguaaaagagagcaaggaaaaauacuauccgcacuagcuacgaaugcuucuguaauagccagauaucguaccguaggagaauauuuuuacaaagaauuuugugaaguaaucaaaaauccacaaggccuaaauaccaaugaaaauuguacacaaccuaaaguaagaguauuaaaaccgauccgaaacaaaggaggugaauacacaaauuguauauuacaagaagaucuacaaagagaauuaagaugcaucuucgaacaccaaaaaggcuucgguuuucccauaacucaagaguuccaagauaaaauccuaaaaauugccuucuaucaacgcucacuuaaagacuuuucacauuuaguaggcaaaugcacguuuuauccagaugaaccacgagcaccaaaauucagucuaagugcaauagaauuuauaaccaaagcaaaaaccaucaaucuauuaguaggaaucguaaaagaaagcggagaaguuugggauaaagaacaauggagggaacgguuagauagcguauuuucagcgguaugcgaacgaggaaauuuaacauucgcacaaaugaggaaaauauuaaaaaucgacgaaagaauacaauucaaagaaguugacuacacagccaaaaacccugaaaacaagaaauuuguugaguucaaaaaucuaaagaaauuuugugaaaucuuaggagcaauuguuggggauagagcauuagcugacaguauagcacgagauaugacacucauaaaagacgaagaagaauuagcgcaaaaauuaagaggauaugguaaauuuagccaagaacaaauaacucaacucggagcccuaaauuucucacaccauauuaaucuuagcuuaaaagcucucagugaaauucuacccuuuaugagggaaggaaugagguaugaugaggcuugucaggaagccaaacuacaggcuaaacauaaugauaagaaaagcaaauuccugccaccauuuuguggaagcauauaugcugaugaauuaaccaaucccguaguacauagagcaauagcagaauacagaaaaauauuaaacgcacuaauagcaaaauacggaaauguacacaaaauacacauagaauuaacccgugauguagguaaaaauuuccaagaacgagaaaaauauaaaaaggaaauagaaagcaauuauaaagcaagaguacaagcaaugcaagaaugcgaaaaacucggauuaacauuaagugaaggaaacauacuuaaacuuagguuauucauggaacaaaaugaacguugcguauacucuggaaggaaaauaaccuuagcaaaucugaaagaacagggugccuuagaaauagaccacauucucccauacaguaggaguagcgaugauaguuacaugaauaaaguauuaguauucacaaacgaaaaucaaaauaaagguaauaaaacaccauacgaggcuuucggaggagauucccaaaaauggggugaaauagaaucccucgcauuaaggaguggauauccaaagaagaaagcuaaaagaauauuagacaaaggguucggagauagagaagcaggauucaaaagcagaaacauaguagauucaggguauauagcucgauuaaucgcaaauuauacaaaagaguacuuaaaauucuuaccuuuagacucucaugaaaacacagcccuaaucgcaggggaaaaagacucaaaaauucacguggaagcaguaaaaggaauguuaaccgcaacuaugagacacuucuggggcuuagggucuaaaaauagauacgagcacacccaucacgcgauagacgccauaauuaucgcauacauuaaugccgcgaugauucaaagauuuagccaguuccgacaaaaucaagagucgcuuaaagccagauuuuaugcaaaagaguuagcaaaagaagaauuuaaaacccaaagagcuuucuuugaaccuuuuucgggauuccgagagcaagugcuagcaaaaguaggccaaauauuuguaucacguccaccaagaaaaagagcacgaggggcuuuacaugaagaaacauuuuacucaauugacgauaagaaacuaagugaaacauacgguggcaaagaagggguacaaagagcucuaaguuuaggcaaaauuaggcaaauaggaacuaaaauuguagcuaacggaccuaugguaagaguggauauauucaaacauaagaaaucagggagguuuuaugcuguuccaauauacaccauggauuucgcucuagggauacuaccaaacaaagcugucguaucaggaaaagauaacgacagaauaaucaaagauugguuagaaauggauagcaacuacgaauuuuguuucucacuauuuaaagaugauguuauagagguacaaaagaaagacauggaaaaaccggaacucgcauauuucgucaguuuaaauaccagcagcgcaaguauagcgcuaguaaaacaugauaacaaauuugaaacccuaacuucaaaucaagcaaaacuauucucuaaugcaaaagaaaacaacguaauagcagaaucacugggaauacaaaauuuaaaagucuucaagaaauacaaaguaucacccuuaggugaaauaaaagaagcuaaauaugaaccaagacaacccauagcccucaaaacgucaccaaagaaacauagaaaacaaaauaaugcacaauga

SEQ ID NO: 8408 - RNA, 3108 nt, Artificial Sequence
  Cas9 variant
augcgacgcuuaggccuagauuuagggacaaacucaaucggguggugccuccuagacuuaggagaugacggggaaccaguaucaauuuuucguacaggagccagaauauucagcgacggaagagacccuaaaucauuagggucacuaaaagcaacgagaagggaagcaagacugacccgaagaagaagagauagauucauacaacgccagaaaaauuuaaucaaugccuuagucaaauauggauuaaugccagcagacgaaauacaaagacaagcucuagccuacaaagacccuuauccuauaagaaagaaagcauuggaugaagcaauugacccauaugaaaugggaagggcaauauuucauauaaaccaacgaagaggauuuaaaaguaacagaaaaagcgccgacaaugaagcgggcgucgugaagcaaucaauagcagauuuagaaaugaaacuaggcgaggccggagcaagaacaauaggugaauuuuuagcugacagacaagcaacuaacgauacaguaagagcuagaagacuaagugguacgaacgcauuauacgaguucuauccugaucgauacaugcuugaacaggaguucgacacacuaugggcgaaacaagcagccuuuaacccaagccuauauauugaagcagcacgagaacggcuaaaggaaauaguauuuuuccaaaggaaauuaaaaccccaagaaguaggacgauguaucuucuuaucagaugaagauagaauuucaaaggcccuaccaaguuuucaaagauucagaauuuaccaggaauuaucaaacuuagcauggauagaucaugacggcguagcacaucgaauaacagcuucauuagccuuacgcgaccacuuauuugacgaauuagaacauaaaaagaaacuaaccuuuaaagcaaugagagcaauauuacgcaaacaagguguaguagacuauccagucgguuucaaccuagaaagcgacaacagagaucaccuaauugggaaccuuacaagcugcauaaugagagacgcaaagaaaaugauaggaagcgcaugggaccgauuggacgaggaagaacaagauucuuucauuuuaauguuacaagaugaucaaaaaggugacgaugaagugagaucaauauuaacccaacaauauggacuaucugacgauguagcagaagacugucuagauguuagacuuccagauggccacggaaguuuaagcaagaaagcuauagacagaauauugccagugcuuagggaccaaggguuaauauauuaugaugcaguaaaagaagcagggcuaggugaggcuaaucuauaugauccauacgcagcauuaagugacaaauuagacuauuacggcaaagcacucgccggccacguuaugggagcgagcggaaaauuugaagauuccgacgagaaaagauacgguacgauaaguaacccaaccguacauauagcacucaaucaagugagagcaguagucaaugaacucauaagauuacauggaaaaccagaugaaguaguaauugaaauuggcagagauuuaccaaugggggcagauggaaaaagagaacuagaaagauuccaaaaagaaggacgcgcgaaaaaugaaagagcaagagaugaacuuaagaaauuagggcacauagacaguagagaaagccgacaaaaauuucaacucugggaacagcuugcuaaagaaccagucgacaggugcuguccauuuacuggaaaaaugaugaguauaucagaucuauuuucagauaaaguagaaauagaacauuuguuaccguucucguuaacccuagaugacaguauggcaaacaaaacaguauguuuuagacaagccaauagggauaaaggaaauagagcaccauucgacgcguuuggaaacaguccggcaggauaugauuggcaagaaauauuaggaagaucucaaaauuuacccuacgcuaaaagguggagauuccuuccagacgcaaugaaaagauucgaagcagacggaggauucuuagaacggcaauuaaaugacacacgauauauuucaagauauacaacugaauauauaucuacaauuauaccuaaaaauaaaauuuggguaguaacaggaagauuaacuagccuauuaagggguuuuuggggauuaaauagcauuuuacgaggacauaauacugacgacggaacuccugccaagaaaagcagagaugaccacagacaccacgccauagaugcuauaguuguagguaugacaucaagaggacuucuacaaaaaguaaguaaagcugcccgacgaagugaagacuuagauuuaacaagacuuuucgaagguaggauugauccgugggauggauucagagacgaaguaaagaaacauauagaugcaauuauaguaagucacagaccaagaaagaaaucacaaggagcuuugcacaacgauacagcguauggaauagucgaacacgcagaaaauggagcaagcacgguaguccacagagucccuauaaccagccuaggaaaacaaagugauauagaaaaaguaagagauccucuaaucaaaagcgcuuuauuaaacgaaacagcugggcuaucuggaaaaaguuuugaaaaugcaguacaaaaauggugugcagauaacucaauaaaauccuuacgcauaguagaaacaguuagcauaauaccaauuaccgauaaagaaggagucgcauacaaaggauauaaaggagauggaaaugcuuauauggauauuuaucaagaucccacaaguagcaaauggaaaggggaaaucguaaguagauuugacgccaaucagaaagguuuuaucccaaguuggcagucacaauucccuacagcucgauuaaucaugcgacuaaggauaaacgaucuacuaaaacuacaagauggagaaauagaagaaauauauagaguacaaagacuaagcggaucuaaaauacuuauggcgccacauacugaagcaaaugucgacgcgagggacagagauaaaaaugauacauuuaaacuuacaucaaaaucuccugguaaacuccaaucugcaucagcaagaaaaguucacaucagcccuacaggucuaauuagagaagguuga

SEQ ID NO: 8409 - RNA, 3108 nt, Artificial Sequence
  Cas9 variant
auggaacaacuaaacuauauauugggauuagauauaggaauagcaucagucggaugggcagucguggaaauagaccauaaugaagacccaauaagacuaaucgauguaggcguccgcacauucaacaaagcagaaguagcaaaaacaggagagagcuuaucauuaauaagacgacucgcacguggaucaagacgacuuguuagaaggaagaaaaugcgccuauuaacggcaaaacggcuucuaaaaagugaaggcauucuaucagacuuagauuucaacaaaggugcaauauugaaccugcccaauaauugcugggaguuaagaguuaaaggacuugauaagaaacucucugauaaagaaugggcagccguacuccuccauauaaucaaacauagaggauacuuaucacagcgaaaacaugacagaaaaacagacgacaaagaauugggagcucuacuuaguggagucaguaaaaaccacagucugcuggaagaaggcgaauuuagaaccgcagcagaauuagccauaaacgucuuuugcaauuccaaaggccauauacgaaaccaauggggcgacuacucacacacuuucucaagauuagaucuucaaaaagaaauaaaacaauuauucgugucucagcgagaacuaggaaacccauacacaucaucaucauuugaagaaaauaucaucucuuuacuaaugaaacaaaaagaagcaauuuccgguaacgacauauuaaaaauguugggcaaaugcacauaugagaaaaaugaauauaaagcagccaaaaauacguacucagcagaaagauucguauggcuaacaaaacuuaauaaccugagaauaguagaugauggagucgaaagagcauuaaacucaagugaaagaaaacuacuuauagacgagccauacaagaaagcaaaacuaacauaugcacagguaagaaaaauauuagaacugccugauucagcaguauucaaaggaguaagauauuucgcagauaaugcagaaagcucuacauuaauggaaaugaaauucuggcacagcauaaggaaagcacuagaaucaaacaaccuuaaagaugaauggcuuguacucaaaaccaaaccagaauuauuagacgaaauaggaaccggauucucaauauacaaaaccgaugacgauauaacaucauauuuaagcaacaaacucgauaagaaaguacuagacauccuauuggucgaaguaucauucgauaaauuuauagaauuaagccuaaaaugucuaagaaaaauaauuccucuaauggaaaaaggauaucgguacgaugaagcauauaaauauauuuauggagaaguuaacauagaauauaacuuaaaugauaucaaaaacccaguugugcucagaaguuucucgcaaaguaggaaaguaauaaacgcuguaauaagauuauacggauccccagcaagaauacacauagaaaccgcucgcgauauaggaaagagcuuuaaagaaagaaaagcaauagaaaaacaacaagagaaaaauagauuagaaaaaguaagagcugcagaacacuucaaacaauuauuuccaaacuaugucggagaaccaaaagcgaaagacauccuuaagguaagacuguaugaacagcaacaaggaaaaugucuauacucuggaaaaauucuagauauaaaaagauuaauggaacacggauacguugaaauugaucacgcgcucccauucucaagaacaugggacgacagcuucaacaacaaaguauugguauuagcaaacgaaaaccagaauaaaggaaauaaaacaccauaugaaugguucaauggaaaagauaacagugacaguuggaaacgauuccuugcucuaguuaacaauuccggcuucagugcaguaaagaaacaacacauacuaaugaaagaaauagacgaagagggauucaaacaaaggaaccuuaacgauacaagauacauaacucgauucuuauguaacuggguagagaacaacauccccuuauuaggaaaaggaguaaagagaguuuucgcaccacaaggaaaaauuacugcacuacuccgaaguaauuggggaauaagaaaaguccgagaagauaacgacaggcaucacgcaauagacgcaauaguuguagcaugcaccacaguaagcauccaacaaagaauaacaaacuacguuaaaaauucggaaauaaauagaaaaaucaaaaggcaaaauuaucuaaaauuuccagaaccauggaaauucuucagagaagauauaucaauacgaguauucaguaauaacccuauagaggaacugaaacaacaacuaucggacaggccagaagccaaccaccaguucguuacaccacucuucguuucaagggcaccagugagaaaaaugacaggacaaggacaugaagacacaauaagaucagcaaaacgaauaucugagggaauaucaguccucagaguaccauuaacuaaacugaaugauaaauccuuagaauuaaugguuaaccgagaacgcgaaaaagaauuauaugaugcacucaaacaaagacuauuagaguucaaaaacgacccugaaaaagcauucgcugaaccuuucuacaagaaaggugggcaacaagugaaaacagucaggauugaaagaguacagaaaaauggaguacucguaaauaacaauacaggaauugcagauaauggaaacauugucagaguggauguguuucucaaaaagaagaaauauuuccuuguucccauauacaguuggcaaguggcuaaaggaauacuuccaaacaaagcaauaguugcacacaaaaacgaaugcgacugggcagacauggaugguuccgcacaauuuuuauucucauuauacaccaaugaccuaauugaaguuguccucaaagacagcacgauacuaggauacuucagcaguaucgauagagcuacagccgcuauaaucauaaaagaacccgacauggaaaaaucaaaaggaaaagaagggauacacagggucggaguaaaaacagcgagauccuucauaaaauauaacguagacguacuagggaaaaacauaagccgaugcagaaaagcaaaaagacucccuguaagauga

SEQ ID NO: 8410 - RNA, 3108 nt, Artificial Sequence
  Cas9 variant
auguuaagaaaaaugcauuauaggcucgcauuagacuuagguucaacaucuuuaggaugggccaugauacgacuuaacgcagguaacgaaccaugugcaguaauaaaagcaggcguacguauauuuucaaauggcaggaacccaaaagaugggucaaguuuagccguuacgagaagagaagcgcgagcaaugaggagaagaagagauagauuacuaaaaagaaaagccagaaugauucagacauuaauugaauauggauuuuucccugcaaaagaggaucaacgaaaagcacuggaaauuaugaaucccuuugcacuaagagcuaagggauuaaaugaagccuuaaccccagcugaauuugcaagagccuuauuccacauaaaccaaagaaggggauuuaaaucgaacagaaagacagacaagaaagauaacgacucaggggcgcuaaaaacagcaauuaacaaacuacgcgaaacacuaaaaacagaaaacuguagaacuguuggagaauggcuaaauaagagggauguagcuggauuaacaguaagagccagauaucaucaagauaaaacaauaaaagaagaugggaaaagcaaaauuaauaaauauuacgacuuauauaucgaccgagcuaugauagagcaugaguucgacgaacucuggaaaaagcaggcggaacugaauccaacuuuauuuacagaagcagcaagagcggauuuaaaagacguucuauuacaccaacgagcucucaaacccguaaaaccuggaagaugcacuuucaugccggaugaagaaagggcaccacuagcucuaccaucgacccaaagauuccguauguaucaggaagugaauaaucuacgaauacuaagggacggacuuaaagaagaaucuuuaacguuaaaccaacgggaugaccuaauagccgcacuagaagaaaauaauaaacguacauuuacacaaauaaagaaauuacuuggucuaggaggaguaguaaaauuuaauuuugaagacccaaaaagagaagaacuaaaagguaauacuacaucagcaauauuaggcaaagaugaacauuucgggucaguuugguucaaauuugacgaggccaaacaagaugccauagucaugcaacuauuuaaagaggaaaaugaagcuaaauuacuaagauggcuacagaaugaaaccggaauugacgagaaaagagccgaaacaauagcaaauguuggacuaccagaaggcuauggaagucuaugugcauuagcuuuagcaagaauuuugccggaauuacgacgagauguagugcccuacucagaugcagcgaaagcggccgguuuucaucauucugacacaagcaauaaucaggaaguuccaggauuaacguucccaauugaauuaguaguaaccgaaacaggggaaauaaagacaaaacauauauuucaugaacuaccauauuauggagaauaccuucaacgccaugucggauuuggaucagguaaaccagaagauucagcagaaaaacguuauggcaaaaucgcgaacccaacaguacauauaggcuuaaaccaagugaggcuaguaguaaacacacucauuaaaagauauggacauccuuccgaagucauaguagaaguagcccgagaucuaaaacaaaguaaagacuuaagagacgaagaagguaaaaggcaagcagaaaaucagaaaagaaacaagcgaauccgaaccgcaauugcgggagucuugcaaacauccgaagaaaggguaagaagagaugacauugagaaaaugauccuaugggaagaauuaaguuucgauccagcagacagaagauguccauacaguggaguacaaauaagcgcggcaaugcucuuaucagaugaaguagaaauugaacauauacuaccauucucacaaacauuagacgauucacugaacaauaaaacaguagcacuaagacaagcgaacagaguuaaaggaaauagaacaccaugggaagcauucggagcacaaaguacagcgggguuugauuacgcgacaauauuagcaagagccgaacauaugccaaaaggaaagagauauagauuugcggaagacggauaccaacgcuggcuaaaagaugacgcuggauucuuaccacgugcccuaaacgacacaagacauaugaguaaaguagcccgagaauauaugucacuaauaugccccaauacacgagugauaccaggaagaaugacagcaaugcugagagguaaauucggacuuaacgauguauuggggcuaaauggagagaaaaaucgaaacgaccauagacaucaugcaguagacgcauguguaauugcaguuacagaucaagggcuauuacaacgguuugccaaagcaagugcuucagcuagggaacaacaacuaaaucggcuagucgaaaauaugccccuuccaugggaaaguuacagagaacacguagaaagagcaauagaugcaauaugggucucccacaaacccgaccacucucaugaaggagcaaugcacaacgacaccgccuauggauuauugggagacgguaaaguaucaauacauaaaaugguagaaggaaaaagagaaagaauagaagaaagucuaaaaguaauagcguucacaaaugcuaaagcaaacgacagacacgguuuauuagauaacggagaaccaaggcccuacaaaggcuauaaaggagauucgaauuauuguaucgaaauaauaagaaacgaaaaagguaaaugggaaggggaagucauaucaaccuucgacgccuaccaauuagugagagaacauggaguagcaagguugagacacccaacuuuaucuguaagugguaaaccacucguaaugagacuaaugaaagacgaaacaauacgcaugguaacaaaugaaaagccuauaacugcaagaguauguuggguuagaagcgauacaagaauagcguuugcuaguacaucagaagcaaauguagaugccagagacagagauaaaaacgauucauucaguuauauaguuaaaacagcaucgguucuccaaaaacuccaagcccgaagaauaagcauuucaccuacuggcgaacuacgggauccuggauuuaaagaauga

SEQ ID NO: 8411 - RNA, 3108 nt, Artificial Sequence
  Cas9 variant
auggaacaacuaaacuauauauuaggacuugauauagguauugcaucuguaggaugggccguagucgaaauagaccacaacgaagaucccauacgacuaauugacgugggaguaagaacguucaacaaagcagaagucgccaaaaccggcgaauccuuaucacuaauacgacgacucgcaaggggaucaagaagauugguaagaagaaagaaaaugagauuacuaacugcuaaacguuuauugaagucagaaggaauacuaagcgauuuagacuuuaauaaaggcgcaauuuuaaaccuaccaaauaacuguugggaauuaagaguaaaaggauuagacaagaaauuaucagacaaagaaugggcagcgguacuucuacacauaauaaaacacagaggauacuuaucacaaaggaaacacgauagaaaaacugacgacaaagaacuaggagcacuccuuagcggcguaucuaaaaaccacucguuacuagaggaaggagaguuccgaacugccgccgaacuugcaaucaacguauuuuguaauuccaaaggacacauaaggaaucaauggggugacuauucacacaccuuuaguagauuagaucuacaaaaagaaauaaaacaacucuucguuucucaaagagaacuuggcaauccauauaccaguaguucguucgaagaaaacauaauaucacuacugaugaaacaaaaagaagcaaucucgggaaacgauauucugaaaaugcucgggaaauguacauacgagaaaaacgaauauaaagccgcuaaaaacacguauagcgcagaaagauucgugugguuaacaaaauuaaauaaccugaggauaguagacgauggaguugaaagagcacuuaauaguucagaaagaaaauuauuaauagaugaaccauacaagaaagcaaaauuaacauaugcacaaguaagaaaaauacuagaauuaccugacucagccguauucaaaggcguaagauacuuugcagacaaugccgaaaguucaacacuaauggaaaugaaauuuuggcacucaauuaggaaagcauuagaaucaaacaaucuaaaagaugaauggcuaguucuaaaaacaaaaccagaacuacucgacgaaauugguacaggcuucagcaucuacaaaacagacgacgauauuacaucuuaccuaucaaacaaauuagacaagaaaguacuagacauucuguuggucgaaguuucauuugacaaauuuaucgaacucagcuuaaaaugccuaagaaaaaucauaccccugauggaaaaaggguacagauaugacgaagcauacaaauauauauauggagaagugaacauagaauauaaucuaaacgauaucaagaaccccguuguauuaagaaguuucucucagucaagaaaggucauaaacgcaguuaucagacucuauggaucacccgcaaggauucauauagaaacagcuagagacauaggcaaaucguucaaagaaagaaaagcaauagaaaaacaacaagagaaaaaucgacuagaaaaaguaagagccgcagaacacuuuaaacaacuauucccuaacuacguaggcgaaccaaaagcuaaagauauccuaaaaguaaggcuauacgaacaacaacaaggaaaaugcuuauauucgggaaaaaucuuagacauaaaaagauuaauggaacacggcuacguugaaauagaucaugcacucccuuuuagcagaacaugggacgauucauuuaacaauaagguccuaguccuggcuaacgaaaaucaaaacaaaggaaacaaaacgccauaugaaugguucaacggaaaagauaacagugacucauggaagcgauucuuagcauuaguaaauaacucaggauucuccgccguuaagaaacaacacauucuaaugaaagaaauagacgaagaaggauuuaaacaaaggaacuuaaaugauacucgauauauaacccguuuucuaugcaauugggucgaaaauaacauaccuuuauuagguaaagggguaaaaagaguauuugcaccacaaggaaaaauuaccgcgcuccuuagaagcaauugggguauuagaaaagucagggaagauaaugaucgacaccacgccaucgacgcuauaguaguagcaugcaccacaguaucuauacaacaaagaaucacuaacuaugugaaaaauucagaaauaaacaggaaaauaaaaagacaaaacuaccuaaaauucccagaaccauggaaauucuucagagaagauauauccauaagaguauuuucaaauaaccccauagaagaauuaaaacaacaacucucagacagaccugaagcaaaccaccaauuuguaacgcccuuauucguaucaagagcacccgugagaaaaaugacaggccaaggccaugaagauacaauaaggucggcaaaacgaauuucugaaggcauauccguacuuagaguaccucuaacaaaacuaaaugauaaaagccucgaacuaaugguuaacagagaaagagaaaaagaacuuuacgacgcgcuaaaacaaagacugcuagaguucaaaaaugauccagaaaaagcauucgcagaacccuucuauaagaaaggaggacaacaaguaaaaacgguacgaauagaaagagugcaaaagaacgggguauuaguuaacaauaauacaggaaucgcugacaacggcaacauagugcgaguagacguuuuucuaaagaaaaagaaauauuuccuaguacccaucuacagcuggcaaguggcaaaagguauauuaccaaacaaagccauagucgcacacaaaaaugaaugcgacugggccgacauggacggaucggcccaguucuuauuuucuuuauacacaaacgaccuaauagaaguaguacuaaaagauuccacuauacuuggauacuuuuccucaaucgacagagcaacggccgcucugauaauaaaagaaccagacauggagaaaagcaaagguaaagaaggaauacauagaguaggaguuaaaaccgcaagaucauucauaaaauacaacguagacguauuaggcaaaaacaucagccgauguagaaaagcaaaacgguuaccagucagauga

SEQ ID NO: 8412 - RNA, 3111 nt, Artificial Sequence
  Cas9 variant
augcguauauuuggauucgauauaggcauuacaucuauagggugggcauauguagaaucaaacgaauugaaagacugcggaguaagaauauuuacaaaagcagaaaaccccaaaaauggcaaaucucuagcuuugccaagacgagaagcaagaggcgcucgcagaagauuagcgagacgaaaagccaggcuuaaugcgauaaagcgucuuuuaugcaaagaauuuggccuaaacguaucagauuacuucgcaaaugacggagaacuaccaaaagcguacgaaacgacaaaagacacaaaauccccauaugaacucaggagccuagcacuagaacaaaaauuagaaccaaaagaacuggcacgaguaauccuacauaucgccaaacacagaggauacggaaacaaacacgcuaaaaccggaucagacaaagauucagguaaaguacuaagugcaauaaaaguaaaugaaacagcaaugaaagacaaauaucaaucaguaggugaauaucuauacaaagaguucuaccaaaaauuaagauuagaaucagagaaaaagggaaacaauauaacuaaagaguucaaaaacguaagaaacaaaggggaaaauuacgaacacugugucgcacaggaacaaguaagagcagaacucgaacuaauauuugcaaaacaaaaagacuuuggagcaacauuuuccgaaaauuucgaaagccaaauuauagaaacggccuuuuaccaaagagaucugaaaaguuuugaagacaaaguaggcaaaugcguuuucuaugaaaaugaaaaccgagccccaaaagacucauugucagcaauggaguucguagcgcuaacacgaauaauuaacacacuuaaaaauuuagaagagaaaagcaaaaaucuaggaauuggcgaaguauauggaaaagauaaaauucaagaaauacuaaaaauaguacuagauaaaggcgaaaugucauauaaaaaguuacgugaaauauuacaccucgacgaacacauauuauucgcaaaagacagcaaguuagauuauacccaaggaguacaagaagcagaaaaagcaaaauucauagaacuaaagaaucuaaaagcauucaagaaagcaaugggaggugauuuuucaaacuuugcucgagaagaauuagauaaaauagcgacagauauaaccuuagucaaaagcaaagagaaccuagcgaagaaacuacaaaauuauagugcucucucaaaagaacaaguggaggcacuaucgaaccuuucauuugcaaaacauaucgacuuauccuuaaaagcauuagaacagauacugccauucaugcgaggagauaaaacaggaaaaugcuuacgcuaugacgaagcaguaaagaaagcagaauugcaagaacauagaaaacauaaacaaaaaggagaguucuuaauaccucuaaaagauuacgagccuuaccuugcaaacccgguaguagcaagagcacucucagaauacagaaaaguauuaaacgcacuacuacgaaaauacggcaaaguacauaaaauacaucuggaguucacaagagaagcaaaacuaagcgccaaagaaagacaaaaauacgaaaaagaacaaaaagaacauuucgaagcaaaucaaagagcaauacaacaaugugaaauauuaggacugccuauaaacggcacaaacauacugaaaaugaaacuaugguuagaacaaggagaaugcugugcauauagcggugaaaagauaacacgugaacaccuacuagacucaaacgcacuccaaguagaccacauauacccauauucaagaucuuuugaugacagcuacaugaauaaaguccucguauuugcuaaggaaaaucaagacaaagguaacaaaacacccuucgaagcauucggaggagauaaagaaaaaugggaucgaauacucucucugucagccaaguuaccaaaacaaaaacaacgaagaauuucaaauacaaacuucaaagacaaagaaggcgguuuccuagcaagaaauuuaaacgacaccggguauauagcaaaacuagcaagucaauggacaaaagauugcuuagaauuugaagaucuaagggaaaacgaaguaacaauagcaggagaaaaaggaucuagcguacacauugagguaguaaguggacagcugacaagcaugcuucggcacuauuggggauuagggaacaaagauagaaacaaucaucuucaucaugccguagaugcagucaucuuagcauauacaaauaaugccaugaucaaagccuucgcaaacuuuaggaaaaaccaagaagaaaacaaaaagaaauucuaugcaaaacagaucgccgaaagcgaauauaaagcgaagaaagcauucuuugaaccaugcaaaaauuuuagacaaagggucgaggagaaaauaaaagaaauauucgucaguaaaccaccaagaaaaagagucagaggagcacuacaccaggaaaccuuuuauccauuugaaaaauugugcaacgauaaagaauauucagaaaaacuaaaaauggacuauggcggugaaaaaggaaugcagaaagcgauagcuuuaggaaaaauacgacaaaucggaacaaaaauaguaaguaacggagcaaugguaagaguagacauuuuuaaagauaagaaaggaaaauucuaugcagucccaauauauacaauggacuuugcauuagggauccugccuaauaaagccguagcaauaggaaaagacaaagaugggguaaucaaagacuggauagaaauggacucgaauuacgauuucuguuucucacuauuuaaagacgauuuaauccuagugcagaagaaagaaauggaacgagcagaacuaugcuauuuuguaucauucgggaguacaaacgcccaaauaaacguagaaaaacacaauaacaaauuugaaggucuaagugagaaugagaaaauacuauauucaaaugcaacccaaaaagaaguagccggcaaauccauagguauacaaaacuuaaaaacauucgaaaaauaccaaguaucaccauuaggggaaguacaaaaagcagaguucgaaccacaccaagaaaucaaacuaaagaguaguccaaaaagaaaagacuga

SEQ ID NO: 8413 - RNA, 3111 nt, Artificial Sequence
  Cas9 variant
auguuacauaaaaugcacuauagacuagccuuagauuuaggaaguacauccuuggguugggcaaugauaagacucgacgcugauaaucagccaugugcggucauaaaggccgguguuagaauauuuucaaacggacgaaauccaaaagauggaucauccuuagcaguaacacgaagagaagcacgggcaaugagaagacguagagacaggcuauuaaaacggaaggcaagaaugaugcgaacauuaauagaauauggauucuuuccugcagaagcagcacaaagaaaagcacuugaaacaauaaacccuuucgcucuacgagcaaaaggucuagaugaagcacuaaccccagcugaguucggcagagcguuauuucacauaaaucaaagacgaggauucaaaaguaacagaaaaacagacaaaaaggacaaugauucaggggcccucaaaacagcaauaggcaaaguuagagcaacaauugaagcagaaggauguagaacaguaggggaaugguuacacaagagggauguagccgguuuaacaguuagagcacgauaccaccaagacaaaguuauaaaagaagacggaaaaacaaaaauugauaaauacuaugauuuauacauugauagagcaaugauagaacaagaguucgacgaacuuuggaaaaagcaagcugaauuaaauccagcauuauucacugaagcugccagagcugaccucaaagacguucuacuacaucaacgaccacuuaagccuguaaaaaguggacgauguacuuuuaugccugacgaagaaagggcaccccuagcccuaccgaguacgcaaagguuuagaauguaccaagaaguuaauaacuuacgcauccuccgagauggauuaaaagaggagcccuuaacauuaaaacaaagggaugacuuaauagcggcauuggagaaaaauucaaaacauucauucacacaaauuaaaacacuauuagguguaggaggugcaguacaauuuaacuucgaagauuuaaaacgacaagaacuaaagggaaacacaacgucagcaauacuaagcaaugauaaacauuuuggcaaagcaugguuuacauuugaugaagcaaagcaagacgcaauaguuuuacaauuaguaaaagaagaaaaugaagcaaaauuaguaaggugguuacaagaugaaaccggaauagacgagaaaagagccgaagcaauagccaacguagguuuaccugaaggauaugguagccuuugugcaaaggcgcucgccagaauacuaccagaauuacgaagagacguaaugacuuacgauaaggcgguacaagcagcuggauucgaacaccauagcagauuagggucaaauacugaaauuccggggcuaaccuuuaaaauagaaucgauagaucaagacucaggagaaguaaaacaauuucacauucauaaaguacuacccuauuauggagaauaccuacaacgacaugucggguucggcaguggagaaccagaagacccggcugagaaaagauacggaaaaauagcuaacccuaccgugcacauaggauuaaaucaaauaagauuaguaguaaaugcacuguuaaagagauacggacacccaagugaaguaauaguugaauuagcaagggaucuaaaacaaaguaaagaccaaagggaugaagaauccaaaagacaagcggaaaaccagaaaagaaauaagagauuaagagaugcaauagcgggaacauugaaaauaucagaggaaagaguacgaagggaugacauacagaaaaugauacuaugggaagaauuaucauuugauccagccgaucggagauguccauauucuggugcacaaaucagugcuacaaugcuucuaucagacgaaguagaaguagaacauauuuuaccauuuucacaaacucucgacgacucauuaaauaauaagacaguugccuuaagacaagcaaauaggauaaaaggaaaucgcacaccuugggacgcguuuggagcgcaagcgguagcaggauuugauuaugaaaguauauuaguucgagccgaagggaugccaaaagcaaaacgauauagauucgccgaaaauggauaucaaagauggcuaaaggaugaugcgucauuccuagcacgagcauuaaaugauacgagacauaugucaaaagucgcuuuugaauacuuaaaauugauuugucccaauacgagaguaauaccaggcagaaugacagcaauguuacgggcgaaauucggguuaaaugauguacuaggacuaaacggagagaaaaaucgaaaugaccauagacaucaugcagucgacgcaugcgugaucgcuguaacagaccaaggauuacuacaaagguuugcaaaagcaucggcuagcgcaagagaacaacaauuaaauaggcuaguggaaaauaugcccuuaccauggggaucauauagagaacaugugcaaagagcaauaaaugcaauauggauaucgcacaaaccagaccacagucaugaaggcgcaaugcacaacgacacagcguauggcuugagaggagauggaaaagugucuuuucauaagaugguagaaggagugagaacacacagcgaagauaauuuaaagguaauugaaaucaguaaugcaaaagcaacggaccgacacggacuccucccaaauggagaaccaagacccuauaaaggcuacaaaggagacagcaauuacuguauagaaauuguaaggaaugaaaaaggaaagugggaaggugagguuauaagcacuuucgaagcauaucaauuaguuagggaacauggaaucgcacgccucagacauuccacacuuucaguaagcggaaaacuauuagucaugaggcucaugauagaugauguaguaagacuaauuauagaugaacaaacccguacaaugagaaucgcaacuuuaagcggaaauggccaaauauuuauggcggauacgucagaggcaaacguugaugcaagaaacagaucaaaggaagaaacauuugcguauguaucuaaaauggccgggagccuacaaaaagcuaaugcucgcagaauuaacauaagcccaauuggagaacuaagagacccggguuucaaggaauga

SEQ ID NO: 8414 - RNA, 3114 nt, Artificial Sequence
  Cas9 variant
auggaaaggauauucgguuuugacauaggaacaacaucaauaggauuuaguguuauagauuauucaaguacacaaagcgcaggcaacauacaacgacugggaguaagaauauucccugaagcuagagacccagaugguacaccgcuaaaccaacaaagaagacaaaaacguaugaugagacgacagcuaagaagacgcaggauaagaagaaaagcauuaaaugaaacauuacacgaagccggauuccuaccugcguauggaagugcugauuggccugucguuauggcagacgaaccauaugaauuaagacggagaggucuggaagagggacuaagugcauacgaauuugggagagcaauuuaucauuuagcacaacaucgacauuuuaaaggacgagaauuagaagaaagugauacgcccgacccugacguugaugacgagaaagaagcagcaaaugaacgggcagcuacauugaaagcauugaaaaacgaacaaacuacacuaggagcuugguuagcccggagaccuccaucagacagaaaaagaggaauacaugcacauagaaauguaguugccgaagaauuugagagacuaugggaaguccaaaguaaauuccacccagcacuaaaaucagaagaaaugagagcgagaaucagugauacaauuuucgcacaaagaccugucuucuggcguaaaaacacacucggagaauguagauuuaugccaggagaaccucuauguccuaaagguucuuggcuaucucaacaaaggagaaugcuagaaaaacucaauaauuuagcaauagcuggagguaaugcaagaccacuugacgcagaagaaagagaugcuauacuaagcaaacuccaacagcaagcaucaaugucauggccuggugugagaagcgcccuaaaagcacuguacaaacaacgaggagaacccggcgcagagaaaaguuuaaaauuuaauuuagaauuaggaggagaaucuaaacuauuaggaaacgcacuagaagcaaaacuugcugauauguuuggacccgauuggccagcacaccccaggaaacaagagauaaggcaugcaguccaugaaagacuaugggcagcugauuauggcgaaacuccagauaagaaacgaguaauaauauuaucagaaaaagauaggaaagcucacagagaggcagcugcaaacucauuuguagcagauuuuggaauaacaggugaacaagcagcacaauugcaggcuuuaaaacuaccaacaggaugggagcccuauucaauaccagcacuuaauuuauuucuagcugaauuggaaaaaggagaaagauuuggagcccuaguaaacggcccagacugggagggauggcgaagaacgaacuuuccacacagaaaucagccuacuggagaaauacuggacaaauuaccuagucccgcaaguaaagaagaaagggaacgcaucucacaacuaagaaaccccacuguuguuaggacgcaaaaugaacuuagaaaaguuguuaauaauuuaauaggacuauauggaaaaccagacagaauuagaauugaagugggucgagaugucggaaaaaguaaaagagaaagagaagaaauccaaucgggcauaagaagaaaugaaaaacaacggaagaaagcaacagaagaucuaaucaaaaaugguauagcuaauccaaguagagaugacguagaaaaauggauacuauggaaagaggggcaagaacguugcccguauaccggugaucaaauaggauuuaacgcacucuuuagagaaggacgcuacgagguagaacauauauggccuagaagcagaucuuuugacaauucaccacguaauaaaacacuuuguagaaaagauguuaauauagaaaaagguaacagaaugccauuugaagcauucggucaugacgaagauagauggucugccauacagauacgccugcaaggaaugguaagugcaaaaggagguacaggaaugaguccaggaaaaguaaaaagguuuuuagccaaaacaaugccagaagauuuugcagcuagacaacugaacgacacgcgauaugcugcaaaacaaauauuggcgcaacugaaacgguuauggccugauaugggacccgaagcgccaguaaaaguagaagcaguaacaggacaaguaaccgcacaacuaaggaaauuauggacacucaacaauauauuagcagaugacggugagaaaacaagagcagaccaucgacaccacgcaauagaugcguuaacaguugcauguacgcauccaggaaugacgaacaaauuaagucgauauuggcaauuaagagaugauccuagagccgaaaaaccagcauuaacacccccuugggauacuauaagagcagaugcugaaaaagcaguaucagaaauaguaguaagccacagagucaggaaaaagguuagcggaccauugcauaaagaaacaacauauggagauacagggacagauauaaaaacaaaaucugguacauauagacaauuuguuacgaggaagaaaauagaauccuugucaaaaggagaacuagaugaaauuagagacccaagaauuaaagaaauaguagccgcgcauguggcaggucguggcggugauccaaagaaagcauucccaccauauccgugugugucgccggguggaccagaaauacgcaaaguucgauuaaccagcaaacaacaacugaacuugauggcacaaacaggaaauggauacgcagaccuugguaguaaucaccauauagcaauuuauagauuacccgauggaaaagcagauuuugaaauagugagcuuauucgaugcuucaagacgacuugcacaacguaauccaauagugcaaagaacuagagcggauggcgcuagcuuuguaaugaguuuggcagcgggugaagcaaucaugauuccagaaggcucaaagaaaggaaucuggauaguacaaggagucugggcaaguggacagguuguauuagaaagggacacagaugcagaccauucuacaaccacaagaccaaugccaaauccaauauuaaaagaugacgcaaagaaagucucuauagauccaauuggcagaguuagaccuagcaaugauuga

SEQ ID NO: 8415 - RNA, 3117 nt, Artificial Sequence
  Cas9 variant
auggcaaaacaaguaagauaucgacuuagucuagaucuuggcaguacuagcuuaggaugggcuauauuuagguuagacgcugaugcccauccaacagcaauuaucaaagcaggaguuagaauuuuuagugauggaagaaaugcuaaggaugguaguucauuagcgguaacaaggagagcagcaagaucaaugcgaaggagacgagaucguuuacucaggagaaaaacaagaaugcucgacgcguuauuggaauacggcuuuuucccacaagacgcagcccaaagaaaagcauuagaaagacuaaauccguaugcacucagagcagaaggacuagcacgaccacuaaccccaggagaguucgcaagagcaauuuuucaucucaaucaaagaaggggauuuaaaucaaauagaaagacugauaagaacgauaaugauucuggugcauuaaaaacagcaacaucacaacucagacaagauauucaagccucgggaugucgaacuguaggagaaugguuauggacgcagagauuacaaaagaaacccgaagguguaccacaucaaggcguaagggcuagauauagagaaaccccucauauuaacucugaaggaaagaaaagaauagaaaagaaauaugacuuauauauugaucgaucgaugauagaagcagaauuugacgcuuuauggucagcacaagcaacguucaacccagugguauuucaugcaacagcucacgaaaaauuaaaagacauauuguuauaucaaaggccuuuacgaccaguaaaaccuggaagaugcacgcuauuaccagaagaagaaagagcuccccuagcguuaccaaguacacaacgcuuuagaauuuaccaggaauuaaauaauuuaagacuauuaguagaucaacugaacgaacagccauuaacauuagcacaacgagauacuauugcaacacuaauggaaggaagggcuaaaaucaguuuugaccaaauacgcaaagcacuaaaauuagguucgaugacaaaauucaaucuggaagacgauaaaaggaacgaauugaaagggaaugcaacaggaagucaauuggcaaagaaagaauuuuucggccccgcuuggcaucaauuugaugaagcacugcaggacgauaucguguggcaucuucucucagaggagaacgaaagugcacuuauaaguuggcuacaggaucgaacggguauugacgcagcuacagcccaggcaguaagcaaugcaucucuaccugaaggauacgguucucuaaguaggaaggcuuuagagguaauauuaccaagacuccguucagaaguaauaacguacgauaaagcaguacaagcugcagguuuuagccaucauucucaacuggguuucgaauacgauccagacgauguagaagauuggauagaccaugcuacaggagaagugaaaccuaucuuuaaaagacuuccauauuauggaaaagcgcuacaacgacauguggcauuugguaguggaaaaccagaagacucacaagagaaaagguaugguaaaauugcgaacccgacagugcauauagguuugaaccaaguaagaguugucgcaaaugcauuaaucgcacgguacggacgaccaaccgaaauuauaauagaacuagcuagggaucuuaaacaaucaagagaacagagacaacaagaccaaagaagacaagcagauaaccaaaaacgaaacgcacgcauaagaaauucaauugcacaagcacuaggaauagcggaagcaagaguaagaagagaagauauacaaaaauggauauuaugggaggaacuagauccaggcgaugcaaugcauagauguugcccauacaguggaguuccaauaagcgcaagcauguuacuaucugaacaaguagagauagagcauaucuuaccauucagcaugacgcuagaugacagucuaaauaaccgcacaguuagcuuaagacaagcgaauagaauaaaaagaaaccgaucaccaugggacgcacgagaagauuuugaggcacaaggauggcacuaugauggaauccuacaaagggcagguuuaaugcccguacaaaaacguuauagguuugcggccgacggauaucaacgaugguuaagagaugaucaagacuuucuagcaagagcacuaaacgacacucgauauuuaagcagaauagcggcagaauaccuuagauuaguauguccucagggaacaaggguaauaccgggacaacuaacagcauuacuaagaagaagauuuggauuaaaugacauucuagguuuagaaggugagaaaaaucgaaaugaccauaggcaccaugcaguagaugcaugcguaauagguauaacugaucauggacuaaugcaaagauucgccagggcuagcgcacaagcacgugaacaaggccuaacaagguuagcagaagaaaugccgcucccauggccuacauaucgagaucauguggauagggccguuaguuuaauauggguaucucauaaaccagaucacggacaugaaggcgccaugauggaggaaacagcauacggacugaugaaagacggaacuauacgacagagacauaaagcagauggaaccaagggacgugaaguagcuaauguaauacguauagcagaaccagcccaaccaacaagacacggagucgaugaucaagggcgaccacugccauauaaaggguauauaggagguagcaauuacuguauagaaauaacaagaggagcacaaggaaaaugggaagguaccguaauaucaaccucugacgcuuauggcauaguaagagcaagagguauagcaggacuuagaaacacaagucaaggccagaacggucacccucuaguuaugagguuaguaauuggcgacucccuaagacuacgaauaaacgaugcacuacaaacgaugagaguaacaaaaauaagcggcaauggacaaguauuuauggcagggguacacgaagcaaauguugaugcaagaaauagagauaaaagucaagccuuugcauuaguaucaaaaauggccgggucacuccaggcagcccaagcgcgacaagcuacuauaucaccaauaggagaaauucgcgauccaggauuuccaggauga

SEQ ID NO: 8416 - RNA, 3120 nt, Artificial Sequence
  Cas9 variant
augaaaaaaaggauauugggacucgacauagguauagcauccguaggaugggcacugauagaauuugacgacgaauuucaggacaacaaaaaaaaaggaacaauaauaaaaucaggaguucgaauauucacaagagccgaaacacccaaagaaagagaaccuuuagcaaaaccaagaagagaagcacgaucgcaacguaggagaaucucuugucgaguugaaagacugaauuucgugagagaacucuuuguaaaaaacggacucguagcuaaagaaucaguaaacaagaauaacccaaauaacauauacauaacucuaaaucaaauaaaaacaccauggcaacucaggauggaagcacuggacagaaagcuaacaaaugaagaguucgcgguaguccuaacacaccuagccaaacauagaggcuacaaaagccuaagaaaaacagacucaaaagauaauaaaacaggagaaauguuaaaggcaaucaaccaaaauaaagaaagguuagacaacuccgacuaccgaacacuaggagaaauguuuugcaaacaugaguccuacaaagaacacaaacgaaauaaagauggggaauacauuaauucaguuacgagagaacuaauagaagaggaagcagaaaaaauauuugcaaaacagagaaaagaaggaaacaacuuugcagacguagacauagaaagagaauauuuaaaaauagcauuuucacaaaagccuacaggaagcauaaacaaaaugguagguuuuugcacauucgagaauggagaaaaaagagcacccagagauaguuacucagcagagcuauucaaaguacucaacacuaucaacaacaccacaauaacugauaugaaaacaggagaaacaagaaauuucacaggagcagaaauaaaaaaaauaaucgaaauaauaaaagacaccaaaggcaucacauacguaaaaauaaaaaaagaauuaaaacuaggaaguucacaauuuucuggcguagauuaccgagaaaaugcaaaaucaaaaggagaaggagaaaucuucgucucaaugaaaacauaucaugagaucaaaaguaaaauagaaaaauuaucaaaagagaaguggaauaaacuaaaagaaaacacagaacuacuagacagcauagucaacauaauagccaauuuuaaagacgaugaaaguaucaaaaaagaguuccaaaaauuaaaaauugaugaagacauaauagauguacuucuaaauuuugaguuuaagaaauucauaaacuuaucuuuuaaagcuuuaagaaaaauaauaccuuuccaauuccaaggacaaaaauacauaacagcaucaaugaguguuggauacagcuuaaaacaagaagggaucaaaaauaaauucuuaagggucccaucacaagaagaaaaugugaauguaccaguaguggcaagagcauucgcccaaacaagaaaggugauaaacgcugugauaagagaauacggucaauucgaucagauaaacauagaacuugcaacggaucuaaaaaauagcaaauucgacagaagcaaaauagaaaaaggacaaaaagaguuccaaucucaaaaagacaaagucuuccaagaaguccaagaucuaacaggugaaauaauaccauccucaagcuuauuacuuaaauauagacucuggagagaacaagaugaaagaugcauauacucaggaagaaaaaucucccgaaaagaccucuuagauaccggguuucuagauauagaccacaucauaccauauuccaaaucaauggacgacgguuucaacaauaaaguacucuguuuagcggaagaaaauagaaacaaaaaaaacgauauccccuuuaauuacuaccaaaggauaggacgcgauuggaacuucuuaauauccauaauugccucgaugaaaaacaugaaauauguaaagaaaaaaagauuacuaaagcaagaacucagugauauagaaauagaaucuuucauagaaagaaacauaaacgauacaagauacgcaacaagguacauaaaaaauuucuuagaaaacaaucuagaauucaaagaaaacgaauucaucaaagcaaaaguacaagcuagacauggaggauuaacuagcguacuacgauacaacuggggaauaucgaagaauagggaagaaucauaccuacaccacgcaaaagaugcaaucacaguagcauguucaacgcaaggcaugguacaauauauaucaaauauaagccaaaaauacgaaaacgggaaauauaaaaugaaacaaauaaaagaaagaacugagaacagaauucccaaaccaugggacucauucaaagacgacgucgaacgcucaauaaaugauauauucgucucauucgccccacgacacaaagucacaggauccgcccacaaagagacuauauacagcaaaaaacaccuagaaaaaggcuacguuacaaucaagaaaucuuuagacaaaauaaaauuaucagaccuaaaaaacauaccuugcgaugaaaauugcgauauaauacggguccuaaaagaacggcuagagaaauuuaacgacgauagcuuaaaagccuucgcagacccuguacauaugccaaccaaauguucaaauaaaaaaggcccaauaauaagaagugucaagauaaaagaaaacaauaagacagguaucgaaguaagaaaaggauuaguagagcgaggagacaugguacgaguggauguauuuauaaaggacaagaaguauuauuuaguaccaauauauguaucggacuuuaaaaauaaagaucugccaaauaaagccauaguaagcagcaaaagcgagaacgaauggaucaugauagacaaaaccuacucauucaaauuuucauuauuuaaagaugaccuaauaaaaauaaaaaauaaaaaaggugaaauauuuggauauuuaggcgguguacacagacucacgggcggcauaaacauaaaaucaugcuauaaaccaaaagaaaaagacggcaacauaggcucaaaaugucuacucgacuucagaaaauuccaaguaggaauacuaggagauuacaaugagguaaaacacgaaaaacgaaugccugccuacauaaacaccaaaaaagacaaagaacauuga

SEQ ID NO: 8417 - RNA, 3123 nt, Artificial Sequence
  Cas9 variant
auggauaggagagaugcaagagcaaugagaaggagaagggauagauuucagcagcggcaaagagcuuuauuaaaauaccuuguggcugacggauuauucccggaagaugaaggagaacgcaaggcuuuagcagcucuagacccguaugcacuaagagccagagcucuagacgaagcauugagucugcacgagcuugggagagcauuauuucauuugaaccaacgacgaggauuuaaaucaaacaggaaggcagauagaaaagcagacgaugaugcaggaaaaauagcgauagguguggauagagcaagagaagccauggcagagaauggggcucgaacuuacggagaauggcuacacagaagacgagcaagugcaacggacgcaaaugcaauuccaccagucagaacaagauuacgaccggaaucaggagaagaugccaagggagauggauaugacuuuuauccuggaagagaccuucuugaagaagaauuugcagcaauaugggaggcacaagcagcucaucauccagaugugcuaacagacgaugucuaugaaagguuauucgagauaguuuucuaucaaagaccacugaaggcuccucaaauagggauguguacgcuaaucgcuggugauaggcgguuaccaaaggcucauccauuauuucaaagaagaaggcuacuagaagaauuaaaugcauuaaugauuguacguccuggagagguagcacaaagauuaacgagagaagagagggacacauuauuucuuaaacuaaaagauagaaacaaaguuagcuuugaaucauuaagaaagacuuuaaaacuagauccugaugccagauuuaauaaagaaucugaaaauagaacagaguuaaaaggagaugagguagcagcagcaauggguucuaaaacacgauuugguaauagauggguacacuugaguauugaagaacaaugggcaguaauagaaagacuuggagauguugaaucggaugccgaggaugcagcuuucagggcauggcucgcagaaagguaugaguuaacuccagaacaaacaagagcuguuacaaaugcgccacuaccccaagguuauggccgauuuggugaaacagcaacaagaaaauuaauagaugcacugagggauggagagaaagacggccgagugcuaguauauagugaagcaguaaccgcagcaggguuaggccaucauuccgacagaagaacaggggaagucuucgaagaugaagaaggaaggccucaguuaccuuauuacgguguagccuuagaaagacauauaaugccaggaacuggagauccaucugauagugacgagaugagaguaggaaggcugacuaacccaacaguucauauaggccuaaaccaauugaggagaaucguaaauagauuaaucagagcauaugguccaccggcagaaauagcuauagaauuagcucgagaauuaaaauugacugacgaagauaagaaaagaauaaacaaagaaaacaacaguaauagguuagaugccgaacgucgaucagaaaaguuauuggcgauagguaaaccagacacaggggcuaauagggcacuauugaaauugugggaagaauuaaauccagcaaauguauuagacagacgcuguauauacucaggaguacaaaucaguauagacauguuauuuucagccgcgguagaaguugaucauauacucccauuuacugcuacguuagaugauucgaacggaaauaaaauaguauguacucgagaagcuaaccgagaaaaacguaaaagaucaccuuaugaagcguggggacauagcgcgcgaugggaagaaauagcagcaagggcggcccaauuaccaagaaauaagcguuggagauucgaaccggaugcuauggaaaaauuuaaagaugauggaggcuuucaggcuaggcauuuaauagacacacaauaccuggcaaggcucucgcgagaguaucuggcaacauuauauccagacaaaggagaagggucaggccauauauggguaaguccagggagauuaacagaaaugguaagaaggaagcugggauugaacgaucuauuacccgaccauaauuucgguggcggugcugaucaagccaaaaauagauuagaucacagacaucaugcaauagaugcaguaguaguagcaauaguugauagaggaaugcugaauagaauagcaagagcaagcggacaagagggcgcagaaggcagggaaagaauuaucaucccagaaccuugggaaggguuuagagaugaucugagaaccgcaguaaacgccauaacaguuucucacagaacagaccauggaacagcaucuaaggcagguuugccaaaaggaaaagaugcaacagcuggacgauuacacaaugacacugccuacggauuuacgggggaaucagacgcaaaaggaaacucaauaguaguuaggcgaguuccuuuauccaguuuuaagaaacuugccgauauagacagaguacgcgaucccgaauugaaagcggcuuuauaccaacaucucgacggguuagaaggaaaagcauucgaaaaggcaauaggagaauuuggaagucgagaauggcacccauauggaggaguaagaaggguaagaguaacugaaccacuuagcguaauaccaauccgcgauagaaauggacauauuuauaagggauacaagggcgauucuaauuaccgauaugauguuugggaguuacccggaggaaaauggguaaacgaggugguaucgauguucgaugcacaucaaccgggauggcaaagugcaauaagggcagcaaauccuacagcccggaaagucuuaaguuuacauagagaugaugugcuggcaauagaaagaaacggcgcggaaagagaauuaguacgagugguaaaauuuucagaaaaacaauucgcgguagccccaccaaaugaagguggcgcacuaaaagcaagggaugcagauaagggggaccccuuuaaauauagcuauccaucgccgaauacauuaaaagcguuaagggcaaggcaagucagaauagaugaacuuggaagaguguuagauccaggauucccagcacgaacaaaacagcgaaaaacaagaaagccaaauuga

SEQ ID NO: 8418 - RNA, 3132 nt, Artificial Sequence
  Cas9 variant
augcaacgagauaacccguuagucuaucgauuagcauuagaccuuggaagcacaaguuuaggaugggcgguauuuagguuagaugcagaaggaagcccgcuagcaauuauaaaagcaggagcaaggauuuuuagcgacggccgaaauccuaaagaugguaguucauuagcaguaacaagacgagccgcaagagcgaugagacgacggcgugauagauuacuuaaaagaaaagcuagaaugcuaggugcauuagaaagacaugguuucuuuccacaagaugaaagugcaagaaaaguccuagaaacgcugaacccuuuucuauuaagagcacaagguuuagaaguugcacugaaaccugaagaauuuggacgagcacuauuucaucuaaaucaaagaaggggauuucaaucuaacagaaaaacagauagaaaggacucagauagcggugcauuaaaacaagcuauagguacauuaagagcucaaaugcacgaaucaggaugcagaacaguaggcgagugguuuuggaaaguacggauggaacacaaaccagaggguguaaaaggacaagguguaagggcaagguauagggaaacuccauuuacuacugaugaagguaagaaaagaauagauaaaagauaugauuuauacguugauagagcuaugguagcucaagaauuugacgcacugugggcugcucaagcggcauucaaucccgcguuauuuaaugaagccgcacgagcagaauuaagagauaucuuguuacaucaaagaaaacuaagaccgguucaaccaggaagauguacauugguaccagaggaaccuagagcucuacuugcgcuaagcaguacacaaagauuuagaauauaucaagagguuaaucacuuaaggguccuacaugacgagcuaagagaagagacacuuacucuagcgcaaagagaccagaucgucgcacuacuagaaaaacaagcuaaagugacauucacugccaugagaaaggcuuugggcuucucggcacuauuuaaucuagaggacgccaagcgagauggacuaaaaggaaaugcuacagcggcugccuuaagcaagaaagauuuauuuggaccguuaugggcaggauuuggaacagcacugcaagacgaaauaguaacacaacuaaugacugaggaaucggaaccccgucuuauugcauggcuucaagaacacaccggaguagaugaagcaagagcacaagcaauugccaacaccggacuuccggaaggauauggauccuuagggagaaccgcauuagcaaggauaguaccagaacuacaaagagacgugauuaccuacgauaaagccguacaagcugcaggguucgcucaccauagcgauuuaggguuuucauuugaacacggagcugaugaaguagaaaggauaggggaaaggaccauagcaucaaccggagagauuaaaccgguuuucgccuuuaaacaguuaccauauuauggucgagcuuugcaacgacacguagcauuugcaaaagauaauccuagaaaugacgaagaaagauauggaaaaaucgcaaauccaacaguacauauaggguuaaaucaagucagaguaguugugaaugcauuaaugagaagauaugggcguccggcagaaguagugauagaauuagcuagggauuuaaaacaaaguagggaacagaaacuugaagcacagcaacgucaagcagacaaccagaaaagaaaugccagaauaagaagaagcauagcggaaguuuuaggaauaagugaagaaagaguaaggacacuagauauacaaaaauggauacuaugggaagaacuuucacaugaugcagcggauagaagauguccguacuccggaguacaaauauccgccaguaugcuucuaggugaaagaguagaaaucgaacauauauuaccuuuuaguaugacuuuagacgauaguuuaaauaauagaacuguagcgcuucgagaagccaauagaauaaagaggaacagggcacccugggaagcucgugcagacuucgaagcccagggguggaguuaugacggaauuuugcaaagggccgaaagaaugccgcuaagaaaaagauacagguuugcaccggauggauaugagagguggcuaggagaagacaaagauuuucuagcaagagcauuaaacgacacucguuacuugagccgaguagccgcagaauaucuucggcuagucugcccaggcucagcaacacggguuauuccaggccaaaugacagcuuuacuaagaggaaaauuugguuugaaugacguacucggacuagauggagagaaaaacagaaacgaccauaggcaucaugcaguagaugcauguguuauaggcgugacagaccaacgaaugaugcaaagauucgcgcaagcaaaugcucaagcaagagaagacggucuaacaagacucguagaagacaugccacucccauggcccacauacagagaucacguagaaagagcaguacaucauauaugggugagccauaaaccagaucauggauuugaaggugcuaugauggaagaaacuagcuacggaauauuaagagacggaaguauaaaacagcgacgaaaagcagacgggucagcuggcagggaaauaagcaaucuaauaagaauagcugaaccugggcaaccccaaaggcauggaguagacgcagaaggaaggccacuuccauacaaaggauauguaggaggaaguaauuauuguaucgaaauaacaguaaacgacaaagggaaaugggaaggacaaguuauaaguacauuugaugcauauagaaucguaagagaaggagguuuaaggcagcuaagacacccaacacaggggcaaaaugguagagcuuuagcaaugcgauuaguaauaggagacucaguacgucuagaagcaggagaggggucacuccaaacucuaagaguagcaaagaugagugcagcaggacaaguauucaugagcgaagugaaucaagccaauguagaugcacgaaauagaaacggugauuugccauauguaaguaagauggcagguucuuuucaaaaagcuagagcuagacagguaacaaucagcccuaucggagaauuaagagacccaggauuuaaaggauga

SEQ ID NO: 8419 - RNA, 3135 nt, Artificial Sequence
  Cas9 variant
augaaauauacccucggccuagaccuaggcuacaauagcaucggaugggccauccuggaaaacgacgaaaacggaagccccaucaaauuauucaacgcagguguccacauauucgaaccaucaauugaagacauagaaauagaugguaaaggaaaaacaaaaaaugucaaaagaagagaggcacgccugagaaggagacaguuauucagaaagacaaagcgacuugaaaaacucuuaaacuuuuuuauacaagaaggauucuuccaaaaccaaaagguauuaauaaaugauccuuucgaaagagcagaauuccuauaucaauuagacaaaaaguccagaaacccuuauauauuacgcagagaggcccuagacaaccgauuaucccucgaagagauagcacgaaucuucuaccacauagcucaacacaggggcuucaaaaguacgaaaagagaguuagcagaaaugaacaaagacgaaaaaaaaaaaaaggaagacggaaucauccaaagugaaauaaacacauuaaaagaagaaaucaaaaaaaacucaugucgaacccuaggcgaauacuuugcuaaacuauucgagaauggcgaaaaaaucaggggaagacacacagaccgaaaaauguacgaagaagaauuucaaaaaauauuuaacaaacaaaaagaauuuuacccaaacauauuuacagaugaauucaaaaaaaaacuauacaagcuaauauuucaccaaagagaacuaaaaagucaaaaagauaaaguaggauucugcagccucgaacgagguaaaaaacgcgcuccacuagcacugcuuguaucacaaagauauagauacaugugcaaagugaacaaccuuaacgucauagacacggaaacaggagagaacagagaacuaacggucgaugaaaaaaagaaauuauacgaaaaacuggaaaauucagaaaaacucucauuuaaagaaauaaaaaaaauauuaaaccugagcgaaaagcgauacauauucaacuuggagaaaucggaaaaauacaucauagguaacaaaacaaauguaaaaaugaaaaauauaauaaaagacugggacaacuucgaugaagauaagaaaaauuucuucaucaaugaagcaagaacaguaguuaaaauugaaacuuuagaacgacgaggaaaaaaauuaggguugucagaugaagaaagcaaagaauucucaaaaguaguuuuugaagaugguuaucucaacuuuagcaaaaaagcaguugaaaaacuguuaccuuauuuaaaagaagggaaaaaagaauaugaggccauaaaauuagcauacccagaaaacagcguacagaacgacaaccuaaaagaacuagauuuuuuaccacccauaaagaguaaagaacucaaaaaauauuucgaaguaagaaacccaauaguagaaaaagcauuaacagaaacccgcuaucuaguaaacuuccuaauaaaaaaauauggcaaaccagaaacaaucaagauagaauuagcaagagagcuaaaacuaagcaacaaacaaaaagaaagaaaacauaaagagaaccaagaaaaccgaaaaaaaagagaagaagugauagaaaaguuaaaaaacgaccuaaaaauaagugaacccacggaaacacagauucaaaaauaucuguuagcagaagaaugugacuguaaauguccauauaccggaagaaguaucagcauggacagccuguucggagaacacccacuguuugauauagaacauauaaucccauucgauagaucacucgacaacagcuuccucaacaaaacauuauguuauucagaagagaaccguaaaguaaagcacaauaagacgccauacgaagcuuacuaugggaccgaaaaaugggaggccauaaucgaaagaguaaaaaaauucaaauccaacguaagaaacgaaaaacuaagaagauuccaaaugacaaaagaagacgucgagaacuacauacaaaacuuuagcacucaaaauuuaaacgauacaaaauaugcaucaaaacuugcaaaaaaauacuuaggccuuuuauaugguuccauaaacgaagacggaauagauaaaaauagaaaaagaagaauauucgcaaguucagguaaaguaacuagcacacuaagauaugcacuuggacugaauacaauacucaaugacgaaaauauaaaaacucgagaagaccaccgacaucaugcaauagacgccaucacaauagcgcucacagacaguucaaugauaaaaaaaauuucagaugccucaaaaagagagaagaauauaaacagccuauucaaagauuuccaagcacccugggaaaauuuccgaaaagaagucgaagagauaaucgcaaagaugaauaucucaauaagaaucaacaaaaaaguuucaggucaaauacacgacgaaacguucuauaaaaaaccauuuaaagaagaagaaaaaagcuacacucaucaacgaauaaacuuagaagaacugacaauaaaagacgaagacaaaaaaaaacaaagcucaaaacuaauagacaacauaguggacucaaaaauacguaauaucaucauaaacaguuuaaauggagaaaaaccaaaaauaagauuuaaagaucccaaagaucauccauauauaauccaaaaaaacgguaaaaaaauucaaauucacaaagucacgauuaaaaccaaauuggagacauacaacgaaauaggaccagaaaaagcgaaaagauacguaaaauccuccgacucgcaucauauagaaauauuugaagacuuaaagacaaaaaaaugggacgguuauguuguaagccuacuagaagcauacgaaagaaaaaaaaaaaaacuaccaaucgugaauaaaaacuuaggugaaggaaaaaaauuccuauucagcuuagcgaagggagaaauaauagaacuagauacagaaaacggaaaaagagaauuauuugucgugcgcauaauuucagcgagcaacaaucagauaaaguuuacaagaauaaaugacucaagaaaaauaacggacauaccugcuacaggucuaacggccugcccaagcagccuaaaaaaaagaaacugcaagaaaguagucauuaauauauuaggagaaaaacacuacagcaacgacuga

SEQ ID NO: 8420 - RNA, 3135 nt, Artificial Sequence
  Cas9 variant
auggcggaaaaaaaauuuaaauaccgacuaggacuugacuuaggaacaaacucaaucggaugguguauguuaagauuaaacaaagacaacgaaccagcagcaguuauaaaaucgggagucagaauauuccacgacggcaggaaugaaaaaaccaaggaaccacuagcaguaguaaggagaaaugcacgcagcauaagacggaaccuagacagaaaaauauccagacgaaaucaccuccuaaauacucuugucaaauacuuucucuuaccaagcaacgaaaucgaaagaaaagcccuagccgucuuaaauccauacgaacuacggaguagagcaguaaaugaaagacuagaacuuuuugaacugggacgcuuauuaaugcaccuuucaaagagaaggggauucaaaucaaaucguaaaguagacaaagaagauucuagcggaaaaauaaaaccugcaaucgaacgacuaaaaaauaaaaugcaagaaacaaauaaaaaaacugcaggagaguaccuauacucccuuaugcaaaauggaaaaccaguuagagccagauuaggaagaauagauggaagcaacggcuacgaaaucuacuuagauagagccuuaauagaagaagaauacaacuuaauaaugaacgagcagaaaaaacaucacaaggaauuaacagacgacauaauuaacgaaaucuuuaacauaauuuuuuaccaacgcccucugaaaaaacaaauaauuggaaaauguucauuaacaggugaagacaccaaacuaaagaaagcacauguccuagcacaagacuuuauacuauugcaaaaaguacaagaccuucgaguauuugacgacaaucaacuugaauuuagaccucucucgaaugacgaaaaagacauaaucaaaagagaacuacgaaaaaagaaagagguaucuuacgaaaacauacgaaaacuauugaaaaaauacuaugaaaauguaaaauauggaauguuuucccaugaaacccuauauaaaaaacuacagggaaacaaaacaaaugcauuaaugucagacaaagaaaucauuggugacucaugguacucucuaucgccagaaguucaauaugacaucauagaagaacucuacagugacaaagacaacgacgaauugaguaaacuuuacagugaaaaauuuaaucuaaacgaaagucaaaucaacggcuuacuaaauaaagccauauaucgauuagacuccggauauauaagauauggaaaaacagcaguaacuaaucuaaauuccauuauggacaaagauaaccuuaaucuacacgaugccagagaagaagccggauacgaaaaagagaacaaacaagaugccagcgaauaccuagaguacuacgguaaaguauuaccagacaguguuguggauccacaaauugagaauccuaaaaaugacgaagaaagauacggcaaaauugcgaaccccacaguacaugccgcauuaaaucaauuaagaaaauuaguuaaugagcuaauaaaauuauacggaaaaccugaacaaauaguaauagaacuagccagagaccuaaaaaacucucgaaaagcgaaggauguaauaaacaaaaaaauagcggaaaacagaaaauuaaacgaagaaguagacaaaaccuuacaggaauacagcgagaaauauaacacucauauugucaaaaacaaacucaaccgagauaaaguaaaacuauggcgugaacuagggaaagauccucuagaaagaaagugcauauauacaggcgaacaaauaaauaucgcaaaacuauuuagcgacgaaguucagauagaacauauagugccauacagcaaaacauuagacgauucauuuaacaacaaaacucugagcaugaaacaagcaaauuacuacaaaggaaacaaaacgccuuaugaagccuuuaaagauuccaaagauggauacaacuaugaugacauaauagccagagcaaaacugcugaauaaugauaacaaauucaaacgauucacaaaagaugcaauggauauauauaauagggauggaaaagauuucaucgccagacaacuaucagauacucaauauuuaagcacacgugcauuaaucuaucuucaaagucuauacgaaaaagcacaccauucuucgauauggacaauaccaggccaacuuacagcauuaauaagaaauuauuuaggucuuaacacacuaauaaguaaugacaaaaacaaaaaucguaaugaccauagacaccaugcuguagaugcauucguuguagcaguaacaucacgaaguuuguuacaaaaaaucucauaugcggcaucacuacaagaagaccuugacaaccgaaauguuucgaguuauagaaacaaacuccuagaaaaaaugccggaacccuuuccaaacuacaggaaaagccuagaacuagccauagacaauauaaaaacaagucacaaggcagacaggucuaucagcgggaaguuacacgaagacacggcauaugguauugucgaaaaugacgauaaauacaacguaguaaccagauggacaguagacaaauucaaagaacaaaagcauuuugaaacaauaagagauaaugaacugaaagaaauagcgugcucagacaaagaacuauucgcgaaaauaguagaaacaaggaaaauaaaaaguauaagaaaacuagccaaagaaaauccaguaaucaaaauaaaagacaaaaguggacgagauuacaaagcauucgcgggcggcaauaacauaugcguggaaauauacgagguagauggcguacguaaaagcgaggucauacaacuauucgaugccgcacaaaaaggauuuaugccagaauggaugaaaaaauauccaaauggcaaacuauuaaugagauuauuuaaaggagacguuaucggcuucauagaaaacagaaaguacaauuacuacacuauaaaaggcaucagcauugccgaucaaaacuuaaagcuacucgcuaucaauaaagcggaaggaauuuuuaagaaaggacuaaacauacuuuuugacucaaacaacaaaaauagcuuaaaugcaaaacaauucaauauaagcguaacaggcauaguaacaaaaaaaaaaaccgccgauguaaacuucuggaaaaacagaaaauga

SEQ ID NO: 8421 - RNA, 3135 nt, Artificial Sequence
  Cas9 variant
auguuacacaaaaugagauauagguuagcauuggaccugggaucaaccucccucggaugggcaaugguaagguuaaaugcaaaucaacaacccugugcaguaauaaaggcaggagugcgaauuuuuaguaauggcagaaacccaaaagauggaucaagccuagcuguaacucgaagagaagcuagauccaugagaaggagaagagauagacuucuaaaaagaaaagcaagaaugaugagaaccuuaauagaauacggauucuuuccagccaacgaaacacaacgaaaagcacuagaaaaucuaaauccauacgcauuaagagccaagggauuggaugaagcucuaacgccaagcgaauuugccagagcauuauuucacaucaaucagagaagaggauuuaaaaguaacagaaagacagacaagaaagacagcgacucuggagcauugaaaacugcuauaaaacagcuccauaguguauuagacccacaagguaaugacggaaaaccaagaacuguaggagaauuauuauauaaaagauuuacagacuugucgaaacugccaaaagaccgaacgguccgggcaagauauagacaggauaaaauaguaaaagacgacggaaagaccaagauagacaaauacuaugaucuguauauugacagagcaaugauagaacaagaguuugaugcccuauggaagaaacaaagugaauuaaaucccauacuuuucacagaaaacgcacgugccgauuuaaaggauguauuauuauaccaacgcagcuuaaaacccgucaagccugguagauguacguuuauguccgaagaagaacgagcaccacuagcucuaccaagcacacaaagauucagaauguaucaagaaguuaacaaucuacggauacuaagagaaggguuaaaagaagagagcuuaacacugcagcaaagagacgacuugauaaaugcacuugagaaaaacaauagaaggacauucacacaaauaaagaaauuauuagguguagguggaucaguacaauucaauuucgaagauccaaaaagagaagaacuaaaagguaacacgaccagcgcaaucuuaggaaaaagugaacacuuuggggaggcuugguuugccuuuaaugaagcuaaacaggacgcuaucguacuacaauugauaaaagaagaaaacgaagcuaaauuaguucgauggcugcaagaugaaacaggaaucgaugaaaagagagcagaaguaauagcaaacgcgggguuaccagaaggguacgguagcuugugcauagaggcuuuagcgagaauacucccugaauuaaggagagauguuguaacguaugauaaagcaguccaagcagcaggauucgaacaucauucuaaguuaaaucgaaaugaagaaauaccagauaucacguuuaaaauagaaucuauugauagaaauagcggagaaaucaaacaauuucauuuacauaaagaacuuccauacuacggagaauacuuacaaagacacguaggauuugguucaggaaaacccgaagacucaauagaaaagagguauggcaagauagccaauccuacaguacauauaggacuaaaccaaguacguguaguugugaaugcccucauaaaacgauacggacacccaucggaaauaauaguagaaguugccagagaucuaaaacaaagcaaagaccgcagagaugaagaaaauaagagacaagcugaaaaccagaaaagaaaugaaagauuaagaaaagauauugcagauauacuugggauaagugaagaaagaguuagaagagaugacauagagaaaaugauacuaugggaagaauuaaguuucgauccagcagauagaagauguccauacaguggcguucaaguaaguacagucaugcuuuuaucggacgaaguugaaguagaacauauuuuaccauucucacaaacauuagaugauagucucaauaauaaaacgguagcccuaaggcaagcaaacagaauaaaaggaaauagaacuccaugggaagcauucggaacuagcaacaucagcggcuuugauuauagugggauauuaacaagagcggaauuaaugccaaaagcaaaaagauaucgauucgcugaagauggcuaccaaagaugguuaaaagaugacgcaggauuucuagcaagagcucuaaacgauacuagacacuugagcaaaauagcuagggaauauaugagucuaauaugcccuaauacaagaguaauaccaggacaaaugacagcaauguuacgacguaacuucgguuuaaaugauguacuaggauugaauggagagaagaauagaaaugaccauagacaucacgcaguugacgcaugcguaauagcuguaaccgaucaaggucuucuacaaagguuugcagccgcaucugcaagugcacgagaaagacaauuaaaucgucucguagagaauaugccacuaccaugggaaaguuauagagagcauguacguagagcuauugaugggauauggguaagccauagaccugaucauucacaugaaggugcgaugcauaaugauacggcuuauggauuacgaggaaacgguagaguaucauuucacaaaaugguggaaggaaaaagagaauacauagaggacaaucucaaaguaauagaaauaacugacaccaaagcaauagauagacacggcuuauuaccgacaggaaaaccacgaccauauaaaggauauaaaggggauaguaauuauuguaucgaaauagugaggaaugagaaagggagaugggaaggugaaauaauuaguacauucgaugcuuaucaauuaguuagaaaauauggaauuguacaauuaagauaucccguauuaucaguaucaggcaaaccauugguaaugaggcugauacguaaugacuuuguaagacuagagcaugaaggaauuacaagaacauuaagagucuguaaaaugagggaagacggacaagucgcauuagcagauguaacagaagcaaauguagaugcaagaacacgaacaaaagaaauauguuacguauucaaaacgggagggagcuuacaaaaggcuaaagcccgcagaaucacaauaucaccaauaggcgaauugagagauccaggauucaaggaauga

SEQ ID NO: 8422 - RNA, 3138 nt, Artificial Sequence
  Cas9 variant
augcaaaaggagaaaccauuagcauauagacuagcauuagauuuaggaucaacaaguuuggguugggcaguguugagacuuagcgcaccaggagaaccaucggcuguaauaagagcugguaguagaauauuuuccgaugggagaaauccuaaagauggaagcagcuuagcggucacaagacgagcggcaagagccaugagacgaagaagagauagacucuuaaaacgaaaagcuaggauguuagcagcuuuagaaagacacgguuucuuuccacaagacgaagcugcuagaaaagcauuagaaaaacucaacccuuauggacuaagagcgaggggauuggaauccgcguuaaagccggaggaguuuggacgagcacuauuccauuugaaucaacgccgaggauuucaauccaacagaaaaacagacagaaaagauucagauaguggagcacugaaacaggcaauaggcacacuacgagcccaaaugcaugaaucugguuguagaaccguuggagaaugguuuuggaagguacguauggaaagaaagcccgaagggguaaaagggcaagggguuagagcgcguuaucgagaaaccccuuuuacaacugaugaagguaaaaagcgaauagacaaacguuaugauuuauacguagauagagcuaugguugcacaagaauuugaugcauuaugggcagcacaagcgacauucgcaccggcacuuuuuaacgaagccgcacgugcugaacuuagagauauuuuguuacaucaacgcaaacuaagacccguucaaccaggaagguguacauuagucccagaagaaccuagagcuuuauuagcccuuccaucaacacaacgauucagaauauaucaagaaguaaaucaccuccguguacuacacgaugaacuaagggaagaggcuuuaacauuagcacaaagagaucaaauaguggcacuauuagaaaggcaagcaaagguaacuuucacugcaaugcgaaaagcacuuggguuuucggcauuauuuaacuuagaagaugcaaaaagagauggucuaaaaggaaacgccacaacugcggcauugggaaagaaagaucuuuuugggccacucugggcaggauucgauacagcguuacaggacgaaauaguaacacaacugaugacagaagaaucagaaccuagguugauagcgugguuacaagaacauaccggugucgaugaagcccgugcacaagcaauagcuaaugcaggcuuaccggaaggauaugguagcuuaggaagaacugcguuggcaagaauaguacccgaauuacaaagagauguuauuacauaugauaaagccguacaggcagcaggauuugcucaucauucagauuuagguuucaguuuugagcaugaugcagacgaagucgagagaauaggagagaggacuaucgcaaguacuggagaaauaaaaccaguauuugcuuuuaaacaacuaccauacuacggacgugcucuacaacgucacguugcuuuugcaaaagaaaacccaaggaaugacgaagaaagauacggaaaaauugcaaacccuacagugcacauaggccugaaccaaguaagaguaguuguaaacgcgcucauguguagauacgggcguccgaccgaaguagucauagaacuagcccgagaucuaaagcaaaguagggagcaaaaauuagaagcucaacaacgacaagcagacaaccagaaaagaaaugcaagaaucagaagauccauagcagagguacuagggauuucugaggaacgaguaagaaccuuagacauacaaaaauggauacuuugggaagaauuaucucacgaugcugcagacagaagguguccuuacucaggaguacaaauaagcgcaucuaugcuucuuggagaaagaguagaaauugagcauauacuaccauuuaguaugacauuggaugacucccuaaauaacagaacgguugcccuaagagaagcaaauagaaucaaaagaaaucguacucccugggacgcaagaaccgauuuugaagcacacggcuggaguuaugauggaauuuuacaaagggcagaaagaaugccacagagaaaacgucauagauucgcaccagacggcuaugaaagauggcuaggagaagauaaagauuuucuagcaagagcguuaaaugauacacgauauuuaagucgcguagcugcagaauaucuuaggcuuguaugcccaggcucugcuacuagaguaauccccggacagaugacagcucuguugaggggaaaauuuggauuaaaugaugugcuaggacuagauggcgagaaaaauagaaaugaucaucgccaucaugccguugacgcauguguaaucgggguaacagaucaacgaaugaugcaaagauuugcacaagcaaaugcgcaggcuagagaagacggcuuaacaagacuuguagaagauaugccauuaccuuggccaacauacagagcgcaugucgaacgcgcuguaagacacauaugggucagucauaaaccagaucauggauucgaaggagcaaugauggaggaaacuucuuauggaaucuuacgugauggaacaaucaagcaaaggagaaaagcagaugggagugcaggcagagagauaaguagacucauaagaauaacagaaccaagucaaccucaaagacauggugucgacgcugaaggacgaccauuaccauacaaagguuauguuggagguuccaauuauuguuuagaaauaacaguaaaugacaaaggaaaaugggaaggucaaguuauaaguacuuucgaugccuauaggauaguaagagaaggaggacugagacaacuuaggcauagcacccagggacagaauggacaggccuuagcaaugagauuaguuauaggugauagcguuagauuggaaguagaugaacaagaaagagucaugagaaucguaaaaauaaacgggaacaauggacaagucuuuauggccccuguucacgaagcgaauguggaugcacguaauagugacaagaaugaggcauuugcuuauacaagcaagauagcagguucuuuccagaaaacuaaagcaagacaaguaacuaucucgccuauuggagaacugagagaucccggauucaaaggauga

SEQ ID NO: 8423 - RNA, 3138 nt, Artificial Sequence
  Cas9 variant
augaaaccccgaaaccuaaacuacauacuuggcuuagaucuaggcauugcaucggucggauggucuguagucgaaaucgacgaaaacgaguauccaauacgacuaauagacguaggaguaagaacauucgaaagggcagaaguuccaaaaacaggcgaaagccuugcacuagcgcguagauuagcaagaucaacuagacgauuaauaaggaggagagcauuucgacuacuaaaagcaaaaaggcuauuaaaacaucaccaaaucguaaaugccgaagaacuuacacaguuacccaaucaaugcugggaacuucguguaaaaggacuagauagucuacugucaaauacugaaugggcugcaguuuuacuacauuuacucaaacaccgcggauacuuaucccagagaaaaaaugaagcccaaaacgccgauaaagaacuggggaaauugagggaaggaauggacaacaacucgaagcucuuauuagaaaauaacuacagaacaccugcugauauagcgguuaagaaauuugcagucgaagaaggacauaugagaaaccaaaggggagcuuacacccauaccuucaacagauuagauauuuuggccgagaugcaauuauuauucaaaacacaaagagaauuaggaucuacauacgcaaauggugaauuggaacaagccuuuugcgaacuucuucuauggcaaaaacaagcacucaauagaagccaaaugcuuucacuaguaggcaagugcaccuuugaaaaagaggaaaaaagagcagcaaaggcaagcuacucagcagaacgauuugucgcaauccaaaaacugcagaaccuucgaauccuagaaaauggagaagaaagaggacuauuugauucagaauucucacuacuccuggaaaacgcuuauaaucuaaaaucaggacuaaccuacaaacaaguaagaaaaauccuaagcuuauccgaaaacgccauauuuaaaggccuaccuuaucuaucagacgauuuagagaaaccugaaaaaacacaauuccuagccuucaaguuuuaccaucaacuagcugacauauuaaagaauaacggcuuuuccgaugaguggcaaaaacuaagccaagaaccgacacuacuagacaagcuaggcacagaacucagccuauguaaagaagaaaaugaauuuaucgcucaauucaacggcgaacuaccugaagcaaugcuaucaacgcuauuuaaccauacaaauuucgacaaauucauccacauaucuuuaaaagcuuugaauaauauauuaccacuaauggaacaaggaaaugacuacacaaaagcauggcgaaaaguauauccagaaccaacaaaaaaggacgaaaaaacccuaccaccaauuccagcagacgaaauaagaaauccaguaguauuaagaaguuuaucccaagcaagaaaaguuauaaaugccgucauccgccucuacggauccccagcucgaauucauauagaaacggcacgagaauuagguaaaucguacgaugacagacaaaaaauaaaaaaacaacaagacaaaaauucagaugaaagagaucaagcggucaagaaauuccuagaagaauguccaaauuuugccaauaaaguuaaaggaaaagauauauuaaaaauacgacuauauauaaaccaagacgguaaaugccucuauucaggaaaaccacuggacccccaccgauuacuugaaauaggauacguagaaaucgaccaugcgcuuccauucucacggacaugggacgauucucaaaacaacaaaguucuaguuuuagcaaacgaaaaucaaaacaaaggaaaucaaacaccauucgaauggcuaggaaaagaugaacaccaaugggcgcuauuuguugcccgagucaacgguugcagauucccauaugccaaaaaacaaagaauacuuacaaagaaguuagacgagcaaggguuuuuaaaaaggaaccuaaacgacacucgauacgucucagccuaucuaaugaaacauauuaaagaaaaccuacacuuaguuggaaaagggagcgauaaaguauucgcuaguaauggacaagucacaaauuuccucagaagauguuggggacucgaaaaaaaaagggaagaaggcgaccgacaccacgcacucgaugcaauaguuguugccugcuccacagcaagcaugagacagaaaauaacauuauucaagaaauaucaaagauggaaucuaaaaaccggcaaacauauugaucaagagaccggagaaauaauaccccuccauuuucccgcuccaugggauuucuuuagacaagaagucaugauaagaauuuucucagaaaugccacaagaagaccuuauaaugcaacucccugauagaccccaggcuaaucacgaauucgugcaaccucuauucguaucaagggcacccagccggaaaauguccggacaaggacaugaagcaaaacuaagaagugcacgaauguuagaagcaacagggaaaucaauuaaaaaagaguuccuaaccgauuuaaccaucaagaaucucgaacacauggucaauaaagaaagggaaccagaauuauaccaagcacuaguagaacacuuuaaaaaauacggagacaagccaaaggaaaaauuuuuuaagaaaggaggagucgaaguaaaaucaauucgaauauccaaaacacaaaauaagucaguaaacuuaggcaauaaaacaaucgcggacaauggugauauaguacgaacagaccuauucuuaaaaaacaaaaaauauuauuucguaaauauauacgcauggcaagucagcaaaggaauacugccaaaagaaaccaccacugguaacauauuagauaauucauacgaauuccaauuuucacuauuuaaaaaugaccuacuugaaauuccccacccaaaaaacgaaaacgacaguauacuugcuuacuuuaucagaccagacgaugaaaggagauggauccuuaaauuucacgacaacgcuaagauaccggacauauauggaaaaaaagaugaaacaucuauaagacucucaauacaaggacaaaaauuuauuaaaaaauaucaaguagacgaauuagggaaaaacauacgaccaugccggccuacaaaaagacaaggaguaagauga

SEQ ID NO: 8424 - RNA, 3141 nt, Artificial Sequence
  Cas9 variant
augaaaauauauucauuugauauugguguagcaucaauugguugggcauucaucgaaaacgaaguauuacaggauugcggcauaagaaucuuuaccaaagcagaaaacccgaaaaacggcgccagucuagcacuaccccggagggaagcacgaggaguacguaaaaggcuagcgcgaagaagaggccgacuaaauacaauaaaacagcuucuaugcaaagaguucggauuacaauuggaagacuaccugaguaaugacggagaacuaccaaaagcauacacagcaucaaaagcaaaccccuuaaaaucaccauacgaacuuagaacauuagcccucucgcaaaaauuagacucaaaagaucucguuagaguaauauuacauauagcaaaacauagagguuacggcaacaaacacgccaaagauucaaaagauacugaaucgggcaaaguuaagaaagcaauagaauuuaauagaaaaacauuagcagaaaaaggcuauagaaguguaggugaauauuuauauagagaguucuuccaacaaucuagaauaagucaaaauaacggcgcaacugaauuuguuaacguucggaacaagacagguaacuacgaacacuguguggcucaggacaugcuaaaagacgaauuagaacuaauauucagaaaacaaaaagaacuaggauuacaucuaagcgacggauucgaaaaacagcuccucgacaaaauauucgaacaaagaccgcuaaagagcuucgccgacaaaguaggaaaaugccaauucauagccggagcaaaaagagccccgaaagacaguauaucagcaauagaguuuguagcauugucuagaauaauaaauacauuagcaaaucuaucaaagaaaucaggagaaauguaugauaaagcuaugguacuaacaauccuagacaguguuuuagaaaaaggagaaaugaguuauuacgccuuaagagaagcaauaaacuuagaugagaaaauacguuuugcugacucaaggcuagauuauuccaaagaaauaaaagaaacugaaaagguaaaauuuguagaaugcaaaaaccuaaagucauuuaagaaagucuuagguaauuguuauaaaacauuagaaagaaaacauauugauucuauagcggaacgaauagcaguaauaaaagacguagaaaaacuccauaaagaacuagaaagcuacugcgcaaccgaacaauuaucauugacuucagaacaaauccaagcgcucagucaccuaaacuucaguucccauauuucucuuagucuaaaagcguuagaacaaauacuacccuucaugagaggagaaagagaagccagaagcuccgaugcagacuacuguauaggaauagacgaaagcggagaaagccaauguuuacgauaugacgaaucaguugaaaaagcaggccuaaaagcauuaagcaaagacacucuaaaaggacaaauauuaccaccuuuaaaugaguuugaacccuaccuagcaaauccaguaguugcaagagcacuagcugaauauagaaaaguuuuaaacgcacuacuuaaacaauauggaagcccucacaaaauucauaucgaauacgcaagagaagcuaaguuaaacaccacagaaagacaaaaauaugaaaaagagcaaaaagacaauuaugcagcaaaucaagcagcgcauaagaaaugccaagaacugggacuagaaccuaguucgacaaaccuucuuaaauuaaaauuauggcaagagcaaggaggacuaugucuauauucuggagcuaaaauaacaauuucauauuuacaagacccuaccgcacuacaagucgaucauauauaccccuacucgcgaaguuuugacgauucauauaugaauaaauguuuaguacuaacuaaagccaaucaagaaaagggaaaucgaacuccauucgaggcuuuugguacagauucagccaaauggggcguaaucacaaccuuagcacaaaaacuuccacauaagaaaagaagacgaauacuaaauacagcauuuaaugauaaagaagcaggauucaaacuaagaaaccuaaaugauacaucuuacauagcccgccuaguugcagauuauaccgaaaccuaccuagaguuccuaagccucgucgaaucugaaaacacuacacuugggaaaggacaaaaagguaguaagaaacacauagcaaucguaaacggugcuuuaacaucuacaaugagauauuaucuaggauucgcuaguaaagacagagauaaccaucuacaucacgcucucgaugcggugauaauaggauucaugaacgacaguguaauaaaagcauucagugacuuuaagaaaacucaagaaacaucaaaagccgcuuauuacgcucauacacuuagcaaacaagaauauaagaaacaaagagccuucauacaauuaccaucaggugaaaauuucagagccaacguacuagaaaaagcggaaaguguauucgucuccaaaccacccagaaaaagaguaagaggagcauugcacgaagaauccuuuuauucccaaaaugacacaaaacuauuaaaaagcuacggaggagcagaaggaauugaaaaagccuuacaacucggaaaaauacggcaaauaggaacaaaaauuguauccaacggagcaaugguacgaguagacauuuuuaaacacagaaaaaguggaaaguuuuacggaguaccgguauacacaauggauuucgcucuagguauacuaccuaauaaagccguaguacaaggaaaagacaaaaacgacguaauaaaagacugguuagaaauggacuccucauaugaguucauauuuucacuuuacaaagaugauuuacuauuaguccagaagaaagaaauggcagaaccagaacuaugcuauuuugucaguuuugacacgucaggagcuucuauaaaaguagcuaaacacgauaacaauuucucaacuuuaacugaaaaucaaaaauuauuguucucaaacgcaaccaaagaagaagucguagguaaauccauagguauucaaaaccuaaaaguauucgaaaaauggcaaguaaguguauuaggagaaguaaaaagaacacaaagcuauccaagagaaaacauuagcuuggcuucuaaagccaagaaauga

SEQ ID NO: 8425 - RNA, 3144 nt, Artificial Sequence
  Cas9 variant
augaaacugcuucgauauauuuuaggauuggaccucggaauagcuucugucgggugggcaauaguagagauagaugaaaaugacuuuccgauaagauuaauagauauaggcgucagaacguuugacaaagcagaaguaagcaagacaggggaaucacuagcacucgcaagacgucuggcaagaucuacaagaagauuaauaagacgacgagcuuuucgucuucucaaaggcaaaagauuacuaaagcaacacaauguaauaaacaaagaagccuugacaacacuaccaacagacugcugggcucuaaggguaaaaggauuagacgaaaggcuaaguccgacagaaugguccgcaguacuacuacacuugcuaaagcauagaggauaucuuucacaaaggaaaaaugaagcaaaaucggcggacaaggaaaugggagcuuuauuaagcggaguugcauccaaucaccaguuacuuguggaaaaccaauuuagaaccccugcugaaauagcggucaagaaauuugcacuagaagaaggacauauaagaaaccaauuaggagcauauacucauacauucaauagacuugaucuucuagcagaaaugaaacuauuauuccagacacaaagagaacuuggaaacccacauaccagcggacaacuagaacaagaauuuugcgaauuacugauguggcaaaaaccagcuuuaaguggagaugcuauacuaaaaauguuaggaaaauguacauuugaaacaaaugaauauaaggcugcuaaacacagcuauacagcagaaagauuugucugguuaacuaaacuaaauaacuuaagaauacuggaacauggaagcgaaagaguucucaacacagacgaacgaucacuguuacucaaucaacccuacgaaaaggcaaaacuaacauacacacaaguuaggaaacuucuuggauuaagugaagaagcucguuuuaauggagucagauauggcaaagaaaaagccgaagacgcgacuuuaauagaacuaaaggccuaccaugcgauacgcaaggcaguagaaaaagcugacaaaucugcgugggaaacacuuaaaaaucaaaccgccuuacucgaugaaaucgguacaacuuucucaauauauaaaacagaugacgacaucacugaacaauuaaauggaaaauugucagauaccguacuaaaugcacuauuagaaaaucuaaauuucgauaaauucauccaguuaagccuaaaaucccuauacaauauagugccacuaauggagcaaggguuaagauacgacgaagcaugucaacagauauauggagaccauuucgguaaaaagagcggagagaucaacagacuucucccaccgauaccagcagaugaaauuagaaauccuguaguguuaagaagucucacucaagcucgcaaaguaauaaacgccguaauuagacucuauggaucaccagcucggauccacauagaaacagcaagagaauuaggaaaaucauacaaagauagaaaagaaauugagaaaagacaagaacaaaacagagccgaaagagaaaaggcaacugcacaauucaaaacacuauucccaacauucauaggagaacccaagggaaaggacaucuuaaugaugcguuuauacgaacagcaaaacggccaaugucuauauucuggaaaaccacucaacuuaaacagacuacuugaaaaaggcuauguagaaauagaucauagucucccuuuuaguagaacaugggacgauucacaaaacaacaaaguguuaguauuagcaggagaaaaccaaaauaaaggaaaucaaacacccuuugaguggcuaggaaaagaugaacaucagugggcguuauucguagcaagaguaaacggaugucguuuuccuuaugccaaaaagcagaggauccuaacccaaaaacuagaugaacaagguuucauagaaagaaaccuuaaugauacacguuauauagcacgauucuuaguaaauuucguacgagaaaacuuacaccuaacaggaaaagguaaaaauaggguauuugcaagcaacggacaaauaacugcauuucucagaggaagauggggguuaagcaaagucagagaagagucggacagacaucaugcguuagacgcggucgucguugcauguucuacaguagcuaugcaacagaaaaucacucgauucguaaaauaccaagaaggaaaccuacaaaccgcugaacggauagacagagaaacaggagaaauaauaccuuuacacuuuccagacccauggcauuucuucagacaagaaguaaugauccgaauauuuagugagaauccacaagaagaccucaucauucaacuuccggaucgacccgaagcuaaucaugaauuuguucaaccccuauuugucucuagaaugccaacacgaaaaaugucuggacaaggccauauggaaaccauaaaaagcgcgaaacgucuugaugaaggaaucagugugagcaaaguaccguuaacacaacugaaacuuaaagaucucgacaacauggucaacagagaaagagagaaggcauuauacgaagcucucaaagcuagauuaaacgcuuuuaacgacgauccaacuaaggccuuugcugaaccauucuauaagaaaggaggccaacaaguuaaagcaguaagaguagaacaaguucaaaaaucagguguaguuguuagaaauggaaacggaguagcagacaaugccucuaugguaaggguggacguuuucauaaaaggaggaaaauacuucuuaguaccuauauauacauggcagguagcaaaaggaauauuaccagaucgagcgguaguagcugcgaaagaugaaagcgaaugggaauuaauggacaaaacagcacaauuccuauuuaguauguuccccaaugacuuaauucaaguaaaaacaaagaaagaaaccuucuuuggauacuauaauggauuagauagagcuacaggagcaauaaaucugaaagaaccagacaguaauauaaauaaaggaaaaagugggcuacauagaucaauaggaguaaaaacagccuuaucaguugaaaaauaccaaguagacgaauuaggcaaaaauauaaggccaugcagaccuagcaaaagacaagcaguaagauga

SEQ ID NO: 8426 - RNA, 3147 nt, Artificial Sequence
  Cas9 variant
augaaaaggcuuggcuuagauauaggaaccaacagcauaggaugguguuuaauagaggacgauggggauggaaaaggaagaauaauagacauaggggcacguauauuuagugauggacgcgacccaaaaucaggggccucacuugcaguagacagacgagcugcaagagcaaugagaagaagaagagauagauaucuagggagaagaaccgcauucuuaaaagcacuuaaaagauucggcuugaugccggcagaugaauccgcagcuaaauuauuagcagaccgagacccauacgaacuucgagcaagagcacuugacgagagauuagaaccgcaugaaauuggcagagcauuauuccacuuaaaccaacgaagaggauuuaaaucaaauagaaaagcugaaaggaaaacaaaagaugcugaagauggaaaaauagcaaacggugcgaaagcauuagaccaagcaauggcugaaucuggcgcugagacguuaggucaauuucuaucaucaagagacaccaagagaguaagaauggguagugaugcgcaaggguaugacuuuuauccacaacgaagacauguagaauaugaauuugacacaauuuggaguaggcaacaacaacaucauccggcacuuuuaacagaagaagcaagaaagaaacuucaugauauacuauuuuuccaaagaccauugaaagagcaagaaguaggaguuuguacguuuguacauaaugaaugccgacuaccaaaagcccacccacucuuccaagagcgacguuuauaugaagaaguaaaucaacuugagauaacuacuccaggcgcgccaaaccgaaaauugacaauggaugagagagacgcauuaaucuuagaauuaaggucuagaaaagaaaggagcuuugauagccucgcaaaaagauugaaauuagcaccaggccaaucuuuuaauaaagcaagugaaucacgaacgcgacuaagaggagaugaaguauaugcaguaauggcccacaagaaacgguuuggagacagauggccgcauuuagauagagauaggcaaugggcaauaauaaaaagaauuauagaagaagaagauccagacaaauuacacgcauuuuuaacaggcgaaugggguuuaaccgacgaacaagcauuagcgaccgcgagggcuccacuaccagaauuauacggaagauuaggcccuaccgcaacugcacgaauccuggaagaauuaaagaaggacguaauuaccuaugaugaagcaguaagaagggcuggauggcaucauucagacgauagaacaggagaaauccuaccgcaauuacccuauuauggagaacuacuuacaagggauauaccacccggaacucaagacccaaaugauccaccugaacagagaugggguaaaauuacaaacccuacaguacauauaggucuucgccaauuagaaaaacuuguaaaugcgauaauuaagguucaugguagaccagaucaaauaguaguagagcuagcacgagaacucaaacuuaaugaaaaggauaaagaggaacauaauaggagaauacgaagagacacugcagccgcccaauuaagaucagcuaaacuacaaucagagggaauaccugauacuggagcaaauagaaugcuguuacgaauaugggaagaauuaaacccuggagaaguauuagauagacguuguccuuauuguggagaaccaguaggaaugaggaugcuauuugcgggugaagcagacaucgaucacauaauaccauacagucgaucucuagacgauagcgcuggaaauaaaguaguagcucacaggucgugcaauagagcuaaaggaaauagaacuccauaugaaaaauggguccaugauccagauagaugggacguaauaagcacucaaguugcgcgauuacauaaguccaaacaauggcgauuugguccggacgcaauggcaagaguagaaaaagauggugguuuuaucgcaagacaauuaacagauacccaauacuuaaguagauuagcuggaagauacuuaagcucauuauauccuacaaaagaugauggaaguguuuauguuauaccuggaagaaugacagcaaugcugagaagaagauggggacuaaacucuuuacuaccagaccauaauuuuguagacaaugaacauucaaaugcaccuaaaaaucgacuggaccauagacaccacgccaucgacgccgcuguaguggcuguaaccacaagggcauugaugcaggagaucgcacgaacagcuggcagagcagaagacaaagauuuagaccgucuauucgaagaucuaccucaaccaugggaaggguuccgagaagaguuaggagaaaaauuagucagaguaacagugucacauaaaccagaccacggaagaaaaggcuuaccacccaaaaaucgagaugucacagcuggucgucuacauaacgauacggcauacggauuaacuggagauguagcagcagaugguaaaacgccaauuguaguacaccgaguaccuuuaaugagucuaaaaccagcugauauuucugauccugaccguauaccagaucccgcccuaagaucagcucuacauagggcaaccgauggucuaucaggaaaagcauaugaugcagcauuggcuggauuugcaaaaacucacccacaauucgcaggaauaagacgaguaagaguaagagagccacuuaccguaaucccgauagcagauagagaugguagaccuuucaaagcauacaaaggagaugccaauucaagaguagacauuuggagaaugccagaugguaaaugguuaagcgauguaguuacaauguacgaagcacaucguagagaccauagugacaggagaccucauccagcagcuaagaaauuaaugucacuacgacaaaaugauaugauagcaguagaaagagauggggcaccaagacaaauaaugguaguaaaacaaauauggccaacacaaauaaaccuaguagaacauaaagaaacagguaaucugaaagacagacacucgaacgaaacugauccguuuagauucuucgcaccaacagcaggagggcuuaagaaaaugaaagcacgccaaguacguauagauccauuaggucgcauauucgauccugguccgcgauga

SEQ ID NO: 8427 - RNA, 3147 nt, Artificial Sequence
  Cas9 variant
auggcuaauauagcugaaaacuuaguauuuggaaucgacuugggaauagggucaugugguugggcaguguuaaaccaaaaggcaaaagaugaaaauaucgucgcacuagguaguugguguuuugacguaccagaaacagauaaagaaagaaucccaaccaaccaaaucagacgagcuaauagacugcuaagaagaguuaucagacgacgccgaaauagaauggcggaaauccgaagguuauuugccaguaaggguauguuagauacagcagacccagaugcacucgcaaaaauaagugcugacccuugggaaaugagagcaaaaggacucgauuaccaauuaacaccucaagaguucgcaguagcacugggacauauagcgaagcgaagagguuuuaaaagcgcggcaaaacguguaaguacaaaugcuccaucagaagacucaaaaauguuagcagccuuagagaaaacaaaagaacaaucagcgcaauauagaacaauaggagaaauguuugcuagagauccggccuacgccgaucgucgaagaaauagagacggaugcuuugacagaacaaugucacgagaagaccuguuuaaagaaacacaaauauuauucgaaagucagagaaggcucggaaauuucagcgcuacuucagaaaccgaacaagcguuuauagacauagcguuuagacaaaaaccuaugcaagauuccgaaagauuaguugaaacaugcuuauuugagccagaugagaaaagagcaucaagguucgcuccaucuuucgaacguuuuagacugcuaugcagguuaguaaaccuccguguaaccgauggauuagaagacaggccccuuacaccagaagaauuaaggcucgcuugcgaagaugcuggaaaaacuagaaaauugucaguaaagaaaguaagaucauuaauaggauuaagagaugaucaaagguuuaccacuauaccaccggaucaagaacaacaugauauagcagcacguacgggagacgcuuuaaccggaacugcuaccuuuagagcaauacucggugaauccuuuuggagacaauuacuaccccauccagaacaauuagacagagcggcuuggauaauaaguuuucaugaauuaaccgacacaauaauuaguaaacuagcaacuauaggucuaccaagcgagguuauggaacuuauuaggaaagcucuagaagauggaaaauuuucuaaauucaaaggcgcugcaucacuaucggacaaagcagcacgaaaacuaauacccuuuuuacaagaaggucuuacauaugauaaggcuugucagaaagccggguauaaccaugccgcaucaaaauucacacauuaugacucgaucgacaccaaagcuaaauuuaacagcuuaauggaugaugucagagauucuauaacaaauccuguagcgcgaaaagcaauaagugaaggcaugaaacaaguaugggcaaugcgaaaccaauggggccuacccggagcuaucuguaucgaauuagcaagagacguagguaacagcgccgaaaaacggagagaaauagaaaguggaauuaagaaaaacacugcucaaagagagagagaacgucaagaagcuaaagagcacuuaaaucaaagugauauuaguucagagacacuacucagauauagacuauggaaagaacaaggaggaaggugcuguuauacagaucaaccaauaacacccucucaauugaucgccucagauaauucaguacaaguggaucacaucuugccuuggagcagauuuggagaugacagcuaccuaaauaaagcacuaugcaccgcaaaagcuaaucaagaaaagaaaaacagaacuccaugggaauggauacacaaucaaaaagguguugaggcuuggaaccauuuuaccgcggcaguugaaucaagaaaagaaacuagaggccuaaagaaacgaaauuuucuauuaaaaucuucaaaagaaacagaagaaagauuuagauccagaaaccugaaugauaccagauacgcagcacgaguaauggcagaagcuguaagacuuuuauacccaucggguaaucgggcagaaaaaggaggaguaaaaagaguauuuacuagacccggagcacuuacagcagcccuccgacacgcuuggggaguagaaucucugaagaaaauaaaugggaaaagauuaaaugaugauagacaccacgcacuagaugcugcagucguugcugcgguaagcgaaaaagaaauacagaaauuaacuaaaaguuuucaaauaugugaacaaaaaggauuagccagaccaaugagagacguacccaugccaugggaagguuuuaggcaucaacuagaaaccgcauacgcagauauccgugucgcaaggccugaaagacgacgagcgagaggaaaaggccacgaugcaacaauaagacaauuaagagaggaaaaagacggcccaguugucuacgaaagacgagcaauaagcgaucuuaaauugacagaccuagaaagaauaaaagacccagaaagaaauucagcgauaauaagcaguuuaagaacauggauugagaaaggcaaaccagcugauuacccuccacagaguccaaaaggugaugaaauaagaaaaauaagggugaugucacgaaacaaaccagccguaucaguaagaggaggaaccgcagaccgaggagaaaugacuagaguagauguauucaccaaaaugggaaagaaaggaaaaccugaaugguuucuuguuccgauauauagacaucaaguaauagaccguauucaauggccccaaccucccaaucaagccgcagcuaauggaaaaagugagaaaaauuggccaacaaugggacuagaacaugaguucagauuuucacucuauccacggagcuauguacaaaucguuaaacgugacggcgaaaucaucgaaggauauuuugccggauuagacagaacaguugcagcuuuuagucuauuaagcucuagugauccaacuucaauucaaagagguauaggcgcgaaaacucuagaaucaauaaggaaauauaaugucaauagguuuggagauauaucaaugguagaacaagaaacucgaacauggcacggagacgucugcauaucaccagaucaacccgacagugcauga

SEQ ID NO: 8428 - RNA, 3147 nt, Artificial Sequence
  Cas9 variant
augguagaaaaaauucuggggauagaucuaggaauaucgucacucggaugggcaguaguugaauacgauaaagauaacgaugaaaacaacaaaaucauagacuguggaguccgacuauucacagcagcagaaacacccaaagaaaaggaaagcccaaauaaagcgagaagagaugcacgcggacuaagaaggguaauaaaacggcgaagaguacgaaugaacacaauaaaaaaucuauuaauaacuuacaaauugauugauaaaaccuuauuagacgaagaaaugggcauguuucacucacaaucaaauagggucgacguauggaaauuaagacacgacgcacuauaucacuuacucaguggagaugaacuagcaagaguacuaauacauaucgcaaaacauagggguuauaaauuccuaggagacgacgaaagugacgaagaaucaggaaaggucaaaaaggccggagcugaacucaaaaaaaaauuccuugaagcggguugucaaucugucggagaauggcuuuggaaagaaagaggucuucaaggaaaaaaacgcaacaaaucaggagacuacgaaauaucaauuccuagagauuuccucguagaagagauacaaagaauauucgaaacacaacaaaaauucggcagcacauucgccaccucagaacuccaaaaagcauauacagacauagcguuuuauguaaaaccuaugcaaucaaucgaagauaugguuggguacuguaccuuuuaccccaaaauaaaaagcaaaaaucaagauggagaaaaaagagccccaaaagcaagcccaucagcggaacaauuuguuauucuaucaaaaaucuuuagcacaaucgucauugaugaaaacaagcaagaaaaaaaacuuauagagcucaaaucaauagagcaguugauccagauagcaagaucaaaagaaacacucaaauacaaacaguuaagaaaagaguuaaauuuagccaaagauauaaguuuuaaauccaucucagaugaagaaaaaacauggauaaaucuaguaggaaacgcaaaauucaaaaaaauccuaggacuaaacuacgaaacguuuuuaaaaaacacagaaaucucagacgaaauagcaaaaaucuuaaccuaugacaaaacauuugaacaaaaagaaacgaaauuaaaaaaccuucuaguaaauaucgauuggauagacaauaaccacauagcagaacuugcaaaacuaucauuuagccaauucaaccaauuaagccuuaaagcaaucaaaaucauaucuaaaauuaugauagaaggauacgcaagauacgaugaggcagugcaauaugcuuuugaaaacaacuuacuacccaagccaucccaugaaaaaagcauauuauuacccccucucaaagaaaccaauaucgcaaucuuaaacccuacagucauacgagcauucgcccaauuucgccaaguagcaaacgcccuaguaagcaaauauggaucauuugacaaagugcauuucgaacuggcaagagaaguuaauacaaaagaagaucgaaaacguugggaaaaagauagagacaaaaacgaaaaaaugcaccgccaaauuacagaaaaguuaguagaagaaggcguuaaaccuucauacaaaaacauauuaaaaagcaaacuaaggagugaacaaaaagauacauguccauacugucaaaaaaauuuacauuaccccaugauauuugaggacgguuacgcagaaaucgaccacaucuuaccacucagccaaucccaagacgauuccuauguaaauaaagucuuaguacacagcgcuuguaaucaaaacaaaaaaaacagaacuccguucgaaugguuucaagacgaaaagaaagauugggacaccuuuaaaaguuauauauuaauggaaucuacucuaggagaaaaaaaaagaaacuaccuaauaaaagagaauuucagcgacccucagucuagaaaagaauuuauaagcagaaacuuaaaugacacgcgauauaugaguaaagccauaaaaacauacugugaaaaccacuggaaauugucacacgacgaugauaaauuaagaauacagguacgaucugguaaacuaacaucaacauugcgacaccaauggggacuagacaauaaaaacagagaaacacacacacaucacgcaauggacgcaaucaugauagcauuuucaacucaaggaaugguaaaaaaauuauccgacuacuuugcuaaaaaagaagcaaaaguagaaaaggacaaaccgguauuaauaacccccauaaaacaguuuaaagaagcuguugaacaagcaacaacccuagagagacaagaaucaauacagacaaaagcaggcgacacaauaacccugaacagacuacuaauuucaagaccaccaagagcuucaguaaccggugcagcacaugaacaaaccgccaaaccauaucccagaaucaaaccuauaaaaaauaaauauaaaaggagaaggauaccuaucgaugaggacaaauucgaacuauucagaaaugauaaaguagcaaguggaaacgacaaaaacuucuacaacaguucaacaaucccacgagucgacauauauaaaaaagaugauaaauaccauguaguaccaauuuacuuaagugauaugacgaaagcagagguaccuaacaagucacuaggaacaaauccggaaggcauggacgaaaaauacuucugcuucucuguauucaaaaacgaccuuauagaacucgaaacgaaagcaacaccaaaaaaaccaucuaaaaaacuacuuggcuacuuuaaacaacuaaacggcgcgaacuucauacucaauagcauucauaauggaauaaucgacggcuuugucugcucaccgauaacacucuucaaacaacaaaaagauaugugcaaaaagugccuucccgaagaccgugcaauagguaauuguucucaagaaacgcuagaauucugggaagcagaaaacauaaaaguucccaaaaaagauuuugaaugcgaccaaggaauaaaauuugcaauagcaguaagaaaauacacgaucgauccacuaggauacuaucacgagguaaaaggcgaaaaacuucuaggaacaauaccucaaggugcaaaaaaacauccaaaaagacaaaaauga

SEQ ID NO: 8429 - RNA, 3150 nt, Artificial Sequence
  Cas9 variant
augauuaacgaaagauuaacuuuuggaauugaccuagguauaggaagcuguggaugggcuguauuaagacacgcugaugcggcgggugaaccaggaguaaucgaaggauuagggagcuggugcuucgaugucccugaaacuucaaaagaacgaauaccaacaaaucagguacguaggaguaaccgguuauuaaggcgaguuauaagaaggagaagaaauagaauggcggaaauacgacguuuguuucaugcucaaggucuauuaccaagugcagaugaagacgcauuaaaaaggccaagacuagauccaugggaauuacgagcuagaggacuagaccaauguuuaagugcagaagaauuugcaguugcauuaggacauauugcacgccaucgaggauuuagaucauccgcaaaaagaaaagcagcaaauacuucaggggaagacucaaaaauguuaucugcacuucuaguuacgagagaaagaacugcuagauaucgaacugucggggaaauguuugcgagggauccagaauacucagcaagaagaagaaauagagauggaaucuuugaccgaacaguagcgcgagacgauuuaauacaugaaguaggaaaacuauuugaagcacaacgagcaagaggaucugcauuugcuuccccagacuuggaagcagacuucaacgcgauagcauuuagacaagcagaaaugcaagauucugagagauugguuggaaauugcccauuugaacgagaugagaaaagagcagcaagaugggcacccagcuuugaaagauucagguuacuaacucguuuaauuaaucugagaauagcaacugcagaaggagaacguagauucacaccagaagauuuagcuagagugucagccgaauuaggugcaacagcgaaauugccagugucucgaguacgagcucuaaucggguugcugccagacgaacgauucacuacaauaagaguagaagaugaagauagagauauuguagcgcgaacgggagaggcagcaccaggaacuuggcgccuacgaaaaacauuaggcgaagcauuaugggccgaaaugcaagcgagaccggaccaguuagaugcaauagcccauguuuuaaguuucuuugaagcgacagcuaaaauaagaagcgaauuagauagauuagguuuaccugcagcaguaauagaagcacuagaucgaggauuagaagauggagcuuuugcaaaauucaaaggagcaggacauauuuccgcaaaggcuuguagaaaucuauugccucauuugcaacagggacauagauaugaucaagccugucguuuagcaggguacgaucaugcugcauccacucuaagccauacggcccaaguaguaaguaaagcaggauuuaacgcucuaguaacggaauuaggagaaaguauagcaaauccuauagcuaggaaagcauuaacggaaggauuaaaacagaucagggcuaugugugcaagauggggguuacccggugccauacauauugaauuagcgagggaaguaggaaacaguaucgaaaagagacgagaguuagagagucaaagagagaccacuacaaaaaggagacaaacggaaagagaugagauaagaggucuguuagcccuagaggauguagacgaugauacucuauuacgauacagacuuuggaaagaacaaggcgguaaaugucuauacacaggaaaagauauacacguaagacaacuaaucgcaacugauaacaguguacaagucgaccacauucuuccauggucuagauucggagaugacaguuuuaauaauaaaacauuauguuuggcaagugcaaaccaaaggaaacgaggccaaacaccaugggaaugguuuucacuaacugguacuccagaggcuugggaaguauuugcaucaagaguagaaacaaguaaagauuuaagaggauucaagaaaagaaauuuacuuuugaaaaacgccgaugaaguugcacaaagauucagauccagaaauuuaaaugauacucgauaugcagcaagauuacuagcugaagcagcaaaauuguuuuauccagccggagauagacaagaaaaagacggacgaagaagaguucuaaccagaccagguccguugacugcagcuuugagacacgcauggggacuugaaaguuugaagaaagcugauggaaaaagaguuucugaugauagacaucacgcgcuagaugcauuagccguugcggcaauuagugaacgagaaguacaaagauuaaccagauccuuucaggaaugggaacaacagggacuagcaagaccuuuaagacauguugccccaccauggccaggauuucgaggugacguacucgcagcauacgcacaggcuuuuguggcgagaccggaaaggcgacgagcacgaggcaaaggucacgaugcaagcauaagacaaguuguaggagaagggccagaagcccaagucuucgaaagaagaggacuugcagauuuaaaagaagccgaucuugacagaguaaaagaccccgagcgaaaucaggcaauuauugaagcuguacgagcauggauauuagccggacggccagcggacgcaccaccgcgaucuccaagaggagacgucauuguaaaauuacgcacagcaccagcaaagaaaauuaaaccagccguaccaguccgugggggcaccgcggauaggggugauaugguucgaaucgauguauuuacuagaccaaauaggaaagguagagaugaaugguaucucguaccaauauauccucaucaaguaaugaauagaaaagcauggccacauccacccaugaggagugucguagcauacaaagaugaagcaggauggaccgaaauaggagcugaacauaguuucagauucucucuauacccaagaucauacguacaauuaguaaaaaguaauggugacguaauagaaggauauuuagucucaauggaucgaucaacuggagcauuucgcgucuuuguacauaacaauccagcugaaauggcaaaaggaaucggagccaaaacauuauuaaaccuacguaaauucaauguugauagauuuggagucaggacagaaguaaaaucagaggugagaacuuggcauggagaaguauguacaaguccagucccgccagauuga

SEQ ID NO: 8430 - RNA, 3150 nt, Artificial Sequence
  Cas9 variant
augcaauuaucaaaacuaaauuacauacuuggacuugaccuaggaauagcuuccguaggauggagcgucauagaaauagacgaaacagaaaugccaauacgacugauagauguaggaguaagaacguuugaacgggcagaaguaccgaaaacuggcgaaucacuagcacucgcucggagguuagccaggucaacgagaagacuaauaaggaggagagccuuuagacuccuuaaagcuaaaagacuuuugaaaaaccaucaaauaguaagugcugaugaacuaucaacauuaccaaaccauugcugggaauuacgaguaaaaggucuagaugaaagauugacaugucaagagugggcggcaguacuauuacaccuucuaaaacaccgaggauauuuaucccaaagaaaaagcgaagcacaaaaugccgacaaagagaugggagccuuauuaucuggaguagcaaauaaccauaaacuccuaagcgagaaucauuaucgaacaccagcagaaauagcaguaaagaaauucgcauuagaagaaggacauaugagaaaucaaagaggagcauauacacacacuuuuaauagauuggacuuacuugcugagaugagauuacuauuccaaacgcaacgagaacucgguucgccuuaugcuaguggagaguuagagcaagaguucugcaaacuucuuauguggcaaaaacccgcacuuucaggagacgcaauacuaaaaauguuaggaaaaugcacuuuagaaccaacagaauauaaagccgcuaaaaacacauacacagcagaacgcuuuguauggcucacuaaauuaaacaacuuaaggauacucgaaaacggaucagaaagagcacuuaacgcugaugaaagagcacuccugcuuaaccaaccauaugaaaaagcuaaguuuacguacgaacaggcucguaaacuacuccaguuaaacgaagcagcacgauuuaauucgguaagauacggcaaggaaaaugccgagaaaaguacauuaauggaaaugaaagcauaucaugccauaagaaaggcaguagaaaccgcugauucuagugcaugggcuacauuaaaaacacaaccacuauuacuugaugaaauugguacagcauucuccauuuauaaaacugacgaagacaucaaaacacaauuacaaggaaaguuagcugacaacguaauugacguucuacuugaaaauuuaaacuucgacaaauuuauacaacucaguuuaaaagcacucuauaaaauacuaccucuaauggaacaggggcuucguuaugaugaagcaugcucucaaaucuauggugaucauuuuggaaagaaagaacagaaaaacgauagauuacuaccucaaauaccagcagacgaaauaagaaauccagugguauuaagaacacuaagccaagcgagaaaaguuauaaaugcaguuaucaggcuuuauggaaguccagcacgaauccauauagaaacugcgcgagaacuagguaaaucauauaaagauagaaaagaaauagagaaaaggcaagaacaaaauagagcagaacgagaaaaagcaguugauaaauuuaaagaauuguucccaaacuuuauaggagaaccuaaagcaaaagauaucuuaacuaugagauuauacgaacaacaaaauggacaaugucuuuacucuggaaaaaguuuagaucuacauagauuguuagaaaaagguuauguggaaauagaccaugcucuacccuucagucgaacaugggaugacaguuucaacaauaaaguauuaguauuagccggagaaaaucaaaauaaauccaaccaaacaccuuucgaauggcuuggaaaagaugaacaaaaaugggcauuauuuacagcaagagugaauaguugcagauuucccuauucaaagaaacaaagaauauuaaccaagaaacuagaugaugaaggauuuauucaaagaaaucuaaaugacacaagauauauagccagauuucucgugaacuucguaaaugacaaucuucauuugacaggaaaaggaaaaagaagaguauucgccucaaauggacaaauaacggcauuccuaagaggaagauggggacuaacgaaaguacgagaagaaagugauaggcaucacgcacuagacgcugucguuguagccugcuccacaguuucaauacaacagaaaauaacgagguuuguuaaauaucaagaagguaaccuacaaacggcagaaagaaucgacagagaaacuggggaaauuauuccacuccacuuccccgacccuugggcguuuuucagagaagaaguaaugauaagaauauuuucugaaaugccacaagaagaccugguaauuaaguuaccugacagaccucaagcaaaccacgaguucguacaaccacuauuuguaucuaggaugccaacuagaaaaaugucaggucaaggacacauggaaacaauuaaaagugcaaaaagacucgacgaaggcauuagcguaaguaagguuccucucacacaauuaaaguuaaaagaucucgaaaacaugguaaacagagacagagaaauagcccuauaugaagcauuaaaagcuagacucacagaauuuaaggacgauccagccaaggcuuuugcagaaccguucuacaagaaagggggcguacaagugaaaaguguuagaguugaacaaguacaaaaauccggaguuguugugaggaauggaaacggaguagcagacaacgcgagcaugguaagaguagacguuuuuauuaaaggaggaaaauauuuccuagucccaauauauacuuggcaaguugcaaaaggaaucuuacccgaucgcgcgguaaucgcauacacucccgaaaaugaaugggaacucauggacgauagugcccaauuucaauucucaauauacccuaaugaucuaauuaaauuaacuacaaagaaagcuauuuucuuugguuauuauagcggauuuaaccgcuuaacaggagccauaaauauuaaagaacacgauuuacaaauuuccaaaggagauaaaggcguacauuuaggacuaggagugaaacuugcuuuaagucuagaaaaguaccaaguagacgaacuagguaaaaauauaagaccguguagacccacacaaagacaaaauguacgcuga

SEQ ID NO: 8431 - RNA, 3153 nt, Artificial Sequence
  Cas9 variant
augagcuccuauagauuuucauucgaucuaggaacaaacucaaucggcugggccguauucgaauuagacccaaaaacuagaccaguagcacuugcugauugcgggguacgaauuuuuccggauggaagaaaucccaaagacaagcaaucacucgcaguagccaggagagaagcuagagcaguaagaagaaggcgagaccguuaucuuaaacgaagauccgaacuaauggaacgucuaguagcuaaagguuuaaugccagaaagucgagaugaucaaaaagcauuggaaggucuagauccauaugcauuaagagcagccggacucgacgaugcacuaccuccccaucacuucggcagagcacuguuucauuugaaccaacgacguggauuuaaaucuaauaggaaaacagacagaggagaaaauucagaaacggguauaaccaaaaucgggaugaagaaauuacaugaagcucuauuaagugaaggaugccgaaccuuaggugaacuacaacacagacaucaugaagcaaaucagacuccugcaauggauacaaauccuaaaucaguaaggagcaaauuaagaggagaaggagcaaaagcagucuacgacuucuaucccucaagagacgcaguugaagaugaauuuaacaaauuaugggacagucaaaaacgauuccacccggacuuacuaacagauagugcacgugaugcaaucagagaugcaauauucuaucaaagaaaauuaaagacuccagacgcaggucgaugcucuuuuaacccagcagaagaaagaguagcaagggcaaugccaauagcacaacauuucagaauacuacaauuugucggggacuuacgacuuauugauaaugaucuaguaaggcacccccuaaacaaugaccaaaagaaagcacuauauagagacuuauuagcaaaagguaaauuaacauucaaagcaaugagaaaaacuauaggcauaggaagcgaauacgcguucagucaugagagcgagaaacaaucagaguuucgaggagacgaaacugcugcacgucuagccggacccaaauacuuuggaccaaaauggagagaauuaucauuuaacgaccagagugaaauaguagauagauuacuacaugaggaaaacgaagaaacacuuauacaauaccuacaagaccgauuuggcuucgaccaugauagaugcgaaguaauugcagaugcaccauugcccgacggacauacuagacuuggaaaaacagcucucgaaacacuuguagaaauaaugagagaugaucaucuaccuuacgaucaagcaugcaccaaagcuggauaugaacacgcauuaccuccggaugguguaauuuuggaugaucucccauacuauggcauagcacuugagcgacacguagcauuuggagauggcaaaucagaaaacccggagaaaagguacggaaaaauagcaaaucccacaguacacauagcacuuaaucaauuacgaaaaguaauuaacgcauugauagcgagguauggacacccagaccaaguugugauggaaauagcaagagaccuaaaacaauccaaagcaaaaagagacgacauaucaaaagaacaaaagaaaaaucaagaucguaaugaccagagaagaaagaaauuacaagaagcucacaucgcgguaaaugcagaaaacauguuacgaaugcgacuaugggaagaacuagaugaagauaaugcagccgcaagagcauguccauucacaggagaaacaauuaguauggcuagguuauuuaguccagaaguagaaauagaacacauccuuccauuuucaagaucauuagauaacucaccagcaaacaaaacauuauguaugguuugggcuaauagagccaaaggcaaucgaacaccaugggaagcauuuggcagagacagggaaccaggauucgacuggcccgaaauagccgccagagcugcacgacuacccaaaaauaaaucauggcgauucgguccagacgcaauggaaagacuugaaagagaaggugacuuuuuagauagacaguuaacggauacacaauauuugucaagaaucgcuagagaauaugugacgaaaauaugcgacccaaaucaaguuuggguaacaccagguaggcucaccgccugguuaagaagaaauuggggauuaaacgguauacuacccacugggaaugccaccaaaaacagggaugaccacagacaccacgcuaucgacgcgauaguaguaggauuaacagaucgcgguauacuaaaucgaguaucaaggagugcagcauuagcagaagcagaagaucuugauaggaguauagcagagaugccugacccauuugaugguuucagagauaacauccgacauauacuagaacaaauuauugucagccacaaaccagaugcaggauucguaccaggccauccaaaaggaaauacaaccccaggagcguuacacaacgauacagcauacggaauaauaaaaaccgacgcaaaaggcaugucagaaguaguuacaagaaaagauguacucucuuuuaaaggaacaaaagaaauagaaaguauaagggaugcugcuacccgucaaucucuacuggacgcaguagcgggcguuccaagcggauuagccuuuaaagaggcuuuaagagauuggaguguccgaacaggcacgaaacgcguaagaguuacuuucaauaugaguguaauaccaauacaagaucgugacggaaaagcauauaaagguuauaaaggugacggaaacuuaugugcugaaauauacgaaaggccagauggaaaauggggagaugaaauaauaucaagguuugaugcaguccaaccaggguuuaccccacaauggcaaagagaccauccagcagcacauaggguuaugagauuauuuagagaugauaugauaauggcagaaauagauggaguaaugaccguaugcagaauugucaaaaugagcccagggaaagugguauuuacaccccaccaugaagcaaacacugacagcaggaauagagauaaagaugauccauucaguuuccacacaugcucaggagaaucuuugagaaaaaggaaagcacaaaaacuuuucguugauccucuagggaaaauuagaggguauagagcaaaagaagguuga

SEQ ID NO: 8432 - RNA, 3153 nt, Artificial Sequence
  Cas9 variant
augggugaaaauaugaucgacgaaaguuugacuuucggcauagaccuggguaucggaucuuguggaugggcagucuuaagacgaccaagcgcuuuuggaagaaaaggaguaauagagggcauggguucaugguguuuugaugugccagaaaccucaaaagagcgaacaccuacuaaucaaauuagaagaaguaaucgcuuauuaagacgaguuauucggcgaagaagaaaucguauggcagcaauaaggagacuacuccaugcagcaggccuguuaccguccacugacucagaugcccuaaaaagaccaggacacgauccaugggaauuacgagcgcgcggacuugauaagccacuuaaacccguugaauuugcaguagugcucggacauauugcaaaaagaagaggauucaaaagugcagcuaaaagaaaagcuacuaacauaucaucggaugauaagaaaauguuaacugcuuuggaggcuacgagagaaagauugggucgcuacagaacaguuggugaaauguuugcaagagauccggauuucgcaaguagaagacgaaauagagaaggaaaauaugaucgaaccaccgcaagagaugaucuagagcacgaagugcaugcauuauuugcugcucaacgacgauuaggacaaggauucgcaucuccggaauuagaagaagccuuuacagcaucugcauuucaucaaaggccaaugcaagauucagaaagauuagucggauuuuguccauuugaaagaacugagaaaagagcagcaaaacuuacaccaucauuugaaagauuuagauuauuggccaggcuucucaauuuacgaauuacgacaccagacggggaaagaccacuaacaguagaugaaauagcacugguaacacgggacuuaggaaaaaccgcgaaacuuucaauaaaaagaguaagaaccuuaauaggacuagaagauaaucagcgauuuacaacuauaagacccgaagaugaagauagagauauaguagccagaacaggaggagcaaugacagguacugcuacguuaagaaaagccuuaggagaggcauuauggacagauaugcaagaacgaccagaacaauuagaugcuauagugcaaguauuauccuuuuucgaagcgaaugaaacaauaacagaaaaauuaagagaaauaggacuuacacuagcaguacuagauguacucuuaacagcacuugacgcgggaguauucgcaaaguucaaaggugcggcacauauaaguacuaaagcugccagaaauuuauugccucauuuagaacaagggagaagguacgaugaggcgugcacuauggcaggauaugaucacgcagcuucccgccugucacaucauggucaaauagucgcaaaaacacaauucaaugcccuaguuacagagaucggugaaucaauagcuaaccccaucgcaaggaaagcucuaaucgaagguuuaaaacaaauaugggcgaugagaaaccauuggggacuuccaggaagcauacauguagaacuagcuagagauguuggaaauucaauugaaaagaggagggaaauagaaaagcauauugaaaagaauacggcauuacgagcacgagaacgaagagaaguacaugaccuauuggauuuagaagacguaaauggggacacauuauuaagguauagacuguggaaggaacaaggggguaaaugcuuguauacaggaaaagcuauacauauaagacaaauagcugccacggacaauaguguacaaguagaucauauauuaccauggaguagauuuggggaugauucauuuaacaauaaaacacucuguuuagcaucagcaaaucagcaaaagaaaagaucaacaccguaugagugguuaagcggucaaacaggugaugcauggaaugcauuuguucaaagaaucgaaacgaauaaagaacuucgaggauuuaagaaaagaaauuauuuauuaaagaacgcuaaagaagcagaggagaaauucagaucucgcaaccuaaacgauacacgauaugcugcgcgucuauuugcugaagcuguaaaacucuuguaugcuuucggagaaagacaagaaaaagggggaaauagaagaguguuuacaaggcccggagcucuaacagcagcacuacggcaagccugggguguugaaucauuaaagaaacaagauggaaaacgaauaaaugacgacaggcaccaugcguuagaugcucucacuguagcagcaguagacgaagcagaaauccaaagacucaccaaaucguuucaugagugggaacaacaaggccuaggacgaccucugagacgaguagaaccaccaugggaaucuuuccgugccgacguugaagcaacuuauccagaaguuuuuguagcaagaccagaaaggcgcagagcaagaggagaaggccacgcagcaacaauacgacaaguaaaagaacgugaaugcacaccaauaguauuugagagaaaagcgguaaguucucuuaaagaagcugaucuagaacgaauaaaagauggcgaaagaaaugaggcaauuguagaagcaauacgaagcuggauugcaacagggagaccagcugaugcaccaccgagaaguccaagaggagauauaaucacuaaaauaagacuagcaacaacaauuaaagcagcaguuccagucaggggaggaacagcagguagaggcgagaugguucgggcggacguauuuucuaaaccaaauagaagaggaaaagacgaaugguaucuggucccaguguacccacaucaaauaaugaacagaaaagccuggccuaaaccgcccaugagaaguauaguugccaacaaagaugaagacgaauggacugaaguagggccugaacaucaauuucgauucaguuuauauccaagaaguaauauugaaauaauacgaccgucaggagaaguaauagaaggauacuuugucggacuucauagaaacacuggagcacuaacaauaagcgcacauaaugauccaaaaucgauucauucaggaauaggcacaaaaacauuacucgcgauaucaaaauaucaaguggauagauuugguagaaaaucaccaguaagaaaagagguaagaacauggcauggcgaagcauguauuaguccaacaccaccaggauga

SEQ ID NO: 8433 - RNA, 3153 nt, Artificial Sequence
  Cas9 variant
augaaaauacuaggauuugauauugguauagcaaguauaggaugggcuuucguagaaaauggagaacuaaaagauugugguguucggauuuuuacuaaagccgaaaauccaaaaaccggugauagccucgcaaugccaagacgugaagcaaggucaguaagaaggcgauuagcaagaagaaaaggacgcuuggaaacacucaagcgacuacuagcaaaagaaugggacuuaugcuacgaggauuacauugcagcggauggugaacuaccaaaagcauucaugggcaaaaaccuaaacaauccauaugucuugcgauaugaagcauuacaaaggcuacucucaaaagaagaauuaguacggguaguccuucauauagcaaaacaucgaggauacggaaauaagaacgcgaaaaucacaaaaucagaagaaucuaaacgagaacaagggaaaauauuaagugcuuuagcaacaaacgcuucggcaaucgcuagguacagaacuguuggggaauauuuuuacaaagaauuuugcgaagugauuaaaaacccacaaggcuuauccacuaaugaacauuauacacaaucaaaaguccguguguuaaaaccaauaaggaacaaaggaggcgaguauacaaacugcauauuacaagaagaucuucaaagagaauuaagaugcaucuuugaauaucaaaaagguuucggauuuccuauaacucaagaguuccaagacaaaauccuaaagauagcuuuuuaccaaagaccauuaaaagacuuuagucauuuaguaggaaaaugcacguucuacccggacgaguucagagcccuaaaauguucguuaucggcaguagaauuuauaacuuuaucaaaaacuauaaaugucuuaaccuauauaucaaaagaaagcggagaaguguauagcaaaggucaauacgaacaaauguuagauaguguauuuaaagccguaugugaaaaaggaucauuaucauuugcucaauuaagaaaaauacuacauauagacgaaagaauaagauuuaaagaaguagacuauauggcuagaaaaaguaaaaacacaucaggagauagcacccauaaacagaaaacaucuaacccugaaacaaagaaauuuauagaacacaaaaauuuaaagaaauuuugugagauacugucagaaaucgccgaagauagagcacuagcugauagcauagcacgagacaugacucucauaaaagacgaagaaaaauuagcgcaaaaacuccauggauacgguaaauuuagccaagaacaaauaacgcaacuuucagcucuaaacuucucacaucauauaaacuuaucuuuaaaagcauuaucagaaaucuuaccauucaugagagaagggaugagguacgaugaagcgugcaaacuagcaggacugaaagcuagacacaaugacaagaaauccaaauuuuuaccaccauuuugugaaucaaucuaugcugaugaacucacgaauccuguaguacacagagcuauugccgaauauagaaaaauauuaaacgcgcuuaucgcgaaauacgguagcguucauaaaauccauauugaacuaacaagagauguggggaaaaacuuccaagaacgugaaaaauacaagaaagaaauagaaaguaacuacaaagccaggguccaagcaaugcaagaaugugaaaaacuaggauuaacacuaagugaaggaaacauacuaaaacuacgccuauucagagaacaaaaugaaaucuguguauauagcggacgaaaaaucacuuuggcuaaccuaaaagaacagggugcauuagaaauugaucacauacuacccuacagucgaagcuccgacgauucauauaugaauaaaguauuaguauuuacaaacgaaaaucaaaacaaaggaaauaaaacaccauaugaagcauuuggaggagacucacaaaaauggggagaaauagaaucuuuagcauuacgaucaggauacccaaagaagaaagccaaaagaauacucgauaaaggauucggagauagggaagcuggcuuuaaaucaagaaauauuguugacuccgguuauauagcacgauuaauagcaaauuacacgaaagaguacuuaaaauuccuaccuuuagauucccaugaaaauacugcauuaauugcaggagaaaaagauucaaaaauccauguggaagcagugaaagguaugcucaccgccacaaugcgucauuucugggguuuaggaucuaaaaauagauaugaacacacacaucacgcuguagaugcuaucauaauagcuuacauaaacgcagcaaugauacaacgauucucucaauucagacaaaaucaagaaagccuaaaggcaagauucuacgcaaaagaauuggcaaaagaagaauuuaaaacucaacgagcauucuuugaaccuuuuaggggguuuagggaacaaguauuagcaaaagugggucaaauauuugugucaagaccaccacgaaaacgcgcacgaggagcucuacaugaagagaccuucuauaguauagacgauaagaaauuaagcgagacauacgguggaaaagaagguguacaaagagcuuuaagccuaggaaaaauaaggcagauaggaacuaaaauagucgcgaacggacccaugguaagaguggauauauuuaaacauaaacaaucaaggagauucuaugcuguccccauuuacacgauggacuuugcacuagggauucuaccuaauaaagcaguaguauccggcaaagacacuaaaucuaagguaauaaaagacugguuagaaauggauucguguuaugaguucugcuucucuuuauuuaaagacgaccuaauugaaguccagaaaagcgauauggaaaaaccagaauuggcuuauuucguuucacuagaugcuucagacggacgaauaaaaguuagacaucauuguaaugacauuacaaaaauaaacgaaaaucaaaagaaauuauucucugaagcgauagaaaaagaaguaguuggacgagguagcauacaaaaccucaaagucuuuaagaaauacaaaguauccccacucggagaaaucaaagaagcaaaauaugaaccgagacaacccauagccuuaaaaaccaguccaaagaaacauagaaaacaaaacaaugcucaauga

SEQ ID NO: 8434 - RNA, 3156 nt, Artificial Sequence
  Cas9 variant
augaauaacuauaucuugggguuagacaucggaauuacgucgguaggauacgguauagucgacagcgacacaagagaaauaaaagaugcaggagucagauuauucccagaagcaaaugucgacaacaaugaagguagaagaucgaaacggggagccagaagacucaaaagacguagaauucacagacuggacagaguaaagcaccuacuagcagaauacgaccuauuagacuuaacaaacauaccaaaaucaacuaauccauaccagacgcgcguaaaaggucucaacgaaaaauuauccaaagacgagcuaguuauagcacuacuacacauagcgaaaagaaggggaauacauaaugucaacguaaugauggacgacaacgauagcggaaaugagcuaagcacaaaagaccaguuaaaaaaaaacgccaaggcacuuucggauaaauacguaugcgaauuacaacuugaacgauuugaacaagacuauaaaguuagaggagaaaaaaaccgauucaaaacagaggauuuuguuagagaagcacgcaaacuacuagaaacacaauccaaauucuucgaaaucgaccaaacauuuauuaugagauacauugagcuaaucgaaacuagaagagaauacuucgaaggaccugguaaaggauccccauucggaugggaaggaaauauuaagaaaugguucgagcaaaugaugggacacuguaccuacuucccagaagaacuuagaucuguaaaauacaguuacucagcugaacuauucaacgcauugaacgaccugaacaauuuaguaauuacuagagacgaggacgcaaaacuaaacuauggagaaaaauuccaaauaauagaaaauguauuuaagcaaaagaaaacacccaaccuuaaacaaauagccauagagauagguguacaugaaacggaaauuaaaggcuacagagucaacaaaagcgguaaaccugaauucacucaguucaaacuauaucacgaccuaaaaaauauauuuaaagauccaaaauauuuaaaugacauacaauuaauggauaacauugcagaaaucaucacaaucuaccaggacgcugaaucaauaauaaaggaacuaaaccaauuaccagaacuauuauccgaacgagaaaaagaaaaaauauccgcguuauccggauauucggguacacaucgccuaaguuuaaaaugcauaaacuuauuacuugacgaccucugggaaucaucucuaaaccaaauggaacuauucacaaaacucaaccucaaaccaaagaaaaucgaucuaucacaacaacauaaaauaccaucaaaacucguagaugauuucauucuuucgccagugguaaaaagagcauucauccaauccauacaaguuguaaacgcaauuauagacaaauacggacucccagaagacauuauaauagaacuagcacgcgaaaauaauagcgaugacagaagaaaguuuuuaaaccaauuacaaaaacaaaacgaagaaacacgcaaacaaguagaaaaagucuuaagagaauauggaaaugacaaugcaaaaagaauaguucaaaaaauaaaauuacacaacaugcaagaaggcaaaugccucuauucacuaaaagauauaccacucgaggaccuacuaagaaacccacaccacuaugaaguugaccacaucauaccaaggucuguugcauuugacaacaguaugcacaacaaaguauuagugagagcugacgaaaauucgaaaaagggaaauagaacaccauaccaauaucuaaacaguuccgaaaguuccuugaguuauaacgaauuuaaacaacacaucuuaaaccuaagcaagacaaaagacagaauaacaaaaaaaaaacgagaauauuuacuagaggaacgcgacauaaauaaauuugacgugcaaaaagaauucaucaacagaaaccucguagacacaagguacgcaacaagagaacucacaucccuauuaaaagccuacuuuucagcaaauaaccuagacguuaaaguuaaaacaauaaacggauccuuuacaaauuacuuacgaaaaguauggaaauuugacaaagaucgaaacaaaggauauaaacaccacgccgaagacgcacuaauaauagcaaacgcggacuuucuguucaaacacaauaaaaaacuacgcaauaucaauaaaguauuagaugcaccaagcaaggaaguagacaaaaaaagagucacgguucaaucagaagacgaauacaaucaaauauucgaagacacacaaaaagcucaagcaaucaaaaaauucgaaauacgcaaauucucccaucgcguggacaaaaaaccaaauagacaacuaauaaaugacacccuauacuccacacgaaacauugacgguauagaauacguaguagaaucaauaaaagacauauacucugucaauaaugacaaaguuaagacaaaauuuaaaaaagacccacacagauuacucauguaucgcaacgacccccaaacguuugaaaaauucgaaaaagucuuuaaacaauacgaaagcgaaaaaaacccuuuugccaaauauuacgaagaaacuggcgaaaaaauaagaaaauuuucaaaaacaggacaaggaccauauauaaauaaaauaaaauaccuaagagaaagacuaggaagacacugcgaugucacaaacaaauacauaaauagccgaaacaaaauuguacaauuaaaaauauacagcuaucgauucgacaucuaccaauacggcaacaacuacaaaaugauaacaauauccuacauagacuuagaacaaaagucaaauuacuauuauauuucacgagaaaaauaugagcaaaaaaaaaaggauaagcaaauagaugacucauacaaauucauaggaaguuuuuacaaaaaugauauaaucaacuauaauggggaaauguacagaguaauuggagucaaugauucugaaaaaaauaaaauucaauuagauaugauagacaucagcauaaaagacuauauggaauuaaacaauauaaaaaaaacaggcguaauauauaaaacaauagguaaaucaaccacccauauagagaaauauacaacggauauacuaggaaaccuauauaaagcagcaccuccaaaaaaaccgcaacuaauuuuuaaauga

SEQ ID NO: 8435 - RNA, 3159 nt, Artificial Sequence
  Cas9 variant
auggaaaauaaaaaccuacacuacauacuaggauuagaucuaggaauagccucuguaggaugggcagucguggaaaucgacgaaaaggaaaacccauugaggcucauagauguaggcguacgaaccuucgaacgcgcagaaacacaaaaaggagaaucauuggcacuaucaagaagaucagcaagaucugcccgcagauuaacacaacgucggguagcacgcuugaagaaagcuaaacggcuacugaaaucugaaaauauacuucuuucaacagaugaacgacuaccacaccaaguuuggcaacuaagaguagaaggauuagauagaaaauuagaaagacaagaaugggcagcuguacuuuuacauuuaauaaaacaucgaggauauuuaagccagagaaagaacgaaucaaaaucagaaaauaaagaacucggugcgcuacugucagguguagcaagcaaccaugaauuauuacaacaagcaacauauagaaccccugcagaauuggccguuaagaaauuugaaguagaagaaggacacauuagaaaccaacagggcgcauauacacauacauuuaguagacuagaucuucuugccgaaauggaguuauuauucaguagacaacaacauuucggcaauccguucgcuucagaaaaauuacuagaaaaccuuacagcgcuauuaauguggcaaaaacccgcauuaucaggagaagacauacuuaaaaugcuaggcaaauguacauucgaagacgaguauaaagccgccaaaaauacguacaccgcggagcgauuuguguggauuacaaaacuaaacaauuuacgcauacaagaaaacggucuggaaagagcacuaagcgacaaugaaagauuaauguuaauagaacaaccauacgaaaaagcgaaauugacuuacgcccagguaaggucaauauuaaaucuaagcgacgacgcuauauucaaaggaguaagauacagcggagaagacaagaaagcaauugaaaccaaaacaacccugauggaaaugaaagcguaccaucaaaucaggaaaguccuugagggaaacaaccuaaaagcagaauggguagcguuaaaagcaaauccaacuuuauuagacgagauugguacagcuuucagucuguacaaaacagacgaagacauaucagcauaccuugcuggcaaacuuagccaaccgguauuaaacgcuuuacuggagaauuuaucauucgauaaauuuauacaguuaagucuaaaagcccuuuacaaauuauugccauugaugcaacaaggauuaagauaugaugaagcauguagagaaauauacggagaccacuaugggaagaaaacagaggagacucaucauuuucuuccccagauaccagcagaugaaauuagaaauccaguaguacuaaggacacuaacucaggcucggaaagucauuaacgguguaguucgacuuuauggcagucccgcucgaauccauauugaaacagggagagagguaggaaaauccuauaaagauagacacgaauuaaagaaaagacaagaagaaaauagaaaacaaagagagaaaacaauaagugaaauuaaaacucuauucccaaacuuuucaggugaaccaaaaggaaaagacauacuaaaaaugagacuauauuaccaacaaaaugcaaaaugccuuuauucaggaaaaccacuagaacuacaucgauuauuugaacaaaaauacguagaaguagaccaugcuuuaccacuaagccgcacuugggaugacucauucaauaacaaaguuuuaguccuagcuaacgaaaaucaaaacaaagguaacuuaacaccauuugaaugguuagaugguaaaaacaauagugaacgauggagaacguuuaaggcuuuaguagaaacaucugccuucccauacgcaaagaaacaacgaauauuaucacaaaaauuagaugaaaaaggauuuauugagagaaaucuaaacgauacucgauaugucgccagauuccuauguaacuuuauagcagauaauaugcaccucacaggugaaggcaagcgaaaaguauuugcaucuaacggacaaauaaccgcauuauuaagaagaagauggggauuagcaaaaaguagagaagacaacgauaggcaccaugcacuagacgcaguauuaguagcauguuccacuguagcaaugcaacaaaagauaacacgauuuguccgcuuuaaggccggugacgucuucacaggugaacgaaucgaccgcgaaacgggggaaauaauaccccuacacuucccuacuccauggcaauucuucaaacaagaaguugaaauucgaauuuucucagacaacccaaaacuagaacuagaaaauagacuaccagacagaccucaagcaaaccaugaguucguacaaccacuauuuguaucaagaaugccaacccgcaaaaugaccggacaaggacauauggaaacggucaaaagcgcaaaacgucucaacgaaggaauaaguaugaucaaaaugccauuaaccaaacugaaguuaaaagaccuugaauugaugguaaacagagaaagagaaaaagaccuauaugacgcacucaaaacuagauuagaagccuuuaacgaugacccagcaaaggcuuuugcagaaccauuuaugaagaaaggcggagcuauuguaaaaucagucaggguugaacaaguacaaaaaucaggcguucuaguaagacaggguaauggggucgcagauaacgcaaguaugguacgagucgauguguucacaaaagacggaaaauacuuccucguacccauauacacuuggcagguagcaaaaggaauacuacccaacaaagcaguaauacaagguaaagacgaagaagauugggaagacauagaugacgcgacuuuucaauuuagcuuacaucccaaugaccuaauaucaguaaaaaccaaaaaggacgaguucuugggauacuuuaacggacuaaauagacauacagguggcaucaauauaagaacacaugaccuagaaaaaucaaaaggcaaacaagguaucuucgaagguaucggaguaaaaauagcccuaucauuugaaaaauaucaaauagaugaacuagguaaaaacaucagauuauguaaaccaagcaaacgacaacccguucgauga

SEQ ID NO: 8436 - RNA, 3159 nt, Artificial Sequence
  Cas9 variant
augaaaaacacaucguuaaacuacguacuuggauuagaucuuggaauuucuucgguuggaugggcagucguagaaauagaugagaaagaaaacccccucagcuugauagauguaggaguacggacauucgaaagagcggaaacacaaaaaggagaaagucuagcacuagcuagaagacuagcaagaucagcaagacgacuaacacaaagaagagucgcuagauugaagaaagccaaacgacuauuaaaaagcgaaaauauacuauuaagcaccgaugaguguuuaccacaucaaguauggcaacuaagaguugaaggcuuagaacgaaaauuagaaagacaggaaugggcagcagugcuauuacauuuaauaaaacauagaggauauuuaucccaacggaaaaaugagucaaaaagcgagaacaaagaauugggugcacuacuaagugggguagccaacaaucacaaacuauuacaacaaacaacauaccgaacucccgcagaacuagcuguaaagaaauucgagguagaagaaggucauauaagaaaccaacaagggucauauacacauacauuuagccgauuagauuuacuaagcgaaauggaauuacuauuuagucgacaacaacacuucgguaacccauuuaccagcgaaaaauuacuagaaaacuugacagcacugcuaauguggcaaaagccagcguuaucaggagacgccauccuaaaaauguuaggaaaguguacauuugaaaaugaauauaaagccgcgaaacauacauauagugcugagcgauuuaucuggauuacaaaacuaaauaauuugagaauacaagaaaacggucuagaacgggcacuaaaugauaaugaaagauuagcacuaaugaaacaaccauaugagaaagccaaauuaacauacgcucaagucagaaguauauuaaaccuuucagaugaagcaaucuuuaaaggauugagauauuccggugaagacaagaaaacaagcgaaacaaaaaccguacucauggaaaugaaggcuuaucaucaaauaagauuagcauuagagaaaaacgaucuaaaaacugaaugggcagaauuaaaaguuaacucaucguuacuggacgaaauaggaacagccuucucuuuauauaaaacugaugaggacauaaguacaugucuagcaggaaaacuaagucaaccaguacucaacgcacuucuagaaaaccuaaauuucgauaaauuuauccaacuaaguuuaaaagcauuacauaaaauacuuccccucaugcaacaaggccuaagauacgaugaagccugcgcagaaaucuacggagaccauuauggaaagaaaacugaagagaaucaucuauuacuaccacaaauaccagcugaugaaaucagaaauccagucguacugcguacauuaacucaagcaagaaaaguuauaaacggggucgucagacuauacaguaguccagcaaggauacauauagaaacuggaagggaaguuggcaaaucguaccaagacagacgagaacuagagaaaagacaagaagaaaacagaaaacaacgcgaaaaagccauaucugaaauuaaaacccuuuuuccgaauuucaguggagaaccaaaagcaaaagacauauuaaaaaugagguuauauuaucaacaaaaugcaaaaugcuuauauucuggcaaaccauuagaauuacacagauugcuagaacaaggauacguugaaaucgaucacgcauuaccauuuaguagaacgugggaugauuccuuuaacaacaaaguauugguauuagcgaacgaaaaucaaaacaaagguaaucuaaccccauucgaaugguuagacgggaaaaauaauagcgaaagauggaaagcauucaaagcgcuaguugaaacaucagcauuucccuauacaaagaaacaaagaauccuuagucagaaacuagacgaaaaaggauuuauagaacgaaaccugaacgauaccagauauguggcaagguuucucuguaauuucauagcugacaauaugcauuuaacaggagaaggcaaaagaaaaguauuugcaagcaacggacagauaacugcccuucuaagaggaagauggggauuagcaaaaucaagagaagacaacgauagacaucacgcacuugaugcaguuguuguggcaugcucaaccguaaguaugcaacagaaaauuacuagauucguaagauuugaagaaggaaauguauucacaggagaacgcauagacagagaaacuggugaaauaauuccccuacauuuuccagcaccguggaaauucuuucgagaagaaguagaaauacgaauauuuagcgauaauccgaaauuggaacucgaaaauagauuaauagcaaggccacaagcaaaccaugaguuuguacaaccucuauuuguaagcagaaugccgacccguaaaaugacaggucaagggcauauggaaaccauaaaaagugcgaaaaggcuuaacgaaggacuaucaguuauaaaaauguuauuaacaaaauuaagauuaaaagauuuagaaucuaugguaaauagggaacgugaaaaagaacuguacgaagcguuaaaagcuagacucgaagcauuuaaugaugaaccagcaaaagcauuugcagaaccauuuaugaagaaaggaggcgcgaucguaaaaagcgugcgaguagaacaaguacagaaaaguggaguacucguaagggauggaaacggaguugccgauaacgcgaguaugguaagaguagacguuuucacuaaaggaggaaaauauuuccucguccccaucuauacguggcaaguagcuaaagguauacugccaaauaaagcaguaauacaagggaaaaaugaagaagacugggaagugauggacgacgcgacuuuuagguucucccugcaucaaaaugauuuaguaaaauuaguaacuaaaaagaaaacaaucuucggguacuucaacggccuaaauagagcaacagggaacauugacauuaaagaacaugauuuagaaaaaucaaaagugaaagauggaauacaccaaucaaucggcauaaaauuggcacugaguuuugaaaaauaucaaguagaugaacuuggcaaaaauauacgauuauguaaauccucaaaaagacaagcaguuagguga

SEQ ID NO: 8437 - RNA, 3159 nt, Artificial Sequence
  Cas9 variant
augauaggagaacaugucagaggcggguguuuauuugacgaccauuggacuccaaacuggggagccuuucgucuuccaaacacaguucgaacauucacuaaagcagaaaauccaaaagacgguucaucacuugccgagccuagaaggcaagcacggggacuuagacgccguuuaaggagaaaaacacaaagacuagaggauuuacggagacuccuagccaaagaaggaguauuaaguuuguccgaucuggaaacacucuuuagagaaacuccggcgaaagaucccuaucaauuaagagcagaagggcuagaucguccgcugagcuuuccagaauggguccgaguauuauaucauauaacuaaacauagagguuuccaaucuaacagaagaaauccagucgaagacggccaagaaagguccagacaagaagaagaaggaaaacuacugagcggcguuggagaaaacgaaagacuccuacgcgaaggaggcuacagaacagccggugaaaugcuagcaagagauccaaaauuccaagaccaccgaagaaacagagcaggagauuauucacauacucuaaguaggaguuuguuauuagaggaggcacgaagauuauuccaaagucaaagaacauuaggaaauccccacgcuagcucaaacuuggaagaagcguuucuccaucuuguagcauuccaaaauccauuugcaucaggagaagacauucgaaacaaagcgggacacuguucauuagaaccugaccaaauaagagcaccaagaagaucagcaucagcugaaacauucauguuacuccagaaaacuggaaaucugagauuaauucauagaagaacaggagaagaaagaccauuaaccgauaaagaacgagaacaaauccauuuacuugccuggaaacaagaaaaagucacccacaaaacacuaaggagacaccuagaaauaccugaagaauggcuuuucacagggcugccauaucaucgaucaggagauaaagcugaggaaaaacuauuuguccaucuagccggaauacacgaaauaagaaaagccuuagauaaaggaccggauccagcaguaugggauacucuaagaaguagaagagauuuacuagacaguauagcugauacauuaacuuuuuauaaaaaugaggaugaaauauuaccccgacuugaaucguuagguuuaagcccagaaaaugcgagagcucuggcuccauuaaguuuuaguggaacagcucacuugucccuaucagcauuagguaaacuacucccucaccuagaagaaggcaaaucauauacucaagcacgagcugacgcugguuaugcagcaccuccuccggauagacauccaaaacuucccccauuagaggaagcagauuggcgaaaucccgugguauuccgcgcauuaacgcaaacaagaaaaguagucaaugcacuugucagacgauauggaccgccauggugcauacacuuagaaacggcuagagaauuaagucaaccagcgaaagucaggagacgaauugaaacggaacaacaggcaaaugagaaaaagaaacaacaagcagaacgagaguuccuugacauaguagguaccgcgccuggaccaggggaccuucuuaaaaugagauuauggagggaacaagggggauuuugcccauacugugaagaauauuuaaaccccacuagacuggcagaaccaggauaugcugaaauggaucauauacuaccauauagccguucauuagauaauggguggcacaauagaguacugguacacggaaaagauaacagagauaaaggaaauaggacuccuuucgaagcguucggaggagauaccgcccgaugggacagauuaguagcauggguacaagcuagccaucuaagugcaccaaagaaaaggaacuuacugagagaagauuuuggagaagaagccgaacgugaauuaaaagauagaaacuuaaccgauacgagauucauuacaaaaacagcugcuacccuauuaagagauagacuaacauuccauccugaagcaccaaaagauccaguaaugaccuuaaaugguagauuaacagcguuuuuacgaaaacaauggggacuacacaaaaauaggaaaaauggggacuuacaccaugcacuagacgcagcgguccuugcaguagcaaguagaucauucguuuauagacugucaucucacaacgcagcuuggggugaauuaccuagaggcagagaagcugaaaacggauuuucacuaccauacccagccuuuagaagcgaaguguuagcuagacuauguccaacaagagaagaaauucuuuuaagauuagaccaagguggcguuggguacgacgaagccuuuagaaauggguuaagaccaguauuuguaucaagagcgccgucacgaagauuaagagguaaagcccauauggaaacacuacgaagcccuaaauggaaagaucacccagaagguccacgcacagcaaguagaauaccauuaaaagaucuaaacuuagaaaaacuagaaaggaugguaggaaaagaccgagaucgaaaacuauacgaggcguuaagagaaagguuagcagcuuuuggugguaauggaaagaaagcauuuguagcuccuuuccgaaaaccauguagaucaggagaaggaccccuaguucgaucccuaagaauauucgacaguggauauucugguguagaauugagagauggaggagaaguuuaugcaguagcagaccaugagucuaugguacgaguagauguauaugcuaagaaaaaucgauucuauuuaguuccaguauauguggcggauguggcaagaggcauagugaaaaaucgagcuaucguagcccauaaaagcgaagaagaaugggaucucguagauggguccuucgauuuccgguucaguuuauucccaggcgaucucguagaaauugagaagaaagauggcgcuuaccuaggcuauuauaaaucaugccauagaggagauggucgucuacuucuugauagacacgauagaaugccaagagaauccgacugcggaacauucuaugugucaacaagaaaagacguacuguccaugaguaaauaucaaguagauccacuuggcgaaauccguuuaguagguagugaaaaaccaccauuugugcuuuga

SEQ ID NO: 8438 - RNA, 3162 nt, Artificial Sequence
  Cas9 variant
augaaaagaaacuauauccuuggacuagacaucggaauaacaagcgucggguacgggauaaucgacuaugaaacacgagaugucauagacgcuggcguacgccuauucaaagaagccaacguagaaaacaacgaaggaagacguucaaaaagaggagccagaagacuaaaaagaagaagaagacaucgaauacaacgaguaaaaaaauuacuauuugauuauaacuuauugacugaccacucagaguuaucggggaucaacccuuacgaagcaagaguuaaaggucuaucccaaaaauuauccgaagaagaauucucagcggcauuauuacacuuagcaaaacgcagaggaguacacaacguaaacgaaguagaggaagacacuggaaacgaacucucaacaaaagaacaaauaucaagaaacucgaaagcacuggaagaaaaauacgucgcagaacuacaauuagaacgcuuaaaaaaagacggagagguaagaggcucaauaaacagauucaaaaccucagacuacguaaaagaagcgaaacaauuacuaaaaguucaaaaagcauaccaccaacuugaccaaucauucauagauacauacaucgauuuacuagagacuagaagaaccuauuaugaaggcccaggagaaggcucucccuucggcuggaaagacaucaaagaaugguaugaaaugcuuaugggccauugcacauacuuccccgaagaacuacgaucaguaaaauacgcauacaacgcagaccucuacaaugcacugaacgaccuuaacaaccuaguaauuacccgagacgaaaacgaaaaacuagaauauuaugagaaauuccaaauaaucgaaaacguauuuaaacagaaaaaaaaaccgacauuaaaacagauagcaaaagaaauauugguuaaugaagaagauauaaaaggauaucgaguaacgucaaccggaaagccagaauuuacaaaccugaaaguauaccacgacauuaaagacauaacagcacggaaggaaauaauagagaaugccgaacuguuagaucaaaucgcgaaaauucuaacaauauaccaaucauccgaagacauacaagaagaacuuacuaaccuaaacucagaauuaacccaagaagaaauagaacaaauuucaaacuuaaaaggcuauacaggcacacauaacuuaucacuaaaagcaauaaaccuaauucuugacgaacucuggcacacaaacgacaaucaaaucgcaauauuuaauagauugaaacuaguaccaaaaaaaguagaccuaucacaacaaaaagaaaucccaacgacucuaguagacgacuuuauccucuccccagucgucaaaagauccuuuauacagaguauaaaaguaauaaacgcaauuauaaaaaaauacggacuuccaaacgauaucauaauagaacucgcacgagaaaaaaacaguaaagaugcacaaaaaaugaucaaugaaaugcagaaacgaaacaggcaaaccaacgaacgaauagaggaaauaauucguacaacagguaaagaaaaugcaaaauaucucauagaaaagauaaaauugcaugacaugcaagaaggaaagugccuguacucauuagaagcgauaccauuagaagauuuacuaaacaauccuuuuaacuaugaaguugaucauauaauacccagaucaguaucauucgauaacuccuucaacaauaaagugcuaguaaaacaagaggaaaacagcaaaaaaggcaaccgaacaccuuuccaauacuuaucaucuucagauucuaaaauuaguuaugaaacauucaagaagcacauacuuaaccuagcaaagggcaaaggaagaauuagcaaaacaaaaaaagaauaccuacuagaagaacgcgauaucaaucgauucucgguacaaaaggacuucauaaacagaaacuuaguggacaccagguacgccacacgaggacuaaugaacuuacuacgcaguuauuucagaguaaacaaccuagacguuaaaguaaaaucaauuaacggaggcuuuacaagcuuucuaagaagaaaauggaaauucaaaaaagagagaaacaaaggcuacaaacaccaugcggaagaugcucuaauaaucgcuaacgcagacuucaucuucaaagaauggaaaaaauuagacaaggcaaaaaaaguaauggaaaaccaaauguucgaagaaaaacaagcugaaaguaugccagaaauagaaacagaacaagaauauaaagaaauauucauaaccccacaucaaauaaaacacauaaaagacuucaaggauuacaaauauucccaucgaguagacaaaaaaccaaacagagaacuaauuaacgacacccuauacaguacaagaaaagacgauaaaggaaacacccuaauuguuaacaacuuaaauggacuauaugacaaagauaaugauaaacuuaaaaaauuaauaaacaaaucaccagaaaagcuauugauguaucaccacgacccccaaacauaucaaaaauuaaaacucaucauggaacaguauggcgacgaaaagaacccuuuauauaaauauuaugaagaaaccggaaacuaccucaccaaauacucaaaaaaggacaauggaccuguaaucaaaaaaauaaaauauuacggaaacaaacucaaugcacacuuagauauaacugaugacuacccuaacucgagaaauaaaguaguuaaacucagucuaaaaccauacagauucgacguauaccucgauaacggaguauauaaauuugucacaguaaagaacuuagaugucauaaaaaaagaaaauuauuacgaaguaaacagcaaauguuacgaagaagcaaaaaaacuaaaaaaaauaucaaaccaagcggaauuuauugcuucguucuauaacaaugaccuuauaaaaauaaauggcgaacuauaucgcguaaucggggucaauaaugaucucuuaaaccgaauagaaguaaauaugaucgacauaacauaccgcgaauaucuagaaaacaugaacgauaaaagaccacccagaaucauaaaaacuauugcgaguaagacacaaucaauaaaaaaauauaguaccgacauuuuaggaaacuuauacgagguaaaaaguaaaaaacauccacaaauuaucaaaaaaggauga

SEQ ID NO: 8439 - RNA, 3162 nt, Artificial Sequence
  Cas9 variant
augaaaagaaacuacauauuaggacucgacauaggaauaacaucaguagguuacgguauuauagacuaugaaacacguaacguaaucgaugcuggaguccgacucuucaaagaagccaauguagagaacaaugagggacgaagaagcaagagaggcacaagaaggcugaaaagacgacgaagacaccguuuacaaagaguaaaaaaauuacuauuugaccauaauuuucucacagauaauucagaauuaucuggaauaucaccguaugaagcacgaguuaaagguuuaaaccaaaaaauaagugaagaagaauucucuguugcccuauuacauuuagcaaagcgaagaggaguacauaacguaaaugaagucgaagaagauacaggaaacgagcuaagcacaaaggaacaaauaucccguaacucaaaagcucuagaagaaaaauacguagcagaacuacaauuagagaggcucaaaguagacggagaaguacguggcgcagucaaucgcuuuaagaccucagauuacguaaaggaagcgcaacaaauccuaaaaguacaaaaagcauaucaccaauuugaccaaucauucauagacacuuauauugacuuacuagaaacccgaaggacuuacuacgagggaccaggagagggaucaccauucgguuggaaagacauuaaagaaugguaugaaaugcuuaugggacaaugcacauacuuuccagaagaauugagaagcguuaaauacgccuauaaugcagaccuauacaacgcguuaaacgaccuuaauaaccucguaauugcccgugaugaaaaugaaaaacuagaauacuacgaaaaauuccaaauaauagaaaacguauucaagcaaaaaaaaaagccaacacucaaacaaauagcaaaagaaauacuuguuaacgaggaagacauaaaaggauaccgagucaccucaacaggaaagccagaauucacaaauuucaaagucuaccacgauauaaaaucaauaacuagucgaaaagaaauauuagaaaacgcagaacugcuaaaucagauagcaaaaauauuaacaaucuaccaaagcuccgaagacauacaaggagaguuagcacggcucuauucagagcucacgcaagaagaaauagagcaaauaucaaagcuggcagguuacacuggaacccauagacuaagccuaaaagcuauaaaucuaauuauagacgaacuauggcauacuucagacaaccaaauggagaucuucaacagauuaaaacucguaccuaaaaaaguagacuuaucccaacaaaaagaaauaccaacaacacuuguagacgacuucauccuuagucccguagucaaacgcucauuuauacagucaauuaaaguaauaaacgcaauaaucaaaaaauauggauucccaaaugacauaauaauagaacuugccagagaaaaaaauucuaaagaugcucagaaauucauaaacgagaugcaaaaacggaaucgacaaacaaacgaacgaauagaagaaaucauaagaacaaccgguaaagaaaacgcaaaauacuuaauagaaaaaauaaaauuacaugacaugcaggagggaaaaugccuauauucuuuagaagcaauuccacucgaagauuuauuaaacaauccuuuuaauuacgaagucgaccauaucaucccgcgaucaguuagcuucgacaauucauucaauaauaaggucuuagucaaacaagaagaaaacucaaaaaaaggaaauagaacuccauuccaauauuuuuccaguucagacucgaaaauaucauacgaaauauucaaaaaacacauucuuaacuuagcgaagggcaaaggacgaauaaguaaaaaaaaaaaagaauaucuccuagaagaaagggauauaaacagauuuucaguacaaaaauacuucauaaauaggaaucuugucgauacccguuacgcaaccagagaacuaaugaaccuacuccggucauacuucagaguaaaugaucuagauauuaaaguaaaaucaaucaacggaggauucacaucauuccucagaaaaaaauggaaauucaaaaaagaacgaaauaaaggauauaaacaucacgcagaagaugcccucauaauagcaaaugcagacuucauuuuuaaagaauggaaaaagcucgacaaaacaaacaaaguaauggaggaccaaaucguagaagaacaacaagcagaaucuaugcccgaaaucgaaacagaacaggaauauaaagaaauauucauaacaccacaucaaauacaagacauaaaagacuucaaagacuauaaguauucgcauaggguugauaaaaagccaaauagagaacucguuaacgauaccuuguacucuacccgaaaagacgacaaaggcaacaccuuaauaguaaacaaucuaaaaggcuuauacgauaaagauaaugacaaacuaaaaaagcuaauuaauaaauccccagaaaaacuucuaauguaucaccaugacccacaaacauaccagaaacuaaagguaauuauggaacaauacagcaacgaaaaaaauccuuuauauaaauaccaugaagaaacgggaaacuacuuaacaaaauauucgaaaaaagacaacgggcccguuauaaaaaaaauaaaauauuacggaaacaaacuaaauguauacuuagacauaacaagagacuaccuaaaaaguaggaacaaaauaguaaaacugucacuaaaaccauacagguuugacgucuaccuagacaacggcguauacaaauuugucacugucaaaaaccuagacauuauaaaaaaggaggauuauuacgaaguagacuccgacuccuacgaagaagcuaaaauagucaaaaaaguaagcgagcaagcacaauucgucgcaucauucuauaauaacgaccuaauaaaaguagauggagaacuuuuucguguuauaggagugaauaacgaucugcucaaccgaauagaaguaaacauggucgacaucacuuacaaagaauaucuggaaaacauaaaugacaaaaaauccucacgaauuauuaaaacaaucucaaguaaaacucaaagcauaaaaaaauacaguaccgacauauuaggaaaucuauaugaagcaaaaucaaaacagagaccacaaaugacaaugaaaggauga

SEQ ID NO: 8440 - RNA, 3162 nt, Artificial Sequence
  Cas9 variant
augaagagaaauuauauauugggucuugacauaggaauaacaucuguagguuauggaauaaucgacuacgagacaagagauguaauugaugcaggaguaagacucuucaaagaagcaaacguagaaaacaacgagggucgaaggaguaaacgaggggcaggccgucuaaaaagaaggcgacgacacagacuacaaagagucaaaaaacuauuauucgauuacaaccuccucacagaccacucagaacuuaguggaaucaacccauaugaagccagaguaaaaggacuuagucaaaaacuaucagaagaagaauuuuccgcagcauuauuacaccuagcaaaaagaagaggaguucacaaugucaaugagguagaagaagauacaggaaacgaacuuuccaccaaagaacaaauaaguagaaacagcaaagcauuagaagaaaaauacgucgcagaauuacaauuagaacggcucaaaacggacggcgaaguaagagguagcaucaacagauucaaaacaucagacuacgugaaggaggcaaaacaacuauuaaagguacaaaaagaauaccaccaacuugaccaaaguuuuauagacacguauaucgaccuauuagaaacgagaagaaccuacuacgagggaccuggagagggaucaccuuucggguggaaagacauaaaagaaugguaugagaugcuaaugggacauugcacauacuucccagaagaauuaagaagcguaaaauacgcauauaacgcugaccucuacaacgcauuaaacgaucuuaacaaccuggucauagcaagagaugaaaaugaaaaauuagaguauuacgagaaauuccaaauaauagaaaacguuuuuaaacaaaaaaaaaaaccaaccuuaaaacagauugaaaaggaaauucuuguaaacgaagaagauaucaaggguuaccgaguaacaucgaccggcaaaccugaauucaguaaucuuaaagucuaccacgacaucaaagacauaaccgcgagaaaagaaauuauagaaaaugcagaauuacuagaucaaauugcagaaauauuaacaauauaucaaucaagugaagauauacaagaagaacuuguaaaacuaaacucagaacuuacccaagaagaaauagaacaaauaagcaauuuaaaaggauauaccggcacacacaaccucagcuuaaaagcaauuaaccuaauauuagacgaacucuggcacacuaaugacaaccaaauggcaauauucaaccgacuaaaacuaguacccaaaaaaguggacuuaucucaacaaaaagaaauacccacaacauugguagaugacuucauauuauccccuguaguaaaacgaucauuuauccaauccauaaaagucauuaaugcaaucauaaaaaaauauggauugccaaaugacauaauuauagaacuagcaagagaaaaaaacagcaaagacgcgcagaaaaugaucaaugaaaugcaaaagagaaauagacaaacaaacgaaagaauagaagaaauuauacgaacaaccggaaaagaaaacgcaaaauaccugauagaaaaaauaaaacuacacgauaugcaagaaggaaagugccuauauucacuggaggccauuccacucgaagaccuccuaaauaacccauuuaauuacgaaguagaucacauaauaccaagaagcguaagcuucgacaacucguuuaacaauaaaguacuuguaaaacaagaagaaaacucgaaaaaaggaaacagaacacccuuucaauacuuaucaucauccgacucaaaaauaucauaugagacauuuaaaaaacauauacuaaaccuagccaaaggaaaaggaagaauaucaaaaacuaaaaaagaauaucuuuuagaagaaagggacauuaacagguucucgguacaaaaagacuucauuaaucguaauuuaguagacacccgauacgcaacacgagaacucaugaacuuacuacgaucauauuucaggguaaacaacuuagacguaaaaguuaaaagcauaaacgguggcuuuaccagcuuucuaagaagaaaauggaaauuuaaaaaagagcguaauaaaggcuauaagcaccaugcagaagacgcacucauaaucgcuaaugccgacuucauauucaaagaauggaaaaaacuagauaaagcaaaaaaagugauggaaaaccaaacaguagaagaaaaacaagcagaaaguaugagugaaauugaaacagaacaggaauacaaagagauauucauaacuccacaccaaauucaacacaucaaagacuucaaagauuauaaauacucacaucgaguugacaaaaaacccaacagagaacuaauaaacgacacauuguauucaacaagaaaagacgauaaaggcaacacauuaauaguaaauaaucuuaauggucuauaccauaaagauaaugauaaacuaaaaaaauuaaugaauaaaucaccagagaaauuauuaauguaucaucacgacccucaaacauaccaaaaauuaaaacuaauaauggaacaauauggagaugaaaaaaauccacuauacaaauauuacgaagaaacugggaauuaucuaaccaaauacucaaaaaaggacaauggaccaguuauuaaaaaaauaaaauauuacggcaauaaauugaaugcacacuuagauauaacagaugacuacccaaacaguagaaacaaaguagugaaacuuucauuaaaaccauacagauucgauguauacuuagauaauggagucuacaaauuugucacuguaaaaaaccuaaacguuaucaagaaggagaacuacuaugaaguaaauaguaaaugcuaugaaaaagcaaaaaaauuaaaaaagauaagugaccaagcagaauuuauagcuucauuuuacaauaacgacuuaauaaaaauagauggagaacuguaccgaguuauaggggucaauacagaccucauuaaccgaaucgaaguaaauaugguagacauaacguaucgcgaguauuuggaaaacaugaaugacaaaagaagccccagaaucuucaagacaauagcuucaaagacccaaucaauaaaaaaauacucaacugacauucuaggcacauuauaugaaguaaauucaaaaaaacauccacaaaugauaaugaagggauga

SEQ ID NO: 8441 - RNA, 3162 nt, Artificial Sequence
  Cas9 variant
augucagguauggucuucggaaucgauuuagguauagcaagcugcgggugggcaguauuaagacaaccgcaaagagacggagauccaggugaaauuguagauuuagggucauggauguuugauguuccagaaacagauaaagaaagaacaccuacaaaccaaguaagaaggggaaaccggcuauuaagaagagucauaagacgacgcgcccaaaggaugguagaaauaagacguuuauuucacgaucauggcuugcuagcaggacaugcaccagaagcacuaaaaagagcgggauuagauccaugggauuugagagcacgcucauuagauaaaguucuagaaccagcagcacuagcaguagcacuaggacauauagcaaaaagacgaggauuuaaaagcgcagcacgcaggaaagaagcaaacacagcaggagaugaucaaaagaugcugaaagcauuggaagcgacucaugaacgacuuggcagauacagaacgauuggagaaauguucgcaagagauccugacuuugaaagcaggaaaagaaauagagauggaauguuugacaggacacaagggagagaugaucuuuugcaugaaguaggagaaauauuuaaagcacaaaggagguuggguagcgcauuagcuacggcagagcuggaacaggcauucacagcaauagcauucagacaacuuccaauucaagauucagaaagauuagugggacuaugucaguucgaaccgaaagagaaaagagcggcacgguuugcgccuaguuuugaacgauuucgacuuuuacaacgauuaacaaaccugaggguaguaacaguugaaggugaaagaccuuuaacagcagaugaaauagccgcagcugcggcagaucuagguagaacagcgaaacuaaguguaaaagaaguaaggaaaagaauaggauuggcugccgaccaucgauucgcggcauucaaagcugaugaggaagauagagauauaauagcaaggacaggcgaagcauuacacggaacauauagauuaaggaaagcauuaggagaaggacuaugggcagaaaugcuacccggccagcuagaugcgauugcgcacgcauuaaguuucuucgaaacacaagaugucauccucaaagaacuagauaaacuugaucuaccggcaggaguccgagacgcaauagcaacaggauuggaugcaggagcauuugcaagauuuaaaggaaccgggcauauauccgcucgagcugcaagagcacuguugccgcauuuggaggccggacuacgcuaugaucaagcauguacaaaagcaggauacgaucaugcagcaucgcgaugggccaaaagagaacagguagcugauaaggcugcauucaacaggcuaguaacugacaugggugcugaaaucgcaaacccaauagcgagaaaaaguuuaacggaagcucugaaacaacucugggcaaugagaaauagguggggucuuccugacgcaauacauauugagcuagcaagagacgucggaaacaguuuagagaaaaggagggaaauagaaagagcuauagagaaaaauacugcagcgagagaaagagaaagaggagaagcaagagaucuccuagggauagaugauguaagcggugauacucuauuaagauacagauuauggaaagaacaagcagggagauguccauacacagaugcgcccauacccccuggagcuauuauagcaacagauaauucauuccaaguagaccacauucuuccuuggaguagguucggggaugauagcuuugcaaacaagguacuuugugccacugcugcuaaucaaaggaagaaaggacaaacgccaugcgaauggauuacggcagcccagggagaagaaggaugggcaacuuuuguagcaagaauugaagguaaugcagcguuuagaggaccaaagaaaagaaacuauguacuuaaaaaugcgaaagaggcugaggaacgguuuagagcuaggaauuuaaaugacacucgauaugcugcaagauuacuagcugaagccguaaaauuauucuacccugaaggcgaacgacaagauaaaggaggugugagaaggguuuuuacucgaccagggggucugacagccgcacuaagacacgcauggggaguagaagcccuaaagaaacgugacggaaaaaggguagaugacgcacgacaucacgcacuugacgcuuugguaguugcagcaauuggagaaggggagguacaaagauugacaaggucauaucaggaaugggaacaacaaggacuugcaaggccauuacgaaggguggauccucccuggggagacuuucauucauuuagaagggaaguaaaagaugcauaugacggcauauucguagccaggccugaaagaagaagggcucgcggggaaggacaugcugcaaccauaaggcaagugagggaaagggauggagcagccguaguguuugaaagaaaagcuauagcagacuuaagugagaaaaggcuagcggauaucaaagaccccgaaagaaaucaagcaauaguggaagcaauucgacaauggaucguagacggaagaccagccgauagauuaccacggucaccagcuggugaugaaauuagaaaagugcgcuuaaggacaaaagggaaaccagcaguacaagugagggguggagcagcugauagaggagaaauaguacgaguugauguauuuacaaaaccgaacaagaaagggaaaaacgaguucuauuuagugccaauauauccacaucaaguuaugaauaaagcggaauggccaacaccaccgaugagggcaguaguagcuuauaaggaugaaucggaauggacccuuuuggacgaaaauuuuggguucuuauuuaguuuauuucccagaucauauguagaaguaacaaaaccaggaggagaaguacuuucaggauauuuucaaggaauggacagaucuacaggugcaaucagucuauucaaucauagagauucaaggaguuuaacggaugauucggggaacucaacccgugggaucggggcaaaaacacuuuuaacgaugaagaaauauagcguugaucguuuuggaaaaagagcagaaguaaaaagugaaguuagaacuuggcauggcguagcauguacauauccgacgcccccaggauga

SEQ ID NO: 8442 - RNA, 3165 nt, Artificial Sequence
  Cas9 variant
augaaauuaacuccacuaaacuauauacuaggacucgaccuaggaauagcaucaguaggaugggcaguuguugaaauagaugaacaagaaaauccacugggucuaaucgacgugggaguucgaacauucgacagggcagaaguagcaaaaacaggagaaagccuagcucuagcaagaagguuagcaagaucguccagacgacuuguuaaacguagagcggacagaauuaagaaaguaaaaagacuccuuaaaagcgaaaauauauuacuuucugccgaugaacaacuacccaacgaugucuggcaauuacguguaaaaggauuggaccaaaaacuugaaaggcaagaaugggcugcaguucuucuacauuuauuaaaacauagagguuaucucucacaacgaaagaaugaaucaaaaucagaaaauaaagaacuaggugcauuaagaucuggcguagcagcaaaucaucaaauauuacagucagcugaauauagaacaccagcagaaauugcugucaagaaauuucauguagaagaaggucauauacgaaaccaaagaggcgcauacacucacacauuuucaagacuugaucuauuggcagaaauagaauuacuauuuacucgacaaacagaacuugggaacccucauacaagugcaaaauuguuagaaaauuuaaccgcucuacuaauguggcaaaaaccugcucuagcaggcgaagcaauucucaaaaugcuagguaaauguacauuugaacccacagaauauaaagcagccaaaaacucuuacucagcagaaagauucguuuggcugaccaaacuaaauaauuuacgaauacucgaacaaggagcggaaagagcauuaaccgauaaugaaagauuugccuuauuagaucaaccauaugaaaaagcuaaauucaccuaugcccaagcgcguaccaugcucgcauuacccgacgaagcaauauuuaaaggagugagauaucaaggggaagauaagaaagccguugaaaccaaaaccauacuaauggaaaugaaagccuaccaccaaauuagaaaagcauuagaaaacgccgaucucaaagcagaauggaaugaacucaaaaauaauucagaauuauuagaugacaucggaacugcuuuuagcuuacauaaaacagaugaagacauaugcagauaucucgauggaaaacuauccgaauccauccuaaacgcacuucuagaaaacuuaaacuucgacaaauuuauucaacuaucauuaaaagcauuacaacagauacuaccccuaaugcuacaaggacaaagauaugaugaagcaguuagugcaauuuauggagaucacuacggaaagaaaagugcugaaauaaacagauugcuaccuacaauaccagccgacgaaauacgcaauccaguuguucuuagaacgcucacgcaggcaagaaaaguaaucaaugcaguaguaagauuauacgggucaccggcccguauacauauugaaacuggucgagaaguagguaaaucauaucaagaucgaaagaaacuagaaaaacaacaagaggacaacagaaaacauagagaaucagcuguacaaaaauuuaaagaauacuuuccaaacuuuguaggugaaccgaaaggaaaagacauacuaaaaaugagauuauaugaacugcaacaagcaaaauguuuauacucagguaaaucauuagaguuacacagacuacuagaaaaagguuacguggaagucgaccaugcccuaccauuuagccgaacaugggacgauaguuuuaauaauaaaguccuaguacucgcaaacgaaaaucaaaacaaaggaaaccuaaccccauacgaauggcuugaugguaaaaauaacucagaaccauggcaaaauuucguggcaagaguacaaaccuccggauuuucacauacaaagaaacaaagaauccucucacauaaauuagaugaaaaaggauuuaucgagagaaacuuaaaugacacaagauauguaguuagauuucuuuguaauuucaucgcagauaacauguuauuaaccggaaaagguaaaagaaaaguguucgcaucaaauggucaaaucacagcacucuugagaggccgauggggauuacaaaaaguuagggacgauaaugaccgacaucaugcauuagacgcaguuguuguagccuguaguaccguagcaaugcaacagaaaaucacaagauucgugcguuacgaagaaggaaacguauucucaggagaaagaauagauagggagacaggagaaauaauuccauugcauuuccccucgcccugggccuucuucagagagaacguugaaauacgaauauuuagugaaaaccccaaacuagaauuggaaaacagguuaccugauuauccacaauauaaccacgaauuuguacaaccauuauucguaaguagaaugccaacacgaaaaaugacuggacaaggucacauggaaaccgugaaaagugccaaaagacuugaugagggucuaucaguauuaaaaguaccauuaacacaauuaaaacuaaaugauuuagaaagaaugguuaauagagaacgagaaauggccuuauacgagagcuuaaaaguaagacuagaacaauuugauaacgaccccgcaaaagcauuugcagaacccuucuauaagaaaggaggagcucuaguuaaagcaguaagggucgagcaaacacaaaaaucaggcguauuaguuagggacgguaauggcguagccgauaacgcuucaaugguaagaguagacguauuuacaaaagccgggaaauacuuuuugguuccaauauauacguggcaaguagcaaaagguauacuuccaaauaaagcaguaacugcaaauguagaugaaauagauugguuagaaauggaugaaaguuaucaguucauauuuacuauguaucccaacgaccucguaaaaguaaaacuuaagaaagaagaguucuuuggcuacuauggugguuuagaucgugcaacaggagccauaguaauuaaagaacacgauuuagagaaaaguaaaggccgacagggaauauacagaauuggcguaaaacuggcacuaucauucgaaaaauaucaaguugaugaacuugguaaaaauauacgaccaugucgucccaccaaacgacagcauguaagauga

SEQ ID NO: 8443 - RNA, 3165 nt, Artificial Sequence
  Cas9 variant
augagaauauuaggaguagaucuaggcguagccuccguaggaugggcguuagucaacgacaaaaauaacaaaauuauagauucaggcguaagaaucuucacacagagcacgaaccgagaaggaaaaacauuagccgcagucagacgcucauuuaggggcggacgaagaguacucagucgacgaaaacaacgauuaaaccaauuaaagaaauuguuuauagcccauaaacuacuaucaaaaagugaguucaaacaucuguucaacagcaaaaacagacuugauauauggcaacuaagagcuaaaggacucgaacaacaacucaauaauaaggaaugggccagaguucuuuaccauauagccaaaagacgagccuaccaaucaaaucgcaaaucugaagaauccggaaacaccgauaaaaagaaaguccuaucagguaucucuaaaaacgaaaagaaaaugaaugaacucggauauaaaacaauaggggaaaugcuauacacggaaaaccgauaccccgauaacaggauccguagaaacaagaaagaccaguauaaacacaguauaagucgugaccuacuuagaaaagaaauagacguacuauucgaaucacaacgcgacuucggaaaucaauuugcaacugauggacuaaaagaacauuacaaagacauagcuuuuacacaaagaccaauaaaauuuaaagccgauuuaguaggaaaaugcacuuuugaaacacaagaauacagaggugcuaaaaauugcuucuccgucgagaaaaguacacuacuaucuaaaauaaacaacacggaucuuauagacaaauccacaggagaaauaaaaagauuauuugaaauaagugaguucgauaaacuacucgauauauuuuacucaauaaaagaaguaaaauacacaacacuuaggaaacaacuuaaaauaacagacgcauucaaguucaaacagcuagauuaccaucaaaacuuugaauauaaaacgaacaucaaagcaaaaaucgaagauuuuuacaaguuggaagauugguuaacaccggaacaaaaaguuuuacuagaaaaacaagugcuagacgauaagaaagaaaaauucaaaugcuacaaauacagcaguauacgcucaauccuaagccuuagcgaaagccagaaauuuaacggcguuaaauacgacacaaaaguagaaaacacagucuucggaaaacuaaauggcuaucacagcauaaagaaagaacuaaauaaagaagucuuugacuuacuguuuauugauaaagauaaauucaacaaaauagcagaaauacuuucauaccaaaaagacgacaaaucggcuacacaagaccugaagaaacaaguauucaacgacuuuaacauggauaaaacuaucguaaacgaagcaauaaacagccuacugaauauuagcuuuucaggauucaacuccuuauccuuaaaagccauaaauaaacuucugccauaccuaugucaaggucucaaauaccacgacgcaguagcacacagugaauacaaacaccacucccaauucaaagcagcaaacccacaacaauaccuacgaccccuuaacaaagaagaaaauuaccagauaacaucaccaaccguuaaaagaguauucucacaauuucguaaaguacuaaaugcgguuauaagaaaacacgguagcuucgacgcaaugcacauagaaauggcacgugaacuuaaaaacagcaagaaaaucaaauucgaaauacaaaccggucaaaaagaauacgcacaagaaaaagaagccauuaggguaaaauuccuagaaauauuuaaauacgaagguucagguagggaucuccuuaaacuacggcuauaugaacaacaacauggaaaaugcauauauaguaagaaagaaauagaaauaaacaaacucuuagaagacggauacguagaaauagaccauauacuaccguggucaagaacauucgauaauucccucaauaacaaagcauuaugccucagcgcugaaaaucaaaacaaagcaaaucaaacaccauuugaauaccuaacaaacagcgauaaaaauuccaaagauucaaaagaauggcaagaauacaaaaauuaugucaguucguucgcaggaauaaaacaagcaaagaaacauaaacuacuaaacacuacacuaccaccccgaagagggaaugauuucuccgaugauauuaaaaacccugaaagugguuuccucgcaagaaaccuaaaugacacagcauacgcaucgagguuuauuaaaaacuuuguacagaaccacuugcaauuuagccaaaacgauaccauaaaacaaaaaguuaaaguuagaagcggagcauuaacgaaucaacugagguacaacuggggaauagaagagaaaaaucgagacaacaacuuacaucacgcagaagaugccauuauacuagcauuugccacucaaggagaaguucaacgaaugagcacuauauccgcaaaaagagaagauuucaaauaccaaacagcaaaagaaagaaaaauaaaauucacuccaccauucagcgauuuuaaauccgugcuagacgagucaguaggcgacauauucguaaguuucgcaccuagacgaaaaauaucuggcgcagcccacaaagcaacaauaaaaccuaaagauacaggcggaaaauacaaauucccaguaaacaauggaauggcagaaaacggaguaauacaaagaguagacguauuuaagaacgcuaagaacaaauaucaauucaucguuuucuacccagcagauuucuauaaagacgacuuuccggaacuugaccuaaaaggaaacgaaaucgacaaaaacguacaauuccuauucucacucuuuaaagacgaccucauagaguucaagacgaagaaaacaaaaacaaaagacaguaaacaccuccuagcguacuucaaauacauaagaucagacggcaaaauagcauuucaacaaaacuacaaagcugaaauagaaagaaaagaaagcgacaauaagaaaggauauaaagauauauuacuagcaacgggaagugguuuagcaucacuuaagaaauaucaaguuuccguacucggcgauauagcagaagucaaaaacgaaaaacggcuacccuuaauuaaacaaauguacaaaucaaaacccaaaaagaaauga

SEQ ID NO: 8444 - RNA, 3165 nt, Artificial Sequence
  Cas9 variant
augaaccaaaaauuuaucuuaggacucgacauaggaauuacgagcguuggauacggcuuaauugauuaugaaacgaagaacaucauagacgccggugucagacuguucccagaggccaauguugaaaacaaugaaggaagacgauccaaacgagguucacgucgacuaaaaagacgaagaauccaccgacuagaaagaguuaagaaacuacucgaagauuacaaccuacuagaucagagucaaauuccacaaagcacaaacccauaugcuauaagaguuaaaggcuuaagugaagcacuaaguaaagacgaauuaguaauugcccuacuccacauagcuaaaagaaggggcauccauaaaaucgacguaauagacucaaacgaugacguuggcaaugaauuaucaaccaaagaacaauuaaauaaaaacagcaaauugcugaaggauaaauuugucugucaaauacaacuggaaagaaugaaugaaggccaaguacgaggagaaaaaaaucgauucaaaacagcagacauaauaaaagaaauaauacaacuccuaaacguucaaaaaaacuuccaccaguuagaugaaaacuuuauaaauaaauacauugaauuagucgaaaugagaagagaauacuuugaaggacccggaaaaggaagccccuauggcugggagggagauccuaaagcuugguaugaaaccuuaaugggacauuguacauacuuuccggacgaauuaaggucuguaaaauaugccuacuccgccgaccuauucaaugcuuuaaacgacuuaaauaacuuagucauccaaagagacggacuaucaaaacuagaauaucaugaaaaauaccacaucauagaaaauguauucaaacaaaagaaaaagccuaccuuaaaacaaauagcaaaugagauaaaugugaauccagaagauauaaaaggauaucgaauaacgaaaucaggcaaaccacaauucacggaauuuaaacuuuaccaugacuuaaagagcguccucuuugaucaaagcauacuagaaaacgaagacguacuagaucaaauagcagaaauacucacaaucuaccaggacaaagauuccauuaaaucaaaacuaacggaacuagacauacuauuaaacgaggaagauaaggaaaauauagcccaacuaacaggguacacaggaacacacagauuaucacuaaaauguauacgauuaguucuagaagaacaaugguauuccucacgaaaccaaauggaaauauucacccacuuaaacauaaaaccaaaaaaaauaaauuugaccgcagcaaacaaaauaccaaaagcaaugauagaugaauucauacuaagcccagugguaaaaagaacuuuuggacaagcgauaaauuuaauaaauaaaauaauugagaaauacggaguacccgaagauauaauaauagaacuagcuagagaaaacaacuccaaagacaaacaaaaauucauuaacgaaaugcagaaaaaaaacgaaaauacacguaaaagaauaaacgaaauaauagggaaguauggaaaucaaaaugcaaaaagauuaguggaaaaaaucagauuacacgacgaacaagaaggaaaaugccuauacagcuuagaaucaauaccauuagaagaucuacuaaacaacccgaaccacuaugaagucgaccacauaauacccagaucuguuucauucgacaacaguuaccacaauaaagugcuugucaaacagucagaaaauaguaaaaaaucuaaucugaccccauaccaauauuucaauuccggaaaaaguaaacucucuuacaaccaauucaaacaacacauccucaaccuaagcaaaucacaagauagaaucucgaagaaaaaaaaagaauaccuccucgaagagagagauauuaacaaauucgaaguacaaaaagaauucaucaaucgaaaucuaguggacacacgauacgcaacacgugaauuaacaaacuaccuaaaagcauacuucucagccaauaacaugaacguaaaaguaaaaaccaucaauggaucauuuaccgauuaccuccgaaaaguauggaaguucaaaaaagaacguaaccauggcuauaaacaccacgcggaagaugcacucauuauagcaaaugcagauuuucucuucaaagaaaauaagaaacuaaaagcaguaaacagcguacuagaaaaaccagaaauagaauccaaacaacuagacauacaagucgacuccgaagacaauuauagcgaaauguucauaauaccaaaacaaguccaagacauaaaagauuuccgaaacuuuaaauacagccacagaguagacaaaaaaccaaacagacaauuaauaaacgauacacuauacagcacaagaaagaaagacaacucaacauauauaguccaaacaauaaaggauauuuaugcgaaagacaacacgacgcuuaaaaaacaauucgacaaauccccagaaaaauucuuaauguaccagcacgacccaagaacauucgagaaacuagaagugauuaugaaacaguacgcaaacgagaaaaauccauuagccaaauaucacgaagaaacgggagaauaccugacgaaauacucaaagaaaaauaauggucccauaguaaaaagccuaaaauacauagggaauaaacucggaucacaccucgacguaacacaucaauuuaaaucaucgacaaaaaaacuaguuaaacuguccauaaaaccguaccgauuugacguauacuuaacagauaaaggguacaaauuuaucacaauuucuuaccuagauguacuaaaaaaagacaauuauuauuacauacccgaacagaaauaugauaaacuuaaacuaggaaaagcaauagacaaaaaugcaaaauucaucgcaucauuuuacaaaaacgaucucaucaaacuagauggcgaaaucuacaaaauaauuggagucaacuccgacacacgaaauaugauagaacuagaccugccagauauccgauacaaagaauauugugagcuaaauaacauuaaaggagaaccaagaauuaaaaaaacuaucggcaaaaaagucaauucaauagaaaaauuaacaacagacguacucggaaauguguuuacaaacacacaauauacgaaaccacagcuucuauucaaacgcgggaauuga

SEQ ID NO: 8445 - RNA, 3165 nt, Artificial Sequence
  Cas9 variant
augaaauugacaccccuaaauuauauucuagggcuagacuuggguauagcuucaguaggaugggcagucguagaaauagacgaacaagaaaauccuuuaggccuaauagacguaggaguaagaacauucgauagagcugaaguucccaagacaggagaaucauuagcgcuagcacgaagacuggcaagaagugcaagacgacuagucaaaagaagggcagaucgcauaaaaaaagcuaagagauuauuaaaagcagaaaauauacuguuguccgcagaugaacacuuacccaaugauguauggcaauugagaguaaaaggacucgaccaaaaacuagaaaggcaagagugggcggcaguauuauuacaucuucuuaaacauagagguuaucuaagucagagaaaaaacgaaucaaaaucggaaaauaaagaacuaggagcauuauuaucaggaguagaaacaaaucaucagauauuacaaucugccgaauauaggaccccagcagaaauagcugucaaaaaauuucacguagaagaugggcauauaagaaaucagcguggggcauacacacauacauucucgcgucuagaccuuuuagcagaaauggaacuacuauuccaaagacaaacagauuuaggaaauccacauacauccgcaaaacuauuagaaaacuuaacagcacuacuaauguggcaaaaaccagcucuagccggugaagcaauauugaaaauguuaggcaaauguacguuugagccaacagaauauaaagcugcaaaaaauucguauagcgcugagagauucguaugguuaacuaaacuuaauaauuuaagaauacuugaacagggagcagaaagagcucuaacagacaaugaacgauuugcacuccuugaccagccauaugagaaagccaaauuuaccuaugcucaagcacgaacaaugcucgcuuuaccagacgaagccauuuuuaaaggaguaagauaccaaggugaagacaaaaaggccguugaaacaaaaaccauauuaauggaaaugaaagcuuaucaucaaauaagaaaagcauuagaaaacgcugaucuaaaagcugaauggaaugaacuaaaaaauaacagugaacuauuagaugauauaggcacggcuuucagccuucacaagacugacgaagauauaugucgauaccuagaugguaaauuaagcgagagcauacucaaugccuuacuagaaaaccucaauuucgacaaauuuauucaacugagcuuaaaagcauuacaacaaaucuuaccguugaugcuacaaggacaaagauaugaugaagcaguaagugcgauauauggagaucauuaugguaaaaaaucagcugaaaucaacagacuguuaccaacaauuccagcugacgaaauccgaaaucccguaguacuacguacauuaacacaagcaagaaaaguaauuaaugcaguaguaagacuauaugguucaccugcaagaauucauauagaaacaggucgagaagucgguaaaagcuaucaagaccguaaaaaauuggaaaaacaacaggaagauaacagaaaacaaagagaaucagccguaaaaaaauucaaagaauacuuuccuaacuuuguaggagaaccuaaggguaaagauauuuuaaaaaugagacuuuaugaacuacaacaagcuaaaugcuuauauagcgggaaaucacuggaauuacauagauuauuagaaaaaggauacguagaagucgaucacgcgcuaccuuuuucccguacuugggaugacaguuucaauaauaaaguauuaguacuggcaaaugaaaaccaaaauaaaggaaacuuaacaccauaugaaugguuagauggaaaaaauaauuccgaacauuggcaaaacuuuguagcgcguguacaaaccucaggauuuagucacacaaaaaaacaaagaauacuuagucauaagcuugacgaaaagggauuuauagaaagaaacuuaaaugauacaagauauguagcaagauuccuauguaacuucauagcagauaacaugcuguuaacaggaaaaggaaaaagaaaaguauucgccaguaacggccagauaacagcucuucuaagaggacgauggggacuacaaaaaguaagagaugacaaugaucgacaccaugccuuagaugcggucgugguagcaugcaguacaguuguaaugcaacaaaaaauaacacgauuuguacgauaugaagaaggaaauguuuucucaggagaaagaaucgacagagaaacuggugaaaucauaccacuacacuucccaaguccaugggccuuuuuuagagaaaauguugaaauaagaauauucagugaaaauccaaaacuugagcucgaaaauagacuaccagauuacccacaguacaaucaugaauucguacaacccuuauuuguaucacggaugcccacgagaaaaaugacuggccaaggacauauggaaacagucaaaagugcaaaaagacuggacgaaggccuaagcgucuugaaaguuccacuaacacaauuaaaauuaagugacuuagaaaggaugguuaauagggaaagagaaguaacacuauaugagucauuaaaagcgagacuagaacaauuuggaaaugacccagcuaaagcauuugccgagccauuucauaaaaaaggcggagcaguaguaaaagcagucaggguagaacaaacacaaaaaaguggaguuuuaguaagagauggcaacggcgucgcagauaacgcaucuauggucagaguugauguguuuaccaaaggaggaaaguacuuuuugguacccaucuauacguggcaaguagcaaaaggaaucuuacccaacaaggcggugaccgccaacgucgaugaaaucgacuggcuugaaauggacgaaaguuaucaauuuaucuucacaauguaccccaaugaucuggugaaaguaaaacuaaagaaagaagaauucuucggauacuacggcggauuggaucgggcgaccggagcaauugugauaaaggaacacgaucuagaaaaaagcaaaggaaaacaaggaaucuaucguauaggaguaaaacuagcuuuaaguuuugaaaaauaucaaguagaugaacugggaaaaaauauacgaccauguagacccacaaaaagacaacacguacguuga

SEQ ID NO: 8446 - RNA, 3165 nt, Artificial Sequence
  Cas9 variant
augaaagagaaauacauccucggacuagauuuaggaaucacuucaguaggguacgguauaauuaauuuugaaacaaaaaaaauaauagaugcaggaguaagacucuucccagaagccaauguggacaacaaugaagguagaagaagcaaaagaggcagucgacgacucaaaagaaggcgaauacaccgauuagaacguguaaaacugcuacuaacagaauaugacuugauaaauaaggaacaaauaccaaccucuaauaacccauaucaaauacguguaaagggauuaucagaaauacuuucuaaagacgaacuagcuauagcacuccuacaccuagcuaaaagacgaggaauacauaacauaaauguaucauccgaagaugaagacgcuucaaacgaacuaucaaccaaagaacaaauaaaccgaaauaacaaacuccuuaaagacaaauacguuugcgaaguacaacuccaaagacuaaaagaaggccagauucgaggcgaaaaaaacagguuuaaaacaaccgacauccuaaaggaaauagaucaacuauuaaaaguacagaaagacuaccacaaccuagacauugacuuuauaaaccaauacaaagaaaucguagaaacgagacgagaauacuuugaaggaccaggacagggaucuccauucggauggaauggggacuuaaaaaaaugguacgaaaugcuaaugggacacugcacauauuucccccaagaacuaagaucagucaaauaugcauauucugcagacuuauuuaaugcauuaaaugaccuaaacaaccuaauaauccaacgagacaacagugaaaaacuagaauaccaugaaaaauaccacaucauagaaaacguauuuaaacaaaaaaaaaaaccaacacucaaacagauugccaaagaaauagguguaaacccggaagacauaaaaggcuaccgaauaacaaaaucuggaacaccacaauucacggaauuuaagcuauaccacgauuuaaaaaguauaguauucgacaagucaauacucgaaaaugaagcuauucucgaccaaauagcagagauauuaacuauuuaucaagacgaacagucaauaaaagaagaacuaaacaaguuaccagaaauacuaaaugaacaggacaaagcagaaauagccaaacucauagguuacaacgguacacacagauugucacucaaaugcauacaucuaauaaacgaagaauuauggcaaacaagccgaaaccaaauggaaauauucaacuacuuaaacauaaaacccaauaagguugaccuaucagaacagaauaagauuccuaaagacauggucaaugauuucauauuauccccaguggucaagcgcacguucauacaaagcaucaauguaauaaauaaaguaaucgaaaaauacggaauccccgaagacauaauaauugaauuagcgagagaaaacaacucugaugaccguaagaaauuuauaaauaaucuccaaaaaaaaaacgaagcaacccgcaaacgaauaaacgaaauuauaggacaaaccggaaaccaaaaugcaaaaagaauaguagaaaaaauacgauuacaugaucaacaagaaggaaaaugccuauauucucucgaaucuauagcccuaauggaucuacuaaacaacccccaaaauuacgaaguugaccauauaaucccacgaucaguagccuuugauaauuccauacacaacaaaguccuaguuaaacaaauagaaaacuccaaaaaagguaaccgaacgccauaccaauaucucaauaguucagacgcuaaacuauccuauaaccaauuuaaacaacacauccugaaucucucuaagagcaaagacagaauuucaaaaaaaaaaaaagacuaccugcuagaagaacgugacauaaacaaauucgaaguacagaaagaauucaucaauagaaaccuaguagacacuagauaugcaacaagagaacuaacaucauaccuuaaagcauacuuuucagccaacaauauggacguaaaaguaaaaacuauuaauggauccuuuacaaaccaccuaagaaaagucuggcguuucgacaaauaccgaaaccacggauauaagcaucaugccgaagaugcacucaucauagccaacgcagacuuucuauucaaagaaaacaaaaaacuacaaaacaccaacaaaauuuuagaaaaaccaacgaucgaaaauaacacaaaaaaagucacagucgagaaagaagaagauuauaauaaugucuucgaaaccccaaaacucguagaagacauaaaacaauauagagacuacaaauucucacaucgaguagacaaaaaaccaaaccgccaacucauuaacgauacgcucuacucaacaagaaugaaagacgaacacgacuacaucguacaaacaauaacagauauauacggcaaagauaauacaaauuuaaaaaaacaauuuaacaagaauccagaaaaauuccugauguaccaaaaugauccaaaaacauucgaaaaacuauccauuauaaugaaacaauauucugaugaaaagaacccucuagccaaauacuacgaagaaacaggagaauaccuuacaaaauauuccaaaaaaaacaacggaccaauaguaaaaaaaauaaaacuacuaggcaauaaagucggaaaccaccucgauguuacaaacaaauacgaaaauuccacaaaaaaauuagucaaacuaucaaucaaaaacuaccgauuugacguauaccuaacugagaaaggauacaaauucgucaccauagcauacuuaaacguuuucaaaaaagacaauuacuacuauauaccaaaagauaaauaccaagaacuaaaagaaaaaaagaaaauaaaagacacugaucaauucauugcgagcuucuacaaaaacgaccuaauuaaauuaaacggagaucuauacaaaauaauugggguaaacucagacgaccgcaacauaaucgaauuagauuacuacgauauaaaauacaaagacuauugcgaaauaaauaacaucaagggcgaaccacgaauaaaaaaaaccaucgguaaaaaaaccgaaucaauagaaaaauucaccacagauguacugggaaacuuauauuuacacucuacugaaaaggcuccacaacucauauucaagagaggccucuga

SEQ ID NO: 8447 - RNA, 3165 nt, Artificial Sequence
  Cas9 variant
auggaaaacaaaaaccucaauuacauucuaggacuagaucuagguauagcgucagugggaugggcaguaguagaaauagacgagaaagagaauccacuaagacuuauagauguaggugucagaacuuuugaaagagcugagguaccaaaaacaggcgaaucacuggcccuaagucggagauuagcaagaucugcaagaagguuaacacaacgacgcguagcaagauuaaagaaagcaaaacgacugcuuaaaucagagaacauccuccuaucuacagacgaacgacuaccacaccaagucuggcaacugcgaguagaaggacuagaucauaaauuagaaagacaggaaugggcagcuguacuacuacaucuuauaaaacauagaggauaucuaagccaaaggaaaaacgaaucaaaaucagaaaauaaagaacuuggagcacuauuaucuggaguagacaauaaccacaaacuccuacaacaagcuacauacagaaguccggcagaacuagcuguaaagaaauuugaaguagaagaaggacacauaagaaaucagcaaggcgcauauacacauaccuucaguagacuagaucuacuggcagaaauggaauuacuauuuucuagacaacaacauuuuggaaacccauucgcuagugaaaaacuacuagagaaccuaacagccuuacuuauguggcagaaaccagcuuuaucaggagaagcaauucugaaaaugcuagguaaauguacauuugaagacgaauauaaagccgcuaaaaauacauauucagcagaaagauucguauggauaacaaaacucaacaauuuaagaauacaagaaaauggacuagaacgagcauugaaugacaaugagagauuagcguuaauggaacagccauacgacaaaaauagguuauuuuauucucaaguaagaaguauacucaaauuauccgaugaggcaauuuuuaaaggacugagauauucaggagaggacaagaaagcuauagagacaaaagcaguacuuauggaaaugaaagcauaccaccaaauaagaaaaguccuagaaggaaacaauuugaaagcagaaugggccgaacuuaaagcaaauccuacauuacuagaugaaauaggaacggcuuuuucauuauauaaaacagaugaagauauaagugcauaucucgcuggaaaauuaucacaaccaguauuaaacgcacuuuuagaaaaccuaucauuugacaaauuuauucagcuaucgcuaaaagcccuguacaaauugcuuccccuuaugcagcaaggacuuagauacgaugaagcauguagagaaauuuauggagaucauuacgggaagaaaaccgaagaaaaccaucauuucuuaccucaaauaccagcagaugagauucgaaauccggucguauugcgaacacucacucaagcucgaaaagugauuaaugguguaguaagauuauauggaucaccagcaagaauccacauagaaaccggaagagaaguaggaaaaucauauaaagauagaagggaacuagaaaaacgccaagaagaaaauagaaaacaaagagagaacgcuauaaaagaguucaaagaauacuuuccucauuucgcgggugaacccaaagcaaaagauauacuaaaaaugaggcuauauaagcaacaaaacgcuaaauguuuauacagcggaaaaccaauagaacuacauagauuauuagaaaaagguuauguugaaguagaucacgcacugcccuuuucuagaacaugggacgacaguuuuaauaacaaaguucuaguucuagcaaacgaaaaucaaaauaaaggaaauuuaacaccuuucgaauggcucgacggaaaacacaacagcgaaagauggcgggcauucaaagcccuaguagaaaccucagccuucccauaugcaaagaaacagcgcauauuaagccaaaaacuagacgaaaaaggauuuaucgaaagaaaccuaaaugauacccgauauguagccagauuuuuaugcaauuuuauagcagauaauaugcaccuaacuggagaggguaaaagaaaagucuuugcaagcaauggccagauaaccgcauuauugcggucacgaugggggcuagcaaaaucuagggaagauaaugaccgacaucaugcauuagacgcaguagucguagcaugcucaacaguagcaaugcaacagaaaauaacaagauuuguaagauuugaagcgggagacguuuuuacgggagaaagaauagaucgagaaacaggcgaaaucauaccacuacauuuuccaacuccauggcaauucuuuaaacaagaaguagagauuagaauauuuagugacaauccuaaauuagaacuagaaaauagacuucccgacaggccucaggcuaaccaugaauuuguucaaccacuauucguaagccgaaugccuacacgaaaaaugacuggacaaggacacauggaaacaguuaaaucagcaaaaagauuaaacgaaggcaucaguguuaucaaaaugccucugacaaagcuaaaauuaaaagaccucgaauuaauggucaacagagaaagagaaaaagauuuauacgauacacucaaagcaagacuagaagcauucaacgaugacccagcaaaagcauucgcagaacccuucauaaagaaagggggagccauaguuaaaaguguuagagucgaacaaauacaaaaauccggaguacucguuagggaaggaaacgguguugcagauaaugccaguaugguaagagucgauguuuuuacuaaaggcggcaaauacuuuuuagugccuaucuacacauggcaagucgcuaaagguaucuuaccaaauaaagcagcaacacaauauaaagaugaagaagauugggaagucauggacaauagcgcuacauuuaaauuuucguugcacccaaaugacuuaguuaaacugguuacuaaaaagaaaaccauauuaggguacuuuaacggacuaaaccgcgcaacaggcaacaucgauauaaaagaacacgaucuagacaaaagcaaaggcaaacaaggaaucuuugaagguguuggaauaaagcuagcacuaaguuucgaaaaauaccaaguagacgaauuagguaagaauauaagacuuugcaaaccaucaaagagacagcccgugcgauga

SEQ ID NO: 8448 - RNA, 3168 nt, Artificial Sequence
  Cas9 variant
augaacaacuauauacuaggucuagauauagggauuacgucaguaggauacgggauaguugacucagauacacgagaaauaaaagacgcaggggucagacuuuucccagaagccaacguugacaacaacgaaggaagaagaucaaaaaggggagcaaggagauuaaaaaggcgaagaauacacagacuggauagaguuaaacaccuacuagcugaauacaaucuucuagauuugacaaacauaccaaaaucaacaaacccuuaucaaauuagaguaaaaggauugaacgaaaaacuaucaaaagacgaauuaguaauagcguuacuacacauagcaaaaagacgaggcauacacaacguaaacgucaugauggacgauaacgacagugguaacgaacuaucaacaaaagaccaacucaagaaaaaugcaaaagcgcuaucagacaaauacguaugcgaacuacaauuagaacgcuucgaacaagacuacaaaguccguggcgagaaaaacagauucaaaacagaagacuucguaagagaagcaaggaaauuacuagaaacacaaucuaaauucuucgaaauagaucaaacauucauaaugagauacaucgauuuagucgaaacacgaagagaauacuuugaaggaccggggaaaggaagcccauuuggaugggaaggaaacaucaagaaaugguuugaacaaaugaugggucauuguaccuacuucccagaagaacuacgaucaguaaaauaugcuuacagugcagaacuguucaacgcuuuaaaugacuuaaacaaucuagucauaaccagagaugaagaagcuaaacuaaauuauggagaaaaauuucaaaucauagaaaacgucuuuaaacaaaagaaaacaccaaaccucaaacaaauagccaaagaaauaggaguaagcgaaacagauauaaaagguuaccggguaaacaaaucugggaaaccagaguucacgcaauuuaaacuauaccacgauuugaaaaauaucuucgaagacucaaaauaucuaaacgauguucaacuaauggauaacauagcugaaaucauaacaaucuaucaggauccagaaucaauuauaaaagaacuaaaucuacuaccggaacuauugagcgaaaaagaaaaagagaaaauaagugcguuaagcggauacgccggaacucaccgccuaagccuaaaaugcauuaaucuucuacuagaugaccuaugggaaucaucucuaaaccaaauggaacuauucaccaaacucaaccuaaaacccaagaaaauagaucuaagccagcaacauaaaauaccaaucaaacucgucgacgacuucauucuuucuccaguaguaaaaagagccuuuauacaaucaauacaaguagugaacgcaaucauugacaaauacggucucccggaagauauaauaauugaacuagcccgcgaaaacaacucagaugacagaagaaaauucuugaaccagcuacagaaacagaaugcagaaacaagaaaacaaguagaaaaaguccucagggaauacgguaacgauaacgcaaaaagaaucguacagaaaauaaaacugcauaacaugcaagaaggcaaauguuuauauucccucaaagacauaccauuggaagaccuacuuaaaaacccuaaccacuacgaagucgaccacauaauaccaaggucaguggcauuugauaacuccaugcacaacaaaguauuagucagggcagaagaaaacagcaagaaaggaaaccgaacaccuuaccaauacuuaaauagcucagaaucuagcuuauccuacaacgaauuuaaacaacauaucuuaaaccucaguaaaacgaaagaucgaauaaccaaaaagaaaagagaauaucuucuagaagagagagacauaaauaaauaugacguacaaaaagaauuuaucaauagaaaccucguagacaccagauacgcaacacgagaauuaacaagucuacucaaagccuacuucagugcaaacaaccuagauguaaaaguuaaaacaauaaauggcucauucacuaacuaucuaagaaaaguauggaaauucgacaaagaucgcaauaaaggguauaaacaucaugcugaagaugcccucauaauagcaaacgcagauuuucuauuuaaacacaacaagaaauuaagaaacauaaacaaaguacuagacgcaccuucaaaagaaaucgacaagaaacguguaacaguacaauccgaagacgaauacaaucaaauguucgaagacacgcaaaaagcacaagcaaucaagaaauucgaaauacggaaauucucacaccgcguagacaagaaaccgaaccgacaacuaauaaaagacacacuguauaguacuaggaauauugacgggauagaauacguaguagaaucuauaaaagacauauacucggucaacaacgauaaaguaaaaacgaaauuuaagaaagacccacacagacuacugauguaucguaacgacccacaaacuuucgaaaaauucgaaaaagucuuuaaacaauaugaaucagagaaaaauccauucgcuaaauacuaugaagaaacaggugagaaaauucgaaaauuuucaaaaaccggacaaggaccauauaucaauaaaauaaaauaucuaagagaacgacucggaagacacugugacguuaccaacaaauacauaaacuccagaaacaaaauaguacaacuaaaaauauauagcuauagauuugauauauaccaauaugggaacaauuacaaaaugauaaccaucucguauauagaccuagaacaaaaaucaaauuauuacuacaucucucgagaaaaauacgaacagaaaaagaaagacaaacaaauagaugacucauauaaauucauagguaguuucuauaaaaacgauaucauaaacuacaauggggaaauguacagagugauagguguaaaugacucagagaaaaacaaaauacaauuagacaugauagacauauccauaaaagacuacauggaacuaaauaauaucaagaaaaccggagucauauauaaaaccauaggaaaaaguacaacccauaucgaaaaauacacaacagauauacucggcaacuuauauaaagcagcaccacccaagaaaccccaacuaauauucaaaagaggaauggaauga

SEQ ID NO: 8449 - RNA, 3168 nt, Artificial Sequence
  Cas9 variant
augacaccaaucagcgaaagccuauuguucggauuagacguaggaauaaguucaugcgguugggcuguacuuaaacacucggacacaacuggccacauagaagcucuaggaucauggugcuucaaugcaccagaaacaaaaaccgagagaacuccaacuaaucaaauaagaagaucaucaagauuguuacgaagaguaguaagaagacgcagaaauagaaugacggagauaagacgacuauuugcuagacauggacucauagacaacgacaggccugaugcacucagacagccagccauagauccaugggagaugagaggacaagggcucgacagacaacuaacaccagaagaauuugccguagcuuuagcacauaucgccaaacacaggggauuuaaaagcagugccaagagaguaaaaaguaaugcaucaccagacgacuccaaaaugcuagcugcauuagagaagacaaaagaauuaucugcacaauaucgaacaauaggagaaauguucgcgagagacagugcuuacgugcaacgcagaagaaaucgagauggucucuucgacagaacgauuucaagagaugaucuaauugaugaagcuaaaauuuuauuugaccgucaacgaaagcuaggaaauccuguagcaucgaccgaaauagaagaagcauuuacacgaauagcguucuggcaaaauccaaugcaagauucaggaguguuagucgcgucaugucccuucgaaccaaaagaaaagagaucaucacgguucucaccaucguucgaaagauuucguuuguuguguagauuaauaaauuuacgggucacugaugguccagaagaacguccucuuacugaagaagaauuacgauuagcauaugaacaugcaggaaaaacgcguaaacugacagcggcagcaauaagaaaacucauuggauugagagacgaccaacacuuuacuacaauaccuccagaacaagaaaaacaagacauaacaagcagaacuggagaaacauuugccggcacagcuacguuccgaucaguuuuaggagaaagucuauggagacaacuuuuaccacacccagaauggcuagauaacgccgcauggauaauuuccuuucaugaacuuacagaaacaauuauaaagaaauuaggcgaaauaggauugccuguggaagccuacgaauuaauaugugaugcauuaaaaagcgauaaaagcccuuuugcaaaauucaaaggcgcaaguucgcuaucagacaaagcaguaagagcacugauucccuaucuucaacaagguuugacuuacgauaaagcgugucaaaaagccggguaugaccacgcagcuucaagauuuucagggagagcaacaauagauacaaaagcgaaguuuaaugcgcuaauggcagaaguaagagauaguauugcuaauccgauagcaaggaaggcacugucagaaggaaugaagcaauuaugggcaaugaggaaucgauggggauuaccaggagcaauuugcauagaacuagcaagagauguagguaauuccuuagagaaaagaaaagaaauugaacgaaauuuaaaaacaacugcaaaacagagagcuagagaaagagaagaagcaugcgaguuacucaacuuaaaagaagugucaucagauaucuugcuacgcuauagauuauggaaggagcaaggaggaagguguuguuacuccggaaaaucaaucacaccagauaugcucauggcacaggacaauagaauacaaauugaucauauauuaccauggucuagauuuggugaugauuccuauagcaacaagggacuauguuuggcaaaggaaaaucaggcuaagaaaaaucaaacaccuuaugaauggauccacggacaaggaacaacagcucaaaaagaacaaugggauaaauucguagcugauguagaaagcagaaagaacacgaaaggauuaaagaaaagaaacuuccugcuaaaaggaucuaaagaaaucgaggaacgauuuagaaguagaaaccuaaacgauacuagauacgcggcaagguuaauggucgaagcugcgcgguuacuuuacccagcaggacagagaggggagaaaggaggaacccgucguguauucacaagaccaggagcucucaccgcugcauuaagacacgcauggggagucgaaucacuaaagaaaauagauggugaacgauuacacgauaaucgccaccaugcacuagacgccgcaauuguagcugcggucucugaagcagagauacagaaauuaacaaagagcuuucaggaaugcgaacaaaaaggucugagcagaccuaugagagauguagcuccacccugggacggauucagagaccaacuaaaagagaaauaugaaacgauauuuguagcucgucccgaaagacagagagcgagaggucaagggcacgaagcuaccauaagacaaguaagagaagaagaaacagggccaguaauauacgaaagaaaagcagugucagcacuaacccucgcagauuuagcuaaaauaaaagacccugacaggaaugcgggauuaauagcaucauuaagacaauggaucgaggcgggaaaaccagcagacaaacccccaagaacaccaugucaucaaucagccgcuggucaugaaauuaggaaaguuagacuagcaacgauaaucaccccagcuguaccaguaaggggugggauggcgaaaagaggagaaaugacuagaguagacauauuuaaaguaauuggaaagaaaggaaaaccagaaugguacaugauaccaauauacccucaucaaauuaugaauagaucacaauggcccgcgccuccaaauaaagcaguaguagcggguaaaucugaagcagacuggccgauaaugggcgcugaagcacaauuccaauucagccuauacccuugcucauauguaagacuauuuaaagaggggaccguaauagaagguuauuucuguggaugucacagaaguagggcauauauaaccuuggcauuaagcaccggugcagcuccucuacaaaaaggaauugguauuaaaacucaagaacauauacaaaaauucucuguaaauagauuuggugagcuaucuccaguuaaacaagaaacaagaacuuggcacggaguagcaugcacaagcccagaucaacaugauuga

SEQ ID NO: 8450 - RNA, 3171 nt, Artificial Sequence
  Cas9 variant
augaaagcauuaaauuacauacuaggauuagauuugggaauugccagcgucggaugggccgugguagaaauagaucaaaacgaacuaccuaucagacucauagaccuaggugucagaaccuucgaaagagccgaagucccuaaaacaggagacucacuagcacuggcucggcgacuagcaagaaguucaaggagauuagucagaagacgagcaguccgacuacuaaaagcaaaaagauuacuaaaacaagaaggaauuuuacaagcagaugacuuucacucuagccaccucaaaccauuaccaaauaauccaugggaauuaagaguaaaaggacuaaaucaucuacucgaucgaaaagagugggccgcaguacuauuacacuuauugaaacauagaggauaucuuagucaaaggaaaaacgaaucaaaaaccgauaauaaagaacuuggagcauuauuaaaaggggugagugaaaaucgacaacuuuuacaagcucaggcuuucagcaccccagcagaaauagcaauaaagaaauuucaacaagaagaaggccauauaagaaaucaaaggggagcguacagucacacauucgacagaaaugaccuacucgcggaauuaagacuauuauuucaaaagcaacgagaauuuaacaauccauauacgagucaaaguuuagaacaagcuaucgcggaacuacuuauguggcaaaaacccgcacuuucgggagaagcaauauuaaagauguuaggaaaaugcacauucgaacccucagaauacaaagcaccaaagaauaguuacucggcagaauauuuugucuggcuaacaaaacuaaacaaccuuagaauauuggagaauggagcugaucgaggauuaacagccgaagaaaggcaauuauuaaucaaccaaccauuugaaaaggcuaaauuuacauacgcgcaagcaagaaaacuacuagaauuaagugacuuagcaauauucaaagguguaagauaugguaaggauaaugcagaaagugcaacgcuuauggagaugaaagcguggcaugcgaucagaaaggcauuagagucaaauggccuaaaaaccgaguggaacggcuuaaagacaaaaccagaauuacuugauaaaauaggaacagcuuuuaguauuuauaaaacagacgaagauauaucccaauaccugaauggugaacuaagcccagcaguacuaaacgcgcuauuagaaaacuuauccuucgauaaauuuauaagauuaaguuuacaaagucuagcaaaaauccugcccuuaauggaacaaggcuuacguuaugacgaagcauguaaacaaguauacggagaucauuauggaaagaaagaacaacuggaguugagguucuuaccaaaaauaccaguggaagacauuagaaauccagucguccuucguacgcuuagucaagcgagaaaaguaauaaacgggguaguuagacuauauggcucaccagcuagaauacauaucgaaacagguagggaagucggaaaaucauucucagagcgacgugauauaucaaaaagacaagaagaaaauagaaaugaacgacagagagcugucgaaaaauuuaaagaguucuuuccgcacuuuguaggugaaccaaaagcaaaagauauacucaaaaugagacuauacgaacaacaacauggaaaaugucuuuacucaggaaaagaauuagaucuuaauagacuuuuggaaaaagguuacguugaaauagaccacgcauuaccauuuaguagaacaugggaugauaguuuuaauaacaaagucuuaguccuggcaagugaaaaucaaaauaaagguaaucaaacuccuuaugaaugguuaaauggaaaagaaaaugcggaacgguggaaguuauuucaagcgcuaguaaauggcaguagauuucccuacagcaagaaacaacgaauauuaacuaaauauuuagaugaggacggauuuagagaaagaaacuuaaaugacacaagauauguagcaagauuuuuauguaacuuuauagaagauaauaugcaauuaguaggacaaggaaagaaaagaguauucgcaaguaauggccaaauaacagcacuauuaagacggucaugggguauacaaaaaguaagagaagacaaugaucgucaucacgcaguagacgcaguaguaguggcuugcucaacacgugcauuacaaaagaaaauaacagauuacgugagauacaaagaaaugaauguauucacuggagagaaaauugaccaggaaaccggagaaauaaucaaauuucauuuuccagaaccuuggaaauucuuuagacaagaagucgaaaucaggguuuuuagcgaaacaccagcagaagacguaguaauugcauuaccagauagaccgcaagcgaaccaugaauuuauacagccguuauucguauccagggcaccuacaaggaaaaugacuggccaaggacauauggaaacaauuaaauccgcuaaaagacuugcagaaggacuaaguguaucaagagucccauuaacccaauugaaacugaaagauuuagaaaacaugguuaaucgagaaagagaaaaagcauuauaugaagccuuaaaaguuagauuagaaaaauucaacaaugauccagcaaaagcauucgcugauccuuucuacaagaaagggggacaacaaguaaaagcaguaaggguugaacagguccagaaaaguggaguccuaguaaggcaagaaaacggaguagcugacaacgcgaguauggugcgaguugacguauucaucaaaggaggcaaauacuuuuuaguaccaauauauacauggcaaguagcaaaaggaauauuaccaaauagagcagcaacacaaggaaaagaagaagaauauugggauauaauggacgaaacagcaauauuccaauuuucacuuuaucaaaaugacuuaauaaaauuaguaacgaaaaagaaaaccauuuuuggauauuuuaacggauuaaauagagcaacgagcaacauuaacauaaaagaacacgaucuagacaaauccaaagguaaagauggcauauaccuugaggugggagucaaauuagcacuaucgcucgagaaauaccaaguagaugaauuggggaaaaauauacaaccgugcaggaguaugaagaaaagaccaccaguaagauga

SEQ ID NO: 8451 - RNA, 3171 nt, Artificial Sequence
  Cas9 variant
augccuaaacagaaaagcacaagauacaggcuagcacuggauuugggaaguacaaguuuaggaugggccgucuuacgacugaaugaacaacaugaaccaaaugcuauuauaagagcugguguuagaauuuucucaaauggaagaaauccgaaagacgguucuagccuugcaguuacuaggagagcagcaagagcaaugagaagaagacgagacaggcuuuuaaaacgaaaagcaaggaugaugaauaagcuaguggaauacgguuucuuuccagcagauguugcagaacgaaagaaauuggaaagaauaaacccguaugaacuuagagcaaaaggacuugacgcuccauuaacaccaggagaguucgcaagagcuuuauuucauauaaaucaacgacgaggauuuaaaucaaauaggaaaacagacaagaaagaaaaugacagcggggcuuuaaaagcagcaauuagucaucucagacagcaguuacaugaaaggaaagcuagaaccguaggagaauggcuguggcaaagauugcaagcaggccuagguacacgagcacgauacagagagucaagaguagcacaagcaaauggaaaaacuaggauagagaaaaguuaugauuuauauguggaccgucaaaugauagccgaagaguucgaugccuuaugggcugcccaagcugcauucaacccacaacaguuuucggaacaagcacgaggugaauuaagagauguauugcuuuuucaacgagauuuacgcccugugcguccuggccgauguacccuacuaccugaugaggaacgagccccgcuagcacuaccaagcguacaaagauucaggauuuuacaagaagcaaaucaucuucgacuacuacauccagaccuaagagaagaaccacuaucauuagcacaaagggacgcaguaguugacgcacuagaacauaacucaaaaaggacauuugagcaacuacgaaaacuuuuaaaauuaaaugggacaguuaaauuuaaucucgaagaugaaaaacguaaagaacuaaaaggcaaugcaacuagcgcuacacuuucuaaagacggccuguuuggagagaauugguggaaucuagaugaagcgcuacaagacgcaauaguauggcaguuaguauccgagcagucagaagaaaaauuacaaaauugguuacaagcaaauacaggcgugaaugcgacucaagcagaaacuauugccaacgcaggacugccugaaggauacgguagcuuaagcuauaaagcauuagcacgaauuauaccagcauuacguggaacagagguagcaaauggaaucgacgucccacgcacauaugaucaggcaguucaagcugccggauucgcccaccauucagaucuagacucaggauuugacuucgaacauagccacgaugaaguggaaagaauuggagaaagagugauugcuagcacuggugagguaaaaccaguauuugcauucaaacaauuaccauacuauggcaaagccuuaagaagacacguagcauuugccaaagaacauccccgaaaugaagaagaaagguaugguaaaauagcaaauccaacaguacauauuggauuaaaccaacuaagaguaguaguaaaugcacuaauuagaagauauggcaggccaacagaaguagugguugaauuagcuagagauuugaaacaaagcagagagcaaaggcaagaagaacagaaaaggcaagcugauuaucagaaaagaaaugaacacaucagaagagaaauagcaucaaugcacggaugcgcagaagaaagaguaucucaugcagauguacaaaaauggauacuaugggaagaauugagcuucgauguugccgauagacguugcccguauucaggaguacaaauaucggcucaaaugcuacuaucgaaccaaguagaaaucgagcauauccuucccuucucacaaacucuggacaacucacuuaacaauagaaccguagccaugagacaagcaaacaggauaaagggaaauagaacaccauggcaagccagagaagacuuugaacgccaagguuggucguaugauucaauacuacaaagggcggaaagaaugccgaaagccaagagguauagauucagcagagacggauacgaaagaugguugaaagaagacaaagauuuucucgcaagagcacuuaacgauacaagauaucucucgcguguagcuaaaacauacauggagcuaguauguccacuggguacaagaguuauacccggccaaaugacagcacuuuuacgcgcaaaauuugguuuaaacgacguucuaggucuaaacggugaaaagaauagggaugaccauagacaccaugccguagaugcaugcguuauaggaguaacugaccaaggacucuuacaaagauuugcgcaggcaucugcagaugcuagagggaauggacucgaaaaauuaguggaaaauaugccuguaccaugggcaacauaucgagaucauguuaaaagagccauacaauguauauggguaucgcauaaaccagaccacggauacgaagguccaaugauggaagaaacagcguaugguauucgaaaagauggaaguauaagacagaaaacuaaagcagauggaucaaccggacgcgaaauuacucaccugauccgaauaacagaacccacacaaaaccuaagacacggagucgacgcucaaggacaaccauuagcuuacaaaggauacgugggaggcucaaaugacuguauagaaaucacacaaaaugaacaaggcaaaugggaagguaauguaauuacaacauuucaagcauaugauauaguccgcagguuaggcucaaaacaaggaccgagaagauuaaggcaucccacgcuugcacaaacacuugauguauauggaaaaccgaaaaagcuaguaaugagguuaaugaucgacgauuguguucgauuagaacuagaugguaauaagaaaacgcuacgugugguaaaaauaacgggaaauggucaaguauucauggcaccaguacaugaagcaaacguagauaaaagaaauagcgauaaaacagauccauuugcauacgucucuaaauacgcaggaaguuuucaaaaagcaaaagcuagacgaauaacaauaucgccgaucggagaauugcaugaucccggcuucuga

SEQ ID NO: 8452 - RNA, 3174 nt, Artificial Sequence
  Cas9 variant
augucugauaaaucaaaaauauuaggauucgauauaggcauuacaagcauaggaugggcauacguagaaggagaagaauuaauagauugugggguacgaaucuuuacuaaagcagaaaacccaaaaaccaaagaaucccuagcuuuaccgagacgagaagcaagaggaguucgaagaagacuagcucgcagaaaaggaagacuaaaugcgauuaaacagcuaauuugcaaagaauuuggauuaaacuaccaagacuacauagcacaagauggagaauuacccaaagccuacgcuggaaaauuaauaaaucccuacgaacuacgaucgaaggcuuuacgagaaaaacuagaaaaagaagaauuggccagaguaauucuacacauagcaaaacacagaggauauggaaacaaacaugcaaaagaaaccgaugacgcugaaaguggaaaaaucaagaaagcuauuucaaauaacgagaaaauacuaaacgaaaaaggauaucaaagugcaggagaauauuuauaccaagaguucuuucagaaagaaagacugcaagaagaaaagaaaggaaauaauacgacaaaagaauuuaaaaaugugagaaacaaagccggagauuacgaacacuguauugcacaaacccaaaugcagaacgaacuaagacuuauauucgaaaaacaaagagaguucggucuaaauuucagcgaagaauuuaaaaagaaaguauuagaaacagcauucuuccaacgaccuuuaaaagacuuuagugacaaaauaggagacuguacauucaucgaaggagcaaaaagagcacccaaagauucacucucagcaauagaguucguagcgcuaggacgaauaauaaacacacucaaaaaucuacaaaauaccuccggcgaagucuauagucgagauaaaaucaaugaaauacugcagauagucuuagauaaaggcgaaauuucauacaagaaacuaagagaaaucuuagauauagaaaguuccguaagauuuaaagacagcaaacuagacuauacaaaagaacuaaaagaagcagagaaaacaaaacuauuugaaagcaaaaauuuacaaaaauucaagaaagcccucggcagcuucgaaggaaucagcagagaaauauuagauagcaucgcaaaagaaauaaugaucacuaaagacaaagaaaaauuagcaaaagaacuuaagaaauuuccacuagacgaaacacaaauacaaaacuuaucgaaccuaucuuucucacaaaccauaaaccuaucauuagaagcauuaagccaaauacuuccauucaugcguggcgaaagagaagauaaaugcuuacgcuaugaugaagcaguagaaaaagcaggacuaaaagaagucgccaaaaacaaaaguaaagacgacuuccuuccaccccuagaaaauuaugagcccuauuuagcaaauccggucguagcaagagccuuaagcgaauacagaaaaguacuaaacgcacuauuaagaaaauauggaaaaaugcacaaaauacauauugaguucacacgugaaguggggaaaagcaaagaagaaagaaauaaaauagaaaaagaacagaaagaaaauuucgccaaaaaucaagaagcacaaaaacaaugcgaaauccuaggacuuccaauuaauggagcaaauauuuuaaaaaugaaacuuuggagagagcaacaagagucuugcguuuacagcggaaaagaaauagccauagacgaccucaaaaaccccgcaauuuuacagguagaucacauauauccauacucgagaaguuuugacgacucauauaauaauaaaguauuaguauuuuccaaagaaaaucaaaacaaauugaacaaaaccccuuuugaagcauuuggagaaaauaaagauaaaugggaaaagauauuaagucuagcgucuaaacuacccaaaccgaaaagacaacggauauauaacaugcaauucaaagauaaagaacaaggauuucucacaagaaacaucaaugauacuggauacauagccagauuaguaucacaguggacaaagaauuguuuauccuucgagaaacuaagcgaagacgaaguaagcaucgcuggagaaaagggauccaaaguacauguugaagugauaucaggaucauuaacagcaaugcuaagacacuacuggggacucggagacaaaaacagagacaaccauuuacaccacgcaguugaugcgaucauaaucgcauacucgaacgaaaaaguuauaaaggcuuuuagcgauuauaagaaacauagagaacaaaacaaagcaaaauuuuaugccaaagagauagcugaaagugaauacaagaaacaaaaaguauucuuugaacccaccaaucauuucagacaaaaaguauuagagaaaauugacaguauuuucguaagcaaaccgccacgaaaacgagcaagaggagcucuacacgaagaaacauucuacagcuuugaacgucuuugcaacgauaaagaauacgcaaagaaagagaaaauggauuacggaggaaaagcagggauacaaaaagcaauugcacuaggaaaaauacgacaaguuggaacaaaaauaguaagcaacggaacaaugguaagaguagauaucuuccaacacaaaagcaauggaaaauucuacgguguucccauauacacuauggacuucgcauuagguguucuacccaacaaagcagucgucagugguaaagauaagcaagguguaauaaaggauugguuagaaauggauagcaacuaugaauuuugcuucaguuuguuuaaagacgacuuaauucuaguacagaagaaagaaauggaaaaagccgaauuguguuacuauacagacuucaacucaaacacugcgggaauuaaauucgaaaaacauaacaaccuauacguaaaucuaaacgaaaacgaaaggaaauuguuuacuagcaaagaaguuguaaaaggagggaagaaaaacguauggaaggacaagacacccaaggaaaucgaacaauuagagaaaaacagaaaaauaauaggaggauucgucacuaucgaagaccuaaaaacauucgaaaaauaucaaguaucaccacuaggugaaguacaaaaagcggacuucgcaccuaggcaagcaauaacccuaaaaucaucacccaaacauaggauaaauaaauga

SEQ ID NO: 8453 - RNA, 3174 nt, Artificial Sequence
  Cas9 variant
augucaaacagaguaccauacagauuagcauuggaucuuggaacgaacucuaucggauggugcuuauuagauuuaaacggaaauggugauccuuguggaguaagacgcauggggguacgaauauuuccagacggaagggauccaaagaguaaagagagcuuagcugcugacagacgccuagcaagaucuaugcgacgaagaagagaucgauaucuaagaagaagaucugcauuaaugaaugcguuaguagcagcagguuuaaugccggcagacagagcaacaagaaaggcguuagaaagcgaagacccgugugaauugagagcuagagcucuauuugaaccccuuacagccggacaaguagguagagcuuuauuucauuugaaucaaagaaggggauuuaaaaguaacagaaaagcagcaggagaagagaacgaagcaggaaaaaucaaagcaggaaucagugcguugaaagcugaaauagaagcaagcggcgaaaccacgcuaggagcaugguuggcggcgagacauagaaaaagagaaacuguccgagcaagguuagauggagcuggagcuaaggcauccuaugaauuuuauccggaaagggguuuaguacaugaugaauuucaagccauaaggaccgcccaggcacuucaucacccugcuguaacagcagaacagugggauagaguugaaucaguaauauuucgacaacguccuuuaagaccugugagaccagguaaauguacacuuuuuccugaucaggaaagagcucccugggcauuaccgguagcgcaagaguuccguauauuaacagaaaucggaaauuuaaaacuauauagaccaggagaagaaccaagagaauuaucagcagaucaacacgcacaguuauuugcuaaauuauguagaucagcugaucuaacauucgagaaaauccggaaagaacuuaaguuagauccuggcuugaagguaaauuuagaaggggaaaagagagacagacuaaaaggagaugcuguuacuucugcauuaucagcgaagaaaagauucggcccaaaauggaacgcacuaacaccagacgauagaagagacauaguaggaagauuaauagaagcagaagaugaagccgaacucgcaggaugguuggaaaguguacaugguuuacccagcgaaaacgccgcacauacagcagcgagucccggacuaccggauggauacugucgauuaucagaaaaagcacuugugaaauuaguuccacucaugagagaacaacgauugagauaugacgaagccgugcuugcucucaauuugcaccauucugauuuucgaccagaaggacuauuagaugaauugccauauuacggcgaaccauuagaaagauucauagcuuucggaaguggagaacccagugauccuccugaacaacauuuaggaagauucccaaacccgaccgugcauauaggauuaaaugaacuaagaaagcuaguuaauagaauaguagaacgauggggaaaacccgcagacauaguaguagaguuggcacgcgaucuuaaaagaaguagagaugaacgagauacaauacaaagagaacaagcucaaaaccagaggaaaaaugaagauagauuugcaaaaauuaaagaacugggaauagauccuagaccagauagcauguuaagacuacgacugugggaagaauuaccaaaaguuggaguuggacauguuugcgucuauacaggggaaccuauagguauucgaagauuauuggaaggagauguagauaucgaccacauauuaccauuuagcagaacacuaucagacggggcagauaauaaaauaguaugcguaaggagagcaaauagauucaaaagagauagaagcccaugggaggcuuuuggagugacugcaguagaugguuaugauugggcagcgauagcacaaagagcagaagaacuaccgaaaaauaagcgauggagguucuuaccagaugcaauggauagauuugaaggagagagaggauuuuuggaucgacagcuaguugaaacuagacacuugagccgaguagcacgccaauauuuggcuagcaucguugaucucaacaaaguuagaguagcaccaggaaaacuuacugcaaugcuaagagcuagauggggacuaaacaaaauauuaagcgacggaaaccugaaaaauagaagcgaccacagacaucacgcaauugaugcagcgguacuagggaugauagaccaaagacucgugcaauugguagcccaagcagcagcacgagcagaagcgaaugaauuggaacgauuauuugacggacugcccgacccuuuugauggacuagcagcaacguccuuuggagaucaaguucgcgagaaaauaagaggaauuacuguuagucauagggcugaacauggauggcaaggaagaaugcauaaugacaccgcguaugggccaguagaagcagugaacgguguacauacaguaguaacaagaaaaccuuuaucuggucucacagcaaaagauuuuccuaauaucagagacagaguucuagcaaaagcacuagaagaucauguugcugcagaagcggccgcuggacguagcuuuggagaugcacuaggaaguuucaaaugggguggacaaccgguaagaagaguucgaaugcuugacguauuaggaaaucccauaccuauacaggauccgucaggaacgguauuuaagguuuauaaaggggauaguaaugcaugguacgaaauacuacgcgaccccagaggcagauggacuggaaaaauaguaaguacauuugaggcauaccgucuccaccgagaauggcuugcugaaacagguggagauucaggaagagggucagguguguuucuagacugggccgcaaagcguguuguaggugaagcaggcacaccauuauuuaggcuuuucaagggagaccuacucgcacugggggaagccccggauagaagaauagucaggguaguaaaguuuagugaaggccaaguagcgcuagcacuucacuuagaagcuggaaauuuaaaagcaagagaugcagauaaaggugauccauuuaaguaccaguauuguaguccagacucauuaaggaaacaagcagcaagaccagcuggaguugaccuccuaggcuauguacaugauaaaggaccuuuagaauga

SEQ ID NO: 8454 - RNA, 3174 nt, Artificial Sequence
  Cas9 variant
augcgcagacuaggacuagauauaggaacuaacaguauaggauggugucuaauagaagaugauaagaaaauaguagacauuggaguaagaauauuuagugacggaagagauccaaaaaguggcgccagucuugcggucgaccgcagagacgcgagggccaugaggagaagacgcgauagauauuuagggagacgaucagcauucuugcaagcauugguggugcacggguuaaugcccgcagaugcagaugaggcuaaauuaguggcagacagagauccauaccaguuaagagcuaaagccuuacacguagccuuggaaccauuugaaauaggcagagcacuauuccacuuaaaucaaagaagaggauucaaaucaaauaggaaagcagauagaaaagcgaacgccggagaagauggaaaaauugccgaaggcgcgaaagccuuagaucaagcaaugucggaagcuggaguagauacacuaggucaauuucuggcacugaaagagacgaaaagaguaagauuaggaagcgauggucaggcuuaugauuuuuacccucaaagaagacauauugaauaugaauuugauagaauauggaaaguccaaagugaauaucauccagccuuauuaacagaagcagcaagagcagcauugcaucgaauauuauucuuccaaagaccuuugaaagcacaagaaguaggauuuuguacguucgcuggugugaauggaauagcagcaaaugaaagaagacuaccaaaagcacacccauuguuucaacaaagaaggcuauaugaagaaguuaaucaauuaagaauugugucagccggagcugcggaccgaccauuaacacuagacgaaagagauagacucauccuaagacuacaggauagaaagaaagugucauuugauacacuugcaaagaaagaccuuagacuugcggacggagaaagauuuaauaaagaaucagaaaaccggaaagaacuaauaggagaugagguacgcgcugagaugucagauaagaaacguuuuggaacuagauggguacauuucggacucgaugagcaauuaagaauacuagcaaaacugcaagaugaggaaaauccagaggcacuauuagacugguuaagaagugaauauggacuagaugaagcagccgcagaaucaguggcaaaugcacguuuaccagagggguauggaagauucggagaaacagcaacacgucuucuauuagaugcauuaaaagcugagguaauaacauacgauaaagcugcacucagggcauuuggccaucacagugacuuuagaacaggugaaguauuagauagauuaccauauuacggagaacuucuaacgcgagaaauagccccaggaaaaccagaauacggagauccauuagaaagacaauauggaaaaauaacuaauccuacuguucauauaggauuacgucaauuagaaaagcuaguaaaugcaguaauagcaguacauggucgaccagaucaaauagucguagaacucgcgagagaacuaaaauugaacgaaaaagaaaaagaugaacauaaacgacgaauaaaacgagacacggaugccgcaaucgcuaggggaagaaaacuagccagugaagguuuuauagacaacggugccaaccggauguuaaugagaauuugggaagaauuaaacccagcuaauccacuggaucguagauguccauauugugcagaaccaauaggaauaagggccuuauucaguggagaagcugauauagaucauauuauaccuuauagcaggucacuugaugauaauguuggaaauaaagucguugcacaucgaucaugcaauagagcaaaaggaaauaaaacuccauaugaaaaguggggaccucauauugauccugaacgcugggaacgaauaagugaucaaguagcaagauugcacaaaaguaaacaauggagauuugggcccgaugcaauggaaagaauagacagagauggaggguuucuagccagacaacugacugacacacaauauuuaucaaggguggcagggaaauaccuacgaucauuauauccgacugcucaaucagggagaguagauguaauuccaggaagaaugacagcaaugcuaagaagaaaauggggacugaacaguuuguuaccugaucauaacuacguugaaaaugaacacucaaacgcuccgaaaaacagauuagaucauagacaucacgccauagaugcagcaguagcagcgguaacaacuuuaagccuaaugcaacaaauagcugacgcagcagggagagcagaggauaaaaaucuggaucgacucuucgaagauauaccucaaccauggccaggauuuagggaagaauuaggagaagcauuacgcaguacaacaguaucgcauaaagcagaccauggaagaaaaagaaggccuucaagagacagagauguaacagcagcaagacuacauaacgauacagcauacgggcuaacgggagacguagccgcagauggaaaaacuccgauuguaguccacaggguaccacuagcgucguugaaaccggcagaccuaauagacccuuuaaggauuccagauccaguacucagggaugcauuauaugcagcaacaagagauagaacaggaaaggaauuugaacaggcuuugacacaauucgcgcgacaccauccccuguucaagggaauaagaagagugagaguacgggaaccacugaauguaauaccaauaagggaugcagcagggagagcguauaaggcuuacaaaggagaugcgaacgcucgauucgauguguggagacucccuaauggaaaauggguaagcgacauaguaagcauguuugaugcacacuguauggcagacaagucagauagacgaccccauccugcagcuaagaaaguacuaucauugagacaaaacgauaugguagcaauagagagaucuggaguaacccaaauugcacguguagugaaauuuucgacuaacggaucaauagcacuugcugcugauaacgaagcuggagcuuuaaaagcaagagaugcagcaccaaaugacguagauccuuuuaaauacaucuuuucauccggaggaggauuaaagaacuuaaaagcacgucaaguaaggguagauccccuagggagagucuuugauccaggaccaagagaauga

SEQ ID NO: 8455 - RNA, 3177 nt, Artificial Sequence
  Cas9 variant
augaaaaacagcuacauccuagggcucgauguaggaauagcaagcguuggauaugguuuaauacacagugacucaaaaaguguaauagacgcaggaguaaggcuguucccagaagccaauguagaaaacaaugaaggucggagagcgaaaagaggaaguagacgcuuaaaaagacgaagaauacaucggcuagacagaguaaaauacuuacuggcucaauaucacuuaauaauugacgacaaaauaccuaaaagcacaaacccauacgccauccgaguaaaaggccuaagcucggcccuuagcaaaucagaacucguuauagcuuuacuucaucuagcaaaacgcagagguauacacaacguaaauguaguaauggacgaaaacgaaucgacuaacgaacuuucaacaaaagaacaacuaaaagaaaaugcaaaacaauuggaaaacagguacguaugcgaacuacaacuagaucgauuaaacgaacaauauaaaguaagaggugaaagaaacagauuuaaaaccgaagauuuuguacgagaagcgagacaaauauugacaacacaacaaaaauaccaugauauugaugaacacuuuauagaacaauauacucaccuacuagagacucgacgagaauacuaugaagguccagguaaaggaagucaauacgggugggaaggagauuuaaaacaaugguacgaaaugcuaaugggccgcuguacauauuucccagaggaacucagaaguguaaaauaugccuacacagcagaucucuuuaaugcccuuaacgaucuaaacaauuuagucauagccagggacgaaaacgagaaauuggaauauuuugaaaaauaccauaucauugaaaacguauuuaaacaaaagaaauccccaacacuaaaacaaauagcaaaagaaauagacguaaaagagagugacauuaaaggguacagaauaaccaaaaauggaaaaccacaauuuacaucauuuaaacuauaucaugaccugaacaaaauauucuuagauaagaaaaaucuugagaauauagaacuacuagacgaaauugccuucauauuaacacuuuaucaagacccacuaucuauaaaagaagcauuagaucaacuacaagauuuacuaaccgaaucggaaaaagaagcaauagcacaccuaaacggauacacaggaacacauagguuaucacugaaaugucuacaccuguuaauagacgagauguggcaaacaagucguaaccaaauggaagucuucaccgcacucaacuuaaaaccacaaaaauaucaguugucaaaacaaaaacaaaucccaaagaaaaugguagaagaguucauacuaucgccaguuguaaaaagaucauuuauacaaaguauagaaauagucaauacgauaaucaagaaauacggauuaccugaagagauaauaauagaacuagcaagagagaaaaacagcgaagaccgaagaaaauuccuaaaucgaauacaaaaagaaaaugaaaacaccagaaaacaagucgaagaaguaauaagagaauacggaaauagaaacgcaaaaggacucgucgagaaaauaaaacuccaucaaaugcaagaagguaaauguuuauacagccuacaaaacauaccccuagacgaccuauuaagaaauccuucacacuaugaaauagaccacauaauaccacgcuccguaucauucgacaauucuuuuaacaacaaaguauuagucaaacaagaagaaaacucgaagaaagguaaucgcaccccauaccaguaccuaaauagcaacgaaaguguacuuaguuauguucaauuuaaacaacacauuuuaaaucucucuaaaaguaaagaacgaauaucuaaaaagaaaagagaauauuuacuagaagaaagagacauaaauaaauuugaaguacaaaaagaguucauaaaccggaauuuaguagauacaagauaugcaacacgcgaauuaguacaauugcuaaaaucauacuucucagcaaacgauuuagacgucaaaguaaaaacaauaaacggcaguuucacaaauuauuugcgaaaagcauggaaauuugacaaaucacgaaauaaaggauuuaaacaccacgcagaagacgcacuaauaauagcuaacguaaguuaccucuuuaaacaaucaaaagaacuaaaagaagccaaugcaauacuagaaaacaauaacuuaagccuaaauaaaaacaaagauaguaaaaaucuuuuaacagaacaagauuauagaaaaauguucgaaauuccaaaacaaguccaggacauaaaagauuauaaggacuuuaaauacagucacagggucgacaagaaaccuaaucgacaacuuauaaaugauucacuauacaguacaagagaaguuaacgaaaaccacuauaucguccaaacggucaaagacaucuaugcgaaagauaacacuaaaauuaaagaccuuuuccugaaaacaccagaaaaacuacucauguaccaacacgacccccaaaccuucgaaaaauuaaugcuuguuauaaaacaauauggagaagagaaaaacccuuuugcaaaauauuacgaagaaaacggcgaauaucuuacuaaauaugcuaaaaaugaaaaagggccaacgaucaagagacuaaaauauauaggcaagaaaguggguacccacuuagacauuucaacuaacuucucaggagcaaaacgaaaaguaguacaauuaucaauaaaacccuucagauuugacgucuuucauagcaaagcagguuaucauaugcuuacuuuaacauauauggauauuaaaaagaaagaaaaacacuaccaaauauugaaaaacgaauaccaagcacuaaaagaaagauauaaaguaccauccgaugcacaauucauaggcuccuucuauuacaacgaucucauaucuauuaaugacgaacuauucagaguaaucggcguaaacaauucaacgagaaauguaguagaacuuaacauggucgauauaaacuacaaagacuauugcgaccuaaugggaauaaagaaaacaccacgaauauuuaaaaccauaacaaagaaaaccggcaaaauagaaaaauauagcacggacaucuuaggcaaccaauucaaagucaaacccucgaaaucgccucaacuuaucuucaaacgaggaguucuauga

SEQ ID NO: 8456 - RNA, 3180 nt, Artificial Sequence
  Cas9 variant
augcgacgucuaggauuagauauaggaaccaauucaauagguuggugcuuaacacagggaccaggagaugaagcagacggaauaguagauauaggcguaagaauauuuucagauggucgagauccccaaaguggcacaagucucgcuguagacagaagagaugcuagggcagcaaggaggagaagagauagauauaucggaagaagaucagcauuccuagacacuuuagucgcacauggauuaaugccagccgaugcggacgaagcaaagcuaguagcugcguuagacccauacacacuacgugcuagggcacuugaagcaccauuaacaccacaugaaauaggacgggcgcuauuucacuuaaaucagagacgaggauuuaaaucuaauagaaaagcagaacguaaaacaaacgaugccgaugauggcaaaauugcaaccgcagcauaugcacuagauagagcaauguuagauggaggcuucgauacuuuagggcaauuccuaaaugcacaagaaacaaaaagaguaaggauggacggcgaagcacaagguuacgauuucuacccacaacgacgucacguagaauaugaauuugacagaauuuggacagaacaagcaaaacaucauccagcucuacuaacugaaacagcucgauaugcgcuccauagaauuuuauuuuaucaaagaccacuuaaagcacaaguagucggaaaaugcacuuuuguacacucagaagaucgccuggcgaaagcucauccauuauuucaacaaagaaggcucuaugaagagguaaaccaauuagaaguuacaacaccgggagaagcuaauagaaaacuaacacuagaugaaagagauaggcuagugagagaacuaucucauaagaaagcaauagcauuuacgucauuagccgccaaaauaaaacuagagccaggacaaucauucaauaaagcaucugaaacgagaacucagcucgcaggagaugaaguaagggcaguauuaggugauaagaaacgauuuggaccugcaugggaacauuucgaucgagaucgacaauggacaauaguggaaagauugcuagaggaagaagacccugacgcuuuacaugcguuuuuaacacaggauuguggcuuagacgacgagcacgcugcugcuacagcuaaaacauccuuaccagaaggauacggaagacucggagcaacagcaacagcaagaauauuagcggaacuucaagcagaaguuauaacauaugacgaagcuguacgccgaugcggauggcaucacagcgaccaccguacaggggaaaucuuaccacaacuacccuauuauggugaacuucuaacucgagacauuccaccagguacccaagacccaaaugauccaccugaaaaacgaugggguaggauuacuaacccuacuguucauauuggauuaaaccaaguacgucaacuugugaaugccauaguggcaguucacggcaggccagaccaaauaguuguagaacuugcuagagaacuaaaauuaaacgaaaaagauaaagaagaacauaaucggagaauacguagagauacagcggcagcaauuaaaagaagcgaaaaacuaacacaagaaggauuuccagauaccggugcaaaucgaaugcuauuacgguugugggaagaccugaauccagcuaauccauuagaucgaagauguccauacugcggagcuccuauaggcaugagagcguuauucgcaggagaagcagaugucgaucacauuaucccauauaguaggagccuugaugauagugcaggaaauaaaguaguagcacacagaaguuguaacagagcaaaaggaaaccgaacgcccuacgaaaaauggagcgacgauccugacagaugggaugcaauuacagcucaaguugcccggcuacauaggaguaaacaauggcgauuuggacccgaugcaauggcaagaguagaaaaagauggaggauuuuuaucgagacaauuaacagauacccaguauuuaaguagauuagcagguagauaucuaucgucacuuuacccaacaaaggaagaaggauccguuuauguuauaccgggucgaaugacagccaugcuaagaagauuauggggguugaaugacauuuuaucagaucacaauaucguugaaaauaaacauagcaacgcucccaaaaauagacuggaucaccgucaucacgcaauagacgcagcuguaguagcaguaucuacuagaagccucaugcaaaggauagcaagaacagcugggcaggcagaagacagaaaucuagacagacuauuugaaggacuagauccaccauggccggguuuucgcgaccaauuaagagauagauuguuagcuguaaccgucucccauaaggcugaccauggacgaacagguacuccaguaccaggaaaagaugcgacagccggaagauuacacaaugacacagcauacggacuaacaggagaaacaucagcaaaaggacuuccaaucguaguacauaggguccccuuaacuagcuuaaaaccugcugauauaacagacccagauagaaucccagaccccgucuuaagagacgccaucgagcgagccacagcaggaaaaaugggcaaagauuucacagaugcacuugcaaaauucggaagaagcggagcccaagaaacagaucguaaaggggaaagacuauuuagaggaacacgaagaguaagaguccgggaaccgcuaggcguaauacccauagcggaugcaucuggacgaguauauaaggcauauaaaggugacucaaaugcuagguuugauguauggagguuaccagaugguaaauggguauccgauauaguaucgauguuugaugcccauagaccagaccaaggcgaucguagaccccauccagccgcgaagaaaguauuaagucuacgacagaaugauaugauagcuauagagcgcgauggggcgccacgagaaauaguucguguagucaaauuuagcacaaucggcucuguacagcucgccgcuacaacagaagcagguccacugaaagcuagagaugcaucuccaccugauguagacccuuuuagguauauuaacaguucggcagggggauuaaagaaaauaaaagcuagacaaguuagaauugacccacuagggagaauauuugauccaggaccaagauga

SEQ ID NO: 8457 - RNA, 3180 nt, Artificial Sequence
  Cas9 variant
augauagaaagaauacucggcguagauuuaggaauaaguaguuuaggaugggcaauaguagaauacgauaaagaugacgaagcagcaaauagaaucauagauugcggaguacgauuauucacugcugccgaaacaccaaagaaaaaggaaucaccaaauaaagcucgacgugaagccaggggaauacgacgaguuuuaaauagaagacgaguacguaugaacaugauaaaaaaacuauuuuuacgagcuggucuuauacaagacguagaccuagacggugagggaggaauguuuuacagcaaagcaaaccgcgcagacguaugggaacuaaggcaugauggauuauauagauuacucaaaggugaugaacuagcaagaguacuaauacauauagccaaacacaggggguauaaauuuauaggagaugaugaagcugaugaagagaguggaaaaguaaaaaaagccggcguaguguuaagacaaaauuucgaagcagcaggguguagaacaguaggagaauggcuauggcgugagagaggagcaaauggaaaaaaaagaaauaaacauggugauuaugaaauaucaauacaucgagacuuauuagucgaagaaguugaggcaauuuuuguagcccagcaagaaaugcgaaguacgauugcaacagacgcgcuaaaagcagcguauagagaaauagccuuuuuuguucguccaaugcaacguauagaaaagaugguuggccauuguacuuauuucccggaagaacgaagagcaccaaaaagugcaccgacagcagaaaaauuuauagcuauaucaaaauucuucucaacaguaauaauagauaaugaggguugggaacaaaaaauaauagaaagaaaaacacuagaggaacuauuagauuucgcuguaagucgagaaaaggucgaauuccgccauuuacgcaaauuccuagaucuauccgauaaugaaauauucaaaggccuacauuauaaaggcaaaccaaaaacagcuaaaaaacgagaagccacuuuauuugauccaaaugaaccaacagaguuagaauucgacaaaguggaagcagaaaaaaaagcauggauaucacuaagaggcgcugcaaaacuucgcgaagcccuuggaaacgaauuuuacggaagauuuguagcccuuggaaaacaugccgaugaagcaacaaaaauccuaacauacuacaaagaugaagggcagaaacgaagagaacuaacgaaacugccauuagaagcagaaaugguagaaagauuaguuaagauuggauuuagugacuuucuaaaguuauccuuaaaggcuauaagggauauuuugccugcaauggaaucgggagcuagauaugaugaagcaguacuaauguuaggaguuccccacaaagaaaaaucagcaauauugccgccgcuuaauaaaacagauauugacauacugaauccgacgguuauccgcgcauucgcacaauucagaaaaguugcuaaugcauuagugcguaaauauggagcauucgaucgaguacauuuugagcuugcaagagagauaaacaccaaaggagaaaucgaagacauaaaggaaagccaaagaaaaaaugaaaaagaaagaaaagaagcggcggacuggauagcagaaacaagcuuucaaguaccguuaacuaggaaaaauauccuuaaaaaacgguuauauauccaacaagacggaaggugcgccuauacaggugaugugauagagcucgaaagacuguuugaugagggcuauugugagauugaucauauauuaccacguagccgaagcgcugacgacucuuucgcuaauaaagugcugugcuuggcacgggcaaaucaacaaaaaacugaucggacaccauaugaaugguuuggacacgaugccgcuagauggaacgcauuugagacgcgaacgucugcaccgaguaaccguguuaggacugguaaaggaaaaauugauaggcuauuaaaaaaaaauuuugaugaaaacagugaaauggcauucaaagauagaaaucuaaaugauacaagauauauggccagggcaauuaaaacauauugugaacaauacugggucuucaaaaauucacacacaaaggcaccaguacagguacggaguggaaaauugaccagcguguuacgauaccaaugggguuuagaaagcaaagaucgagaaucacacacacaccaugcaguugacgcaauaaucauagcauucucaacacaaggaaugguacaaaaacucagugaauauuacagauuuaaagaaacacacagagaaaaagaaaggccuaaauuagcgguuccguuggcaaauuuuagagaugcaguagaagaagccacaagaauagaaaauacagaaacaguuaaagaagguguagagguaaaaagguuacuaaucucaagaccaccacgagcaagaguaacaggccaagcacaugaacaaacagcaaaaccauauccgcgaauaaaacaagucaagaacaaaaaaaaauggagauuagcacccauugaugaagaaaaauuugaaucuuucaaagcugauagaguagcaagugccaaucaaaaaaacuucuaugaaacuuccacgauaccucgaguagacguguaucacaaaaagggaaaauuucaccuugugccaauauaucuacaugaaaugguuuuaaacgaauugccaaauuuaucauugggaacaaauccggaagcaauggacgaaaacuuuuucaaauucucuauuuuuaaagaugauuuaaucaguauacaaacacaaggaacaccaaaaaaacccgcaaaaauuauaaugggauauuuuaaaaacaugcacggagcaaacaugguguuaagcucaaucaauaauaguccaugugaaggauuuacauguacaccaguuucaauggauaaaaaacacaaagauaaauguaaacuauguccugaggaaaacagaauagcuggccgaugucuacaaggauucuuggauuacuggagccaagaaggauuaagaccgccaagaaaagaauuugaaugcgaucaaggaguaaaauuugcacuugauguaaaaaaauaucaaaucgacccacugggauauuauuacgagguaaaacaagagaagcgauuaggaacaaucccacaaaugaggagugcaaaaaaacuaguaaaaaaauga

SEQ ID NO: 8458 - RNA, 3180 nt, Artificial Sequence
  Cas9 variant
augucaaagcgucuccgauaucgauuagcucuugauuuagguacgaacucaauuggauuuugucuauuggauuugaauggugaugguagaccuuguggaguuagaaggaugggcguaagaauauuuccagacuuuagcaaauuacaacaguccuuagcugcagacaggagauuagcacgaucaaugaggcgaagaagagaucgcuacuuacgaaggcgaaaagcucuaaugaacgcguuaguagcagcggcacuaaugccggcagauccaaaagcaagaaaggcguuagaagcacuagacccguacgaguuacgagcugcugcaguagcagggccauuaccagcacaccaguuaggucgagccuuguuccaccuaaaccaaagaagggguuucaaaaguaacagaaaagcagcuggagaugagaacgaagcggggaaaguaaagaguggaauuagugcauuaaaagcggaauuagcugccucaggagcaggaacauuaggacaaugguuagcugcucgucacgccaaucgucaaccaguacgagcaagacuuacggguacuggugcgaaagcaacauauagcuuuuauccagaaagggcauuagugcacgaagaauuucaagcuauaagagccgcucaagcuccacaucauccuggcguaacagcagaacaaugggaucgaauagaaaguguuauauuucaucaaagaccgcuaaaaccugugaaaccagguaaauguacguuauauccugaagaagaaagagcuccaugggcgcuaccgauagcucaaagauuuagaauuuuacaugaacuacauaaucucagaauaguaaggccuggacaaggagaagaaggacuuagcccugcggauuuugauagguucuuugacagguuauguagaaaaggugauuugacuuuuaagacauuagccaaggaauuaaaacuucccccagacgcaagaauaaauuuagaggaugauaagagagauagauuaaaaggagaugcaacugcugaugcguuaucagcggaaaaaggaaaaagaagaagaauaggggcagcauggcauucauuuccggcagacaggcaaagggaaauuguaggucgauuaaucgaugcagaagaugaaggagaauuagcugcaugguuaguagaagaacuaggauuaccgugggaaguggcaauacugacugcugaacguccaggcuuaccagaugguuauuguagauuaucugaaaaagcucuagaacagguagugccguuaaugcacgaggaacauuugccguacgaugaagcgguacgagcacuuggucuacaccauagugaccauagaacuggggaauuucuagaugaacuaccauauuauggacuacccuuagaaagauucaucgcauuugggacuggagaagcagacgauccaccggaacugagaaucggaagauuuccuaacccuacaguacacguagcauuaaaugaauugagaaggguaguaaauagaauaaucaggaggugggggaaacccgaagagauagugguagaauuagcuagggauuuaaaacagagucgugcagauagagacaaaacacaaagagaacaagcggacaaucagaaaaagaauuggacaagaacgcaacaacugagagaauuaggaauggaaccaacuggggaagcacugcuacguuuaagauuaugggaagaacuuccuagaauuggaucagcacauguauguguuuauaccggucaaccaauaaguaugacgcaacuucuacaaggggauguagauguagaucauauauuaccuuucucgaggacacuagcaaauggggcagacaauaaaauaguaugucaccguagagcaaaccgaaucaaaagaaacagaacuccgugggaagcauuugguguuguuucagcggacgguuaugacugggcagcuauugcggaacgagccgaaagucuuccuaagaauaaaagauggagauuccuaccaaaugcuauggaaagauuugaaacugaaagaggguuuaucgacagacaauuaguagaaacaagacaucuaagcagaguagcaagagaauauuuaggauguauaguuccucuugagaaaguaagagcagcuccaggaagguugacagcgaugcuaagggggagaugggguuuaaauucaauauuaagugacgcaaacuugaaaaauagaucagaucaccggcaccaugcaguagacgcggcaguacuuggugucauagaucaaagauuaguucaaagaguugcugacgccgcuaaaagagcagaagaaaaggaacuagaaaaacuauuugaugggcuaccagauccauucgaaggacuacccgggccaucauuucgagaucaaguacaagagagagcacaaggaauuauugucucacauaaaccagaacacggauggcaggggcgaaugcauaaugauaccgcuuacgggccgguagagcggcuacccgauggaacacacagaguaguaacaagaaaaccuuuagggucccuagcagaaaaagauuucggaaauauacgagacagagcgcuagcagcugcacuagaaagacauguagcagaacaagcagcacaaggucguagccuaggagaagcacuaaguuguuucacauggaccggaggagagguacgaagagugagaauguuagacaaauuagguucgccaguugcaguacaggacgacgauggacauacuuuuaaauuauauaaaggugauucuaacgcaugguaugagauacucagagauggaagggggagauggacaggaagaauaguuucgacauacgaagcauauaggcuacaugcggagugguuagcugaaaggggugauggaggaagaucggacgcugcauucccagacugggcugcccggagauuaugugcagguauugguaaacccuuauucagacuauucaaaggagauauguuagcuuucggaacagcaccuaaucgcgaaauaaugaagguagucaaauuuagugaaggacgaaucguauucgcgggucacagggaagcggggaauuuaaaagagcgggaugccgauaaagacgauccauucaaauaucgaacaugcucgccagaagcacugcguaaagcgcaggcacgaccaguaggaguagacccugcaggauucguacacgauaggggaccucuagaauga

SEQ ID NO: 8459 - RNA, 3180 nt, Artificial Sequence
  Cas9 variant
auggguauaagauuugcauuugaccuagggacaaacagcauagguugggcgguuuggcgaacaggaccagguguauuuggagaagauacagcagccagucuugacggauccggaguucuaauauuuaaagacgggagaaacccuaaagauggacaaucauuagcaacaaugagaagaguaccaagacaaucaagaaaacguagagacagauucguacuuagaaggagagauuuacuggcggccuuaagaaaagccgguuuauuuccaguugauguggaagagggaagacgauuagccgcgacggaccccuaucauuuaagagcaaaagcacuagaugagucauuaacuccacaugaaaugggaagaguaauauuucacuuaaaucaaagaagaggauucagaucaaaucgaaaagcagacagacaagauagagaaaaaggcaaaauugccgaagguucaaaacgacuugcggaaacucuugcggcaacaaacugcaggacuuuaggagaguucuuaugguccagacauagggguacgccucggacaagaucuccaacaaggauaagaauggaaggugaaggcgccaaagcucuauacgccuucuauccaacaagagaaauggucagggcggaauuugaaagauuauggacggcacagagucgauuugcacccgaucuucuaacaccagaacgucacgaagaaauagcagggauauuauucagacaacgagauuuagcaccgccgaaaauagggugcuguacauuugaaccgagugaacgaaggcuuccacgggcauuaccaucuguggaagcuagagguaucuaugaacgacuagcgcaccuacgaaucacaacaggcccaguaucagacagaggauuaacgagaccagaaagagauguacuagcaagcgcucuauuagcagguaagagcuuaacguuuaaagcaguaagaaagacguuaaagauauuaccacaugccuuaguaaauuuugaagaagcaggagaaaaagguuuggacggugcucuaacagcuaaauuauugucaaaaccggaucauuauggugcagcauggcauggucucaguuuugcggaaaaagauacauucguaggaaaacuguuagaugaagccgaugaagaacgguuaauuaggagauuaguaacugaaaaccguuuaagugaggacgcggcaaggagaugugcuucaauuccucuugcagauggauauggcagauugggaagaacggcuaauacagaaauucuugcagcgcuaguagaagaaacagaugaaacaggaacaguaguuaccuaugcggaagcaguaagacgagcuggugaaagaacgggaagaaauuggcaucauucugacgaaagagaugguguaauccuagaucgauuacccuauuauggagaaauccuacaacgucauguaguaccaggaagcggcgaaccugaagaaaagaaugaagcagcgcguuggggaagauuagcaaacccaacaguacauauagggcuuaaccaacuuagaaaaguagucaaucgauugauugcugcacacgguagaccugaucaaauuguggucgaguuagcaagggaacucaaauuaaaccgggaacaaaaggagagauuggacagagagaauaggaagaaucgagaagaaaaugaaagaagaacugcuauauuagcagaacauggacaaagagacacggcagaaaauaaaauaagacuuagacuauuugaagaacaagcucgugcuaaugcgggcauagcucuauguccauauacuggucgagcaauagguauagcagagcuuuucacaagugaagucgaaauagaucauauacuaccaguauccuuaacuuuagacgauagcuuagcaaauagaguauuauguagaagagaagcaaaucgggagaaaagacgacaaacaccuuuccaagcauuuggagcaacaccagcuuggaaugauauaguagcacgagccgcuaaauugcccccgaacaaacguuggagauuugauccagcggcuuuagaaagauucgaaagagaagggggauucuuaggaaggcaauugaacgaaacaaaauaucuaagccgauuagcuaaaauauacuuggggaaaauaugugauccggauagaguauauguaacuccggggacauuaaccggauuacuuagagcuagauggggccuaaauagcauccuaagugacucaaacuuuaagaaccggagugaccacagacaccaugcgguagaugcgguaguuauagguguacuaaccagaggaaugauacaaagaauagcccaugaugcagcacgggcugaagaucaagaccuagauagaguauuuagagauguaccagucccguucgaagacuuucgagaucauguaagagaacggguaagcacaauuacuguagcaguaaaaccugagcauggcaaagggggagcguuacaugaagauacauccuaugggcuaguaccggauacugacccaaacgcagcacuugggaauuugguaguaagaaaaccaauaagauccuuaacagcaggagagguggauagggugcgagacagagcauuacgggcaagauugggugcuuuagcggcuccauucagagaugaaagugggagaguaagagaugcaaagggauuagcacaagcauuggaggcguuuggggcagaaaacggaauuagaagaguuagaauacucaaaccagaugcaucaguuguaaccaucgcugauagaaggacaggaguaccauacagagcaguagcgcccggagaaaaccaucauguugauauaguacaaaugagagaugggagcuggagaggguuugcggcuagcguauucgaaguuaauaggccaggauggagaccagaaugggaaguaaagaaacuaggaggaaaacuugucaugcgacuacacaaaggagauaugguagagcuaucagacaaggauggccaaaggagaguuaaaguagugcaacaaauagaaauaucggcaaauagaguaaggcugagcccucauaaugacggcggcaaacuucaggauagacacgcagacgcugaugacccauuuaggugggauuuagcaacaauuccucuuuuaaaagauagaggauguguggcaguaagaguugacccgauaggugucguaacgcuaagaagaucaaacguauga

SEQ ID NO: 8460 - RNA, 3183 nt, Artificial Sequence
  Cas9 variant
auggcgguaaaaagucugaauuauaucuuaggauuagacuuaggaauugcaucuuguggaugggcuguuguugaaauggaugaacaggaaaauccauugagacuuauagauguaggcguacgaacauuugaagaagcagaaaacccaaaagacggaagcagucuagcugaaacaagaagacuggcacgcgcacaaagacgauuaaucuccagacgagcuaauagaaugaacaaacuaagacgauuguuaaaacaagaaaauguacuccaagcaaaugauuacgacgaaaaaggucuaauaauaggauuacccaaccaggcuugggaacuacgagcacaagggcuagauagaaaauuagaaccaaaagagugggcagcuguuuuaauucauuuaguaaaacaucgaggcuauuuaucacaaagaaagaaugaaucacaaacagcugacaaagagcuaggugcacuacucagcgggaugaaucauaaccaucaacuacuacaaagccaaaguaaccaauaccgaacccccgcagaacuagcaauaaaacaauucgcaacucaggacggacacauaagaaaccaaagaggagcauacacacacacauuuaacagauuagacuuacaaaaugaacuaaaccagcuauuugaugcccagacaaggcuaggaaacccgcauguaucaggaagucuaaaaacagcuaucaaugacuuauuaaugaaucaaaaagcagcucucaguggagaugcaauacuagaaaugcuagguagaugcaccuuugaaccuucagaauacaaagccgccaaaaauacauacagugcagaacgauuugucugguuagguaaauuaacuaaccuacgaauccaagacaacggacuagaaucugcacuaucacgagaacaaagagagcuccuacucaaugaaccauauaacaaaacaaaauuaacuuaucaacaaguaagaaaacuuuuaagauugccagaaacagcauuuuucaaaggacuuagauauggaaaagauaaugcagaaagugcaacacuaauggaaaugaaaucauaucaugcaauucgaaaaucucuagaaaacaaaaguuuaaaaucugaaugggaaaagcuaaagacucagccaaaacuauuagaccuaauaggcacggcguucucuaucuacaaaacugacgaugaaauugcagguugccucaaaaaucagcugccagaaaacguaauaauagcucuacaagaacaauuaaauuuuucuaauuuuauggaacuaucacuuaaagcauuagaaaaauuacuaccccuuauggaacaaggacuacgcuacgacgaagcguguacucaaauuuauggaaauaggcaugagaaaaucgcagacaaaacugaaaaauucuuaccuaauauaccagcugauaaacuaagaaaucccguaguucuacguacccuaacacaagcaagaaaaguaauaaaugcaauaauaagaagauacggcaguccagcaagagugcacaucgaaacuggaagagaaguaggcaagagcuucucagauagagauaaacugaagaaacaacaggaagaaaaccaagaacaaagacguagagcaauagaugaauggaaacaauucuuuccaaacgcagcacacgaaccaaaagcaguagacauccugaaacuuagauuauaccaauuacaacaaggaaaaugucuuuacucaggauuaccaauagauguuagaaggcuaccugaaaaagguuauguagaaauagaucaugcuuugccuuuuagcagaacaugggaugacucauuuaacaauaaaauucuaguacuugcaucggaaaaucaaaauaaaggaaaucaaacaccauaugaauaccugagaggagcagauaacucagaaucuuggagacuauuuguagaaaauguucagaacugucaauucaguccuaauaagaaacagaaaauaauggcaaaacaacuagacgaaaaaggcuucuuagaaaggaaucucaacgacaccagauacguaucaagguuuuuaugucaauuuauaagcgaauaccugcaccuuacgggaaaagguaagaaacgaguauucgccucuaaugggcaaauaacugcuuuacuacgcggaagauggggauuaaguaaaaaccgugaagaaaacgauagacaccaugcagucgaugcaguuguaguugcaugcucaacaguugcaaugcaacagaaaauaacacaauucguacgcuaccaaaaaggaaauguguuuaccggagaaaggauagauaaagagacaggagagguaauuucaauacauuucccuaccccaugggaacacuucagagaagaagugaugauaagaguauuugaugauaauccucugagaacgcuaccagaaaaauuaccaaacagaccagaagccuuacaugaauauguuaugccauuauuuguaucacggaugccuacaaggaaaaugacuggacaaggacauaaagaaacgauuaaaucggcaaaaagacuagaugagaaaauaagugucuuaagaguaccacucacacaacucaaacuaaaugacuuagaaaacaugguuaauagagaaagagaacccgcauuauacgaagcacuaaaagcaaggcuagaacaauucaagaaugauccagcaaaggcuuuugccgaaccauuuuucaaacaaggaggacaacaaguaaaagcuguacguguggaaauaguacaaaaaucaggcaugcuguuaagaaaaauaaauggaguagcagacaauggauccauggugagaguagacgucuucgagaaaaguggaaaauucuacuugguacccauauaugcuuggcaaguagcagaaggaauacuaccaaaccaugcaguaguacacucaaaagaugaauccgauuggauauugauggacgaauccuaccauuucaaauuugccuuauacaaaaacgaccuacuagaaguucaaacaaagaaaggauguauaaugggauauuuugcuucacuagaucgagcaacuggugccauaacaaucagagaacacgauagagauaaaaagaaaugcaaagauggagaacaucguagcauaggagucaaaauggcaucgagcuucaagaaacuucaaguggaugaacuggggaaaaauauacacgaaacaagaaguagaaaaaggcccaauaucggauga

SEQ ID NO: 8461 - RNA, 3186 nt, Artificial Sequence
  Cas9 variant
augcauacccuaccuuacacuuuaggacuugauauagggauagcaucaguaggcgcagcccuacuaucugacgaaaguauauuaggaaugcauguaagaaccuuuucugcagcagaaacugauaaagaaggggacccgcuuaauaaaauuagaagagaagcaagaagcgccaggcguagaauaaggagacgagcccauagauuauuaagauuacgucgucugcuaaaaagaacaggacuaauaucggauacuucguuagaagucuuaaaaacaucuaaaacuccuuggcaauuaagaucagagggauuagacagguuauuaagcccuucugaguuagccgcagcguuauaucacauagucaaacauagaggcuuucagagcaauagaaaagcagaauuaaaaaccgacgcaaaagcgggacaaaugcuuucagguguauccgcaaaucaacaauugaugagagauaaaucauacagaacgauagcggaaaugguuuguaaagacgaugcauucaaagaucacaaaagaaacaaagguggaucauaccgaaauacguuugcuagauccgacuuagcugacgaauuaaaaacauuacuaaagaaacagagagaauacgauaauccgcucgcaaccccagaacuagaagaagcaguacauacucuauuaauggcuagaaggccaguauuuaaagacgaugauauagaaaagcuaguaggauucuguacauucgagcacggcgagaaaagagcaccaaaagcggcauucaguucggaaagauucauauggcuaggaaaauugaauaaccuuagacuuauauacccaggcgaacaaagaagccucacaccagaagaaaggucacagauaauaaaucuacccuuuacucaagcaucaguaaaauuuagccaaauuagaaagaaacuugaccuaccggaauauguuagauuuaauuugguaagguacaaaccuggcgaagaaacaucaaaaagcgaaacagcaacauucuuugaagccaaggcuuuucaugaacuaagaaaaacuuaucgagaaucuggaauaucagaauuaugggaaagggaccaacaugauccacaaagacucgaucagauagcuacagcaauugcagucuauagagaugaugaaagaauaagaaaugaguuaucaccucacacuauugaaaacgaaguaguagaagcgguauuaaauugcgacuuuacccaauuuaucaacuuauccuuaaaagcucuaaauaaaauuuuaccauacauggaacaaggccagagguaugaugaggcuugcacaucagcaggauaccagcaucacucuccccaacaaaaugaagaaaaauccggaaggauucccccuccagauaaaaacgucauaagaaacccaguaguuuauagaagccuuaaucaagccaggaaauuaauaaacgcaaucacaaaacgauacggggcgccagcagcuauucauuuagaaauggcaagagaccuuuccaaacccuuuagugaaaggaaaucaauagaaagagaacaggaaaaauacagaaaacaaaaaguucaacucagaaaugaauauauagaacauuuuggaacugaaccuaacggccugaauuuacucaaauuuagacuuuacaaagaacaagaugcccaaugcgcuuauacacaaaaagcauuagaccuauccagacuaaaugaagcaggauauguugagguugaccacauacuuccauacucacggucuuaugaugauucauuauugaacaaaacauugguacuaacagaggcaaacagagacaaaggaaacagaacgccauucgaauuuauggguggagacgaucaaucucaacauuggcaaaaauuuguaagaugggugcaaaugaacccaaaaauuagacaagcuaaaagaaaccgcuacuuaagaaaagacuuuucagaaaaagcugcacgagaauuucgggauagacacuuaaacgauacacgauauauaggucgagaauuaaaagcaaugauugaaucacauguucaguggcauccggacucaaaaucaaaagauugcugcguaguucuaucuggucaguuaacggcacuacuacgaggaagauggggguuuaacaaagauagagcagcaggagacuugcaucaugcaguagaugcagcaguagucgcagcagcaaccagaggcaugauacaacgaauggcuaggcacaguaaauuccaugaacucaaaaauguuagaacaaguuaugcugacccagacacaggagaaguagucaauuuagcagcagcucgggaucuagaaaaacauuucccauugccaugggacaauuuucggaaugauacucucgccuaucuuaauccaagugccauaagcgcugaugaaucugcacaagaaggacaccgaggcguuaggguuuccagagcacccacaagaagaaaauuaggagcugcccaccaagaaaccauucguagcaaaggaaaagauaauauauuacuugaacaaggacucucagcaguaaaaacuccucuuucuaaacuuacgcugaaaaauauagaaaacaugguaggcuaugaagacccaaggaacgcagcgcuaguaaaaguauuaagagaacgccuagaagcauuuggaggagauggagcaaaagcauucgcaccgaaucaaccacccguuuacaaaccauccaaaccagggaaacaagcaccagaaauaagaaguguaaaaauggcaagcaaaucuaaaggagcacuacacguccgagaagguuuagcagauuccggccguaugauaaggaucgacauauacgaaacuaaaaauggcuacguugggguaccaauuuacguaucagauaaagcaagaaguaaacuaccaaaagcauauccaaagaaaggagaagauagggccaacuggccagaagucgauacaaacgauaacuuucuauuuaguuuauauucaacagauuggauagaagccaaaacaaagaaagaaacaauugcaggcuacguaaaaucauacgauauauucgauggaagauugcuuguauacgcacacgauaacaagaaaguuguaagaaaauuaacacuaagcgcacuugcugaccuacagaaacuucacguaucgauacuaggagaucuauauaaaggagggacaccaaaaugcagcccuuuaagaaaaggccaagaacuauga

SEQ ID NO: 8462 - RNA, 3186 nt, Artificial Sequence
  Cas9 variant
augcuacgccucggacuagauauagguagcacaucaauaggaugguuuuuauaucgcauaacuaacggcaugaucgccgagauaauagauuguggugucagguuauuuucugacgguagagaugcgaaaacuggaguaucuucagcaguagaaagaaggaacgcuagggcauugaggcguagaagggaucgguauuuaagacgacgagcugcuuuaaugcgaagacuagcagcagcaggauuaaugccggaagauccaucacaggcaaaaccauuagaacucuuagauccuuaucguuuaagagcggacgcacuagaccgaagacuagaguuaacagaguuaggacgagcauuauuucauuugaaccaacgaagaggauucaaaaguaauagacaaacugauagaggaaauaaugaaggggguaagauaauagaugguagugcaagacuugaucaagcaaugauggcugugggcgcgaggaccuauggcgaauuucugcaccuucgaagaucccaagcagaagacuuacgaagaguaccaagcgugagaacaagauuaacauuaagaucaguagauggaggaaaagccgaaacuggcuaugacuuuuauccugauagacgccauuuagaagaagaauuuaacaaaguaugggcugcacaagcggcucaccacccuguauuaacagauaguuuaaggcaugaaguuuuugaaacuauuuucuuucagagaccauuaaaggcuccugcaguaggacgcugccucuucuucccagaaccacgauuaccccgagcccacccauuaacacaacgucguguuuuauacgagacaguaaaugcccucagaauacgaacagaaucaggcgcagcaguaccauuaggaaaggaacaaagagacaaaguaauuauguuauuagauggaaaagccccaguaaaagcaauagcaucugcuaaauugucacuaaaagccauagcaaagcaucugaaauuaagagacggacaaaccuuuacucuugaaaaaggacgagauuauaucgcaugugacccagucagagcaaguuuaucccauccggauagauuuggaccccgcuggagcguuuuagaagcagaaguccaggcagaaauagucgggcggauacgugaugaugaugauacaauggcuuuaguagaaugguuaaaacaagugcauggcuuagaugacgcucaugcucgagcuacagcggaugcaccucucccggaagguuacggaagacuuggcgaaacagcuacaaggaaauuauuagauuguuuaaaagcagaaguauuaaccuauagugaagcugucggaaaagcgcuagaccaacaucacucagacagaagaaccggagaaauucuagaaaguuuaccauacuacggcgaaguacugcaagcucacgucauuccgggaacuggcgaaccgcaucacgaugacauaacuagauuuggacgaauaacuaauccaaccguccacauaggacuaaaucaauuaagaagauuaguaaauagaauaauagcuagguauggcaaaccagcagaaauagucguagaacuagcuagagaccucaaacaaucaacuggacagaagaaagcugcaauagcauuaaaccuuaaaaaucgaaaagcugcagaagcuagaagugcuuuacuaacagaauggggcguuccugauacaggagcaaauaggauguauguuaggcuauggcaagaacuacacgaagacccuaugaugagaagauguccauacacggguacuauaaucaguccaucgcuauuauucagcggagcgauugauauagaucacauuuuaccauacaguagaacacuagaugauucaacagcuaauagaacacuauguaugaaagaagcaaacagacagaaaaggaauaaaagcccauccgaagcaagaagagaugguaugagaauaugggcauuggaagaugacaauuuaaggcauauacccgaauuuaaaagauggagguuugcagaagacgcuauggcaagauucgaaggugaaagagauuucgaagcuagagcacucguagacacucaauauuuaucaaggauuucgaaagccuauuuggaaacacucuaugauggagcagacggaaaaucacacgucuggguaguccccggaagauuaacugaaaugcuaaggagacauuggggucuaaaugggauauuaacagauccauuacgagacguaacaaaagaaaagaauagaauggaccaucgacaucaugcuaucgacgcggcugucguugcagcaaccgauagagguuuaauaaaagcaauggcugaacaagcacgaacagauguggaucaagguagagaagcacuagcuagcucaauuaugccacccuggccagguuuuagagaagcuguagcagcucaaguagauagaauuauaguaucucacagaccugaccacggaagaaucgaucuaacaacccgaaugaaaggaagagaucaaaccacaggacccuuacauagagacacugcauacggcuuaacaggacaaucagagaaaggagucccucuaguagucacaagagaaccauucgauaaccuuacaccaacaaugauuggaaaaauaagagacgagccacuaaaggcagcauuggcagcuguaacagcgggaaagaaagacgacgcauuugccgaagcguuagcgcauuucagagauagaccaggaccauaccauggaauacgacgaguaagauuaauagagccaauaucugugguugaaauccgugacgcaucagggagggccuacaaagguuacaaaggaaauucaaaucauugcuuugaaguauggagauuaccaggaggcgcaauaacagaacauauagugaguaccuucgacgcccaucaaccaggucccgaaccaagaccacauccggcagcuaaaagacuauuaagacuauuuaaaagcgacaugguuaaacucgaugauucuaaauuuggacccguaauagcaacaguaguaauguuugauaggaauggaaaaauaaguuuagucccucauaccgcuucaaaugcccgaaaaagaugugaaaaguauaaagaagaucucuauuuacguuuuacagccagaacauuaauagaagcaggagcaagaagaauaauaguagacgaaacaggacacuuccgggaucccggacgaaaaggcuga

SEQ ID NO: 8463 - RNA, 3189 nt, Artificial Sequence
  Cas9 variant
auggcugaaaaacaacauaggugggggcuggacauaggaacuaacucaauuggaugggcaguaauagcauuaauagaagguaggccugcaggauuaguagcaacgggcucgagaauauucagcgauggaagaaauccaaaagaugggaguagcuuagcuguugaaagaagaggcccaaggcaaaugaggaggagaagagauagguaucugcgucgaagagauagauuuaugcaagcauugaucaacguuggcuuaaugccaggagacgccgcugccaggaaagcauugguaaccgagaauccuuauguacuaagacaaaggggacuugaccaagcucuaacacuaccagaauuuggaagggcuuuauuucauuuaaaucaaagaagaggauuucagaguaacagaaaaacggaccgagccacagcaaaggaaucgggaaaaguaaagaacgcaauagcggcuuuucgagcagguauggggaaugcaagaacaguaggagaagcacuagcaaggagauuggaagacggaagaccaguaagggcaagaaugguuggucaagggaaagaugaacacuaugaacuauauauagcgagggaauggauagcgcaagaauuugaugcuuuaugggccagucaacaaagauuucaugcagagguuuuagccgaugcggcaagagauagacugcgagcaauauuacucuuccagaggaaacugcuaccaguuccgguagggaaguguuuucuagaaccgaaucaaccaagaguagcagccgcuuuaccaagugcucaaagauucagauugaugcaagaauuaaaccauuuaagggugaugacucuagcagacaaacgcgaaagaccuuuaucuuuucaagagagaaaugauuuauuagcgcagcuaguagcuagaccaaaaugcggauuugauauguuaagaaaaauaguauuuggggcuaauaaagaagcauaucguuuuacgaucgagagcgaaagaagaaaagaguuaaaaggaugcgauacggcagccaaauuagcaaaagucaaugcuuuagguacaagauggcaagcauuaucauuagaugaacaagauagguuaguuugucuauuauuggacggagaaaaugaugcaguacuggcagaugcacuacgagaacacuauggucucacggaugcacaaauugauacacuucuaggauugucauuugaggauggacauaugaggcuugggagaucagcacuucuaagaguuuuagaugccuuagaaucggguagagaugaacagggauuaccacuaagcuacgauaaagcugugguugcggcaggauauccagcccauacugcagaucuagaaaauggcgaaagggaugcacuaccauacuacggagaauuauuauggagauauacucaagaugcaccaacagccaaaaaugacgcagaaagaaaauucgguaaaauagcaaacccaaccguacauauaggauugaaucaacugagaaaauugguaaacgcauuaauacaaagauauggcaaaccugcacaaaucguuguugaacuagcacgaaaucugaaggcuggccuggaagaaaaggagagaauaaagaaacaacaaacagcgaaucuggaaagaaaugaaagaauaagacaaaaacuucaggacgcuggaguaccggauaauagagaaaaucgauuaagaaugagauuauucgaagaacucggacaaggcaaugguuuaggaacaccauguauauacaguggaagacaaauaagccuacagagacuguuuucaaacgauguacagguagaucauauauuaccauucaguaaaacacuagaugauucuuucgccaauaagguauuagcacaacacgaugccaaucguuauaaaggaaaucgagguccuuuugaggcuuuuggagcuaauagagacggauaugcuugggaugauauucgagcaagagccgcaguauuaccacggaauaaacgaaauagauuugcugaaacagcgaugcaagauugguugcauaacgaaacagacuuucuagcaagacaauugacagacaccgcguaucuuucaaggguggcaagacaguaucucacugcaauuugcucuaaagaugacguuuauguaucuccaggacgacuaacagcuaugcuccgggccaaaugggggcucaacagaguguuagauggaguaauggaagaacaaggacgaccugcugugaaaaauagagacgaccacagacaccaugcuauagaugcaguaguaauaggugcaacagauagagcaaugcuccagcaagucgcaacccuggcugcuagagcacgugaacaggaugcagaaagauugauaggagauaugccgacgccuuggccaaauuuucuagaagauguuagagcagcaguagcaagaugugugguaagucauaaaccagaucauggaccagaagguggauuacauaaugauacggcauacggcauaguagcugguccauuugaagauggacgauacagagucagacauagagucucccuguuugaccuaaaaccgggagaccuuuccaacgugaggugcgaugccccacuccaagcagaauuagagcccauauuugagcaagacgacgcccgagcaagagaaguagcauuaacggccuuagcggaacguuauagacaaagaaaaguauggcucgaagaacuuaugucaguucuaccaauacgaccaaggggagaagacgggaagacauugccugauuccgcuccauauaaggcuuacaaaggagauuccaauuauuguuacgaacuuuuuauaaacgaaagaggcagaugggacggagaacuuauuucgacguuucgagcaaaucaagcugcauaucguagauuccgaaaugauccugccagauuuagaagguacacagcgggagggcgacccuuauuaaugcgauuauguauuaaugauuauaucgcaguagggacagcagcugagaggacaauauuuagaguuguuaaaaugagugaaaauaaaauaacucuugcagaacauuucgaaggagguaccuugaagcaaagagaugccgauaaagaugauccauuuaaauaucuaaccaaaucacccggcgccuuaagggaucuaggagcucgaaggaucuuuguagauuuaauaggucguguacucgacccugguauuaaaggagauuga

SEQ ID NO: 8464 - RNA, 3189 nt, Artificial Sequence
  Cas9 variant
augaauuuaaauuacauucuuggauuagaucuaggcauagcaaguguaggaugggcaguggucgaaauagacgaacaagaaaauccacaaagacuuauagauguggguguccguacuuuugacagagcagaagucuuaaagaccggagagagcuuggcgcucgcaagacgucuugcacgaagcucaagaagacuuguaaaaagacgagcagaaagaaucaagaaagcaaaacgauuacuaaaagcagaaaaccuucuauugagugcagaugaaaucuuaccaaacgaagcauggcagcuaagaguaaaaggacuagaucaaaaauuagaaaggcaagaaugggcagcaguucuauuacaucuauuaaagcauagaggauauuuaagucaaagaaagaaugagagcaaaucagaaaauaaagaauugggagcauuacuuagcgguguagcaauaaaucaccaaauauuacaauccgcagaguacagaaccccagccgagauagccguaaacaaauuucaagccgaggaagggcauauaagaaaucaaaggggagcauacacucauacauuuucaagacuagaccuauuagccgaaauggaacuucuauuucaaaggcaggccacacucggaaacccccacacaucaacaaaauuauuggaaaaucuaacagcacuuuuaauguggcaaaaaccagcacuugcaggagaagcaauauuaaaaaugcuaggaaaauguacauuugaaccaacagaauauaaagcugccaaaaauaguuauagugccgagagauuuguguggcuaacaaaauuaaacaaucuccggauacuugaacaaggagccgaaagagcauuaacugauaacgaaagguuugcccuacuagaccaaccauaugagaaagcaaaacucacauacgcgcaaguacgaaccuuacuaggacucucugacgaagcaauuuucaaaggacugagguaucaaggugaagauaagaaagcaguagaaacaaaaacaacgcuaauggaaguaaaggcuuaccaucaaauaagaaaagcgcuugaaggacucgauuuaaaagccgaauggaaugaacucaaaaauaaccccgcauuauuagaugaaauagguacugcauuuucacucuauaaaacagaugacgauauacaucgauauuuagacggaaaauuaucugaaucaguacuuaaugcguuacuugaaaaccuuaauuuugauaaauucauacaacuaucacugaaagcccuacaacaaauccuaccauugaugcuacagggacagagguaugacgaagcugucagugcaauauacggagaucauuacggaaagaaaucggaugaaauugaucgauuacuaccaaacauaccaacggacgaaauaagaaaucccguuguauuacgaaccuuaacacaggcuagaaaaguaauuaacgccguuguacgucuuuacggaucaccagcuagaauacacauagaaacaggaagggaagugggaaaaagcuaucaagacagaaagaaauuagaaaaacaacaagaagaaaacagaaaacaaagagaaaaugcagugaagaaauuuaaagaauacuuccccaauuucguaggggaaccuaaaggcaaagauauacuaaaaaugcgacuauaugaauuacaacaagccaaaugucucuacucuggaaaaagucuagaauuauauagacuauuagaaaaaggauacguagaggucgaucaugcucuacccuucuccagaacaugggaugauuccuucaauaacaaaguacucguuuuagccaacgaaaaccaaaauaaaggaaacgcaacaccauaugaauggcuagacgggaaaaauaauucugaaggauggcaacauuuugucgcgagaguccaaaccagcggauuuucauacgcuaagaaacaacgaguauuaauacaagaacuagaugagaaaucguucauagagagaaauuuaaaugauacuagauauguugcacgauuucuuuguaaccauauagcagauaacaugcuacuuacagguaaagggaaaagaaaaguguuugcaaguaacggccaaauaacagcacuacuacgaggaugcugggggcuccaaaaaguaagggaaaacaacgaucgacaucaugcucucgaugccguaguagucgccugcucgacaaaaagcaugcaagacaaaauaacuaaauuuguaaaauauaaagaagggagacuauuuaaagacaagaaagacggcguauauaaaggagaaagaauaaauagggaaacaggcgaaauuauaucccuacacuuccccacaccauggaaauucuucaaagaaaacguggaaauacguauauuuagugaaaauccgaaacuagaauuagaaaaucgauuaccagauuauccucaauauaaccacgaauuuguacaaccauuauuuguauccagaaugccgacaaggaaaaugacuggacaaggccacauggaaacagugaaaucggcaaaaagauuagacaaaggacugaguguacuaaaaguuccacuaacacaauuaaaacuaucagaucucgaaaggaugguaaauagagaaagagaaauggcucuauacgaagcacucaaagaauguuuagaacaauucggaaacgaccccgcaaaagcauucgccgaaccauucuacaagaaaggaggugcccuaguaaaagcugucagaguagagcaaacacagaaaagcggagugcuaguaagaaauggaaacggaguagcggacaacgcaacagguaguauaguuagaguagacguguucacaaaaggagguaaauacuuuuuaguccccauauauacauggcaaguugcaaaagggauucuaccuaacaaagcaguaauacaaggaaaagaugaaucagagugggaagagauggaugaaaaugcuguguuucaauuuagcaugcauaaaaaugauuuaauaaaagucaaaacaaagaaaggagagauuuuuggauacuuuaaugguuuagaccgcgccacagggaguauugaaaucgaggaacacgaucuagagaaaucuaaagguaaaaauggaagccacaggggacuaggaguaaaaacugcauucuuucuagagaaauaucaaguagaugaacuaggcaaaaacauaagaccaugcagaccaacgaaacgacaacauguacguuga

SEQ ID NO: 8465 - RNA, 3192 nt, Artificial Sequence
  Cas9 variant
auggaaaaucacauaaauuaucgacuaggacuugauauuggaauagccucaguaggauggagugugauaaaccuagacaagaaaagaaucgaagaccuagguguaagaaucuuuaacgcggcagaacacccaaaagacggaucaagucuagcauuacccagaaggauagcacgagggagaagaagauuacuaagaagaaaagcauaccgaguaaaacgcguccgaaaacuaauaguugacuauaacauuuuaaccaaagaccaacucaacgauuuauuuaaacaaaaaugccaaaacagcguaugggaaauaagaguuaaagcacuagacaacaaagucacaaacgaagagugggcucgacucuuaauuaaccuauguaaaagaagaggauucaaaagcaauaggaaaaacgaggcagacgauaaagaaacaaagaaagucauuaauagcauuaaaucaaauaucaaaggcaugaaagaaaguggaagccgaacaauaggagaauauauauauacgcaaacauuaaguucaggagauauuucuaaaaguuuuagaaauaaagacggacaauacaauaauuguguaagucgcaaaaugauagaagaagaaauaaaaauacuauuuaagaaacaaagagaauuaggaugcgaguucgcaagugaagaaauagaagaaaaauauuuagcaauauucaacagucaacgccccuucagcaaauucgaagaccuugagaaaaugguagguuuuugcacguuugaaaaagcaagcaaagaaagacgagcuccaaaaugcucaauuagcgcagaagaguucguucuguaugauaacaugaacaaauuaagcauacuuaauaaaggagacacuaggaaauuaacaaaugaagaacgaaaaauuauuguugaaaacgcuuuuaaaaauaaagaaauaaaauauagcaaacuacguaaaauucuaaaccugaguaacgacgaaagauuuagcaccuuaucguauaguaacaaaacagaauuaucaaaaacagaaaauucaaaauuuguugcccuaaaaggguaccacgaaauaaaaagcgcaauagaaaaaucauucggaaaagauacguggaauagagucaaaaacaaccggacaaugcuaaacgacauagcauacguccuaucaauagcaaaaacagaugaagacauaauaaagcaauuaagccuaagaaacauaccgagagaaaucauagacgcaguacuaggccuuucauuuucaaaauucucaaaucuaucgaucaaagcaauugagaaaauacuaccauauuuaaaagacggacaacaauauaacgaagcgugcaaaagugcaggauacgauuuuaaggccacauauaacggagaaaaaucguacaaacucccccucauagacauugacgaaauuguaaacccaguaguaaacagagcacuuucacaaacaagaaaaguuauaaaugcuguaauagaucgguacggaagcccaauaggaauaaacauagaacuggcaagagauuuggccaaaaacuucaaagauagaucaaaaaucaaaaaggaacaagaagaaaacagagccaacaaagaaaagaucaaaaaugaauuaaaaauguuaaugaauaaagaaccgacaucgucugaaauauuaaaauauagauuauggaaggaacaacgagaagaaugugcauauagccaggaaagaauauacauagaagacuuauucaaaguaggccaauacgaaauagaucauauaauaccauuuucaagaucuuucgaugauaguuuaaacaacaaaguauuagucaaagcagccgaaaaccaaaggaaagcuaacagaauacccuaugaauacuucggauccgacgaagaccgaugguacagguucgaagucuggguagaacaguccagcuuaucauucaaaaagaaaaacaaccugcuuaagaaaagauuuaguagagaagacucuaucgaauuuaaagacagaaacuuaguagacacccaauauauaucaagauacauaaguaacuucauaaaaucaaggcuaaucuucaaagaaucagacuccaaacaaaaaguaauaacaauaaauggaagggcgacaagcuauuuaagagcaaaauggggacuccuuaaaguaagagaaaacggggacaaacaccaugcccuagacgcaaccguaauugcaguugccacacaaggcaugguucaggaaauuucuaaauauucaaaagcgcacgaacuaaaauacaucaggcaaggagacgaguuuauagauauagaaacuggagaaauaguaaaagucaaagaccauaaacaccuaucuaaagacagguuaccagaaccauggcuaggcuucagcucggagcugaggcugagauuaagcgaaaauccuaucgaagaauugaagaaaucucccauuuccacuuacgaugaagaauuuauaagaaaaacaguaagaccaauuuucguaucccgaguuccauaccguaaaguuacaggucgacuauuugaagaaacaguauauucuccaaaagcauucauugaugaagguuuuauagccaaaaagaaacuacaagacuuaacacucaaagauuucgaaaauauauacaacuacaauucagauaagaaauuauaugaugcauugagagaaagauuagaagaauacggugggaaugcaaagaaagcauucgccgaagaauuuagaaaaccaacaaaaacaggcaaauuagggccaauuguaaaaaguauaaaagucaaaacaaaaaucccauucaaagacggaauugaccuaaacggagguaaagucaagaaagacgguuuaguuagaaucgacauauacgaaaaagaaggaaaauacuacgucguaccuguguacagguuagacauacaacaaggaaauauacccaagaaagccgcaguagcaaauaaagaagaaaaagacuggauccuaauggaugagaguuauaacuucaaauucucuuuauacaaaaacgaucuuauauauauaaaauaugacucuaaaggggaauauuuugguuacuacgacggcuuugaccgacauacgggcgcgauaacccuagaaagacaugauaauuccgagagauacaggggaaucgggaucaaaacagggguaaaagaaauauucaaguacaacguugauguuuuaggaagguauuacaaaguagcaaaauga

SEQ ID NO: 8466 - RNA, 3192 nt, Artificial Sequence
  Cas9 variant
auggaaaaauuucauuaugucuuagggcuggaccuaggaaucgccagugugggcugggcugcuauagaaauagacaaagaaaccgaaacauccauagguuuacuagacugugguguaagaacguuugaacgcgcagaaguuccgaaaacaggagauucucuagccaaagcaagacgagaagcaagaucuaccagaagauuaauaaggaggagaucacaccgacucuuaagauuaaaaagauuauuaaaacgagaaaucuuucgccaaccagaaacauuuaaggaucuaccaauuaaugcuuggcaacuaagaguaaaaggauuagauucuagacucaacgaguaugaaugggcagcagucuuacugcaccuaguaaaacacagaggauaccuaagccaacgcaaaucagaaaugucugaaacugacuccaaaucagaaaugggucgacuuuuagccggaguagcugaaaaccaucaacuauuacagcaagaacaauacagaacgccugccgaauuagcucucaaaaaguuuguaaaacacuuucgaaacaaagggggagauuacgcucauacauuuaaucgucuagacuugcaagcagaacuacacuuauuauuccaaaaacaaagagaacuagguaauccauucacaagccccgaacuagaaagacaaguagaugaccuucuaaugacacagagaucggccuugcaaggugacgcgauacucaaaauguuaggucacugcgguuuugaaccagaacaauucaaagcagcuaaaaauacauucagcgcagaaagauucauauggcuaacaaaacuaaacaaucuuagaauacaagaucaagggaaagaaagagcguuaaccgcagacgaacgaacaaaacuacuagaugaaccuuauaagaaauccaaacucacauacgcucaaguaagaaaacucuuaagucuuccucaaacagcaauauucaagggauuaagauaugaucuagaacaugauaagaaagcagaaaacaguacacuuauggaaaugaaaucauaucacaauauucgacagacguuagaaaaaucaggcuuaaaaaccgaauggcagucaaucgcuacacaaccagaaauauuggacgcaauaggaacggcauucucaauauauaaaacagaugaagauauuucucaugaacugaaaacauguagauuaccugaaaauguacuaaacgaauuacuuaaaaacauaaacuuugacggauuuauucagcuaucguuaacagcacuaaggaaaaucuuaccauuaauggaacaaggauaucgauaugaugaagcaugcacacaaauauauggaaaccaucauucgggaucacuacagcaagaaaguaaacaauucuugccucauauaccaauugaugauguccggaaccccguagucuuuaggacacuaacacaagcaagaaaaguuguaaacgcaauuauacgaagguauggaucaccggcaagaguacacaucgaaauggcucgagaauuaggcaaaagcaagucggaccgagaucgcauagaaaaacaacaacagaaaaacaagaaagaacgagaaaaugcaguagcaaaauuuaaagaagacuuuccagauuuuguaggugagccccgaggaaaagacauacugaaaaugagacucuaugaacaacaacacggcaaaugucuauauaguggacaugauauagauauaaaccgcuuaaaugaaaaaggauacguagaaauagaucaugcccuaccauuuucuaggaccugggaugacucacaaaacaauaagguauuaguacuaggaucagaaaaucaaaacaaaagaaaucaaacuccggaugaauacuuggacggagcaaacaauucccaacgauggcuagaauuucaagcaagaguacaaacaugucacuuuagcuauggcaagaaacaaagaauccagcuugcuaaacuugacgaugaaacggaaaaaggcuuccuagaaagaaaccuaaacgauacucgcuacauagcucgcuucaugugccaauucguccaagaaaauuuauaucuaacaggaaagggcaaacguuuaguauuugcaucaaacgguggaaugacagccacauuacgcaaccuauggggacuacgaaaaguuagagaagauaaugacagacaucaugcucucgaugcuauaguuguagcaugcuccacugcaucgaugcaacagaaaauuaccaaagccuuccaacgacaugaauccaucgaauauguagauacagaaacaggagaagucaaauuccguauaccacaaccaugggacuucuuuagacaagaaguaaugauacgcguauuuucagaucaaccaugugaagauuuagucgaaaaacuuagugcacgaccugaagcucuacaugacaacgucacaccccucuuuguaucaagagcacccaaucgaaaaaugaguggacaaggccaucucgaaacaauaaaaucagcaaaaagguuaucagaagaaaauuccauggucaagaaaccccuuacaacuuuaaaacuaaaagauauaccugaaauaguaggguacccaucuagagaaccccaacuauaugcagcauuaaaaacaagacucgaaacgcaugacgaugaucccauaaaagcauucgcuaaaccauuuuauaaacccaacaaaaauggggaacuaggcgcucuaguccgaucgguuagaguuaaagguguacaaaacacuggcgugaugguacaugacggaaaaggcauugcagauaaugcaacaauggugagagucgauguuuacacaaaagccgguaaaaacuaccuuguaccaguauauguauggcaaguagcacaaggaaucuuacccaaccgagcaguaacaaguggaaaaucagaagcagauugggacuuaauagaugaaaguuuugaauuuaaauuuucacuaaguagaggagacuuggucgaaaugauaucaaacaaaggacgaauauuuggauauuacaauggauuagauagagcaaacggaaguauuggcauucgcgaacaugaccuagagaaaagcaaaggaaaagacggaguccaucgugucggaguaaaaaccgcuacagcauuuaauaaguaccaugucgauccacuuggaaaggaaauucacagaugcaguagugaaccaagaccaacauuaaaaauuaaaaguaagaaauga

SEQ ID NO: 8467 - RNA, 3192 nt, Artificial Sequence
  Cas9 variant
auggaaaaggacuauaucuuaggauuagauaucggaauaggcucaguaggauacggacuaauugacuaugacacaaaaucaauaauagaugcaggaguaagauuauucccagaagcgaaugcagacaacaauuuaggaagaagagccaagaggggugcgaggagauuaaaacgacguagaauacaccgacuagaacguguuaagucacucuuaucagaauauaaaaucauuagcggcuuagcuccaacaaauaaccaaccauacaacauacgagucaaaggcuuaacagaacaacuaaccaaagacgaacuggcaguggcacuauuacacaucgcuaaaaggaggggaauacacaaugucgacguugcagcagacaaagaagaaacugcaucagacucacuuucuacaaaagaccaaaucaacaaaaacgccaaauuccuagaaucccgauauguaugcgaacuucagaaagagagacuagaaaacgaaggacauguacguggugucgaaaaccgcuuccucaccaaggauauaguucgcgaggcaaaaaaaauaaucgauacacaaaugcaauauuauccagaaauagaugaaacauucaaagaaaaauacauaucauuaguugaaacaagacgagaauacuacgaaggaccagguaaaggaucaccauacggaugggacgcagacgucaaaaaaugguaucaauuaaugaugggacacugcacuuacuucccaguagaauuucgaagugugaaauacgcauauacagcagaucuauacaaugcucuaaacgauuuaaacaaccuuacaauagccagagacgacaauccaaaacuagaauaucacgaaaaauaccacauaauugaaaacgucuucaaacaaaaaagaaacccaacccugaaacaaauagcaaaagaaaucggcguaaaugacauuaacauaucaggauacagaguuacuaagucaggaaagccacaauuuaccaguuuuaaacucuuucacgaucucaaaaaaguagucaaagaucaugcaauauuagacgauaucgaccuauuaaaucaaaucgcagagauauuaacaauauaccaagacaaagacaguaucguagcagaacuuggucaacuagaauaucuaaugagcgaagcagacaaacaaucaauuagcgaacucacugguuacacagguacccauagccugagcuuaaaguguaugaacaugauaauagaugaauuauggcacagcaguaugaaucaaauggaaguguucacauacuuaaacaugcgaccuaaaaaauacgaacucaaaggcuaccagagaaucccaacagacaugauugaugacgcaaucuugagucccguaguaaaaagaaguuuuaaacaagcaauaggaguaguaaacgcaauuauaaaaaaauauggcuuacccaaagacauaaucaucgaacuagcaagagaaaguaacucugcagaaaaaucaagauacuuaagagcaauucaaaaaaaaaaugaaaaaacacgagaaagaauagaagcaaucauaaaagaauacgggaaugagaacgccaaagggcuaguacaaaaaauaaaacuacacgacgcgcaagaaggaaaaugccuauacaguuuaaaagauauaccccucgaagacuugcuuaggaacccaaauaacuacgacauagaccacauuaucccacgaagcguuucauuugaugacagcaugcacaauaaaguccuuguacgcagagaacaaaacgccaaaaaaaacaaccaaacgccauaccaguacuugacaucaggcuaugcagacauaaaguauagcgucuucaaacaacauguacuaaauuuggcagaaaacaaagacagaaugacaaaaaaaaagcgagaauaccuuuuagaagaaagaaacaucaacaaauacgauguccaaaaagaauucauaaacagaaacuuaguugauacuagauacacaacccgagaacuaaccacauuacucaaaacauauuucacuauaaacaacuuagacguaaaagucaaaacgauaaacggaucauucacagauuuccuaagaaaaagauggggauucaagaaaaacagagaugaaggguauaaacaucaugccgaagacgcauuaauuaucgcaaaugcagacuacuuauucaaagaacacaaacuacucaaagaaauaaaggacguaagcgaccuagcaggagaugaaagaaacucaaacguaaaagaugaagaccaauaugaagaaguauuugguggauacuucaaaauagaagacaucaaaaaauauaaaaucaaaaaauuuagccacagaguagacaaaaagccaaauaggcaauuaaucaacgacacuauauacucaaccagaguuaaagaugacaaacgcuacuuaauaaauacccuaaaaaacuuguaugauaaaucaaacggagacuuaaaagaaagaaugcaaaaagaccccgaaucauuacuuauguaucaccacgauccacaaacuuucgaaaaacuaaagauaguaaugucgcaguaugaaaacgagaaaaacccacucgccaaauacuuugaggaaaccggacaauaucucacaaaauacgcaaaacacgauaacggacccgcgauucauaaaauaaaauacuacggaaacaaacuagucgaacaucuagacauaacaaaaaacuaucacaauccacaaaacaaaguaguacaacuaagucagaaaucauucagauucgauguauaucaaacugauaaaggauacaaauucaucagcauagcauacuuaacuuuaaaaaaugaaaaaaauuacuaugcaaucucacaggaaaaauaugaucaauuaaaaucagaaaagaagauauccaacaacgcagucuucauaggaucuuucuauaccagcgauauaauagaaauaaauaacgaaaaauuucgagucauagggguuaacucagauaaaaacaaccuaauagaaguagaucgaaucgacaucagacaaaaagaauucauagaacuagaagaagaaaaacaagugaauuacaugaacucagacucauauuuaaaaaauaauagaauaaaagugacuauagggagaaaaacaacaaauauugaaaaauuucauacagacauauuagggaacauguacaaaucaaaaagacccaaagcaccacaauuaguauucaaaaaaggcuga

SEQ ID NO: 8468 - RNA, 3195 nt, Artificial Sequence
  Cas9 variant
augucugaauguguuacaaggaggauuuuaggaauagaucuaggcauagcaagcugcgguuggggcguuauugaaguaggagaagcaaguggcaguaucauagcuagcggcguaagauguuucgaugcaccuuuaaucgauaaaacgggagaaccaaaaucagcgacuagaagaacagccagaggucaaagaagaauaauuagaaggagacgacaaagaaugaacgcaguaagacguuuacuagcagaguucggcguauuaacaggaagaucaccagaugcauuacaucaagcauuauugcgccuuucgcaaaguguagcaggaagucaaguuacgccuuggacauuaagagcagcagcucaugaacgaaaacuaacaaaugacgaauuggcaguaguacuaggacauauagcaagacauaggggauuuagaagcaauagcaaaaaugauggaggagcaaaugccgcagaugaaacaaguaaaaugaagaaagcaauggaaacuacaagagagggauuagccagauaucacagcuucggagcaaugaucgcauccgacccuaaauucgcggauagaaaacguaauagagauaaagacuauagucacacagcuaaaagguccgacuuagaagaugaaguaagaacaauauuuagaucacaaacuagguucgguagccucguagcuagugaaaaacuaucacaagccuucgcagaugcugcuuucuuucaaagaccucuacaggacagugaagauaugguaggaaguugucccuuugaaccuggucagaaaagaacagcucggagagcaccaucuuuugaauuauuuagauuucuaucaagacuugcaaaucuaaaauuaaccguagguagagcaccagaaagaagauuaacacccgaugaaaucgcucuugcagcgaaaggauuuggagaaacaaagaaaaguaucacuuuuaaaucauuaagggaggcuuuagaucucgaucccaacgcucgauucucaggaguagcaaaagaaaaagaaaguacacuagauguagcagcaagaacaggaggagcugcauauggaacaaaaacacugaaagaugcauuaggugacgcaccuuggagaucauuaucgaggaugcccgaaaaacucgauagaaucgcugaaauauugagcuuuagagaggauaugaaagcaauaagaaauggauuagaagaaguaggucuugaugggcuaguaguagacgcuuuaaugcaagcuacagcaaacggagauuucaaagauuuuacaagggcagcgcauauuucggcauuggccgcgagaaauauuauucccggacuaagagaaggucugguauauucagaugcuuguacucgagucggauaugaucaugccgcaagacccgcaguuccacuaagccaaauaggaaguccaguaacgagaaaagcacuaucugaagcacuaaaacaagugcgcgcaguagccagagaauauggaccaauagauuauuuucauaucgaacuagccagaucuauuggaaaauccgcagaggaacggaagaaacucacagacgggauagaagcaagaaauguggaaaaagagaaacggaggaaagaagcggcagaacaccuagguagagcacccagugacgaugaauuacuacgcuaugaacuagcaaaagagcaaaacuuuaaaugcauauauaguggagacccgauagauccagcgggaauuagugccaaugauacacgauaucagguagaucacauauuaccuuggucaagauuuggagaugauucuuacgucaauaaaacuuuguguaccgcaagaaguaaucaaaacaaaagaggaagaacgccauucgaaugguucgaugcagacaaaacagaggcagaauggauggaauauucagcuagaguagaagaucuaaaagaaguaaaaggcagaaagaaaagaaacuauucaaucaaagaugcagcgagcguggaagacaaauucaaagcaagaaauuugaccgauacacaaugggcaacuaggcuauuagcagaugaauugaaacggauguuuccaccccgagaaugugaaagaguuguaacaguacgagcugauggaggaaaugacggccuaagcauuguagaggaaaggagaguauuuacuaggccaggagcaaucacgaguaaauuaaggcgagccuggggacucgaaggacuuaagaaacaagauggaaaacguguagaagacgauaggcaucaugcuguagacgcauuaguuuuagcggcuacaacagagucgcuacugaauaggcuaacuguggaaguacaacaacgagaacgagagggcagacaagaugauauauuucauugcagucaaccauggccagguuuuagagucgauguucaaagaacaguuuauggaagugaaacgaugccaggcauauucguauccagagccgaaagacgacgagcacguggaaaagcccaugaugccacuguuaaacaaauacgggauauagacggcgaaagaauagucuuugagagaaaaccuauagaaaaauuaacagauaaagauuuagaacgaauccccguaccugaaccauacggaaaagccgcugauccgaagaaacuaagagaugaauuaguagaaaacuuacgcgcauggauugcggcagggaaaccaaaagauaaaccaccuagaucacccaaaggggauauuauaagaaaaguaaggauagaaacgaaggauaaagucgcuguagagauaaacggaggaacuguugauagaggugauauggcgagaguagacguauuccgaaagaaaaauaagaaaggaguuugggaauuuuacguaauaccaauauauccacaucaaauaguagccuccgcuuuaccgccuaaccgggcgguuauagcauauaaagcagaaucagaauggacggccaucgauggaugcuucgaauuugcauggaguuuaaacccaaugucauacuuagaacucguaaaaaguaauggcgaacuaauagaaggguauuuuagaaguauggauaggacaacaggagccauuaauuuaucacccaugucuacaaauucagaaacaaucaggaguauaggaguuaaaacuuuaaguagcuucagaaaauuuacuguugauaggcugggucguaaauuugagauaccacgagaaguaagaacauggagaggugaagcaugcacauga

SEQ ID NO: 8469 - RNA, 3195 nt, Artificial Sequence
  Cas9 variant
augaaacgcacaagccuuagagcauauagauuaggaguagauuuaggcgccaauaguuuggguugguuugucguuugguuggaugaccacgggcaacccgaaggauuaggaccaggaggaguaagaauauuuccagacggcagaaauccgcaaaguaaacaaaguaaugcagcgggacgcagauuagcgagaagcgcaagaagaagaagagauagauacuuacaaagaagagggaaauuaaugggucuauugguaaaacacggacuaaugccggcggacgaaccugcacgaaaacgauuagaaugccuugauccauacggauuacgagcaaaggcauuagaugaaguguuaccgcuucaccauguagguagagcucuguuccaucuaaaccaaagacgcggacuuuuugcaaauagagcgauugaacaaggagauaaggaugcgucagcaauuaaagcugcggcaggacgauuacagaccagcaugcaagcguguggagcaagaacuuuaggagaguuuuuaaacaggagacaucaauugagagcgacaguaagagcaaggucaccaguagguggcgauguccaagccagauaugaauuuuauccaacgcgcgcuaugguggaugcugaguucgaagcaauaugggcagcacaagcaccacaccauccaacaaugacagcagaagcacaugacacuaucagagaagccauuuucagucagagagcaaugaaaaggccaaguauagguaaaugcucauuagacccugcaacaagucaagacgauguagacgguuucagaugcgcuuggagccacccguuagcacaaagauucagaauuuggcaggauguaagaaaccuagccgucguggaaaccggaccaaccucaagucgacuaggaaaagaagaucaagauaaaguugccagagcguuacuccagacagaucagcuuagcuuugaugaaaucagaggauuauuagggcugccaucagaugcuagauuuaauuuagaaagcgauagaagggaccaccucaaaggagaugcaacaggggcaaucuuaucagcaagaagacacuuuggcccggccuggcaugauagaucauuggauagacaaauugauauuguagcauuauuggaauccgcacuagaugaagcagcaauaauugcaucucuaggaacuacucacaguuuagaugaagcagcagcacaaagggcauuaagugcacuacuaccugauggauacugccgauugggcuuaagggcaauuaaaagaguauuaccacuuauggaggcaggaagaacuuaugcagaagcagcaucagcugcugguuaugaucaugcucuccuaccuggaggcaaguuguccccgacaggauauuuacccuauuauggacaauggcuacaaaaugacguaguaggaagugaugaugaaagagauaccaaugaaagaagauggggaagacucccuaauccuacuguacauaucggaauuggacaauuaaggagaguugucaaugaauugauaagauggcaugggccaccagcagaaaucacaguagaacuaacaagggaucuuaaacuaaguccgagaagauuagcggaacuagaaagggaacaagcugagaaccaaagaaagaacgacaaacgaacgaguuuauuaagaaaauuaggauugcccgccucaacucauaacuuacuuaaacuucgccuuugggaugaacagggcgacguagcuagugaauguccuuauacaggugaagcaauaggacuggaaagauuggucucagaugacguagauauagaucaccuaauuccauuuucaauaaguugggaugauucugcagcuaauaaaguaguauguaugcgauaugcgaacagagagaaaggaaacagaacaccuuuugaagccuuuggacauagacaagggcgacccuaugauugggcagauaucgcugaaagagcagcgagauuaccaagagguaaaagauggcgauucggaccuggugcgagagcacaauucgaagaauugggagauuuccaagcucgacuacucaaugaaacuucauggcuagcaagaguagcaaaacaauaucuagcagcaguaacacauccucauaggauccacguacuaccuggaagguuaacagcacuccuaagggcgacaugggaauuaaacgaccuucuaccuggaucugaugauagagcagcaaaaucaagaaaagaucacagacaccaugcaauugaugcucuaguugcugcauuaacugaccaggcauuauuaagaagaauggcgaacgcucaugaugacacaaggcguaaaauagagguucuucuuccauggccaacauuuaggauagaucuagaaacuagauuaaaagcaaugcucguaagucauaaaccagaucacggucuucaagcacgucuucaugaagacacugcauacggaacuguagaacauccagagacugaagacggagcaaaccucguuuauaggaagacuuuuguagacauuucagaaaaagagauagauagaauuagagaccguagguuacgagaucuagugcgagcucacguagccggugaaagacaacaaggcaaaacguugaaggcugcagucuuaucauuugcucagagacgagauauugcugggcauccaaacggaauccgccauguccgcuuaaccaaaagcauuaaaccagauuaucuggugccaauaagggauaaagcaggucgaauauauaaaucuuauaaugcaggagaaaaugcauucguagacauacuccaggcagaaucaggcagauggauagcuagggcaacaacaguauuucaagcaaaucaagcaaaugagagucaugaugcaccagcagcacagccuauaaugcgaguauuuaagggugacauguuaaggaucgaucaugcaggcgcagaaaaauuugucaaaauuguaaggcuuucaccaucgaauaauuuacuauaucuaguagaacaucaucaagcaggaguauuccaaacuagacacgaugauccagaagauucauucagguggcuauuugcuucuuuugauaaguuacgagaauggaacgcagagcuaguucguauugacacgcucggacagccauggagaagaaaaagaggacuagaaacagggagugaagacgcuacacgaauaggguggacgagaccgaagaaguggccauga

SEQ ID NO: 8470 - RNA, 3198 nt, Artificial Sequence
  Cas9 variant
augaauaaagauauaaauuacgcacucggucuagauauuggaauaaccaguguuggaugggcagugauaaaucuagaccuaaacagaauugaagaucuaggaguacgcauauuuaacgccgcggaaaaccuaaaagacggaucaaguuuagcguugccaagaaggcuggcaagaggaagacgaagauuauuaagaagaaaagcauaucgaguagaaagaguaagaaaacuaauacuuaaaaacaauauacuaacaaaagaagaacuagagggccuguucaaaaacaaagaaguaaucgaugucugggaagcaagaguuaaaggcuuagauuacaaacuaucaagagaagagugggcaaaaauacugaucaacuuuugcaaaagaaggggauucaaaagcaauaggaagaacgaagcaaaggauaaagaagcagggcaaauauuaagcagcauaucauacaacauagagaaaaugaaggaaacaaauuccagaacgauaggugaauauauauacaaugaaguuaaaaacagugaagacucauaugcgccacuaagaaauaaauuuggcgaauauaaaaugugcguaucaagggauguuauccgagaagaaauacauacacuuuuugaaaaacaacgggaauuaggaaauaauuuugcaucggaugaaauugaagauaaauauuuugaaauauuuaauucacaacgcccauuuucgaauuuugaagaucuggaaaaauuagucggauucuguacauucgaacguaaaaagcacaaaagagcaccaaaacauuguauaagcagcgaagaguucacguuauaugaaggaauuaacaaguuaaguauaaucaaggauggcgagaaaagaaaauuaagcgaagaagaaagaacgcuaguaguaaacgaagcauuuaacaagaaagaaauaaaauauacaacacuaagaaaauuacuaggauuauccgaagaagaauuauuuucuacgcuaacauauaguaucgacaaagauauaucuaaaaccgaaaauacaaaauucguaucccuuaaaggauaccaugaaauaaaaagagcaauagaaaaaggaguuaguaagaaagcauggcaggacaucgagaauaauagaaaucuauuaaacgacauagcauacguauuaacacuaggaaaaaccgacgaugaaauugagaaacaacuaagacugaggaacgucccagaagaacuauuugagagcuuacuagauaugucauucaacaaauuuaauaaucuaucaauuuaugcccuggagaaaauacucccuuucaugaaagaaggguaccaauauaacgaagccugcgaaaaagcaggguauaacuucaaagcuauauacgaaggaguuagaacuaagaaacuaccuguaauagaaauagaugaaauaguaaacccagugguaaacagagcauuagcacaaacgagaaaaguaauaaauucuguuauagacaaauacggaagccccguaaggauuaauauagaacuagccagggaucuggcuaaaaauuuuaaagauaggaaacuaaucgaaaaagaacaaaaagaaaacagggcaaaucuagauaaaauacgagaaaaccuaagagaauuaauggauaaagaaccaaccguaguagaagugcucaaauauagacuaugggaacaacaaagaggugaaugugccuauacacaaagccaaauaccacuagaaagacuuuucaguccaggguacugugaaauagaucauauuauuccauuuucgcggaguuuugacgauucccuaaguaacaaaauucuaguacucggcagugaaaaucaaagaaaaggaaauagaacacccuacgaauauuuuggugaagauagcgaaagguggaacucauuugaaauaugggucaaagguucauaccuaaauuacaaaaagaaagccaacuuauuaaagaagaaauucagcgaagaagaacagagagacuggaaagcacggaauuuacaagacaccaaauauauaugcagauauauaaguaauuucgucaauaacagacuggaguuuaaagaaagugaaaauaaacaaaaaguaauaacagucaauggcagagcgacagccuaccuaagaagccguuggggauuaaacaaaguaagagaggacggagauaaacaucaugccuuagaugcagcagucgucggaguuacaacacaaggaaugguacagaaaauaaguaaauauucaaaagcacacgagcuauacacaguacgaaagaacgacgaguucguagauguagaaaccggagaaugcguggaugucgacgaauacaaagaaauacgaaaagacauccuccccagaccuuggcgaggauucagcgaagaacuaaaguugcgacuaagcgauaauccauuagaagaacuaaagaaaaguccuauagaaacauacaaugaagaguucauaaaagaaaacguaaaacccauauucguaucacgcguaccauucaggaaaauaagugguaaauuauuuaaggaaacaauauacagcgaaagggcauucaaagacggauauuuugucaguaaaaagagcuuagucgaucuuaaacgaggagauuuagauaauuucuauaauuaugaaugugacaagaaauuauaugaugcaauaucagaaagaaugaaagaguucaauuacaauggaaagaaagccuuugaaagcccauuuagaaaaccaacuaaaucagggaaagaaggaccgguaguacgaagcguaaaaaucaaaagcgcagucccauucaaagacgggauaccgaugaacgaaggucuaguagccaaagaaggaaugguaagaauagacauauacgaaaaagaaggaaaauacuucgucguuccaguguacagauaucaacuagcaaaaggaauaguaccgaaacgugccgcuauagcuaagaaagaugaacucaaauggcccauaauggaucaaacauacaauuucaaauuuagcauuuacaaaaacgaucuaaucgaaguaaaauaugauaagaaaggcguauauuucggauacuacgacgguuuugaccgcaauucggcuagucuuacaauagaaaaacaugauaacuccgaacgauaucguucaauagggcuaaaaguaggaguauuagaaaucaauaaauaugaaguagauguucuaggcaauuaccauaaaguaaaauuaggggguaauuga

SEQ ID NO: 8471 - RNA, 3198 nt, Artificial Sequence
  Cas9 variant
augaauaaagacauaaacuaugcguuaggauuagacauaggaaucacaagcguaggaugggcaguaauuaaccucgaccuaaaccgaaucgaagaucuaggcguuagaaucuucaacgcugccgagaacccaaaagaugguagcucauuagcacuaccaagaagacucgcacgaggcagacgccgucuauuacgccgaaaagcauacagaguagaacguguaagaaaauuaauaguuaaaaauaacauuuuaacaaaagaggaacucgaaggucuauuuaaaaacaaagaaguaauagauguaugggaagcuagaguuaaaggucuagacuacaaauugucucgcgaagaaugggcuaaaauccuuauuaacuucugcaaaagacgaggcuuuaaaaguaacagaaagaaugaaacaaaagacaaagaagcaggacaaauauuaucuucaauuaguuauaauauagagaaaaugaaagaaacuaacucuagaaccauaggagaauacauuuauaaugaagucaaaaauagcgacgacucauaugcacccuuacgaaauaaauucggagaauauaaaaugugcguuucaagagauguuuuacgagaagaaauacacacacuauucgaaaagcaacgugaacuagguaacaacuuugcauccgacgagauagaggauaaauauuucgagauauucaacucucaacgcccauucucaaacuuugaagaucuagagaaacucgucggauuuuguaccuucgaaagaaagaaacacaaacgagcuccuaaacauuguauaucuucagaggaauuuacacucuacgaaggaaucaauaaacucucaaucauaaaagauggagagaaaagaaaacuaagugaagaagaaagaacauuaguuguaaaugaagccuucaacaagaaagaaaucaaauacacaacacugagaaaauuauuaggccuuagcgaagaugaacuauuuucaacacugaccuacagcauagacaaagacaucagcaaaacugaaaauacaaaauucgucagcuuaaaaggauaucacgaaauaaaaagggcaauagaaaaaggugucucaaagaaagcauggcaagauauagaaaacaauagaaacuugcucaacgauauagcuuauguacuaacacuugggaaaacagaugaugaaaucgaaaaacaauuaagauugcgaaauguaccggaagaauuauucgaaucauuacucgauaugucauucagcaaauucaauaaccuaagcauuuaugcuuuagagaaaauacuaccauuuaugaaagaaggauaucaauauaacgaggcuugugaaaaagcaggauauaauuuuaaagccauauacgaagguguaagaacaaagaaauuaccgguaauugaaauagacgaaauagucaauccaguagucaaucgagcauuggcacaaacuagaaaaguaauaaauagcgucauugacaaauauggauccccgguucgcauaaacauagaauuagcaagagaucuugccaaaaacuuuaaagaucgaaaacugaucgaaaaagaacaaaaagaaaaccgagcaaauuuagauaaaaucagggaaaaccuaagagaacucauggacaaagaaccaacagcaguugaaguccuaaaauaccgcuuaugggaacaacaaagaggggaaugcgcauacacacagagccaaauagcuuuagaaagguuauucucacccggauacugugaaauagaccauaucauacccuuuucgagaucuuucgaugacagcuuaagcaauaaaauuuuaguacuuggcagcgaaaaucaacgaaaagggaacaaaauaccauaugaauauuuuggagaagauucagaaagauggaacucauucgaaaucuggguaaaaggcagcuacuuaaauuacaaaaagaaagcaaaucuacucaaaaagaaauucaccgaagaagaacaaagagacuggaaagcaagaaacuuacaagacacaaaauauauuugcagguacauauccaacuucgugaauaauagauuagaauuuaaagaaagugaaaacaaacaaaaagucaucaccguaaacggacgagcaacagcauauuuaagguccagauggggauuaaauaaaguuagagaggauggagauaaacaucaugcacuagaugcagcaguuguaggggucacaacccaaggaaugguacagaaaauaucaaaauauaguaaagcucacgaacuauacacaguaaggaaaaacgacgaguucguagacguagaaacaggagaauguguagacguagacgaauauaaagaaauuagaaaagauauacuaccaagaccauggagagguuuuagcgaagaacuuaaacuacgacuguccgauaauccucuugaagaauuaaagaaacuaccaauagaaacguacaacgaggaauuuauaaaagagaacguaaaacccauauuuguuucuagagucccguuuagaaaaauuagcggcaaauuauucaaagaaacaauauauagugaacgagcauucaaagauggauacuuuguaucaaagaaaagccucguagaucuuaaaagaggggaccuagauaacuucuacaacuaugaaugugauaagaaauuauacgaugcaauaagcgaaagaaugaaagaauuuaauuacaauggcaagaaagcauucgaaucaccauucagaaaacccacaaaaaguggcaaagaaggaccaguaguaagaucagugaaaauaaaaagugccgccccauucaaagacgggauaccgaugaacgaaggauuaguugcaaaagaagguauggucagaauagacauauaugaaaaagaaggaaaauacuuuguaguaccaguauacagguaccaauuagcaaaaggaauaguaccaaaaagggcugcaauagcagguaaaagcgaacuaaaauggccaauuauggaucaaacauacaauuuuaaauuuucaauauucaaaaaugaucuaauagaaauaaaauacgcaaagaaagauggcuauuuuggauacuaugaugguuucgaucggcacacagcaagucucgucauugaaaaccaugauaacagugaucgauauagaggaauagggguaaaaacagguguuguagaguucaacaaauacgaaguagauguccucggcaacuaucauaaagucaaccuugggggcaacuga

SEQ ID NO: 8472 - RNA, 3201 nt, Artificial Sequence
  Cas9 variant
augagugaaagaguagucagaagaauacuaggcauagaucuaggaauugccagcugcggauggggaguuguugauauuagcggugccggcggaggaauuauugcaacuggaguaagaugcuucgacgcuccauuaauugauaaaacaggagaacccaaaagcgcaacucgacgaacugcaaggggacaacgaaggauaguaagaagacgaagacaaaggaugaauggagugagacgacuacuaugugaguucggacuuuuaccagauccaagacccgacgcacuuaaccaggcaaugaggagaauuaguacagcauccgcagcagcucagguuacgccuuggacucuaagagcagcagcgcaucaaagguuauuaucaaacgaagaacuugcaguuguauuaggacacauugcaagacauagaggcuuucgaucuaaugcuaaaaacgaagcaggcgcaaaugcagcagacgaaacaaguaaaaugaaaaaggcaauggaagccacaagagaaggacuagcaaaauaucacgccuuuggagauaugauagcuaacgauccuaaauuugcaaauagaaagcgaaaucgggauaaagauuauagucacacagcuaaaagaucagaccuagaagaugaaguaagggcaauacuaagagcucaauuacgauucggaucagcagcggcaacagaaacauuagcacaaacauucgcggacguagcauucuuccaacggccacuccaagauucugaagacagaguuggagacugcccauuugaaccugggcagaaaagagcagcacgccgagccccuagcuucgaacucuuuagauucuuaucacgucuugcaaaucuaaagcuagcagugggaagaaguccagaaaggagacuaaccgcugaagaaaucgcacucgcugcaaaaggauuuggagagacuaaaaagacgauuaccuuuaaaagucuaagagaggcccuugacuuagacccaaacgccagauuuagugguauugguaaagauaaagaggcuuccuuagauguaguggcgagaacgggaggagcugcauacgguacaaagacacuaaaggaugcuuuaggagacgcuccauggcgaaguuuaagcagaacuccagagacacuagauagaauagcugaaauauugagcuucagagaagauaucacaucgauuagaaauggauuagaagacuuaggacuggauucguuagucguugaagcacucaugcaagcggcggcgaacggggauuuuaaagaguucacaagagcuggucauauaucagcacgagcugcaagaaacauaauacccggguuaagagaaggauuagucuacagugaagcaugugcacgaguaggauaugaccaugcugcacgauuaaguguaccacuugaccaaguuggaucgccagucacaagaaaagcacuaagugaagcucuaaagcaaguaagagccguggcaagagaauacggaccaauugacuacuuucacauagaacuagcaaggucaguugguaaaagcgcagaagaacgaaaacaauugacugacggaauagaagcgagaaaugucgaaaaggcaaaaaggagaaaacaagcagaagaacaucugggacgagcgccaagcgacgacgaguuauugagauaugaauuagcgaaagaacaaaauuuuaaauguauauacagcggagaugcaauagacccugcuggcguagcagcaaaugauacacgauaccaaguggaucauauauuacccuggagcagauuuggagaugacaguuauuuaaacaaaacauuauguacggcgagaagcaaucaaaacaagcgaggaagaaccccguuugagugguuugaggcugauaaaacggauguugaguggauggaguacgucgcacgaguugaaaaucugcaggaaguaaaaggaagaaagaaaagaaauuauucaauaaaagacgccgcagcuauugaagacaaguucaaagcuagaaacuuaacagauacccaaugggcuacuaggcuauuagcagaugaacuaagcaggauguuuccgccuagagaaugugaaagagcuauaugugguagagcagauggaggaaaugacggauuaacaauuguagaggaaagaagaguauuuacacgaccaggcgcaauaacgaguaaacugagacgagcaugggggcuggagggacuaaagaaacaagauggaaagagaguugaagaugauaggcaucaugcaguagaugcgcuaguauuagcagcaacuacagaaucauuguuacaaagguugacaguagaaguucagagaagagagagagaaggcagaccagacgacauauuucacugugcugaaccauggagaggauuucgagccgaugucagacgcacuguauacggauccgaaacaaugccaggcauauuuguaucacgcgcagaaagacguagggcacgaggaaaagcucaugaugccacaauaaaacagaucagagaaauagaaggggaacgacuuguuuucgaaagaaaaccaguagaaaaguuaacugacaaagaucuagagaaaauaccaauaccaaagccauauggacaagucucagacccaaagaggcucagagacgaauuaguugaaucauugcgagccuggauugcagcgggaaaaccaaaagauaggccuccucuaaguccgaaaggagaugugauaaggaaaguaagaauacaaacaaaugacaagguaagugucgaaauuaauggaggaacaguagacagaggugauauggcacggguugauguauuuagaaagaaaaacaagaaagcaguaugggaauauuauguaguaccgauuuacccgcaucagauaguagcuuugaacgauccgccugauagggcaguaauagcauaugcagaagacaaagauuggaaagaaauagauagcaguuaugaauuuuuauggagucuguuuggauuaaguuacguggaaauuagcaaagcaaacggugaauguauugauggauacuucagaggauuacauagaggaaccggagcggcaucaguauguaaacauauaucucucgggaaagacgcgaccguaagcgggauaggauugaaaaccuuggccaguuucaagaaauucacaauagauagguuagggagaaaauuugaaauaccucgggaaguuagaacguggagaggagaagcauguacauga

SEQ ID NO: 8473 - RNA, 3201 nt, Artificial Sequence
  Cas9 variant
augucacaucuaguacuaggacucgaucuagguccaaauucaauagguugggcuuuaguaaaugacgauccugaacauccaguggaaucaaagcuaguagaucuaggugugcgaguguucccggaagggguggauaauuucgacacaucgaaagaauuaucaagaaaugaagauagaagaguggcaagaggaaugcgaagacaaauaagaagacgugcucgcagacgacaacaauuaaaacaggcacuaauugauucaaaauuauggccaucugauccaaaugaugaaguaguauuguauaacacuaaccccuacgaacuaagagcucgcgcauuaaaagaacgauuagagccacacgaaguuggaagagucuuauugcacuugaaccaaagaagaggguucuuaaguaauagaaagaaagauagaggagacaaagaaguucaaggaauguuagcagaaauaaacgaaaaugaacaacaguguaaagacgguggguuugacacgaucggcgcauggcuggccgacaaacaagcaaauauagaucaugcuaacagggaagaaaaugaucauguacgaaauagacacuuagcaagaagccaauauguagaugaauuugaggcaaucuggucaguacaagcgaaacaucacccgaaacuacuaacagaagaacuaaaaguaggaaaacuaggaaaacagacauacccggucaagccgauaccgagguggcacgaacauagacaaggauugaguccacuagaaucguucggaauauacggauugauauuuuuccaaagaccaauguacuggccaaaaucaguugucggacuuugugaauuagagccaaaggaaaggcgaugucaaaggucagacagaagacagcaaagauuucgacuacuacaagaaguaaacaacuuaaaauacguagauccagacacucauuuagaacaaaaacuugaugacaagcaaagacgauuauuauuagacaaauuaagucauacaaaagaaaugacuuuugaccaaauacgaaaagcauuagacuuuuuagaaagcguaaaauuuaauuuagagcgaggagaaaggucaagauuaaaaggagugccaauagacgcccuauucgcagcaaaagacguacuaggacaagaaugguaugauagaccagaacaacagaaaacagaaauaguugcaguauuacuagacaaugaaagagacgaugacagaauaauugcuagagcaguagcagaauggggaaugaccgcaaaagaagcagaggcaauguuggguguagaucucccagcaggcuaugcaaaucuaaguuguaaagcaauagagaaacuauuaccacauauggaaagaggacuacuauacauggaugacgaugagagcaacagugcaaugcaugcagcagguuacuuaagacgggaucaacuaagaagaagaauauuugacguacuaccagacccagcuagaacgccaaauuguccaauuggugacauuccaaauccaguaguaaaaagaacgcucaccgaaauaagaaagguuguaaaugcaaucguaagagaauauggcaagcccgacgcaauacauuuggaacuagcaagaaguguccaaaugggcaaggagaaaagaucagaauacucgaagaugauaagagauagagaagcagaacgagauggaauuguagaaaaacuuagagaaagcgguguaagaguuacccgcgauaauauacuaaaguaccaacuuugggaacaacaaaaccaagaaugcauauauucaggaaaaccuauaucauuugaaaaauuauuuggagaaggaggagguguggagguggaccacauuuuaccaagaucaagaagucuugacgacucgcaagccaacaagaucguuuguuuaaggacugcuaacgcggguaaaggcgaccaaacacccuaugaaugguuagcagauacacaacccaaacaauaugaacaaguaugccaaagagcagguaugcuuaugagaucuggaaggaugccauaugcgaaauaccggcgauucauacaaagagagcuagaacuagacaaguuuauugcaagacaauuggcagauacaggauauauuaccaaagcaacgauggaguaccuaagauaucuauucgacaaagaccacgacguauuaggacuaaaaggccaacuaacugcagaacucagguaucauuggggauuagaaaccauauuagaagaguuacccgauuccccggcauggcaugaagcagacaguggaaaauuaagaccuggagagaaaaauagggccgaucauagacaucaugcuauagacgccguaguuauagcacuuacaaaucgaaggagguugguucaacuuucagacauaguaaaacgcgguggugcaagagcccauggagaaauauuagaagacccauggccuaauuucagggaaaacguuguccaggcaauaaagaaaacaaaugugucacauaggguagaaagaaaaguagcaggcaaacuacaugaagaaacuuuguaugguccaacaagaacaccaggagaauggguucuaagaaaaccuguaauagcacucucagccaaugaagucgaacgaauacgggacgcuacaauaagacaaauuguaguaagugcauuggcugaugcuggaauagacguagguagagggaagaaaccggaugccaagaaaaugaaagaagcgcuaucaaaauuaaaaaugccauccggaguuccaauacguaaagucagacuaacaaaaccagaacaaacuauacaaccaguacgagcaggaaggccggaucaggccuuuguuaaacccggaagcacacaccacuuauguauauuugaguucacugaaaaugguaaaacaaaacgcgacgccguuuuuguaacaauguuagaagccaugaaucgacuaaaaagaagagaacccgucauacagagaacccauccagaacgaccugauagcagauuuguaaugaguuuaagugcccgagaaauguuauuagcaaacuggaaagauggggaaaggcuauuaacguuuaaaaccgcaagcaguacacaaggacaaauaugguucgcggagcauacagaugcacgaaaaucggcagacuauaaacaauuugucgcaaacgccaauacauuagacgcaaagaaaguaacgguagauccacuagggagaauaagaugggcuaacgauuga

SEQ ID NO: 8474 - RNA, 3204 nt, Artificial Sequence
  Cas9 variant
auggggacaagacuuggacuagauauaggaacaaauucaauuggauggugucuuuuuaauuuagacggaaguggacgaccgauaggaauacgugauauugguguuagaauauuuuccgauggacgagacccacguucaggagcuagcuuagcaguggaaagaaggguagccagagcuaugcguagaagaagggauagauacauuagaagaagaagugcauuauuagaagcauugauuaauacaggauugaugccggcagauguacaagaaagcaaagcauugaccggaugugauccuuacgucuuacgggcacaagcacuggacagagcauuagaugcucacuuacuuggaagagucuuauuccacuugaaucaaagacgagguuuuaaaagcaacagaaaagcagaacgcaaagcuggagaugauaaagaaggagguaaaauagccgauggagcuaaagcacuggaucuagcuaugcacgaagcuggugcacgaaccuacggagaauuuuuggcuggacgcgauucuagaaggguacgauuaagagcagaaggugacgguuaugacuucuauccagagaggagacauuuagaagcugaguucgaugccauaugggaugcgcaagcggcauauaaucccgcuuuacuaacugauguaguaagggauagauuaaggcgcauaaucuucuuucaaagaccauuaaaagcaccuaaagucgguggguguacauucuuuaacgaagaaccacgacuaccaaaagcacacccacucuuucaagaacgucgcuuauaugaggaagugaaccaauuagaaaucacacgagcaggagcgccaucuagaaaacuaacacuagaucaaagagacaagauaauaagaaaacuaaaaagugcaaaaaccgcuagcuuuagcggacuagcaagauuacuaaaauuagcagauggugaaaguuuuucuagaguuacagagaauagaacaggacuagcaggagaugauaucuuuacaaguuucucggacaagagguguuuuggugacaggugggcacauuuugaccccgguguacaauggaguauuauagaaacaguuacagaagaagaagaccccguaagauuacgagauuggcuaauggcaacccacgggguaacuguggaacaggcugaagcaaucggaagaguaagacucccugaagggcauggaagacugggugaaacagcaagucgauuaauucuagcacagcuaaaaaguggaaguaaagauggacauccacuaacuuauaaugaagcaguagaagcggcacuagguaaaucacacucugauuuuagaacaggugaaauauuagaacaacuaccuuauuauggagagauuuuaucaagagaaauuccuccuggcagucuagauccagaugacgaugaugagauuagauggggaaaaauaacuaauccaacaguacauauaggucuaaaucaauuaagacguuuauuaaacgcccuuauaaaagcacacgguagaccagaugaaauaguuguagaacuagcaagagagcuaaaauuaucagagaaagauaaagcagaacacaauaggcguauaggagcuaacacaagagcagccgaggcccguagcaagaaacuauuagaaucgggucaaccagacacaggagcaaauagaaguuuauugaaacuaugggaagauuuaaacccaaacaacccauuggauagauguuguccauuuuguggaagacacauaggacaaauggcacuauucucaggugaaacggaaaucgagcauauaaucccauauucaagguccuuagaugauuccgcagcgaacaaaguaauugcgcauagaucuugcaauagggagaagggaaacagaacccccugggaagcauggggacauacugaaagaugggcaauaauagcagaacaaguuucucgucuacauaaaucuaaacaauggagauuugcaccagaugcaauagaacguuucaaucaggaaggaggauuuauagcaagacaacuaucagauacacaauauuugucaagaauggcgcgaaccuacuuaucuagccuauauccugauacagcaggaguauacguaauaccaggucgcaugacagcuauguuaagacgguuauggggucuaaacgaguuacuuccagaucacaacuaugucgagaacccacacaguggcgcacccaaaaauagacuugaccacagacaccacgcaauagacgcagcagucguaggaguaacaacaagaggcuuauuaaaugaaauuuccagagccgcgggaagggcagaacgacaagauuuagacagauuauuuauagaucuaccaaaaccaugggaaacauucagagaagauuuacaugagagcuuagcuagaguaguaggcagucauaaagcagaucacggucgaaaaggaguaccagcaaaaggaaaagaugccacugcagcuagauuacauaaugaaacggcauauggcuugacaggacuuacgucagaaucaggcuugccaauagucguucauagaguaccauuauugucacuaaaacccgaugauuuaucaaauccgauaaggauucccgacgcagcacuccaaagagcacuacgugaagcgacagauggaaaaucuggaaaggacuuccaagaagcauuagcucaauuuucaaaaucagacccgguguucaaagguauaagacauguaagagugagagaaacccuaaagguaaucccuaucagagaugccucaggacacgcuuucaaagcguauaagggagacgcaaacgcaagauaugacguguggcgaaugccugacggaaaauggguuagcagcuggagagauagagacggaaaggcucacuccgguauuauuacaauguuugcugcacaccaagcaggacagccuguacagagaccucauccagcagcaaaaagaguuuuaucgcuaagacaaaacgaucugguagcaguagaaccacaaggucaaccacgcaaaauaaugcgcguagucaaauuuuccucuggaggucagauaacauuugccgaacaucaagaagcagguccguuaaaagcccgagacgcuacgaguccugauauagauccauuuaaguacuuuuauaguuccgcaggaggauuacaaaaagcacgagcaagacaaauaagaaucgacgaacuagguagaauauuugacccuggaccaagguga

SEQ ID NO: 8475 - RNA, 3207 nt, Artificial Sequence
  Cas9 variant
augaaauauguacuaggacuggauauuggaauugcaagcugcggaugggccguaauaaaccaagaaaaacauagaauagaagaccucggaguucgaauauucgauaaagcagaaaaccccaaagacggcaaaaguuuagcaacgccacgccgcgacgcuagaagcacuagaaggaccuuacgccgaaagaaacauagaaugcaacgcauaaaaauccuucugguaaaacacggauuacuaagcaaaacagaaauagaucaccucuacgaaagugccaccgaaauagacguaugguaccuacgguuaaaugcauuggaacgcagauuaaauccuaaagaguucgcuagaguacuaauccaucuaucaaaaagaagagguuucaaaucuaacagaaaagaaacuacacugucagaaaaugggcaaauacuugaaaauauaucagaaaaccuucaaauaauggaacagaaaaauuaucgaacugugggagaaaugauauuaaaagacaaacgauucgaaaaucacaaaagaaacaaagaugguacauacauagggaccgugacacgacaacaacuucaagaagaaauacaaaugauauucaacgcacaaagacucuacaaaaacaaccaugcaacugaaaaauucgaaaguucuuaucuugaaauaugggcaagucaaagaccauacgcaucuaaagaccaaauagagaaaaugauaggauacugcacacuagaaccaaaagagaaaagagucccaaaagcaucaugguccuuccaauacuuugucgcccuacaaaccauaaauaaucuacgacuaauuucaaaagaucgaaucgaagaacuaucuuuugaagaaaagaaaaggauaaugaaccuagcacuugaaaaaucaauaguuaaauacaucgacauaagaaaauuauuaaguguacccaaagaauuucaauucaauucccucucauauagcgcugacauagucgauacuacaguagaaaacaagaaaugcauagaacuuaaagaauaccauaguauaaauaaaguauauaaacaaauauacggacaaaaugcacuaaacuuacuaccaaaagauuacgacacaauagcguacggccuuacgaucuucaaagaugacaaagacauacaagaauacuuacaaaauaaauaugugaacgcgaaaggcaaaccaaucagcaaccuagcuaacaaaacauaugaugacaccuuuauucaaguucuacucacacuaaacuuuucaaaaaugggccaucucaguuucaaagcacucaaaaauauaauacccuuccuugaagaaggauuauccuaugauaaagcaugugaaaaagccggauauaacuuuaaaggaaccaguuauacuaagaaaacuaaauaucuaccaguuauuccucaaaauacaaaccccgucguucaccgagcauugucccaaacaagaaaagugaucaacgcaauaaucaagaaauauggaagcccaaacgcaauucacauagaaacugcacgagaauuauccaaaacuuuccaagaacgaaaagaaauagacagcauguaucaagacaacaguaagaaaaaugaacaugcaauaugcaaacucaaagaacuaggaaacauuaacccaucaggaauaaacauaguaaaauuuaaacuuuggaacgaacaagauggaagaugcauguacaccggaaaauacauagaaccccaccgucuauucgaagaagguuacacugaaguagaucauauacuaccauacucuagaagucuagaugacucauacaacaauaaaguauuaacacucggaacagaaaaucaaagaaaaggaaauaaaacgccauacgaauacaugcgaaacaacucgauaugggacgaauuugaaacacgaguucaaagcaacaagaaaauaaauaaaaagaaacaacaaaaacuccuacuucaaaacuucucccaugcaagagagcaagaguucauagaacgaaaucuuaaugauacacgauacgcaacaauauaucuaucaagccugauccagcagcauuuaauauuuuccgaaucaucacgagaaaagaaaguccacacaguaagcggaauuauuacaagucaucucagauccagauggggauuuaauaaagauagaaaagaagggcacauacaucaugcacuugacgcuguuauagucgcagucacaucagaccauaugauccaacgaguaacaaaauacuacaaauuaaaagaacuuaaccgaaauaggcaagcaaaacgaaugcaauuccccgaaccaugggaaggauucagacuugaacucgaagcacgcaucagcccuaacacccaacaauaucuaaaaggaauaagauuuaaaaacuacgcagauguaaacuuaucugaaauaaaacccauauucguuucacgaaugccaaaaagaagcauuaccggcgaacuccaucaggaaacaauccguaaauuccuagguuauaacgaaaaaggcaaaguccuuacagcaacuaagacgaaacucgaagauauaccguuugacgcaaauggagauuucccaauguucggaaaagaaaccgaucuauacaccuacaacgccauuaaagaaagauaccuaucucauaagaaagacaaauccaaaucuuuccaagaaccauuauacaaacccaccaaaaguggaggaauaggaccauuaauaaaauccauuaaaauaauggacacaaggaccauagugaacccuguaaaucaaggaaaaggaguugucuacaauagcaaaauugcacgaacagacgucuucaagaaaggggaaaaauauuauuuaaucccaauauauacaauagaccuuaugaaaaauacccucccccaaaaagcaauaaccgcaggaaaaggauacgaggacuggaccacaauagacccguccuucacauucuuauucucccuauucccaaacgaucuaauacaaauaguaccaagcaaaaacaaaaccaucaaagcacgaacaacggugagcaagaaagaaguacuauugccaaguuuaacaggauauuuuaaaggcguacacuccgggacagcaggcaucacagucgaaacacaugacggcucaaucauagcaaaugucggaucaaaacaacuauuauccuuugaaaaauaccaagucgacguccuaggccauuauacaaaaauaaagaaagagaaacguaucgggauggcaauauga

SEQ ID NO: 8476 - RNA, 3207 nt, Artificial Sequence
  Cas9 variant
augaauaaagcaguagcauaucggcucgcauuagauuuggguucaacaagucuaggcugggcuauauuccgauuaaacgaagcgagagaaccaacagcaauaauucgagcgggaguaagaauauucucagacggucgcaaugcuaauagcgagccauuagcuguacauagaagagucgcccgugcaaugagaagacgaagggaucgguuauuaaaaaggaagaaacgaaugcaugaucaguuaguacaacauggauuuuucccugcagaaguugcggaacgaaaagaauuagaaagauuaaauccauaucaacuaagggcaaaaggguuacaugaagcauuaacuccuggagaguuugcaagagcguuauuucauauuaaucaaagacguggguucaaaaguaauagaaagaccgauagaaaagacaaugacucuggagcauugaaacaagcaaucagcgaauuacgaaagagaauacaagauucugacugcgcaaccgcgggcgaaugguuuuggaaagaacgcaugcagcaaaaaccagagggcgugaggggacaguggguuagagccagauaucgaaaaacaccaucaacuacagacgaaggcaagaaaagaauuggauaugaucuauauguugacagagcaaugguagagcaagaauuugacgcacuaugggcagcacaagcugcauuacaacccgguuuguuuacagaagcagcuagggcggaauuaaaagauacauuacuauaccagagagaucuacgaccuguaaaaccagguagauguacauuguugcccgcggaagaaagagccccucuagcauuaccaucaacucaaagauucagaauauuacaagaaguuaacaaccuuagacuauuagaugaagcauuacgagagguaccuuugaaccuagcgcaaagagaugcggucguaucagcauuagaaggcaagaaagaacugaguuucgcagcuauuagaaaacugcuaacacuaaguggaaaauuuaacuuggaagaugagaaaagagcggaauugaaaggcaaugcaacaagugucauuuuagcgaggaaagacuuguuuggugaugcaugggcgggauuugacgcggccguacaagaugaaauaguauggagauuaguuucacaagagagugaaggggcucucauagcuugguuacaacagcauacuggaguagacggagugugugcggaagcaauuguaaacacaagacuaccagauggguauggaagguuaucuagaaaagcacuagaaagaauuguuccagcuuugcaacgugaaguauguacuuaugacaaagcaguucaagcggcgggauuugcgcaccacagugacuuaggguuugauuucgacuacgcagaagaugaaguacaacaaguaggagaacacacaauagcaagcacaggagaaguacaagcacaauacgcuuucaaacaauuaccuuacuacggaaaggcuuuacagcgacauguagcuuucggaucgggugaugcuaaagaucaugaagaaaaaugcuauggaaaaaucgcaaacccuacggugcauaucggcuuaaaccaaguaaggacagucguuaaugcauuaauaagaagauauggucacccaacagaaguaguaguagaacuagcacgagauuugaaacaguccagggagcaaaaacaacaaacucaacgagaacaagcagauaaccagaaaagaaaugaagauauaagaaaaagaauagcaccgauacuggaaacaagcccagaacgcguaagagauagagacaucaaaaaguggauauuaugggaagaacuaaauaagaaagauauugcagaccggcacuguccauauaguggagagagaauuucugcaacuauguuauuaucagaagcaguugaaauagaacacauucucccauuuagucgaacauuagaugacucucuaaauaaucguacugucgcgaugagaagggcaaauagaauuaaaggugauagaaccccaugggaagccagggcugauuucgaggcacaaggauggcgauaugaagcuaucuuacaaagagcggaagguaugccaccuaggaaaagauauagguucgcagaggauggauaccaaagaugguuaggaaaagauaggaacuuuuuagcaagggcuuuaaaugauaccucauaucuuucaagguuagcagcaaauuauuuaagauuaguauguccacaaggaguaaggguaauaccaggucagaugacagauaagcuaaggggaaaauucggauuaaacucaguauuaggauuagaugguaagaaaaacagaaaugaccacagacaccaugcaguagaugcaugugucauaggcguuacugaucaaggacuaaugcaaagauucgcaaaugcgaguaaacaagcaagagagaacgggcuaacgagguuaguucaagacaugcuacuucccugguggccgagcuauuaugaucacguagaacgagcaguaaggcauauaagggugucacauaggccggaucauggauuugaaggugcaaugaugaaagggaccgcucacgguauaagagaagacggaauaagggaagacggaagaauaaaacaacgaccaaaagcaaaaggaucagcugaucauaaaacuauuacacuaauaccuauugaugaaccuagacaacuggcaagacacggaguggacgccgaaggaaaaccuuuaccauacaaggguuaugcaagcggaaguaacuauugcauagagauaacgaaaaaugguaaaggaaaaugggagggacaaguaauauccacauuugaugcguaucgcauaaaagcggcggcagaugcagcagcaagagcuggucaaguuauaucuacgguugaggcugauucaauaguaagaaagucaggaugggaaagauuaagaggagcgcaaagucaaaauggucaaccauuaguaaugagacuuguuauaggagauucuguacguauggaaguagacggaagagaugaaguuaugagggucguaaaaaugucuggaaaagaaaugguuuuugccccaguuagggaagcaaauguagauaagagaaauaauaugccagacgagcaagacccauuuacauacacauacaagagagcugaccaacuccguaaagcgaaagccagacaggucaccauaagucccauuggagaguuaagggacccugguuucaaaggauga

SEQ ID NO: 8477 - RNA, 3207 nt, Artificial Sequence
  Cas9 variant
augcaauacguacucggacucgauauuggcaucgcaaguuguggaugggcaguaauaaaucaagaaaaagaacgaauagaagauuuagggguacgcaucuucgauaaagcagaaaacccaaaagauggaaagucccuugcagcuccucgaagagacgcaaggaguacaagaagaacacuaagacgaaaaaaacauagaauguugagaaucaaaauauuacuagugaaacagggacuucuauccaaaaaugaacucaaccaucuauaugaaucaacaacagaagucgauguauggaaucuaagauuagacgccuuagaaagaaaacucaaccccaaagaauucacuaggguacugauacacuuggcaaaacgaaggggauuuaaauccaacagaaaagagacuacacuauccgaaaauggucaaauacuagaaucaauaagugagaaucagcaaauaauggaacaacaaaacuacagaacugucggagaaaugauauuaaaagacaaaaaauucgaaaaccauaaacgaaacaaagacggaaccuauauaggaacaguaacacgccaacaacuacaggaagaaauccaaaugauauucaccgcacagcgcuuguacaaaaacgauuacgcuacagaagaauucgaaauaucauacuuagaaauaugggccagccaacgaccauaugcgucuaaagaccaaauugaaaaaaugaucgguuacuguacacuagaaccuaaagaaaaaagaguaccaaaagcauccugguccuuccaauauuuuguagcucuacaaaccauaaacaaccucagacuuauaucaaaagacagaauugaagaauuaucauucaaagaaaaaaaacaaauaaugaaucuagcuuuagaaaaaucgauugucaaauacauagacauaagaaaacuacuuaguaucccaaaugaauuccaauucaacucccuaaguuauuccgcggauacggucgacacaacacuagaaaacaaaagaugcauugaacuaaaagaguauuacucaauaaauaaagucuacaaacaaauauacgaaaaaaaugcacucaaccuacuaccaauagauuacgacacuauagcuuacggacuaaccauuuucaaggacgauaaagacauccucgaauaccuacaaaacaaauacguaaacgcaaaaggaaagccaauaaauaacuuagcaaaaaagacauacgacuauaccuucauacaagcuuuacucacacucaauuuuacuaaaaugggacaucuuagcuucaaagcacuaaaaaacauaauuccauuuuuagaagaaggguuaucauacgacaaagcuugcgagaaggcuggauauaacuucaaaggaacaaguuauacagaaaaaacuaaauacuuaccagucaucccacaaaacaccaacccgguaguccacagagcacuaucacaaacaagaaaaguaaucaacgcaauaauaaaaaaauacggaucaccaaaugcaauacacauugaaacugcccgagaacuaucaaaaaccuuucaagaacgaaaagaaauagacucuauguaucaagacaacucuaaaaaaaaugaacaugcaauacacaaauuaaaagaauugggaaacauuaauccaucaggaauuaauauaguaaaauucaaguuauggaacgaacaagacggucggugcauguacuccggcaaauacauagagccacauagauuauuugaagaaggauauacagagguagaccacauauuaccauauuccagaucccuagaugauagcuacaacaacaaaacacuaacacucggaacagaaaaucaacgaaaaggaaacaaaacacccuacgaauacaugggaaacacaucuaucuggaaugacuucgaaaccaggguacauaguaacaaaaaaauaaacaaaaaaaaacaacaaaaacuacuccuacagcauuucucuuacgcaagagaacaagaauuuauugagcgaaaucuuaacgauacaagguacgcaaccauauaucuaucuucccuuauacaacaacaccuaaucuucucugaauccucaagaaaaaaaaaaguacauaccguuuccggaauuauaaccucacaccucagaucucguuggggauucaacaaagaucgcaaagaaggccauauacaucacgccuuagacgcuguuaucguagccguaacaagugaucacaugauucaaagaguaacaaaauauuauaaacuaaaagaauuaaacagaaaccuucaagccaaaagaaugccauuccccgaaccaugggaaggauuuagauuagaauuggaagcacgaauaucaccgaacacucaacaauauuuaaaaggauuuagauucaaaaauuaugccgacguaaaucuaucagaaauaaaacccauauuuguaucccgcaugcccaaaagguccauaacaggcgaauuacaccaagaaacaauaagaaaauuuauagguuacaaugaaaaaggaaaaguuuuaacugcuauuaaaacaaaacuagaagauauccccuuugacgcaaacggagacuuuccaauguauggaaaggaaacagaccuauauacuuauaacgcaauaaaagaaagauuccuuagucacaaaaaagacaaaagaaaaucguuucaagaaccucuauauaaaccaacaaaaaguggaggaaucggaccuuugauuaaauccaucaaaauaauugacaccagaacaauagucaacccagucaaccaaggaaaaggaguuguauacaacaguaaaauagcccgaaccgacgucuuuaaaaaagaugaaaaauacuaucuaauccccaucuacacaauagaccuaaugaaaaacauucuaccucagaaagcuauaacagccggaaaagguuacgaagacuggaccaccauagacccguccuucacauuucucuucucacucuucccaaacgaccucauucaaauaguaccaucaaaaaacaaaacuauuaaagcaagaaccacaguauccaaaaaagaaguccuacuuccuucucuaacaggauacuucaaaggcguacacuccggcacagccgggauaacuguugaaacacacgacggaucagucaucgcuaacgucgguucaaaacaauuacucuuaauagaaaaauaucaagucgacauccuaggccacuacacaaaaaucaaagaagaaaaaagaaucgguauggcaauuuga

SEQ ID NO: 8478 - RNA, 3207 nt, Artificial Sequence
  Cas9 variant
augccuaaaucagcaaaaccacaacaagcauacacccuaggacuagacauagggauugcaagugugggagcagcccugcuuggacaacaacauauaauaggacugcacgucaggaccuucgacagagcugaaacugccaaagaaggcgagccauuaaacaaaaucagaagagacgcuagacucacuagacgucgacuacaaagacgagcacacagacuauugcgacuaaggagauuauucaaaagacauaaucuuauaccagauacagauacaaguacauuuaucucaggacaaucacccugggaauuaagagcucaaggauuagaucgucaacuaacaagugcugaauggacaacagucuuguaucacauaguaaaacauagaggauuccacucaaacaggaaaagugaaguaaaaacugaugaaaaagcgggacaaaugcuuagcgggguaaaccaaaaucaagcacuacuuaaacaaucaggacuuagaacaaugggugaacuagcagcacgacaugaagcauucagagaagcgaaacgaaacaagaaaggugcauacaaccauacauucucgagacaugauuuagaagaugagcugcacuuauuauucaguaggcaaagagaauuaggaaauccauacgcaacaccagaauuagaagacgcaguacauacacuauuaaugcaacguagaccagcucuuucaggaacgaauuuauuaaaaaugguaggacacuguacauuggaaccagacgaauuuagagcgccaaaagccucauacacagcagaacgcuucauauggcuaacaaaacucaauaaucuaagaguuaguggaucuggugaaacacgacccuugaacgaaucugaaagacaagcacuucuaaguaaaccauuuucacaaagcaaacuuacguauaaacaaguaagaaaaauauuagaauuaccggauaauauaagauuugucggucuacauuaccacccugcacaagauaauggcaaaucaccagaaaauagagucuucuuugaagccaaggcauuucacgcuuuaagaaacguauacaagaaagcaggguuaaacuuagaauggcaaagagacagccaaaaccccgaaaaacuugacaacauaacauacgcauugacaguauuuaaagaagauaaagaagcuaaacaaugguuaauagaaaaaggaguugaagccaguguaauugaagcaguacuaaaugaaucauuuucugaguuugugagacucaguaucaaagcccuccggaaaauuauaccacauauggaaaucgggcacagauaugacgaagccgugaaacuagcaggauauucacaucacucccacuuaccucagccaagcaaaacaccauauauaccccguuucucgaaacaaucaauugcuaaucccguaguaucuagagcacuaaaccaagccagaaaguuaguaaacgcuauaguacgagaauauggaccacccgaugccguccacauagagcuagcacgugaucuuaauaaaccauuugaugaaagacgcaagauagaaaaagaccaagaaaaauaccaaaaagacaaagccagagauauagaaacauuucaagaaaauuuuggauuuacaccaaaaggauuacaguuaacaaaauggcgacuguacagagaacaaucgggaaaaugcgcauauucauuaaagccacuagacauuaaccgauuauucgaagauggguauguugaaauugaucacgcauuaccauauagcaggucauuuaaugauggaaugaacaacaaaguuuuaaccuuaacaacugaaaacagaaauaaaggcaaucaaacuccauaugaauacuuagauggagcaucaaacuccgcacaguggcguaacuuuguagcguggguaaauucaaauaaaucuuaccgagccaguaaacaaagaaacuuacuaagaaaagacuucgcagcucaagcagcaacagaauuucgcgaacgacaucucacugacacaagauacauagcacgcgaauuuaaaagaaugguugaaacccacuuaaaacuaaauaaaccaaaucaaagaugcguaguuguaaguggacaacucacagcauacuuaagagcccgauggggacuuauuaaaguacgagagaauggcgaucuacaucacgcauuagacgcagccguuguugcagcgugcagucaugcaaugguuaaacguuuagcagacuauucuagaagaggugaacuucaauacgcaagaggacaccauuucgacccugaaacuggagaaauuauagauauuaaugcauugagaaaacuagacgaucacuuuccgcaaccauggacagauuucagaagagaacuacuugcuuggcugucaccugaccccgcacagcaacucaaaaaucuagcauacuacacugaugaaagacucaaacaggucaaaccuauaagaguaucacgagcaccaacacgacgggguuuaggggcagcacaccaagaaaccauucggagugcaaaauacuuaggugaaaauagaucgacuguaaaaacgccacuagaaaaacugaaacuaaaagauauuccaaacaucguaggauacgaagauccuagaaaucaccaacuaauacaagcaaucagucaaagguuaaccgaacauggagaugaugguaaaaaggcauucaaagaaccacuauauaaaccaggcaauaacaaaagcacagcuccaguaguaagaagcguaaaauuauuuacaguacaaaaauccggaauaccugugcgagguggcaucgcaaacaauggaaacaugguacguguagacauauuuacaaagaaagaacguuauuuugccgucccaguauauguaagcgacgcagcuagaaaugaauuacccaauaaagcaguagcuagaggcaaagacggauggauagacauagaugauucguuuucuuuccuauuuucccuauauccaaacgacuggguaucagugguagugaaaccacaugaagcacccugugaggguuacuaugcaggacuagacauaucaacaggcgcaauucacauaugggcccaugaccgaaauagaagcguagguaaaaauggacuaaugagaucuauaggaauaaaaacugcucacucaguugaaaaauaucauguagaccucuuaggcaaucuguauagaguuguccaugaaacaagaaaaccucuucgagcaggaaaauga

SEQ ID NO: 8479 - RNA, 3207 nt, Artificial Sequence
  Cas9 variant
augcaguaugucuuaggauuagauauagguauagcuuccugcggcugggcgguuauaaaccaagaaaaagaaaggauugaagacuugggagucagaauauuugacaaggcagaaaacccaaaagaugggaaaaguauggcuacaccaagaagagacgcuagaucaacccgcagaacucucaggcgcaaaaaacacagaaugcaaaggauaaagauaauucuaguaaaacaaggccuacucagcaaaacagaauuagaccaucuauaugaaucagcaaccgaaguagaugucuggaaccuacgucuggaugcauuggaacgcaaguuaaacccaaaagaauucacaagagucuugauacauuuagccaaaagaagaggauucaaaucaaaucguaaagaaacaacuuuaucugaaaauggacaaauccuagaaucaauaagcgaaaaccaacaaauaaugggacaaaaaaauuacagaaccguaggggaaaugauucuacaagauaaaaaguucgaaagccauaaaaggaacaaagacggaaccuauauaggaaccgugacaagacaacaacuacaagacgaaauacaaaugaucuuuaacgcccaaagacuauacaaaaauaacuaugccacagcagaauucgaaaacucauaccucgaaauaugggccucgcaacgcccauaugcaagcaaagaccagauagaaaaaaugauaggcuacuguaccuuagaacaaaaagaaaaacgagcgcccaaagcaaguugguccuuucaauacuucgucgcacuacaaacaauuaacaaucuccgucucauaaguaaagacagaauagaagaacucagcuuugaagaaaaaaagcaaauaaugaauuuagcucuugagaaaucuaucguuaaauacauagacauaagaaaacuguuaucagucccuaacgaauuccaguucaacucgcuuagcuacagcgcagacacaguagacauaacaguagaaucaaggaaauguauagaguugaaagaauaucauucaauaaacaaaguauacaaacaaaucuaugaaaaaaaugcuuugaacuuacucccaaaagacuacgauacaaucgcauacggccuaaccauauucaaagacgacaaagacauacuagaauaccuacaaaauaaauacguaaacgcuaaaggaaaaccaauaagcaauuucgccaauaaaacauacgaugacacuuucauacaagcauuauuaaaccuaaacuucacaaaaaugggacacuuauccuuuaaagccuugaaaaauauaauaccauucuuagaggagggacuuucauaugacaaagcuugugaaaaagcagguuacaacuuuaaagguacaucguauacggaaaaaacaaaauaucuuccaguaauaccacaaaauaccaacccagucguacaccgugcucucagccaaacucgaaaagucauaaacgcaauuauaaaaaaauacggaagcccaaacgcaauacauauagaaacagcaagagaacuaucaaaaacuuuucaagaaagaaaagaaaucgacucgauguaccaagauaauucaaaaaaaaacgaacacgcuauuuguaagcuaaaagaauugggaaacauuaacccaucaggaauaaauaucgugaaauucaaacuauggaacgaacaagacggacgaugcauguauuccggaaaguacauagaaccacacagacuuuuugaagaaggauacacggagguagaccauauacuaccauauucacgcucauuagaugacagcuacaacaauaaaacucuaacucuaggaacagaaaaucaaagaaaaggaaacaaaacaccauacgaguauaugggcaacacaucaauauggaacgacuuugaaacaagaguacagucaaacaaaaaaauaacaaaaaaaaagcaacaaaaauuauuacuacaacauuucaguuacgcuagggaacaagaauuuaucgaaagaaaccucaacgauacuagauacgcaacuauauaccuuagcucacucauucagcaacaccuaauauucucagaaaguucacguaaaaaaaaaguccacaccgucucaggaauaauaacaucacaucuaagaucaagaugggguuucaauaaagaucguaaagaaggacacauccaucacgcccuugacgccguaauaguagccguuaccucagaucacaugauucagagaguaacaaaauacuacaaacugaaagaacuuaauaggaacuuacaagcaaagaggaugccauuuccugaaccaugggaaggauuccgucucgaacucgaagcaagaauaucaccaaacacccaacaauaccuaaaaggcuuuagauuuaaaaacuacgcagacgucaauuuauccgaaaucaagccaauauucguauccaggaugccaaaaagaaguauaacaggagaacuccaccaagaaacaauacgaaaauucauaggguacaacgaaaaagguaaaguacuaacugcaauaaaaacuaaauuagaggauauaccauuugaugcaaauggagacuuuccaauguacggaaaagagacagauuuauacacuuacaaugcuauaaaagagagauuucuaucccauaagaaagauaaacgcaaaucuuuccaagaaccauuauacaagccuacgaaaaguggcgguauaggcccauuaauuaaaagcaucaaaauaauagacacucguaccauaguaaacccagugaaucaaggaaaaggugucguauacaacaguaaaauugcaagaaccgauguauucaaaaaagacgaaaaauacuaccuaaucccaaucuacacuaucgaccuuaugaaaaauauacugccacaaaaagcaaucacugcaggaaaaggcuacgaagacuggacuacaauagacccuucauuuacauuuuuauuuucccuauucccaaacgaccuaauacaaauugucccuaguaaaaauaaaacaaucaaagcgaggacaacagugaguaaaaaagaaguacuguuaccuucacucaccggcuacuucaaaggaguacauucagggacugccggaauuacaguagaaacgcaugacgguucuguaauagccaacguagguagcaaacaauuacuauuguucgaaaaauaccaaguugacguccuuggccacuacacuaaaaucaaagaagaaaaaagaauaggaauggcaaucuga

SEQ ID NO: 8480 - RNA, 3210 nt, Artificial Sequence
  Cas9 variant
augaagaaacaaccacaaagauauauucuuggguuagauuugggaaucgcaaguguaggaugggcguuaauauuaguggauggagcugaaaauccaguaggucuguuggacuguggagucagaacauucgaacgugcagaagucccaaaaacaggcgauucacuugccuuagcacguagacaagcaagaucugugaggaggcuaaucagaagaagggcacaccgacuauuacgauuaagaagacuauuaaaaagagaaggaaucuuaucggcagcagauuucaacagcgacggauuacccaauuugccaauugaugcauggcaacuaagaguagcaggucuugaacgaaaacuuaccaaucaggaaugggcugcaguacuccuucauuuagucaaacauagaggauacuuaagucaaagaaaaagcgaaacucaaacagaaaacaaagaacuagguagauuacuagcugguguugcagaaaauucuaaacuacuaagugaaucaucagaacaauacaggacgccugcugaauuagcaguaaaauuauuugcggaacaaaguggaagacuacgcaauaaagguggagacuacacacacacauucaaccgccuagaccuacaaaaagaacuacacuuacuauuugaaagacaaugugcauuggguaacccuuucgcaagcgccgaauuacaaucaaaaguggaugaacuucuaaugacucagagaucagcccuucaaggcgaagcaguacuaaaaauguuagguaaaugcacuuuugaaccauccgaauauaaagcagcuaaaaauacauauucagccgagcguuuuauuugguuaacaaaauuaaauaaccuaaggauauuauacaacggugaagaucgagcacuagacgaaggcgaaagaaaacaacuauuagacgaaccauacaagaaagcaaaacucaccuacaaacaaguaagaucaauucuuaaccuuccagaaucagcaguuuuuaaaggucugagguauggaaaagauucagauggccuaaaagccgaaaauggcgcacuaauggaaaugaaggcauaccacaaaaucagaacggucuuagaaaaagcaggacucaaaggagaaugggaaaauagaauuagaaacccagaaauauuggaccaaauuggaaccgcuuucaguguguauaaaacagacgaagacauaaaagcagaacuugcagcacuacgacuuccagaaaacguacuagacgcuuuauuagcaggacuaaauuucgauaaauucauacaacuaucacuaaaagcauugucgaacauacucccacuaauggaaagaggaauccgcuaugaugaagcauguaaagaaguauauggagaccaucgagcacuugcagaaaguaaaaaucaaaugcuucugccgcaaauaccagcaaaugaaauaagaaauccgguaguacucagaacacuaacacaggcaagaaaagugauaaacgcuaucauaagaagauauggaucaccacaacgaguacacauagaaacugcaagagaguugggaaaaucauuuaaagacagaaaagaaauagagaaaaggcaagaagaaaaccgaaaggaacgagaaagagcagccgaacauuuuaaagaguuguuuccuagauuuacaggagaaccaaaaaguggcgauauacuaaaacugagguuauaccagcaacaacaggguaaauguuuauauucagguauuccaauagaccucggaagacuaaaugaaaagggguauguagaaauugaccacgcuuuaccguucucacgaaccugggaugauucuuuuaacaacaaaguuuugguccuaggaagugagaaucaaaagaaacgaaaucaaacuccauacgaauaucuugacggagcuagagauagccaaagauggagagaauuucaagcuagaguacaaggaugcagauuuccauacgcuaagaaacaaagaauacaaaccgccaaauuagauucaaaaaccgaacaaggcuucuuagaaagaaauuuaaaugacacaagguacauugcaagauuccuaugugguuucauagaaaagaguuuacaucuacaaggugccggaaagagaaggguauucgcgucaaauggccaaauaaccgcguuacucagaggacuauggggacuaaagaagguacgagaagauaacgaccgacaucaugcucuugaugcaaucguaguagcaugcucaacaguaagcaugcaacagaaaauaacgaaagcgaugcaaaggagagaaacauuagaaacuauuaacacagaaacaggugaaguaaaaacacgaaucccacaacccugggacuuuuucagacaagaaguaaugauaagaguuuucagcgaugcaccacgagaagaauuagcagaaaaacuuaacucaagaccagaggcauuacaugauuuuguaaguccauuauuuguaucucgagcaccuaauagaaaaaugacaggucaaggacaccuugaaacugucaagucagcuaaacguuuaagugaaaauauuagugucguaaagaaaccacuaacagcguuaaaacuuaaagauauugaaaauauuguaggauaccccgacagagaaccugcacuauacagggcuuuacaagaacgccuacaagcguauaaagaugauccugcaaaagcauucgcagaaccuuucuauaaaccagcuaaagauggaggacaggggucauuaguaaaagcaguacguauuauugaaaauacaaaacauggccucaaaguccgaaacgguaucacagauacaaauggagacaugguuagggccgauguauaucaaaaagcagauaagaaaggaaaaagacaauauuucauagucccaguuuaugccuggcaaguagagaaaaaugaauugccaacaguggauuguaaaggauacgaaauagaugauacauacgaguucuguuucagccucuacaaauacgacauaauugaaauucaaaauccagauaauaugaguaaagaacucagaguguacuacauaaacugcgauucaucagaugguagauuuuggcuagcacaucacgauaaaagugccaaagaacaacaauuuagaauaucgacacaaaaccaaccgauuauaaagaaauaccaaguagauccucuugguaaagaaauaagacuauguaaagcagagaaaaggacagaauuaaacggaaagaaaaagaaauga

SEQ ID NO: 8481 - RNA, 3210 nt, Artificial Sequence
  Cas9 variant
augaacuacgauauaggauuaagaaucggaauaacuuccuguggaugguccauuauaaacaaagauuuagagagaauagaagauuuaggaguaagaguauuugaaaaagcagaaaaccccgauggaacagcuagcgcagccccuagaagagaagcaaggaaaagucgaagaaaacacagaagaaaaaaacacagaauugaaagaauaaagagacuaauuguucaacaugaccuacugucaaaaaaagagcuagauagucuauaucuaaguccauuuaauauagauguuuggaauuuaagagucgaagcacuagaacguaaacuugauaauagagaauucgcaagaguacucauucaccuagugcagcgacgaggcuuucaaacaauccgaaaaucgguugaaauacaagaggaaggcaaauugcucgaaaauguaagcgaaaacgaaagaauaaugaaaguuaacggauacaaaacuguaggagaaauguucaguaaacacgaaaaauucacacaccauaaaagaaacaaagacggcucauauacuagcguaguuaccagaagucugcuccuuaaagaaauuaaaacaauauucaacucacaacggauacuaggcaacguauuuucaacacaaaaauuagaauccgacuaccuauacauauggggaagccaacguccaacacuaacauaugaacaauuaaugucaauggucggcaauuguauauacgaaaaaaaagagaaaagagcaccaaagacaucaugggcuuuccaauacuucucacuacuacaaaagauaaauaaauuaaaaguaagcgacgauaauacacuaagaaaacugucaaaagaagaacgagauauaguaauagaacucgcuuucaaaaaaaaaaauguuagcuucguugacauucgcaaagcacugaaauuaaaugauaacacaaaauucaaucaucucacuuacucacacguaguagaaacaaagaaaguagagaaggccacauucauagaacuaaaaggcuaucaucucauaaaaaaacagcugaaagaccgcaacguagaacuaacgcaagaacuacaaccaaaagauuacgaugcaauagcagcagcguccacuuucuucaaaaacgacaucgaauuuagagauuaccugagaaaucaauaccuggacucaaacggcaaaagaaaaucaaacauagcgaacaaagucuuugaagacaaaguaauagcagcuguuuuugaauuaaacuucucgaaaguaugucaccuaaguuuuaaaucacuauauaagcuuauaccccaccuagaaaaaggacucgauuauaaagaagcaauccucugugcaggauauaauuucagggacgaaaacaaacgagacaaaaaacuauuccugccaguaauacaacaagaaacaaauccaguaguacacagagcauuaacacaggcgcguaaaguaauuaaugcuauaauccgcgaauacggaaguccaaauacaauaagauuuguaguagcaaaugacuuagcaaaaaccuauaaacaacgaaaagaacuagaaucaacacuaaaaaaaaacagagcggaaaaugaaaagaucaaaacaaaacugcuaaguaugggaauaauaaacccuaccggaauggacaucguaaaauauaagcuuugguacgaacaaagcgguaucugcuuauauacaggacgacaaauggaacuuucauccuuauucaaaccuggauacucaauaguuaaccacauaauaccauacaaccgaucauuugacgauacuuaccacaauagaguccuaacuuugacugaaaccaaauaugaaaaagggaacaaaauccccuucgaauauuuuggcgcugaagaaacauguuggaacgaauacgagaaaagaguuucaacaagcaagaaaauacacgauaaaaaacgagaaaaacuauuaauaagaaauuuugacauagaauacgaaaacgaaaugauaaguaacaacgucuucgacacacauuacauaggauccuacuuugaaaaauauauugacgaacauuuacaauuuaaaaaaaguacaaaaaaacaaaaaguauuuucaauccacggaaacaugguagcccaucuacauaguagauggggcuucaauaaaaauucucgagaaauuuaccuuaaucaugccguagacgcagcuaucgucgcaguauugacagaucaacuaauacgaaauauagcagauuacuaucgaagagacaacauacuugaacagaaaggaucacucaaauuuccggaaccauggaaaagcuuuucaauagaacuggaagccagaauauccccgcaaguacgggaucuaauaaaaaagcuaaaucuagauagcuaccuagauguugacauccuucacaucaaaccaguauuuauuucaaagaaaccaagacgaaaagucaauggugaagcccauaaauccacaaucagaaguuuaaucggcauaaacgaaaucggaaaaaccguuaccugcaucaaaacuagauuagaagauauaccuuucgaugaaaauggugauuucccaauguacggcaaagacacagacaaauauacuuauacagcuaucaaagaaagauaccuagaauuuaacaaagacaaagaaaaagccuuuucaaccccuuuauacaaauuaaaacgaaacggcgaaccggguaaccaaauaaaaagcguaaaaauaauagauacaagaaauauaguaaacaaaguaaaccaaggaaaaggaauagcauauaauucaaacauaauaagaguugauguauuuucacgagaucaaaaauacuacgucguaccaauauacuugagagauuuuauaaaaggaagccugccaaauaaaauaauaaccgcagcaaaaggauuuaugcaauggcccgaaacagauaauucauauacauucuuguucucaauuuuccccaacgacuuaaucaaagucguaccaaaagaaggaaaauuuauaaaagcaaagaaugaaaauaaagagaauaucaauuuaacugaaauacuuggauacuucaaaggacuagauucaaguacaggugcauucacacucgaaucucacgaugguagccuauuagcacgaggaauaggaacaaaaaacuuauuacuuauagaaaaauaccaaguagauguauuaggacgauacaacaaaguuggcaaugaagaaagacaggauaucaaaauucaacaaaauuga

SEQ ID NO: 8482 - RNA, 3210 nt, Artificial Sequence
  Cas9 variant
augaauuaugauauaggucuccgaaucgggauaaccaguugcggcugguccaucauaaacaaagacuuagagagaauagaagauuuaggagucagaguuuuugagaaagccgaaaauccugacggcacagcuagugcagcaccaagacgagaagcgcguaaaucacgaaggaaacacagacgaaagaaacauagaaucgaacgaauaaaacgucuaauaguacagcacgaucuccugaguaagaaagaauuagacagcuuauacuuaucaccguucaacaucgacguauggaaucuucaaguagaagcauuagaaaggaaacucgacaacagagaauuugcacgcguacuaauacaccuaguucaaagacgagguuuucaaacaauaagaaaauccguagaaauacaagaagaaggcaaacucuuggaaaacguuagugaaaaugaacguaucaugaaagucaauggauauaaaacaguaggagaaauguuuaguaaacacgagaaauuuacacaucacaaacgaaauaaagaugguaguuacacuucagucgucacacgaucgcuacuccuaaaagaaauaaaaacuauauuuaauucacaacggauauuaggcaacguauucucaacacaaaaacuagaaagcgacuaccuauacaucugggguucacaacgcccuaccuuaacauacgaacagcuaaugagcaugguugggaauugcauauacgaaaagaaagaaaaacgagcucccaaaacaucaugggcauuucaauauuuuagccuucuacagaaaauaaacaaacucaaaguaucugacgauaauacccuucgaaaacucagcaaagaagaaagagacauaguaauagaacuggcauucaaaaagaaaaacgugagcuucguagauauacgcaaagcacuaaaauuaaaugauaacacuaaauuuaaccaccuuacauauucacacgucguugaaaccaagaaaguagaaaaagccacauucauugaauuaaaaggauaccacuuaaucaagaaacaauuaaaagacagaaauguagaauuaacgcaagagcuacaaccaaaagauuaugaugccauagccgcagccucuacauucuuuaaaaacgacaucgaauuucgcgacuaccuccguaaccaauaucuugauagcaacggaaaaagaaaaagcaacauagcaaauaaaguauuugaggauaaaguaauugcugcaguauuugaacuuaacuuuucaaaagucugucacuuaucguucaaaucacuauacaaacucauuccacauuuagaaaaaggauuagauuacaaagaagcuauucucugugcaggcuauaauuuccgagaugaaaauaaaagagauaagaaauuauucuuaccuguaauucaacaagagacuaacccaguuguacacagagccuuaacacaagcuagaaaaguaauaaaugcuauaauacgagaauauggaucuccaaauacgaucagauucguaguagcgaaugaccucgcaaaaacuuacaaacaacgaaaagagcucgaaaguacauuaaagaaaaacagagcagaaaaugagaaaauaaaaaccaaacuacuaagcaugggaauaauaaaccccacuggaauggauauuguaaaauauaaauuaugguacgaacaaaguggcauuugcuuauacacagguaggcaaauggaacuaucuucccuauuuaaacccggauauucuauaguuaaucacauaauacccuauaauagauccuucgacgacacuuaccauaauagagucuuaacccucaccgaaacuaaguacgaaaaaggaaauaaaauaccauuugaauacuucggagcugaagagaccuguuggaaugaauacgagaaaagaguaucaacuucaaagaaaauucacgacaagaaaagagaaaaacuuuuaauaagaaacuuugauauagaauaugaaaacgaaaugauauccaacaauguuuucgacacacacuauauaggaucauauuucgaaaaauacauagacgaacaucuacaauucaagaaaaguacuaagaaacaaaaaguuuucucaauacacggaaacauggucgcacacuuacauaguagauggggauucaauaaaaauucgagggaaauauaucuaaaccacgccguugacgcagcaauugucgcaguacuuacagaucaauuaauaagaaacaucgcagacuacuacagacgagacaacauauuagagcagaaaggaucacuaaaauuccccgaaccauggaaaucauuuagcauagaacuagaagcaagaauaucaccccaaguaagagaccucauaaagaaauuaaaccuagacuccuaccuagacguagacauacuacauauaaaaccagucuuuauaaguaagaaaccccgaagaaaaguaaacggcgaagcacacaaaagcacaauacgcucacuaauuggaaucaacgaaauaggaaaaacaguaacaugcaucaaaacacgacucgaagauauuccauuugaugaaaauggagacuuccccauguacggcaaagacaccgacaaauacacauacacagcaauaaaagaaagauaccuagaauuuaacaaagauaaagaaaaagcauucucgacaccucucuauaaacuaaaaagaaauggcgaaccaggcaaucaaauaaaaaguguaaaaauuauagacacacgaaauaucguaaacaaaguaaaccaaggaaaaggaauagcauacaacagcaacauaauacgagucgacguauucucaagagaccaaaaauacuacgucguaccaauauaccuacgagacuuuauuaaaggaucauuaccaaacaaaauaauuacagcugcaaaaggauucaugcaauggccagagacagauaacagcuacacuuucuuauucaguauauucccaaacgacuuaauaaaaguaguaccaaaagaagguaaauucaucaaagccaaaaacgaaaacaaagaaaacaucaacuuaaccgaaauacuaggauacuuuaaaggacuagacaguucaaccggagcauucaccuuagaaagccacgacggcucacuuuuggcgagagggauaggaacaaagaauuuacuucuaauagaaaaauaccaagucgacguccuuggccgauauaacaaaguuggaaacgaagaacgccaggacauaaaaauccagcaaaauuga

SEQ ID NO: 8483 - RNA, 3213 nt, Artificial Sequence
  Cas9 variant
auggcuacaagacuaggacuagacaucggaacuaauuccauaggauggugcuuauacgacggagauaguauacgagauauaggaguacgaauauucuuagaugguagggaaccauccaaacuaacuguaaguggaucaggaacuccccuagcaguuaaaagacgagaugccaggggagcaaggaggagaagagauagauacauuggacggagaagugcaaugcuucgagaauuaaggaagcauggauuauuaccugcagacccuaaacaagcaaaaguacuggaaacucaagauccauacgcauuaagaguacgugcauuagacgaaaaauuagaaccacaccaaauagggagggcacuauuucaucuaaaucaaagacgaggguucaaaucuaauagaaaagcggaacgagcgaguaaagcgggagaagacgguaaaauagcuacugcuacgaagcuauuagacgaagaaaugcaaagacuaggggcaaggacacuaggagaguucuuaguuaaaagagauucagaguucgauggagaagccgguaaaagggucaggaugagagcagauaguaaagcauaugauuuuuauccagacagacgacauguacuagacgaauuuagggcuauauggaaugcccaaaaagucuggcauccagaauuauuaacggaacaggcuuggaacgacauuuuucgagugauagaauaucaaagagaacuuaagccacaaguagucggacauuguacauuugcaggaauuaauggaguaccggcagacgaaaaacgacuuccaaaagcucauccacuauuucaacaaagaaggcuuuaugaagaaguaaaucaacucaaaguuguagcaccuggagaagcgggucgaccacucaccagggaugaaagagacgcauuaauuuuaaaacuucaagauaagaaaucuguuucuuuugaaacuuuagggaaaacucuuaaacuuaaagauggggagagauuuaauaaagaaucagaaaacagaaaagccuuggauggagacgaggucagagcagccuuaucagguaaaaagcuguucggaacuagaugguuucauuucagugcagaagaacaauggaugaucauugaaagauuauuagaggaggaagauagugaaacauuguuaaccugguugaagaucggcuaccgacuagaugacgaagcugcacuggccguagccaaugcaaaauuaccagaaggccacgggagauucggguugagugcaacaacagccuuacuaaaagaauuaaaagcggauguuuguaccuaugcagaagcagccaagagagcaggauuucaucauucugauuucaggaccggagaaguuuucgaucaauugccauauuauggggaaauacuagcuagagagaucgcgccagguaaaccagaauauggcgaugaaaaugaaagaagauuugggaaaauaacgaacccuaccgugcacauaggccugaaccaauuaacuaaauuggucaaugcuauaauaagguuacauggaaaaccugauuauauauuuguugaacuugcaagagaauuaaaauuaaaugagaaggagaaaauagcauauaauaggcaacugaaagaaaacacagaugcagccagagacagaggggcgaaauugggaacuauggguguaagggauacaggacgaaaccggcuaauuuuacggcucuggacagaacuaaacccuggagaugcuuuaaaucgaagaugcccauuuuguggagaacaaauuagucaacgaaugauucagaauggugaaguagaaauagaacacauuaucccauauagccaaugcuuugaugacggaauugguaauaaaguucuaucccaugugcguuguaaucgacaaaaaggagaucagacaccaugggaaagauggggacaugauccagaucgauggucaauaauucaggaacaaguugcucaccuucacagaaguaaacaauggagauuuggucccgaugcaagagacagguacgcagcagaagaagauagcuuucugccaagacaacuaauagauacacaauaucuaaccagaauugcagccaaguaccuugcaugccuauaucccgaaaggggugaaaggcauguauuugcaguacacggcggaaugacggcaaugcuuagaagguuaugggaucuaaauucaauuuuacuagaccacaacuggguagaaaaucuaaacaguaaugcacccaaaaauagauuagaucauagacaccaugccaucgacgcggcaguaguuggaauaaugacgccaggacuuauagcagaaauagcuaaagccgcugcacgugccgaaaaacaaaaucuugacagacuauuugaagaacuuccaaugcccugggcucaacauccaaaugacagacgauuuagagacgaauuaagagaaaagaucuuagcagcgaccguaucacacaaagcugaccacggaagacaaggaaaaccugaaagagguagagauauaacugcuggaaaauuacauaaugacacagcuuauggcuucacuggacugacaucagacacagggcuuccaguaguuguacaucgagucccuuuaacaucacucacaccaaaagacauagcagaucccgaucgaauaccagacacaacgcugagaggaucuuuauggcaagcaacuagagacuuaagcggaaaagaauuugaaaaagcgcucuuagacuucucaaggacacaugcacaauucaaagguauuaggagaguaaggguuagagaagguuuaacucugauuccaauucguaaccacgcugguaaaccuuauaagggguaucugggugauucuaaugcacgguacaacguauggcaaaugcccgauggaagauggguacaucaaguaauaucaacauucgaucuacaucaaccaggauuuauagaacaacgcccacacccugcagcaaagaaaguucuaagucucaggcagaacgacuuaauagcgauagaaagagauggagccuuaagacaaauaaugcgaguacaaaaauacggacaaaacggacaaauauuucuaauagaacauaacgaggcuggcaauauggcggaaagaaauaagaauacugaugauccauucaaauucuaugggccaggggcaagugcacuuagaaacaugaaggcaagacaaguuagaaucgacgagcuagggagaauauuugacccgggaccaagguga

SEQ ID NO: 8484 - RNA, 3213 nt, Artificial Sequence
  Cas9 variant
auggcaaaagacuuugaauacauacuaggacuagaccuaggugaaacaagcaucgguuggaguguuguaagauuaaacgagggagucccugaacaucuagaaagacuuggaguaagaaucugcucagauggaagagacgcacaaagucaugaaccacuaagcguugcaagaagaauagcaaggggauuaagacgaagaagggauagguacauccacagacgcauuagacuaacagauguccuagucaaauacggauuaaugccggaagauauaaaagaaaggaagaaacuacaagcacuaaauccauacagacuaagaagcgaagcacuagauagaaaacuagaaccauaugaacuagguagaguuuuauuucauauaaaucagagacgcggauuuaaaagcaauaugaaaacugauagaaaagacagcgaaucuggugccaugaaacaagccauacuuaaaacccgcgccaaaauggaagccucaggugcaaggacacuaggagaguuccuauacuuucuuaacaaagacaaaacaaguacacaagaauacguuccagucagaaugagaagucauagcgagaaaaacaaaacaguauacgaaauguauccagaccgggcaauguaugaagaugaaguccacaaaauauuugaacaacaagaacuaucaccagaagcgcaaacagaaauauucaauacaauauucuuucaaagaccuuuaaaaccgguagaacucgguuuuugugaguuugaagauggagaaagacgagccuauacagcgaguguagucuuucaaaaauucagagcacugcaacaaauuaaccaaauauauguucaggacgauuaugaaagacggccacuuacuaaagaagaaaaagacaucuuaaaacauuuucuauuagaagacuucucggcauuagauaaaaacgggcuacuaaccugggcaaaaguuagaacguuacuaaaacuacaaaagaagaaauuuaauuuagaaucagaaagaagaaaaggacuaaaugcugauguaacgagcuggaaacuuucaaaugcagcauguuuugguagagaaugguuuucuuuuagcgaugcaaagaaagaagagauaguagccuuaaucacaggagcagaaaaagaagaagaacuaauagcagaacuaaaaacaaaauauggauuaucagaugaacgggcuaaaaacacagcaaacguuucacuaccugauggcguagcaagccuaucagcaaaagcaaugaagaaacuaauuccauuuuuagaagaggggauguuauaugacgacgcagucaaacaagcaggguacgucuuuucuucaaguuuuaaaggaguuuuacccgaaaaauaugaaacauuuauagaaccagaaaguggagaaugcuuugaugaauuacccuauuauggccaaguauugagaagguacguacuuggaggaguuccaucagaagaaaauaaacuauuuccagaaaaauauuacggaaaaaucaauaauccaacaguacacauaguauuaaaucaauuacgaaaacucauaaauucacuugucgcaaaauacggccacccaagaaaaauagucguugaaauggcaagggaccuuaaacucucgaaaaagcaaaaagacgcaauugcuaaggaacaagcacucaaugaaagagaaaauaaaagaauaggagccgaacuagaacgauuagauauaaggaauaauuaugauaacaggaugaaauauaaauuaugggaggaucugucaacagacccaacaaaacggucauguccguuuugugguaaacaaauaagucaacaagauauauuuucuccggaguucgaaauugaacacuuaauuccauucucaaggagcuuuauggauggaagauccaacaaaguuuuaagcugcagaagaugcaaccgagaaaaaggcaauaaaacuccguuugaggcuuuugggaaugauucaacucgauggaaugcaauaaugggacgagucgagagcuuaccggaaaauaaacgauggaaauuugcuucagaugcuaugaguagauuugaaagagacggagaccuauuagcgagaaugaugacagacacacaauacauggcacgaaucgcuagacguuauuuauguugcgcugcaaacccuaaccaaguauaugggauacccggacaguugacagccaaacuuagagaacauuggggacuaaacucgauauuaucggaccaaaaagaaaaagacagaucagaccaucgacaucaugcaauagaugcauuuguaguagcuugcacugacagaggaacacuacaaaaguauucgacugaacguagagauuacgcaaaaccugaaaugccaagugaaaaagcaccacauauaccauuugccgauuucagacuaucugauaucaaacgaguauuugacgaaaucauaguaagucacaaaccugaucgcggaaaugcaagagcagcgauauuaaaagggggaacaguugccaaacuacaugaagaaacuuauuacgggaugggcggagaagguucuaagaaaggaacguggaaacuaauacaaagaauaccuguuucagaaauaaagaaagcaagcgauuuagauuguuuaauagaccagaaaggaacagcuaauccauugagaguacuccuugugggugcuucagaaucugaacaggaacaaaucauugcgagcuacuuugcaagaagagguacgcauaaaguaaggacauauagagaaagaaauaaagauguaaucuuaccauuuaaagauaaagauggcaaacucuaucguuaugcagucuauggcaguaacgcauacgcugaaauauauuguccagauagagguaaaaacgcaggaaaauggcaaguagaaauuauaccgaauuacugcgcacaccaaaaaggcuuuauuccuaaauggcggcacacagaugcccaugcuaaauuaauaaugagacucuauaggaaugacaugguagcauacgaaaaagaaggcaaaacuguaauagcacguguaaagaaaaugggugggaacggaguaaucguguucaggaaccaccuaaucgcuaaagaagaaggugacagauuaagcuggcaagccguaguaaguggcaugcaaagugcaaacuuaagaaaaauauauguagacgucuuaggucgcguaauagaucccaaacgaccaaugacacaaaacgaaacugacggacaagauaauuga

SEQ ID NO: 8485 - RNA, 3213 nt, Artificial Sequence
  Cas9 variant
augucgcacuucagauuaaaacaauuaaacuacauacugggauuagacuuagggauugcuucaguaggaugggcuguuguugaaauugacacugaagaaaacccgacgcgucuaauagacguuggcguuagaacuuucgaaagagcugaaguaccgaaaacaggggauucucuagcagcggcaagaagacaagcaagaagugcuagaagacuaauacguagaagaacacaccgacuacuaagagcuagacguuuauuaaaacgcgaggguauccuucaugccgacgaccuaaaugcagaaggccuugucaaagaacuacccaauacuccauggcagcuaagaguugaugguuuggauagaaaauuaaugccaaaagaaugggcagcuguacuuuuacacuuaguaaaacauagagguuaucucagucagcgaaagaacgaaagugaaggagcugacaaagaguuaggaagacucuuggcuggaguucaugaaaaccaucaagcacuacaaucgagugaauauagaaccccagcagaacuagcagugaaaaaguuccaagcacagaguggacauauaagaaaccaacgaggagacuacacucacaccuuugacagaaaagauuugcagcaagaacuacaucaauuauuugcagcgcaacagaaauacggcaacccauucguaucagauggauugaaacaagguaucgaaacauuacuaaugcaacaaagaccagcuuuaucaggagaugcaguacagaaaaugcugggaagauguacauuugaaacagaagaguucaaagccgcaaaacacaccuauucagcagaacgauuuauauggcucacgaaauuaaauaaccucagaauacaagaaaacggcaaugaaagaugccuaaccgcacaagaaagaggacaaauaauagacuuaccauauaagaaagcaaaacuuacauaugcacaaguaaggaaagaacuaucauuaccagaaaacgcauucuuuaaaggauuaagauauggaaaagaaaacgcagaaacggcagcacuaauggaaaugaaagcauaccaugcuauuaggaaagcauuagagaaagcaggacugaaaacagaauggcaaggauuagcauguaaaccagaauuacuggaugcaauaggcacuguauuuuccuuauauaaaaccgacgaagauauauccacacgccuacaagggcaacugagugaagacguaauaaacgcuuuacuugcggguuuaaauuuugauaaauucauacaacucucccucaaagcccugucuaaaauauuaccacuuauggaacaagggcaaagauaugaugaagcccaugcagcguuauauguaagaucaacaccacaaccacaacgcuuauuaccacaaauaacagcagaugaaauauguaacccaguaguccuaagaacacucagccaagcucgaaaaguuauuaacgcaauaguaagaagauaugguucaccagcuaggauacacauagaaacagggagggaagucgguaaauccuuuaaagaucgacaagaaauacagaaaagacaagaagacaaucauaaggaacgaaaacaagcagcagaaaaauuuuuagaauacuuucccaauuucguaggacaaccaaaagcaaaagacauacuaaaacuuagacuauaucagcaucaacacggacaaugcuuauacaguggaaagacacuagacauaugucgauuaaaugaaaaaggauaugcagagauagaccaugcacuuccguuuaguagaacaugggaugauaguuucaauaacaaaguuuuaguucuagccggagaaaaucaaaauaaagggaaccaaacaccauaugaauggcuaggcggcgcuagcaauaguccaagauggcaggaguucgucgcgcgaguagguucuagccgauuccaccacaguaagaaacaaagaauauuguugcgccaguuggaugaagaagguuuuaaagaacgaaauuuaaaugauaccagauauguagcacgauucuuaugcaaguuuauagaagaaaacauguuacucuuagggagagggaaaaggagaguuuuugcaaguaauggccaaauaacaucauucuuaagaagcagauggggucuaagaaagguaagagaagaaaaugacagacaucaugcauuagacgcaguugucguagcuuguucuacgguagcgauacaacaacgaauuaccuauuuuguaagacaaagagagaugaauauauuugauggagaauuaauagauaaagagacaucagaaguaagcagaccauauuuuccacaaccgugggauuucuuucgacaagaggugaugaugcguguauuuggaaagcccgacggagacccuaguuuuccagaagccgacacaaaagaaacacuuuguacacuccuugaaacaagauuaaguucuagaccucaagccguacacgaauauguaacuccacuauucguaagcagagcucccacuagaaaaaugaguggucaaggacauaaagaaacaguaaaaucugcaaaacuacuacaugagggcaaaucaguccuaagaguaccauuaacacaauuaaaaccaaaucuacuagagaaaaugguaaauagagauagagaaccucaauuauaugaagcgcuaaaagagagguuagcagcuuacggaaaugauccggccaaagcguucgcuacagaguuuaggaagaaaggcggacaguuaguuaaagcuguuagaguagaagauacacagaaaagcggaguauuacuacacaaaggaacgggaguagcugauaacgcaacaaugguuagaguagacguauuugagaaaucaggcaaauacuauuuaguaccaauauauaguuggcaaguggcacagggcaucuuaccaaauaaagcaguaauacaagguaaagacgagaaaaacugggaugaaauggacgaaacuuauacuuuuaaauuuucaauguacccaaacgaccugguagaaauuaacacuggaaaacaacgacuauucgguuauuauauaggauuagacagagcaacaggagcuauaucaauaagagaacaugauuuagacaauuuuaaagguaaaaauggaauauaucgaguaggcguaaaaacagcuauaaguuuuaagaaauaccaaaccgacgaauuagguaaaguugugguaccuuguagaccuaagaaacgccuuccaguacgauga

SEQ ID NO: 8486 - RNA, 3216 nt, Artificial Sequence
  Cas9 variant
augagguuaggauuagauauuggaaccaauaguauagggugguggcuauaucaaacggaugauggaacuaucacggacguauuagauggaggaguacgaauauuuagcgauggucgagacccacagucaaaagaaucacuugccguagauagaagaguagcaagggcgcagagaagaagaagagaucgauaccucagaagaaaagcugcauugaugaaaagaauggcgggugcaggccuaaugccaacagaccaagcacacgcaaagaaauuagaaucauuagacccuuaugcacucagagcagaagggcuagacugugaacugccacuuacacaucuagguagagcccuauuccaucuaaaucaaagaagagguuuuaaaaguaaccguaaaacagauagaggagauaaugaauccgguaaaaucaaagaugcaacugcacgcuuagauugggcaaugagagacgcaaaagcgagaaccuauggagaguuucuacauacaaggcaacaaaaagcagacgaucccaagcgaaugccaaccguaagaacacgauuaacuguggcaagaagagacaaugcagaaaaagaagaagccggcuacgauuuuuacccagacagacgacaccucuccgaagaguucgaugccuuaugggccgcacaggcagauuaucacgaagcacucucggacgauuuaagagaucaaaucaagacaauuauauuucaucaaagaccacuaaagacacccgaaguaggacuaugccuuuuuacagacgaaagaaggauaccaagugcacauccacuaaaccaaagaagaauuuuauuagaaacagucaaugcguuaaggauuguagcuagaggggaagcugcuaggagauuaacguuagaagagagagaucaaauuguacaugcuuuagauaauaaaaaucacacaaagacuuuaaguggaauggcaaugaaacuaaaagcucuugggaaagugauaagacuacguagugaucaaacauuuacacucgaaacagcaaauagggacgcaauagcgugcgaucuuguaagagcaagucuuucacauccagauagaaugggaggaguauggacaacccuagaugaaggcgcacaaugggaagugguacaaagaauuagagcaguucaaagugauuccgaguucgacgcuuuaguaguuugguuagaacagaaucauggacuugauaacgcgcaugcacaagcaacagcuaaugcuccuuugccagaagguuaugggagaaugggccuaauggcaacccgaagaauacuagcugcacuucaaagcgacguuaugccuuacagcgaugcaguagcugcauguggauggucacacucaggaggacccaccggagaagucuuagaaaaacuuccguauuaugggaaaauucuggauagacaugucauaccaggcaccuaugaugaaaacaaugaggauguaaaaagguacggucguauaacaaaucccacaguacauauagguuuaaaucagauaagacggcuaguuaauagaauaauauguauacacggcaaaccagaugaaauaguuguagaauuagcgagggaucuaaagaacagugaagaccaaaaacgagaaauacagaaaauaauuaagaaaaauacagacgcugcaauuaaaaggggcgagaaauuaauaaacgaauuaggucaaaaagacaccggugcaaauagauuaguguuaagauuaugggaagauuuaggacaugacguuaugacuagaaauugcccauacucgggcaaaagaauaucagcggggauguuauuugauggcucaugcgacguagaucacauauuaccguacucgaggacauuagaugaugggauagccaacaaaacauuaugccuaaaagaggcaaacagacagaaaucaaauaauacaccaugggaaguauggggcgaaaccgaacaaugggauacgauagcagccaaucuuaaaaaucuaccggauaauaaagcguggagauuugcaucagaugcuaugcaacgauucgaaggagagaacgauuuuagugcaagagcacuaaaagauacucaguaucuaagcagaauagcgagagccuaucuagaugcacuauaugauggaggugacgguaauucacauguauggguaguaccaggccggcucacagaaaugcuaaggagacauuggggguuaaacggauuagaagcguuaacagacucagacgaaaauacaguaaaagcuaaaaauaggauggaccaccgucaucaugcaaucgaugcugcaguaguugcagcgacagaucgaggucuaauucaaaggauauccaaaauagcaaaaagagaugaacaagcaggagcagaagaagucgcaagaucugugucuccucccugggacggauucagagaugauauagcagcacaauuaaguagaauuauuguuagucacagagcugaucaugggagaauagauagucaagcaaaacagcaaggagaagaugcgacugcuggucaacuacauauggauacggcauaugguguaguggacgcaggaagaguaguuagccguaaaccccuuuuaucgcuuucggaaagugauaucaaaaagauaagggacccggauuuacaaagacaucuaacccguguuacuaagggacuagauaaaaaggaguucgaacacgcacuaucagauuucgcgaacgcuagaaaacuaccagaccagagcgaaaauccguauuuuggcaugagaaggguuagguuaauagaugcauuacaggacucagcacgaguaucgguaagggauagggauggacauaucuauaaggcauauaaagcgggaucaaaucauuguuaugaaguguggagacuaccagacggaaaaaucaaaccaugggcaauaucaacauucgaggcucaucaaaccggaacagaaaguaaaccgcauccagcagccaaaagauuauuaagaguauuuaaacgagauaugguugcaauagaaagagauggagaaaccuugauguguuacguacagaaaauggauauagcaaacggguuauucuuaguaccgcauacagaagguaaugcggaugcaagaaacagggauaaggacgacaguuuuaaauucauacaaaugucggcuguuuccuugauaagagcaaaaauuaggagaauacauguagaugaaaugggacgacuuagggaucagggaccucccagauga

SEQ ID NO: 8487 - RNA, 3216 nt, Artificial Sequence
  Cas9 variant
augagauacaccauuggacuugauauugggauagcaaguguaggaugggcgguuauaaaugaagauaaaaguagaauagaggauuuaggagugagaguauuuaaaaaggcagaagaaccugauggaaagucguuaaauuuagccagaagagaagcacguggaucacgaagaagaauacgccgacgagcaacacgaaugcaaaaaguaaaagaacuguuaguuaaauacaaccuaguuuccgaaaaagaacuggaaacacuauauauaauaacugaaacuacaccagacguauaugaacuacgagcaaaaggccuugaucgucuucuaaguagacaagaauuugcaaggguccuuacaaacauagcgaagcgaagaggauacaaaagcaaucgaaaaauagacgaagaagacaaagaaguagggaaauuaucaaaagguaccauagaaaacaaacgaauacuccaagaaaaaggauaucgaacaauuggagaaauguuuuacaaagaugaaaaauuugaauauaacaaaaggaacaaggcgggagaauacaacaguacgguacuaagaucuaugcuuauagacgaaguacauacuuuauucgaaaugcaaagaaaguucaaaucagaauucgccaacgaagaauucgaaaaagaauacguagaagucaugacuuaccagaaacccuacauaacgcccgagcucuuagagaaaaugcugggaaaauguacauuugaaaaaggagagccaagagcucccaaaaauucauacaccuuugaacgcuuuaugcuauuacaaaaaguaaauaaucuuaacauuuauauaaacggcgaaaaaguagaaauaccacaggaaaaaaagaaagaaauaaucgaauuagccuacaaacaaagugaaauaaaguacacacaacucagaaaaaaacuagaacuaccaauagaagcaagauuugcagaccuaaauuaucaaaucaaaagaacagaggaugaaagcgaagaagcacuaguaaagaaaaucgaagauaaaaaauuuguaaaacucgaaggauggcacaaaauucgguuagcgcuaaaagaaaauaaagauaaauuugaaaaaaucgaaaaaaaccccgaauuacagaacauaauagcagaugcacuaguacgaaacaaaacagacgaaaccauuaaaaauuacuuagaaaaaucagacaucgacgaagagauaauaaacgcuauacuaaacaucaacuucacaaaauuuggucauuuaucauauaaagccaugaacaaaauaauaccagaauuagaaaaaggucuaacuuaugauaaagcaugcgaaaacguuggauaugaauucaaaggaagaaaaaaugaacuccaauacaaauuaccaccagugacggaacuggaagaugaaauacugaacucagucguacuacgagccgucagucaaacacgaaaaguuauaaaugcaauaauagauaaauacgggagcccuacagcgaucuauauagaaacagcaagagaacuaucaaaaccauaugacgaaaggaugaaaauagaaaaaagacaaaaagaaaaugcagcaaacaacgaccaaaucaaagaauacauaaaagaaacauuuggauucgacccaaaacccuuugacauaguaaaaaugaaauuauggcgagaacaaaauggcaagugcgcuuauaguucgaagccaauaccagccgaaagacuauacgaagaaaacuucguacaaguagaucauauaauacccuuuucccggugcuuugacgauaguuaucaaaauaaaguacuuguacuaacagaugaaaaccaaaaaaaaaaagaaagaacgcccuuugaauauuucggagaagauaaagaaagauggcaccaguuugaagaauucgucaaucuaacauauaaauucaacacacgaaagaaagagaaccuacuuauaaaaaauuuuaacgaagaaaaaucaaaagaguggauacaaagaaacaucaaugauacaaaauacauuucaaaauuuauguauaacuacauagccaacaaucuaaaauuugcagauucugaaaguaaacgaaaaguauauaacauaaauggacaagcaacauccauccuacgucauuauugggggcuaaaaaaagacagagaagaaagcgacaaacaccacgcccaagaugcaguaauuauagcgugugccacuaacaaaaacaucaaaaagguuuccgauuacagcagaagaaaauuauuauauaaaaacaaugaaauuaucgaugaagaaacaggggaaauaauagauaaaaaauauaacauagacauuagcauaaaagaaccauggccaaaauuccgagaagaagucgaagcucguauggaagacgcagacaacaacggacaauuauaugcacuaauuaacggaaauuuuacuaacuaugacgacguagacauuacacauauaaaaccaauuuucacaaguaggaugcccgaaagaaaaauaacaggccgagcucacaaagauacaaugagaucacagaaauucauccaacaaggacaaaacuucaccgucguaaagaaaccacuaaaggcaauaucaaaacaagaaauagaaggaaucauaaacaauccagacuucaaaaauuuauaccucagcgacaaaaaacuauaugaugauaucuaucaaaaaaugaaagaagcagacuuuaaagcagaaaaagcuuucgcaaacgaauauagaaaauauucgaagaauggaaacucacccauagucagaagcauaaaagucgcgagcgccggggcaacaggcguacaacugaaaaacggagcuauagcagaaaacgcaaacauggucaggguggacguauucgaaaaggacaauaagaacuaucuggucccaauauauguaagugacuuugcaaagaacgaauuaccaaacaaagccauaugcgcuaauaaagacgaaaaagaauggauagaaaugacggaaaaauauaaauucaaauucagucuguacccuaacgacuuaguaaaaauaaaaagaaaaaacgaaaaagaauucuacgcauacuauuguucaacucaccgcggaacaggaaacauaaaucugcuacuagugaacggagaagcaagaaaagacggaguaggaauaaaaaauacagaaaucuucgaaaaauaccaaguagacguucucggcaacauaagcaaagugaacaaggaaaagagagaaggaguuaaauga

SEQ ID NO: 8488 - RNA, 3216 nt, Artificial Sequence
  Cas9 variant
auggauuauagaauagggcuagauauuggaaccaauucuauaggaugguccauaauagaacucacaaccgugcagaguaaauuagacggcaaauaccgauuaaaagccguaggcuuaauugaugcuggcguacgaauguuugacagagcagaaguaccaaaaacgggagcaagccuagcauugccuaggagauuggcaaggucaucgcguaggagauuaaccagaaggucagcaagaaagaaagccauaagaaaccuucuagucaaagaagacauacuaaaucagauagaauuagaucaucuauaucguacgucagaacuggucgauauauggcaaauaagaguagaaggcuuagaaaggagacuaggcagacaagaaugggcacgacuuuuaauacauuuaggacaaaaacguggguaucggucaacuaggaaagcagaagaaggugcagauacagaagguagagccguacuaucuuccauaaaagaaaaccaagagaccuuaaaacaauauagaacaguaggagaaaugugggccacugaugacaaauucaaaggcagaguaagaaacuccaccaacgaguucaucuuuaacguaagccgcgauaauuuagaagaagaaauacgauuucucuuucagcaacaaagagaacuagguucaauguacgcauccaaauuauuagaagaaaguuacauggaagucuggggccaucaguuaccauuugccucaggcgaaaguauacucaaaaacguaggaacuugcucacuauacgaaaaagaaaaacgagcagcaaaagcuaccuauacauuccaauauuuuauggcucuugacaaacuaaauaauguaagaauccuacccucaaugagaacauuaucagaagaggaacguggacuugcacuuaaagcaauguucgaaagagauaaauuaccuaaaaauccaccaaaauucacuuauucucaucucagaaaagcaauuaaacuagaagaagacgaaacauuucagacaauaucuuacgauguagagaaaacguuagcaaccaacgaaucagcaguauuuguaaaucuagcggcuuauuaucaaauaaagaaaguaugugaugaacacaacgaaaauuacgacuacguggacuacaacacaauagggcaugcacuaaccguauauaaaacugacgaggauauuaauaaauacuuagcaagcaaaaauaacauagcaaaaaggguuuacgccaaugauuucaucgauaguguauuaaaacacucauauacuacauuuggccauuuaucauuaaaggcuuuaaguagaauuauaccauuaauggaagaaggugaaguauuugcaaaagcaaaagaaaaagcaggauuuaaagaagaaagcuauuuagaaauaaaaaguaagcuauuaacaaauauaccagaugccaucaaaaauccagucguaaugagaagccugacccaagcaagaaaaguuauaaaugcaauaauaaaacguaugggagaacagccugcaucaauucaaauagaacuagcaagagaauuaucgaaagauguuucugaaagaaagaaaauaacaaauggcuucgcggagaauagaucacgaaaucaauuugccauaaaaaccuuagaagaaaaccauauaacgaauauacgcggacaagauauaguuaaauucaaauuauggcaggaacaagggggaagaugugccuauagccuaaaaccaaucaaauuagaagaacucauuucauuccugaaaaaggaacgaagauacgaacacaaucuagauguagaccacauaaucccguacucaaaaacauucgaugauaguuauacaaacaaaguacugguauucagugaugagaacaggaagaaaggagaccaaaucccagcagaauacuuaggaauagguacgaaacgaugggaaaaauauaaagaauuuguaauaacaagcaaguucccggcaagcaagaagaaacgacuauuaaaagaacaauuaguugaaagagaagaauuauuuaugaaagaacggcauuuaaaugacacaagauaugcuagcagauauuucaugaacuuucugagagaaaaccuuuuacguaaagaaacagucuuacacgaaacgcagugggucacggcaguagcaggaagaguaacaucacauauaagaaaaagacuaggcuuuggaaaagauagagaagaaacacaucugcaccacgccuuggaugcaaucauagucgccugcacugauaaauggaugauagauuguguaaccaacuauuauaaaagcagagaaggcggaagcauaaaacgaaaagagaucagauucccgagcccauggaaugguuucuggcaugauguucaaaccaaauuggcacaauuaccacaaccagaggucauaaacgaaucaauaucuaaaggaaauccugacgcaguggauuacaugcuuguuagucgaaugccaaggaaauccauaaccggugcagcucauaaagaaacaauaucaaaauggggaggauaugaugauaagggaaaggcacuauuaguuaagaaaguagcucuaucagaacuuaaauucaaaaacgaugacuucccaauguauaauaaagaaacugauccacuacuauacgaagcaaucaaaaauagauauguagaaucaggacgagauguaaaaagagcuuuugccacaccacuuuacaaaccaaguaaaaguggaaaaagaaacgaagucaaacgagucaaagucauagcagagaagaaagcaaugguuagagaaguaaauggaggaauagcagaaaacggcggauuaguuaggagcgacauauuccuaaaagaaaagaaauacguuaugguaccuguauacacauuugauacaauaaaacaacaacucccaaauaaauacguaguaaguggacgaggguacgaacaauggccagaauuaacagcagaacacguauuccaguuuucaguuuauccauaugaauuaguacaugucgggacaaacaaaggggacaacucauucuauuauuuugcaucacuaaauauauccaguaacguacucaaauuuucggaaugcaaucgaccaacaaaagauuauauugaaauaggauuaaacaguauaauacuauuagaaaaauacgaaauugacguuuuaggucgcaucacugggcagucaaagaaaggaauaagacaaaguuuuaaaaauaacaaaucucaaaugaaagaauga

SEQ ID NO: 8489 - RNA, 3219 nt, Artificial Sequence
  Cas9 variant
augaggcuaggacuagauauagguacuaauagcguagguugguggcuauacaaaacggacggagaggcagccagugcaagaaucguagaaguaauugacggagguguaagaauauuuucagauggacgugacccaaaaaguaaaacaucauuagcaguagauaggagaguugcaagagcugccagaagacgaagagauagauaucuaagaaggagagcuagcuugaugaaacuuuuagcuagaacaggacuaaugccagcagauccuguagaagcuaaaaagcuagaaagauuagauccauacgaacuaagaucaacgggauuagacgaugcacuaccauuaacccauuuugguagagcacuauuucaccuaaaccaaagaagagguuuuaaaucaaacagaaaaacagaccgaggagacaacgaaaaugguaaaauaagagaggcaacugcaagacuagauuuagaaaugaugacgaguggggcaagaucauacggggaguuccuacauaugcguaggcagagagcaagcgaucccagacacguaccaucaguacggacacguuuauccguggcugcaagaggcgguccugacgcaaaagccgaagcagguuaugauuucuacccagauagacaccaccuagaagaagaauuucaugcacuuugggcagcucaagcaacacaccaccaggcacuuacugacgauuuacgagaucuagucuucgagaaaauauuuuaccaacgaccacuaaaagaaccaaagauaggauuaugucuauuuacagcagaagaaagaauagcuaaggcacacccacuaacacaaagaagaguacuguucgaaacaauaaaucaauuaagagucaccgcggacggaaggucaacuaggccuuuaacacuggaggaacgagauacauuagugcaugcacucgacaauaagaaaccaaccaaauccaugacuucaaugaauaugacauuaaaagcacuagcaaaacuucucaaauuaagagauggagagcgguuuacauuagaaacaggagugagagaaaauauuucaugcgauccaguaagagcaugcauggcacauccugccagauucggaccacaauggaguucauuagacugggaagcacaaugggacgugauauccagaguacgucaaguacaauccgagggugaguuuaucgaauuaacagauugguuaauacaaggucacggauuagacgcagaucaugcaaaagccguuggcaaugcuccucugccagaaggguaugccagacuugguuuuucagcaaccgaaagaauauuagaucagcuaaaagcagaaguuuguacauacucugacgcugucgcuaaaugugguuggcaucauagugaccaaagaacaggagccugccuugaaguauugccuuauuauggcgagguacuugauagacauguuauuccaggaacauacgaugcaaccgaugaugagauaacuagguaugggcgaauaacaaauccaacuguacacaucggauuaaaucaguuacggagauuaguaaacaaaauuauagaaguacacggaaaaccagaccaaauaguagucgaacuugcaagagaacuuaaacaaagcgagccgcaaaagaaagaugcaaugaaaagauuaagaaacacuacugccgaugcaauuagaagaagcgaacagcuugaacaacuaggacagccuaacaccggacauaauagaaugcuacuaagacuuugggaagaucuaggccccgcaauugguccaagaugcugucccuauacaggaaaaacaauaucgguaacgaugguguuugacggaaguugcgauguagaucauauucuccccuuuucgagaacucuggacgacaguuuugcaaacagaacauuaugccuaaaagaagccaauagagagaaaagugacagaacucccugggaagccugggguggaacggaccaaugggaugauauagcagcaaaccugaaaaaucuacccgagaagaaacgcaaaagauuuggaccagacgcaauggaaugguucgaaggagaaaacgacuuccuggaccgugcuuuaguagacacacaauacuuggcgaaaauaucacgaauguaucucgauacccuauuuacaaaaggcggccauguauggguuguacccggaagaaugacagaaaugcuuagaagacauuggggcuuaaaugcuuuguuaaacgauaaagacagaggagcuguuaaagcuaaaaacagaacagaucaccggcaucaugcaauagaugcagccguaguagcggcaacugauuaucguuuaaugcagaaaauaagcagagcggccggacaaggugaaaaugcaggucaaagcgcugaacuuauagcaagagauacagaugcgccaugggaacauuucagagccgauauugcaucucaauuagagaaaaucauugucagucauagagcagaucauggaagaaucgauguggaaggcaggaaaacaggccgagacucaacagcaggcaggcuacauaacgauacagcuuauggagugauagacgauuuaacgguugcaucgagaaccccacuaaugucacuaaaaccaagugauaucgcaauaacagaaagaggcaaaaacauaagagauccacaauuacaaaacgcuuuauauguagccacaaaagggaaagaaggaaaaauguucgaacaagcucugguugacuuugcaucuaaagaagguccauaucaagguauccguagaguacgucuaguagaaacacuacaaaaagccgcgagagucgaaaucgguaaaacugaaucuggccaaccauuaaaagccuacaaaggagauagcaaccauuguuaugaacucuggaaauuaccagaugguaaaauagugccucaaguaguaacaacauaugaggcgcacgcaggcagcgcgccaagaccacacccugcggcaaaaagaaucuuaagaguuuuuaagaaagauauggucaaacucacaaaagauggcgaagaaaucguaggauauguacaaucaaugcauauuaaaaaugguuuauuuguugcacaacauuuagaagcaaaugcagacgcaaggaauagagacaaaaccgauccauuuaaauuucuacaaaugggagcaggaaccuugguaaaaaccggauugaggagaguauuaguagaugaaauagggcgauugcgagacccuggcccaccgaaauuauga

SEQ ID NO: 8490 - RNA, 3225 nt, Artificial Sequence
  Cas9 variant
augcaaacuaaaaaccucccauauacacuuggacucgauauagguauggcaaguguaggugccgcacuccuucuaccagaucaagaacgaauuuuagcguuacacguaagaaccuuugauaaagcagaaacagcuaaggagggcgagucccuaaacaaaauaagaagagauucaagauuaacucguagaagaaucagaagacgagcgcauagauuaguaagacucgcuaggcuaaugaaaagagucgggcuuauagccgaugcaaauccugaggcauuugcuuugccagguguaucaccauggcaccuuagagcagacggguuggaucgucuacuugaacccaaagaaugggccggaguuuuauaucaucuagugaaacauagaggguuucaaagcaaucgaaaaagcgaagcaaaagcagaugaaaaagccggacaaauguuaaguggagucggacgaaaccaggcucuacuaaaagaggcaggauaccguacuguuggagaacuagcagccagacaugaagauuucaaagaagcaaaacgaaacaaaggggguaguuauucacauacuuuugccagagcagaucuaaaugcagaacuaaaucucuuguucgaaagacagagagcauuaggaucuagacuagccagugcugacuuucaagaaaacguuagagauuugcuuauggcaaggagaccaacauuaagcggagcuaacuuacuaaaaauggucgggaaauguacuuuugagaaaucugaagaucgagcuccaaaagcuggguauagagcagaaagauuuguuugguuggguaaauuaaauaauuuaaagauuguuggauccggagaugcucgaccacucaccgaugcugaacauagaauuguaauagaucuaccauucacacaagcaaaauuaacauucaaacagguaagaaaagccuuagaacucgaaacacaccaaagauuuaaccuacuaucauauagaccagacccaaaaggaaaagauaaagauccggaagaaucaacauucuuugaggcaaaaaguuuucacacucuccgaaaagcauacgaaggugcaggccuaaagaaagaauggcaaagggacgcauuggacccagaucgacuggacgcacuggcauaugcauugacguguuacaaagaugacacugagucaagacaaugguuaguugcccaaggaauugguacaccaauaauugaagcaguacucgcagaaaguuuugauaaauuuauucauuuaucacaaaaagcucuaaaagcgauacuaccgcauauggaagcgggacaacgcuacgaugacgccgcaaaaucagcgggauaugaccauucacaaccagacgcaggcacagguaaaagagcaacauuaccaccaccagauaaagauacaauaagaaacccaguuguauaucgcgcacuuaaccaagcacguaaauuaguaaaugcaauuguagcagaguauggaccaccagcagcuguccacauagaauuagcacgagaccugucaaaaccgauagacgaaaggagagauauagaaaaaggacaaaaagaauuucaagcacuaaaagaaaagcuagcugcggcauuugaagaaacuuuucauagaaagccaucaggucuagauuuauuaaaauacagauuauuuagagagcaacuugaccaaugcccauauugccaaaaggcccuaguuguggauagacuuuuugaaccuggauacgcucaaaucgaucaugcauuaccauauucaagaucauuugaugauggaaugaauaauaagguaguuguucauguugcaugcaaucaagacaaaggaaauaggacaccauacgaguuccuagacggagcuggagauucagaaagguggcaacgcuucguugcuuggguccaaggcaacaaagcuauaaggcaggccaagagaaauagauuacuaagggucaacuucgguacagaugaagcuaaagaauuuucgaaacgaaaucuauccgacacuagauacauauguagagaauuuaaaaggacaauugaaacacaguucgcauggcauucugaugcggaagggaaugagaggugcguaguauugucaggccaacugacaaguuuauuaagagcacgguggggguuaauaaaaguucgagaagacggugaucugcaucaugcauuagauguagcagucauugcugcagcgucaagaagucuaguaaaaaggauggcugacuauucaagaagaaaugaacucgaaauggugcgaaacagauacguagaucccgcuacuggggaagucguagacgucgcggcacuaagacaaauugaagaccauuuuccaaaaccauggccacuauucagagaagaacuacuggcaagacuagcacccgaaccaaaacuccaauuaacaugcguauccucuuaugaugaagguuuacgggaaaguauaagaccgauaagaguaagucgugcuccaaccagaagaggucugggcgcugcacaccaagagaccauaagauccuuacgagauggaucucagagugccauaaagacaccauuacgagauuugaaccuaaaagaucuagaaaauauaguaggauucgaaagagauacagcucuuauagaugcuauaagaacuaggcuagaagcauucggcggcgaagggaagaaagccuuugaugauaaacaaccuccauuaaggaaaccaucaaaagauccugauaaagcuccaaucauacgaucaguuaaauuauuaguaacgcagaaaaguggaauaccuauuagaggagguauagcaaacaauggugcuaugcuuagaagcgauaucuucacaaaagcaggaaaauuuuacgcuguuccaauuuauguagcagacgcaguaagaggagaacuaccccaucgagcaguugcacaagcgaaaccagaauuagaauggccgaugauggacgaaucauaccaauuccuauucagcuuacauccuaacgacuggaugacgauaagacucaaaaaugagguccgagaagguuacuacgcaggacuagauagagcgaccggaaauauaucucucuggcuacacgacagaaaccaaaacgugggacaaaaaggcuuauugacaggaaacggaaucaaaacggcucuggcaguagaaaaauaucauguagauuuacuaggaaaauuacacagagugcauaaagaagaaagacaaccuauacacauuaaacccgguaagcgcuga

SEQ ID NO: 8491 - RNA, 3234 nt, Artificial Sequence
  Cas9 variant
augaaauauucaauaggacuagacaucggaauugcaagugugggaugggcaguaauaaaugaagacauagaacgaauagaagauuuaggaguaaggauauucgauguugcagaacaacccaaaacuggcgcaucuuuaaguacaccaagacgacucgcuagaaguacgcgaaaacgauugagacguaggcgacauagaguggaaagagugcgaaaauucaugauccaaaaaggauuacuaacacaaguucaaauggaacaauuauacgauuggaaagacggugacuuagauaucugguuaguaagagucaacgcguuagaacggaaacuuuccgacagggaauuugcgcgaauacucguccacuuugcgaaaaacagaggcuuccaaaguaacagaaaaucagaacuacaagaagaagacaauggagccguccuauccgcaguacaggaaaacaaacgauugauggaagaaaaaggcuaucaaacaauaagcgaaaugcuauuauaugacgaaaaauuugagggaacaaaaaggaacaaaggaggagaauauacacacguagucgccagaucagaucuaaaacgagaaauccaacuuauauuugaaaagcagcgugcauauggccacgcauuugcaacuauggaaaacgaagauaaauucuuacagauaugguccagccaaagaccauuugccaccaaagacgacauagcaaagaaaauaggaaauuguacauucgaacccaaagagaaaagagccccgaaaucaacauauacauuugaaagauucagagcauuagacaaacuuaacagguuaagaauacugucuggaacgucaccagcaaggaguuuaacacaagaagaacgagaccuaauacugaacagucuuuuuaguaagaaagaaguaaaauacaaagaacucagaaaauuguuaaaacugaaugaugaacaaagguuuaacgaaauauucuacgauccaaacgaaaagauagagaaaaacgaaaacagaacauucuuaagucuagaaagccaguauaaaauaagaaaaaucuuacagaaaauagaaggaaaaagccuuaaugauaccuauagaccaguagaccuagauacaauagcuuaugcccuaacaguauucaaagacgaccaagauauacgagauuaccuacaaaaucaauacguagcaucuaacgggaagaaagaauuaaaucuagcuaauagaaaauauaacgacgaacuaauugaagaacuucuacauuuaucguucaccaaauuuggucaccuaagccuaaaagcacuuaggaacauccuaccauuuauggaacaaggaauaccauaucaccaagcaugcgaaaaagcgggguaucaguucaauaagaaaguaaauagagaaaaacaaaaacuccuaccuccaguaccagcaaaagacauaguaaauccagucguaauacgcucauuaucucaaguccgaaaaguaauaaacggaaucauaaaaagauacggauccccaaguagcaucuauaucgaacuagcacgugaaaugggaagaggcuacaaagaaagaaaagacuuagaaaaacaauacaauaaaaacagacaaaugaaugaaggagccaagaaacacauauuagaacuaagaccagaguucggagaccccagaggacacgauauauuaaaauacaaacuauggcaagaacaggacugucgaugugcauacucuuuuaaaagcauaccaauuaaacaauuauucgaaauuggguaugcugaagucgaccauauuauaccauauagccguagcuucgacgacagcaacaacaauaaaguauuaguucuggccgccgaaaaucaaaauaaacaaaauagaacaccuuaugaaugguucggacacgacgaaacaaaauggcaagaauuuacaagucuaguaacaacaaugaaagucaguaaaaagaagaaaucauugcuuuuaaagaaaaacuucgaugaagaacaagcagaggaguucagaucacgacacuuaaaugauacaagauacauaacucgauacauaaaaacauuuauagaagauaaucuacaauucagaauagaagaaggcaagaaaacguacguacacaccgucaacggagcauacacaaguuuaaugagaaaacgauggggcuuuaacaaaaaccgacaagaaaacgcauuacaccacgcacuggacgcuguuauaguagccguuucgcuacccuuuaaacauaaaguucgagccuauuucaaacgcagagaagaauacgcacacaaccaauuaaaaagagaaggugaguucuuccccgaaccuuggccaggcuucauacaugaauuagaaauacgaaugaugcaagauucagaaaacaucaaauuagcaauggaguccuuaaauuuaaaaacauaugaugagagcuuuauaaaagaacucaaaccaauauucguuagcaggaugccaaaacgagcuaugaaaggucaaauucacgaagaaacacucaaaagaguacguggcagaaccgacgauggcuauauaagaacaguuaagaaagucaaacucgaccagauaccauuugacaaaaauggugacuucccaauguuuggaaaagaaaccgacaugaaaacauacgaagccauaaaaagcagguaccuagaaagcggaaaagauaagaagaaagcauuuaacacgccccuauacaaaccagcuaaaaacccagaaaacgcaccuauaauaagaagcauaaaaauagaagaaaaagcaaaucguguaguuaugcuagacgaaaagacggcagccgacaaugcaaguauuguaagaacagaaguauuucgacacaaagaaaccgguaacuacuuccuaaccccuguauauguugcugauguuuuagcaaagaaagugccagaccguuuaauaacaacuaagaaaccuuacagcgaauggcgaaaaauaacagaugaauacgaguuucuauucucauuauauccaaacgaccuaauacgagugaaaaugccuaaagagaaagaaacuaaaacacacaccggagaaaaacauguauggcaagaaaauuuuauguauuucaaaggaguucacucaggcagugcaggaguacggaugauagaucacaugaacagcuucgaggacgagauaggagucagaaaauuaguuguuuucgaaaaauaucaaguugauccauuaggaagaaugaauaaaguucacggagagaaaaggcacggaauuuga

SEQ ID NO: 8492 - RNA, 3234 nt, Artificial Sequence
  Cas9 variant
augaaauacaguauaggccuugauauugguauugcaaguguugguugggcaguuauaaacgaagauaucgaacgcauagaagaucuugguguucgaauauuugacguagcugaacaaccaaaaacgggagcuucacuauccacaccaagacgucuggcgagaucaacucgcaaacgccuucguagacgacgacacaggguugaacgaguaagaaaauucaugauacaaaaaggccuauuaacacaaguccaaauggaacaacuauacgacuggaaagauggagacuuagauauuuggcuaguaaggguaaaugcauuagaaagaaaacuaagcgauagggaguucgcaagaauccuaguacacuuugcuaaaaacagaggguuccaaagcaacagaaaaucugaauuacaagaagaagauaauggagcaguccucagcgcaguccaagaaaacaaaaggcuaauggaagaaaaaggauaccaaacaauaagugaaaugcuucuauacgacgaaaaauuugaaggaacaaaaagaaacaaagguggagaauauacgcaugucguagcaaggucugacuugaaaagagaaauacaauuaauauuugaaaagcaaagagcauacggccaugcauuugcaacgauggaaaacgaagacaaauucuuacaaauauggaguagucaacgaccauucgcuacaaaagaugauauagccaagaaaauagggaacuguacuuucgaaccaaaagagaaaagagcuccuaaaagcaccuauaccuucgaaagguucagagcuuuagacaaacucaaucgucuacgaauauuaucaggaaccucacccgcgagaagccuaacucaagaagaaagagacuuaauauugaacucucuuuucagcaaaaaggaaguaaaauauaaagaacucaggaaauuauuaaaacucaaugacgaacaaagauuuaacgaaauauucuacgacccgaacgagaaaauagaaaagaacgaaaaccgaacguuucucagccuagaaagccaguacaaaauuagaaaaauuuuacagaaaauugaaggaaaaucccuaaacgacacauacagaccaguugaccuagacacuauagcauaugcauuaacugucuuuaaagaugaccaagauauaagagacuaucuacaaaaccaauauguagcauccaaugguaagaaagaacuaaaccucgcaaaccgaaaauauaaugaugaauuaauagaagaauuacuacaucugagcuuuacgaaauuuggacacuuaagucuaaaagcacuaagaaauauccuaccauucauggaacaaggaauaccauaccaucaagcaugcgaaaaagccggauaucaauucaauaagaaaguaaacagagaaaaacaaaaauuauuaccaccaguaccugccaaagacaucgucaauccuguaguaauacgaucacuaagucaagucagaaaagucauaaauggaauaauaaaacgcuauggaagcccaaguagcauauauauugaacuggcccgagaaaugggaagaggauacaaagaaagaaaagaucuagaaaagcaauauaacaaaaaccgacaaaugaacgaaggagccaaaaagcacauauuagaauuaagaccugaauuuggagauccuagaggucacgacauacucaaguauaaauuauggcaagaacaggauugucgaugcgccuacucguucaaaaguauaccgauuaaacaacuguucgaaauaggauaugcagaaguugaccauauaauaccauacaguaggagcuucgacgacagcaauaacaacaaagugcuaguacuagcagcagaaaaccaaaacaaacaaaacagaaccccuuaugaaugguucggucaugacgaaaccaaauggcaggaauuuacaucauuaguaacaaccaugaaaguauccaaaaagaagaaaucauuacuacucaagaaaaacuuugacgaagaacaagcugaagaauuucgcagccgccauuugaacgacacacgauacaucacaagauauauaaaaacauucauagaagauaaccuacaauuuagaauggaagaaggaaagaaacaauacguucauacaguaaacggagcauacacaucccuaaugcggaaacgauggggauucaauaaaaauagacaagaaaaugacuuacaccacgcgcuagacgcaguaauuguugcaguaucacucccauuuaaacacaaagucucggcauauuucaaaagacgggaagaauacgcucacaaccaacuaaaacgagaaggagaauuuuucccugaaccuuggccaggcuuuauacaugaacuagaaaucagaaugaugcaagacucagaaaauauaaaacuagcaauggaaucuuugaaccuaaaaacauaugacgaaucauuuaucaaagaacucaaaccaauauucguaucacgcaugccaaaacgagcuaugagaggacaaauccaugaagaaacacuaaaaagaguuagaggaagaacagaugacggauacauaagaacuguaaagaaaguaaaauuagaccaaauuccauuugauaaaaacggagacuucccaauguucggcaaagaaacagacaugaaaacguaugaagcgauaaaaagccgauacuuggaaagcggcaaagacaagaaaaaggcuuuuaacacaccccuauacaaaccagcgaaaaacccagaaaaugcgccaauuauuaggucaauaaaaauagaagaaaaagcaaaccgagugguaaugcucgacgagaaaacggcagcagauaaugccucaauagugcgcacugaaguauuccgacauaaagaaaccggcaacuacuucuuaacaccuguauacguagcugacgucuuagcaaagaaaguaccugacagauuaaucacaacaaagaaaccauacagcgaauggaggaaaauaacagacgaauaugaguucuuauucucacuauauccaaaugaccuuauacgaguaaaaaugccuaaagaaaaaggcaccaaaacacacacaggggaaaaacauguauggcaagaaaacuucauguacuuuaaaggaguacauagcggaagugcaggcguaagaaugauagaucauaugaauagcuuugaagacgaaauagggguuaggaaauugguaguauuugaaaaauaccagguagauccacuaggaagaaugaauaaaguacacggcgagaaaagacacggaauauga

SEQ ID NO: 8493 - RNA, 3234 nt, Artificial Sequence
  Cas9 variant
augcaacaaaaaccccaaagguauauacuaggauuggaccuaggcauagcaaguguaggaugggcuugcguaugggcugacgaaaaugaacauccaacaggauuacuagauuguggaguaagaacauuugagagagcugagguacccaaaacgggugauaguuuagcacuagcacggagacaagcuagguccguuagacgauuaauuaggcgacgagcgcauagauuacuaagacucaggagacugcucaagcgagaagguguccugcuaucagccgacuuuaacgagaacggacuuguaagaggguuaccaauagaugcaugggcuuugagaguagcaggauuagacagaaaacuaucgaauaaagaaugggcagcaguucucuuacacuuaguaaaacacagaggauaucuaagucaaagaaaaaaugaaacacaauccaaagauaaagaauuaggaagauuauuagcaggaguaaauggcaauagagaagcacuacaaaauagaucggaugaauaucgaacugcagcagaguuagcgguaaagaaauuugcagcugaaaacaauggaagcuugcgaaauaaaggaggagacuacucacauacauuugacagaaaagacuuacaacgggaacuucaccuacuuuuugagaggcagcgagcuuuagauaauccuuuuacuuccucagaaauggaggcagcaguagaugaacuacuaaugaaacaaagaucggcuuuacaaggugaagcuguccuaaaaaugcuaggaagguguacauuugagccaagugaauauaaagccgcaaaaaauacauacucagccgaaagguuuguuuggcuaaccaaacuaaauaacuuaagaauacaauacaacggagaagaaagagcauuaagugaagcagaaagaagacuacuacuagaugagccuuaucaaaaagccaagcuaaccuacaagcagguucguacaauacuggaauuaccagaaagugcuguauuuaaaggguuaagauacggccauggagaagauggauuaaaagcagaaucagguacucuaauggaaaugaaagcguaucacgccguaagaaaggccuugaaggacgccggacuagaaggagaaugggaaaauagaauaagaaauccggaauuacuagaugcgauaggaacggcguucagucuuuauaaaacagacgaagacaucagagcaaacuuagcagcuuuucgauuauccgaaaacguacuagaagcauuauuagcagguuugaauuucgauaaauucgugcaccuaaguuuaaaagcacuagcuaaaauccuuccauuaauggaacaaggaaugagguaugaugaagcauguaaagaggccuacggagaucauuacggagcgaaggaacaagaagaccauagacuauuaccuccguuuguggcagaugauauaagaaauccaguaguuuuucgaacucuaacacaggccagaaaaaucgugaacgaaauaguacgaagauauggaucuccuuuacgcguacacauagaaacaggaagagaaguuggcaaaucguuuagugauagaaaagaaauagaaaaacgacaagaagaaaauagaaaagaaagggaaagagcggcagcacacuuuaaagaauuauuucccaacuuugcaggagaacccaaagcacaagauauauuaaaacuaagauuauaugaacaacaacacggcaaaugucuguauagugguaaagaaauugaucugcgaagacuaccagagaaaggauacguagaaauagaucaugcguuaccauucucacguacgugggaugauaguuuuaauaacaaaguucuuguacuuggaaaagaaaaccaagauaaacgaaauaggacaccauaugaauauuuagaugguaagggaaauucuggagcuuggagggcauuugcagaacgaguuucgggauguagauuucccuacgcgaaaaaacaaagacuccuaacacaaaaauuggacgaaaagaccgaacaagguuucuuagagcguaacuuaaacgacacaagguauguagcaagauuucuaugccaauucauagaagaaaaaaugcaccuagagggagcagggaaaaaaagaguuuuugcgucaaacgggcaaauuacggcucuguuaagaggcuucuggggguugaaaaaaguaagagaagaaaacgacagacaccaugcgcuagaugccguugucguagcaugcucaucaguaucaaugcaacaaaaaauaacgagacauuucagauauagggaagaacuugaacauauagauagagaaacaggagaaguaauacacggauucccacaaccaugggaguucuuuagacaagaaguuaugacccgaguauuuagugaugauccuguaucagaauuggcagagaaauuagacagcagaccagaagcuguucaugaauuuguaaccccuuuauuuguuuccagagcaccucauagaaagguaacaggccaagggcaucuugagaccauaagaucugcaaaaagauuagaugaaaaaauuucagugguaaaacuuccccucacccaacuaaaaacaaaagauauagaaagaaucguaggauauccaaacagggaaccagcuuuauaugaugccuuggcagcacgauuagcagcuuuuaaagaugauccugcaaaagcauucucggaaccauuuuauaaaacgggcaaagacggaaaaugcgggguauuagucaaagcagugagaguagaaaauguccaaaaaucuggguuauuaguaagaaaagacgaaagugggaaaaugcagggaguagcggauaaugcaacaaugguaaggguagauguauuuggaaaaaacggaaaaaauuaucuuguuccaguauaugcauggcaaguugagaaaggagagcuaccaaauagagcgguaguagcauaugccgacgaagaagauugggaugaaauggaugauucguuugaguuuaaguuuucacucuacccuaacgauuuaguagaaguuguaacaaaaaaagauaaguucuuuggguauuacucaggauuuaauagagcuaccggagcaauaaacauaaaagaacacgauuuaucaaagagcaaaguuaaaaaugggguuuaugaaggcauaggaguaaaaacagcacaaagcuuccaaaaauaccaaguagauacauuaggaaaaacuauuagauuauguaagcccgaaaaaagaaugggauucaaaaaaaaauga

SEQ ID NO: 8494 - RNA, 3237 nt, Artificial Sequence
  Cas9 variant
augagauacguauugggccuagacauaggaauagcauccugcgguugggccgucaucaaccaagaaaaagaacggauagaagacuuaggaguaagaauauucgacaaagccgagaaccccaaagacgguaaaucacuagcagccccacgcagagacgcacguaguacacguagaacucuacgaagaaaaaagcacagaaugcaaaggauaaaaguacuacuagucaaacacggacuucuauccaaaacagaauuagaccacuuauaugaaagcgcaacagaaguagaugucuggaaucuacgacuugaugcacuugaacgaaaauuauaccccaaagaauucgcaagaauacuaauacacuuagcaaaaaggagaggcuucaaauccaacagaaaggaaaccacacuaucugagaacggccaaauccuagaaagcauaagcgaaaaccagcaaaucauggaaaaacaaaacuauagaacagucggcgaaaugauauuaaaagauaaaaaguucgaaaaucacaaacgaaacaaaaauggcacauauguagguacuguaaccagacagcaauuacaagaugaaauacaaaugauauuccacgcacaaaggcucuacaaaaaugauuacgcaacagaagaauuugaaagcucauaucuagaaauuugggcaucacaacggccauacgcauccaaagaucaaauagaaaagaugauuggcuacuguacccucgaaccaaaagaaaaaagagcacccaaggcgucauggucuuuccaguauuucguagcucuucaaacgauaaacaaucuacguuuaauaagcaaagacagaauugaagaacugucauuugaagaaaaaaaacaaaucaugaaucuagcgcucgaaaaguccaucguuaaguacaucgauauucguaaacuauuguccguaccuaacgaauuccaauuuaauagccuauccuacuccgcagauacuguagauaccgccguugaaagucgaaagugcauagaacuaaaagaauaccacuccauuaauaaaguauauaaacaaaucuauggcgaaaacgccuuaaacuuauuaccaaaauauuacgacacuauugccuacggacuaacaauauucaaagacgacaaagacauccuagaguauuugcaaaacaaauacguaaaugcaaaaggcaaaccuauuucaaacuuugcuaacaaaaccuacgacgauacauuuauccaagcucuuuuaaaucugaauuucacaaaaauggggcaucuuuccuucaaagcauugaagaauauaauaccauucuuagaagaaggacucagcuacgauaaagcaugugagaaagcaggauauaacuuuaaaggaacgagcuauacagaacaaacaaaguaucuacccguaauaccacaaaauacaaauccugugguucaccgagcucuaucacaaacaagaaaagucauuaacgcuaucauaaaaaaauacgggaguccaaacgcgauucauauagaaacugcaagagaacucucaaaaacauuucaagaaagaaaagaaauagauuccauguaccaagauaacucaaaaaaaaacgaacacgcaauccacaagcuaaaagaauuaggaaauauaaacccaucuggaauaaauauuguaaaauuuaaauuauggaacgaacaagauggacgauguauguacucaggcaaauauauagagccacaucgccuauuugaagaaggcuacacggaaguagaucacauuuuaccauacucacguucauuagacgacucauauaacaacaaaacgcucacacuuggaacagaaaaucaaagaaaaggaaacaaaauaccauaugaauauaugggaaauacuucaauauggaacgacuucgaaacaagaguacaauccaacaaaaaaauuaauaaaaaaaaacaacaaaaauuauuauuacaacauuuuagcuaugcgcgagagcaagaauucauugaaagaaaccuaaacgauacacguuaugcaacaauauaccuauccucacucauacaacaacaucuaauauucuccgaaucuucaagaaaaaaaaaaguccauacagucaguggaaucaucacaagccaccuaagaucacgaugggguuuuaauaaagaccgcaaagaaggacauauccaucaugcgcuagacgcuguaauaguagcaguaaccucagaccacaugauacaaagggucacaaaauacuacaaacuaaaagaauuaaaucgcaaccugcaagcaaaacgaaugcccuucccagaacccugggaaggauucagacuagaacuagaagcaagaauaucacccaacacacaacaauaucuaaaaggucuaagauucaaaaauuacgcagauguaaaucuuagugaaaucaaguccauauuugucucuagaaugcccaaacauuccauaaccggagaacuacaccaggaaacaauaagaaaauucauaggcuacaaugaaaaagggaaaguauuaacagcaauaaaaacaaaauuagaagacauaccuuucgaugcuaauggagauuuuccgauguaugguaaagaaucagaucuauauacuuacaaugcaauaaaagaaagguauuuaucacacaaaaaggacaaaagaaaaucauuucaagaaccccuauauaaaccaacuaagucuggcggaauaggccccuuaauaaaauccauaaaaaucauggauacaagaacaauagucaacccaguaaaccaaggaaaaggaguaguauacaauucaaaaauagcccgaacugaugucuucaaaaaagaagaaaaauacuaccucauaccaaucuacacuaucgaccuaaugaaaaauauauuaccucaaaaagccauaaccgcaggaaaaggcuacgaagauuggacaacaauagacccaucuuuuacauuccuauucucacuauuuccaaaugaucugauacaaauuguuccuucuaaaaacaaaacaaucaaagcacgaacaaccgucagcaaaaaagaaguacuccucccuucucuaaccggauacuuuaaaggaguacacuccggaacagcuggaauaacuguagaaacacaugauggaucagucauagcaaacguugggagcaagcaacuuuuacuuauagaaaaauaccaaguggacguucuagguaacuauacaaaaauaaaagaagaaaaaagaauaggauuaaccacauacaaugacaauaaaaaaauugcagcuugcuga

SEQ ID NO: 8495 - RNA, 3237 nt, Artificial Sequence
  Cas9 variant
augaaacaacaaccccaacgauacauacuaggucucgauuuaggaauagcaucuguaggaugggcacuaauuuuagucgacgaagaaggaaacccaauaggacuauuggauugcgguguuagaacauucgaaagagcagaaguaccaaaaacaggagacucguuagcauuagcaagaagacaagcaagaagugugagaagacuaaucagacgucgcgcacacaggcucuuaagacuacgaagacucuuaaaaagggagggaguuuuaagcgcggccgauuuuaauagcgacgggcucccaaaucuaccuauagacacuuggcaauuaagaguagcaggacuggaaaggaaacuaacaaaucaagaaugggcugcaguuuuacugcaucuaguaaaacauagaggauaucuaagucagagaaaaucagaaacacaaacugaaaacaaagaacuaggaugucugcuagcuucaguagcuaaaaauucaaaauuauugucagaaaaugcaaaucaauacagaacuccugcagaauuggcaguucgacuauuugcagaacaguccggacaucuaagaaauaaagggggagauuacacacacaccuucaaucgauuagacuuacaaaaagaauuacaucuucuauuugaacaacaaagaaccuuugguaacccauucgcaucugcggaacuacaaaguaaaguagauggauuauuaaugaugcaaagauccgcguuacagggagaagccguacucaaaauguuaggaaaaugcacuuuugaaccaucagaauauaaagcagcaaaacauacauauucagcugaaagauucauaugguuaacaaaacuuaauaaccuaagaaucuuagaaaauggaacugaacgugcucuaaaugaagcagaacguaaauuacuuuuagacgagccauacaagaaagcaaaacuaaccuauagucaagcgcgaaaauuacuagauaugagucaugaugccacauuuaaaggacuaagauacggcaaagacagugaagguuuaaacgcagagaauggugcacuaauggaaaugaaagcauaucacaaaauaagaacaguucuggacaaagcuggucuaaaaggagaaugggaaaauagaaucagaaacccagaaauauuagauaaaauaggcacugcauuuaguuuauacaaaacagacgaagacauacaagcagcucucgcagaccuacgacuaccagaaaauguacugaacgcucuacuugcaggauuaaacuuugacaaauuuauacaacuuucacuaaaggcauuaucaaacauuaugccacuaauggagagggguauaagauacgaugaagcaugcaaggaaguguauggagaucaccgagcucuagcugaaagcaaaaaucaaauguuauugccaccaauaccugcaaaugagaucagaaauccugucguacuaagaacacuaacacaaaccagaaaaguaauaaaugcaauaauucgaagguacgguucaccucaaagaguccauauugaaaccgcacgagaauuaggaaagucauuuaaagauagaaaagaaauugagaaaagacaagaagaaaaucgaaaagaacgagaacgggcagcugaacauuuuaaagaauuauuuccgcauuucgccggugaaccuaaaggaggagacauauuaaaacuaagguuauaugaacaacaacagggcaaauguuuauauucaaguauaccuauugaucugggaagauugaacgaaaaaggcuauguagaaauagaccacgcauuaccuuuuucuagaacuugggaugacucauuuaacaauaaaguauugguguuagguucugaaaaucaaaagaaaagaaaucagaccccauaugaauacuuagauggagcaagcaacagucaaagauggagagaguuccaggcaagauuacaagguugcagauucucuuaugcaaagaaacaaaggauacaaaccgcaaaacuagauucuaaaacagaacaaggauuucuagaaagaaauuugaacgauacaagauacauagcaagauuuuuaugcggauucaucgaagaaaaccuacauuuacaaggcgagggaaaaagaagaguauucgcaaguaauggacaaauuacugcccuacuacgaggcuuguggggacuaaagaaaguacgagaagaaaaugacagacaucaugccuuagaugcaauaguaguagcauguucuacagugucuaugcaacagaaaauaacgaaagcuaugcaaagacgcgaaacucucgagacaguagauacagaaaccggagaaguaaagaccaggauaccacaacccugggacuuuuuccgacaagaaguuaugaugagaguauuuucugauacaccccaugaagaauuagccgaaaaacuaaguggaagaccugaggcacugcaugauuuuguuagccccuuauuugucaguagagcaccuaauagaaaaaugacgggccaaggucacuuggaaacagucaaaagugcaaagcgucucucagaaaacauaucagucgugagaaaaccacuaacugcacucaaacuaaaagauauagaaaauauugugggauacccugaucgggaaccagcauuauaccaagcauuaagagaaagauuacaagcauacaaagaugauccggugaaggcuuuugcugaaccauuuuacaaaccagcuaaaaauggcggacaaggaagccuuguuaaggcagucagagucaaggauguacaaaagacaggaguaaugguaaggaaagauagaggagguaucgcuagaggaauagcugacaaugcgacgaugguaaggguugauguuuucgguaagaaagggaaaaacuaucuuguaccagucuaugccuggcaaguagcuaaaggcaucuuaccaaauagagcugucguagcauacgcagaugaagcagauugggacgaaauggaugauucuuaugaauuuaaauuuacauuauacccaaaugauuugguagaaauuauaucgaagaaaggaagaauauucgguuauuacagcggguuaaauagagcgacaggugcgauugacauaaaagaacaugauuugaguaaagaaaaagccaaaaacggcauucaccaaucggucggaguuaaaacuguguuaucauuccaaaaauaucaaguagacccucuaggaaaagaaauaugccuaugcaaaguugaaaaacacccugaacuuaauuccaaaaagaagaaauga

SEQ ID NO: 8496 - RNA, 3237 nt, Artificial Sequence
  Cas9 variant
augggcuaucuaauagguuuagacauuggcauuaccucaguaggauaugcuguacuacaaacagauuuuaaaggaaacccuuauaaaauccuacuaaugaacaccguaauauucccaguagccgaagcucccaaaacaggagaaucccuagcugcccccguccgacagaaaagaucaucucgaagaacuaaucgcagaaccaaauuccguaaacuaagaguccaaaaauuauucguacgguucggucuacucgaaucagccgauguagcaacauucuugaaucaaaaaguaccacaccaagacauuuggcaacuacgcaaagaugcauuaaacagaaaacucucaaauagagagcuauucgaaaucuuguacuucuucguuggccaccgaggcuucaaaucaaauagaagaucugaaguaacaggaaaacaaccaaaagacaaucaaguaguucuuacuucaauacacgacaggggaaauacccucaacgacuucgauucacuaggugaaaugaugcaagagcuuccagaauuuaaaaccauaaaacauaauaaagcauacagaccugacaacacaauuuacccguuacgugcuuggauagaacacgaacuuagcgcaauuuucucgguucaacagaaaaacaauaggcaaauaacugacaauuucauuacacaauaucuugauauuuuccguucccaaagagacuucgaucaaggcccagcagcaccuuccagauucggcggcaacaugaucgagagaaugguaggaccagacucccuagaugcccaugaaaaacgugcugcaaaauuaaccaauaccuucuucagauuuaauuuccugagcacccuaaacaaucuaaaaauucaacugaccuuaggagcugaguuccauccacucacaacaccccaaagagaaaucgucuuacaagcugcuacucucaaaucacucaacuacaaacaaauccgacauaaacuacaauugccagauucagcucgauucaaccugguaccauaccaaucaaacgaagauccaauaaaaacagaaucaaaacauuaucucuucaaaagaaaagcccuuacacaaauagaagcaguuacugauaacccacaacuaauagauaaaauuggcacaauccuugcauacuucaaaggggauaaaacacgccaagaaaaacuaucagcacuaaaucuuagcagagcggaaauuaaacaacuacuuccgaucaaccaaccuggauuuggcaaccuaucacucaaaacaaugcauaaaauccuucccuauuuagaacaaggacaccuuuaucacgaggccgcacaacuugcugguuacgauuuccaaaauaaucugguagaucgucaauauuuacgcgacaaucucaagaaccccguaguaaaccgagcaauuggaaaaacaaucaaaguaguaaaugcaaucauaaagaaauacggcgacccagacgcuauacauaucgaacucacucgcgagaucaaacauagccaugaagaacgacagaaaauagcacgacaaaugaacaccaauauggaccaaaaugacaaaguagcagaacaccuaagagaaaacgguaucccuguaaauggacaaaacauaauaaaaaguaaacuauuuuacgaacaaaaaggaauagaccuuuauuccggacaacaaauuaacgaacaagaucuuuauacugaagaucacuaccaaguagaucacauuauacccuauucaauaucauucaacgacucauucaccaacaaaacaguaacucgaaccucaaacaaccaaaacaaagcuaacagacugccauuagaauaccuaucagaagaaaaacaagaugccuuccgagcaagaguaaugucuaauauaagcaacuacagaaaaagacaaaaucuacuaaaggaagguauaacugaagacaaucgucaacaauggaaaacaagaaauauuaaugacacugguuacauaaaucgauuacuuucucaauaccuacgaaacaacguacaauuuacaaagaaaucacauaacccaguauuuaccguuaacggcgcaacaacugcuuauauaagaaaaagauauggaaucauuaaaaauagacaggcaaccgacuugcaccaugcaguagacgcagucauaauaggcuguaucuccaacacauucguuucaagauuagcaaaauacucagaagcucaagaagcacgcuaucauaaacaauuauggcaaaucacacaauaccgccaagaacauaaagaccucuccacuauagaauaucaggaacuaaucaaacaauuccccuuacccuggccugacuucagacacgaacuuauggcgagauuaucuaccgaccccgccaaaaugauggcccaccauaccugggaacacuauacagaugaagaaauaucccagcuaaaaccugccuucguaauuagaagugcuaaucacaaaguaacaggcagugcacacgacgauaccaucuacaguaagaaacuuuacgaccaacguggagucggccuacuacgaacaucccuccaaaacuuaaaauacgauuccaagaaagacggaaucaaaaauuacgagagacuaaaagacgguaguaacagucuaguauacgauucacuuuuacgcgcacuaaaagaacaugacgguaacgcaaagaaagccuuuccagacaaccaacuacuuauaucaaccggaaaccaucaacaaauaauaacacauguaaaaacugucaagaaaauuacacaucccauagagguaaacagagacacugcuauugccauaggagguagaaugauaagaguagacauauucaaacaagcaaaagcccaaaaacucauaggcauaccagucuauguuaacgauacuguaaaaccaacauuaccaaacagagccugcacaucuggaaaacgauauucugauugguaccaacuaacacgccaagaucaauuccucuguucucuagucuccaacgacuuaguacucguagaaacggcuucgccacucaaaguaacaaacaacauaaccaacgaagaaguucaaaccacucaacuauuauguuauuucaguuccuucaacaucgcaaacgcacaaauaaacuuccacucaauaaauaaugauagcucaaucaacccaauugucuuaaauaaagucaccuaucugacuaaauaucaacucgacuauuuaggcaauuauuucccaguaaaacacgaaucacguaaaacauucaaucgaaaaagguga

SEQ ID NO: 8497 - RNA, 3237 nt, Artificial Sequence
  Cas9 variant
augcauaccagacuagcuuuggauauaggaacaacaaguaucggauggauccuauaugaauuaguuaacggucaaccagcaucuauauuggacggcgguacucggauauucucugauggcagagaagcaaagacuggacacucucuagcaguaggaaggagaacugcucggggaaugcgaagacgaagagauagauaccuaagaaggagagcagcacucaugaaaagauuagcagcaauagggcuaaugccagaaucacccgaagcagcagcacaacuugcuacuuuagacccauacgaacuuagagccagaggauuagaccaccccuuaccgccggaacaccuggggagagcacuauuucauuuaaaccaaagaagaggauucaaauccaauagaagaacagauaaaggaaauaaugaaggagggaugauagccgacgccagcgcaagacucgaacaagcaaugauggcagcaggcgcacgaucuuacggagaauuuuuacauaaacggagagcagaagcaacagcaccaagagcgacaccagcuguacgaacacguauuaacccacaucuaacaggggaagacggaaaagaacaaccuggauacgauuucuacccugacagaaaacacuuagaagacgaauuucaccguuuaugggaagcacaagccaggcauaacccagaucucacaccagcaaugggagaccuguuauuccaaacaauuuuucaucagcgaccauuaaaagcaccagcaguaggaagauguuuguucuuagacgaaccuagacuaccaaaagcucauccuuuaacacaacaaaggacauuguaugaaacaguaaacaugcugagaaucgcaccuccgggacaaccaaaacgaagacuuaguagaguucagagggaucaaauuguccaugcacuuaacaacagaaaaauauuagcaaguccagggaaaaacguacuaacauuagcagcuauuggcaaauuauuaaaauuaagaccuggagaagccuucagucuagacacagcgaauagggacgcuauagcgugugacccugugagaaugucacucgcauaugaaggaagauuugguccccaauggagcgcauuaagcguagaaagccaaugggaacuaauacaaagauuacgagacgaccaagacggagcagcacuuguggauuggauuauggacagauacggauuugauagagauagagcaagagcuauagcagacgcuccccuaccagaaggauucggaagacuaggagaaacagcaacaagagcuguguuagccgugcuuaucggaggaacuacagaacaagaaguucuaacauauucagaggcaguagccgcuuguggaugggaccacagccgacuggggaccggagaaguauuagacagguuacccuauuacggucaaguacuugacaggcauguucugccaggcaccgguaggccugaagacgaugaaauaacuagauuuggcagaauaacgaacccuacgguacauauaggauuaggucaaguaaaaagacuugucaacaagguaauagacgcauggggacgaccgcaugagaugguuguugagcuagcaagagaucuaaaaaugagcgaagaucaaaaacgcaaucuugcuaagguaaacgcacaaaaccagagggcagccgaaaugagauccgcuaaacuuauuggagaucuaaaaaucgaagauaacgggagaaauagaggaauacuaagaguaugggaagagucagcagcagauguauuacacagauguugcccuuauacaggagcacaaauaagugcuucaaugcucuuugauggaagcugcgacauagaucacauauuaccauacucaagaacacuagaugaugguuucaauaauaggguuauuugcuugaaauccgcgaauagagagaaaagaaauuugacuccaugggaagcauggggaaacacacccaaaugggcagcuaucgaagccaaucuuaaaaauuuaccacccgcaaaggccuggcguuucgcgcccgaugccauguuaagauaugaaggugaaagagauuuuacagcaagagcuuuaguagacacgcaauacuuaagccgauuagcgcgagaauauuuagaauguuuauacgcagaagauauugacccuggaccucauucaggaaagaaacccaggagaccaaucuggguaguaacaggaaaauuaacugaacuauugagaagacauuggggcuuaaauucauuacuaccugaugcacaucgagguacagcgaaagccaaaaaucggcuagaucacaggcaccauaugauagacgcagcugucguaggagcaacggaucaugcaacuguacaaaggauagcaaauauggcaaaaggcaauguagaaaauggucuagaagaucuugcagguaccauacuaccacccuggccagguuuacgagacgaucuaaaagcaaggcuugaaagaacgauagucucccacagagguaaccacggugcaauagacccagcugcgcgaaaacaggggagagauacgacuagcggacaacugcauaaugacacugcuuacggacuuacaggagaaacauuaaaagggguaccauuaguaguaaaccggaaaccaauagacauguuaacaccagcuaugauagacaaaauaagggauccgcaucuaucgaggugguugacagcagugacaaaaggaaaagaaggaaaagauuucaaagcagcuguagaagccuuucgagcacaucccgggccuuacaggggaaucagaagaguucgucuaauagaaccgguugaagugauaagaauaaaagauagaaacggccgaccauauaaaggauacaaaggagacucaaaccaaugcuacgaaguauggugccugccagacagaacccuaacacaccacgucguaaguacauuugcagcccaucaaggucaaaccggaaaaccccacccggcugcgaaacgccuagcaagauuguauaagggugauauggugcgacuggacagaucuaaauuuggcagcguuauugccacaguagaaaaguuugacagaaacggacaauuagaauuaguaccacauaaugaaggaaaugcagaccaaagguauaggaaagauaaaucugacaguguuuucaucaggcuucgagcagcaacauucaucgcaagcggcgcgaggagagucauaguagaugaaaugggaagaauaagagacccggguccagguaaacauuga

SEQ ID NO: 8498 - RNA, 3240 nt, Artificial Sequence
  Cas9 variant
augaaauacggaauaggacuagacugcggcaucaacucagugggauacugcaucauggaauuaaacagcgaugacgaaccuaaacgaaucguucggcuaaauaguagaauuuucaccgaagcugaaaauccuaaagacggaaguucacuggcagcccccagacgcgaagcuaggggacuuagaagacguauccgaagacauaaacacagauuagaaagaauaagagcauuauuaguaagggaaaacauaguuacacaagccgaauuagacaacauguucucagguacauuaucagauauuuaugaacucaggacagcggcacuggacgcuccccuaaauaacauugaauucgcacggguuuugauaaaucuugcacaaagacgaggauuuaaaucuaaccgcaagucagaaaaaaguuccagcgauaaagaaacuggcaaauugcuaucggccauaaaaaaaaacaaagaaucaaucgaagccggaggauacagaacaguuggagaaaugcuauucaaggaugaaagauaugcuaaacacaaaagaaauaagggcgaagcauaucuaaacaccgugucgagagacaugaucgaagcagaaauucaugcagucuuugcgucccaaagaaacuucggaaugccauucgcaaaugaaaaaauagaaaaugaauauacagauauagcuuuaagucagagacccuucgaucuaggaccaggagaaggaccagaaaacuguaaaucuccuuaugcaggcaaacaaauaaaaaauaugauaggacaauguacauuuuuuccagaagaaaaacgcgccguaaaagcaucauauucauuccaacuauuuaguuuacuccaaggcauuaacaacauuacccucguuucgucagacggaaacaccuuuccucuaagccaagaacaaagaaaaacacuaaaagauuacugcuuuaaaacagcaaacguaacguaugcuucaaucagaaaaguccuccaaauaccacaagaauacacguucaaaaacauaacuuacacugacgauggaauagaaaaaagcgagaaaaaaacaaaauuccaacaccugaaaccauaccaugaaaugaaaaaaguucugggaucagcuauacaaacauuaacaccagaagaacucgacgaaaucggagaaaucuucacuuuuuacaaagaugaaacaauaauaauaaaacaacuagaggaaaccgaaaucgauaaaagccuauacgauuuguuacuacaacuaccgacauucgaaaaagcuggacacauaaguacaaaagcaugcaaaaugauaaucccuuuccuagaagagggaaaaacauacgacaaagcaugcgaaugugcagguuuaaacuucaaagcacauacaaacaugcaaaaacaaauguuacuacccgcaaaaucagaugaacuaaacgauguaguuaauccaguggucagacgcgcuauaucgcaaacaauaaaagucgucaaugccauuauucgagaaaugggcacaagcccaaccuacauaaauauagaacuggcucgagaacuaucaaaaucuaagaaggaacgcgacgaaauaaacaaaaaauacaaacuaaaccaagcagaaaacgagcgguuaaaaaacgaaaucauagacaauuucaaaauuaaaccaaacggccaggauauaauuaaacuaaaacuauggcaugaacaagacgacggaauauguccuuauacagggguaagaauuaaauaugagaaucuauucgacgauggauaugcagaaauagaccacauaauuccauacucauugucuuuugaugauucauuuaacaacaaaauucuuacuacagcgacacaaaauagacaaaaaggaaaccgaauaccauuagaguaucuaccagaaucagaaaaagacggauuucgcguauggguaaacagcaacauacgaaaccacagaaaaagacaaaaccuacucaaagaacacuuuacagaagcugacaagaaagaguucaaaucaagaaaucuaaacgauacacgauaccucaauaaacuacucuuaaacuauaucaacgacaacuuacuauucacugacuuuuauaauggaaagaaaaagcacguaacaucagucaacggagcaguaacugcauauauacgaaaaagauggggaauuaauaaaaacagagaagacggagauuuacaucaugcaguagaugcagccgucauugcaugcguaacacaagguauuauuaaucgaauuacugccuauuccgcaagaaacgaagcuccuuacgacuuaaacacagaaacuggagaaauaaaagaacgcuucccacugccuuaccccaacuucaaaaaagagcuagaugcacgaacaaccauagaagaugaaaaaagacucaaaagaguacuuaugucauuuaguaacuacucauacgacgauguagagaaagcaaaaccauguuucguauccaggacuccccaccgaaaaguaacaggugcagcucacgaagaaacaauacgaucaggaaaaguagaaggauuuacaguaucuaaaacugaacuaacaaaauuaaaacuuacgaacggugaaauugaaggcuauuaugaaccagaaucagauacacuacuauacaacgcauuacuacaaagacuaaaugaauuuggaggagacgccaaagcugcauuugcggacgaauuucacaaaccuaaagcugauggaacuccggggccagucgugaaaaaagucaagacaauaaaaagauccucaucaaaugugaaagcccgcaacaaaaauggacuuggaguagcagauaauggauccaugauaagaauagauguauucuauguagaaaaugaaggauauuacuucgucccaaucuacguagcugacacuguaaaagaaaugccaaaugaagcauguccguuuggcaaagacaaaaaaaaaauuaugacagacgaugauuucuuauucagcuuauaccccaaugaccuaauaaaaauaacagcaaaaaaagacaugaaguuuagcuuagccaacaaagaaaguggauuaccaaaaaacaaauacgccaacgaagugcuugucuacuacagcgcagccgacauuucuaacgcaucaaucucuguuauuaugcaugacaaugcauacaaauucagaggaugcggaauuaaaucauuaguaaagcuagaaaaauacacaguagacccccuaggaaauguaagcaaaguaaaucgagaaaaaagaauguacuucaaauga

SEQ ID NO: 8499 - RNA, 3240 nt, Artificial Sequence
  Cas9 variant
augagacuuggacuagauauugguacaaguucaauaggauggugguuauacgaaacugauggagcaggaucugaugcuagaaucacagguguagucgacggaggaguaagaauauuuucugauggccgagauccaaaaagcggggccucacuugccguugaccgcagagcagcaagagcgaugagaagacguagagauagauaucuaagaagaagggcgacucuaaugaaagucuuagcagaaaccggacugaugccugcugaccccgcggaagcaaaagcacuugaagcauuagauccguuugcauuaagagcagcuggacuagacgagccauuacccuugccgcaccucggcagagcacuguuccacuugaaucaaagacgaggauuuaaaucgaacaggaaaacagacagaggagacaaugaaucgggaaaaauuaaagaugcaacugcacguuuagacauggaaaugauggcuaacggcgcaagaacauacggagaguucuuacauaaacguagacaaaaagcuaccgacccuaggcauguaccuucgguaaggacaagauuguccauugcgaauagaggaggaccagauggcaaagaagaagcaggguaugacuucuacccagaucgaagacaucuagaagaggaauuucacaaacucugggcagcacaaggagcucaucauccagaauuaacggaaacauugagagauuuauuauuugagaaaauuuucuuucaacgaccauuaaaagaaccagaaguaggauuaugcuuauuuucaggccaccauggcguuccucccaaagacccuagacuaccaaaagcucacccacuuacucaaaggagaguguuauaugagaccgucaaucaacuaagagugacugccgacgggagagaagcuagaccccuaacaagagaagaaagagaucaaguuauacacgcgcucgauaauaagaaaccaacaaagagcuuaaguucaaugguguugaaacuaccugcucucgcaaaagucuuaaaauuaagagacggagaaagguuuacacuagaaacugguguuagagacgcaauagcgugugauccauuacgagcaagcccagcucauccagauagauucggcccaagauggagcauuuuagaugcugaugcucagugggaggucauaagccgaauuagaagaguccaauccgaugcggagcaugccgcauuaguggauuggcuaacugaagcccacggcuuagaccgcgcccaugcugaagcaacagcacaugcaccauuaccagauggcuacggaagacuuggauuaacagcaacuacuagaauauuauaucaauuaacagcagauguuguaacauaugcugacgcuguuaaagcgugugguuggcaccacagugacgguagaacaggagaauguuuugauagacuaccguauuauggagaaguguuggagaggcauguuauaccagguucauaucacccagacgacgaugauauaaccagauuugguagaaucacaaauccuacaguccacauugggcuaaaucagcuuagaagguuaguaaauagaauuaucgaaacacauggaaaaccacaccaaauaguuguugaauuagcaagagauuuaaagaaaucagaagaacagaaaagagcugauauaaaaagaauuagagauacgaccgaagcagcaaagaaaagaagcgaaaaacuggaagaacucgaaauagaggacaauggacguaaccgaaugcuacugagacuaugggaagaucuaaacccagacgaugcaaugagaagguuuuguccguacacaggcacacgaaucagcgcugcaaugauuuuugauggauccugcgauguugaucacauacuaccauauucacggacauuagaugauagcuuuccaaaucgaacacuaugcuugagagaagcaaauagacagaaaaggaaucaaacuccauggcaagcauggggcgacacaccacauuggcaugcaauagcggcuaaucugaaaaaucuaccugagaauaaaagguggagauucgcaccagaugcuaugacaagauuugaaggagaaaauggcuuuuuagacagagcacucaaagauacccaauauuuagcaagaauaagucgaucauaccuagauacccuauucacaaaaggaggacacguauggguaguuccaggaagauuuacugaaauguugagaagacauuggggacucaacaguuuauuaucagacgccggacguggugcaguaaaagcgaaaaaucgaacagaccaucgacaucaugcuauagaugcggcaguaauagccgcaaccgauccgggccugcuuaaccgaauaucgagagcugcugggcaaggagaagcugcaggccaaucagcagaauuaauagcuagagacacacccccuccgugggaaggauuccgggaugacuuaagaguccgacuagauaggauaauuguuagucauagggccgaucacggaagaauugaccaugcagcaagaaaacaaggcagagacucuacagcaggacaacuacaucaagaaacagcauauucaauagucgacgauauacaugucgccaguagaacagaccuacugagucuuaaaccagcgcaauuacuagacgaaccaggucgaucuggacaaguaagagacccacaguuaaggaaagcauuaagaguagccacuggaggaaaaacggguaaagacuuugaaaacgcccuacgcuacuucgcgaguaaaccagggccauaucaggcuauucgccguguuagaauaaucaaaccacuacaggcacaggcucgaguaccaguacccgcccaagaccccauuaaagcauaccaaggcggaaguaaucaucucuucgaaaucuggagauuaccugacggagaaauagaggcucaaguaauaacaucauucgaagcccacacccuagaaggagaaaagcggccacacccagcagcgaagcgcuuauuacgaguucacaaaggagauaugguugcuuuagaacgggaugguagaagaguagugggacauguacagaaaauggauauugcuaauggauuauuuauuguaccacacaaugaagcuaaugcagauacucgaaacaaugauaaaucagauccuuuuaaauggauacaaauaggagcccgcccagcaauagcuuccggcauaagacgaguaucuguagaugaaauugggagacuucgagacggaggaacaagaccaauauga

SEQ ID NO: 8500 - RNA, 3240 nt, Artificial Sequence
  Cas9 variant
auggaugaagaagccaaaauccaauuaucaaaagaaucauacgaagaagaauuagaaucacuacuggaaaaaagcggagaagaauuccgugaugucuucuuacaagcaaaaaaaguuuaugaugcuauauuauuaucagauauacucucuaccaagaagcaaaacagcaaagcaaaacuaucacugggaaugaucgaaagauacgacagucauaaaaaggauuuagaagaauuaaaacaauuuguuaaagcaaaccuaccggagaaaacagccauuuucuucaaagacagcucaaaaaacgguuaugccggcuacauagacggcaaaacgacacaagaggacuuuuauaaauuucugaaaaaagaacuaaacgguauagcaggaagcgaaagauucauggaaaaaguagaucaagaaaauuuccugcuuaaacaaaggacaacugccaacggaguuaucccucaucaaguccaucuaaccgaacucaaagcaauaauugaaagacaaaagccuuacuauccauuuuuagaagaagcacgcgacaaaaugauacgucuacugacuuucagaauaccauauuauguuggaccccuggcacaaggagaagaaacuuccuccuuugcauggcuagaacgcaaaacuccagaaaaaguuacaccuuggaaugccacagaagugauagauuacagugcaucagcaaugaaauuuauccaacgaaugauaaacuaugacaccuauuuaccaaccgaaaaaguacuuccaaaacacuccaucuuguaucaaaaauauacuauauucaaugaauuaacgaaagucgccuauaaggacgaaagaggaauuaaacaucaauuuucaucaaaagaaaaaagagaaaucuucaaagaacuauuccaaaaacaaagaaaagugacgguaaaaaaacuacaacaauuccuuagcgcgaacuacaacaucgaagacgcagaaauccuuggaguagauaaagcauuuaauucaagcuaugccacuuaccaugauuuucucgaccuugcgaaaccaaauacggaaagagucgcagaauugcucgaacaaccggagaugaacgcuauguuugaagacauaguaaaaauauuaacaaucuuugaagacagggaaaugaucaggacacaacuaaaaaaauaccagucgguguuaggagacggcuuuuucaaaaaacuuguaaaaaaacacuacacagguuggggucgauuauccgaaagacuaauaaauggaauacgcgacaaaaaaacuaauaaaacaauauuagacuacuuaauagacgaugacgauuucccauauaacagaaaccgaaacuucaugcagcuuauuaaugaugacucauuauccuuuaaagaagaacuggcgaaugaacuagcauuagcaggaaaucaaagucuacuagaaguaguagaagcacuacccggaucaccagcuauaaaaaaagguaucuggcaaacuuuaaaaauaguagaagagcuaauugaaaucauuggcuauaauccaaaaaacauuguaguagaaauggcaagagaaaaccaacguaccaaccgaucaaaaccacgauugaaagcgcuugaggaagcacuaaaaaguuucgacucaccuuuauugaaagaacaaccugucgacaaccaagcauuacaaaaggacagauuauaucuguauuaucuacagaauggaaaagacauguauaccggagaagcucuugacauagaucgacugagugaguacgauauugaccauauaauacccagaucauucauuguagacaacagcauugacaacaaaguacuuguaaguaguaaagaaaacagauuaaaaauggaugacguaccugaccaaaaagugguaaucagaaugagacgauacugggaaaaacuacuacgagcuaacuuaauaucagaacguaaauuugcuuacuuaaccaaacuagaauugacccccgaagacaaagcccgauucauacaaagacaauuaguagaaacacgacaaauaacuaaacacguugcggcaauacucgaucaauauuucaaccagccugaagaaaguaaaaauaaaggaauaagaaucauuacccuaaaaucuucucucguuucccaauuuagaaaaacauuuggcauucauaaaguaagagaaaucaacaaccaccaccacgcacaugacgcguaucuaaacggaguaguugccauagcuuuacuaaaaaaauauccaaaauuagaaccggaauucguauacgggaacuacacuaaauucaacuuagcuacagagaauaaagcaacagcgaaaaaagaauucuacagcaauaucuuacgauucuuugaaaaagaagaauacucauaugaugaaaacggggaaauauucugggauaaagcaagacacauaccacaaauuaaaaagguaauaucaucacaccaaguaaauauaguuaaaaaagucgaaguacaaacggggggcuucuauaaggaaaccgugaauccaaaagggaagccagacaaacucauacaacgaaaagcaggaugggauguaaguaaauacggaggauucggcaguccaguugucgcauacgcagucgcauucaucuacgagaaaggaaaagcacggaaaaaagcaaaagcaauagaaggcauaaccauaaugaaacaaucacuuuuugaacaagauccaauuggauuccuaucuaauaaaggauacuccaacguaaccaaauuuauaaaacuaaguaaguauacacuauacgaacuugaaaauggaagaagaagaaugguagcaucacacaaagaagcccaaaaagccaacaguuucauucuacccgaaaaacuagucacuuuauuauuuuacgcacaacacuacgacgaaauagcacacaaagagucauucgauuauguaaacgaccacuuaucugaauucagagaaauacuagaucaaguaauagauuucucaaauagauacacaauugcagcaaaaaacacagaaaaaauagccgaacuauucgaacaaaaucaagagaguacaguucaaucacuuucucaauccuucauaaauuuaaugcaacuaaacgcuaugggagcaccagcagauuuuaaauucuucgacgucauaauuccuagaaaaagauacccaucuuuaacagaaauuugggaaucaacaaucauauaccaaagcauaacaggacuucgagaaacaagaacacguauggccacccuaugggauggagaacaguga

SEQ ID NO: 8501 - RNA, 3240 nt, Artificial Sequence
  Cas9 variant
auggacgaagaggcaaaaauccagcuuagcaaagaaucauacgaagaagaacucgaaagucuucuagaaaaaaguggagaagaauucagagacgucuuucuccaagcaaaaaaaguguaugaugcuauccuuuuaucugacauacucucaacaaaaaaacaaaacucaaaggcaaaacucagucuaggaaugauagaaagauaugacucccauaaaaaagaccuagaagaacuaaaacaauuuguuaaagcaaacuuacccgaaaaaacagcaauuuucuuuaaagauucaucaaaaaauggauacgcgggguacauagacggaaaaacaacacaagaggacuucuauaaauucuuaaaaaaagaauuaaacggaaucgccgggucagaacgcuucauggaaaaagucgaucaggaaaacuucuuacuaaaacagagaacaacagcuaauggaguaauaccacaccaaguccaccuuaccgaauuaaaagcaauuauagaaagacaaaaaccauauuacccaagcuuagaagaagcucgagacaaaaugauccgauuauuaacauuccgaauacccuauuauguaggacccuuggcacaaggagaagaaacuucaucauucgccuggcuagagcgcaagaccccagaaaaaguaacaccauggaacgcaacagaaguuaucgauuacucagccucagcuaugaaauucauacaacgaaugaucaacuacgacacuuacuuaccgacagaaaaaguucuccccaaacacaguauacucuaccaaaaguacacgauuuuuaaugaguugacaaaaguugcauacaaagacgaaaggggaauaaaacaucaauuuucaucaaaagaaaaaagagaaaucuuuaaagaacuauuucaaaaacaaagaaaaguaacaguaaaaaaacuacaacaauuucucucugcuaauuauaacauugaagaugcagaaauauuaggugucgauaaagcauucaacucuagcuaugccacauaucacgauuuuuuggauuuagccaaaccaaacaccgaaagaguggccgaauuacucgaacaaccagaaaugaacgcaauguucgaagauauugugaagauucucacaauauuugaagauagagaaaugauccgaacccaauuaaaaaaauaccaaucaguauugggagacggcuucuuuaaaaaguuaguaaaaaaacauuauacaggauggggaaggcucagugaacgauuaaucaacggcauuagagacaaaaaaacuaauaaaacaauccuugacuaucuaaucgacgacgacgacuucccauauaaccgcaauagaaauuucaugcaacugauaaaugacgacagucuaaguuucaaagaagaauuagcaaacgaacuagcauuagcaggaaaccaaucacuacuagaagucguugaagcauuacucggaaguccagcaauaaaaaaaggaauauggcaaacacucaaaaucguagaagaacuaauagaaauaauaggauacaaccccaaaaauauaguaguugagauggcgagagaaaaccaaagaacgaacagaaguaaaccccgcuuaaaagcacuagaagaagcucuaaaaucauuugacucuccacuacucaaagaacaacccguagauaaccaagcacuacaaaaagauagacuauauuuguauuaucuccaaaaugggaaagauauguauaccggagaagcauuagacauugauagacugagugaguacgauaucgaucacauuaucccuagaagcuuuauaguugacaauucaaucgauaauaaaguacuaguaucaaguaaagaaaaucgauuaaaaauggacgacguccccgaccaaaaggucguuauaagaaugagaagauauugggagaaauuacuucgugcgaaucuaauaucagaaaggaaauucgcauaccuuacaaaauuagagcuuaccccagaagauaaggcaagauucauacaaagacaauuagucgaaacccgacaaauuacaaaacaugucgcugcgauauuagaccaauacuucaaucaaccugaagaaagcaagaauaaaggaauaagaaucaucacauuaaagagcuccuuaguaucacaauuccgaaaaacauuugguauaaacaaaguccgagaaauuaacaaucaccaucaugcacaugacgcauauuuaaauggagucguagcgauagcguuauuaaaaaaauauccgaaacuagaacccgaauucguauauggaaacuacacaaaauucaaccuugcaacggaaaauaaagcuacagccaaaaaagaauucuauucaaacauacuuagauucuuugaaaaagaagaauacagcuaugaugaaaacggagaaauauucugggacaaagcuagacacaucccccaaauuaaaaagguaauaucaucacaucaaguaaacauaguaaaaaaaguggaaguccaaacagguggcuuuuauaaagaaacugucaauccuaaaggaaaaccagauaaacuaauacaaagaaaagcgggcugggacguauccaaauacggaggauuugguagcccaguagucgcauacgcaguggccuuuaucuaugaaaaaggcaaagccagaaaaaaagccaaagcaauagaaggcauaacuauaaugaaacaaucacuauucgaacaagacccaaucggauuccucucaaauaaaggguacuccaacguaaccaaauuuaucaaauuaucaaaauacacauuauaugaacuagaaaauggaagacgcagaaugguagccucacacaaagaagcacagaaagcaaacagcuuuauacuaccagaaaagcuaguaacgcuacuauaccacgcccagcauuaugaugaaaucgcgcacaaggaaagcuucgacuauguaaacgaucaucugucagaauuccgagaaauacuugaccaaguuauagacuucuccaaucgguacacaauagcagcuaaaaauacagaaaaaauagcagaguuauuugaacaaaaccaagaaagcacaguacaaucacucucgcaaucuuucaucaacuuaaugcaacucaacgccaugggcgcccccgcagacuuuaaauuuuuugauguaauaauuccucgaaaacguuauccaagcuuaaccgaaauaugggaaagcacuauaauuuaucaaucaauaacaggacuuagagaaacacgaacacgaauggcuacacuaugggacggagaacaauga

SEQ ID NO: 8502 - RNA, 3243 nt, Artificial Sequence
  Cas9 variant
augaaaacgaguuucgcauuugauauuggcacuaauaguaucggaugguguguccuagcccuugacaacgcaaauuuaccauaucgaauccuugaugcaggaguaaggaucuuuuccgaugguagagaaccaaaaucaggaacuagcuuagccgaaggaaggcgacuagcaaggggaaugucuaggagacgagauagguacaaaagaagacguaaagccguuauaagaacuuuaauugaauaugggcuaaugccagaugacccugcagcaagacgagcacucguggcugagacaaacgauaaagcgccagguaaaaucgcaagugauguauaugcgcuaagagcaagagcacuagaugauaaacugccacuccaccacauagguagagcauuauuucacauaaaucaacgaagaggauuuaaaucaaauagaaaaacagacaaaagggacaaugaucaaggaaaaauagcaagcggaauuucaagguuaagagacaaauuagcuagugaaggaaugaggacauuaggagaauaucucaaucauagacaccaagccggaaacuggguaagaguacgacccucaagaguucccgguaaagaugauaaagaggaggacgguuauggcuuuuacccagaaagagcacuucuucaagacgaauuuaaugcuauauggacagcacaagcagcacauuauccagauguucuaacugaagagagacgaacacaucuggaaacaauaauauuuuuccaaagaccguuaaaaccaguucaaguagguaaaugcaguuucaacccuggugaggagcgauugccaagagcgcacccgcuuuuucaagaguuccgauuauacaaagaaguaaaugaacuagaauuaguugauagaaaucaagaccaucauaaauuaucauuagaucaaagagaugcuuugauagcgcaacugaaaacacagagagaagccgcauacucagccuuaagaaaaacugcaagagcuccuuugggcacaagauuuaauaaagaaacugaaucccgaacuaaaaugaaaggagaugaagucgcagcugaauuauccgcaaaaacucgauuuggccaagcauggauuaguaugcccuuagaagaacgauggauaauugucgauacacuucggagaguagaagacccauuagaauuaaccgcaugguuagaacaacauuauggucuagauggugaacauaucgaugcaauccuagcggcaagauuaccagaaggauaugggcguuuaggagaaacagcacuuacagaaauucugguugaacuuaaagcugcagugauauccgaagccgaggcagcucgcagagccggcuaugaucaugcacuucuacaaaggggagcuggauuggaggcuuuaccuaaauaucaagaagugauagcacguagaauaccuccaggaacgggcaacccagacgacccauaugacguagaaaaagguagaauaacaaauccaacgguacauauaggacuaaaccaacuucaaaagguuuuaaacgcgcuaauacgccguuacggaaaaccagaacaaauagcaauagaacuagcaagagaauuaaaauugaaugaugaacagaaaagagagaaaaauauugaaauagcaagaaauacacgagcagccgaacaaagaagugcaaaauuaguggaacuuggcguaccagacacagguuauaauagaguauuauuaaaauuaugggaagaauuaaauuuaagggcaccagaaaacagagucuguauauacuguggggaaccaauaaauauugaaacuuuauucagcucagcaguagauauagaccacauacuaccguggucuaagacacucgacgauucucaagcgaauagauuaguaugucacguagcauguaacagacaaaaagcuaacuacgccccagcagaaguaccucaauggcaaggcagguacgaugacauuuuagcuagagcaaauacauugccauuaaauaaaagguggagauuuggccgagacgcaaugaagaaauucgcagacgaagaaacauuucuagcaaggcaacugacagacacucaguauuuaucaagacuggcccaugcauacauggcugcauuauauccggaugaagaaccagaugcccaaggaguacuagcaagaaagaaucacgugcguguaauuacagguaggaugacugaaaugcuaaggagacaauggggucuaaauucauugcuagcagaccauaaccagaaaaacagaaaugaucauagacaucacgcuauagaugcagcaguaguaggaguaacuaccagagcguuacuccaaagaauagcaacaguagcaggaggacgagaagcucaagcacuugaagaaacaauuggcaaaauagaaccuccguggcccggguuuagagaugaauuacaagcaguaauuaaaagaauaguaguuagccacaaaccagaucacgguacauuaccuaaaccaggucaaggaggccaaacagccggacaauuacauaacgauaccgcauacggcuuaacuggagaaacugauucuagaggaacuccaauagucguaagaagaaaaccguuuacaucacuuacugaaaaagaucuaccaucaauacgagauagacaacuagcucaagcacuaggaucagccauagcaggaagaucaggaaaagaacuacaagcugccuuggaacaauuuagagauagggaugacuauaaauccaucagacaugugagaguaguggaaccauuaaauguaauuccaauacgugacggaacugggagagcauauaaagcauacaaaggagacgcaaauuauagauaugauguaugggaacuaccaaaugguaaguggaugcaugaaguagucagcauguuugaugcacaugacaggaguuggacaagugcaguacauauacaucacccugcugcuaggagaguuuuaucacugaaacaaaaugacaugguugcuuacgaccacccacaagacgguccaacuauaggcagagugguuaaauuuucacaaucuggacagaugacguuugccccacacaaggaagcaggagcauuaaaagccagagacgcugauccagaggacagauucagauacuucuauaaaaguggaagugcaaugaaagauaucggauuaagacaaguaagaguagaugaaauuggaagaguguucgacccaggaccuagagauaaagaagccagaaaugcuagaaagaagaaaagcacagauuga

SEQ ID NO: 8503 - RNA, 3243 nt, Artificial Sequence
  Cas9 variant
auggcgaaaucauuugcuuuugauaugggaacgaacagcauagguugggcuguauuaggauuagacagcgcaggagacccugacucaauugagggugcggguguaagaauauucucagaugguagggagccaaaaucgggagcaucuuuagcagaggguaggcgaauagcaagaggaaugucaaggagaagggagcgauauaaagcgaggaggaaagcacuaauaagaacacuaggugauuauggucuaaugccuuuagaaagagccgcaaggagagcccuuguagcggaaacaaaugaccgaucauucggauuagucgcgcaagacguauacgcauuacgagcucgagcacucguggaaaaauuaccaccauaucacuuaggacgagcucuauuccaccuuaaucagaggcgaggguuuaaaagcaauagaaaaacugacggaagagauaaugaguuagguaugauugcaacuggcauugccgcccuagaugcucaacugaaugggaggacucuugggcaauaucuacacgaaaugcgaggcgcagauccgagacagcggggacaaguuagaguaagaccgcauuuagaaauaaaugauaaaggaagagaaauugcagcuuauggguucuauccacaacgagcaaugcuagaaagagaauuuaaugcaauaugggcagcccaagccccacaucauccagaacuguuaucugaagagagacgagcucauuuguuucaaguaauauuuuaccaaagaccauuaaaacaaccagacccaggaagauguaguuuuaauccggccgagccaaggcuagcaaaagcccauccacuauuccagagauuuagauuaguuaaagaaaucaacgaauugagaauaguuacagguuccaacagccagggagugccacuaacauuagagcaaagagauauucuccuuacuuuauuaagagauaagaaagcaucuaguuucaaaacucuauuagcaaaaauuauuaaggggcaaccagaagcacgcuuuaacaaagcuagcgacucgagagacaaaaugaagggagaugaauuagcagcgacaaugucugauaagacaagauuugggcaagcaugguucgcaaugccagaagcugaacaauggcguauaauagcaaaauuacgagauauagacgauccguuagaacuaaaugcaugguuagaaucggaauaugguuuagcacccgaacguagggacgcaguagcgaacgcacuuuuaccucaaggauacgguagauuaggcgaaacugcgcuuagaacgaugcuagacuaucuugaagcagcaguaauuucagaggcagaagcagcagcgcaagcaggcuaugaucacgccuuagcuagaagaggagcaggguuagaucaacuuccgaaauaccaagaaguacuaggcaggagaaucccacccgggucaggugaaccaaaugacccuuaugacauuagaaugggacgaauaucuaacccaacuguacauauugcauuaaaucaauuaagaaggguugugaaugcuuuaauaagaaaauacggaaagccagcugagauagcuaucgaguuagcaagagaucuaaaacuuucagaagaacagaagagagaaguaaacgcuacgauagcaaagaauacaagggacgcagaaaggagagcaguaagacuugcugaugaaggaauagacaacacaggacauaaccgcgcuuugcuaagguuuugggaagaacuugcagcagauccgcuagaccgaguguguguauauugcggagguggaauaggagcggcaucccuauucaauggcaguguagacauagaucauauauuaccauggagucguacauuagaugauagucgugcgaauaggauucuugugcacaauucauguaaucgacuuaaaagaaauuuugccccuuuugaaguaccagaauggagggaaaucuaccaggauauauuggucagagcagcaaaauuacccgcuaacaagucauggagguuugcuccggaugccauggauagguuugagggggagaaagacuuucuugccagacaauuaacagauacacaauaccuagcgagaauggcacaugaauauuuagcagcauuauacccagaugaggagccagaugaguggggaguauucgcgagaggaaaucauguaagaguaguaccuggaagacugacagaaauguuaagaagggccugggguuuaaaugcuauuuuaucagacgauaaucgaaagaauagaaaugaucauaggcaucaugcaauagacgcggucguaguaggaguaacaacaagagauaugcuuaauaaaauaagccaagcagcaggacggggagcagauaugggggcagccgacgcgcuacgaagauucgacccaccauggccuucauuccaucaagcaguacgugcugccguagaaagaauccuaguaucacaucgagcagaucacgggacuuuaccagggaccgacggacaaggcagcacagcuggucaauuacauaacgacacggcauacggccuaacaggcgaaacaagaaaagguuuagcagucgugguacgaagaaaacccuauuuaagccuagaaccuagagauauagaaacaauacgagauccacaauuaagagaucaccuagcuacagaaacauauggacucgccggcgcggaguuuaccgcagcacuaaaaagacuacaacaaacagauaaauucuaugccggaauaagaagaguaaggguaacagaagcgcuuucaguuauuccaauaagagacgcaacaggucacgcauauaaagcauacaaaggugaugccaauuuucguuacgacguaugggagcuuccaaaugguaaauggguaccggaaguaauuucaauguuugaugcccacgacagaggaugggugucacaaguacaugcagcaaauccagccgcaagaagagugcuaucucuuagacaaaaugauaugguugcguaccaacacccugaacaaggauuaguguacggaagaguaguaaaauucggccaaagcggacaaaugacguuugcugcacaucacgaaggagguucauuaaaaucuagagaugcugauagggacgauccauucaaauauuuuuacaaaucugcuggcacaaugaaagauauugggcuaagacagauuagaguagaugagauaggucguguacaagacccaggaccccaagaucgcgauucaaaaagaguaagaaaaagugaucgguga

SEQ ID NO: 8504 - RNA, 3246 nt, Artificial Sequence
  Cas9 variant
auggcagcauucaaaccaaacccaauaaauuauauuuugggccuagacauaggaauagcaagcguagguugggcuaugguagaaaucgaugaagaugaaaacccaauauguuuaauagaccuuggaguacgcguauuugagagagccgaaguaccaaaaacaggagauagucuugcuauggcaagacgacuugcuagaagugucagacgauuaacucgaagacgagcucauagauuacuacgcgcacgaagauuacuaaaaagagaaggaguauuacaagcugcugacuuugacgaaaauggacuaauaaaaucccuaccaaacacaccuuggcaacuacgggccgcagcuuuagaucgcaaauuaacaccacuugaauggucugcaguauuauuacacuuaaucaaacauagaggauacuuaucacaacgcaaaaacgaaggugagacagccgacaaagaacuaggugcauuacuaaaaggcgucgcagacaaugcacacgcuuuacagacaggggauuucagaacaccggcuaaauuagcauuaaacaaauuugaaaaagaaucaggacacauuagaaaccaacguggugacuauagccauacauuuucuaggaaagaucuucaagcugaauuaaaccuacuuuuugaaaaacaaaaagaauuuggaaacccccauauaucagacgggcuuaaagaaggcauagagacacuacuaaugacacaaaggccagcacuaucuggagaugcuguacaaaagauguuaggacauugcaccuucgagccuacagaaccaaaagcugcgaaaaauacauauacugcagaaagauucguaugguugacaaaauuaaacaaucuacgaauauuagaacaaggaagugaacaaccacuaacagauacccaaagagcaaaauuaauggaugaaccauacagaaaauccaaauuaaccuaugcccaagcgagaaaauuauuaggacuugaagacacugcauucuuuaagggucuucgcuacgguaaggauaaugcugaggcauccacguugauggaaaugaaggcuuaccacgcuaucagcagggcauuagaaaaagagggauuaaaagacaagaaaagcccauuaaaucuuucgccagaacugcaagaugaaauaggaacugccuuuucauuauuuaaaacagaugaagacauaacggguagacuuaaagacagaguacaacccgaaauauuagaagcucuauugaaacacauuagcuuugauaaauucguucaaauaucuuuaaaagcgcucagaagaauagucccuuuaauggaacaaggcaaaagauauaaugaagcaugugcagaaauuuacggugaucauuauggaaagaaaaacacugaagagaaaauuuauuugccgccuauaccugcagaugaaauccguaauccaguuguauuacgugcucuaucacaagcucgaaaagucauaaauggcguaguuagaagauacggaaguccggccagaauacacauagaaacagcuagagaaguagguaaaucauuuaaagauagaaaagaaauagagaaaagacaggaagaaaauagaaaagacagagaaaaagcugcugcgaaauuucaagaauacuuuccaaacuuuguuggagaaccaaagaguaaagacauauuaaaacuaaggcuuuaugaacagcagcacggaaaaugcuuauauucaggcaaagaaaucaaccucgguagauuaaaugaaaaagguuacguagaaauagaucaugcacuaccauuuaguagaacaugggaugacucuuuuaauaauaaaguuuuaguauuggggagugaaaaccaaaauaaagguaaucagacaccauaugaauauuuuaauggcaaggacaacaguagagaauggcaagaauuuaaagcuagaguagaaacaucgagauuuccaagaagcaagaaacaaagaauacuucuacaaaaauuugacgaagauggauucaaagaaagaaaucuaaacgacacaagauaugucaaccgauuuuuaugucaauucguggccgaccgaaugcgauuaacagguaaagggaagaaaagaguuuucgcaagcaacggacaaauaacaaacuuacuacgagguuucuggggacuuagaaaaguuagggcagaaaacgaccggcaucaugcacucgacgcagucguaguagcauguucaacaguagccaugcagcagaaaauaacaagguucgugcguuacaaagaaaugaacgcuuucgauggaaaaaccauagauaaagagacaggagaaguucuccaccagaaaacacauuuuccacaaccaugggaguucuuugcacaagaagugaugauaagaguuuuuggaaaaccagaugguaaaccagaauuugaagaagcagacacaccugaaaaauugcgcacauuauuggcugaaaaacuaucuucaagacccgaagcaguacacgaguauguaacaccacuguuuguaucaagagcgccaaauagaaaaaugucgggucaaggucauauggaaacuguuaaauccgcuaaaagacuagaugaagguguaaguguauugagaguacccuuaacccaauuaaaauugaaagacuuagagaaaaugguaaaccgagaaagggaaccaaaauuguaugaagcauuaaaagcaagauuagaagcccacaaagacgauccagcaaaagcauuugcagagccauuuuauaaauaugauaaagcaggcaaccggacacaacaagugaaagcgguaagaguagaacaaguacaaaagacaggugucuggguaagaaaucacaauggaauugcagauaacgcaacgaugguaaggguagacguauucgaaaaaggagauaaauauuaucuuguuccuauuuauucauggcaaguagcaaaaggaauacuuccugacagagcaguagucgcauacgcagacgaagaagacuggacagucauagaugagagcuucagguuuaaauuuguucuauacucaaaugauuuaauuaaaguucagcucaagaaagauuccuuucugggauauuuuagcggauuagaucgagcuacaggagccaucaguuuaagagaacaugacuuagaaaaauccaaagguaaagauggaaugcacagaauaggaguaaaaaccgcauuaucauuccaaaaauaucaaauugaugaaaugggaaaagaaauacgacccugcagacuaaagaaaagaccuccgguucgauga

SEQ ID NO: 8505 - RNA, 3246 nt, Artificial Sequence
  Cas9 variant
auggcugcauucaaaccuaaucccauaaauuauauacuaggacuugacauaggaaucgcauccguaggaugggccauggucgagauagaugaagaugaaaacccaauaugcuuaauagaccucgguguaagaguauucgaaagagccgaagugccaaaaacaggagauagcuuagccgcugcaagacgacuugcaagaucaguaagaagauuaacaagacgaagggcucaucgccuacuccgggcuaggagacuacuaaaaagagaaggaguuuuacaagcggccgauuucgaugaaaauggacucauaaaaagucuaccuaacacaccauggcaauuaagaucagcagcucuagacagaaaacucacaccacuagagugguccgcaguacuauuacaucucauaaaacacagaggauaccuaagccaaagaaagaaugagggggaaacggcagauaaagagcugggagcacuacuaaaaggagucgcugauaaugcucaugcccugcaaacaggagauuuucgaacaccagcagaauuggcauugaacaaauuugaaaaagaaaguggccacauaagaaaccgacggggagauuacagccacacauuuucacgaaaagaccuccaagcagaacuggaccuacuauucgaaaaacaaaaagaguucggaaacccacauauaagcgaugauuuaaaagaaggaauugaaacucuacucaugacccaaagaccagcauuaucaggagacgcuguucagaaaauguugggacacuguacuuuugaaccaacagaaccaaaagcagccaaaaauacuuauaccgcagaacgguuuguaugguuaacaaaacugaacaaucuuagaauuuuagaacaagggucagaaagaccuuuaacagauacagaaagagcaacucuaauggaugaacccuaucgcaaaaguaaacugacauaugcacaagcuagaaaauuacuagaacuagacgacacagcauuuuucaaaggauuacgauaugggaaagauaaugccgaagcauccacauuaauggaaaugaaagccuaccaugcaaucagccgagcauuagaaaaagaaggguugaaagauaagaaaucgccucuaaaucuuaguccagaacugcaagacgaaauaggcacagcauuuaguuuauuuaaaacggacgaagacauuacgggaagauuaaaagacaggguacagccagaaauucuagagguauugcucaaacacauaucauucgauaaauuuguacaaauaucuuuaaaagcucuaagaagaaucguuccacuaauggagcaaggaaaaagauaugaugaagcaugugcugaaauuuacggagaucaugauggcaagaaaaauaccgaagagaaaauuuauuuacccccaaucccggcagacgaaauacgaaacccgguaguccuucgagcacuaucgcaagcaagaaaaguuauaaaugcagugguuagaagguauggauccccugcaagaauacauaucgaaacagcaagagaaguagguaaaucauucaaagaucgcaaagaaauugagaaaagacaagaagaaaaucggaaagacagggaaaaagcagcagcaaaauuccgggaauauuuuccuaauuuugugggagaaccaaaaagcaaggauauacuaaagcucagacucuacgaacagcaacacggaaaaugcuuauauucagggaaagaaauuaauuuaggacgacuaaaugaaaaaggauauguagaaauagaccacgcucuacccuuuucuaggacaugggaugacucauucaauaacaaaguauuaguacuaggaagcgaaaaccaaaacaaaggcaaucaaacacccuacgaauauuuuaacggaaaagacaauaguagagaauggcaagaauuuaaagccagaguagaaacuucaagauuuccaagaucuaagaaacaaagaauuuugcuacaaaaauucgaugaagaaggauucaaagaaagaaaccucaaugauacacguuaugucaauagauuuuuaugucaauucguagcugaucacaugcuacuaacaggaaaaggcaaacgaagaguuuucgcaaguaauggacaaaucacaaacuuacugcgcgguuuuuggggacuaaggaaaguaagggcagaaaacaauagacaucacgcauuagacgcuguaguaguugcauguucaacaguagcaaugcaacagaaaauaacuagguucguacgauacaaagaaaugaaugcauuugaugguaaaacaauugauaaagaaacaggagaagugcugcaucagaaaacacauuuuccgcaaccaugggaguucuuugcacaagaaguaaugauuagaguauuuggcaaaccugaugguaagccagaauuugaagaagcugauacaccagaaaaauuaagaacuuuauuagcagaaaaacuaaguucuagaccagaggcuguucaugaauacguaacaccauuauuuguuucaagagccccaaacagaaaaaugucaggacaaggucacauggaaaccguaaaaagcgccaagagacucgaugaaggcgugucaguucuacguguaccauuaacacaauugaaacugaaagaucuagagaaaaugguaaauagagaaagggaacccaaacuauaugaagcguugaaagccaggcuagaagcccauaaggacgacccugcaaaagccuucgcagaaccauucuacaaauacgauaaagcugguaaucguacacaacaagugaaagcagugagaguagaacaaguacaaaagacagguguaugggugagaaaccauaaugggauagcugauaacgcaacgaugguaagaguugauguauuugagaaagcuggaaaauacuacuuaguaccaauauauagcuggcaaguugcuaaaggaauacuaccagauagagcaguaguagcuuacgcagacgaagaaggcuggacaguaauagacgaaucauucagauucaaauucguauuauacaguaaugauuuaauaaaaguacaauuaaagaaagauaguuucuuagguuauuuuucaggacuagacagggcaacuggagccauaucacuuagggaacaugaccucgagaaaagcaaaggaaaggaugguaugcauagaauaggaguaaaaaccgccuugagcuuccaaaaauaccaaauugaugaaaugggaaaagaaauuagacuauguagacuaaagaaaagaccuccaguaagauga

SEQ ID NO: 8506 - RNA, 3246 nt, Artificial Sequence
  Cas9 variant
augacagcauucaaaccaaauccuauaaauuauauacuaggguuagauauaggaaucgcaucaguaggaugggcaaugguugaaauagacgaagaagaaaacccaauacgauugauagaccuagguguaaggguauuugaaagggcagaaguaccaaaaacaggagauucauuagcagcagcacgaagauuagcaagaucaguacgaagacuaacuagaagacgagcacauagauuauuaagagcaagaagauuauuaaaaagagaagguguauuacaagcagcagacuuugaugaaaauggacucauaaaaaguuuaccaaacacaccguggcagcuaagagccgcagcguuggaucgcaagcuaacaccauuagaauggagcgcaguacuacuucauuuaaucaaacauagggguuauuugagccaacgaaagaaugaaggugagacugcagacaaagaauugggagcauuauuaaaggguguagcagauaacgcacaugccuugcaaacaggcgacuucagaacaccggcugaacucgcaguuaauaaauucgaaaaagaaagcggccauauacgaaaucaacggggugauuauagccauacguuuucaagaaaagacuuacaagccgaauuaguauuacuauuugaaaaacaaaaggaauuugguaauccacauauauccgauggccuuaaagaagguauugaaacacuauuaauggcacaacgaccagcuuuauccggagaugcaguccagaaaauguuagguuauuguacuuuugaaccuacugaacccaaagcagcuaaaaauacauauaccgcugaaagguuuauuuggcugacaaaacuuaacaaccuuaggauucuagaacaaggaucagaaagaccuuuaaccgacacugaaagagcaacacucauagacaugccuuacaaaaacaagcucacauaugcaaaagcuagggaguuacugggacuagacgacacggcauuuuucaaagguuuaagauauggaaaagacaaugcugagucagcaacauuaauggaaaugaaagcauaucaugcaaucagacgagcauuagaaaaagaaggguuaaaagacaagaagucaccacuaucacuaaguccagaacuacaagaugaaauaggaacugcauucucccuguucaagacagacgaagacauaacgggaagacuuaaaggaugccuccaaccugaaauauuagaugcuuugcuaaaacacauaaacuucgauaaauuuguacaaauaagucuaaaagcccuaagaagaauagugccauuaauggaacaaggcaaacgauaugacgaagcaugugccgaaacauacggagaccauuacggagagaaaaauucugaagaaauguuauacuuaccaccaauaccggcagacgaaauacguaacccaguaguacuaagagcauuaucacaagcacgaaaaguaauaaauggaguagucagaagauauggaucaccagcucgaauacauauugaaacagcuagagaaguaggcaaaaguuuuaaagacagaaaagaaauagaaaaacgucaagaagaaaacagaaaagauagggaaaaggccgcagcaaaauuccgagaauacuucccuaacuuuguaggagaacccaaaaguaaagacauacuuaaacucagacuauaugaacaacaacauggaaaauguuuauauuccggaaaagcaauagauauaagaagacuaaacggaaaaggauauguugaaauugaccaugcacuacccuuuagcagaacgugggacgacuccuucaacaacaaaguauuaguauuaggaagugaaaaccaaaacaaaggcaauagaacuccauaugaauauuugaauggaaaagauaacucaagggaaugguuagaguuuaaagcaaggguagaaacuucaagguucccgcauaguaaaaagcaaaggguauuacuacaaaaauucgaugaaaaaggauuuaaagagcgaaaccuuaacgauacgagauaugucaacagauuuuuaugucaauuuguagcugaucacaugcaguuaacggguaaggggaagagaagaguauucgcaagcaauggccaaauuaccaauuuacuaagagguuuuuggggauuacauaaaguacgagcagaaaaugacagacaccacgcucuagacgcagugguuguagccuguagcacaguugcgaugcaacaaaagauaacaugcuucgugagauauaaagaaaugaaugcauuugauggcaaaacaguagauaaagaaacgggcgaagucuuacaccagaagacacacuucccacaaccaugggaauuuuucgcucaagaaguaaugaucagaguauuuggaaaaccggacgggaaaccugaguucgaagaagcugauacgccagaaaaguuaagagcacuauuggcagaaaaauuaagcucaaggccagaagcaguacaugaauacguaacaccauuauuuguaagcagggcuccuaauagaaaaaugaguggggcccauaaagacacuuuaagaucagcgaaaagauucguaaaacauaaugagaaaauaagcguuaaaagagucuggcugaccgaaauaaagcuagcagacuuagaaaauaugguuaacuacaaaaauggaagagaaauagaauuauacgaagcacuuaaagcaagacuuggugcauauggcgguaacgcaaaacaagcauucgauccaaaagauaauccauuuuauaagaaaggagggcagcuagucaaagcuguccgaguagagaaaacccaggaaagcggcguucuacuaaacaaaaagaaugccuauacaaucgcagauaacggugauaugguaaggguagauguauucuguaaaguagacaagaaaggcaaaaaccaauauuucauaguaccaauauaugcuuggcaaguggcugaaaauauacugccugacauagauuguaaaggauauagaauugaugauagcuacacguuuuguuuuucacuacauaaauaugacuuaauagccuuucaaaaagaugagaaaagcaaaguugaauuugcuuauuacauaaacugcgacucaagcaaugguagauuuuauuuagccuggcaugauaaagguucaaaagaacaacaauucaggauaagcacacaaaaucuaguacuuaugcagaaauaucagauagacgaauuaggaaaagaaaucagaccuuguagauuaaagaaaaggccaccaguuagguga

SEQ ID NO: 8507 - RNA, 3246 nt, Artificial Sequence
  Cas9 variant
auggcagcguuuaaaccaaaucccauaaacuauauacuaggauuagauauaggaauagcaagcgugggaugggcgaugguugaaauugacgaagaugaaaacccaauuuguuuaaucgauuuaggaguuagaguauuugaacgagcggaaguuccaaaaacuggggacaguuuagccgccgcaagacgcuuagcaagaucaguaagaagacucacuagaaggagagcacacagacuucuacgagcaagaagacuacucaaacgcgaaggcguacuacaagcagcagacuuugaugagaacggccuuauuaaaagucuuccaaauacucccuggcaauuaagaucugcagcauuagacagaaaauuaacgcccuuagaauggagcgcaguacuuuuacauuuaauaaaacauagggguuauuuaucacaaagaaagaaugagggcgaaacugcagacaaagaauugggagcacuauuaaaaggaguagcuaauaaugcucacgcacuacaaacaggagauuuuagaacaccagcugaauuagcgcuaaacaaauucgaaaaagaaaguggacauauaagaaaucaaagaggagauuauucucacacauuuucacgcaaagauuuacaggcagaacuaauuuuauuauucgaaaaacaaaaagaauuuggaaauccccacguaucgggagguuuaaaagaagguauagaaacucuauuaaugacgcaacgaccagcucuuucuggugacgcuguacagaaaaugcuuggacauugcacuuucgagccggcggaaccaaaagccgcgaaaaauacauacacagcagaaagauucauauggcuaacaaaacucaacaaucuccgaauacuagaacaaggaucagaacgaccccuaacggauaccgaacgagccacacuaauggaugaaccauauagaaaaagcaaauuaaccuaugcucaagcaagaaaauuacucggucuugaagauacagccuucuuuaaagggcucagauauggaaaagauaacgcagaagccucaacuuuaauggaaaugaaagcauaucaugcuauaaguagagcucuagaaaaagaaggucucaaagauaagaagucaccuuuaaaucucucuccagaacuacaagacgaaauaggaacugcguuuucacuuuuuaaaacugaugaagauauaacaggaagauuaaaagacagaauacaaccggaaauacuugaagcacuacucaaacacauaaguuuugauaaauuuguacaaauaaguuuaaaagcccuaagaaggauaguaccauugauggaacaaggaaaacguuaugaugaggcuugugcagaaauuuauggcgaucauuaugguaagaaaaauacagaagagaaaauauacuuaccgccaauaccugcagaugaaaucaggaauccuguaguacuccgugcuuuaucucaagcgcgaaaaguuauaaaugguguaguaagacgauaugguagcccugcaaggauucacauagaaacagcacgagaaguaggaaaaaguuucaaagaucggaaagaaauagaaaaacgccaagaagaaaauagaaaagauagggaaaaagcagcagcuaaguucagagaguauuucccaaauuucguaggggaaccgaaaucaaaagauauacuuaaacuucgacucuaugaacaacaacacgguaagugccuguacuccgguaaagaaauaaaccuaggccgauuaaacgaaaaagguuacguugagauugaucacgcacuaccuuuuucaaggacaugggacgauagcuuuaacaacaagguauuaguccuuggaucagaaaaccaaaacaaaggaaaucaaacucccuacgaauauuucaacggaaaagacaauucuagggaguggcaagaguucaaagccagaguagaaaccucacgauuuccacgcaguaagaaacaaaggauacuccuccaaaaguuugaugaagauggauucaaagaacguaaucucaaugacacuagauaugucaacagguuucuaugucaauuuguagcugacagaaugcgccucacaggaaaagguaaaaagagaguuuucgcaucaaauggacaaauaacaaacuuacuuagaggauucuggggauuaagaaagguaagagcugaaaacgaccgacaucaugcucuggacgcggugguaguugccuguaguacaguagcaaugcaacagaaaauaacaagauucguaagguauaaggaaaugaaugcguucgauggaaaaacgauugacaaagaaacaggagaaguacugcaucagaaaacacauuucccccaaccaugggaauuuuucgcacaagaaguuaugauaagaguauuugguaaaccagauggaaagccagaauuugaagaagcagauacaccagaaaaacuaagaacuuuacuggcagaaaaacuaucuucaagaccagaagcaguccacgaauauguuacaccccuauuuguauccagagcuccuaacagaaaaaugucgggccaaggacacauggaaacaguaaaaucagcaaaaagauuagaugaagguguuagugugcuacgcgugccauuaacacaacuaaaauuaaaagacuuagagaaaaugguaaaucgcgaacgcgaaccaaaauuauacgaagcauuaaaagcaagacuagaagcucauaaagaugauccugccaaggcauuugcagagccauuuuauaaauacgauaaagcagguaaccgaacacaacaaguaaaggcgguacgaguagagcaaguacagaaaacaggaguuuggguaagaaaucauaaugguauagcagacaaugcaacuaugguuagaguagauguauucgaaaaagcagguaaauauuauuuaguuccgauauauucauggcaaguugcaaaagguaucuuaccagaucgugcuguaguugccuaugcagaugaagaaggauggaccguaauagaugaaucguucagguucaaauuuguacuauauucgaacgacuuaauaaaaguacaauuaaagaaagauucuuuucuaggauauuucagugguuuagaccgagcuacaggugcaauaaguuuaagagaacacgauuuagagaaaaguaaaggaaaagauggaaugcaucgaauuggaguaaaaaccgcauuaaguuuccaaaaauaccaaauagacgaaaugggaaaagaaauaagacuuuguagacuaaagaaaagaccuccugucagauga

SEQ ID NO: 8508 - RNA, 3246 nt, Artificial Sequence
  Cas9 variant
augcuaaaacgagucuuaggaauagaugucggaauaucuagcauuggaugggcauuacuagaauuucaaggugauauagauaacaaagaucuuccaucuggaaaaauacucgcaucuggcguaagaguauuuacucaagcugaaaacccuaaaaacggcgaaagucuagcaaaaccacgaagagaugcaagacuugcaagacgaagaacaagaagacgagcucaaagacuaacagacauuaaagauuuguucuuuaaauauaaauugguuacagguauaaguagaaauaaaauuaauuccauuuauaaaacugaagaaaacaagaaagacccauggacacuuagaaaagaagcauuauacaggaaauuagacggcgaagaauuugcaagaguauuaacucauauagcaaaacauagagguuucaaaucaaugcguaaaagugaagaagaagggagugauacaaaagcaaaagaaacucaacguguacucacagaaauaggcaaaaauaaagauacauuaaaaacaggaauauggcaaaccgcuggagaaaugauagccucaaggccgaaaggugacgcaagacgaaacaaaacugauuccuauaaaaauucuauaagccgggaacuauuacaggacgaaacuaaaauaaucuucgaaaaacaaagggguaugaacucucaauucacauccgcagacuuagaaaaagaauauucggacauagcauuccaucaagcaccuauacagaguaugcuaaaaaugguuggaggauguaccuucgaaaaagacgaagaaggaaaaaggcuaaaaagagcacccaaaaauuccuauucagccgaaguauuuaccgcuuuaacuaaaauaaauaaccuaguucucaaaaccaaaacagcaaauauaaaugaccgauuccuaacaacagaagaacgaaagaaagcauuagaauuaugccauucaaacgcuaaaguaacuuucaaacaauuaaggggugaacugggacuaccagaagacuggauauucaacaccguugauuacgccaagaaacccaagaaaacugcaguaaaagaaaccgaaccugaaagugcuugcuucuuucaaaugagaggauacaacgaaauaagaaaaagugugggaaaagacuuauggacagaaaucaguaugaagaaagaaauucuaaauucaauagucacaacacuagcaacagagaaaagcgaugaagcaauaaaagcccaacucaagaaaucagaaguaccagacgaaauugcagaaaaaguacugggucuaaacuuucgcggauuccuacaucuauccauaaaagcacucgacaaaauaauaccauuuaugauggcaggagacaaauacacugaugcaugugacaaagcagguuacaaagaacaaauaucaggcaucaagaaaauauuuuuaagaaaauuaaacgaugaagaaaacgaacaaauaacaaauccugucgcaaaaagagcaaucacacaauuccgaaaaguaauaaaugcuauuauucgagaauacggaaaauucgaucaaaugaauauagaacuagcccgcgauuuagcaaaaucauacgaugaccgaaagaaaauaaaagaaggacaagaagacuuuagagccgaaaaagacagagcugcccaaagauguaaagacaacggacuagacccaaauucaaaagauaauuuauccaaauaccgauuaugggaacaacaagauaacggauuuugcaucuauugcggaaaaccaaucgaacuacaacgccuugcagaacaagguuacugugaggucgaccacauccucccuuacucacggaguuuggaugacucacaacacaacaaaguauuagcacauauacaugacaaccaacagaagaaaaaucaaauaccauuugaacacuucggaggugauggaccaaaaugggaagaauuuguaggaagacuaaacagucaauucaaaaaccuaccaaaaucuaaacuaaacagacuuguuaaacguaaauuugaugaaaaagacauggaaggauuuaaagaaagaaacauaaacgacacaagguacauaagccgguuuaucaaaaacuucguggaaaaucaucuagaguucgcagagagugcacaaaaacaaaaaguauuuguaagaagcggcucccuaacagccuucuuaagacaccaauggggacucauuaagaaacgagaugaauccgacagacaccacgcguuagaugcucuagucacagcgugcgcaacccaagcaauggugaaaucaacagcaaucacagcacaaaagauggaaucauacaacuggaucaauaaagaaaaaccaagaaugccucuaccguggcuaaacuuuagggacgacguucaaaaaucauuagacgcaguguuugugagcagagcaccaagacauaaaguaggcggagcugcacacaaagaaacuaucagaucuauuagaaaauguggagaagaaaaccuuauaauugagaaaaccccacucguugauauagcgacaaaaucuggcauaaaacuuaaagauauagagaaacuauauaagaaagaacaaaacagaaaacuauaugaaaccuuaaaagaaaggcucgaacaaaaugguaacgauccagucaaagcauuugggaauccagacgauccaguacgcaugccaacuaacgaucuuacaaaaacaggccccauaauaaaaagcaucaaacuaauaacaaacaagaaaucuggacuaaaugugagggcgggaauagcagacaacggagaaauugcaagacuagauguauaugaaagaaaaggaaaauucuaucuaauccccaacuauguagcagacuuugcaaacaaagagcuacccaagaaagcaaucaaagcuaauacacccgaaacagaauggcccaucauagacagaaauuacaauuucaaauucagucuauucaaagacgaccuaaucucaauaaaacaaaaacucgauucaccagaagaguucuauuauuauaaagggccagauguaucuacagcgaguauaacagucgaaaguguagacagaaaaagacuaugggaggagaaaaagaaaggaaaaauagaaaacguauuucacacccgaauaggcacaaaaacauuaaaaaguuuucguaaauuuaacuuggacauauuaggaacaaaagccccaguagaaaucaagaaagaaacauggguuggugucauaaggaaaaacggagucgcaaacaauacaggaaacaaagcgauguga

SEQ ID NO: 8509 - RNA, 3249 nt, Artificial Sequence
  Cas9 variant
auggcagccuuuaaaccaaauccaaugaauuacauauuaggacuagacauuggaaucgcaaguguaggaugggcgaugguagaaauugauaaagaagagaacccgauaagguuaauagaucuagggguaagaguauucgaaagagcggaaguaccgaaaacaggagauagcuuagcgauggccaggcggcuugccagaaguguacgaagauuaacaagaaggagagcacauagauuacuaagagcaagaagacuacuaaaacgagaagguguauuacaagaugcagauuuugaugagaauggucuaguaaagagcuugccaaacacuccauggcaauuaagagcagccgcuuuagauagaaaacuaacauguuuagaaugguccgcuguauuguuacacuuaauaaaacauaggggauaucucagucaacggaaaaacgagggagaaacugcagauaaagaauuaggagcccuauuaaaaggaguugcugacaacgcucaugcacuacaaacaggagacuucagaaccccugcagaacuagcacuaaauaaauuugaaaaagaaaguggacauauuagaaaucaaagaggagacuauucacacacauucucaaggaaagaccuacaggcagaacucaauuuauuauuugaaaaacagaaagaauuuucaaacccgcacguuucggacucacuaaaagaaggaauagaaacacuccuaauggcacagagaccugccuuaagcggugaugcuguacagaaaaugcuaggacauugcacauuugaacccgccgaacccaaagcagcuaaaaauacauauacggcagaaagauuuauuugguuaacgaaacugaacaaccuaagaauacuugagcaaggaucagaaagaccucuaaccgauacugaaagagcaacauugauggacgaaccguacagaaaaagcaaacuaacuuaugcccaagcacgaaaauugcuuggacuugaagacacagcuuucuucaaaggauuaagguacggcaaagauaaugcagaggcaccaacauuaauggaaaugaaagcguaucacgcaauaagcagagccuuggaaaaagaaggccuaaaggacaagaaaucaccacuuaaucuaagcacagaauugcaagaugaaauaggcaccgcauucagucuauucaaaacagacaaagacauuacaggaagauuaaaagacagaguucaaccggagaucuuggaagcauuacuaaaacauaucagcuuugauaaauuuguccaaauaagccuuaaagcauuaaggagaauaguuccauuaauggaacaaggaaaacgcuaugaugaggcuugugcugaaauauauggcgaccacuacuguaagaaaaaugcagaagagaaaauauauuuaccuccuauaccugcugaugaaauaagaaacccagucguacuaagagcacuaagccaagcaaggaaaguuauaaauugcguaguucgacgauauggcagcccugcucgaauacacauagaaacagcacgagaaguaggaaaaaguuuuaaagauagaaaagaaauagaaaaacgacaagaagaaaaucguaaagaucgagaaaaagcagcagcaaaguuuagagaauauuucccaaauuuuguuggagaaccaaaaucaaaagacauccuaaaguuacgauuauaugaacaacaacacggaaaaugcuuauacuccggaaaagaaauaaaucuuguuagacuaaacgaaaaaggauauguagaaauagaucacgcacuacccuucucgagaacgugggaugacucauuuaauaacaaaguucuaguacuuggcucugaaaaucaaaauaaaggaaaccaaacaccuuacgaauacuucaacgguaaagauaacucaagagaauggcaggaauuuaaagcacgaguagaaacuucuagauucccuagaaguaagaaacagaggauauugcuacaaaaauuugaugaggaaggauucaaagaaaggaaucuaaacgauacaagauauguaaaucgauuuuugugccaauucguagcagaucacauacuucuaacagguaaagguaaaagaagaguguucgccucaaacggucaaauaacuaacuuauuacgcggguucugggguuugcgaaaaguaagagcagaaaaugaccgucaucaugcacuagaugcuguaguaguugcguguagcacuguugccaugcaacaaaagauuacacgauucgugagauauaaagaaaugaaugccuuugauggcaaaacaaucgacaaagaaacaggagaaguacugcaucaaaaagcacauuucccacaaccgugggaguucuuugcacaagaaguaaugauucgaguauuuggaaaaccagacgguaaaccagaguuugaagaagcagauacuccugaaaaacuacgaacauuguuagcggaaaaacuaaguagccgaccagaagcgguucacgaauaugucacaccucuauuuguaucucgagcacccaaucgcaaaaugucuggucaaggucacauggaaaccguuaaaagcgcgaaaaggcuugaugaaggaauaaguguacuuagaguaccacuaacacaauugaaacuuaaaggacuagaaaagauggucaauagagaacgagaaccaaaacuuuaugacgcacuaaaagcacaauuggaaacacauaaagacaauccagcuaaagcauuugcagaaccauucuacaaguacgauaaagcuggcaauaggacacaacaaguuaaagccgucagaauagaacaaguacagaaaacgggaguguggguacgaaaucacaauggaauagcagauaacgcaacaauggucagaguugacgucuuugaaaaaggcggaaaguauuacuuaguuccuauuuauaguuggcaaguagcaaaaggaauacuuccggauagagcuguaguugcuuucaaagaugaagaggauuggacaguuauggacgauaguuuugaauuuagauucguauuauaugcaaacgaccugauuaaauugacagcaaagaaaaaugaguuuuuagguuauuuuguuagcuuaaacagagcaacaggagcaauagacauuagaacucaugauacagauucgaccaaagguaaaaacggaauauuucaaucaguugggguaaaaacugcacucagcuuucagaaaaaucaaaucgaugaguuagguaaagagauaagaccaugccgauuaaagaaaaggccaccaguucgauga

SEQ ID NO: 8510 - RNA, 3249 nt, Artificial Sequence
  Cas9 variant
auggcggcuuucaaaccgaacccaauaaauuacauucuaggacucgacauaggaaucgcgaguguaggaugggcaaugguagaaauagacgaagaagaaaauccuauaagauuaauugaucucggugucagagucuuugaacgagcagaaguccccaaaacuggagacucacuagcgauggcacgaagacucgcucgcagcguaagaaggcucacaagacgacgagcucaucgauuauuacgugcaagacguuuacuaaaacgagaagguguacuccaagcagcagacuuugacgaaaaugguuuaauaaaaucccucccaaacacaccauggcaacuaagagcagcagcacuggaccgaaaacucaccccauuagaguggagugcuguauuauuacaucuaauaaaacauaggggauauuuaucacaaaggaaaaaugaaggcgagacagcagacaaagaauuaggcgcauuacuaaaagguguugcuaacaaugcccacgcgcuacaaacaggugacuuuagaaccccggcagaacuggcacuaaauaaauucgagaaagaaucagggcauaucagaaaucaacgaggagauuauucacauacuuucucacguaaagaucuacaagcagaauuaauucuacucuuugaaaaacaaaaagaguucggaaauccacacguaagcggggguuuaaaagaaggaauagaaacauuacuaaugacccaaagaccugcccugagcggggaugcaguacagaaaauguuaggucacuguacuuuugaaccagccgaaccaaaagcugcuaaaaacacauauaccgcagaaagguucaucuggcuaacuaaauugaauaaucucagaauacucgaacaaggcagcgaaagaccacuaaccgauacugaaagggcaacauuaauggaugaaccauacagaaaaucaaaacugacuuaugcacaagcacgaaaguuacuuggcuuagaagacacagccuucuuuaaaggccuuagauauggaaaagauaaugcagaagcaaguacauuaauggaaaugaaagcauaccaugcaauuucacgagcacuagaaaaagaaggacuaaaagacaagaaaucaccauuaaacuuaaguagcgagcuacaagaugaaaucggcaccgcauuuucacuauuuaaaacagaugaagacauaacagggagacuaaaagacagaguucaaccagaaauacuagaagcauuauugaaacacaucaguuucgacaaauucguacaaauuaguuuaaaagcacuaagaagaauagucccauuaauggaacaaggaaaaagauaugaugaagcaugcgcagaaauauauggggaccacuacggaaagaaaaacacugaggagaaaauauauuuaccaccgauaccagcagacgaaauacgaaauccaguaguacugagagcccuaagccaagcacguaaagucauuaauggagucguaagaagauauggaagcccagcaagaauacauauugagacagccagagaaguaggaaaaucauuuaaagaucguaaggagauagagaaaagacaagaagaaaaucggaaagacagagaaaaggcggcagcaaaauucagagaauacuucccaaauuuuguaggagaaccaaaaaguaaagacauuuuaaaauuaagacuauacgaacaacaacacggaaaaugcuuguacaguggcaaagaaauaaaucugguaagguuaaaugaaaaaggauauguugaaauagaucaugcuuuaccauucagccgcacuugggaugacagcuuuaauaacaaagucuuagugcuaggaucagaaaaccagaacaaaggaaaccaaacuccauacgaauauuucaauggaaaagacaauucacgugaauggcaggaauuuaaagcacguguagaaacgagcagauuuccucgauccaagaaacagagaauauuauugcaaaaauuugaugaagacggauuuaaagagugcaaucuaaaugauacaagauaugucaacagauuuuuaugucaauuuguagccgaucauaucuuacuaacaggaaaaggaaagagaagagucuucgcaucuaauggacaaauaacaaacuuacucagaggauuuugggggcuuagaaaaguaagagcagagaacgacagacaccacgcacuugacgcagucguuguagcaugcucaaccguagccaugcaacagaaaaucacaagauuuguacgguauaaagaaaugaaugcguuugacggaaagacuauagauaaagaaacaggaaaaguacuacaccagaaaacacacuucccacaaccgugggaauuuuucgcacaagaaguuaugauaagaguauuugggaagcccgauggaaaaccugaauuugaagaagcagauacaccugaaaagcugaggacauuacuugcggaaaaacuauccuccagaccagaagcgguacacgaauacguaacaccauuguuuguuaguagagcaccgaauagaaaaauguccgggcaaggucacauggaaacgguuaaaucagcaaaaagacuagaugagggaguuucuguacuacguguuccacuaacacaauuaaaacuaaaagauuuagagaaaaugguaaauagagaaagagaaccaaaacuauacgaagccuuaaaagcaagacuagaagcacauaaagaugauccagcaaaagcauuugccgaaccauuuuacaaauaugacaaagcaggcaacagaacccaacaaguaaaggcaguaagaguggaacaaguacagaaaaccgggguuuggguaaggaaccacaacggcauugcugacaaugcaacgaugguaagaguagauguauuugaaaaaggagacaaauauuaucuaguuccuauauauucuuggcaagucgcgaaaggcauacuuccagauagagcaguaguccaaggaaaggacgaagaagacuggcaacuaauagacgacaguuucaauuuuaaauucucauuacauccuaacgauuuaguagaagucauuacaaagaaagccagaauguucggauacuucgcaucaugccacagaggaacaggcaacauaaauauaaggauacaugauuuagaccacaaaauagggaaaaacgguauacuugaaggaauuggaguuaaaacagcucuaucauuccaaaaauaccaaauagaugaguuaggaaaagaaauacgaccuugccggcuaaagaaaagaccucccguaagauga

SEQ ID NO: 8511 - RNA, 3249 nt, Artificial Sequence
  Cas9 variant
auggcagcauuuaaaccaaacccaauaaauuacauucuaggguuggauauaggaauugcaagcguaggcugggcaaugguagaaauagaugaagacgaaaacccaauaugccuaauugauuuaggaguaagaguguuugagagggcagaaguaccaaaaaccggggacagcuuagcaauggcuagaagacuggcucgaucagucagaagauuaacaaggagacgugcccacagacuacuacgagcacgaagacuacuaaaacgagaaggaguacuucaagcagcugauuucgaugaaaauggauugauuaaaucccugccaaauacaccauggcaauuaagagcugcagcauuagauagaaaauuaacuccacuggaauggucagcaguauuacuccaucucauaaaacauagaggauaucuuucccaaagaaagaaugaaggagaaacugccgacaaagaauuaggugcguuguugaaaggaguugcugauaaugcacacgcauuacaaacaggugauuuuagaacuccagcagaauuagcuuugaauaaauuugaaaaagaaaguggacauauaagaaaccaaagaggugacuauucacacacuuucucgcgaaaagaucuucaagcagaacuaauacucuuauuugaaaaacaaaaagaguucggaaacccgcacguaagcggaggguuaaaagaagguauagaaacccuguuaaugacucaaagaccagcacuaucaggggacgcaguccagaaaauguuggggcacugcaccuucgaaccagcagagccaaaagcggcuaaaaacaccuauacagcugaaagauucaucuggcugacaaaacuaaacaacuuaagaauacucgaacaaggaagugaacguccacuaaccgacacugaaagagcaacgcuaauggaugagccuuauagaaaauccaaacuaacauacgcacaagcaagaaaacuauuaggucuugaggauacagccuuuuucaaaggcuuacgauauggaaaggauaaugcagaagcuagcacauuaauggaaaugaaagcauaccaugcuauuagccgugcauuagaaaaagaagguuugaaagauaagaaaagccccuuaaacuuaucacccgaacuacaagacgaaauaggaacugcuuuuucauuauucaaaacagaugaagacauaacgggaagauuaaaagauagaauacaaccagagauauuagaagcacuuuugaaacauauauccuucgacaaauuuguacaaaucucacuuaaagcgcugcguagaauuguaccuuuaauggaacaaggcaaaagguaugaugaagcaugcgcagaaauauauggagaucacuauggaaagaaaaacacggaagagaaaaucuaucuaccaccuauacccgccgaugaaauacggaacccaguaguauuacgagcccuuagccaagcaagaaaaguaauaaauggcguaguacgaagauauggaucaccagcacgaauccacauagaaaccgcuagggaaguaggcaaaucuuucaaagacagaaaggaaaucgagaaaagacaagaagaaaacagaaaagauagggaaaaagcagcagcaaaauucagagaauauuuuccuaauuucguaggugaaccuaaaucgaaagauauacucaaacugagacuuuaugaacagcaacauggaaagugcuuauauagcgggaaagaaauaaauuuaggaagacuaaacgagaaaggguacguggaaauagaccaugcacuaccauuuucgaggacaugggaugacucguuuaauaauaaaguauuaguacuaggaagcgaaaaucaaaacaaggguaaccaaacaccuuacgaauacuuuaauggcaaagacaauucaagagaauggcaagaguucaaagcaagaguagaaacaucaagauucccucgaucaaagaaacaacgcauacuacuacaaaaauucgacgaagauggauuuaaagaaagaaaccuaaaugauacaagauacgucaauagauuuuuaugccaauuugucgcggauagaaugagauuaacuggaaaagggaagaaaagaguguuugcuagcaauggacaaauaacaaacuuauuacgcggauuuuggggacuuagaaaaguaagagcagaaaaugauagacaucacgcccuugaugcaguaguaguugcauguucaacaguagccaugcagcaaaagauaacgagguuuguaagauacaaagaaaugaacgccuuugacggaaaaacuaucgauaaagaaacuggagaaguauuacaucagaaaacacacuuuccgcaaccgugggaguucuucgcccaagaagugaugauacgaguuuuuggaaaaccagauggaaaaccagaguucgaagaagcugauacaccggaaaaacucaggacacuauuagcagaaaaauuaaguucaagaccggaagcgguacacgaauauguaacaccccuauuugucaguagagcuccuaauagaaaaaugaguggacagggacacauggaaacaguaaaaucagcaaaacgacuggaugaaggcguaagcguacuaagaguaccacuaacccagcuaaaacuuaaagacuuagagaaaaugguuaauagagaacgagaaccaaaauuauaugaagcgcuaaaagcaagguuagaagcacauaaagaugauccugcgaaggcuuuugcagaacccuuuuacaaauacgauaaagcagggaaccgaacucaacaagugaaagcagugagggucgaacaaguacaaaagacuggaguauggguaagaaaccacaauggaauagcugacaacgccacuaugguaaggguagauguauuugaaaaaggagauaaauauuaccuagucccaauauauucauggcaagucgcuaaaggcauuuuaccggaccgagccguaguucaagguaaagacgaagaagauuggcaacuaauagaugacaguuuuaacuucaaauucucuuuacauccaaacgaucugguugaagucauaacaaagaaagccagaauguuuggguauuucgcauccugucaucgggggacaggaaauauaaauauacggauacaugacuuagaucauaaaauugguaaaaaugguauucuagaaggaauuggaguaaaaacagcacucagcuuucagaaauaucaaauagacgaacuaggagaagaaauaagaccaugucgacuaaagaaaagaccaccagucagguga

SEQ ID NO: 8512 - RNA, 3249 nt, Artificial Sequence
  Cas9 variant
auggccgcauuuaaaccaaacccgauaaacuacauauuaggacuagacaucgguauagcaagcgugggaugggccauggucgaaaucgacgaggacgaaaauccgauaugcuuaauagaucugggaguaaggguauuugaaagagcugaaguaccaaaaacaggggauagucuagcgauggcaaggcgauuagcgcgaucaguaagaagacuaacaagaaggagagcacacagacucuuaagagcccgaagacuauuaaaacgugaaggggugcuacaagcagcagacuuugaugaaaacggccuaauuaaaucgcucccgaacacuccuuggcaauugagggcagcagcacuagaccgaaaacuaacccccuuagaauggucugcagugcuacuucaucuaaucaaacauagaggauauuuaucucaacggaaaaacgaaggagaaacagcagauaaagaguuaggagcacuuuuaaaggguguugcagauaaugcgcaugcacuccaaacuggugauuuuagaacgccugcagagcuugcacuuaacaaauucgaaaaagaaaguggucacauaagaaaucaaagaggugauuacucccauacauuuucaagaaaagaccuucaagccgaacuaauauuacuauucgaaaaacaaaaagaguucggaaacccacauguaucaggaggacuuaaagaaggcauugaaacacuauuaaugacacaaagaccagcauuaucgggagacgcaguacagaaaauguuaggacauugcacuuucgaaccagccgagccuaaagcggcuaaaaacacguacaccgcagagagauuuauuuggcuaacuaagcuaaauaaccuaaggauauuagaacaaggcagcgagcgacccuugaccgauacagaacgugcaacacuuauggaugaaccauacagaaagucaaaacuuacguacgcacaagcucgaaaacuauuaggauuagaagacacagcauucuuuaagggucucagauaugguaaagacaaugcagaggccuccacauuaauggaaaugaaggcuuaucacgcaauaucacgagcccuagaaaaggaaggauuaaaagauaagaaaagcccacuaaacuuaaguccagaauuacaagaugaaauaggaacagcguucagucuauuuaaaacugacgaagauauaacaggaagauuaaaagaucgaauacaaccagaaauuuuagaagcccucuugaaacauauuucauuugauaaauuuguccaaauaucauuaaaggcuuuacggagaauuguucccuuaauggagcaaggaaaaagauacgaugaagcaugugcagaaauuuacggugaucacuacggaaagaaaaauacugaggagaaaauauaucuaccaccaauaccagcagaugaaauacguaaccccgucguucuaagagccuuaucacaagcaagaaaagugaucaauggaguaguacgaagauauggguccccagcgaggauacacauagaaacugcaagagaaguagguaaaaguuuuaaagaccgaaaagaaauagagaaaaggcaagaagaaaauaggaaagacagagaaaaagcagcagccaaauucagagaauacuuuccaaauuucguaggagaaccaaaaagcaaagacauccuuaaauuaagacucuaugaacaacaacacggcaagugccuuuacucuggaaaggaaauaaaccuaggacgcuuaaaugaaaaaggauacgucgaaauagaccacgcauuaccuuucucuagaacaugggaugacucauuuaacaauaaaguauuaguacuuggcucagaaaaucaaaacaaagggaaccaaacacccuacgaauauuuuaaugguaaagacaacucaagagaauggcaagaauuuaaagccagaguugaaacgucacgauuucccagaucaaagaaacaaagaauacugcuacaaaaauuugacgaagaugguuuuaaagaaagaaaucuuaacgauacuagauauguaaauagauuuuugugucaauuuguggcggaucgaaugagacuuacagguaaagguaagaaaagaguauuugcuucuaacggucaaauaacaaaucuuuugcguggcuuuuggggucucaggaaaguaagagcagaaaacgaccgacaccacgcccucgacgcugucguaguagcuugcucaacaguagccaugcaacagaaaauaacacgauuuguccguuacaaagaaaugaacgcauuugacggaaaaacaauagauaaagaaacaggcgaaguacuacaucagaaaacccauuuuccccaaccuugggaguucuuugcacaagaaguaaugauaagagucuuuggaaaaccagacggaaaaccagaguuugaagaagcagauacaccagaaaaauuaagaacucuccuagcagaaaaacuaucaagcagaccagaagcaguacacgaauauguuacaccauuauuuguuagcagggcaccuaauagaaaaaugucgggccaaggacacauggaaacaguaaaaucugcuaaaagauuagacgaaggaguuagcguacuucgaguuccuuugacacaacucaaacuuaaagaccucgagaaaaugguaaacagagaacgagaaccaaaacuauaugaggcuuuaaaagcuagacucgaagcacauaaagacgacccagcuaaagcauuugcagaacccuuuuacaaauacgauaaagcaggaaauagaacucaacaaguaaaagcaguacgagucgaacaaguucaaaagacuggaguuuggguuaggaaccauaauggaauagcagauaaugcaacuaugguuagaguagacguauuugaaaaaggagauaaauauuaucuaguacccauauauucauggcaaguagcaaaagguauacucccagaucgagcuguuguacaaggcaaagacgaagaagacuggcaacuaaucgaugauaguuuuaauuucaaauucucccuucauccaaacgauuuaguugaaguaauaacaaagaaagcacgaauguucggcuacuuugcuucaugucauagaggaacaggcaacauuaauauaaggauucaugaccuggaccacaaaauagggaaaaacggaauauuagaaggaauaggaguaaaaaccgcacuaucuuuucaaaaauaccaaauagacgaacuaggaaaagaaauaagaccauguagauuaaagaaaagaccaccaguaagauga

SEQ ID NO: 8513 - RNA, 3249 nt, Artificial Sequence
  Cas9 variant
auggcugcuuucaaaccaaacccaauuaauuacauauuaggcuuggacauuggcauagcgagcgucggaugggcuaugguagaaauagaugaagaugaaaauccaauaugucuuauagaucuagggguacgaguauucgaaagggcugaggugccuaaaacgggcgauucacuggcagcagcaagacgauuagcuagaucaguacgacguuuaacgcgaaggcgugcacaucgauuacuuagagcgagacgauuguuaaaaagagaaggcguacuacaagcggcagauuuugaugaaaaugguuuaaucaaaucgcucccgaauacaccguggcaauuaagggcagcugcauuggacagaaaauuaacaccucuugaauggucggcaguauugcuacaucuaauaaaacauagaggauaucuaagccaaaggaaaaacgagggagaaacagcagauaaggaauuaggcgcacucuuaaaagggguagcagacaaugcacaugcacuacaaacuggagauuucagaacgcccgcagaacuugcacuaaauaaauucgaaaaagaaagcggccacauaagaaaccaaagaggagauuauucacacacuuucucaagaaaagacuuacaagccgaacuuauauuacuuuucgaaaagcaaaaagaauuuggaaauccucauguaucaggugggcuaaaagaaggaauagaaacacuauuaaugacucaaagaccugcccuaucaggagaugcuguacagaaaauguuaggucacuguacguuugagccagccgaaccaaaagcugccaaaaauaccuauacagcagaaagauuuauauggcuaacaaaacuaaauaaccucagaauccuugaacaaggaucagaaagaccacuaacagacacugaacgagcuacgcuaauggaugaaccuuacaggaaaucaaaacuaacuuaugcacaagcuagaaaacuuuuaggucuagaagacacagcguucuuuaaaggauuacgauauggaaaagauaaugcagaagcaucgacacuaauggaaaugaaagccuaccaugcaauaagucgcgcucuagaaaaagaaggacucaaagauaagaaaucaccccugaaucuaucaccagaacuacaagacgaaauaggcacugcuuucagccuguuuaaaacagaugaagacauuacagguagacuuaaagauaggguacaaccagaaauacuagaggcauuacuaaaacauauauccuuugauaaauuuguacaaauaagucuuaaggcuuuaagaagaauaguaccuuuaauggaacaagguaaaagguaugacgaagcaugugccgaaauauauggcgaucacuaugguaagaaaaauacagaagagaaaauauauuuaccuccgauaccugcagacgaaauaagaaaccccguagugcuaagagcacugucacaagcaagaaaaguuaucaauggaguaguuaggagauacggaagcccagcuagaauacauauugaaacagcuagagaaguaggaaaaucauuuaaagauagaaaagaaauugaaaagagacaagaagaaaauagaaaagauagagaaaaggcugcagccaaguuccgagaauauuuuccaaauuucguuggagagccaaaaaguaaagauauccucaaauuaagacuauacgaacagcaacauggcaaauguuuauacaguggcaaagaaauuaauuuaggaagguuaaaugaaaaagguuaugucgaaaucgaucacgcacuaccauuuucacgaacaugggaugacucauuuaacaauaaaguauugguacucggaucugagaaucaaaacaaggguaaccaaaccccuuaugaauacuucaacgguaaagauaauucaagagaauggcaagaauuuaaagcgagaguagagacaucucgguuuccaagaucuaaaaagcaaaggauacuauuacagaaauucgaugaagauggauucaaagaaagaaaccucaaugacacccguuauguaaaccgauuucuaugucaauuugucgcagacagaaugcgccuaacugggaaaggcaaaaagcgaguguuugcaaguaauggacaaauaacaaaccuacuccgaggauucuggggacuuagaaaaguuagagcagaaaaugauagacaccacgcucuagacgcaguaguaguugccuguaguacaguagcaaugcaacaaaagauaacaagauuuguaagguauaaagaaaugaacgcauuugacggaaagacuauugacaaagaaacgggagaaguacuacaucagaaaacucacuucccucaacccugggaauuuuucgcacaggaaguaaugauccgaguuuuuggcaagccagauggaaaaccagaguucgaagaagcagacacuccagaaaaacuaagaacacuuuuagccgaaaaauuaucaucucgaccagaagcaguacaugaauacguaacuccacucuuuguuaguagagccccaaaucgaaaaaugucuggacaaggucacauggaaacaguaaaaagcgcuaaaagauuagaugaaggaguaucaguauugagagugccacucacgcaauuaaaauuaaaagaccuugagaaaaugguaaaucgcgaaagagaaccgaaauuauacgaagcauuaaaagcuagauuagaagcacauaaagaugauccagccaaagcauuugcagaaccuuuuuauaaauacgauaaagcuggaaaucgaacacaacagguuaaggcggugaggguagaacaaguacagaaaacuggaguauggguaagaaaucacaacggaauagccgauaaugcuacgauggugcgaguagacguauucgaaaaaggagauaaauauuauuuaguaccaauauauuccuggcaaguagcaaaaggaaucuuacccgaucgugcgguaguacaaggaaaagaugaagaagauuggcaacucauugaugauaguuuuaauuucaaguuuucauuacacccgaaugauuuaguagaaguaauuacaaagaaagccagaauguuuggauauuuugcauccugccauagaggcacaggaaauauaaacauaagaauacaugaucuagaucauaaaauaggcaaaaaugggauuuuagaaggaauuggaguaaaaacagcauuaucuuuucaaaaauaucaaauagacgaacuaggaaaagagauccgcccuugccggcucaaaaagagacccccaguaagauga

SEQ ID NO: 8514 - RNA, 3249 nt, Artificial Sequence
  Cas9 variant
auggcagcuuuuaaaccaaauccaauaaacuacauauuaggccuagauauagggaucgccucaguaggcugggcaaugguagaaauagacgaggaagaaaauccuauccgucucauagaucuaggaguaagaguauuugaaagagcugaagucccuaaaacaggagauucauuagcaauggcucgaagacuagcacgauccguaagaagguugacacguaggagagcacaucgucucuuaagaacaaggagguuacuaaaaagagaaggaguuuuacaagccgcaaauuucgacgaaaauggacuaauaaaaucucuuccaaacacacuauggcaauuacgagcugcagcacuagaucgaaaauuaacucccuuagaauggucagcaguuuuacuacauuuaaucaaacauagagguuaccucucacagaggaaaaacgagggagaaacagcggauaaagaauuaggagcuuuauuaaaagggguagcgggaaaugcccaugcccuacaaacaggugauuuuagaaccccugcugaacuagcacuaaauaaauuugaaaaagaaucuggucacaucagaaaccaacguggagauuacucacauacauuuucacguaaagauuuacaagcagaacuaaauuuauuauuugaaaaacaaaaggaguucgguaauccgcacauaagcgacggucuaaaagaaggaauagaaacauuacucaugacgcaacgacccgcguuauccggagaugcaguucaaaagauguuaggacauugcaccuucgaaccgacggaaccuaaagcagccaaaaauacuuauacaaccgaaagauuuauuugguuaacaaaacuaaacaaucuuagaauacuugaacaaggaucagaacguccauuaacagacacugaaagggcaacauuaauggaugagccauauagaaagucaaaauuaaccuaugcacaagcaagaaaauuguuagagcuagacgauauagccuucuuuaaaggauuaagauacggcaaagauaaugcagaagcaucaacuuuaauggaaaugaaagcauaccaugccaucagcagagcuuuagagaaagaaggauuaaaagauaaaaagucaccauuaaauuuaagucccgaacuucaagaugaaauaggaacugcguuuucuuuauuuaagacagacgaagacaucacaggccgcuugaaagacagaauacaaccagaaauauuagaagcacuauuaaaacacauaaacuuugacaaauuuguacaaauuagcuuaaaagcccuaagacgcauaguaccacuaauggaacaagggaagcgauaugacgaagcaugcgcugaaauauauggugaccacuauggcaaaaagaacacagaagagaaaauagauuuaccuccaaucccagccgaugaaauccauaacccaguaguacucagagcccuaucacaggcuagaaaaguaauaaacggaguuguaagaagauauggaagcccugcaagaauacacauagaaacugcaagagaagugggaaagucauuuaaagaucgaaaagaaauagaaaaacgccaagaagagaauagaaaagacagagaaaaagcagcagcgaaauuuagggaauauuuucccaauuuuguaggugaaccaaaaaguaaagacauauugaaacuaagacucuaugaacaacaacacggaaaaugccuauauucaggaaaagagauuaacuuagggagauuaaacgagaaaggauauguggaaauagaucaugcgcucccauuuucuagaacaugggacgauucauucaauaauaagguauugguuuuaggauccgaaaaucagaacaaaggaaaucaaacaccuuacgaauacuuuaauggaaaagacaacucacgcgaauggcaggaguucaaagcaagaguagaaaccucccgauuuccuagaucaaagaaacagagaaucuuacuacaaaaauucgacgaagacggauuuaaagaaaggaaccuaaacgauacuagauaugucaaucgauuucuuugccaauuuguagcugacagaaugaggcuuaccgguaaaggaaagaaaagaguauucgccucaaauggacaaaucacaaaccuucuacgcggauuuugggguuuaaggaaaguacgagccgaaaacgauaggcaccacgcauuagacgcaguaguagucgcuugcaguacaguagccaugcaacagaaaauuaccagauucguaagauacaaagagaugaacgcauucgaugggaaaacaauagauaaagaaacaggagaaguauuacaccagaaaacucauuuuccacaacccugggaauuuuucgcacaagaaguaaugauuaggguauucggcaaaccagauggcaagcccgaguucgaagaagcagacacaccagagaaacugcgaacauuauuaacggaaaaacuaaguucuagaccugaagcaguccaugaauacgucacgccauuauuugucagucgagcaccuaaucgaaaaaugucuggacaaggucacauggaaacagucaaaucagccaaaagauuagaugaaggaaucucaguuuuaagaguacccuuaacucaauuaaaauuaaaagacuuagagaaaaugguaaauagagaaagagaaccaaaauuauaugaagcauugaaagcaagauuagaagcgcacaaagaugacccagcaaaagccuucgcagaaccauuuuauaaauaugauaaagccggcaauagaacacaacaaguaaaagcuaugcgaguagaacaaguucagaagacuggaguaugggucagaaaucacaauggaauagcagauaacgcuaccaugguacguguagacguauuugaaaaaggagauaaguacuacuuaguacccauauauuccuggcaaguugcaaagggaauuuuaccagacagagccguaguccaaggaaaagacgaagaagauuggcaauuaaucgacgauaguuucaauuucaaauuuucccuacauccgaaugaucuuguugagguaauaaccaagaaagcuagaauguucggcuauuucgcaaguugucaccgaggcaccggcaauauaaacauacgaauacacgauuuagaccauaaaauagguaaaaauggaauauuagaaggaauaggagugaaaacagcccuaucauuucaaaaauaucaaauagacgaacuuggaaaagaaauucgucccugccgacuaaagaaaaggccaccggugcgcuga

SEQ ID NO: 8515 - RNA, 3249 nt, Artificial Sequence
  Cas9 variant
auggcagcauucaaacccaaucccauaaacuauaucuuaggauuagacauaggaauagcuucagugggaugggcaauggucgaaauugaugaagaugaaaacccaauaugcuuaaucgaccuaggaguacgagucuuugaacgagcugaaguaccaaaaacaggagauucauuagcaauggcaagacgucuagcaagaaguguaaggagauuaaccagaaggagagcucacagauuacuacgagcuagaagauuacuuaaacgcgaaggcguacuucaagcggcagauuuugaugaaaauggacuaauaaaaucauuaccaaacacgccuuggcaauugcgagcagcugccuuagauagaaaauuaacaccauuagaauggagcgcaguacucuuacaucuaauaaagcacagagguuacuugagucaacggaaaaacgaaggagaaacagcugauaaagaacuuggugcacuucuaaaaggaguagcggauaacgcccacgcauuacaaacaggugacuuuagaacgccagcugaacuugcuuuaaacaaauucgagaaagaaucaggccauauuagaaaccaaagaggagauuacagucacacuuuuaguagaaaagacuuacaagcggaacucaaucuccuauucgagaaacaaaaagaauuuggaaacccucauauuagcgauggauuaaaagaaggaauugaaacacuacucaugacacaaagaccggcauuaucaggagaugcuguacaaaagaugcugggacacuguaccuuugaaccggcagaaccuaaagcagcgaaaaacacauauacugcagaaagauucaucuggcuaacgaaauuaaauaaccuucggauuuuagaacaaggaucagaaagaccacuuacagacacagaaagaacaacucuuauagacgaaccauaccgaaaaucaaaacuuacuuacgcacaagccagaaaacuucucgaauuagauaauacugcauucuuuaaaggacugcgauauggaaaagacaacgcagaggcuucuacauuaauggagaugaaagccuaccaugccaucucacgugcacuugagaaagaaggguuaaaggauaagaaaaguccacuaaauuuaucuccagaacuacaagaugaaauaggaacagcauucucauuguucaaaacagacgaagauaucacgggaaggcuaaaagauagaguacaaccagaaauucucgaagcacuauuaaaacacauaucauuugauaaauuuguucaaauuagcuuaaaagcucuaagacgaauaguaccauuaauggaacaagguaaacgauaugaugaggcuugcgcagaaauauacggcgaccauuauggaaagaaaaauacagaagagaaaauagaucuuccuccgauuccagcagaugaaauaagaaaucccguuguuuuaagagcuuuaagccaagcacgaaaaguaauaaauggagucguaagaagguauggaucaccagcuagaauacacauagaaacagcaagagaaguuggaaaaaguuuuaaagacagaaaggaaauugaaaagagacaagaagaaaaccggaaagauagagaaaaggcugcuacaaaguuuagagaauacuuuccaaacuucguaggugaaccaaagucaaaagauauauuaaaauuaagauuauacgagcaacaacauggaaagugucuauacagcggaaaagaaauaaaccuaggaagacucaacgaaaaaggauauguugaaauagaccacgcacuaccauuuucaaggacuugggaugauaguuuuaauaacaaagucuuaguauuagguagcgaaaaccaaaauaaaggcaaucaaacacccuacgaguauuuuaacgggaaagauaacagucgagaguggcaagaauuuaaagcuagggucgagacgucacgauucccacguaguaagaaacaacguauucucuuacaaaaauuugacgaagaaggguucaaagaaagaaauuuaaaugacacaagguauguaaaccgauucuuaugccaauuuguagccgaccauauguuacuaaccgguaaagggaaaagaagaguuuuugcaucaaacgggcaaauaacaaaucuacugagaggcuucuggggauuaagaaaaguuagggcagaaaaugacaggcaucacgcuuuagacgccgucgucguugcuuguaguacaguagcuaugcaacagaaaauaacacgauuugugcgauacaaggaaaugaaugcauuugacggaaaaacgauagauaaagaaacaggugaaguacuacaucagaaaacacauuucccucaaccgugggaguucuuugcucaagaaguaaugauaagagucuuuggaaaaccagacggaaaaccugaauuugaagaagccgauacgccggaaaaauuaagaacauuacuagcagaaaaacucuccaguagaccagaggcuguacacgaauacguaacaccuuuauuuguuaguagggcaccuaaccgaaaaaugaguggccaaggccauauggaaacagucaaaagugcaaaaagauuagacgaaggaguaagcguacugcggguaccacucacacaacuaaaacuuaaggaccuugagaaaauggucaauagagaacgugaaccaaaauuauacgaagcccuaaaagcaagacuagaagcacauaaagaugaccccgcuaaagcauucgcagagccguuuuacaaauaugauaaagccgguaaccgaacgcaacaagugaaagccgucagaguugaacaaguucagaaaacaggcguaugggucagaaaucauaauggaauagccgacaaugcaacaaugguaagagucgauguuuuugaaaaaggcgauaaguacuacuuaguaccaauauauagcuggcaaguagcaaaaggcauuuuaccugauagagcagugguccaaggcaaagaugaagaagauuggcaauuaauagacgauaguuuuaauuucaaauuuagucuccauccuaaugaccugguagaaguaaucacgaaaaaggcacguauguucggauacuucgcaucuugucacagaggaacaggaaauauaaauauaagaauacacgauuuagaccauaaaauaggcaaaaacggaauauuagaaggaauaggagucaagaccgcacuaucauuccaaaaguaucaaauagacgaacuagggaaagaaauaagaccgugcagacuaaagaaaagaccucccguaagguga

SEQ ID NO: 8516 - RNA, 3249 nt, Artificial Sequence
  Cas9 variant
auggcagccuuuaaaccaaacccaaugaacuauauauuaggauuagauauagguauagcuaguguaggaugggccauuguugaaauagaugaagaagaaaauccaauaagacugauagaccuaggaguucgaguguuugaaagagcagaagucccaaaaacuggagauagccuagcagcggcgaggagauuagcaagaucagugagaagacucacuagacggcgagcucauagacucuuaagagcgagaagacugcuaaaaagggagggaguacuccaagcugcagauuuugacgaaaacggauuaauaaaaaguuugcccaauacaccauggcaguuaagagccgccgcuuuagaccgcaaauuaacaccacuggaauggagugcagucuuauuacaccucauuaaacaccgaggcuaccuaagucaacguaaaaaugaaggagaaacugcggacaaagaauuaggagcacuacuaaaaggaguagcggauaacacucaugcucuacaaacaggagacuuuagaacuccugcugaacucgcacuaaacaaauucgaaaaagaaagcggucauauuagaaaucaacgaggagacuauagccauacauuuaaucguaaagaucuccaagccgaauuaaauuuguuauuugaaaaacaaaaagaauuuggaaacccacauguaucagauggcuuaaaagaaggaauagaaacauuauuaaugacacaaagacccgcacugagcggugacgcaguucagaaaaugcuaggacacugcacauucgaaccuacagaaccaaaagcagcuaaaaacacauacacagcagaaagauucguauggcucacaaaacuaaauaauuuaagaauauuagaacaaggaucagaaagaccuuuaacugauacagaaagagcuacauuaauggaugaaccauaccgaaagucaaaauuaacauacgcucaagcgagaaaguuacuagaccuugacgauacagccuucuucaaaggauuaagauacggaaaggacaaugcugaagcaagcacacuuauggaaaugaaagcauaucaugcuauaagccgagcucuagaaaaagaaggacuaaaggauaagaaaucaccauuaaacuuaagccccgaauuacaagacgaaauaggcacggcuuucucauuauucaaaacggacgaagauauuacaggaagacuuaaagacaggguacaaccagaaauuuuagaagcucuuuuaaaacacauuuccuucgauaaauuuguucaaauaucacuaaaagcucugagaagaauuguaccucuaauggaacaaggcaacagauaugaugaagcaugcacagaaauauacggggaucacuaugguaagaaaaacacagaagagaaaauauaucugccacccauucccgcugacgaaauaagaaacccgguuguucuaagagcacugucacaagcgcgaaaaguaauaaauggcguuguaagaagauacggcuccccagcaagaauccacauagaaacugcaagagaagucgggaaaucuuuuaaagauagaaaagaaauagaaaagaggcaagaagaaaaucguaaagauagagaaaaaucagcagccaaauuucgggaauauuuuccuaauuuuguaggagaaccgaaaucaaaagacauacuuaaacuaagauuauaugaacaacaacaugggaaaugucuauacagcggaaaggaaaucaacuuagggagacuaaaugaaaaaggauacguagaaauagaccaugcccuuccauucaguagaacaugggacgauucuuucaacaacaaaguauuagcuuuagggagcgaaaaccaaaauaaaggaaaucaaacgcccuaugaauacuucaaugggaaagacaauucaagagaauggcaggaguucaaggcacgaguugaaacaaguagauuuccaagaagcaaaaagcaacgaauuuuauuacaaaaauucgaugaagauggauucaaagaaagaaaucuaaaugauacgcguuauauaaacagauuucugugccaguuuguugcagaccacaugcuauuaacaggcaaaggaaaaagaagagucuucgccucuaacggacaaauaacaaauuuacuaagagguuucuggggauuacggaaaguacgggcugaaaaugauagacaucacgcuuuagacgcugugguaguggcuuguucaacaauagcgaugcaacagaaaauaacaagauucgucagauacaaagaaaugaaugcauuugauggaaaaacuauagauaaagaaacaggcgaagucuuacaucaaaaagcacauuucccccaaccaugggaauuuuucgcucaagaagucaugaucagagucuuugguaagccagauggaaaaccagaguucgaagaagcagacacuccagaaaaacuaaggacauuacuagcagaaaaacucucauccagaccagaagcaguacacaaguauguuacaccucuauuuauaucacgcgcgccaaaccgaaaaaugagcggacaaggacauauggaaacaguaaaaucagccaaaagacuugaugaagguauuucaguacuccgaguaccucuaacacaacugaaacuuaaagaccuugagaaaaugguaaaccgagaacgagaaccgaaacucuacgaagcccuaaaagccagauuagaagcucauaaggaugaucccgccaaggcuuucgcagaaccuuuuuauaaauacgauaaagcaggaaaccgcacccaacaaguaaaagcuguccggguugaacaaguccagaaaacuggaguuuggguacauaaccauaauggaauagcagauaaugcaacaauaguacggguagauguguucgaaaaaggagggaaauauuaccuaguaccuauuuauagcuggcaagucgcaaaaggaauacuaccagauagagcaguaguucaaggcaaagacgaagaagauuggacaguaauggacgauagcuuugaguucaaauuuguauuauacgcuaacgacuuaauuaaauuaacugcaaagaaaaaugaguucuuaggauacuucguuucauuaaacagagcaacuggagcaauugacauuagaacacaugacacagauucaacaaaagguaaaaauggaauauuucaaagugugggaguuaaaacagcucuaaguuuccaaaaauaccaaauagaugaacugggaaaagaaauuagaccauguagacuaaagaaaagaccacccguaagauga

SEQ ID NO: 8517 - RNA, 3249 nt, Artificial Sequence
  Cas9 variant
auggcagccuuuaaaccuaauucaaucaacuacauauuaggacuagacauagggauagcuucaguaggaugggcuaugguagaaauugauaaagaagaaaacccaaucagacuaauugaucuaggaguaaggguuuucgaaagagcagaaguaccaaagaccggagacucacucgcugcagcaagaagauuagcaagaagcguaagaagauuaacaaggagacgcgcacauagguuacuuaggacaagacgauuauuaaagagagaaggcgucuugcaagcagcaaacuuugauaaaaauggucugauuaaaagccuaccgaacaccuuauggcaauuaagagcggcagccuuggacagaaagcuaaccccauuagaauggagcgcaguauuacuacauuuaauaaaacauagaggguacuuaagucaacgaaagaacgaaggagagacagcagacaaagaauuaggagcgcuacuuaaaggagucgcagguaaugcccaugcacuacaaacaggagauuuuagaacaccagcugaacuugcacuaaauaaauucgaaaaagaaucagggcauauucguaaucaaagaggugacuacucacauacauuuagcagaaaagaucuccaagcugaauuaaaccuuuuauuugaaaaacaaaaggaauuugguaauccucauauaagcgggggucuaaaagaaggaaucgagacauuacuaaugacucaacggccagcguugucuggugaugcaguacagaaaauguugggccauuguacuuucgaacccaccgaaccaaaagcagccaaaaauacuuauacuacagaaagauucauauggcucacaaaauuaaacaaucuaagaauccuagaacaaggaagugaaagaccauuaacagacaccgaaagagcaacacuaauggaugaaccauauagaaaaucuaaacugacauacgcacaagcacgaaagcuacucucucuagaagauacagcauucuuuaaagguuuaagauauggaaaagauaaugcagaagcaagcacauuaauggaaaugaaagcauaccacacaauaucgagggcacuugagaaagaaggauuaaaagauaaaaagagcccuuuaaaucucucgcccgaacuacaagaugaaaucggcaccgcauuuucucuauuuaagacggaugaagacauaacugguagguuaaaagacagaauccaaccagaaauucuugaggccuuguuaaagcauauauccuucgauaaguuuguacaaauaucgcuaaaagcacuuaggagaauagucccccuaauggaacaaggaaagagauacgaugaagcaugugcagaaauauacggagaccauuacggaaagaaaaauacagaggaaaagaucuaccuuccacccauaccagcagacgaaauacgcaauccggugguccuucgagcgcuaagucaagcaaggaaaguaaucaacggaguagucagaagauaugguucacccgcaagaauacacauagaaacagcaagagaaguagggaaaucauuuaaagacagaaaagaaauugagaaaagacaggaagaaaauaggaaagaucgagaaaaagcagcagcaaaauucagagaauauuuuccgaauuucguaggagaaccaaaaagcaaagacauucuaaaauugcgacuauaugaacaacaacacggaaaaugccuauauucaggaaaagaaauaaaucuaguucgacuaaacgaaaaaggcuacguggaaaucgaccaugcgcuucccuuuucaaggacaugggaugauagcuucaacaauaaaguucuuguauuagguucagaaaaccaaaacaaaggaaaucaaacacccuacgaauauuuuaacggaaaagacaauucaagagaauggcaggaauuuaaagcacgagucgaaacaagccgauuuccaagaucaaagaaacaaagaauauuguuacaaaaauucgacgaagaugguuuuaaagaaagaaauuuaaaugauacgagauaugugaacagauuucuaugucaauucguugcugaccacauauuauugacagggaaaggaaaaagacguguauucgcaucaaacggacaaauaacaaaucuacuacgaggauuuuggggacuccgaaaaguuagagcagaaaacgacagacaccaugcacuugacgccguugugguugcauguuccacaguggcuaugcaacagaaaauaacacguuuuguaagguauaaagaaaugaaugccuucgacggaaaaacaauugauaaagaaacaggcgaaguacuacaccagaaaacucauuuuccacaaccuugggaguucuuugcucaagaaguaaugauacgagucuuugguaaaccugacggcaaaccugaauuugaggaagccgacacucuugaaaaauuaagaacauuauuggcagaaaaacuuucaagucgacccgaagcgguucaugaauacguuacgccccuauucguuaguagggcaccaaaccgaaaaaugucuggacaaggccauauggaaaccguaaaauccgcaaaaaggcuugaugaaggaguaucuguacuaagaguaccauuaacucaauuaaaauuaaaagaucucgaaaagaugguuaauagagaaagagaaccaaaacuauacgaagcacucaaggcacgacuggaggcacacaaagaugacccagccaaagcauucgccgaaccuuucuauaaauaugacaaagcuggaaacaggacccaacaaguaaaagcaguccgaguagaacaaguacagaaaacaggaguauggguaagaaaucacaacgggauugcagacaacgcgacaaugguacgcguagacguuuuugagaaaggagacaaauacuaucuaguaccuauauauaguuggcaagucgccaaaggaauccuucccgauagagccguaguacaaggaaaagaugaagaagauuggcaacuaaucgacgauagcuuuaauuucaaauucucgcuacacccaaacgaccuagucgaaguuauaacuaagaaagccagaauguuugguuacuucgccucgugccacagaggcacuggaaauauaaauauacgcauacaugaucuggaucauaaaauagggaaaaacgggauauuagaaggaauaggggucaaaacagcucuaucauuucaaaaauaucaaauagaugaacuaggaaaagaaauuagaccaugcagacugaagaaaaggccaccgguaagauga

SEQ ID NO: 8518 - RNA, 3249 nt, Artificial Sequence
  Cas9 variant
auggccgccuuuaaaccaaaucccauuaauuacauauuaggcuuagauauagggauagcgagcguugggugggcuaugguugagauagacgaagaagaaaauccuauacgauuaauagaucucggagugaggguauuugaacgagcagaaguacccaaaacaggugauucauuagcuaugguaagaagauuagcaagauccguaaggagauuaacaagaagacgagcacauagacuucuaagagcaagaagacuucuaaaaagagaagguguuuuacaagcggcagacuuugaugagaacggacuaauaaaaagccuaccaaacacgccauggcaauugagggcggcagcuuuagauagaaaauuaacaccccuagaauggucugcaguauuguuacaucucauuaaacacagaggauacuuaagccagagaaagaaugagggagaaacugcggauaaggaauuaggagcacuacucaaaggcguggcagauaaugcacaugcacuacaaacuggugauuucagaacuccagcagaauuagcccuaaauaaauuugaaaaagagagcggccacauacgaaaucaaagaggugauuauucacacacauucucacguaaagaucuacaagccgaacugauucuacuguucgagaaacaaaaagaguucgguaauccacacauaucagguggccuaaaagaaggaauugaaacguuauuaaugacacaacgaccagcgcuaaguggagacgcaguacagaaaauguuaggacauugcacuuuugaaccagcagaaccaaaagcagccaaaaacacauacacagcagaacgauucauaugguugaccaaauuaaauaacuuaaggauauuagaacaaggaagugaaagaccauuaacagacacagaacgagcaaccuuaauggaugaaccauacagaaaaucgaaacuuaccuacgcucaagcacgaaagcugcuaggccuagaagacacagcuuucuuuaaaggauuaagauauggaaaagacaacgcagaagcaagcacacuaauggaaaugaaagcauaucaugcaaucagcagagcauuagaaaaagaaggcuuaaaagauaagaaaaguccacucaauuuaagucccgaacugcaagacgaaauuggcaccgcauuuucacuauucaaaaccgaugaagacauaacagguagacuuaaagacagaauccaaccagagauacucgaggcuuuauuaaaacauauuagcuucgacaaauuuguacaaauaagccuaaaagccuuaagaagaauaguaccacugauggaacaaggaaaaagauaugaugaagcgugcgcggaaauauauggagaucauuacggcaagaaaaacacagaagaaaagauauaucuaccaccaauaccugcggacgaaauacgaaauccagugguacuaagagcauuaucacaggcacguaaagugauaaacgguguaguaagaagguaugguaguccagcucguauucauauagaaacggcaagagaaguuggaaaauccuucaaagacagaaaggaaauagagaaaagacaagaagaaaacagaaaagaccgagaaaaagcagcagcaaaauuucgggaauauuuuccaaauuuuguaggugaaccaaaaagcaaagacaucuuaaaacuacgacuauaugaacaacaacacggaaaaugcuuauauucggguaaggaaaucaacuugggucgucuaaaugagaaaggguauguugaaauugaucacgcguuaccauuuucaaggacaugggaugauucauuuaauaacaaaguucucguauuagguucggaaaaucaaaacaaaggaaaccaaacaccauacgaguacuuuaauggaaaagauaauagccgagaauggcaggaauuuaaagcaagaguugaaacaaguagauucccaagaucgaagaaacagagaauacuacuacaaaaauucgacgaagacggauuuaaagagagaaaccuaaaugauaccagauauguaaauagauuucuuugucaauucguagcagacagaaugagauuaaccggaaaagguaaaaagaggguguucgcgagcaauggacaaauaacaaaccuccucagaggcuuuuggggcuuaagaaaaguuagggcagaaaaugauagacaucaugcacuagacgcagugguagucgcuugcucaacaguugcaaugcaacagaaaauaacgcgauuuguacgauauaaagaaaugaaugcauucgauggaaaaacaauagauaaagagacaggagaaguauuacaccagaaaacucauuucccucaaccgugggaauuuuucgcgcaagagguaaugauucgagucuuuggaaaaccugacggaaaaccggaauuugaagaagccgacacuccagaaaaacuaagaacuuuauuagcagaaaagcuaucaucuagaccugaagcaguucacgaauauguaacaccucucuucguaaguagagcaccgaaccggaaaaugagcggacaaggacauauggaaacaguaaaaucugccaaaagacuagacgaggguguaucaguacuaagaguaccgcuaacacaauugaaauugaaagaucuggagaaaauggucaacagagaacgggaaccgaaguuguacgaggcauuaaaagcaagauuagaagcgcacaaagaugacccagcaaaagcauuugccgaaccauuuuacaaauaugacaaagcaggaaacagaacgcaacaaguaaaagcaguuagaguagaacaaguacaaaagacagguguauggguacgaaaucauaauggaauagcugauaaugcgaccaugguccgagucgacguauuugagaaaggugauaaauauuaucucguacccauauauagcuggcagguagcaaaaggcauucuaccagaccgugcgguaguucaaggcaaagaugaagaagauuggcaauuaauagaugauagcuuuaauuuuaaauuuucacuacauccaaaugacuuaguagaagugaucacuaagaaagcuagaauguucgguuauuucgcaagcugucacagaggaacagggaauaucaauauaaggauacaugaucuagaucacaaaauugguaaaaaugguauauuagaagguauaggaguaaaaacagcauuaaguuuucaaaaauaucagaucgacgaacuuggcaaagaaauaagaccaugcagauuaaagaaaagaccaccaguacgauga

SEQ ID NO: 8519 - RNA, 3249 nt, Artificial Sequence
  Cas9 variant
augcgaguacuaggcuuagaugcgggaauagccagccuaggaugggcauuaauagaaauagaagaaaguaauagaggagaacuuucucaaggaaccaucauaggagcaggcacuuggauguucgacgcuccugaggagaaaacacaggccggagcaaaacuuaaaagugaacaacgucguacauuuagaggacaacgaagaguaguacgacgcagacgucaacgaaugaacgaaguaagaaggauuuugcacucccauggacuauuaccaucaucugaucgagaugccuuaaaacagcccggucuggauccauggcgcauaagagcagaagcucuagaucgauuauuagguccaguagaauuggcaguagcauugggucauauagcucgacacagaggauuuaaaucuaauucuaaaggagcaaaaacgaacgaucccgcggaugauacaaguaaaaugaaaagagcuguuaaugaaacaagagagaaacucgcaagauuuggcucugcagccaaaauguuaguugaagacgaaucauucguuuuaagacaaacacccacuaaaaauggagcaucagaaauaguuagaagauuuagaaacagagaaggagacuacagcaggucauuacuacgagaugaccuugcagcagaaaugagagcauuauuuacagcacaagcacgauuccagucagcuauugcaacagcagaccuacaaaccgccuucacuaaagcggcauucuuucaacggccgcuucaagauagugaaaagcuagugggcccauguccauuugaaguagaugagaaaagagcaccgaaaagaggauauucauuugaacuauucagauuucuuucgagacuaaaucauguaacauuaagagauggaaaacaagaaagaaccuugacuagagacgaauuggcauuggcagcagcagacuuuggagcagcggcaaaagucagcuucaccgcuuuaagaaagaaacuuaaacugccagaaacaacuguauuuguuggaguuaaagcggaugaagaauccaaauuagauguaguagccagaucaggaaaagcagcagaagguacagcgagacuaaggucaguuauuguagaugcauuaggugaguuagcauggggagcauuacucuguuccccugaaaaauuagauaaaauagccgaaguaaucucuuucagaucagacaucgguagaauaagcgagggucucgcacaagcuggcuguaaugcuccucuaguugaugcucugacugccgcagccucugauggaagauuugauccauucacaggugcgggacauauuucuaguaaagcagcuagaaauauauuaaguggacuaagacaaggaaugaccuaugacaaagccugcugugcagcagauuaugaccacacagcaaguagagaacgaggagcauuugauguagggggacacgggagagaagcgcuaaaaagaauuuuacaggaagagaggaucaguagagagcuaguaggaucaccaacugcaaggaaagcguuaauagaguccaucaaacaagucaaagcaauuguugagagauauggugucccagaccguauacacguagaacuggcacgagacguaggaaagaguauugaggaaagagaagaaauuacucgagguauagagaaaagaaacagacaaaaagacaaacuacgcggucuauuugaaaaagaaguaggcaggccaccacaagauggcgcuagaggaaaagaagaacugcuaagauucgaauuauggucagaacaaaugggaagaugcuuauacacagaugacuauauaagucccucacaguuaguugcaacugaugacgccguacaaguagaccacauauuaccguggucaagauucgcagaugauaguuaugcgaauaaaaccuuguguauggcaaaagcgaaucaagacaaaaagggaagaacaccuuaugaaugguucaaagcagagaaaaccgauacugaaugggaugcauucauaguaaggguagaagcucucgcagauaugaaaggguuuaagaaaagaaauuacaaacuaagaaaugcugaagaagcagcagcaaaauuuagaaaucgaaauuuaaaugauacccgaugggcguguagacucuuagcugaagccuugaaacaauuauauccuaaaggggaaaaagauaaagaugguaaggaaagacgucgcguauucaguagaccaggagcacuaaccgauagauugaggagagcauggggacuacaguggaugaagaaaaguacuaaaggugaucgaauaccugaugacagacaccacgcacuagaugcaaucgugauugcagcuaccacagaaagccuacuucaaagagcaacacgagaaguccaagaaauagaagacaaaggucuccauuaugaucuggucaaaaauguaacuccaccguggccaggauuccgagaacaagcaguggaagcaguagaaaaaguuuuuguugcaagagcagagcgcagacgagcaagaggaaaagcacaugaugcaacuaucagacauauagccguuagagagggcgaacagagaguauacgaacgaagaaaaguugcagaacuaaaacuagccgaucucgaucgaguaaaagacgcagaaaggaaugcuaggcuuauugaaaaauuacgaaauuggauugaagcaggcagucccaaagaugauccuccauuaucacccaaaggagauccaauauuuaaaguacgauugguuacuaaaucuaaaguuaacauagcguuagauacuggaaacccgaaaagaccggguacaguagauagaggagaaauggcacgagucgauguuuuuagaaaagcaaguaagaaagguaaauaugaauacuauuuaguaccaauauauccucaugauauagcgacaaugaaaacaccaccgauaagagcgguacaagcauacaaaccagaagaugaguggccagaaauggauaguagcuaugaauuuuguuggaguuuaguacccaugaccuaccuacaaguaauaagcucaaaaggcgaaauauucgaaggauacuacagaggcaugaauaggucagugggggcaauccaacuaucggcacauucaaauucaucagauguuguacaggguauaggagccagaacacuuacugaauuuaagaaauuuaauguggauagauuuggcagaaaacaugaaguagaacgggaacuuagaacuuggaggggagaaacauggaggggcaaagcauacauauga

SEQ ID NO: 8520 - RNA, 3255 nt, Artificial Sequence
  Cas9 variant
augaaaaauacucuauacggaauaggcuuagacauagguguugcgucaguaggaugggcaguggugggauuaaauggaaccggcgagccuguaggcuuacauagacuuggaguuagaauauucgauaaagcagaacaaccaaagacaggagaaucauuagcagcaccuagaagaauggcuaggggaaugaggagaagguugaggaggaaagcucuaagaagggcagauguauacgccuuacuagaaagauccggcuuaucaacuagagaagcccuagcacauauguuugaagcaggagguuuagaggauauuuaugcauuacgaaccagggcuuuggaugaacccguaggaaaagccgaguucagucgaauuuuacuacauuuagcacagagaagaggauuuaaguccaauagaagaacagcuagcgauggugaagacggaagauuauuagcagcaguaaacgaaaacagaagacgcauggcacaggguggauggagaacagucggagaaaugcuauauagacaugaggcuuucgcacuucacaaacgaaauaaggcugaugaauacuugucaacuguaggucgagauaugguugcagaagaagcgagucuauuauuucaacgacaacgagaacuagguugcgcaugggcaacaccugaauugcaggcagaauaucuuucaauauuacucaggcaaagaucuuuugaugaagguccuggggguaauucaccguauggagguaaccaagucgagaaaaugguuggccgauguacauuugaaccagaugaaccgagagcagccaaagcagcguacaguuucgaauauuuuucacuccugcagaaaauaaaccacauacgucuaguagaaaacggcgaaacacguccacuaacacaacaacaacgacaacaacuguuaucauuagcacacaaaacaccggacguaucauuagcuagaauaaggaaagaauuagcuuuacccgaaacaguccaguuuaauggcguaagauguagagccaacgaaacauuagaagaaucagaaaagaaagaaaaauuugcaugucuaccagcuuaucauaaaaugagaaaagccuuggacgguguaguaaaaggaagaauaucaucguuaucaauaucacaaagagaugcagcagcuacagcauuaagucuauauaaaaacgaagauacucuaagagcaaaguuaaccgaagcaggauuucaagcaccugaaauagacgcacuagcagguuugaccggauucagcaaauucggacaccuaucuuuaaaagcgugcagaaaauuaauaccacaucucgaacaaggguugacauacgaccaggcuuguagcgcagcgggauaugauuuuaaagggcacggagcgggagaaagagcguuuacacuaccugcagccgccccugaaauggaacaaauaacaagcccgguaguccggagagcgguagcgcaaaccauaaaagucgugaauggaaucauaagagaaauggaugcuagcccagcuugggugcguauagaauuagcaagggaauuaaguaaaacauuuggagaaaggcaagagauggacagaucaaugagggaaaacgcagcacaaaaugaaagacuuaugcaagagcuacgagauacuuuucacuuauuaucaccuacaggacaagaucuuguaaaauacagacuuuggaaagaacaagauggagucugcgcuuauucauuaagaagacuggauguagaaagauuguucgaaccuggauauguagaugucgaccauauuguuccauacucauuaaguuuugacgaccguagaaguaacaaaguuuuaguacuaucaagcgaaaacagacaaaaagguaauagguuaccucuucaauacuuacaaggaaagaggagagaggacuucaucgucuggacaaauucuucagugagggauuaccgaaaacgacaaaauuuauugcgagaaaaauuauccggugaugaagcagagggauucagacaacguaacuuacaagauacacaacauauggcacgauuuuuauacaauuacauaagugaucaucuugcauuugcgcaaucagaggcuuuagguaagaaaagaguuuuugcaguaucaggagcuguaaccucucauuuaaggaaaagauggggauuaucaaaaguaagagcugauggagaucuucaucaugcauuggaugcagcaguaauugcauguacaacagauggaaugaucagacguauuagcggauauuacggacauauagaaggggaauaucuucaagaugcagauggagcaggaucgcaacacgcuagaacaaaagaaagauucccggcgccguggccaagauuuagggaugaauugauagugcgacuaucagagcaacccggagaacauuuauuagauauaaacccugaguucuacugugaauaugggacugaacacaucaggccaguauuuguuaguagaaugccaagaagaaaagugacaggaccaggacauaaagaaacaauuaaaggagccgcagccgccgacgaaggcuuauuaacagucaggaaagcacuaacagaacuaaaauuagauaaagacggggaaauaaaagauuacuacaugcccagcucagauacacuacuauaugaggcuuugaaagcacaauugaggcgcuuuggaggagacaguaaaaaggcuuuugcagaaccauuuuacaaaccaaaagcagauggaacgccaggaccauuaguacgaaaagucaagacgacagaaaaagcuacauugacaguaccaguucauggaggcgccgccucaaaugauacuaugguaaggguugacguguuucuaguacccggggauggauauuauuggguaccaguuuacacagcugauacccuaaaaccagaauuaccaaaccgugcuguaguucaagggaaaccauacucagaauggaaagaaaugagagaggaggauuuuaucuucucuuuauacccaaaugacuuaguauauguagaacauaaaucaggacuaaaauuuacauuacaaaaugcggauaguacacuagagaaaacacgaacacaaacauccgcauucguauacuuuguaggaggaaguauaaguacggcaagcaucacaauacgaacccaugauaaugcuuaugguauaccuagccuugguguaaaaacuuuaaaaacauuucacaaauaucaaguagacguacuaggaaauguuuuuccaguacacaaagaaacaaggcaaaaauuuagguga

SEQ ID NO: 8521 - RNA, 3255 nt, Artificial Sequence
  Cas9 variant
augaaaaauacccuauacggaauagguuuggauauaggcguugcuaguguuggaugggcuguuguuggauuaaacgguaccggggaaccuguuggacuucauagauuaggaguacgaauauuugauaaagcagaacaaccuaaaaccggagaaagucuagcagcaccccgaagaauggcaagagguaugagaaggagauuacggagaaaagcauuaagacgagcggauguauacgcuuuauuagaaagaaguggauuaucgacaagagaagcccuggcacaaauguucgaagcugguggauuagaagauauuuacgcauuacgcacacgggcauuagaugaaccaguaggaaaagccgaauuuucaagaauauuauuacaucuugcccagcgaagagguuucaagucgaacagaagaacagcaucagacggugaagaugggagguuauuagcagcaguuaacgaaaauaggagacgaauggcacaaggagguuggagaacugugggagagaugcuauaucgacaugaagcauucgccuugcauaaaagaaauaaagcagaugacuauuuaucaacagucggacgagauaugguagcugaagaggcuucccuauuauuucaaagacaaagagaacuuggcugugccugggccacuccagaauugcaggcagaauaccuaaguauuuuauuacgacagcguagcuucgaugaaggaccuggaggagacucaccauauggaggaaaccaagucgagaaaaugguaggaagaugcacauuugaacccgaugaaccgagggcugcaaaagcagcguacucauucgaauacuuuucuuugcuacagaaaauaaaccauauaagacuagcagaaaauggagaaacacgcccauugacacaaccacaaagacaacaauugcuuucauuagcacauaaaacaccagauaugaguuuagccaggauuagaaaagaacuugcacuuccugaaaccguucaauuuaauggaguacgaugccgagcuaaugaaacccuagaagaauccgagaagaaagaaaaauuugcaugucuuccagcauaucacaaaaugagaaaagcacuaggcggaguuguaaaaggaaggauaaguaguuuaaguauaucacagagagacgcagcugcuacagcguuaucauuauauaaaaaugaagacacacuaagagcaaagcuaacagaggcgggcuuucaggcgccugaaauagacgcauuagcaggauuaacaggauuuagcaaauuuggacacuuaucacucaaagcguguaggaaauugauaccccauuuagaacagggacucaccuaugaucaagcauguucagcagcgggauacgauuucaaaggacauggagccggugaaagggcuuuuacauuaccagcagcggcaccugaaauggaacaaauuacaaguccuguaguaagaagggcaguggcccaaacuauaaaaguaguaaacgggaucauacgagaaauggaugcaagucccgcauggguucguauagaauuggcaagggaauuaaguaaaacuuucggagaaagacaagagauggaccguucgaugagagaaaaugcugcuaaaaaugaaagacuaaugcaagaacuaagagauacguuucaccuccuaagcccaacaggacaagaucuuguaaaauaucgucucuggaaagagcaagauggagugugugcguauaguuuacaaaggcuagauguggagcaauuauucgaaccaggguauguagacgucgaccauaucguaccauacucauugucauucgaugaucgaaggucaaauaaaguauugguacuaagcagugaaaacaggcaaaaaggaaauagacucccauuacaauaucuacaaggcaagagaagagaagauuuuauaguauggacuaauucuucaguacacgauuauaggaaaaggcaaaauuuauuaagagaaaagcuaagcgaugaugaagcggaaggauucagacaacgcaaccuccaagauacucaacacauggcaagauuuuuauauaacuauauaagugaucauuuagcauuugcacaaagugaagcccuagguaagaaacguguauucgcaguaaguggcgcaguaacgagucauuuaagaaaaagaugggggcuuagcaaaguucgagcagauggagaucuacaucaugcucuagacgcagccgugguagcguguacaacagaugguaugauaagaagaauaucuggauacuauggucacauagaaggagaauauuuucaagaugcugauggagcagggucacaacacgcaagaacgaaagaacguuuuccagcaccauggccuagauuucgugaugaacuuauaguacgauugagcgaacaacccggggaaccacuuuuagacauuaaccccgcuuuuuauugugaguacggaacugaacauauuagaccugucuucgucagccgaaugccaagacgaaaagugacaggcccgagucacaaagaaacaguaaaaggagcagcugcugcggaugaaggucuauuaacgguuagaaaagcacugacagaacuaaaauuagauaaagauggggaaauaaaggauuauuauaugccgagcucagacacacuauuauaugaggcuuugaaagcacaacucaggcgauucggaggagauggaaagaaggcuuuugcagaaccauucuauaaaccaaaagcugacggaaccccaggaccauuaguaagaaaaguuaaaacaacagaaaaagcuacauuaacaguaccuguacaugguggagcugcuucaaaugauacaaugguaagaauagacguuuucuuuaugcccggagacggauauuacugggugccucuauauguugcagacacacugaaaccagaguuaccuaauagagcuguuguggcccauaaaccauauagugaauggcaagaaaugcgggaagaagacuuuguguuuucgcuauauccaaacgauuuaguauacguagaacacaaaucugaacuaaaauuuacgguccaaaaugcugauucuacacuagagaaaacaagaacacaggcuucugcauuugucuauuuuguuagcggcgguauuaguggcgguacaauaacuguaaggacacacgauaacucuuaugguaucccgucacuugguuuaaaaacuuuaaaaagucuauguaaguaucaaguagauguuuugggcaauguauuuccaguucauaaagaaacaaggcaaaaauuuagauga

SEQ ID NO: 8522 - RNA, 3255 nt, Artificial Sequence
  Cas9 variant
augaaaaauacauuauacggaauagguuuagacauuggcguagcaaguguaggaugggcaguaguuggauuaaaugguacaggcgaaccugugggucugcauagauuaggaguacggauuuucgauaaagcugaacaaccaaaaacgggugaaucauuagccgcaccaagaagaauggcuagagguaugcgcagaagacuaagaagaaaagcacugagacgagcagacguuuaugcauuauuagaaagaaguggauuaaguacaagggaagaauuagcacaaauguuugaagcgggaggauuagaagauaucuaugcucuacgaacaagagcucuagaugaacccguaggaaaagcagaauuuagcagaauccuucuucaucuugcacagcgacgaggcuucaaaucaaauaggagaacagcaucggauggagaagacggacgacuacuagcagccguaaacgaaaauaggcgacgaauggcacagggaggguggcgcacgguuggagaaauguuauauaggcacgaagccuuugcacuacauaaacguaauaaagcugacgauuauuuaaguacaguugguagggauauggucgcugaagaggcuucuauuuuguuugaaagacaaagagccaugggcugcaguugggcagccccagaacugcaggcagaauauuuaucgauacucuugcgucaaagaucauuugaugaagguccaggaggaaauaguccuuauggagguaaucaaguagagaaaaugguaggaaggugcacauuugaaccugacgaacccagagcagcaaaggcagcuuauucuuuugaauauuucucauuauugcaaaaguugaaucauauuagacuagcggaaaacggugagacacgaccacuaacgcaaccacaaagacaacaacuuuuaucacuagcucacaaaacaccugacauaucuuuggcgaggauuagaaaagaacuagcccuaccagaaacaguacaauuuaauggagucagaugcagagccaaugaaaccuuggaagaaagugaaaagaaagaaaaauuugccugucuaccggcauaccacaaaaugagaaaagcccuugacggaguagugaaaggaaggauuucaaguuugagcauaucgcaaagagaugcagccgcaacugcgcuuagucucuauaaaaaugaagauacgcuuagggccaaacuaaccgaagcaggauuucaagcaccagaaauugacgcauuagcaggacuaacuggauucucaaaauucggucauuuaucacuuaaagcaugccguaaacuuauaccacacuuagaacaggguuuaacguaugaucaagcauguacagcagcaggauaugauuucaaaggacauggugcaggagaaagagcauucacauuaccagcagcggccccggaaauggaacaaauaacuucaccaguagugagacgagcgguagcacaaacaauaaaaguaguaaacggaauuauaagagaaauggaugccaguccagcguggguaagaauugaauuagcgagagaacuaucaaaaacauucggcgagagacaagaaauggaucgauccaugagagaaaacgcagcacaaaaugaacgacuuaugcaagaauuacgggacacauuccauuuacuuaguccgacgggacaagacuugguuaaauauagauuauggaaagaacaagauggaguuugcgcauacucacucaggagauuagacguagaaagguuguucgaaccaggauauguagauguagaucauauaguacccuacucacuaucuuuugaugaucgaagaaguaacaaagugcuaguauuaaguagugaaaauagacaaaaagggaaccgauuaccauuacaauacuuacaaggaaagaggagagaagauuuuauaguauggacaaauagcaguguacacgauuacagaaaaagacaaaacuuacuaagagaaaaacuuaguggagaugaagcagaaggguuuagacaaaggaacuugcaagacacacaacacauggcacgguuuuuguacaauuauauaagcgaccaucuagcuuuugcucaaagugaagcacuagguaaaaagagaguauuugcuguaucaggagcagugacaagucaccuaagaaaaagaugggguuuaucaaagguacgagcagacggugaucuucaucacgcauuagaugcagcgguaguagcauguacuaccgacggaaugauccguagaauaucuggguacuaugggcauauugaaggcgaauauuugcaagaugcugauggcgcaggaagucaacacgcaaggacgaaggaaagauuuccggcaccauggccacguuuuagagaugaacucauagugagacuaucagaacaaccggcagaaccacuacuagauauuaacccagaauuuuauugugaauacggaacagaacacauaagaccuguuuucguauccagaaugccgcgaagaaagguaacaggacccggacauaaagagaccaucaaaggagcugcagcagcugaugaagguuuauuaacaguaaggaaagcccucacagaauuaaaauuagacaaagauggagaaauaaaagacuauuauaugccuuccucagacacacuacuguacgaagcacuaaaggcccaauuaagaagauucgguggugaugguaaaaaggcuuuugcagagcccuuuuacaaaccuaaagcugaugguacuccgggaccacugguaaggaaaguuaaaacaacugagaaagcgacucuuacaguacccguacaugguggcgccgcaucaaacgauacaaugguacgaguagauguguuccuagugccaggugauggauacuauuggguuccaguuuacaccgcagauacucuaaaaccugaauuaccaaaccgagcaguagugcaaggaaaaccauacagugaguggaaagaaaugagagaagaagacuuuauauuuagccuauauccuaacgaucuaguauacgucgaacacaaaagcggguuaaaauuuacacuacaaaacgccgauucgacauuagaaaagacuagaacacaaacgagcgcauucgcauacuuuguaagcggaaguauuagcacagccuccaucacaauaagaacucacgauaaugcuuacggaauaccaaguuuaggaguaaaaacucuaaaaacauuucacaaauaucaaguagauguacuaggaaacguuuuuccaguucauaaagaaacacggcagaaauuccgauga

SEQ ID NO: 8523 - RNA, 3255 nt, Artificial Sequence
  Cas9 variant
augcguuugggacuagauaucgguacuaauucaauaggaugguggcuauauggaacagaaggagggagaauaacagaagucguagaugggggaguacgaauuuucucugauggucgagacccacaaucaaaggcuucccucgcagucgacagacgagcugcaagaagucaaagaagaagacgcgauagauaucuuaggagaaaagcagcacuaaugaaaagaauggcacaagucggacuaaugccugcagacccagcagaagcgaaagucuuagaaguauuaaacccuuaugaacuaagggccaguggcuuagacgguccacuaccgcuaacccacuuuggucgagcacuuuuccauuuaaaucaaagaagaggauuuaaaucuaauagaaaaacugauagaggcgauaacgaaagugguaaaaucaaagaugcaacugccagauuagaucaagcaaugauggcaaaaggagcaagaacuuauggggaauuucuacauaugcgcagagcagcagcuuuggauccgaaaagcguaccaaguguacguaccagacuaacagucgcacgaagggacgacgcggaaaaagaagaagccggcuacgauuucuacccagauagaaaacauuuaagugaagaauuugauaaacuaugggcagcgcaagcaagacaugcaccagacguauuaacugaagaucuuagggaugaaauugcaacgauaauauuucaucaacgaccccuaaaaacaccagaaguuggucuuugucucuucacaggacaacauggaguuccggaaagagauaaaagaauaccaagcgcacauccacuuaaucaaagacgaaucuugauggaaacuguuaauaauuuaaaagucgcagcccaaggggagccuagucgaccguuaacuagagaggagcgagaucaaauaguccaugcacuagauaauaagaaacacacgaaaagucuaucgggaaugacaaugaaacuaaaagcacuaggaaaaguaaucaaauuaagaccagagcaaggauucacauuagaaacagcgaauagggaugcaauagcaugugauccaguacgugcaaguuuaagccacccagauagauucggcgccagauggagcacucucgaaucagcuggacaaugggauguuguacaacggauuagagcuguacaaagcgaugcagaacaugccgacuuaguaggaugguuaauggacguacacggauuagacagagaccacgcugaagaaacagcgaaugccccguuaccugaaggauauggcagauuaggccuaacagcaacuacgagaauccuagccgcucuggaagccgacgucuuaaauuauagcgcagcagucgcagcauguggauggcaccacucagacggaagaacaggugaaguauuagaaucacucccauauuauggugaaauucuagaaaggcacguuauacccggaacuggagaccccaaugaugaugacgucaaaagauauggaagaauaaccaauccuaccguacacauaggauuaaaucaacuucgcagauuagugaauaggauaauaacgguguacggacgaccagacgaaaucguagucgaacuagcacgagauuugaaauugagugaagaccaaaagaaagauguucagagagacauaaagaaaaacaccgaagcagcuauucguagaggaaagaaauuagaagaaaugggcguaccgaauaccggagcaaauagaaugguauugagacuaugggaggaccuuggagacgaugugaugacucgaaacuguccauauacagguaaacgaauaucugcaggcauguuauucgaugguaguugugauguagaucauauacucccauauagucgaacgcucgacgauagcuuugccaauagaacacuuugccuuaaagaggcaaaucgucagaaaacagauaaaacgcccugggaagcauggggcgaaacugagcaaugggaagcuauagcugcgaauuugaaaaaccuaccagccaauaaagcauggcgauuugcaccugacgcaauggaacgauucgaaggagagaaagauuuuucugcaagagcacuagcagauacacaauauuuaagcagaaucgcaagagcauauuuggacgcucuauaugauggcgaugauggaaaaagccauguuugggucgucccugguagacuuacugaaauguuaagaagacacuggggcuugaacggggucgcugccuuaacugauucagauaaacaaacuguuaaagccaaaaaucgcacagaucacagacaucaugcaauugaugcagcaguaguugcugcaacggacagaggacuaauaaaaagaauagcagauauggcuaaacgagaugaguucaauggagccgaagaaguagcuagaaguauaccaccaccaugggaaggguuuagagaugacguuagugcucaaguaacacgcaucaucgucucacacagagcugaucauggaaggauagauccagcugcaagaaaaaguggcagagauaguacaucaggccaacuacacaaugacaccgcauacggaauagguagagauggaacugugguaagucgaaaaccguuagcuagcuuaucgccaaacgauaucguggugacuaaaagaggagcaaauauaagagauguagaccuacaaaaacaucuggcaagagugacacacgggcuugacggaaaagcauuugaagcugcucuauuagcuuuugcugccaguccaauauuacccgacaacacggauaauccauauuuuggauugaggaggguacgacuagaagaaacacuacaagaaagugcaaggguggaaguagcugaccaagaaggaagaccauauaaagcauauaaaggugauagcaaucacugcuacgaaauauggugucuuccugacgggaaaauuaaaccacaaguaguuacaacuuacgaagcucaucaaucuggggcugaaaagaaaccacacccagcagcaaaaagacuuaugcgaauuuucaaaagagauaugguuauguuagagagagacggggaaacaaucauaggcuauguacagaaaaugaaacaaaauggcagcauauuugucgcaccacacacggaagcaaacgcggaugcaagagauagagauccaaaagacgauuuuaaauuaauucaauugggagcugguucauuggugaaagcaaaagcaagaagagugauuguugaugaaaugggacguuuacgagauccaggaccaccacuuuga

SEQ ID NO: 8524 - RNA, 3258 nt, Artificial Sequence
  Cas9 variant
auggacaaaggaacaaauaguauaggaugggcggccuuaagacuagaugaacaaggagaaccaguagguauaauugaagccgguguuagaauauaugcagauggccgagaaccgaaaagcggaacaucacuagcagaaggaagacguauagcgagaggcaugucaagacgacgcgaucgauacaaaagaagacggagaacaguguugaauacucugacagaauuuggauugaugccagcuaccaaagcugcaagaaaggcccuaguagcugaaacaaaugaccgaagguuuggagaaguagcuaguaauguauacgcacuacgagcaagagcacuagaugaaaaacucccgcuuuaucaauuagggagagccuuauuccacuuaaaucagagaagaggauuuaaaagcaauagaaaaacagauaagagagacaacgaucaaggaaaaauagcaagugcaauuucccgacuaggaagaaaauuagacgaagcaggagcuagaacuuugggagaguuucuacacaaacagcacgcugcaggaaaauggguacguguaagaccaagucguguaccaggagaagacgacaaagaagaagauggauacggguucuaucccgaacgaaguuuucuagagagagaauuugcagcuauaugggaagcacaagcggcguuuuauccggaacuacugaccgaagaacgccgagaccauuugcacuggguaauguucuuucaacgaccacucaaaagaccaacgguaggaaaaugcucauuucauccggaugaagauagacuaccuaaagcucacccucuauuucaagaauuucgauuaauaaaagaauugaaugaauuagaaguuguacacagaggggauagaagagaaaaacuaacaccagaucaaagggacaggcuauucaaccaauuaagaacucagagaucgagugcauucacagcauuaagaaagacaauaaaagcuccuacaggaacgagauuuaauaaagagagugacgcaagagauaaauuaaaaggagaugaggucgcugcagaaaugagucacaaagauagauuuggacaagccuggauuggaaugccacuagcugaaagaugggcaguuguagcaauguugcucgauacagaagacccccuagaggucaaagcguggcucgaagaaagguacggauucgcagcagauagaauugaugcaauugcagcagcaaaacuuccaacaggauauggaagacucggagaaacagcuuuaagagauaugcuagaugaguuaagaaacggaacugucaaagaugaugcaggaagggauguaguauuaacagaaaggcaagcaauggauaauauuuggggcgauaacccagccuuacaaagagcaguuaccgaugcucgagaauuaccaccguaccaagaaguccuuggacgaagaauacccccagguacuggaaaaccugcagauccauaugauguacaaaaaggccgauuaacaaacccgacugugcauaucggucugaaccaacuuaagcguaucguaaacguacuaaugaggagacaugguagaccggaacaaauagcacuagaacucgcuagggaucuaaaacuaaacgaagaacaaaaagcagagaaaaacagggaaauugcaaggaacacaaaagcugcagaagcaagaggcaaaaaguuggaagaguuaggccacgcgaacaaugguuacaaucgaguccuauuaaaauuaugggaagaccuaaacuuaaaacaaccagaaaauagagaauguauauauuguggaaaagcaauaggcauaggcacccuacuuucaaaucaagucgacauagaccauauucuaccauggaguaaaacauuagaugacucccaagccaauagaauuguuugucacguggaauguaauagacaaaaaggaaaucaugcaccggcugaaguaccgcaauggcaugacagauaugacgauauacuggcgcgagcagaacgacuaccuagaaacaaagcauggagauuuggaagagaagcgaugaagaaauuuaaagacgaugagagcuuucuagcgcgccaacuaacggacacucaauaccuaucaagauuagcccaugaauauuuaggagcauuguacccagaugaagaaccagaugaguggggagggccggcucgacgaaaccacgugagagugauaccgggaaggaugacugaaauguuacguagacaaugggguuuaaaugcaauaauuucagaucauaaucaaaagaacagaaacgaucauagacaucacgcaauagaugcuauaguaguugguguaacuacacguagguuacugcaaagaaucgcaacaguggccggaggaagggaagcucuugcccuagaggagacuauagguaaaaucgaaccuccauggccaggauucuacgacgacguaaaagcugcaauugacaggauuguaguuucccacaaaccagaucauggaucucuaccaaaaccaggaaagccuggaagaacagcaggacaauuacacaaugacacagcauacggauuuacaggcgaagcaagaaauggaguaccuauaaugguacacaggguuccuuuugcuagcuuaacagaaaaagauauuccaagcauaagagaccggcaauuagcagaugcguuauaugcagcuauuucggggauaaguggcaaagcagaauuagcagcugcauuagcgagguucucagaaucaggaccuuauaaggguauaagacauguaaggguaguagaaccagugagugucauagcaauuaaggaccaagccggaaaagccuauaagggauauaaaggugaugcgaauuauagauacgaugucugggaacuaccuaacggaaaauggacacacgaagugguaaguauguuuaaugcacauagaccugauuggcagagcgaaaucagaaguaaaaaucccgcagcccgcaaaguauuaagucuacaucaaaacgauaugguugcuuacgaacauccucaagacgguuacacaaucgggagaguuguaaaauuuuccgcgggaggccaaauggcauuagccggcaauagagaaggaggagccuuaaaaaguagagacgcugaucccgaagauagauucagauauuucuacaaaucugggggagcaaugagagacgugcaguuaagacagguaagagucgacgaaacuggaaggguauucgacccagguccacaagauagagaaagcagaaacgccagaaaacaaaacgaugcaggauga

SEQ ID NO: 8525 - RNA, 3264 nt, Artificial Sequence
  Cas9 variant
augcgguauaaaauaggcuuagauauaggaauaacaucagucggaugggcaguuaugaaccuggauauaccaagaauagaggaucuaggcgucagaauuuuugacagagcagaaaacccccaaacaggugaguccuuagcucuaccaagacguuuagcccgaagugccagaagaagauuacgaaggcgaaagcauagacuugaaagaauacgaagauuaguuaucagagagggaauacuaaccaaagaagaauuagacaaauuauuugaagaaaagcaugaaauagauguauggcaacuaaggguggaagcauuggauagaaaacuaaacaacgacgaauuagcgagaguuuuauuacaucuagccaaaagacgcggauuuaaaagcaauagaaaaagcgaacgcaguaauaaagaaaacaguacaaugcuaaaacacauagaagaaaacagagcaauauugaguucauacagaacaguaggcgaaaugauuguaaaagacccuaaauucgcauuacauaagcgaaauaagggcgaaaacuauacaaacaccaucgccagagaugaccuagaaagagaaauucgccuaaucuucaguaaacaaagggaauuugggaacaugaguugcaccgaagaguucgaaaaugaauauauuacaauaugggcaucacaacgaccuguagcuaguaaagaugacauagaaaagaaaguaggauucugcacauuugaaccgaaagagaaaagagcuccuaaagcaacuuacacauuucaauccuuuaucgcgugggaacauauaaacaaacuacgacucauaagccccucuggggcaagaggacuuacagacgaagaaagaagacuacucuaugaacaggcuuuccaaaagaacaaaauuacuuaccacgauauuagaacacuauuacaccucccagaugacacauauuuuaaaggaauaguauaugauagaggagaaucaagaaaacaaaaugaaaauauaagauuuuuagaacuagaugccuaccaucaaauccgcaaagcaguugacaaaguuuauggaaaaggcaaaucaagcucguuucuaccaauagacuuugauacauuuggguacgcgcuuacauuauuuaaagaugaugcagacauacauaguuaucuuagaaaugaauaugaacaaaacggaaaacgaaugccuaaucuugcuaauaaagucuacgauaacgaacuuauugaagaacuauuaaacuuaucauucacaaaauucggucauuuaagccucaaagcauugagaagcauacuaccguauauggaacaaggugaaguauacuccuccgcaugcgaacgugcgggauauacuuuuacaggaccuaaaaagaaacagaaaacgauguuguuaccaaacauaccacccauagcaaauccgguagugaugcgagcccuaacccaagcccguaaaguaguaaaugcaauaaucaagaaauacggaucuccagucagcauacauauagaauuagcaagggauuuaucacaaacguucgaugaacgacguaaaacaaagaaagaacaagaugaaaaccggaagaaaaaugaaacagcaauucgccaauuaauggaauacggacugacacuuaacccaaccggacaugauauaguuaaauuuaaacuguggucagaacaaaacgggagaugcgccuauucacuacaaccgauagaaauagaaagauuguuggaaccaggauacguagaaguagaucaugucauacccuauucucgaaguuuagaugacucauauacaaauaaaguccuagugcuaacgagagaaaacagagaaaaagguaacagaauaccagcagaauaccucggaguaggcacugaacgauggcaacaauuugaaacuuuuguccuuacaaauaaacaauuuagcaaaaagaaaagagaccguuuauuaagacuccauuacgaugaaaacgaagaaaccgaguucaaaaaucgaaaccuaaacgauacaagauauauaucaagauucuuugcgaacuuuaucagagaacaucugaaauucgcugaaucugacgacaaacaaaaagucuauacaguaaauggaagaguuacagcacacuuacgaucaagaugggaguucaauaaaaauagagaagaaucagaccuacaucaugcagucgaugcaguuauaguugccuguaccacaccaucagacauagcgaaaguaacugcauucuaccaacgaagagaacaaaauaaggaacuagcgaaaaagaaagaaccacauuuuccucaaccguggccucauuuugcagaugaacuaagggcaagauuaagcaaacauccaaaagaaucaauuaaagcucugaacuuaggcaacuaugacgaucaaaaauuagaaagucuacaaccaguauuugucagccgaaugccaaaaagaagugucacuggagcggcacaucaagaaacucuacguagauacguagguaucgaugaaagaucgggaaaaauacaaacuguaguaaaaacuaaauuaucagaaauaaaauuagaugcaucaggucacuuccccauguacggaaaagaaagugacccaagaacuuaugaagccauaagacaaagacuuuuagaacacaacaacgauccgaagaaagcauuucaagaaccuuuauacaaaccaaagaaaaauggggaaccaggucccguaauaagaacaguaaaaauuauagauaccaaaaaccaaguaauaccacucaacgaugguaaaacaguagcauacaauucaaauauuguaagaguagacgucuuugaaaaagacggaaaauauuacugcguuccgguguauacaauggacauaaugaaaggaauauugccgaacaaagcgauagaaccuaauaaaccauauagcgaauggaaagaaaugaccgaagacuacacauuccgauucaguuuauaucccaaugaucuaaucagaauagaacugccaagagagaaaaccguuaaaacagccgcuggugaagaaauuaauguaaaagacguuuuuguauauuacaaaaccauagacucggcaaauggcggguuagaauuaaucagccaugaccacagauuuucacuaagaggaguaggaucaagaacauuaaaacgguuugaaaaauaucaaguagacguacuaggaaacauauacaaagugcggggagaaaaacgagucggauuagccaguagcgcgcauucaaaaccagggaaaacuauccgaccguuacaaaguacuagggacuga

SEQ ID NO: 8526 - RNA, 3264 nt, Artificial Sequence
  Cas9 variant
augcuaagaaugaaauaugcgauaggacuagacauaggaauagcuucagucggauacgcuguauuagcacuagaccaugaagaaaauccauggggaauuauaagauuaggaucacgaaucuucgacguagcagaaaauccaaaagauggggcaucacuugcacuaccccgucgagaagcaagauccguccgcagacgauugagaagacaucaccaccgauuagagcgaauuaaaaacuuacucauaaacacagaguucauaacuaaagacgaauuauuacaucuauaugauggaaaccuaagugauguauaugaauuaagagucaaagcguuagacuacucagucaccaaugcagaacucacacgaauauuacuccauuuagcacaaagaagaggcuuuaaaucuaaucgaaaaagcgacgccaaugacaaagaagcuggacaauuauuagaagcgguaagcgcuaaugcaaaacgcaugcaagaaaaccauuacagaacgguuggcgagauguucuacaaggacgacuuauucaguaaauacaaacgaaacaaaggaggaacguaccucacaacagugcaucgagauaugauagcggcagaagcacgaacaauacuagaaaaacaauucgccuugggcaacaacauaugcacacaagacuuuauagauaaauaucucagcauacuucuuucacagaggcaauuugacgaaggaccaggagaaccaucuccauaugcaggcaaucaaauagccaauaugauuggaaaauguacauucgaaccaaaugaauacagagcagcaaaggcuucguacucauucgaaagauuuaaucugcuacaaaaaguaaaucaucugagauuacuacuagaaggaaaaaguauagcauuagacaacgaacaaaggaagaaaauaauagcacuagcacacgacaaagcagacuuaagauacucucauauucgaaaagcacuuggcuuagaugaaaaaguauuauucaauacaauuacauacaaugaugaugucagcguaauugaaaagaaaacaaaauuuaacuuccuacaagcauaucaccaaauaaagaaaguauuggcugaagacaugcaaaaacuaaccaccgaacaacuugacaacaucggucaaauauuaucaaccuauaaaagcgacaauaaacggacagaagaauuaucggcgcuaggccuggaaaagaaaaucauagacgcucuauuagguauaaauggacucuccaaauuugcacaccuauccuuaaaagcacuuagaaaaauuaaucccuauuuagaagagggcaaaauauacaacgaagcguguacagcagcuggcuacgacuuuaaagcccacgccaauacacagaaaacugaauuacugccugcauauaaagaagaaauggacgacauuacuucgcccguagccaggagagcaaucgcacaaaguauaaaaguaauaaacgcaauuauaagagaacaaaaaggaucaccucuauauauaaacauagaacucgcaagagaaauggcuaaaggauuugaugaacguacacaaauugacaaagcaaauaaagaaaaucaagcuaaaaaugaacgaauaauggaacggaucagaacugaguuccacaaagcaaaccccaccggaauggaccuaauaaaacucaaauuaugggaggaacaagauggccgaagcccauauagucaaaaagcaauaucaaucaauagacuuuucgaaccaggauacguugauauagaucauauaguaccauauucaauaaguuucgacgacucauuuaaaaauaaaguauuagucuuuagcgaugaaaaccgcgacaaaggcaauagacuaccuauagcauaucuacaaucuaaauucggagccaaagcagccgaaaacuuuaugauauggguccaaucuaacauuaaagacuauaagaaaagacaaaaacuccucaaacgggaaauuacagaagaggauauaaauaaauucaaagaacguaaccuccaagacacaaaaacaauuagcagauuccuauacaauuauauaaaugacuaucuucuuuuugcaccaucugacaccggcaaaaagaaaagagucacagcagucaauggaacuaucacagcguaucuucgaaaacguuggggaauaaauaaaauaagggccaacggagauaagcaucaugccguugaugcaguagucaucgcuugcacaacggacaaaaugauaaaggauuugucaucauuuagcagauaccacgaacuagaguacacgcauacagacaccgagagcuuuuuaguuaauagucuaacgggagaaauauuaaaacguuucccauauccgugggaagauuuccgaccagaacuaauggcuagauuaagcgauaauccugcagaugcacuacgaaaguuaaaccucaucuucuaucacgguaucgaccuauccaccauaaaaccaauauuuguaaguaggaugccucgccauaaaguuacaggggcagcacacaaagcuacaauaaaaagcgcacguugccuagacaacggaauaguaaucuguaaaacaucuuuacaaaacuuaaaacuugacaaggaaggcgaaauagcaaacuacuacgcaccagaaagcgauacaauacuauacaacgcacuaaaagaacgcuuaagaucauacgauaauaaaccagcaaaagcauuugcagaacccuucuacaaaccaaaagccgacgguacaccuggaccccuagucaagaaaguaaaaguauaugaaaaaucaacacuaaauguagcaguucaacaaaauaccgcagucgcagacaaugacucaauggucagaguugauguguuccacguaaaaggaaaugguuacuaccucguaccaauuuauauagccgacacccuuaagaaagaauuaccaaacaaagcaaucgucgcuuacaaaccauacgcggacuggccagucauggacgauaguaacuucauauuuucuuuauacccuaacgaccuaauaaaauuugaacauaaaaauagcguaaaauuugcuaaagugaauaaagaaucuacuuuaaacgacuucuauucaacaaaaagcgaaaucgucuauuucaaaggauguaauaucaacacaggagccauaacuauaauaaaucacgaaaauacauauguaguaagcucucuugggguaaaaaccuuacccagcuuagaaaaauaucaagcagauguacuuggaaacuauacaaaagugaagaaagaaguuagaaaaccauucagguga

SEQ ID NO: 8527 - RNA, 3264 nt, Artificial Sequence
  Cas9 variant
augcgcuacaaaauaggauuagauaucggaauuacuagcguaggcugggcaguaauaaaccuagacauaccaagaaucgaagacuuaggaguacguauauuugacagggccgaaaacccucagacuggggaaagccuagcacucccacgccggcuagcucguagugcaagacguagauuacgaagacgaaaacaccgccuagaaaggauuagacgccuuauaauacgagaagguauucuaacuaaagaagaacuagauaaacuauuugaggaaaaacacgaaauagacguguggcaguuacgaguggaagcacuagauagaaaauuaaacaacgacgaacucgccagaguauuacuacaucuggcgaaacgucgaggauuuaaaucuaacagaaaaucagaaagaagcaacaaggagaacucaacaauguuaaaacacaucgaagaaaauagagcuauacucucauccuacagaacaguaggugaaaugauaguaaaagacccgaaauuugcacuucauaagcguaacaaaggagaaaauuacacaaacaccaucgcaagagaugacuuagaaagagaaauccgucuaauauucucaaaacaacgagaguucgguaauaugagcugcacagaagaguucgaaaaugaauauauugcaauaugggcaucacagagaccuguagcaucaaaagacgacauugaaaagaaaguaggauucuguacguuugaaccaaaagaaaaacgagcaccuaaagcaaccuauacauuccaaaguuucauagcaugggaacauauaaacaaacuaagacuaauuaguccaucaggaacucgaggauuaacagaugaagaaagacgauuacuauacgaacaagcauuccagaaaaacaaaauaacauaucaugacaucagaacuuuacuacacuuaccagaugacaccuacuucaaaggaauaguguaugauagaggagaaucaagaaaacaaaaugaaaauaucagauuuuuagaauuagaugcuuaucaccaaauaagaaaagcggucgauaaaguauauggaaaagggaaaucuucaucauuucuucccaucgauuuugauaccuuuggcuacgcucuaacauuauucaaagacgacgcagacauacgaucauacuuaagaaacgaauaugaacaaaauggaaaaaggaugccaaaccuugcaaauaaaguguaugacaaugaacuaauagaagaacucuuaaaccuaucauuuacuaaauucggacacuugagucuaaaagcguuaagaucaauauuacccuauauggaacaaggagaaguguacaguagcgcgugcgaacgugcuggauacacauuuacagggcccaaaaagaaacagaaaacaauguugcuaccaaacauuccaccuaucgcaaacccaguuguaaugagagcauuaacccaagcaagaaagguaguuaaugcaauaauaaagaaauauggcucccccguaucaauucauauagaauuagcccgcgaucuaagucaaacauuugaugaaagaagaaaaaccaagaaagaacaagacgaaaauagaaagaaaaacgaaaccgcaauaaggcaacuaauggaauacgggcuaacacucaacccaaccggccacgacauaguaaaauucaaacuauggagcgaacaaaauggcagaugugcauauucacuacaaccaauugagauagaacgauugcuagaaccaggguacacagaaguagaccaugucauuccauacagucggagucuugacgauucuuacacaaacaaaguauuaguacuaacaaaagagaacagagaaaaaggcaaccggauaccagcugaauaccucggcguaggcacagaaagauggcaacaauuugagacauuuguuuuaacaaacaaacaauucuccaaaaagaaaagagaucgucucuuaagacuacacuacgaugaaaacgaagagaccgaguucaaaaaucgaaaccuaaacgacacccgauacauaucgagauuuuucgcgaauuuuauuagagaacauuuaaaauuugcagaaucagacgacaaacaaaaagucuauacaguaaacgguagaguuacagcccacuuaagaucacgcugggaauuuaacaaaaacagagaagaaagcgacuuacaucaugcaguugaugccguaauaguagcuugcacaacuccuucagauauagcaaaaguuacugcauucuaucaaagaagggaacaaaacaaagaacuugccaagaaaaccgaaccucauuuuccacaaccauggccacacuucgccgacgaauuaagagcucgacuuucaaaacaucccaaagagaguauuaaagccuuaaaucuuggaaacuaugacgaucaaaaacuagaaagccuccaaccuguauucgucucaagaaugccgaaaaggucaguaacaggagcugcgcaccaagaaacacuacgucgcuacguggguauagacgaaagaaguggcaaaauacaaacaguugugaaaaccaaauuaucagaaauaaaauuggaugcgucuggacacuucccaauguacggaaaagaaucugauccacguacguaugaagcuauaagacaaagacuucucgaacauaauaacgacccuaaaaaggcuuuccaagaaccauuauacaaaccaaagaaaaacggagaacccggcccagucauacgcacaguaaaaauaauugacacuaaaaaccaaguaauaccuuuaaacgauggaaaaacaguagcguauaauaguaacauaguucgaguagacguguucgaaaaagauggcaaauauuacuguguaccuguauauacaauggauauaaugaaaggcauauuaccaaacaaagcuauagaacccaauaaaccauacucagaauggaaagagaugacugaggauuauacauuuagauucucucuuuacccaaaugaucuuauaagaauagaacuuccucgugagaaaauaauaaaaacagcaggcggagaagaaaucaaaauaaaagaucuuuucgcuuacuacaaaacaauacacucaggaacagcuggccuagagcuaguaucucaugauuguagcuuuagccuaucuggagucggcucaagaacucuaaaaagauuugaaaaauaccaaguagauguacuaggaaauauauauaaaguccguggagagaaaagaguuggucuugccucaagugcucauaguaaaacaggagaaacuauaagaccauuacaaagcacaagagauuga

SEQ ID NO: 8528 - RNA, 3264 nt, Artificial Sequence
  Cas9 variant
augagauacaaaauaggccuggauauaggaauaacaucuguaggcugggcggucauaaaccuagaucuaccuagaauagaagaccuaggaguuagaauauucgaccgagcagaaaacccacagaccggcgagagcuuagcuuuaccgagaagauuagcaagaucagcaaggcgcagacuaagacgacggcgacacagguuagaaagaauaagacgauugcuaaccagagaaaacguacuaacgcaagaagaacuugauaaacuauuugaaaagaaacacgaaauagacguauggcaauuaagaguagaagcacucgaccgcaaacuaaacaacgaugaauuagccagaguacuccuucaucuugcaaaaagaaggggauucaaaucuaacagaaaaagcgaacgauccaauaaagaaaauucgaccaugcuaaaacauauugaagaaaaucgcagcaucuuaaccggcuacaggacagucggagaaaugauaguaagagauccaaaauucguauuacauaaacgaaacaaaggugaaaacuacaccaacacaaucgcucgcgacgacuuagaacgugaaauucaacucaucuucgccagacaacgagaauuuggaaauaugauauguaccgaagcauucgaaaacgaauauaucgcaauauggucaucgcaacguccuguagcaucaaaagacgauauugaaaagaaagucggcuuuuguacauuugaaccgaaagaaaaacgagcacccaaagccacauauacauuccaaucuuuuaucgccugggaacacauaaacaaacugaggcuaguaaguccuaguggaacuagagaacuaacagacgaagaacggagacuucuauacgaacaggcuuuccagaaaaauaaauuaacauaucacgauaucaggacacuauuacauuuaccagacgacacuuacuucaaaggaaucguauaugauuggggagaaccccuaaaacaaaacgaaaauauaagauuucuugaacucgaugcauaccaccaaauacgaaaaacagucgauaaaguguacgggagaggaaaaucuagcagcuuccuaccaauagacuuugacacuuuuggcuacgcguugacacucuucaaagacgacgcgcacaucagaagcuaucuaagaaaugaauacgaacaaaauggcaaaaggauagcaaacuuagcaaacaaaguauacgauaaugaacucauugaggaacuucuaaauuugagcuucacaaaauuuggacacuuaagucuaaaagcccuaagaaacauauuacccuauauggaacaaggagaaguauacaguagcgcaugcgagcgugcaggcuacacauuuacuggaccaacaaagaaacagaaaacgguacuauuaccaacaauaccaccgauugcaaauccaguaguaaugcgagccuuaacgcaagcucgaaaagucguaaacgcgauuauuaagaaauacggauccccagucucaauacauaucgaauuagccagagaccucagucaaacauucgacgaaaggaagaaaaccaagaaagaacaagaugaaaacagaaaaagaaaugaaacagcaauaagacaauugauagaauacggauuaacgcgaaacccuacuggccacgacauaguaaaauucaaauuaugguccgagcaaaacggaagaugugcguacucacuucaaccaauagaaaucaaacgacuacuagaaccaggcuacguugaaguagaucacgucauaccuuacucuagaucccuagaugacaguuacacaaacaaaguucuaguauuaaccaaagaaaacagggaaaaagguaaucgaaucccagccgaauauuugggagugggaaccgaaagauggcaacaauuugaaaccuucgugcugacuaacaaacaauucagcaaaaagaaacgcgauagauuauuaaggcuacacuaugaugagaacgaagaagcagaauggaaaaacagaagucugaaugacacgagauauauaucaagauucuuugcaaacuuuauaagggaacauuuaaaauucgccgacagugaugauaaacaaaaaguauauacagucaacgguggcguaacugcacaucugagaucacgaugggacuuuaacaaaaauagagaagagucugaucuacaucacgcaguagacgcagccaucguagccugcacuacacucagugacauagcuagaguuaccgcauuuuaccaacgcagagaacaagccaaagaauuagcaaagaaaacugaaccacauuucccucaaccauggccgcacuucgcagaugaauuaagagcaagauuaagcaaaaaucccaaagaaucaaucaaagcacuaaaucuaggaaacuaugauaacgaaaaauuagaaucacuucaaccgguuuuuguaucaagaaugccaaaacgaucuguuacaggugccgcacaccaagaaacucuaagaagguauauaggaauagacgaaagaucaggaaaaauacaaaccgugguaaaaacuaaacuaagcgaaauaaaauuggaugcauccggccauuuucccauguauggaaaagaaagcgauccaagaaccuaugaagcaauacgacucagacuccuggaacacaacaacgacccgaggaaggcuuuccaagaaccacuauacaaaccaaagaaaaauggggaauuaggccccauaauacgaacaguaaaaaucauagauacgaaaaaucaaguaauaccucuaaaugacggaaaaacaguagcuuacaacucaaacauaguccguguagacguauuugaaaaagauggaaaauauuacugcguaccaguauauacgauggauauaaugaagaaagugcuuccaaauaaagcaauagaaccaaauaaaccauacucagaauggaaagaaaugaccgaagacuauacuuucagguuuucuuuauacccgaaugacuuaaucagaauagaacuaccacgagagaaaacaguaaaaaccacagcgggccacgaaauaaauauuaaagacgucuucguauauuauaaaacaauugacucagccacaggaggacuagaacugauaagucacgacaauucauucagccucagagguauagguucucgaacacuaaaaagauuugaaaaauaccaaguagacguucuaggaaauaucuacaaagugagaggagagaaaagagucggacuagcaucaucagcacauccagaaacccgggaaacgauaagaccacuucagucaacgcgagauuga

SEQ ID NO: 8529 - RNA, 3264 nt, Artificial Sequence
  Cas9 variant
augaaaaaauuagucuuaggcuuagacauuggaguagcgucaguuggaugggguauaauagaugcagaaaauggagauguagucgauacaggagugagacuauucucaucacgagacgcuucagaaaaugaaucgcgccggaccucacgacaaagucguagacugaguagaagaaaaaaacacagaagagaaagaaucaaacaauuacuccuagcacaugacauggauauaugcgauauagucaacgaaaaucccuacgagcuacgcguaaagggacuuaacgagaaacuagaaguaucagaaauauacguagcacuaacacaccuugcaaaaagaagaggaguuagcuaucuagaugauguaguagaagaaggaggaaccauaaagagcgaacaccuuaacaaaaacauggaggaaauuaaaagugguaaaaugccuugugaaauacaauuagaaagguucgaaaaauauggacaaguaaggggaaugaucgaaauuaaucaagauacagaagaaagcucauuucuaguaaacauuuuuaggacgagcgacuacaucaaggaagcaaaaaccaucuuagcuacccaacaaaaauuucacaaacaaauuacuaaugaauucaucgacgaauacauacauauaauggccuccaaaagagauuacuuuauaggaccuggcaacgagaaaaguagaacagacuauggggucuauagaacaaauggagauacuugggacaacuuauucgaaauauuaauuggaaaauguucaguauucccggaagaaacaagagcugcacguucaaguuacgucgcacaggaauuuaacuuauuaaacgauuuaaauaaccuaaaaauaaguaaucuugaaucaggaaaauuauccgcaucacaaaaacacgacauuguugaaaaaguaaaaaacucaaaaaaauucggcacuaaagaucucuuaaaauauauagccaguguaugcgaaugcaaaauagaagauaucggagguugcaggguagauaaaaauaggaaaccgauaaugcacacuuuugagaauuacagaaaagugcacaacgcacugaaugaagcagggguggaccuacgacuaucggaaacugauuacgaugaacugaugaagauuaugacauuaaauucagaaacccuugagauaaaaaaacaaugcaaagaaaaacucccccaacuaacugaagauuaccuaaacguauguuuaguuuuaaacaaaaaaggagcauucucagguuggcaugcuuuaagccucaaagcaaugaaacucaugaugccugaauuauauggcacaaguaagaaccaaaugcaaauaauacauacaaugcaacuaggcaaagcauacuuaaaaccacuaaaucaacaaaaguaccuuaacucugaagcaauacuagaagagauuuauaaccccauugcugcccgaagcauuagacaaacaauaaaaguaacaaaugccauauuaaaaaaauauggccaccuagauagcguaauaaucgaaaugccacgagauuaucaaacgagcgaagaugaacgaaaaaugauugaaaaaaugcaaaaagaaaacgaaaaagaaaaaaaagcggcauuaaaaagagcacgugaagaauacccauuucccgacgaagcauucagaaaccauaaagaauuagcuacaaaacuuagguuaugguaccaacaagaucaguucugcguauauucagguagaaaaauaucugugguagauuuaguacgcaaucccaaccaauuugaaauagaucacauaauaccccaaucaguaagccuagaugauucacuuaacaauaaaguacuauguuuuucagaagaaaaucaaaaaaaaggacaacaaacuccauuuuacuaucacaagggcaaaagugguaauuggaccuacgaacaauacaaacuauucguagaaaaauuauucgacaaaaaaaaaaucaguaauaagaagagggaacuauuacuauucgaagaagacauaaauaaaugggauguuagaagaggauuuaucgcccgaaauuuaguagacacaagguacgcaucacgaguaauucuuaauagcuaccaacaauacuuuggaaaucacgaaaugggaaccaaaguaaaagucguuagggggaaguuuacuagucaguuacgaaaaaaauggcguauauucaaggacagaaacgaaagccacucucaucacgcaauagaugcccuaauaguugcagcaacagcaaaucuuagauuauggaaaaaaaauacauuaggaguaucugaugaaggaaaaguuuacgacaaggaaacuggugaaauccuaccuuucgaaaagcuaacagaaagcgaauacaacgaaaugaugaauaaggaaccauaccucaacuuuaaaacuaaacuacaaaacauagagaccaaaguuaaauacucuuacagagugucaaaaaaaguaaacagaaaaauaagcgaugccacgauauauagcacacgcgaaagagauggaauagacuacaucgugggaaaaauuaaaaacauuuacgacguaaagaccuauaaagaucaauuuuuaaaaagauacaaaaaaaacaaagaacaauucuuaauguaucaacaugacccucaaacauucgcaauauuggaaaacaucauggcaacuuaccaagacgcagaaaacccauuucucgcuuauaaaaaagaauacggagucauaaggaaauauagcaaaaaaggaggaggaucaccaguaacgagccuaaaauuuauagacaaaguacuuggacaaaaaaucgaccuaacagcaaaaaaccaagcugcacucccaaaaaauaaaaagguaguccuccaauccaucacacccuaucgcgcugauguauauuaugacgaaaucgauaaacgauaucaccucauaggaguaaaauacucauuguuuaguuucucaaaacaaggauauguaauaaaccccauugcguaccaaaaacuccuagaaaaagaacaaauccacucagaaaugaaauucugcuuuucacuauauagggaagauauaauagaauuuggugaagacccagauucccuuacuagauacagauucuggucuaaaaaugaaucaggaaaaaacaaaauugaaguaaaaccgauagaaaaaccaaauuucgagaaacaaacaguauuaacaauuacgaaaaagauaaagauauuaaauaaauaccaaacagauguacuagguaauagcuuuaaagcccaagaagaaaaagauccaagaaauauagaguga

SEQ ID NO: 8530 - RNA, 3264 nt, Artificial Sequence
  Cas9 variant
augagauauaaaauaggacuugauauagguauuacuucaguuggaugggcaguaaugaaccuagauaucccccgcauugaagaucucggaguccggauauuugacagagcagaaaacccacaaacaggagagagcuuagcauuaccuaggagauuagcuagaagcgcaagacgaagacugcgcagaaggaaacacagacucgaaaggauacgcagauuaguaauaagagaaggaauacuuacaaaagaagaacucgacaaacuauucgaagaaaaacaugaaauagauguauggcaacuacgaguagaagcgcucgauagaaaauugaauaaugaugaacuagcaagaguauuauuacacuuggcaaagcgccgaggguucaaaucaaauagaaaaagugaaagaucaaacaaagaaaacagcacaauguuaaaacacauagaagaaaauagggcuauccugucaucauauaggacugugggagaaaugauagucaaagauccaaaauucgcauuacacaaaagaaauaaaggggaaaacuacacaaauacaaucgcccgugacgaucuagaaagagaaauacgacuaauauuuucaaaacaaagggaauuuggcaacaugaguugcacagaagaauuugaaaacgaauacauaacaauuugggccucacaaagaccagucgcaagcaaggaugauauagaaaagaaaguaggauucugcacauucgaaccaaaagagaaaagggcaccgaaagcaacauauacauuccaaucauucauagcaugggaacauauaaacaaacuuagacuuaucucaccaagcggggcaaggggcuuaacagacgaagaaagacgauugcuuuaugaacaagcauuucagaaaaauaaaauaacauaucacgacaucagaacacuguuacaucugccagaugacacuuacuuuaaaggcauaguauacgaucguggggaaucaaggaaacaaaacgaaaacauaagguuucuagaacuagaugcuuaccaccaaauaagaaaagcuguagacaaaguauacgguaaaggaaaauccaguuccuucuuaccaauugauuuugacacuuucggauacgccuuaacauuauuuaaagacgaugcagacauccacaguuaucuaagaaacgaguaugagcaaaaugggaagagaaugccaaaucuagcaaacaaaguauacgacaaugaauuaauagaagaacuacugaaucuaucauuuacaaaauuuggacaucuaagccucaaagcgcuaagaagcauacuaccauauauggaacaaggcgagguauacucaagcgcaugugaaagagcaggauacacguucaccggccccaaaaagaaacagaaaaccauguuacucccaaauaucccaccaauagcaaauccaguaguaaugcgcgcauuaacucaagcgagaaaaguagugaacgcaaucaucaagaaauacggcaguccgguaagcauacacauagaacucgcacgugaccuaagccaaacauuugaugaaagaagaaaaacuaagaaagaacaagaugaaaaucgaaagaaaaacgaaacugcaaucagacaauuaauggaauauggccuaacacuuaacccuaccggacacgacauaguaaaauuuaaauuauggucagaacaaaauggcagaugcgcuuauagccuacaacccauagagaucgaaagacuauuagaaccuggcuacguugagguagaccauguaauaccauacaguagaagucuagacgauucauauacaaauaaaguauuaguacuaacuagagaaaaccgagaaaaaggaaauaggauaccagcagaauauuuaggagugggaacagaacgguggcaacaauuugaaacauucguauuaacgaacaaacaguucaguaaaaagaaaagagauagguuacuaagacuccacuacgacgagaaugaggaaacagaguucaaaaauagaaaucuaaaugacacuagauauaucaguagauucuuugcaaauuuuauaagagaacaucugaaauucgcugaauccgaugauaaacaaaaaguauacacagucaaugggcgcgucacagcucauuuaagaucaagaugggaauuuaacaaaaauagagaagaaucagaccuacaccaugccguugacgcugccaucguggcuuguaccacaccuucagauauugcgaaaguaacagcuuuuuaucaaagacgagaacaaaacaaagaacuagccaagaaaacagaaccacacuucccucaaccuuggccacauuuugcagaugaauuaagagccagacuuucaaaacaccccaaagaauccaucaaagcacuaaauuuagguaacuaugaugaucaaaaauuggaaagucuacaacccgucuuuguuucacguaugcccaaaaggaguguaacuggagcugcacaccaagaaaccuuacgacgauacguaggcauagaugaacguaguggaaaaauccaaacagucgugaaaacaaaauuaucugaaauaaaacuagacgcaucaggccacuuucccauguauggaaaagaaucagacccacgaacauaugaagcaauaagacaacgucuacuagaacacaacaacgauccaaagaaagcauuucaagaaccauuauacaaaccaaagaaaaacggagaaccagguccgguaauacgcacuguuaaaauaauugacacuaaaaaucagguuaucccauuaaacgacggaaaaacaguagcauacaauaguaacaucguaagaguugauguuuuugaaaaagacgggaaauacuacuguguuccuguauauacgauggacauuaugaaaggaaucuuaccaaacaaagcaauagaaccaaauaaaccauauucugaauggaaagagaugaccgaagacuacacauuuagauuuagucuuuauccaaaugauuuaauaaggauagaacuaccucgagagaaaacagucaaaacagcugcaggagaagaaauaaauguaaaagacguuuuuguauauuauaaaaccauagacucagcaaauggcggacuagaauuaauaucacaugaccaccgauuuucucugagaggagucgguagccgcacacuaaaacgauuugaaaaauaucaaguagauguccuggggaacauuuacaaaguaagaggagagaaaagaguaggauuagccucgagugcacacuccaaaacaggagaaacuguucgacccuugcaaagcacuagagacuga

SEQ ID NO: 8531 - RNA, 3264 nt, Artificial Sequence
  Cas9 variant
augagguacaaaauaggacuagauauaggaauaacaaguguuggaugggcaguuaugaauuuagacauaccaagaauugaagaucuaggaguaagaauauuugaccgagcagaaaauccucaaacuggagaaucucucgcauugccaagaaggcuugcuagaagcgcaaggagaaggcucagaagacguaaacaccgacucgaacgaauacggcgacugguaauaagagaaggcauucugacaaaagaggaacuagauaaacucuuugaggaaaaacacgaaaucgacguauggcaacuucgaguugaagcacucgacagaaaacucaacaacgaugagcuggcaagaguuuuauuacaucuggccaagagacgaggauuuaaaucaaacagaaaaagcgagagaucaaauaaagaaaauucgaccaugcucaaacacauugaagaaaacagggcaauauuaucaucauauagaacaguaggagagaugauagucaaagaucccaaauuugcgcuccauaagcgcaauaaaggugaaaacuauaccaacacgauagcacgggacgauuuagaacgggaaauaagauuaauuuuuagcaaacaacgagaauuuggaaauaugucuugcacugaggaauuugagaacgaauauauaacaaucugggcaagucaaagaccggucgcgucaaaagacgacauagagaagaaagucggauucugcacauucgaaccaaaagagaaaagagcaccaaaagcaacuuauaccuuucaaucauucauagccugggaacacauaaauaaacuuaggcucauaucacccaguggcgcacgaggacuaacagaugaagaaagaagacuacuauacgaacaagcauuucagaaaaauaaaaucacauaucaugauauaagaacacuacuacaccuuccagaugauacauauuuuaaaggaauaguauacgaccgaggggaaagccgaaaacaaaaugaaaauauacgauucuuagaacuagaugcauaucaccaaauaagaaaagcuguagauaaaguauauggaaaaggcaaaaguucaucguuucuaccuauagacuucgauaccuuugguuacgcuuuaacucuauucaaagaugacgcagacauacacucauacuuacgaaaugaauaugaacaaaaugguaaaagaaugccuaauuuggcaaacaaaguauaugauaacgaauuaauagaagaauuacuuaaucuaucuuuuacuaaauucggacaucuuucccugaaagcauugagaucaauacuacccuauauggaacaaggcgaaguuuauagcagcgcaugcgaaagagcaggcuauaccuucacaggaccgaaaaagaaacagaaaacuaugcuauuaccaaacauaccaccaauagcaaauccgguaguaaugagagcgcuaacucaagcaaggaaaguaguaaacgcaauuauuaagaaauacggcuccccuguaagcauacacauagaauuagccagagaccugagccaaacauucgaugaacgaagaaaaacaaagaaagaacaagacgaaaauagaaagaaaaaugaaacagcaauuagacaacuaauggaauauggucugacacuaaauccaacuggccacgauauaguuaaauuuaaacucuggucggaacagaacggcagaugcgcauauagcuuacaaccaauagaaaucgaacgguuauuagaaccaggauauguagaaguagaucacguaauaccauauaguagaucacuagaugauaguuauacaaacaaaguacugguucucaccagagaaaaccgcgaaaaaggaaauagaaucccagcugaauaucuaggagucgggacagaaagauggcaacaauucgaaacuuuuguuuuaacaaacaaacaauucucuaaaaagaaacgagauaggcuacuaagguuacauuacgacgaaaaugaagaaaccgaauuuaaaaauagaaauuuaaacgacacacguuauaucucgagauucuucgcaaauuuuaucagagaacauuugaaauuugccgagucagaugacaaacaaaaaguguacacaguaaacgguagaguaacagcucauuuacgaaguagaugggaauuuaauaaaaauagagaagaaagcgaccuacaccaugcaguagaugcaguaauaguagccugcaccacuccuagcgauaucgcuaaaguaacagcuuucuaucaaagaagggaacaaaauaaagaauuggcaaagaaaaccgaaccacauuucccccaaccguggccacauuucgcagacgaauuacgagcucgacuaaguaaacauccaaaagaaucgaucaaagcacucaauuugggaaacuacgacgaucaaaaacucgaaucacuccagccuguauucguaucaaggaugccgaaaaggucugugacuggagcagcacaucaagaaacucuacgaagauacguagggauagacgaacgaucaggaaaaauacagacaguuguaaaaacaaaacuaagcgaaauaaaacucgacgcaucuggccauuuuccgauguauggaaaagagagugauccuagaaccuaugaagcaauuagacaaagauuacuagaacauaauaacgacccuaaaaaggcauuucaagaaccacuauacaagccaaagaaaaauggagaaccaggaccaguaauacgcaccguuaaaauuauagacaccaaaaaccaaguaauuccacugaaugacggaaaaaccguggcauauaacucaaacauagugcgaguagacgucuuugaaaaagaugguaaauauuauuguguaccaguauauacgauggauaucaugaaagguauacucccaaacaaagcuauagaaccaaauaaaccauacagugaauggaaagaaaugacugaagacuauaccuuucguuuuucacucuauccaaaugauuuaauccgaauagaauuacccagagagaaaacggucaaaacagccgcaggcgaagaaauuaacgugaaagacguuuuuguauacuacaaaaccauagauagugccaauggcggucuggaauuaauaagccaugaucacagauuuucguuacggggagugggaucacggacguuaaaacgauuugaaaaauaucaaguagacgugcuaggcaauauauauaaaguucggggugagaaaaggguggggcuagcaucgucggcucauucaaaacccggaaaaacuauucgaccucuacaaaguacacgagacuga

SEQ ID NO: 8532 - RNA, 3264 nt, Artificial Sequence
  Cas9 variant
augcgguauaaaauaggauuagacauaggcauaacuucagugggaugggcggucauaaaccuagauaucccucgcaucgaagaucuggguguacgcauauuugauagagcggaaaauccacaaaccggggaaucucuagccuuaccaagaagacuagcacgaucagcuagaagacgacuccgaagacggaaacaccgucuagaacguauaagacgccuaauuaucagagaaggaauauugacaaaagaagaacuggacaaauuguuugaagaaaaacaugaaauagacgucuggcaguuacgagucgaagcauuagaccggaaacugaauaacgaugaacuagcacggguauuacuacauuuagccaaaagaaggggauucaaaucgaauagaaaaucugaacguucuaacaaagaaaacucaacaaugcuuaaacacauagaagaaaauagggcaauauuaucaggcuaccgaacuguaggugaaaugauuguuaaagauccaaaauuugcucuacacaaacgaaauaaaggcgaaaacuauacaaauacaaucgcaagagacgauuuagaacacgaaauaagacugauuuucaguaagcaacgcgaauuuggaaauaugagcugcacagaaaaauuugaaaacgaauacauaacaauuugggcgucacaaagacccguagcaagcaaagacgauauagaaaagaaagugggauuuugcacauuugaaccuaaagagaaaagagcuccaaaagcaacauauaccuuucagucuuuuauugcaugggaacauauaaacaaauuaaggcuaaucuuuccaaguggagcaaggggauuaaccgacgaagaaagaagauuauuauaugaacaggcauuccagaaaaacaaaauaaccuaccaugacaucagaacccuacuccauuuaccggacgauacauauuucaaaggaauuguauaugaucgcggagaaucccgaaaacaaaacgaaaacauuagauuucuagaauuagacgcuuaccaccaaaucagaaaagcgguggauaaagucuauggaaaaggcaaaucgagcucuuucuuaccaaucgauuuugacacauucggguaugccuuaacgcuuuucaaagacgacgcagacauacauaguuaucuaagaaacgaauacgaacaaaaugggaaacguaugccaaaccuagcaaauaaaguauaugacaacgaacuuauugaagaauuacuaaauuuaucauuuaccaaauuuggacaccuaucauuaaaagcgcuacgaucaauucuacccuauauggaacaaggcgaaguauacucaagugcuugcgaaagggcugguuacacauucacaggaccaaagaagaaacagaaaacaaugcuucuaccgaauauaccaccaauagcaaauccaguuguuaugagggcucuuacucaagcuagaaaaguagucaacgcuauaauaaagaaauauggaaguccuguaagcauacauauagaacuagcaagagauuugagucaaaccuuugacgaaagacgcaaaacaaagaaagaacaagacgaaaaucgaaagaaaaacgaaacugcgauaagacaacuuauggaguauggacucacacuaaacccuacagggcaugacauaguaaaauuuaaauuauggagugaacaaaacggaagaugugccuauucucugcaaccuauugaaauagaaagauuacuggagccaggauacgucgaaguagaccacguaauaccauacaguaggaguuuagacgauucauacacaaauaaaguucuaguacuaacaagagaaaacagggaaaaaggaaaucgcauaccagcagaauaccucggaguuggaacagaacgguggcaacaauuugaaacuuucguacucacgaacaaacaauuuaguaaaaagaaacgagaucgucuacuaagauuacauuacgaugaaaaugaagaaaccgaauuuaaaaacagaaaccuuaaugauacacgauacauuucgagauuuuucgccaacuuuaucagggagcaccucaaauucgcagaaagugaugacaaacaaaaaguauauacuguaaacgggagaguaacuucacacuuaagaucaaggugggacuucaacaaaaacagggaagaaagcgaccuccaucaugccguagacgcugccauaguagcauguaccacgccaucagauauagcaaaaguaacagcauuuuaucaaagaagggaacaaaauaaagaacuugcuaagaaaacggaaccacauuucccucagccauggccacauuucgcugaugaacuaagagcccgauuaucaaaacaucccaaagaaucuauaaaagcauuaaaucucgguaacuacgaugaucaaaaauuagagucacuacaaccagucuucgucagcagaaugccaaaaagaucaguaacaggagcagcacaucaagaaacgcuacguagauauaucggaaucgaugaaagaaguggcaaaauacaaaccguaguaaaaaccaaacuaucagaaauaaaauuagaugcuaguggacauuucccuauguauggaaaagaaagcgacccaagaacauaugaagcaauuagacaacgauuacuagaacacaacaaugacccaaagaaagcauuucaagaaccauuauacaaaccuaagaaaaauggggaaccaggaccuaucauaagaacggucaaaauaauagacaccaaaaaucaaguaaucccauuaaaugauggaaaaacuguagcauacaacaguaauaucguccguguugauguauuugagaaagacggaaaauauuacugcguaccaguguacacaauggacauaaugaaaggaauccuucccaacaaagcaaucgaaccaaacaaaccguauucggaauggaaagaaaugaccgaagacuacaccuuuagauucucauuauacccuaaugacuuaauuagaaucgaauuacccagagagaaaacuguaaaaaccaccacaggugaggaaauaaauguaaaagauguauuugucuauuacaaaacaauagauucagcaacaggcggucucgaacuaauaucucaugacaaccgauucucacuuagaggaguaggaucuagaacauuaaaaagguuugaaaaauaccaaguagacguacucgguaauauuuauaaaguacgaggagagaaaagagucggacuagccaguagugcacauucaaaaaccggagaaaccaucagaccacuucaaucaacuagagauuga

SEQ ID NO: 8533 - RNA, 3264 nt, Artificial Sequence
  Cas9 variant
augagauacaaaauaggucucgacaucggaauaacaagugugggaugggccgugauaaaucuagacauaccucgaaucgaagaucucgguguaagaauuuuugauagagcugaaaacccgcaaaccggugaaucauuagcauuacccagaagauuggcacgaucagcucgacgacgccuaagacgucggaaacacagacuugaacgaauaagacgacuacuuauaagagagggagugcuuacaaaagaagaauuagacaaacuauuugaagagaagcaugaaauagacgucuggcaauuaagaguugaagcucuugauagaaaauuaaauaacgaugaauuaguacgcguauugcuacaccuagcaaaaaggagaggcuuuaaaucaaauagacaguccgaacgaaguaacaaagaaaauucaaccauguuaaaacacauagaggagaaccgcgcgauacuuaguggauaccgaacagugggagaaaugaucguaaaggacccgaaauucgcauuacacaagagaaauaaaggugaaaacuacaccaacacuauugcacgagacgaccuagaaagagaaauaagacuaauauucucuaaacagagagaguucgggaacaugagcugcacagaagaguuugaaaaugaauacaucgccauaugggcuucacaaagaccaguagcuucaaaagaugauauagaaaagaaaguaggguuuuguacauuugaaccaaaagagaaaagggccccaaaagcaacuuauaccuuccagucuuucauugcuugggaacauauaaacaaacuacggcuaaucaguccaaguggaacccgaggauuaacagaugaagaacguagauuacuauaugaacaggccuuccagaaaaacaaaauaacauaccacgacauaagaacauuacuacaccuuccagaugauacauacuucaaaggaauaguauaugacuggggagaaucguuaaaacaaaacgaaaacaucagauuucuagaauuggaugccuaucaucaaaucagaaaagcaauagauaaaguauacgguaaaggaaaaucaucaucauucuugccaauugacuucgauacuuuuggcuaugcacucacauuauucaaagaugacgcagauauaagauccuacuuaagaaaugaauacgaacagaaugguaaaagaauagcaaaccucgcaaacaaaguauacgauaacgaacuaauagaagaauuacuaaaccuaaguuuuacaaaauucggccaccuaagucucaaggcacucagaaauauuuuaccauauauggaacaaggcgaaguguacucgucggcaugugaaaaagccgguuacacauucacaggacccaagaagaaacagaaaacaguacuacucccaacuauaccuccuauaguuaauccaguaguaaugagagccuuaacacaagcucgcaaaguaguaaacgccauaauaaagaaauauggaucgccaguuucaauacacauagaacuagcacgugaucuaucacaaacguuugacgaaagacgaaaaaccaaacgagaacaagaugaaaauagaaaaagaaacgaaacagcgauaagacaacuaauggaauacggauuaacgcuaaacccaacaggcuuagauauaguuaaauuuaaacuauggagcgaacaaaacgggagaugcgcauauucacuacaaccgaucgaaauagaaagauuacucgaaccaggcuaugucgaaguugaccacguaauaccauauucaaggucauuggacgauagcuacacaaauaaaguauuaguacuaacaaaagaaaacagagaaaaagggaacaggauucccgcagaauaccuaggaguaggcacagagagauggcaacaauucgaaaccuuugucuuaacaaauaaacaauucucuaaaaagaaaagagauagacuacuaagacuccauuaugacgagaaugaagaaauggaauuuaaaagcaggaaccuaaacgauacaagauacauuucuagauuuuucgccaauuuuauuagagagcaucucaaguucgcugaaucagacgacaaacaaaaaguauacacaguaaacggaagaguuacaucgcaccuaagaaguagaugggacuuuaacaaaaaucgcgaagaaucugacuugcaccaugcuguugaugcagcaauagucgccuguacaacgccaucagauauagcaaagguaaccgcauuuuaccaaagaagagaacaaaauaaagaacuugccaagaaaacagaaccccaauucccccagccauggccacacuucgcagacgaacuaagagcaagacuuagcaaacacccaaaagaaucuauuaaagcacuaaauuuaggaaauuaugaugaccaaaaacucgaaaguuuacaaccaguauuugucagcagaaugccaaaaagaucaguaacaggugcagcgcaccaggaaacauuaagacgauauauagguauugacgaaagaaguggaaagauacaaacaguaguaaaaaccaaacuaucagaaauaaaacuagaugcuucaggacauuuuccaauguauggcaaagaaucugacccaaggacauaugaagcaauuagacaaagacuauuagaacacaauaacgauccaaagaaagcguuucaagaaccgcuuuauaaacccaagaaaaauggagaaccgggaccaauaauaagaacaguuaaaauaauugacacuaaaaaccaaguaauaccguuaaaugacggaaaaacaguagcauacaacucaaauauaguaagaauagauguauucgaaaaagauggaaaauacuacuguguaccgguauauacaauggauauuaugaaaggaguucuuccgaacaaagcaauagaaccaaacaaaccauauucagaauggaaagagaugacagaagacuauaccuucagguuuagucuauauccaaaugaccuaauacgaauagaacugccgagagagaaaacaguaaaaacagcggcuggagaagaaauuaacaucaaagacauguucguuuacuauaaaaccauugauucggcaaacggaggccuagaauuaauaucacaugacaauaguuuuaguuugagaggagugggaucaagaacacuuaaaagauucgaaaaauaucaagucgacguauuagguaauauuuacaaggucagaggagagaaaaggguaggacuagccucaucagcacauucaaaaacaggagaaacaauaagaccacuccaaagcacaagagauuga

SEQ ID NO: 8534 - RNA, 3267 nt, Artificial Sequence
  Cas9 variant
augccuaaagaauuugauccucucaaaccagccaaauauagguuagcuuuagacauaggaucaaaaucaauaggauucgcaauaauauuucuaaaagaagacguaaacaaauuacuaaaacccuaugcaauaguacguaguggaguacgcauauucggagaugguaggacaccagcggcaccuggucaauugggaucaucuuuggcagccgaacgaaggguaaaaagaucgauuagacgacaauacgcaagaaaacgcaagagacugcaaagauuauugagaaaucugaaagaauuggguuucuuuccagaugauucgaaacuaugcaaaucuuuugaagaucuaaacccauaugaacuaagacauaaagguuuaacaaaagaacuaaaaccacacgaguucggcagauuauuaaugcacauggcgaaaaaccgaggauuccaaaguaauagaaaaguagaucuacuagcagacaacauagauucacaagcgaaggcugaaacaucagcaaugaaaucugcaauagcaacccuacaaagcagguuaaacggugaauuugaaacacucggugccuaccuauaugaaagauuuaagaaaggugaaacaauaaaaaguagcaaaacacaaaaaggacaaaaggccgaauaugaguucaguauuagucgcagaaugguaaaacaagaauuugauagacuaugggccgcacaagaacaauuuaaccccgaacuauuuaaugaacaagccaaaaacacacucaaagacacaauauucuuucaacgaaacuuauuaccacaaaaaguaggaaaaugcacuuuucuaccagaacaugaaagagcaaguaaagcacuaccuagcucacaauacuuucguauuauaucggaacuaaauaaaauaucauuuacagacgcagaagguuuaauacuacccauaucauuggaacaaaggaauaaauuauugaaaucauugcgaaucaaacaaaaacuaucauucgauagaauaagaacagaauuaaaccucgauucaacugucuuaauaaaccuugaacacgccucaaaggacucaaucgaaggcgauaaaacaggauaccuccuaaguaaaaaggaauacuuuggcccugcauggagggaucuaagucuagaaacccaagacgccauaguuaccgcguuauuaacccaugaaaaugaagcagaauuaguacaaaaauuaguagacgauuuuaauauagcacacgacguugcaaaagcauuagcuaaugcaagacucgaaagccaauauaugagauuaaguaaagaagcaauagaaagauuaauaccagaacuagaaaaagguguugacagccaggaugguuauaaaguuccaguuaaauaucaugaagcaaccgaagcagccggguucggacaucauagugcacuccaagaaaauugggcugauuuuccgacccuagaucuaaaacaguuacauuccgacgauaacgauaaauauacagucgcggaauuaccacuacccuauuacggaaaaguaauaacaagacagguagcauucggaacaggcgacguaaaugauccaguagagaaaagauucggaaaaauagcaaacccuaccguacacauaugccuuaaccaaguaagaguacuauuagacgaaauaauugcuaaauacggauacccauaugaagucaacauagaacuagcaagagaauuaaaacaaaaucaugaacaacgucaaagaagcauuaaacaacaagccgcaaacaagaaagaaaaugaagaaauaagaagagaaaucaaacaagcauacaaagucgaaaaagcaaggauaauaaccgacucagaaauuagcagggcagacauagaaaaauggagacuauggaggagaucaaaaucaaaacucugcguauacucagggaagaaaauaugcgaaacaaugauacuaaauaaugaaguggaaguagaccacauccuuccaagaucaagaaccggagauaacagcuaucagaauaaaguuuuaguauuaaacaaagcaaaucgaauuaaaucaaaucggacaccaugggaagcaaaagaauuauuugaagcacaaggauggagcuacgaggauauauuaaaucgaaugagagccuuagauaaacaccaauuauucagauucgccgaaaauucaauggauaucugggauaaaaacuaccgaaguuucgaagcuagagccuugaacgacacaagauauauaagcaggguaguaaaagacuaccuuaaagugguaugucauaaagauagaauaguaguaucaaauggagcccacacagccuuaauuagaagggaauuuggacucaaugacuuauuaggaaagaaaggcgagaaaaacagggaugaccacagacaccaugcuauagacgcauguguaauaggcgcacuagaucgaucuaugcuaagaaaauuacaaauagcgauggaaguagcagaaaaacaaaauagcgcaagaaacuucgucgggcuacaggaaccaugguucaacuuuagcacucaaguaaggcggaguauaggacaaauauaugugagucauaaaccaaaccacaacuaugaaggcgaaaucuuugaagcaaguauauacggacucagacuaauuucagauaaaagaacugagaaauacguagggauaaaacguaacccagaaacagguaaaacagauaaaccaaagaaaucugugguagucauaucagacccgaaaacucaaaacagguacggguuacgucauaaauuucauucagaaggacuuccaaagaaauacuacggcuuaaguucaagcucaguauuuuguuuagaaaucuaccgagaugaaaaaggaaacuggcaagcauauacuauaccaagauaugaggcauauaggauaguaaaacggaggggaguaaaugcacuauaugacaacaaacguaguaauuuugaaggaagaccucuaguaaugagauuaaugagggacgauugcauagcauuugagaaaaacggugucaaagaaguguacagaauccagaaaauuaacggauuaaagaaaaacauaacacuaacgagacauuuugaugccaauguggaugacagguaucgacgcaugcuaaaagcucaaaaagcugaaaaagcaggcgaagacuuugacucagaagacuuaugcgaugacuuaguuuucagcucauuuggagcaagcagcuuauacucuaauaaagcaaggaaagugacaauaagcccuaugggaguacuacgagacccuggauucaaaggguga

SEQ ID NO: 8535 - RNA, 3267 nt, Artificial Sequence
  Cas9 variant
augaaaaaauugguccugggccuggauauaggaguagccuccgucggauggggaauuauagaugcagaaaacggagauguccuagacgcaggaguuagguuauucagcucccgcgacgcaucagaaaacgaguccagaaggaccagccgaagacaaaguagaagauuaagcagaaggaagaagcauagacgggaaagaauaaaacaacuauuauuggcacaugauauggacguaugcgacauuguaaaugaaaaccccuaucaacuaaggguuaaaggauuaaacgaaaaacuagaaauauccgagauauacguugcauuaacacaccucgcaaaacgaagaggugucuccuauuuggacgauguuguagaagaagggggcgcaauaaaaucagaacauuuaaacaaaaacauggaagaaauaaaaucuggaaaaaugccaugcgaaauacaacucgaacguuucgaaaaauacgggcagguacgcggaaugaucgaaauaaaucaagauacagaagaaagcaguuuuuuaguaaacauuuucagaacaagcgacuacauaaaagaagcaaaaacaauauuagccacacagcagaaauuccauaaacaaaucacuaacgaauuuauagaugaauauauaaacauaauggccucaaaacgagacuacuucauaggcccaggaaaugaaaaaagcaggacagauuauggaguauacagaacgaacggggacacaugggauaacuuauucgaaauauuaauuggaaaaugcagcguauuuccagaagaaacccgcgccgcacgaaguagcuaugucgcccaagaauucaaucuauuaaacgacuugaacaauuuaaaaauaucaucacuagaaucaggaaaacucagcacaagucaaaaacaugauauuguagaaaaaguaaaaaacaguaaaaaauuugguacaaaagaccuccuuaaauacauagcuucuguaugugaaugcaaaauagaaaauauagacggauguagaaaagacaagaacagaaaaccaauuaugcacaccuucgagaauuacagaaagguacacaacgcauugaacgaagcuggcguagacuuaagauuaagugaagcagacuacgacgaauuaaugaaaauaaugacgcuuaacagugaaacacuagaaauaaagaaacaguguaaagaaaaauuaccacacuuaacagaagauuaucuaaacguguguuuaguccuaaacaaaaaaggcgcuuuuaguggauggcaugcauuaagccuaaaggcaaugaaacugaugaugccagaacuauauggaacaucaaaaaaucaaaugcaaauaauccauacaaugcaacuaggaaaagccuacauaaaaccacuaaaccaacaaaaauacuuaaauagcgaagccaucuuagaagaaaucuacaauccaauagcagcacgaagcauaagacaaaccauaaaaguaacaaaugcaauacucaaaaaauacggaccauuggauaguguaauaaucgaaaugccaagagauuaccagacauccgaagacgaaagaaaaaugauagaaaaaaugcaaaaagaaaacgaaaaagaaaaaaaagcagcauuaaagagagcuagagaagaauauccguuucccgacgaggcauuuagaaaccauaaagaauuagccacaaaacuuagauugugguaucaacaagaucaauucugcgucuacucuggaagaaaaauauccguaguagauuuaguuagaaacccaaaccaauucgaaaucgaccacauaaucccacaaucaguaagcuuagaugauucacucaauaacaaaguauuaugcuucagugaagaaaaccagaaaaaaggucaacaaacaccauuuuauuaucauaaggguaaaucuggaaacuggaccuacgaacaauauaaacuauuuguagaaaaauuguucgacaaaaaaaaaauaagcaauaaaaaaagagaacuauuacuauuugaagaagauauaaacaagugggacguaagaagaggguuuauagccagaaauuuggucgacacaagauacgcuagccgaguaauauuaaauagcuaccaacaauauuucggaaaccacgagauggguacaaaaguaaaaguaguaagggguaaauuuacaucccaacuuaggaaaaaauggaaaaucuucaaagauagaaaugaaucacacucacaccacgcaauugacgcucuaauaguagccgcuacagcaaauuuaagacuauggaaaaaaaacaaacuaggaauaucagaugaaggaaaaguauacgacaaggaaacaggagaaauacuacccuuugaaaaauuaaccgcgucugaguauaacgaaaugaugaauaaagaacccuacuugaacuucaaaacuaagcuccagaacauagaaacaaaaguaaaauacagcuacaaaguaucaaaaaaagugaaccgcaaaauaucaaaugacaccauauauuccacaagagaacgggacgguauugauuacaucgucggcaaaauaaaaaauauauaugacguaaaaacguacaaggaccaauuccuaaaacgcuacaaaaaaaacaaagaacaauuccuaauguaccaacaugacccgcaaacauuugcgauucuagaaagcauaauggcaacauauccugacgcugaaaacccauuccucgcguauaaaaaagaacacggaguaauccgaaaauaugcaaagaacaaagcaggugccccgguaaccucacuaaaauucaucgacggagccuuaggacaaaaaauagaugucacauacaaaaauaaagcagcccuccccaaaaacaaaaaaguuguucuacaguccaucaaaccauacagagccgaugucuacuaugacgaaggaaauaaaagauaccaucuaauugguguaaaguacucacuauucuccuucucaaaacaaggcuauguaauaaacccaauagcauaucaaaaauuguuagaaaaagagcaaauccauagcgaaaugaaauucuguuucagucuauauagggaagacauaauagaaucaggagaagacccggauucauuaacaagauaccgcuucuggaguaaaaacgagaguggaaaaaauaaaauagaggugaaaccuauagagaaaccaaacuuugaagaucgaaaagucauaacuaucaccaaaaaaauaaagauauuaaauaaauaccagacagacguacuuggaaacuccuuuaaagcacaagaagaaaaagacccucggucaaucgaauga

SEQ ID NO: 8536 - RNA, 3267 nt, Artificial Sequence
  Cas9 variant
augaauuacaaaaugggcuuagauauaggaauagcaagcguaggaugggcuguaauaaaucuagaucuaaaacguauugaagauuuaggaguacgaauuuucgacaaagcagaacacccacaaaauggugagucucuagcccucccacguagaauagcccggucagcucgucguagacuaagaagaagaaaacacagauuagaacgaauucgaagacuacuuguaucagagaacgucuugaccaaggaagaaaugaaucuacuauuuaaacaaaaaaaacaaauagacguauggcaacuccgaguugaugcauuagaaagaaaauuaaacaaugaugaauuagcaagaguccuauuacaccucgcaaaaagaagaggauucaaaucaaacagaaaauccgaacgaaauuccaaagaaucuuccgaauuucucaaaaacaucgaagaaaaccaaagcauauuagcacaguacagaaguguaggugaaaugaucgucaaagauucgaaauucgcauaucacaaaagaaauaaacucgauucauacucaaauaugauagcgagggaugacuuggaaagagagaucaaacucauauucgagaaacaaagagaauuuaacaaccccguuuguacagaaagguuagaagaaaaauaccuaaacauauggagcagccaaagaccguucgccaguaaagaagauauugaaaaaaaaguagguuucuguacauuugaaccaaaagaaaaacgagcacccaaggcgacauacacuuuucaaagcuucauaguaugggaacauauaaacaaacuacgacuggucagcccugacgaaacgcgagcauuaaccgaaauugaaagaaaccuauuauacaaacaagcauuuucaaaaaacaaaaugacuuauuacgauauacgaaaguuacuaaaccuaagugacgauauucauuucaaaggacuccucuaugacccuaaaaguagccuaaaacaaauagaaaacauacgcuuucuagaacuagauucuuaucauaagaucagaaaauguaucgaaaacguguauggcaaagacggcauucguauguuuaaugaaacagacauagacacguuuggauaugcucuaacaauuuucaaagacgaugaagauauaguagccuacuuacaaaaugaauacauaacaaaaaacggaaaaagaguuaguaacuuagcaaauaaagucuacgauaaaucgcuaauagaugaauuauuaaaccuaagcuuuucaaaauucgcacaccuuucuaugaaagccaucaggaacauccuaccauacauggaacaaggcgagaucuauucaaaagcuugcgaacuagcaggauacaacuucaccggaccuaaaaaaaaagagaaagcacuacuguuaccgguuauuccaaauauagcaaauccagucguuaugagagcauuaacacaaagcagaaaaguaguaaaugcuaucauaaaaaaauauggcucaccaguuucaauacauauagaacucgccagagaccuaucucacaguuucgaugaaagaaaaaaaauacaaaaagaccaaaccgaaaaucgaaaaaaaaaugaaaccgcaauaaaacaauugauugaauacgaguuaaccaaaaacccaacaggccuugacauaguuaaauucaaauuauggucggaacaacaaggcagaugcauguacucacuuaaacccauagaacuagaaaggcuacuagaacccgguuacguggaagucgaccacauauuaccauacucaagaagucuugacgacucuuaugcaaauaaaguucucguacugaccaaagaaaauagggaaaaagguaaucauacacccguagaauaucuuggacugggcagugaaagauggaaaaaguuugaaaaguucguacuagcaaauaaacaauucagcaaaaaaaaaaaacagaaucuccugcgcuuaagauaugaagaaacagaagaaaaagaauuuaaagagcgcaaucucaaugacacuagauacauaucuaaauuuuucgcgaauuuuauaaaagaacauuuaaaauuugcugacggagauggaggacagaaagucuacacaaucaacggaaagaucacugcccaucuacggucaagaugggauuuuaauaaaaacagggaagaauccgacuuacaucaugcaguugaugcuguuauaguugcaugugcuacacaggggaugauaaaaaaaauaaccgaguuuuacaaggcccgagaacaaaacaaagagagugcaaaaaaaaaggaaccaauauucccacaaccauggccacacuucgcagacgaacuaaaagcgaggcuaucuaaauucccacaagaaucaauagaagcguuugcacuuggaaacuaugauagaaaaaaacuagagaguuuaagaccuguguucguaucucguaugccaaaacgauccguaacaggggcagcucaucaagagacacuacgaagaugcguaggaauagacgaacagagcggaaaaauccaaacagcaguaaaaacaaaacuaucagauauaaaauuagacaaagauggacauuuuccuauguaucaaaaagaaucagacccaagaacauacgaagcaaucagacaacgacucuuggaacacaacaacgauccuaaaaaggccuuccaagaaccacucuacaaaccaaaaaaaaacggugaaccaggaccaguuauacgaacaguaaaaauaauugauacaaaaaacaagguuguucauuuggauggaucaaaaacaguagcuuauaacucuaauauaguaagaacagaugucuuugaaaaagacgguaaauauuauugcgugcccgucuacacaauggauauaaugaagggcaccuugccgaacaaagcuauagaggcaaacaaaccuuacagcgaauggaaagagaugacugaagaauauacuuuucaauuuucguuauucccaaacgacuuaguaagaaucgucuuaccacgagaaaaaacaaucaaaaccagcacaaaugaagaaaucaucaucaaagacauauucgcauauuacaaaaccauugauucagcaacaggaggacucgaauuaauaagucacgaccgaaauuucucacuaagaggugucggaucaaaaacacucaaaagguucgaaaaauaccaaguagacguacuagguaauauucacaaagucaaaggugaaaaacgcguaggcuuagcagcaccuaccaaccaaaagaaaggaaaaacuguagauucacugcaaucagucucugauuga

SEQ ID NO: 8537 - RNA, 3270 nt, Artificial Sequence
  Cas9 variant
augacggcuuucaaaccaaauccauugaacuacauucuagggcucgacaucggaauagcaucuguaggaugggccaugguugaaauagaugauaaagaaaaccccguuagguuaauugaccuugggguaagaguauuugaaagagcagaaaugccuaaaaccggagauucgcucgcagcugcaagaagguuagcacguagcguuagaagacuaacaagaaggagagcacacagauuguuaagagcccgaagacuacuuaaacaugaaggcguauuaaaaccugaagacuuugacgaaaacggauuaguaaagccauuaccauauauaccuaaacaaccucguaauacgccauggcaauuaagggccgcugcacucgacagaaagcugaccccucuggagugggcggcuguauuacugcacuuaguaaaacacaggggauaccuaagucaacguaagaacgaaggagaaacagaugacaaagaacuaggcgcauuacuaaaaggcgucgccgauaacacacacgcacuacaagcagguaauuucagaacuccggccgaacuagcacuaaacaaauuugagaaagaaaguggucacauacgaaaccaacgcggagacuacagucacacauuuucaagaaaagaucuucaagccgaacuuguacugcuauucgaaaaacaaaaagaguuuggaaauccuuauguuagugacgaccucaaaaauggaauugagaaucuacuaaugacacaaaggcccgcacuaucaggagacgccauacagaaaauguuaggacacuguaccuucgaaccagcagaaccaaaagcugccaaaaauaccuauaccgcagagagauuuauaugguuaaccaaauuaaacaaucuaagaauuuuaaaccaagguaaugaacgccccuuaacugacgcagaacgcacaacccuaauggacgaaccguacaagaaaucaaaacuaacauacgcacaagcuaggaaacuauuagaucuugacgacacugcauucuucaaaggcuuaagauacggaaaagauaaugccgaaucagcaaccuuaauggaaaugaaagcauaccacgcaauuagccgagcccuugaaaaagagggccuaaaagauaagaaaucaccacucucguuaucgccagaacuucaggacgagauaggaacggcauuuagucuuuucaaaacagaugaagaaauaacaggaagauuaaaagguugccuacaaccagaaauauuagacgcacuacuuaaacauauaaguuucgacaaauuuguucaaaucucauuaaaagccuuaaggagaaucguuccacuaauggaacagggaaaaagauacgaugaagcaugugccgaaauuuacggagaccaccacgguagacgaaauagcgaagaaacacuuuauuuaccuccaauaccugcagaugaaauaaggaauccaguuguauugcgcgcacuaucacaggcccgaaaaguaaucaacggugucggccgaagauauggaaguccugcaaggauacauaucgagacagcccgugaaguuggaaaaucauuuaaagaccgcaaagaaaucgagaaaaggcaagaagaaaacagaaaagacagagaaaaagcagcagccgaauuucaagaauacuucccuaacuucguaggagaaccaaaaucaaaagacauacuuaaauuaagguuauauagacaacaaaauugcaaaugucuauauagcggaaaagaaauaaaucuaggaagacuaaaugaaaaaggguauguagaaauagaucaugcacuuccauucucaagaaccugggacgauucauuuaauaacaaaguuuuagucuuagggagugaaaaccaaaacaaaggaaacagaacaccauacgaauacuuaaauggcaaagacaauucaagagaauggcaagaauuuaaagccagaguagaaacaaguagauuuccacacaguaagaaacaaagaauacuacuacaaaaauuugacgaggaaggauuuaaagaaagaaauuuaaacgacacucgauacguaaauagauuuuuguguaaauucguugcggaucauaugcaauuaaccggaaaaggaaaaaggagaguauucgcaaguaauggacaaauaacaaaccuauuaagggguuuuuggggauuacgaaaaguaagagcagaaaacgaccgacaucaugcauuagaugcgguaguaguagcuuguaguacaguugcaaugcaacaacgcaucaccagguuuguuagauauaaagaaaugaaugcauuugacggaaaaaccguagacaaagaaacuggagagguacuccaucagaaaacccacuuuccucaaccaugggaguucuuugcacaagaaguaaugauaagaguguuuggaaaaccagacgguaaacccgaauuagaagaagcagauacaccggaaaaacuacgagcucuacuagcagaaaaacuaucaagcagaccagaagcaguacacgaauacguagcacccuuauuuguaagcagagcaccgaaucguaaaaugagugggcaaggucauauggagacaauaaaaucacccaaaagguuagacgaagggauuucuguaguaaggguaccauuaacucaacuaaaauuaaaagauuuagagaaaaugguaaacagggaaagggaaccuaaauuauacgaagcucuuaaggcaagguuagaagcacacaaagaugacccagccaaggcauuugccgaaccauuuuauaagcaagacaaagcaggcaauaggacacaacagguuaaagcgguucgaauagaacaaguacaaaagacaggaguauggguaaggaaccaaaauggaauugcagauaaugcuacuaugguaagaguggauguuuucgaaaaagguggcaaauauuaccuaguuccuaucuauagcuggcaaguagcuaagggaauauuacccgacaaagcaauaauagcuuucaaagacgaagaagaauggcaacuaauagacgacucauuuaauuuuaaauuuccauuacacccaaaugaucuaguugaagucauaacuaagaaagcaagaauauuuggauacuuugcaucaugucauagaggcacagguaauauaaauauaaggauacacgaucuugacaacaaaguaggcaaaaacggcauucuagaaggaauuggaguaaagaccgcccuaaguuuucaaaaauaccaaauagaugaauuaggaaaggaaauacgaccaugucgacuaaagaaaagaccaccagucagguga

SEQ ID NO: 8538 - RNA, 3270 nt, Artificial Sequence
  Cas9 variant
augaacgugagauacaaaauuggacuugacauaggaauaaccagcgucggaugggcagugguaaacuuagauauaccacgaauugaagauuuaggaguucgaaucuucgaccgagcggaaaauccacaaacaggagaaagucuagcacuaccaagaagauuagcaagaagcgccaggcgaagacuucgacgaagaaaacauagacucgagcgaauacguagacuauugauaagagaagguauucuuaugaaagaagaauuagacaaguuauucgaagaaagacacgaaauagacguauggcaauuaagaguagaagcauuggaccguaaauugaacagugaugaauuagccagaguauuacuacaccuagcaaagagaagaggauucaaaucgaaccgaaaaucggaacauaauucacgagaaaauagcacaaugcuaaaacacauagaagaaaacagagcgauucuaagcaguuacagaaccguagcugaaaugaucguaaaagauccaaaguuugcccuccacaaaagaaacaaaggagaacacuacacgaacacuaucgcuagagacgaccuagagagagaaauccaguuaaucuucaccaaacaaagagaguucggaaauaugaauugcacaaaggaguucgaaaacgaauauauagcaauaugggcaucacaaagaccauucgcaaguaaagaugauaucgagaaaaagguaggauucugcacauucgaaccaaaagagaaaagagcacccaaagcaacguacacauuccaaucuuucaucgccugggaacauaucaacaaacuaaggcucguuuccccagcaggaacacgaggacuaacagaugaagaaagaagacuccuauacgaacaagcauuccaaaagaauaaaauaacauaucacgacauaagaacauuauuacgauuaccagacgauacauauuucaaaggcgucgucuaugaccgaaacaugccacugaaacagaaugaaaccauuagauuccuagaauuagacgcuuaucaccaaauaagaaaaguuauagacaaggcuuacggcaaaggcaaaagcucaucauuuuuacccauagauuuugacacauuuggauacgcccuuacauuauucaaagacgacgcagauguaagaaguuaucuccaaaaugaauaugaacaaaacgggaaaccaaugccuaauuuagccaauaaaacauacgacaaugaacuuauagaagaacuucucaacuuaucuuuuacaaaauuuggccacuuaucccuuaaagcacuacauaauauacuaccauacauggaacaaggagaaguauacaguucugccugcgaaagagccgguuacaaauuuacaggaccaagaaagaaacagaaaacaaugcuacuuccaaacauaccaucaauagcaaacccuguaguaaugagggcacuuacucaagcaagaaaaguaguuaaugcaauaaucaagaaauauggcagccccguaaguauacauauagaauuagcgcgagaucuaagucaaacuuucgaugaaagaagaaaaacaaaaagagaacaagaugaaaacagaaagaaaaacgaaacagcaauaagacaauuaauggaauacggucucacauuaaauccaacaggccacgacauaguuaaauucaaacuauggucagaacagaauggcagaugugcuuauucucuccaaccuauugaaauagaaagacuacucgaaccaggauacacagaaguagaccacgucauaccauacaguagaucacuagacgacucuuacacuaauaaaguacugguacucacaaaagaaaacagggaaaaaggcaaccguacgccagcagaauaccuugguguuggaacugagagauggcaucaauucgagacauuuguccuaacuaacaaacaauucucuaagaagaaacgcgaucgacuacucagacuucacuacgaugaaaaugaagaaacagaauuuaaaaacagaaaccuaaacgauacuagauacaucucaagauucuuugcgaauuuuauacgagaacacuuaaaauuugccgagucagaugacaaacaaaaagucuacaccguaaacggaagaauaacagcacaccugagaagccgaugggaguucaauaaaaaucgagaagaaucagaucuacaccaugcugucgacgccgcaaucgucgcaugcacaacuccaucugacaucgccaaaauaacagcauuuuaucaacgcagagaacaaaacaaagaauuagcaaagaaaaccgaaccacauuuuccccaacccuggccccauuucgcagaugaauuacgggcuagacuaucaaaacauccaaaagagucuauaaaagcacuaaauuuggguaauuaugauaacgaaaaauuagaaucauuacauccagucuucguaucaagaaugccuaaacgaucaguaaccggagccgcacaccaagaaacacucagacgauauguagggaucgacgaaagaucugguaaaauucaaacaguagucaaaacaaaacucagugaaauaaaacuugaugcuagcggucauuuuccaauguacggaaaagaaucagauccuagaaccuacgaagccauacgccaacguuuacuagagcacaauaaugacccaaagaaagcauuucaagaaccacuuuacaaaccuaagaaaaauggagaacccgggcccauaauuagaacuguuaaaauaauagauaccaaaaaucagguuguuccuuuaaacgauggaaaaacuguagccuauaacagcaauaucgucagaguagacguauuugaaaaagaugggaaauacuacugcguaccugucuacacgauggacauuaugaaaggagugcuaccaaauaaagcgauagaaccgaauaaaccauacagugaauggaaagaaaugacagaagacuacacauuucaauucucccuuuacccaaacgacuuaauuagaaucgaauuaccaagagaaaaagcaauacgaacauccacuggagaggagaucaaaauaaaagacuuuuucgcauacuauaaaacaauacauucgggcacaggcggaauggaacuuauaucucaugaucguucauucucgcuaucuggcguugggucucgaacguuaaaacguuucgaaaaauaucagguagauguccuuggaaacaucuacaaaguacgaggagagaaaagaguaggauuggcaucaucagcacacagcaaaaccgguaaaacuguaagaccacuacaaucuacccgagauuga

SEQ ID NO: 8539 - RNA, 3273 nt, Artificial Sequence
  Cas9 variant
augcgguggaggcuagguuuagauaugggcgcugguaguuuaggauggugugcaguuggauuagacgaucagggauauccagacaguauuuuagccgcaggaagucacaucuuuggcgaugguagagcaccuucaagaggcgaccagcagggaacuccacucggcguugaaagaagggcagcaaaagcaaugagacgaagacgcgauagauuucucgguagacaagcuaaguuacuugccagauuaacacuagcaggauuauuuccagcagaucccguaagagcaaaagcauuggaauuguuagacccauauguauugagagcaagagcauuagaugaggcacugcccccacaccaacuagguagagcauucuuucacuuaaaucaaagaagaggauuuaagucaaaccgcaaaacugacagagguguugaugacgaggcgggcaagauagcgauuggaauugacagguuacgagcugcuauagcagcugcagaagcuagaacuaugggagaguuuuugcacaagagaagacaaucagccccagacgugaaucagauaccauccgugagaacacgauugaggcccgaaacaggagaagaagcaaagggcgacggguaugacuuuuauccaggaagagaguugguggaagaagaauuugaugccauaugggaugcacaagcaccucaucauccuagccuuuugacaccagacaaucgagcauugcuccacgaagcaauauuuuaccaacgaccacuuaaggcaccuaaaauaggaaaaugcacucuccugaauaacgaaccaagauugccaaaagcucacccauuauuccagagaagaagacuacuugaagaagucaaugcccuacguaucguaagaccaggagaaguagcaacaaaacuaacuugcgaacaaagagauuuacuuauguuaaaauuaaaagacaaggcgaaagucucauuugaaacauugagaucgaaaguauugaaauuagaaccugaagcaagauucaauaaagaaggugaaaaccgaacagagcucguaggagaugaaguaugcgcucaaaugagcgcaaaaacacguuucgguaaagcaugggcacauuucacugacgagaaacguugggcaauuuuaaguagauugauagaagaagaagaugaagaaagacucgauacauggcuaagaacagagcauggacucgaugcagagcaggcgagagcaguagcaggagcaagacugccugcaggcuucggaagauuuggugaaacagccacuagacgcuuaauagcagcuuugcaagcagaaguaaucguguauucagaagcaguuguagcugcgggacuaggacaucacucagauaugagaacaggagaaguacuagccgaacuucccuacuauggaaugacauuggaacgacauuuacuuccaggaacgggggauaaagcugacccugaagaguuaaggauuggaagauuaacaaacccaacuguacacaucgccuuaaaucgacuuagaagaauaguaaauagacucauuaaaacauauggaagaccggaacaaauugcuauagaguuaggaagagaacuaaaauuaacggacgaagauaaacaaagauuaucacgccaaaacaauagaaauagagccgaugccgaagcacgcaguaagaaacucgcugaacucggucaagcagacaauggagcaaauagagcuagauugaaauugugggaagaauuaaaccgagaaaaugcuuuggauagaagaugcauauacaguggacaacaaauaucaauagcaauguuauucucugaugccguugaaguagaucauaucuuaccauuugacgcaacauuagaugauucaaacaauaacagaauuuugugucugcgggaauggaauagacgaaaacgaaaacaaaguccuuaugaagccuggggacauacagacuacuggccagacauugcagcgcgugcagcacguuugccaaaagagaaaagauggcgauuugaacccgaugcaaugcaaagauucagugcagaagauagauuuauagcacgucauuugguagauacacaauauaugucacgcuuagcaagagaauaucuagaagccuuauaccccgaaaaaggcgaaggaucaggacaugucuggguuagccccggacgucuaacagaauuaauaagaagaaaacuaggacuaaacgagcuucuuccagaccacaauuucgcaggaguuaaaaauagauuggaucaccgacaccauacaauagaugcauuugucguagcaguuacagauagaucauuauuacaaggaauaucacgcgcaucagcacuugaaggggaagaagggcgagaaagggugauaguaccagaaccaugggauggcuuccgagaagcacuaagaacuacacucaauacgauaacaguuuggcaccgacaggaucacggaacugcuucgaaagcaggacuagcacaaggaagggaccaaaccgcagguaaauuacacaacgauacugcguauggauuaacagggaggcaagauaccaaaggaaaugauuuggucguaagcagaaaaccccuuaugagcuugaaaccggcugacauugaaccaguaccagauguagcuccaauaacuaaagguguuagggauagagacuuacggaaagcauuagcacacuuuacccaagccacugaaggaaaaggguuuuuacaggcccuugaaagauuuacuagacuaggaccauuacauuuucgaggcauuaggaggguuagacuaauacaacccuuagcuguuauaccuauaaaaggaccaggggguguaccauauaaaggauauuuaggaggcgaaaauuuucgcugugacguaugggaaaugccagacggagccuggaaaccagagguaacaagcauguuccaagcacaucaaccaggguggacuagcgccauaagagcagcuuguccaacagcuaggaaaguauuaaguuuacauaaaagagauaugauagcaauagaacgugaagagggaguacgaacgcuaaugguaguagcucagaucuggucgaauggucaaguuacgcuaguagaaccccacgaagcuggagaucuuaauaaaagaaacaaaagugaagacgacccuuuuggcuauuucaugccaacugcagggggauuaaaaagauuaaaggcgagacaaguuagagucgaugaacuaggaagagugcaggauccuggcuucccagccagaaaagcaagaaggagaacaagaccgaaacaaguagacuga

SEQ ID NO: 8540 - RNA, 3273 nt, Artificial Sequence
  Cas9 variant
auggacuggagacuaggauuagacuuaggggcgaauagccuugguugggcagcuuuacgauuagacagagcaggagacccuauaggaauauuagcaaugggcucacgaauauuuagcgauggacgugacccaaaaaguggcgcaaguuuggccguagauaggagagcagcacgagcaaugcgacggaggagagauagauucaagcaaaggcaagcggcucuacuuaaauauuuaauaagagauggguuauuuccugcagaccaagccgauagacaacgauuagcagaugaagauccauaugccuuacgagcuagagcguuggaugaggaacuaucauuauuugaaauagguagggcacucuuccaucugaaccaacguagaggcuuucaaagcaauagaaaagcugaucgaggacaagaugaugaagcaggaaaaauagccgugggaguagauagacugaaucaacaaauggaagaacaaggggccaggacauuaggagaauuuuuacaucaaaggagacgcgccgcaacugacgcaaaccacauaccaucugugaggacaagauuaagaccagaaaccggagagggagcuaaaggugacggguacgacuuuuauccaucuagagcacuuauagcagaagaguucgaagaaauaugggcagcacaggcaccgcauuacccggauaccuuaacacaacaaguacacgaccguuuauaugaaauuaucuuucaccaacgaccccuaagagcaccacaaguagggcaauguaccuuaguagcaggagaaacaagauugccaaaggcacaucccuuguuucagaaaagacgguuauuagaagaaauaaaugcucucaugauaguucgaccuggugaaauugcccaaagguuaacaccugaagaaagagauacauuauauuuaaaacugaaagacaaaagaacgguaucauuugccacacugagaaaaacauuaaaauuggacagugccgcgagauuuaacaaagaguccgaaaaccguacagaacuaaaaggagaugaaguugcugcagaacuuggagcuaagacacguuuagguaccagauggcaacacuuaucaggagaucaacaaugggaaguuguacaucguuuaauggcucucgaaucacaagcagaugaagcggcauucagagauuggauaagucaaacuuacgauuuauuaccugaacaagcagcugcugugcucggagcuagacuaccucaaggccacggaagauuuggaccuacagcaacuacuacuuuaaucgauucucuauuacacgacagaacugaagacggaaggguuguuguuuacucggaagccguucaaagaucaggauuaggucaucauagugaucuacgacacgaucgugacgaugaagauguaaccgaacuuccauacuaugguguagcauuagaaaggcauauuaugccagguaccgccgaaccaacagauccugaagaaaugaggauagguagauuaacaaauccuacgguucauauaggacuaaaccaauuaagacacguaguaaauagacugauaagggcauaugguccaccaaaagaaauagcaaucgaacuagcuagagaacuaaaguuaagugaagaugagaaaaagaaaagaaauagugaaaaccgagauaauagauuagcagcagaaggaagaucaaagaaauuagaagaaauaagacaaagggauacaggagcuaaucgagcacuuuuaaaauugugggaagaacuuaacccaggaaacguacuugaucggagguguauauauacgggugaacaaauaagcauagacauguuauucucggauagaguagaaguagaucauauccuaccguucgcucaaacacucgacgauucaaauggaaauaaauuauuauguuuaagagaagcaaaccgagaaaaacgaagaaggaguccuuaugaagcauggggacacacagauagguggccugauauugcagaaagagcuucaagguuaccaaaacccaaaagauggagauuugaaccagaugcaaugcaacguuuugcaacugaagauggauuucuugcaaggcauuuaguugacacucaauaucuuggacgauuagcaagagaauaucuaucuugguuauauccaggaagaggugaaggaucuggacauguauggguaucaccaggucgacuaacggaaauggucagaagaaaacuaggccuaaacgaccuucugccagaucauaauuucgggggaggagcagaucaaccaaagaaccgacuugaccauagacaccacgcuauagacgcgcugguugucgcaauaguagaccguggaaugcuucaagcaauagcaagagcaucaggacaagaugguagcgaaggaagagaaaggauucauauaccagcaccaugggauggauuuagagaugauuuaagaguugcagucaauggcaucauaguaucacaucguccggaucacggaacaguagcuaaggcagguuuagcacgagguagagaucaaaccgcaggaagguuacacaacgauacagcauauggauugacaggugaaacggacgcuaaagggaauagcauuguaguaagacgcauuccacuaagcgcaauaaagaaaccagcagauauagcacgaguuagagacccucucuugagaaaugcgcuagcagaauuuacaaaaggucuagaugguaaagcguucgaagcaagaauagguagguuucaugaacugggcccauuauuauauagagggauaagaagaguacgaguuguagaaacuuuaacaguaauaccaauacgugaugcugaaggcagagcauacaaaggauacaaaggugauucuaauuauagauacgauguaugggaaaugccagacgguaaauggagaugccaagucguaaguauguucgaugcccaucaaucgacagaacaagcuagaccacauccagcagcucgaaaaauacuaucucuacagagaaacgacauuuuagcuauagaacgaacagagggugauagagaacuuguacgagugguaaaauuuucggaaaaacaguuugccguagcacccccacacgaagggggcagucucaaaacacgagauggaaaugcagacgauccauuuagauacuuauauccaucgccgaauacgcucaagggauggagagcgagacaaguaagaaucgacgaacuagggagaguacuggauccaggguucccagcaagaaaaaguguaagacguacccgaccacgagcagcaccaguagauuga

SEQ ID NO: 8541 - RNA, 3276 nt, Artificial Sequence
  Cas9 variant
auguacucaaauuuacuauuuucauuugacauuggaaccaauaguauaggaugguguguauuugcauuagacgaagccggugaaccauaucguauaguagaucuaggagcaagaauauacgcugauggccgagauccucagaguaaaacuucuuuagcaguagcgcgaagggaagcccgagcaaugucaagaagaagagacagauaccucagaaggagaaaggcuacauuaagaacaaugauagaauauggauuaaugccaggugacaaagcaggacaagaagccguguuaagagaaacaggugacagagaaggaggagaugaaucauuuaauccauacgcccuacgagcacgagcucuuagcgaaaaacuaccuccagcauauauuggaagaguucuauuucaucuaggucaaagaagagguuuuaaaagcaacagaaaaaccgacagaaaagacaaugauaaagguaaaaucgcauuaggcauagacgaacuuacagccgccaugcauagaagcggaucaccaacacuaggagcuugguuggcaaugcgaagggccgaaggacacaguguacgacuaagagccggaagugagguuuucgaugcugaagguuaugcauuuuacccagaacgaucguuauuagaagaugaguuccgacaaauuugggaugcacaagcgguacaucacccggacauauuaacaccagaaaggagagcccaucuauucaggguaauguucuaucagagaccuuuaaagaaaccccuaguaggaagaugcagcuuuaauccagcggaauuucgacuuuccagagcgcauccucuauuucaagaauuuaggcuauacaaagaaauaaacgacuuagaaguaguacuaccugaucaaucucaucgaaaauugacccuagaugaaagaaacgcucuaguagcuaaacuuaaaacuagccgaaaagcgucauucucagcccuaagaaaaacauuaaaacuaacaccggaucucgucuuuaauaaagaaucagaagcccgaaaggaauuacuaggggacgaaauuuauucaguuuuagcagacgcaaagauguuuggagcccgcuggggaggauucagcagagcuaggcaaugggaaauuauaacccgguuaaaagaagaagaagacccggcaagccuaucauccugguuaaaaucagaguuuggacuagacgacgaacguguaacagcaaucgcaaacgcgaguuugccugauggguauggaagauuaggagaaacugccuuagcaucaauguuagaagaacugaaaaccgcgguaaucccagaaucagaagcagcacgacucugugguuaugaucauucaaaccucgccaaagaacaagaugaaggacuggauacauuaccagaauaucaagaaauacuagaaagacauauuccuccaggaacaggagauccggaugacauauacgaccuaagaaaaggucgcauaaccaacccuacaguucauauaggacuaaaccaacuaagaaggguaguaaaugcguuaauacacagauucgguagaccccaacgcaucguaguagaacuagcaagagaucuacaauuaucugaaaaacagaaagaugauguuaauagaagaauugcuaaaaacacaagggaagcagaggguagaagccaaaaauuaaucgaaaugggacaacuagauacaggauacaacagacuacuuuuaaaacuuugggaagaauuaaaccuagauaaaccagaagauagaguuuguauauauagcggaaaacccauagggaucgccaugcuauuuucaggugaaguagacguagaccauauucuaccauggucaaaaacucuagaugauagccaagcuaacaaacuacuaugucuuaaaagugcuaaccgacagaaacgaaauagaacaccaucagaugucccagaauggcgcgauagauacgacgaagucuuagcgagagcggcuagauuaccuaggaauaaaagauggagauucgcagcagacgcaaugcaacaauucgaggcagagggcggcuuuuuagcaagacaauuaacugauacacaauauuuaucaagaauggcucuugaauauuuaagugcuuuauauccaucugaagaagcugauaaaaguggagaauuaagacaaagaaagagaguucauguaguuccuggcagacuaacagaacuuuuaagacgcaacugggguuuaaauacacuguugcccgaucauaacuuaggagaaauggcgcaagaaaagaacaggcgagaccaccgacaccacgcgauagaugcagcgguaauugguacaacuucaagaagucuauuacaaaggaugucgggggcugcugcaagacuagacgauguugcuuuugaugaccuaguuagaacaguagugaaagauaacccucccuggccgggauuuagagaagaauuauuagcagcuauaggcagaguaacuguaagccauaaacccgaucauggaacggucagucgagcugcauaugcacaaggaaaaggacaaacagcagggaaauuacauaaugacacagccuacggauuaacugggcuaguggaugcgaaaggaaguccauuaguaguaagaagaaaaccauucauggcccucgaaguaaaagauauagccucaauuagagacacugaauuacaaucagcucuguacggagcaauuggaagccuaacagagaagaaagcacuacaagaagcacugauaagauuccgcgauacucauccacaauucaaagguauacgacgaguuagaguacuggagacacucagcguaauaccaauuguagauagagauggaaaagcauacaaggguuauaagggagaugcaaacuaucgauacgaaguuugggaaacauuagauggaaaauggcacacugagguagugucaauguuugaugcacaucaaccaggauggcaaaguccauuccacaaacaaaauccagcagcaagaagaguacuaaaacuacaacaaaacgacauggucgcauacgagcacccugcagauggcuauacaauagcaagagugguuaaauuuaguaaugauaaacgaauauauuucgcuucacauagggaaagcggaagucuuaaagcacgagaugcagauaaaggcgauccauucaguuauuuugcuaaggcaaauaauggccuccgagacauaaaauguagacaaguuagaauagacgcagcagguagaauauucgauccaggaccgcaggaucgugaaacuagacaagcgaacaaagguguauga

SEQ ID NO: 8542 - RNA, 3279 nt, Artificial Sequence
  Cas9 variant
auggcauauacgaugggaaucgauguuggcauugcaucuugcggaugggcaauaguagaccuagaaaggcaaagaauaauagacauaggaguaagaacauuugaaaaagcagaaaauccaaaaaauggagaagcauuagcaguaccaagaagagaagcacgaagcucucgacgaagguuaagaagaaaaaagcaucgaauagaacggcucaaguacauguuuguacguaacggauuagcaguagacauacaacaccuagaacaaacguuacgcagccaaaaugaaaucgauguuuggcaauuaagaguagauggguuagauagaauguuaacacaaaaagaauggcuaagaguucuaauacaccuagcacaacgcagaggauuccaaagcaaucgaaaaacagacggauccuccgaagacggacaaguauuaguaaacguaacagaaaacgacaggcuaauggaagaaaaagauuacagaacaguagcagaaaugauggugaaagaugaaaaauucucagaucacaaaagaaauaaaaacggaaacuaucacgguguaguaucaagagcuuccuuacuggucgaaauacacacacuguucgagucccaacgucagcaccacaacuuccuagccagcaaagauuucgaacuagaauauauaaauauauggagcucacaaagaccaguagccaccaaagaccaaauagaaaaaaugauaggaacaugcacauuccuaccaaaggagaaaagagcgccaaaagcaucauggcacuuccaauauuucauguuauuacaaaccauaaaucauauaagaauuacuaacgcacaaggcacucgaccguugaauaaagaggaaauagaacagguugucaauauggcacucaccaaaucaaaaguaucauaucaugauauuagaaaagucuuagaccuuagcgaggaauaccaauuuguuggcuuagacuacggaaaagaagacgaaaaaaaaaaagucgagucgaaagagaccauuauaaaauuagaugauuaccacaaacuaaacaagauuuucaaugaaguugaauuagcaaaaggugaaacuugggaagcgguagauuaugacacuguggcauacgcacuaacauucuuuaaagacgacgaagauauaagagauuaucuccaaaauaaauacaaagacaguaagaauagacuuguaaaaaacgucgcaaauaaagaauacacuaaugaauuaauagaaaaaguaaguacacuaagcuuuagaaagguaggacauuuaagucuuaaagcucuacgaaaaauuauaccauuccuagaacaagggaugacauaugacaaagccugccaagcagcaggauuuaacuuccaagguaucaguaaaaaaaaacgaagcguaguacuccccgucauagaucaaauaaguaaucccguaguaaaccgcgcacuaacucaaaccagaaaaguaauuaacgccuuaauuaagaaauauggaaguccugaaaccauccacauugaaacagcuagagaguuaucaaaaagauucgaugaacgaaaaaauauaacaaaagauuauaaagagaacagagauaaaaacgaaagagcaaagaaacaccuaucggaacuaggcauaauaaacccaacaggacuagacaucguaaaauauaaauuauggugugaacaacaaggaaggugcauguauaguaaccaaccaauaucauuugaaagauuaagagaaucagguuauacugagguugaucauauaauuccuuacucgagaucaaugaacgauagcuauaacaaucgagucuuaguaaugacacgagaaaauagggaaaaaucuaaucagacaccauacgaauauaugggaaacgacacccaaagaugggaugaauuugaacaacgaguaacuaccaacccccaaauaaaaaaagaaaaacgccaaaaccucuuauuaaaaggcuucacaaacaggcgagaacuugaaaugcuagaaagaaauuugaacgacacaagacacauaacaaaauaccuaucgcacuuuauaaguacuaauuuagaauucucaccaucugauaaaaaaaaaaaagucguaaacacuagcggacgaauuacaagccaucuucgaucgagauggggccucgaaaaaaauagagaacaaaacgaccuucaccacgcaauggacgcuguaguaauugccgucacaagugauucauucauccaacaaguaacaaacuauuauaaaagaaaagaaaggagagaacuaaauggagacgacaaguuuccauuacccuggaaauucuucagagaagaaguuauagcaagauuaagucccaacccaaaagaacaaauagaggcacuaccaaaucauuucuacuccgaagaugaacuugcugaucugcaaccgauuuuuguuucaagaaugcccaaaagaaguauaacaggugaagcacaucaagcccaauuccgaagaguaguagguaagacaaaagaagguaaaaauauaacggccaaaaaaacagcacuugucgacauaaguuacgauaaaaauggagauuuuaauauguacggacgagaaacagauccugccacauacgaagcaauaaaagaacgauacuuagaauuuggcgguaaugcuaaaaaagcauuuaguacagauuuacacaaaccaaaaaaagauggaacuaaaggaccauuaauaaaaucaguaagaauaauggaaaacaagacacuaguccacccuguaaacaaagguaagggaguagucuacaauaguucuauugucagaacugauguauuccaacgaaaagaaaaauacuaucuccuaccaguauauguuacagacgucaccaaaggaaaacuaccaaacaaaguaaucgcugcuaaaaaaggauacgaugauuggauagaagucgaugauucauuuacuuuucuauauagccuauauccaaaugacuugauauucauuagacaaaacccaaagaagaaaauaucacuaaagaaaaggaucgagagccauucuauuucagacaguaaagaaguccaagagaucuuaacauacuacaaaggaguggacuccaguacggcagccaucgaauuuauaacgcaugacggaucauauuacgcaaaaggagugggaguacagaaccucgacuguuuugagaaauaccaaguggauauacuuggaaauuacaguaaaguaaaaggagaaaaaagauuagaacucgaaacaucggacaacaaucacaaaggcaaagacguaaauaguauuaaauccacaaguagauga

SEQ ID NO: 8543 - RNA, 3279 nt, Artificial Sequence
  Cas9 variant
augaaauauagcauaggauuagauauagguauagcaagcguaggauggaguguuauaaacaaagauaaagaaagaauagaagacaugggaguaagaauuuuccaaaaagcagaaaacccuaaagacggcaguagccucgcuagcucaagacgagagaaacgagguucccgacgacguaacagaaggaagaaacauagauuagaucgcaucaaaaauauacuuugugaaucaggguuagucaagaaaaacgaaauagagaaaauauauaaaaaugcguaccucaaauccccaugggaacuaagagccaaaucauuagaagcaaaaauaagcaacaaagaaauagcccaaauucuacuucacauagcaaaaagacgaggauucaaaucuuucagaaaaacagacaggaaugccgaugauacaggcaaacuacuaucggguauacaagaaaacaagaaaauaauggaagaaaaaggauacuugacaauaggggacaugguagccaaagacccuaaauucaauacccacgucagaaacaaagcaggaucauaccuauucagcuuuagccgcaaauuauuagaagacgaaguuagaaaaauacaagccaaacaaaaagaacuaggaaacacacacuuuacagaugacguacuagaaaaauacauugaaguauucaacagccaacgaaacuucgacgaagggccaucaaaacccagcccauauuauucagaaaucggacaaauagcaaaaaugauaggcaacuguacauuugaaucaucagaaaagagaacagcaaagaacacauggucaggagaaagauuuguauuccuacaaaaacuaaauaauuuuagaauagucggauuaaguggaaaaagaccacucacugaagaagaaagggauauaguagaaaaagaaguauaccucaagaaagaaguccguuacgaaaaacuacgaaaaauacuauaucucaaagaagaagaacgauuuggagauuuaaacuauagcaaagacgaaaaacaagauaagaaaacagagaaaacuaaauuuauaucauuaauaggaaauuauacgaucaagaaauuaaaccuuucugaaaaacuuaaaucagaaauagaagaagauaaaaguaaauuagacaaaaucauagaaauacugacauuuaauaaaagcgacaaaacaauagagucaaacuuaaagaaacuugaacuuagcagggaggauauagaaaucuuacugucagaagaguucaguggaacucuaaaucuaagccuuaaagcaaucaagaaaaucuuaccauacuuagaaaaaggccuaucauacaacgaggcuugcgaaaaagcagacuaugauuacaaaaacaacggaaucaaauucaaacgaggagaauuguuacccguagucgauaaagaccuuauagccaacccgguaguauugagagcaauuucgcaaacaagaaaaguuguaaaugcaaucauaagaaaauauggaacaccacauacuauccacguggaaguagcgagggaucuagccaaauccuaugacgauagacaaaccauuauuaaagaaaauaagaaaagagaauuagaaaaugagaaaacuaagaaauuuauaucagaagaguuuggaaucaaaaacguuaaaggaaaacugcuacucaaauacagauuauaccaagaacaagaaggccgcugcgcauauucuagaaaagaacucagucuaagugagguaauauuagacgaauccaugacagacauagaccacauaauaccauacucaagaucaauggacgacucauacucaaacaaaguauuaguauuauccggagagaacagaaagaaaucaaaccuauuaccaaaagaauauuucgaucgacaaggcagagacugggauaccuuuguuuuaaacgucaaagccaugaaaauucauccaagaaagaaaucaaaccuguuaaaagaaaaauucacaagggaagacaacaaagauuggaaaagcagagcgcuaaaugauacaagguacauaagccgauuuguugcaaacuauuuagaaaacgcauuagaauaucgggacgauagucccaagaaaagaguuuuuaugaucccaggacaacugacagcacaauuaagagcaagauggcgacuaaauaaagucagggaaaacggugaccuacaucaugcauuagacgcagcaguuguagcagucacagaccagaaagcaauaaacaauauaucaaacauuucgagauacaaagaacuuaaaaacugcaaagacguuauaccaagcaucgaguaccacgccgacgaagaaacaggagaaguauacuucgaagaaguaaaagauacaagauucccaaugccauggucaggguuugaucuagaauugcagaaaagauuagaaucagagaacccaagagaagaauuuuacaauuuauuaagcgacaaaagauaucuaggaugguuuaacuaugaagaaggauuuaucgaaaaacuuagaccaguauucgugucacggaugccaaaucgaggcguaaaaggacaagcgcaucaagaaacaauaaggagcagcaagaaaauaucgaaucaaauagcaguaagcaagaaaccacuaaacucaauaaaacuaaaagaucuagagaaaaugcaaggcagagauacggacagaaaacuauacgaagcacuaaagaacagguuagaggaauaugacgacaaaccagaaaaagcauucgccgaaccauuuuacaaacccacaaauucaggaaaacgaggaccucuaguacgagguaucaaaguagaagaaaaacaaaacgugggaguauacgugaauggagggcaagcgaguaacggaucuaugguucgcauagacguguuuaggaaaaacggaaaauuuuacacaguaccuauauacguccaccaaacguuacucaaagagcuuccgaacagagcaauaaacggaaaaccauacaaagacugggaccugauagacggaaguuucgaauuuuuauauuccuucuacccaaacgaucuaauagaaaucgaguuugggaaaucuaaaaguauuaaaaaugauaauaaauuaacuaaaacagaaauaccagaaguuaacuuaagugaaguacuaggauauuaccgagguauggacacaaguacaggagcagcgacaauagauacccaagacggaaaaauucaaaugagaaucgggauaaaaacagucaaaaauauuaaaaaguaccaaguagacguacucgggaacgucuauaaaguaaaacgagagaaaagacaaacguucuga

SEQ ID NO: 8544 - RNA, 3285 nt, Artificial Sequence
  Cas9 variant
augaaaucaaccuuagcuauagccagcauuucaucccuagguuggguuauagaacuaggagaaaacagaauaaugagauugggauuagacauuggaucaaccucaauagggugguggauauaugaaacaacagauggucaaauaaccucaguuaucgaugggggaguacguauauuuagcgauggaagagauccuaaaucuaaaggaaguuuggcuguagaucgacgaguagcucgagcucaacguaggagaagagaccguuauuuaagaagaaaagcggcauugaugaaacgaauggcagaaguagguuugaugccauccgauccaaaacaagcuaaacaacuggaggcuuuagacccauacgaauuaagagcuagaggauuagaugaaacucuugaacucacagaacuaggaagggcccuuuuccacuugaaucaacgacgagguuucaaauccaauagaaaaacggacgcuggagauaaugaaucaggaaaaauaauagacgcgacugcucgacuggacugggcaaugagagaccauagagcacgaaccuacggugaguuccuacacaugagaagacaaaaagccgauacaccccgaacaacgccggcaguaagaacaagauuaaccauagcagcaagagacggagcggaaaaagaagaaaguggauaugacuucuauccugauaggcaacaucuuagggaugaguucgaugcgcuuugggaagcacaagcagaauaucauggcguauuaacagaagacuuaagggaugaaauugguacaauaauauuucaucaacgucccuuaaaaaccccuaaaguuggaaaaugccuauucacaaacgaagaaagaguagccucagcacaccccuuaaaucagagacgaauacuuguagaaacaguuaaugcgcuaagaguagcacaauuaggagaaguagcuagagcauugacucucgaagaacgagauacaauuuuacacgcacuagauaauaaagcccauacaaaaaguuuaaguggcaugagcauaaaacugaaagcacuaggaaaaguaauaaaacuacgaucaggccaauacuuuacacuugaaacagcaaauagggaugcgauagcaugugauccaguuagagcaucacucucaaaacccgauagaauuggaagcuauuggaguacccucgaucauaacgcacaaugggaaguaguuaaucgaauaagagcuguucagagugaugcagaucaucgugaauuaguagcuuggcuaguaucacagcauagacuugcugcagaacaugcagaaggagcugcguaugcaccauuacccgauggauauuccagauuaggaaucacggcaacgaagagaauauuagcagcguuagaagcgaauguaauuccuuauagcaaggcaguugaaaguugcggcuggcaccauucggaugaaagaacaggggaaguccuggauagauuaccuuauuauggagaaauauuagaccgucauguuauaccgggcacauaugaugauagugaugaugacauaacuagauuugggagaauaacaaauccaacaguucauauuggucuaaaucaguuaaggagauuagucaauagaauaaucgaaguccauggaaaaccagacgaaaucguuguagaauuagcacgugaucuaaaauuaucacaagaucaaaaagcagauguagaacgaacaauaaagaaaaacacccaggcagcaauaagacguggagaaaaauuagaagaaaugggaguaccgaauacuggagggaacagaaugguauuacgauuaugggaagaucuaaaugaugaugauguaaugaaaagguucuguccuuauaccggacaaagaaucagugcagggaugcuuuuugaugggaguugcgauguagaucauauuuuacccuuuuccaggacacuagaugauggauucacaaauaaaacauugugucucaaagaagcgaauagaaagaaacgaaauuacgcaccucaugaagcagcugaaaaagggcugcuagacagggacgcgauggacagugucgcuaaauaccuccccgacaacaaagcauggagauuugcuccugaugcuauugaaagguucgaaggagaacgagacuuuacugcaagagcgcugaaagauacacaauaucuuuccagauuagcgcguaccuaucucgacgcgcuuuaugaugggggagaugacaaaagucauguguggguaguaccgggucgccuuacugaaaugcuaaggagacauugggguuuaaauggacuagaagccuuagcagacucagaugagaaaacaguuaaaaggaaaaauagaacagaucacagacaucaugcaaucgacgcggcaguuguagcagcaacagaucgaaguuuaauacagaaaauaucuaaaauugcagcuucugaugaacaagcuggugcagaagacacguuaaaaucaacacccccgccaugggauaguuuccgagaugacauagcugcacaauuacaaaacauuacaguaagccacagagccgaccacggucgcaccgacaguuuagccaaaggaagaggagaagacacuacaagcggagcauuacaugaggccacagcacuagguauaauagacgaaacacacguuacaguaaggauuccaauagaaucacugaaaucuggucauuuaauagaaggaaguagaaacggauauauaagagacccauaccuacgugaucaacuaacucuagcaacuaaaaacggaagcgauaaagacuucacaacaguacuucaaaaauucuucgacagaaguaaaagguacgguggaacuagaaggguacgaauaauaaaaacucuacaggauacggcucgaauuucaguaccacauaacgcacccauaaaagcauacaaagguggcucaaaucacgcauuugaaauauggagacuuccaaauggaaaaauugaaucacaagugauaacaacgugggaacaucauaaucuaacagaaccaaaacguccucauccagcagcuaaaagaauaauacgauugcauaaaacagauaugguugcuauagaaagagauggaaaaacuguuauaugcuucgugcaaaagacagacccaucaaacggagccuuucuaguaccccauuucgaagcaaaugcagauggaagaaaaaggaaaaaugaaccagucgaaugguaucaaaugucagcaaacagcuuaauuaaagcagacuugagaagagugggaguagacgaaauggguagaguaagagauccaggcccaccgccaauuagguga

SEQ ID NO: 8545 - RNA, 3285 nt, Artificial Sequence
  Cas9 variant
augaaguacagaguaggauuugauuuagguacaaacagucuuggaugggcaguaguaagauuaaaugcaucaggagaaccagauagaauagagguagcgggcagcagaauauuuucagauggccgcgaaccuaagaguggagcaucgcuagccggugcaagaagagaugcacgagcaaugagacgacgccgagacagauuuaaacaaagacaagcagcacuaauuaaguaccuaacucaagcugguuucuuuccggcagaugagagcgaacgaaaggcauuaagugcacucgaucccuaugagcuaagagcaagagcauuagacgaggcgcuaccauuagcacaccugggacgagcguuauuucaucuaaaucaaagaagaggauuuaagucaaauagaaaaacggacagggggaaaaacgaugauacaggaaagauuagaauaggaguagcgagacuguaugaacagaugagagaugcagacgcgcggacauuaggagaauuucuccauaaacguagagcggcugcaagugacccaaaugcaauaccccauguaagaacuagaauaguuacauuagcagcggaagacggaaaagcaagugacguauaugacuuuuacccagaucgccaaacauuggaagaggaauuugaagcaauaugggaagcucaaacgucacaccauccagaagcauuaacagaagaaagacgagcucaauuuuaugaaauuauauuucaccaaagaccauuaaaacaaccuaaaauuggcuuuugcacacuuuuaccgcccgaaaaacgauuacccaaggcacauccacucuuccaacgacguagacuauuagaagagguaaacgcuuuaaggauaguauuaccggggaaagaaacucgagcauuagaaaaagcggaaagagaugccuuacuaucaaaauuaaaccaaagaaagaaagcugcauaugaaucccuacggaaagcauuaaaauuggauccggacgcacguuuuaauaaagaaagugacaauagggaagauaugauaggagaugaaauugcggcggaaauggcacauaaaucaagauuuggaaaaguaugguuagguaugagugcagaggcucaagcacaaguaauugaaagacuaagaggacuagaaagcgaugcugacgcagaugauuucgaagcaugguuaagagacgaccauggauuagcgcaggaacaagcaaaagccguuacagcggcaaaccuaccggaaggguauggaagguucggugaaacagcuacuaggaaacuaaucgcagcguuagaacaagaaguaauuguauauucagaagcaguccagcgggcagguuuaggacaucauuccgaucugagggauggucaaguauggacggacaagaaaggaaacccagcauuaccauauuauggcgcaguucuugaaaggcacauagucccaggcacagccgauccaaaugaaacggaugaugcccuaagaauaggucggcuaacaaacccaacuguacauauagggcuaaaucagcuaaggaggguaguuaacgcauuaaugcguagauacggacaaccucaagaaauagcuauagaacuugcuagagaguuaaaauuaucagaugaucgcaagaaagaaauuaacacaaggaacagagaaaauagaaaagcagcagagaaaaggagccaaaaauuaagaaauauaggacaagcagauaaaggagguaauagggccuuacuaaaacugugggaagaacucaauccagaaaacguacuugauagaagaugcguauacacgggacgaguaauuaguauagacauguuauuuucgggggcagcagaaguugaucauauacugcccuucagcgugaguuuggacgacucuaacggaaaucgaauccuuuguuugcgagaaguaaaucggaucaaaagacaaaggaccccaugggaagcaagagaugacuuacgugcccauuuuggcccugaugcaggaugggaagcuauagcggcgagagcagcucgauuaccuagggaaaaacguuggagauucgaaccugacgcugcuaaccguuucgacgcucaaggcggauucuuagcaagacaucuaaccgacacacaacauuuaagucgauuagcuaggaguuauuuaagugcucuauacccagaaacaggagaagguagcggccauguuugggucucgccgggaagacuaacugaaauguuaaggagagcauggagccucaaucaccaucugccagaccauaacauugcuggagcugcaaaccaaccaaagaacagaaaagaccauagacaucaugccauagaugcaauaguaguagcauuagccgacagagcgaugcuaaauagaauagcacgagaaucuggaaaagaaggccaugaagcagcuggaagauuagucgccagcauacccgaaccaugggaaggauuuucugacgaaguaggacgagcuguacgagcaauaaccguaagucaccgaccugaucacgguacagcaaguaaagcaggacgagcuaaggacaaagaugcaacagcaggaagauuacauaacgaaaccgcauauggauuaacaggggagaaagacgcucggggacuggauauaguaguaacuagaaagccauuauccgcuuuuaagaaaagcgcugaucuugaugcaauucgagacgaugaucuaaaacaaaaacuaaaagcaugggcugcaggaaaggaaggaggagcauuugaacaagcaaugcgaucauuuggagacccagaaagaggaccaagaucacacccaggauugcgaagaauuagaguuacagaaccguuaagugugauaccaauaagagaccgggauggcagaccauauaaagcguauaaaggagauaguaauuacagauuugauauaugggaacuaaaaacagguaaguggaaagaugaagugguuagcauguucgaggcucauagaccgaacuggacuucacccaucagagcuggaaauccaacagccagaaaaguuuuaagcgucagacaaaacgacguaauagcaauagaacgagaaaauggcccagaacuaaugcgaguaguuaaguuuagcgcaggaucauuagcuuuggcaccaccccaagaagcuggaucuuuaaaagcuagagacgcagauaaaaacgacccauuuaaauauguauaugguagcccuagcaguuugcaaagauggaaggcuagacaaguuagaauugaugaacuagguagaguauucgacccuggauuugcaguacgaucaaggagaagcagugaauga

SEQ ID NO: 8546 - RNA, 3291 nt, Artificial Sequence
  Cas9 variant
augaaaaauauauucaguuuugacaucggaacaaauucuauuggaugggcaguguuagcucuugauggaaauggugauccuguacguaucgcugaugcaggcgugcgaauauuuucagacgggagagauccaaaaucaaaagcaucuuuagcugaagcaagacguauggcaagagcaaugucaagaagaagagauagaacacuaagaaggaaacgagcgacacuaagaacauuggccgaaauaggacucaugccagacaccucuagugcaagacaagcacaguuaagagaaacauccgaucccaaaucaggcagcggucaauuaacgagaaauccauaugcacuaagggcacuagcauuagaagaaaaacugccacuauuccacauagguagagcauuauaucacuugggacaaagaagaggcuuccagaguaauagaaaaaccgauagaaaagauaaugacaaaggaaaaauugcuuuaggcauugaggaauuacaugcagcaaugcgccaagauggagcacaaacuuauggccaauggcuagcaaggagacaugcucuaggucaagcaguaaggcugaggucaggggcauuagaccuugaaggagaagguuaugcuuuuuauccagaacgaaaauuauuagaagacgaguuccaucgaauuugggaagcucaggcaagacauuacccagacauacugacaccggaacgccgagaccacuuauuuacaguaauguucuuucagagacccuuaaagaaaccaaaaguagguaaaugcaguuuuaauaaucaggaggaaagguuaucaaaagcacauccauuauuucaggaguuuagacuauauaaagaagugaacgaacuugaaauaguagaacccgauuuaacacacaagaaacuaacacuggaucaaaggaaugcgcuagucaagaaacugcaaguaucacgagaagcaaguuuugcggcucugcgcaaaguccuaaaacuaaggccugaucaacgauuaaacaaagagucagaaucucgcacaaaacuaaaaggaaacgaaguauacgcaguauuaucugauaaaacaagguuuggaccuagguggggaacauuuagccaggcagaacagugggcuauaaucgaacgauuaaaagaagaagaagauccaggacguuuguuugcaugguuaagaagugcuuucggaauagaaggggagcaagcagcagauaucgcaaauguccaucuaccagaagggcauggaagauuaggaaaaacagcuuuagaagcgaugcuagaagaauuaaaagccgaagucaucacagaagcagaagcugcuaaaagguguggauacgaucaugcaagguuaggagguggaucugaugaaggagaaccugaacucccgccauaccaagaaauauuacaacacagaauacccccagguacaaauaauccagaugauccauacgacauagaaaaaggacgauuuacaaacccgacaguacacauagcguugaaccaauuacgccaugugaugaauacauuaauaagaagguaugguaaacccgcucaaauagcgguggaauuagccagagaucuaaaauuaagugaaagacaaaaagaagagguaaacagaacaauagcaagaaauacaagagaugcagaaagaagaggaaaaacacuggaagagaaucgcauaccaaauacaggauauaaucguacuuuacuaagauugugggaagaguugaauccagguaaaguagaggauagauguugcauauauacgggaaaaccaauaagcauaucaauguuauuuucgggagagguagauauagaccauauacuacccuggaguagaacuuuagacgauagucauggaaacaaacuccuaugucuuagagaagcaaauagagucaaaaggaacagggcuccugcugauguaacggaauggagagauaacuacgaugaaauauuaucuagggcugcuagacuaccgcaaaauaaacgcgacagauucgcaccugaugccauggaaagauuugaaaaggccggaggauucuuggcacgacaauuaacagacacucaauaccuaaguagaauggcguuagaauacuuggcuuguuuauuucccgccgaagaaauggauggauuuggagaacuacgaaggcaucgauauauaaacguguguccgggacgacuaacagaaauguuaagaagaaauuggggacuaaauaguauacugagcgacucucaauuaggagaaaccgcccaagagaaaaaccggaaagaccauagacaucaugccauagacgcaauaguuauaggagugacaggcagaucauuacuaaauagaauaucauacgcugcuggacguuuggaagcucaacaacuagaaacgcuaguuaaagaagcugcugcaacaaauaaaccgugggacggauuccgagaagauguggccaaaguaguaggagguauaauaguaucacauaagcccgaucauggaacagcagguagaaaagcaaaagauccagcuagacagcaaacugcgggcagauuacacaaugacacagcauauggacuaacaggagaaacggaugcaagggggaacacgauaguaguaagaagaaagccauuucuaucgcuaacaucaaaagacauaccaaguauaagggacgaagcccuaagagcaguacuggaacaacauuuacgagguauuccagauggaaaggcuuuccaagccgcauuagacgcuuuucgaaaacaaaaaggauuucaccauuaucacgguauuaggcacguaagguugacagaaccgcuaucaguuaucgggauaaaagauagagacggaaaaguguauaaaggauacaagggagaugcaaaccaacgauaugaugucugggaaacacucgacggaaaauggcaugcagaaguaguuucaauguucgaugcacaccaaccaggauggcaaagccguuuccaugccgaaaauccuacugccagacguguacuaagacuccaacaagacgauaugguugcauuaaaugcgccagauggagggagacuccuagucagagucguaaaauuuagacaaaaugggcaaauuaccuucgccggucauaacgaaaguggaaauuuaaaagcgcgagacgcagccaguaaugaacaagacccauucaaguauaucucaaggauggcaucaaguuugaaagacugcggaugccgacagguaagaauagaugcaacaggucaaguguuugauccagggccacaagaucgagcaucaagguuacaaaaacaaucuaaaagauga

SEQ ID NO: 8547 - RNA, 3294 nt, Artificial Sequence
  Cas9 variant
augaagaaacaaccacaaagguauauccucggacuggacuuaggaauagcaagugucggaugggcucuuauccucguagacggagcggaaaaucccguuggauuacuagauugcggaguccgaacauucgaaagagcagaaguuccaaaaacaggagacucauuggcacuagccagacgccaagcgagaucagucagacgacuaauccgaaggagagcacacagacuacuuagacuaagaagacuauuaaaaagagaaggcauucuaagcgccgccgacuucaauucagacggauugccuaaccuaccaauagaugcauggcaacuaagaguagcaggauuagaacgaaaauuaacaaaccaagaaugggcagcugucuuauuacauuugguaaaacaucguggauauuuaucacaaagaaaaucagaaacacaaacagaaaacaaagaauuaggccgauuacuagccgguguagccgaaaauucaaaacuauugagcgaaaguuccgaacaauacagaacgccagcagaacuugcgguuaaauuguucgcagaacaaucuggacauuuaagaaauaaagggggagaguacacucauacauuuaaucgacuagaucuacaaaaagaauuacaucuguuauuugaaagacaguaugcacuaggaaacccuuuugcaucagcugaauuacaaaguaaaguagacgaguuauuaaugacacaaagaucagcccuccagggggaagcuguacuaaaaaugcuagguaaauguacauuugaaccaucagaauacaaagcagcgaaaaauacauacucagcagaaagauuuauauggcuuacaaaacuaaacaaccuaagaaucuuauacaacggcgaagaaagagcccuugaugaaggagauaggaagaaacuuuuagaugaacccuauaaaaaggccaagcucacauacaaacaaguuagaucaauccuaaaucugccugaaagcgcaguauuuaagggacuucgauacggaaaagauagugacggcuugaaagcagaaaauggaacauuaauggagaugaaagcauaucauaaaauucguacaauacuugauaaagccggacuaaaaggagaaugggaaaauagaauaagaaauccagaaaucuuagauaaaauaggaaccgcauucagcuuauauaaaacagacgaagauauacaagccgcacucgcagaucuccgccuacccgaaaauguccuugacgcucuuuuagcgggacugaauuuugauaaauucauacaacucucccuaaaggcccuacgaaauauauugccauuaauggaaagagguauacguuaugaugaagcauguaaggaaguauacggagaucauagagcauuagccgaaaguaaaaaccaaguauuacuaccaccaauuccugcagacgaaauucgaaacccuguuguauuaagaacauuaacucaagcaagaaagguaauaaaugcuauaauaaggagauauggaaguccacaacguguccacauagaaacggcccgagagcuugguaagaguaaacaagagagagacaaaauagauaggaaaaauaaagaaaaucaaaacgauagaaacagauuagcaagcgacauaagaaaacauuuuaauuucgaaccuacaccgaaagacauauuaaaauuaagacuauaugaacaacaacauggaaaaugucucuauuccgaccuaagggaagaaaagggagaauguuuauauacgggcaauguaauugaauugcauagguuauucgaagacggauacguagaaauagaccaugcauuaccacuaucaagaacaugggacaauucacugaacaacaagguccuugugcugaaaucuagcaaucaaaauaaaggaaauaaaacaccuuaugaaugguuggacggagcaaauaauucaagaagguggagagaguuccaagcacggguucaaggaugccauuuccccuacguaaagaaacaaagaauacaaacagccaaacuagacuccaaagcagaacaaggauuucuagaaagaaauuuaaaugauacacgauauauuucuaaauucaugugccaauuuauuaccgcuaaucuaaggcucgcagagaccucaaacgcuuuaauggaagaaguagcaggagaaaauccguacuggaaagagagaaaacgacaacgagucuucgcgccuaguggaagcauaaucgcacuauugagaggucucuggggcuuaaagaaaguucgagaagauaacgaucggcaccaugcccuagaugcaaucguaguagcaugcaguacuguuucaaugcaacagaaaauaacaaaagcaaugcaaagaagagaaacccucgaaacaguagauagugaaacgggagaaguaaaaacaagaauaccucaaccaugggacuucuuuagacaagaaguaaugauaagaguauuuucagauucaccuagagaggaacuagcagaaaaacugaacucgagaccagaagcacuccacgauuuuguaucgccauuauuuguaagcagagcaccaaaccguaaaaugacaggucaaggucauuuggaaacaguaaaaagugcaaaaagacuaagcgaaaauauauccguaguuagaaaacccuugacugcccuuaaauuaaaagacauugaaaacauaguuggguacccagaucgagaaccagcauuauaccaagcucuuagagaaagauuacuagcacacaaagaugauccgguuaaagcauucgcggauaaaccauucuauaaaccagcaaaagacggaggccaagguucucucguaaaagcaguuaggauaauagaaaauacaaaacauggacuaaaaauaagaaacgggauaacagauaccaacggugauauggucagaacagacgucuaucaaaagacagauaagaaaggcaaacggcaauacuucauaguaccugucuacgcauggcaaguggagaaaaacgaauuaccaacuguagauugcaaaggauaugaaauugacgacaacuacgaauuuuguuuuucacuauauaaauaugacuuaauagaaauacaaaacccaaaugauauaaaucaagaacuaagagcauacuacauuaacugcgacaguucggauggcagauucugguuagcauaccaugauaaaucagcuaaagaacaacaauuucgcauuucaacacaaaaucaaccaauaauaaagaaauaucaaguugacacauuaggaaaagagauacgguuauguaaagcugagaaaagaacagcacucaaugggaaaaagaagaaauga

SEQ ID NO: 8548 - RNA, 3294 nt, Artificial Sequence
  Cas9 variant
augggaaaaggagauauauuauuuucauuugacauaggaacuaacucaauagggugguguguuuuugcuuuaagugacaauggagacccauguagaauauuagaugcuaacgcuagaaucuuugcugacggaagggaaccuaagucaggaaauagucuagcagaaggaagacgagccgcaagagcaauggcaagaagacgagauagguacaaaagaagacgaaaagccguuuuaagaacauuaacagaauauggacuaaugccggcagaccccaaagcaagacaagcacugguagcuaaaacgggagaccgagggcccaaaagcgaagaagcauuagcugaugucuacaguuuacgagcaagggcguuaauggaaaaauuaccguuacaccacauagguagagcauuauuucaucuaaaccaaagacgggguuucaagucuaauaggaaaacggacagaaaaucgaacgaaaaaggagcaauagaaacaggaguuaauagacuauuagaagaaaugcgugacacgggagcaccaacauuaggcgcauauuuagcuaaaagacguucagacggaagaccaguaagaguacgagcaggagcuucagaacaagaggcagaagauggaaaaccagcaaaaacagcauaugauuucuacccaguaaggcgguuauuagaggaagaauuugacgcaauaugggaaaaacaauauaguuaucauccugaaguguuaacggaagaaagacgaggucauuuauucagaguuauguuucaucaacgaccgcuaaaaccagcaauaguaggacgcuguaguuuuaauagcgcugaaacgagacuagcuaaggcucacccauuauuucaggaguucagacucuauaaggaagugaaugaauuagaagugguuaugccagaccaaagccauaggaaacuaacuuuaccagaaagggaucgcuuaguauugaagcuaagaggacaacgaaaagccacauaugccgcauuaagaaaagaguuaagacuuagagauuuaagguucaauaaagaaacggaaaauagaacggauaugaugggagaugaaguaacagcggcauuagcagacaaagcuguuuuuggaaaucgauggagcggauuuagcacugaugagaaguggaggauagucgaaagacuuagagaagaagaagauccauuugcauuacaugaaugguuagugagcgaacauggguuaagugaugcugaagcggaacaagcagcuaaaguucaucugccagacgguuauggacgacuaggaccaacagcaguaucaacgauguuggaagaauuaaaggcagauguaauaacagaggcagaugcagcaaggcuagcagguuacgaucacaguuuagcuagagcagacgaagacggauuggacagacuaccaaaauaucaagaaguacuugaaagaagaauaccucccggaacuaacgacccagaugauccauacgacauugcuaaaggaagaauuacaaauccaacaguucacauugcauuaaaucaguuuagacauguaguaaacgccuuagcaagaagauuugguaagccggaucaaauagcgauagaguuagcaagagaauuaaaauuaaaugacagacaaaaagacgaagugaacagagucaucggcagaaauacuagagcagcagcuuuaagaucacagaaacuuagagacauuggacagaaagauaacgguuauaaccgagcauuauuaaaauuaugggaagaauugaacccagauaagccagaagaucgaguuuguguauacaccggacgaccuauuugcauaaguaugcuauucagcggagaaguagauguggaccauauacuaccauggagucgcacaauggacgacagccaagcaaaucgaauuuuauguguuguagaagcaaauagaguuaaagcaaacagagcgccagcagaaguugcagaauggggaggaagauaugacgaaauucuagaaagggcagcccggcuuccucgaaauaaaagauggagauuugcaagagacgcaauggaaaaauauaaagaaaaugagggcuuccucgcaaggcaacugaccgauacacaauaucuauccagauuagcgagggaauacgcagaggcauuguauccaacagaagaaccagacagacuaggggaacuacgaagaagaaaccauguucggguuauacccggaagacuuacagaaauguugcgacgcgguugggguuuaaaugcauuauuaccugaucauaauuuuggugcgggacaagcaaagaauagaaaagaccacagacaucaugcaauagaugcagcagugguaggaguaacuacccguggucuccuccaacgaauaucaacagaggccggucuaagagagaaacuagcacuugaggaaacaauagcagauauaccaaugccauggccaggguuuagagaagaacuuaaagcugcgauagacagagcaguaguaagucauaaacccgaucauggaacacuaccaaagccuggagaacacgguagaacagcgggacaacuacacaaugacacggcguacggaauaacaggagaaacagaugcaagaggaaauccgauaguggucaggagaaaaccauucuugucccuuacagauaaagauauaccaaguauaagagauacagaauuaagaggacgaguguauucggcaacaucaggccucucuggaagggaacuaagugcagcauuagauuacuuuaggaaaacagauaaacaauuucgcgggauucgacacguaagaguaacugaaagccucucaguuauaccgauucgggauagagauggaaauauuuauaaaggauauaaaggagacgcaaauuuuagguacgauguaugggaauuaccugaugguaaauggaaagcagacguaguaacaauguucgaugcgcauagaccagaucgugcagcagaagaaagacggccucauccggcagcaagaaagguacuaucauuaaaacaaaaugauaugguggcaugugaacacccaaaagauggguauacuauaggaagaguagucaaauucaauacagccgggcaaauauauuuugcggcucauaaugaaggagggucucuaaaagcacgcgacgccgauagagcagauccauuuaaguauuuuucuaaaagugcuaguggauuaaaagaaauagcagcuagacaaguaagaaucgacgcaacgggacaaguauuagauccagguccccaagauagggaaucaaggcucgcuaggaacaaacguuuggaaagagaaagggcauga

SEQ ID NO: 8549 - RNA, 3303 nt, Artificial Sequence
  Cas9 variant
augaaauacaccauaggucucgauauaggaaccaguagugucggauggggcgucaucgauaccgaaagaaaucgaauacaagauuugggaguccgacucuuugaaagcgcugaaaaccaaaaagauggugaaagccuagcaaaaccacgaagagacgccagaagcaugcggagacgccuagcuagaagagguaguaggcuugaaagaguaaaaucgauuuucgaaaaagcaaaauuucuaacaagaggacaaaugggaauaacucacgcacgaccaaacgacccauauagacuuagagcagaaggccuugacagacuacuauccaaugaagaccuuuucauugccgucuaucauuuggcuaaacgacgagguuauaaaucaaauaggaaaaauguacuagaaggagacggcgaagacguaagagaaggaaaagccguacuagauggagucgcccaaaacaagaaacucauggcuuuuaggggcuaucguacagucggagaaauguuuuucaaagauucaguuuucacagaagcaaaaagaaacaaagcaggaagcuacaaacacugcguccuaagggaaaugcuagaagacgaacuugguaaaauauuacaugcacaaagaucacucggaaacacauuagucacagacucauucauaucaaaacucuuagaaaagaaaaccgguguauucguuuaucagagaccuuuugcaagugguaaucaaaucuuaaaauuaguaggaccaugcacauucgaaccagaagaaauacgagcugcaaaagccacauacuccuuccaauacuuuaauguacuccagagacuaaacaaccuuacaauuaaaaauacagauacaggaaccgagagaaaauuaaccucagaagagagagcaaaaaugaucgcauuuauuuuuagccacaaagauguacaauaugcucaaauacgucuagaacuuaaacuaucagacguugacagauucaauaugguaaauuacuuuguucaaagaaaagaauuagaaacuaaaacugcagaagaauuaagaagagaaauugaaaagaaaacaaaauucccaucauuaucagauuacuauacuauaaggaaaacaguaucugaaaucgauucagcauucuggauccaaauugaaaaacaacacgacguaauagaugcaaucggagaaauauucacauuauauaaaacagacgaagacauaauugcucaacuaaacacuagaauaccaucaauaccaagaccaguaguuagcgcauuauuaggacuauccuuuacaaaauuuggacaucuaagccuaaaagcccuacgaaaaauaaucccccauuuagaaaacggagauacuuaugacguagcaugcgcaaaagcagaucccaaauacaccgaucgagccaaaacaagggcgcgaaaauugagaccucuagauaaagaggaucauucaauaacuaauccaguugcaagacgagcaauagcgcaaacaauaaaaguaguaaacgcaauuauagauaaauaugacuccccgagugaaguucauauagaacucgggagagaucucgcuaaaaacuucaaagagagaaugaaaauucaaaaagagcaaaaacaaaaucaagaaggaaaugaaagagccauagcaaaaauucacgaacucuacaaauuagaaaauccgagaggacaagauauuauuaaauuccgauuauggaacgaacaaaacggacagugcauguauagcggcgaacggauugacgaaauaagacuauucgauaacggauauacagaaauagaccauauaauuccguuuuccagaucuuuuaaugacaguuacagcaauaaaguauuaguauuaaaaaugaggaaccaggagaaaaugaacaaaacacccuacgaauacaugggaggagacgcugauacauggcagcgcuucgaaaauuugguuaauuccaugcacaauaucggaccaagaaagaaacaaaauuuacuacuaaagaaauacgucgcggacgaccuaacuuugagaacuuuaaaugacacaagguucauagcccgauacaugaaaaacuacauugaaaacacucuacuauuuacugaaggcccucagaaacaacggguauauacaguaaacggacaagcaacugccuaccugcgcaaacgauggguacuacacaaagacaggaccgaaaauaacagacaccacgcacaagacgccguuguuguagccguagcaacacccucucugguacaaggaauuaugagacaugcaaaaaugggagaaauaguagauuacuugcauucgcaaaaauucgcaccaaacgugacagacauagaaacaggcaaaccauuugaauccgccgauauccaaucugcaaaagaaagaaucauagcgaaacaugaacaccgacuaagaauaccagaacccugggaaggcuuuagcgaugaacuagaugcaagaaugggugaugauguaguugaaaaacuaucuuuaagaaaaucaaauauucacggcuacaaaacaacaucugauuuuucacaaauacauccaauuuucguaucaagaaugccaaaaagaaaaaccacugguagagcucaccaagaaacuuuaagaucaccacgaagauucaaagaauuucaagaaucaguuguacgcacaccauuaucuagcaucaaccuaaagaaauuagaagagaugucagggaaaaacagcgacaaauuguuauacgacauccucagaaaaagacucuuagcacacggagacgauccuaagaaagcauuuacagaaccaguacauaaaccacgaaaagauggaacgcaagggccauuaguacguucaauaaaaaugguuagcgaaggacaaagaagcgguauucuagucaacaacgaacaagcauuaguagaccaagauucaaugauacgaauugacauauuuagcaaaccaaacaagaaaggaaaagaugaauacuauauaauaccaguauaugcauaccauuucgcacaaaaagaacuaccaaauaaagugauaacagcaaaagcggaggcggauuggagaacaauagaugauacauucgcuuuugaauuuagucuauauccaaaugaccuaguaaaauuaacaaaaggagacgacauaagguuuggauacuacucaggaugcaacagagcacuggccgcuauccacauacucccacacgaucaaaacaugccucuagugaauaacgggauaaaaacauuagacaaaauagacaaauaugucguugauauucuaggagaguaccauaaaguuggaaaagaaacccgccaacaaauacaguga

SEQ ID NO: 8550 - RNA, 3303 nt, Artificial Sequence
  Cas9 variant
augggugcuacuauuguuacagauauauccagaucagccuucgcauucgacaucggaacaaaaucaauuggaagcgcaguacucagacuagaugacaggggugaaccaauuggaauuauaaaugcagcuguuagaauauacgcggacggaagggagccaaagaguggaacaagucuugcagaaggaagaagacuggcuagagguaugagcagaagacgagaucgauauaagcgaagaagacguacucuauuaaauacucuaaccgaauuuggauuaaugccuccaacagaugaagcaagaaaagcccuacuagcagaaacaaacgauagacgauucggcgcaguugccggaaauguguaugcucugagggcucgugccuuagacgaaaaauuaccauuacaucauuuaggucgugcgcuguuucaucuaaaccaaagaagaggcuuuaagucuaaccgaaaaacagauaaacgcgacaaugaucaaggaaagauagcaucagguauaucgaggcuaggucaaaaauuggaugaagcuggcgcaagaacgcuaggcgaauuuuuacaccgacaacauagugcagguaaauggguaaggguaagaccaaguagaguaccaaguaaggaugauaaagaagaagaugguuacggauucuacccagaacgaaguuuucuagaacgggaauuugcagcaauuuggaaagcacaagcagcauuuuacccagaacuacugaccgaagaaagaggcgaucauuuacacagaguaauguucuuucaaagacccuuaaagcgaccuaaaguaggaaaauguucauuuuacccagaugaagauagacuuccgaaagcacauccacuauuucaagaguuuagauuaguaaaagaacucaaugaacuugaaguaguucaucgaggggaucguagagaaaaauuaacacucgaacaacgagauacuuuauuuaaucaauuaaggacucaacggagcucugcauuuacugcauuaagaaagacauugaaagcgccaacagguacgagauuuaauaaagaauccgaugcaagggacaaguuaaagggggaugaaguagccgcagaaaugucgcauaaagauagauuuggacaagcauggauuggaaugccacucgcggaacguugggccguaauagaaauguuacucgacacagaagacccacuagagguaaaagcauggcuugaagaacacuauggguuugcagcagacagaauagaugcuauugcggcagcaaaauuaccaccggguuacggaagacuaggugaaacagcauuaagagauauguuggaugaacuaaagaauggaacuguuaaagaugauucaggaagagauguaguauuaacagaaagacaagcaauggauaacauauggaaagacaacccagcgcuacaaagaguuguagccgacgccagagaauuaccucccuaccaagaaguuuuaggaagaaggaucccaccaggaacugggaaaccagaagauccguaugauguacaaaaaggaaggcuaacuaauccaacuguacacauuggauuaaaucaauugaaaagaguuguaaaugcauuagugagaagacauggcagaccagaucaaauagcucuugaauuagcaagagagcugaaauuaaacgaagaacaaaaagcagagaaggacagagaaauagcgagaaauacgaaggcagcacaagcacgaucagaaaaacuaagacaauuagauauugaugauaauggauacaaucgaguacuauuaaaacuaugggaagacuuaaaccuaagacagccagaaaacagagaaugcaucuauugcggaaaagcaauagguauugguacguuauuuucaaaucaaguagauauagaccacauauuaccuugguccaaaacccuagaugauagccaagccaacaggaucguuugucacguagaauguaacagacaaaaagggaaucaugccccagcagaaguuccucaauggcaugaccguuaugacgacauuuuagcaagagcagaaagauuaccaaggaauaaagcauggcgauuugggagggaggcuaugaagaaauuuaaagacgaugagucauuccucgcacgacaacugacagauacacaauaccuaucgagaauggcacaugaauaugucgcagcacuauacccagacgaagaaccagaugaguggggaguuuucacacgcagaaaccauguaaggguuauaccaggaagaaugacagaaauguugcgacgucaauggggacuaaaugcgauuauaagugaccaugaccagaaaaacagaaacgaucauagacaucaugcaaucgacgcaauugucguugguguaacaacgagaagacuacuacaaagaauugcaacagcugccggagggagggaagccuuagcacuagaggaaacaauugguaaaauagaaccaccuuggccaggauuuuaugaugacgucaaagaagccauagacagaauuguagucucacauaaaccagaucaugggucuuuaccaaaaccaggggagccagcacguacagcuggacaacuacacaaugauacugcauacggauuuacuggagaagaaagaaaaggaguacccauaaugguccaucggguaccuuucgcaaccuuaaccgaaaaagauauaccaucaauucgagaucgacaacuagcggaagcauuguacggcgccauugcgggaauaucaggcaaggcagaacuagccgcggccuuagcaagguucagcgcgagugguccguacaaagggauaagacaugugcgcguuguagaaccuguaagcguuauagcaauaaaggacagggacggaacacccuauaagggauacaaaggagacgcaaauuacagauaugauguaugggaacugccuaauggaaaauggacacaugagguaguaagcauguucgaugcccauagaccagacuggcaauccgaaauaagaaacaaaaauccagccgcacgaaaaguuuuaaguuuacaccaaaaugauaugguagcauaugaacauccacaagacggauacacaauuggaagaguaguuaaguuugguucaggcggacaaauggcauuagcgggcaaucgcgaagguggugcauuaaaaaguagagacgcggauccagaagauagauucagauacuucuacaaaucaggaggagcaaugagggaugcuagacuuagacaaguaagaguagaugaaacagggcgaguauuugauccuggaccccaggauagagaaagcagaaaugcgcgaaaacaaucagccgcaggcuga

SEQ ID NO: 8551 - RNA, 3306 nt, Artificial Sequence
  Cas9 variant
augaaaacgcuaggccuagaucuaggcacgaauagccuaggcugggcaauaguagaaacgagagacgaaccuacaaaauacucagaagguaguauaguagcaagcgggguaagaauauucagccagucagaaauggccggucgggacccacaaaguaaagcaucuuuagccguagcuagacgacaagcgcgaggaagucgaagacgaagggauagauauuuaaaaagaagacaaaggcuaguggauuuacucguagaucuaggacuaaugccagcugacaaagcagcaagagccgaauuaguuaaaaaucauggagacggaaaaacaggagaucugucaucaucgguauacgcacuacgagcaagggcgcuagaugaagcacucucuccauaugaaauagggagagcgauauuucaucucaaucaaagaagaggauuuaaaucaaauagaaaagcggacucaaacgaucccgaacaaggcguuauaucagaagguaugagggcuuuggaugagaaaauggcagaagcgggagcgagaacaauuggagaauggcuacacaugagacgucuucaaggacuaccaguuagagcaagaauagcacccgauggugaaggauacgcauuuuauccuucaaggggagcacuggaaagagaguucgaccggauaauggcuaggcaaacucuauuucacacugauuugcuaacugauacugcaauaagagaauuaagagaaguuguauuccaucaaagaccccuccgaccuguuaaaccuggcaaauguaguuauaacccacuugaagaaaggcuagcaaaagcacauccauuauuccaaaaauuuagacuccuaaaagaauugaaugaauuggaaauaguaggggaagaucaaaaacacauaaaacucacuccggaacaaagaaacgccuuagcguuacaauuacggacaaguuuaacgaaacaaggaaaaguuccauuuagcaaauuaagaucaacauuaaaauuagggagagaaguuagauuuaacaaagaaacagauaacagaagugauuuagaaggggauguaaucuacuuuagaaugucaagaccagaauguuucgggaaucgaugggcugaucuuccagucgaaaugcaggcugcaauaacagaaagacuuaggacggaaccagacuauaaaacucuaaugaacuggcucaaagcugaaacgggguuagaugaaguucaugcuagagccgucgcggauaccccuguaccagacgguuuuggaagguugggacaaagcgcguugacugcauuaauagaugcacuugagaaugaaguuggcgaagguggguucgucauaacugaagcugaagcugcuaaacgaguauauggacgaaccaauucagaagcugauccggacagaaaaggcguagaugaacuuccaaaauaucaagaaguacuagcaagacacauaccuccaggaacaggagaaccagacgacccauaugacgauuucaugggaagaauaacaaauccaaccguacauauagcauuaaaucaacugagaaggguaguaaaugcucuuauucgaacuuauggaaaaccugaucggauagcaauugaaguagggcgagaccuaaaaaugaaugaucgagaacgagacgaaguaaauagaagaauaggaagaaauacuaaagcagcuauagaaaggggaguaaaacuaacagaaacauuuaggcaguuagacaccgguuauaaucgucucagauuagaauugugggaagacuuaaaucaaaagccagagaauagaguauguaucuauuguggaaaagcgauagcaggacauaugcuauuuaauggggaaaccgacauagaccauauauuaccauauaguaaaacacuagaugauaguaaggcaaaucgaauacuauguugcacaaguuguaauagagaaaagaaaaauaggccuccaagcagaguaccccaauggagaucaagauacggagagauauuagcucgagcaaccacucucccaaagaauaagcaauggagauucgcagaggaugcaaugacuagauucggagaagaggaaggauuucuagccagacaacuaacggauaugcaguauauaagcagauuggcuuuaacuuaccuagcacacuuauaugacuacgaagaaguugacuuagauggaauauacaaaagacacgcaaggguacgugcucuaccggggagaaugaccgaaauguuaagaagacaauggggacuaaacgaauuacuucaugaucauaauuuaauaggaggagauguggcaaaaccuaaaaacagauuagaccaccgacaucaugcaauugacgcaauuguaaucgcuugcacaucaagagcucuaauacagcgacuggcaacagccucggcagcagcugaggaacgaggagccgaaagggugguagaaagaaucgacccgccauggaguggauuucgagaagaugucagggcagcaguaggagcuauugugguaagccauaaaccggaucaugguaccgugggccgugaaggcuacgcuaaaggucgaggacaaacggcggguaaauugcacaaugauaccgcuuaugggcauacaggugaaaaagacgcuucaggaaaugauauaguaguucguagaauagccgucacugauauucgauccccagcagauauaaggaaaauaaggacaaaugcacauggacacuccgaguuaagggaccgcuuauaugaagcaaccagaggauuagaaggaaaagcauucgaacaagccguacuagacuuuguuaaaggggaugccaaauuucgcggaaucagacacguaagaauaacggaaguagccaacccaguguggauaacucacggggauggaaggcacaagaaaggauauuuaccaggaggaaacgacagauuugauguaugggaauuagccgauggaagaugggaugcagaaguagugacaaccuuugaugcccauagaccaggauuuguaccucguaugcgauuagaaaaucauaaugcgcguaaaauaaugucguuaaagaaaggcgauaugauagcuuauaacgauccgguaucaggucaacguauaauugcaauaguuagaaaauuugaccagcguaacaaacaauuauacuuagauccucacaacgaagcagggaauuuagauagacgagaaaaagagaaaacuuauaaaccucuaaggccaaugccuaauccguuaaagaaauauagaccaagacaagucaggauagaugaaauaggacaaguauucgauccaggcccguggugggaacgacaagaugguuga

SEQ ID NO: 8552 - RNA, 3306 nt, Artificial Sequence
  Cas9 variant
auggaacaaacaaguuuagauuuaucacaagcaaugaaaaagguagcacaaccucaaaaaccauacagauuaggagucgacguaggaguagcaagcaucggcgccgcagcaguuacagacacugaaauuuuggggauucacguaagaaccuuugagaaaggagaaauaaacggaaaaaguggaagaaaaccuuuaaaugcagacuaucgaaggcaaaaaggacaacgcaaaagauugagacguaaaaagaaccgacuacuuucguuaagaagguuauuuaggagaguugggaugauagaaagugccgcaaucgaagcauucccuauaucgaguacaucucccuggcaacucagaacagaaggcuuagauagaagacucacaaacgaagagugggcacaaguacucuaccacauagcuaaacauagagguuuucaaucaaauagaagaguagauauggaugaagcuacaaaauuaucugacgcagcaggggauucacccgaaacaacaaccaacacagaauccgacagugacacgaagaaaaugcuugccggcguagcugauaacaaaagacuacuagcagaaaaaggauaccgaaccauuggagaagcugucgccagagauccaaaauucucccacagaauuagaaauaaagaagaaaguuauagucacaccauaggucgugaugagauaaaugccgaacuaaauugccuauuucaagcacaaaaccauuacggaaauccucaugcuaccgaggaacuguccgaacaaauaaucgauuuaauaaauuggagacggaagacgguaacuggggaugauauaaaacguaugguaggaagauguacauuagaaccaaaagaauacagagccgcaauacacucagucagugcagaagaguuccguuggcuaaguacacuaagcagacuucgaaucgucacucaaggcgaaagccgcccauuaacaaaaugugaaugggauaaaguuguagauuuacccuggagacaagaagcaaucacauacacgucaauaagaaaugcuauaggccuucgacacgacaucagaucaagauucaauauaagauaugaaacgggaggcaaaaagacaaaaacagauacuaaaaaugaaacaacuaagggacaaucagcagacgcagucacuucagaagugaaaacugcagaaaaagaaacagcuuucaaagcaaaaggauaccauauacuaagaaaagcauauaaagcauuugguuacgaugaacaaugggaucgagauagguucaauaccgaacuacuugauacacuagcaacugcgguaaccuuuuacaaagaugauagugaaauacaagcacaucuggaaacaaaugacacaccagaguacgcaauacaaauagcacuaagguuaccuacauuaaccaaauucaguaaacuuucaaauaaagcaaucuugaaaauccugccucacaugagagaacggcaaucauacuccaacgcaugucuauuagccgguuacaaaaaucaccauaagcaguaugacgauacaccacaaaauggaaaaauaccaagaagugcaauagaacauauuaaaaacacaguagucuacagaucacuaaaucaagcacgcagagucauaaacgcuaugguuaaagaauacggagcuccacaagaaguccacauagaacuggccagagauauggagaaaagcgccaaaaagaaggacgaaauugaccuauggaugaaaaagagaaagaagaaaaacgacgagcugagagaaagauucgguaaaaaccuauccagagacgaauuauugaaauauaaauuauaugaagaacaaaacggacaaugcgccuauagcuuacagccuauacaacugggucgacuauuagaacccaacuauguagaaguugaccaugcguuaccuagaucccgcucuauggacaauucuuauaauaauaaaguccuaguauuaacgaaacaaaaucgagauaaaggagaucgaacacccuuugaauacuuuggagaagaucaagaauccguagauuggaaacgauuuacuaauuggguagaaagcaauccacaaaugccacaagcuaaacguaggaaauugcucacaaaaucauuacaaaagggaaucuuagauaauuuuucagccagaaaccucagugacacaagauacauagcccgagaacuaaaaacauuaauagagcacuauauacuaaacacuccugaacgagagaaaacaaaauacgaaagaugcguaguaauauccggaaaacuaacagcacaaaugcgacaacucugggguauuaguaaagcgagggauguauccgauaggcaucacggcucugaugcagcaguaaucgcauguauaacacccaguaugguacgaagaauuacaagauaucugcaacugcaagaaagacgagcaaugccgucagccccaggaaaaggggaugaacacccagcaguagucgccagagcaaucccccacgcucccgugccauggcccacauuugaacaugaucuagaagcagcguuagagaaaguccuaguaaguagaccacaaucgagaaaauggucgggcccaauacaugcagauacaauuuacggggaacauaaagaucaggagacuaacaccguagcaccgacccaaagaauaaagcuaacacaauuaacaaaaucaaacuacaaaaacauagucggauacgacgaagagagaaauaaagauuucauagaucagauugaagaaagauuagaaugccauaauuucaauggaaaacaagcauucggaacaucacagaguccaauauauagaauaaagaaaaacggggagcuuggaccggaaguaaagaaaguaaccaucaaacucccaauuaaaaacucgguauucagaauaagaagaggauauguuaaaaacgcgaaaaauagcacaauauauauaaacauauaccagaauacaaaaacagguaaauuugaaaugcacccaguauaugcaaaagacuuaacauccagcgcuaaugcaucaaaaucauucgaauacuccccagacuuacagcuagucgauacuauaagaagaggagacuacauagaaauaacuaggcgaaauggagaaguaauuucgggauauuacgcuacucauaauauaucaacaagcguacuugaauuacaaccccaugacacaacagauucacgaaacaauagaacuccagcaaucaaaacaucucucaauauagaacguuuccauauagacauccuaggacgcaaaagacgcgucguacggagggcuaaaaacggacuagcagacgacagagauaaauga

SEQ ID NO: 8553 - RNA, 3309 nt, Artificial Sequence
  Cas9 variant
augggauaucgaauaggacuagauauuggcauaacuucaguaggguacgcaauacugaaaaccgacgaaaaaggaucaccauacaaaauagaacaucuaacaagcguuaucuucccaauagccgaaaacccuaaagacggcaaauccuuagcaaugccaagacgagaacaacggggagccagacgaagaaauagaagaaccaaauuucgaaaacacaggacaaaaaugcuuuucguuagaagcgaacuauuaaccauaaaacaaauagaagcaaucuacagcgaaaaacaaaaauuauccucaauauacgaacuucgaacuaaagcacuaaaugaaagacucaccaaugaagaauuauuuagaauauuauacuucuuuagcgggcacagaggauuuaaaucaaacagaaaaagugaauuaacagaaaaagauaugggaccaguacuaacagcgauaaaagauauagaagaaaaauuagcagacgggacauaucgaacucuaggagaauauauggaauuagacgaaaaauaucaagaacacaaaaggaauaaagacggaauagaccguuacuuaggcacugccaaaagaagccuaauagaagaugaaauaaaacaaauaauaaucgcacaacaacaauucggaaacaccaaacuaacuucaggauuccaagucgccuuuauaggagacgaagaacaaaccggaaucuucaaugaucaacgagaauuugaagacggaccaggcaaacaaaguccuuacgcuggcaaucaaauagagaaaaugauaggagcguguaccuuugaagaaaacgagaaaagggccccaaaagccagcuauacauuucaauauuuugauuuccuaugcaaacuaaacaaccucaaauauagagaaacaauuggaggagaauauagauuccuuucucuagaacagaaaaauguacucaaagagaaaguucuuacaacacagaaaaucacguuuucaggagugaagaaacuacuagauuuaccagaacacgcacaauucaaucuaguuaauuacggcacaaaaagcaccgucaaagaaacugaaacuaaaucaguauuuuaugcaaugauaucauaccauaaacuaaagaaagcaauaccggcaccuaucuucucaaauuuaaguacggccgaacucgaugaaauaggaagaauacuaacacuauauagcagcgacaaaggaaggaaaaacgaauuuuacucgagacuugcaaucccagaggaaguaguagaagcauuauuacccauaaacuucaguaaauucggaaacuuaucauuaaaagcaaugagaaaaaucauacccuaccuagaaaugggccuuguuuauagcgaagcggcgacucaagcuggcuaugacuucaggcacaagaaaauagaucaagcauauauacaugaaaauguaaccaauccagucguaaaacgcgcugcaucacaaacaauaaaaauaguuaauaauauaauacgaaaauauggagagccagauggcauaaacaucgaacuggcgagggaacuuagcaaaaacuuuucagaaagaaagaaaacaguaaaauaucaagaagaaaauagagcaagaaaugaaaggaucgcugauaaauuaagagaaugugaacuaccagucaauggagccaauaucacaagguuaaaacucuucgaagaacaaggcgaauuugaccccuacacagggcuuaaaauaccauucgaccgugcguucagugaagaauacgaaguggaccacauaauaccauacucaaaaacacuagacgauucauacggaaacaaaauacucguguccgcuaaagcaaaccaagaaaaagguaauagaauaccaauggaauaccuacaagguaaaccagaacgaaucaagaaacuggaauccauaacagccacaaucaaaaaccccaagaaacgagagaaauuacuuaaacaacaauugacuaaagaagaugucgacgguuggaaaacacgaaaccuuaaugauacccgauacauaucuucauuauuacacgacuacuucaaucaaaacauuagcuuugcaaaauuggaaucagagaaaaagaaaagagucauagcaguaaacggagcgauaaccaguaaauuaagagcaagauggggcuuuaauaaaauaagggaaaauggagaugaacaucacgcgcuagaugcucuaauaguagcguguguaacagacaaauacauaaaagagauaaccaguuuuaguaaacgaaaagaaguaagauucaaugaaaaccuguggaaaagagagaaaacaccccaagaaauagaacaagaaguuguucauuuuaagaaagauuaugaccgaaucuuuaaccaagcguucccacugcccuggacgaauuuucgagaagaaguuucauguagaaugucagagaacccagcugaacuaaugaaaaaucauacaugggaaacauacaccgacgaugaaauagcagcacuuagaccuauauucauagucaggaugccaaacaugaaaacuucgggucccgcucaccaagaaaccauacguucaggaaaacucgaagaaaaaggcuuaaauauaagcagggucuccaucgaaaaauugaaacucgauaaagaaggaaccaucaaaucagguaaugcccaauuuuauaaagacucaggcaaugguuggcaacuauuacacgacaaauuaaaaguagcauuagaaaaacacgacggagacggaucaaaagcauuuccggacggaguauuuaaauaccaauaucuugacaaagagcacacaguaagaaaaguccgguuaguugcaaaaaguacauugcaaaccucauuaaacgagaagaaaucaguagcagauaacggaucaaugauucgcaucgacgucuuucguaacgaacaaggaaaauaucaauuuguuccuaucuacgcaaaagauagaguagcuaaaaagcuccccaaccaagcaguggcuguaggaaaaauagcaaaagaauggcccuuaauagaagaauccgacuucaaguucaguuuguauucaaaugauuuaauacggguaaagcauaagaaagggguuaagcauguaucaaaagauggaaauaaagaggagaaaagcaaaacugacuucuuuggcuacuauaccggagcugacauagcaacagcaucaauaagcggaauaucaccuaacaacuucuuugaauuuagaucaaugggccuagcaacucuaaucucaauagaaaaauacaaggucgacuauuucggaaauuaccaccagguaaaugaaaaaguaagacagaaauuucccaaaaauagaauguga

SEQ ID NO: 8554 - RNA, 3312 nt, Artificial Sequence
  Cas9 variant
augaaauacgacauaggcauagauauaggagucgccagcguaggagaagcaguaauagaccaggagggaaacauauuggaagcaugcuccaaccuauucgacgaggcugaugcagcuucuaacguagauagaagaaauuuccgugaagggaggagaaacaagcgacgugaaagaacccgagugaaugacuucaaaaaauuauggacaaaauucgguuucgaaauccccaaaaauguuaugaaugacacaauucuacuaaggaauaaaggaauaaaaugugaauuagaucuaacugaauuauauucugucuuauuauauaugcuaaagcauagaggaaucaguuaucuggaagaugcgauugaugaagcaaaaggaucaaacuacgccaaaggaauagcucugaaccaaaaagaacuaaaagaaaagcuaccaugcgaaauccaacuagaaaggcucaaaauauacgguucauauagaggggacuguauaguaaaaaaagaagaugaagacgaauaccauucgaauguauucacaauaagcgcauacaaaaaagaacuugaaauacuguuucguaaucagaaauuaccagaagaguucauacagggguacaugaaaauauucgaaagaaaaagggaauauuacauaggaccggggaacgaaaaaagccgcacagauuacgguguguacacaacaaacaaggacgaagaaggccauuauauaacagauaaaaauauauucgaaaagcuaauaggaaaaugcagcguguacaaagaugaauuucgagcagccggagcauccuauacagcucaagaauucaaugugcuaaacgauuuaaauaauuuaacaguaaauaaccgaaaacuaaccgaaaacgaaaagaagaaaaucguagaaaaaauaaaaaguaguaaugcaguaaauaugagaagcauaauaaaaaaaguucuaggagaggacauugaacaauuuggcggagcacggaaagacaaagccgacaaagaaauuuaccauaccuuugaaguguauagaaaaaugaaaaaagaauuugaaaaaaacgguauagacauagcagacuucucgagagaaaaacuugacgaaauagguaacauauuaacacuaaacacagaaacagaaggcaucaaaggagcacuacacgaagcaaagaauucguucacguacagugaaauugaaacccuaaucgacauaaggaaaaaaaacagcagccuguucagcaaauggcaaagccuaagccuaaaaauuaugaaugaauuaauaccacaaauguaugcccaaccaaaagaacaaaugcaauuacucacagaaaugggaguauucaaauucaagagcguuaaauucaagaauaguaaauauauacccguagaagaaaucauaaaggacauauacaaccccguggugguacgaucuguacgaacuacaauaaaaaugauaaacgaaaccauuagaaaauacggauauccagacaauaucaucaucgaaaugccaagagacaaaaacaguaccgaagaaaaagaaagaauaaaaaaagaacaaagcaaaaaugaaaaggaauaugaagggauacuaaaacgaauaaaagacgaguaugauaucgagaucaaucgagaugacuauagaaagcaagaaaaacuagcauuaaaacugaaacuauggaaugaacaagaggggagaugccccuacucgggaaaaaugauaagcauauacggacuacuagaagacccacaauuauucgaaauagaccacauaauuccaaaaaguauaucauucgacgacaguagaaacaauaaagugcugguauacagaagugagaaccaaaaaaaaggaaauaacacgccauacauguaucuuucuaaaggagauaaaaacuggaacuaugaccaauauaaauccuacgugcuaggccuaaaaaacaaaggaaauauaagcgauaaaaaaguaaauaauaugcuauucauggaagauauuaauaaaaucgacguauuaaaaggauuuauaacaagaaaccuaaacgacaccagauacgcaaguagaguaguacuaaauaugcuacagucauucuucaaugaaaaagacggaugccccaccaaaguaaaaguaauaagaggaagcuuuacccaccaaaugagaguaaacuuaaggauuaacaaggacagggaugagaguuacucacaccacgcaguagacgcaauguuaauaguauacucacaaagaggauacgaagcauaucgaaaaauccaagaagcaugcguagacuucgaaaccggugagauaauagaugaagaaagguggcagcaauguauauggggcaaagacuaugaccaaguaauguaugaagcuaaauggucaaaaauacgagaaaaaauaauagaggcagaaaaaaauguaaaauaccaucacagaguagacaaaaaaguaaauaggggacucuguaaccaaacaauauacggaacuaggauuaaagauggaaaaauauauaaaauaucaucauacaauauauaugacaacaaagaaugcgcaagccucuuaaaaaugauaaaagggggaaaggaaagcaaaaucuuaauguauaacuaugacucaaaaacauacagagauaugaucaaaaucauagacgaauacucagaugaaaaaaacccauuuguggcguauaugaaggaaacaggugacuauuuucggaaauaugccaaaaagcauaaugguccaaaaauagaaaaggugaaauacuacaaagaggaagcagguucguguauagacaucagucauaaguacggcuaugaaaaaggaaguaaaaaagugauacuaggaucauuaaacccauacagaacagauguuuucuuuaacgaaagacucaaaaaauacuaucuaauagguauaaaauacaaccacauaaaaugugaaggcaauaauuaugucauagacgaggacgcauauaacgggcugcugcgagacgcaggaguaauaucucaugaaaacacaauaaacgaucuagagaaaguaggaguaaaguauuuauucucgcuauacaaaaacgacauuauaaaauacgagaaaaacggugaaauguuuguagaaagauuucuuagcaggacaauggaauacgccaacaauuacauagaaaccaaaccuauccacaaaccauucuuccaaaaaaaagauaaaaaaggaaauauaaaaaacucucaaaaucuaguaggcuuaucaaagacaaaauauaucggcaaacuaguaacagacgcauuagggaauacuuacaugguagaaaaagaaaaguuuucccugauaguagacauuuga

SEQ ID NO: 8555 - RNA, 3315 nt, Artificial Sequence
  Cas9 variant
augaaacuuauauuagcauuagauaucggaauagcaucaguuggaugggcaguccuugacaaaaagucggaaacaguacucgaagccggaucgaauauuuuccccgaagcaagugcagccggaaaucaaguacgaagagagaugagacaagcaagaagaauaaaacgacgacagagaacaagauuagaugacuucaacaaauuauggagaaagaacaauuuaucaauaccgcaauacaaaaguacagaaauaguaaaccuaaaaguaaaagcgcuacgagaagaaauaagccuagacgaacuuuauuuaauauuguauuccuacuuaaaacauagaggaaucucauaccuagaggacgcccaagacgauagccuuucauccagcaaugcauacaccaacggucuacgagaaaaugcaaaagcauuagaaaaacauuacccuugcgaaauacaaagggaucgacuucaaacaauaggcaaauacagaggccaaacacaaaucacagacgacaauaacgaaaagauagaccuaagcaacguauucacaauaggagcauauagaaaagaaauaaagaaaguauuagaaacacaaaaauuauaccacaacgaacucacagaugaauuaugcgaugacuauauauuaauuuuuaaucgaaaaagaaaauacuacgaaggacccggaaaugaaaaaucgagaacagauuauggaagauucacuaccagauuagaccagaauggcaacuacauagacgaagaaaauauauuugaaaaacuaaucggaaaauguagcguauacccagacgaauuaagaggagcugcugcuaguuacacagcacaagaguucaauuuauuaaaugauuugaacaauuuaacuauaaacggccgaaaacuggaagaaucagaaaaacaugcaauaguccaacgaauuaaaaccucaaacacaguaaauaugagaaaaauaauagcagacuguaugggcgaaacaaucgaaaacuuuucaggagcacgaauagauaaaagugguaaagaacaauuccacaaauuugaaacuuauaauaaaaugagaaaaagccucucagaaaucgguacagacauagaugaguucagucgagacgaacucgacaaaaucgguuacauaaugacaauaaauacugauaaagaagcgcucauggaagcauuuaacgaaucaggacucaaucuagaugacagugucaaagaaugccuaauaaguuucagaaaagcaaacuccagcagcuucaguaaauggcaauccuuuaguuuaaaaaucaugaaugaacuaauuccugaaauguacauccaaccgaaagaacaaaugacacuacugacggaaaugggaguugcaaaaggaagcuccggugauuucgcagguuuaaacuacauuccaguggauguuauaagugacgaaauauacaauccaguaguaagaaggucaguaaggaucucauuuaaaaucuugaacgcuguacuaaagaaauauaaaguacuugauacaauaguaaucgaaaugccaagagauagaaacucagaugaagaacgaaaaagaauuacugauucacaaaaacuaaacgaaaaagaaauggaauuuauagaaggaaaauuagcacaaauuuacaauauaaaauuaucaucuagcgauuuuucaucacaaaaacaauuaagucuaaaacuaaaacuauggaaugaacaagaugguaucugccuauauagcggaagaacuaucgauccugaagauauaaucaaaaacccagaccuauucgaaauagaucauauaauaccuagaucaauaaguuuugaugacaguaggucgaacaaaguauuaguguaucguagcgaaaaccaaaagaaagguaaccaaacgccuuauuucuauaucacccauucagacggugccuggacuuacgaacaauucaaagcuaacgugaugaaucuaucaaagaagaaagaauaugcaaucagcagaaagaaaguccaaaaccuccucuacucggaagacauuacaaaaagagacguauuaaaaggcuucauaaaccgcaacauaaaugacacaggauacgcaagucgcguaguauuaaacacaguacaaaacuuuuucaaagccaaagaagcagacacaaaaguuaaaguuauaaaaggauccuacacucaucaaaugcgaucaaauaugaaauuagacaaaaaucgagacgaauccuauagccaccaugcggucgacgcaauguuaauggguuuuucggaaaugggauaugaagcauaccgacgucuacaaggggaauuuauagauuuugaaacaggagaaauuuugaaaaaugacauguggaacgagaaaaugagugacgauguuuaugucgauuaucuauauggaagaaaaugguccgcaauacgaaaugaaaucguaaaagcagaaaaagacgucaaauucuggcacuucauaguaagaaaaagcaaucaagggcuauguaaccaaacaauuagaggaacaagggaauacgacggcaagaaauacaaaauaaacaaauuugacauaaggacaaaagaaggagucaaacuuuuuaagaaacuggccuuuagugaaaaagaaagcgaucgugaaaaacuauuaguuuaccuaaaugaccgacagaccuucaauaaucuagucaaaauauucgaagacuacaaagaugcacccaacccguucguucaauacgaaaaagaaacaggagacguagucaggaaauauucuaaaaggcacaacggaccaagaaucgacaaacuaaaauauaaagacggcgaagucggagcauguauagacauaucccauaaauacggacuugaaaaagauucaagaaaaguaaucuuagaaagccuaguacccuacagaauggacguauauuauaaagaaucagacaaaauguacuauuuaguuggagugaaacaaagcgauaucaaaagucagaacggagcaaauguaauagacgaagaccuauacacgcggauucucauaaaugagaaaaugauugagccggggcagagcagagaugaucuagaacaacuaggauacgaguuuagauuuagcuuuuacaaaaacgauauaauagaauaugagaaagaaggcaaaguauucguagagagauucguaagucgaacaaugccuaaagucaggaauuauauugaaacuaaaccaauaaacaaagcuaacuuugaaaaacagaacccaguaggucuuggcaaaacaaaaaguauuaagaaauacagaacagauauacuaggcaacagauaccuaugugaaaaagaaaaauucacuaaauucuguuga

SEQ ID NO: 8556 - RNA, 3315 nt, Artificial Sequence
  Cas9 variant
augaaucauuacguauugggacuagacauuggaaucacgagcguaggauacggcguuauagaccuagauaauuaucaauuuguagacuacggaguccgauuauucaaagagggaacagcggaagacaaugucaaccguagaacaaaacgaggaagucguagacuaaaacggaggaggcaaacaagacuagaugauaugaaagaacuauuacaaaaagaaaaaauaaugagcgaaacauaucauucaaguuacgacccauaugacaugcguauaaaaggccuaucccaaaaauuaucaaaugacgaauuaacaugcgcgauacuccacauaacaaaaugccgaggaacaacacuagaagcacuugacagcgcagacgaggauagcgaagguacaaaaucuauuuuaucuaaaaacgaucaagauuuaaaaaaauaccauuacguaugcuuagugcaaaaagagcgguuaaaacaaaguggaaaaauaagagguacugaaaacaauuucaagaccgaugauuacaucaaagaguuggaugaaauauuaucacaccaagaucuauccgaagaccuaugcgaaaaaauaagaacuauaguaagucggagacgacaauacuaugaaggaccaggaucagaaaaaagcccuacuccauacggacgauggaucgcucagggaguugcuccaauagacuuaauagaaaaaaugagaggaaaaugcucagucuuucccgaccaacuuagggcagcaaaaaacuccuacacugcagaacucuuuaaccuacuuaaugaccuaaacaaucuagaaugugaaggagaaaaauuaacaacaucccagaaacaagauguuauagacuucguaaacgaaaaaggaggaauaacaccaaaacaguuagcgaaauugcuaaauguagauuuaaaccaaauaaaagguuucagaaucgacaaaaacgacaagccccuacugacagaauucaaaggauauaaagccuuuaaaaaaauuuucgacacaaacaauugcgaccucuacaaaaaagaucucucaaucuuagaugggcuagcagaaauagucacaggaaaaaaaggaauagaagaaagaaaacaagcaauacaacaagcauaccccgaaauagaugaagcaauaguggaacaaugugcugugaugaaagguaugacccaauaccacagucucagccuaaaagcuaugcaucuaauuaaccaagaaaugcuccaaucacccagaaaucaaaugcaaguucuacaugaaucacauguauuugacaagaauagagucucacacaaaggacaaaaauacauagaagcagaugacgaagcaauauuaucaccggucguaaaaagggcacaacgagagacuuucaaaguaguaaacgcauuacgugagaaauauggugaauuugaaagcaucgucguagaaacuacaagagaccgaaacucacaagaacaaaaaaaacguuuaaaugacucacaaaaauauuaugaacaggaaaaucgcaaaguagaugaacucuuaagucacgaagguuacgacccaucaaaaauuaacggaaaaaccaagcuaaaagucagacuuuaucuacagcaggaaggaaaaaccgcauauacgaaugcuccaauagaucuaaacuuacuaaucaaagacgcaacggcauaugagguugaccauauaauuccucucagcauaucucuagaugacuccauaaauaacaaagcauuaauaaacaggacagaaaaccagaacaaauccaacaugacgcccauauacgcaauacuaagagguaaauuaaacauaucauuagacacuuacaaaacaguugucaaaaacaaccgaaacuauacaggcaaaaaacgaucauaccuauuauacgacaaagacauaacgaaauuuagcaacaugcaagaauuuaucgcaagaaacuuaguagauacuaguuacgcaugcagaguuguaaugagcacauuaagcgacuacuucaaagacaaugaaauaagcacacauguacacaccgucagaggaagaguuacaaacauguuuagaaacaggauuaacaugcaaaaggaacgagaaaaagacuaucuacaucaugccguagaugcauuaauuguagccagcaucaagaaauuaaacuuauuaaacacuuaucucuuaaaauacaacuucaacgaucucuacaacgaagaaacaggagaaguauucgcaguaggagacgaccaacaaguguuagaccccaaauacaucagauuuauaacacaacuaaaaacaauauaugaugaaagcaacauguacuauaauggauuaaucgaaaggaaugugaugcaauucccccccauaaaaaucagucauaaaaucgacacaaaaccuaacagacagauaagugacgaaacaaucuauucaacaaggacgguaggaaaugaagaauauguaguaaaaaaauauucugacauuuacgauccaaaguucacccaauugacagacgacauaauuaacgaccgaccauuagaccgauggcucauguaccgaaaugauaaccaaacauuuaaaauaauacaauccauaauucuagaccacuuccacauauuuaaagacgacgaaaaacauuauuccugcacaaaaaaaaagggccaaauacaauacgcacuaaaaggcaaaaauccccuguaucuauauaaacaagaacacgguaagguuaggaaguacgccaaaaaaggaaacgguccagaaaucacaaugaugaaauacuucgacggaaaacuagguaacaacauagacauaucaaaccacuaucacguucacaauaaaaaaguuguauuguuacagauaucaccauacagaaccgauuucuacguaagcccagaaggaaaauauaaaauguuaacaguacgauacgcaaacguuuucuacaaagaaucaaaaaaaaaauacguaauagaugaaaagugguaugcuucagaaaaaaaaagaaaaaauauuacagacgacgacauuuuuguaugcucgcuacaucacgacgaacuaauugggauacaaaaaaaagauggugcuaaguacguauacgaucuaucaaccgaagacgguggcaaaccuagauuauaccauggagaaauggaaauacuuaaauucaccgcaacaaacaaugauagcaagaacaucauagaagugaaaccaaucuauacuuacugcaaaaaacaauuaaugauuucaauagguccaauaacaaaauuagcuaaauaugcaacagaugucuuaggaaacgucuacgagguuaaaaaaaauauaauagaucauuuaucgcaccuauga

SEQ ID NO: 8557 - RNA, 3318 nt, Artificial Sequence
  Cas9 variant
auggguauacgaauaggauuagauauaggcauagcaagugucggaugggccguaguagacgacgauuacaauauaauagaauccggagcaaacaucuucaaugaagcuaaagcagcgucaaauguugauaggcgaacuuucagacaaacaaaaaggcuacuccgacgacaaaaaacaaggcuccgggauuuugauauccuauggauaaacgccggauuagacauaccgaaagaaaaagucaacaagcaauuacaauucagaguucaaggcaugacaauggaacuauccgaaaaugagcuuuacgccgcacucaaaaacauguuaaaacacagagguaucaguuacuuagaagacgcacuugaugaagaacaaucaggaaaaagcacauaugaaaaaggauuacaaguaaaccaaaaggcauuaaagugugauaagaugccaugugaaauucaauaugaaaggcuaaugaaauacggaagcuauagaggccauauagaaguaaaagaugaaaguggagaagaaaugauccuaagcaacauauuuacacuagacgcauacuguaaagaagccaagaaaauccuagaaugccagaaacaauaucauaguuuuauaacagaagcuuuugaagacgacuacuuagcauuacuaagacggaaaaggaaauacuaugaaggaccgggaaacgaacaaagucggacagacuacggaaaauauacaacaaaauuaaauccagaaacaggagaauacgucaccgaagaaaauaucuuugaaaaacuaauuggaaaaugcuccguguauccaaaagaaaugcgugcuucagcagcuucuuacacggcacaaauauauaauaugcuaaacgaccuaaacaacuuaacaauaaauggaagaaaacuagaauaugaagaaaaaaaaagcaucguugaagagguucaaaaagcaaguucaguuaauaugcuaaaaauaauaaaaaagguaauaaacgaagacaucacaacuaucgaaggagcacgaaaagauaaaaacgacaaagagauauuccacaaaauggaaacauacaauaaaaugagacacuacuuugaaaaaaacggauuagaauucaaaaaaaucucaacagaugaccuugacgaaauaggaaacauacucacauuaaauacagaaaaagaggcaauccuugaagcauuuaauaaaucacaacucgaacuuagccaagaggagaaagaagcguucauagagauaagaaaaaaaaacggaagcuuauucaacaaguggcauucauucucacuuaaaaucaugaaagaacugauaccagaacuauaucuacaaucaaaaaaccagaugcaauuacuaacagauauggggguuuucaagaaaaaaacagaaauauuccagaauuacgacaaaaucccaacagacguaauaauagaagacauauacaacccagucgucaaaaggucuauccgcauaacuguaaaaauaguaaacgcacuaauaaaaaaguaugguuacccacgagaaguaguaauugaaaugccacgagacaggaacucagaugaagaaaaaaaaagaauccaagaugaacaaaaaaaaaacgauacugaauuaaaaaaaauaauagagaaaguagaaucagaauacggaauaaaaauaacugacacgcacuuuagaaaucauaaaaacuuaagaaugaaauuaagauuauggcaugaacaagacggucgaugcuuauauagugguaaagugauagacaucagugaauuacuaaacgauugcucuaaauucgaaauagaccacguuauaccaaaaagcauaagcuuugaugacaguagaaguaauaaaguacuaguuuauuccacagaaaaucaaaagaaaacaaaccaaaccccauaucaguaccuugaaggcaauggaaaagaauggagcuuugacgaauauaugaaccaagucaucgaauuaaaggauagaaaauuaauaagcaaagcgaaaaugaacaaauuacuuuucagagaggacauaacaaagauagaaguacuaaaaggcuucauagcuagaaacauaaacgacacgcguuacgcaaguagaguaguacuuaacucuuuucaaaaauacuuugagucaaaacaaucagauacaaaaguaaagguaauaagaggaagcuuuacacaccaaaugagaaaaaaauugcaacucucgaagaaucgagaugaaucguaugcgcaccacgcaguggacgcaaugcuuauauguuauagucaaaugggauacgaagcauauagacaauugcaagaggacuuaauugaucccgauucugagaaaauaagagaucuggguuuguggaaagagacaaucaccgaagcaaaauacgacgaaguacuguacaccgcaaaauggcucgaaaacaggggaaaaauacaagaagcggaaaaaaaaguaaaguucuggcauaaaguagacaguaaagcaaaccgagcacuaugcaaucaaacaauaagagggacgagaguuauagacggaaguauacaaaaaaucaauaaaaucaauauauacaguguugacggcuacaaaacauuuaaaaacaugauacaaaaaggaaaagaaaaagauuuccuuauguacaggaaugaucgcagaucaugggaugacuuaaugaaaguuuauagagaauacucagacgcaaaaaacgccuucgcggcauaucaagaagaaacaggagacuacguaagaaaauacgcaaaaaaacauaacgguucaaaaauaacaaauuuaaaauacugcgcaaaggaacucggaagcugcauagacauuucccauaaauauggccucgaaaaagauaguagaaaagugauacucgaaaguuugucaccauacagaucagacgucuauuacaaugccgguuuaaaacaauauuacauaguugguauuaaaaauagugaucuaugcuuccuuaaaggcgaauacuucaucgauuccaaaagauacuugcagauacugcgugaagaagguguuuuaaccgaacaacauacccucaacgauuuagcugcaauaggaacggaauuucaauuuucacuauacgaaaacgauuaccuagaauaugaaaaaaauggagaaauuaaaacagaaagguuucuaucacguacuaaaccaaagcaaaagaacuacauagaaacaaagucaauugacgccccaaaaauuaaaaauaaaaaacaaaaccuaguaggucuugcaaaaucaaaaagcauaaaaaaaauaaggguagauauucuagguaauagauacuacgccaguaaagaaaaguuuucacuaaugguugauaaauucuga

SEQ ID NO: 8558 - RNA, 3318 nt, Artificial Sequence
  Cas9 variant
auggacauggcauggcgacuaggacuggaccuaggaaccaacucacuuggaugggcugcacucagucuugacgcugcaggagcaccagaugcaauuuuagcggcgggaaguaggauuuuuggagacggcagagauccucaaaguggaacaucauuagcaguugauaggagagccgcaagagcggcaagaagaagacgagaucgauucaaacaacgccaacgagcuuuauuaaaacauuuggaagcagacgggcuuuucccugcagacccggagguacagcaagcauuagcagcucuagauccauaugcacuaagagcaagagcauuggaugaagcucuaagucuacaugagauagggagagcccuauuccaucucaaccaacgaagaggauuucagucuaauagaaaagcagacagaggcaaagacgaagacgcagggaaaauagcuauuggcguugaccguuuaaaggacgcuauagcggccgcgggugcacgaacguuuggggaauuucucaggcaacggagagcuggugcaacgggagaaaaucagauuccaucugugcgaacucgcuuaagagccgaaacgggagaaggagcuaaagggucaggauacgauuucuauccaagcagagcucuccuaaaagaugaauuugacgccaucuggcacgcacaagcagaacaccauccaaaaguauuaacagaugaagccuaucauagacuacaugaaaucguauuucgccaaagaccauuaagggcaccuaaaguaggugcauguacuuuagugccaggagaagccagauuaccgaaagcucauccauuguuucaacgaaggaggcuauuagaagaacuaaaugcauuaaugauagugagagcuggugcuguagcugaacgccuaacucccgaacaaagagacuuauuauuauuaaaguugaaagauaaggguaaaguaacauuuaaaucguugagagaaaaaguauuaaaauuagauggagacgcgagauuuaauaaagaaucagaacauagaacugaauugaaaggagacgaaguugccgcugaaaugggaggcaagacaagauuugguucauuauggccucauuugucgaccgaacaacaauggaccguaauagaaagacaacaagcguuagaaagugaugcggacgaggcagcauuuaggaccuggcuaguugaaacacacaaauuaacggcagagcaagccagagccguagcuggagcacgauuaccugcaggacauggaagguucggacugaccgcgacugcugcuuuacuagcagcacuaagagauggaagaaccccggaggguagagguccaaacgcaccagcaacagaagcugguagagucguuguguauagugaagcagcugcgauagcagguuaucaucauagugaucauagaaguggagaaguuuuuacagacgcgaaaggacgaccggcacuaccguacuacggagugccauuagaccgacauauaguacccggaacagcagacccagaugaacccgaugaagcugcaagaauaggaagauuaacgaauccuacuguacacauagcauuaaaccaauugagacgagucguuaauagacucauacgagucuacggaccaccagcggaaguugcauuagaacuagcaagagaacucaaacuuuccgaagaugaaaagaaagaaagaaacagagagaacaguagaaacagacuggacgcugagaaaagaagcucuaaauuggccgaauuaggacaaagggauaaugguggaaaucgcgcgcuacuuaaacuaugggaagaacuaaauccugaaaauauuuuagaccgaagauguauauauagugguaggcagauuucgauuggaaugauauucucaggggcagccgaaguggaucacauauuaccauucgaugcaacuuuagaugauucaaacgcuaauaaaauuuugugucuucgagaagcaaauagagauaaaagaaaacgaucacccuucgaagcauggggcggaacaccacaaugggaagaaauagcugaaagggcuucgagauugccaagaaacaaaagauggagguuugaaccagaugccauggaaagguuugccgaagaagguggauuuuuagcgagacaucuaguagacacacaguauuuaggcaggauugcacaugauuauuuaagauguuuauacccggauaaaggcgacgguaguagucauguuugggucucacccgggagacuaacugaaaugguaagacgaaaauuaggacuaaacggacuacuaggcgaccacaaucuaggagcagagcaaccuaaaaauagaaaagaccaccgacaccaugcuauugaugcuguagucaccgcuauucuugauagaagcaugcuacaaagaauacaaagagcaaguggagaaggagcaucagaugcggaguuacuacgaauuauaguaccagaaccauggacuggauuucgcgaugaucuccaacgagcaguagacaggauaguuguagcgcauagagcagaucacggaacaguagcaaaagcggcaacaagagguagagaccaaacagcagccagacuucauaaugacacagcauacggauucacaggugaagcugacgccaaaggaacgccaauuguugugcaucgagcaccacuaggugcguuaaagaaaccagaacauauugaucaaguuagggauccuuuauuaagagcagcgcuccacgacuucacugcaggcuuaaguggaaaaccauuugaagauagaauugcagcuuuuccccggcuagguccucuugauuauagaggaaucagaagaguacgcguuguugaaccuuuacaaguaauuccaauacgagacgcugcugggagagcauacaaaggauacaaaggagacucaaauuaucguuaugauguaugggaacuaccagauggaaagugggaacaacgaguauugcaaauguauuaugcacaccaaaguggagaacccccuaggccacauccagcggcaagaaagguuuuaucacuacauagagaugacguauuagcaauagaaagaggggaggguggaagagaguuagucagaguaguuaaauuuaguacaaacgaauuuacccuggcaccauuaaaugaaggcggugcauuaaaaaguaggcaugcagauaaaggagauccauuuagauaucuauauccuucgcccagcacauuaaaagcguggagggcaagagagguaaggguagacgaguugggaaggguacucgacccagguuuuccagcccggaaaagaagacgaguaacaagacccgguagagcugacgcugauuga

SEQ ID NO: 8559 - RNA, 3321 nt, Artificial Sequence
  Cas9 variant
augcaguauauuguagcuauagacauaggaguugcaucaguaggcuacgcaguaaucgacaaaacaucggaaaccguaauugaagcaggauccaacauauuuccugaagcaucagcaacugacaaccaagaacguagagguaugagacaagcaagacgcuuaaaaagaagagaaagaacucgauuagacgauuuuacaaaacuaugggaauaucacgguuuagcuauaccacaagucaagaaaaaugacauaguaggacuaaaaguuaaagcacucuaugaaucuauuaguuuggaugaagucuaucuaauacuauacagcuaccucaaacaccgaggaauaucauaucucgaagauguagaagauucaaguguaagcggaucaacagcuuaugccaacggacuaaaacugaacgcuaaagaacuagagaaaaauuucccaugcgaaauucaaaaauaucguuuagaaaauauaggaaaauacagaggacaaauacaaauagaagaugaccaaggcgaaaaacuggaccuaucaaacguuuuuacaauuggagcauauacaaaagaaauucaacaaauauuagacacucagaagaaauaccaugccgaaauagaagacgaguucugcgaaaaauaucuaaaaauauuuacaagaaaaagaaaauacuaugaaggcccaggaaacgaaaaaucaagaacagacuacgguaaauacaccacaagauuaaaagaaaacggcgaauauaucacagagaaaaauauauucgaaaaacuuauagggaaaugcaguguauacaaagacgaacuacgagcagcaagugccucauauacagcacaagaguucaaccuacuaaaugaucuaaauaaucuaacuguaaacggaagaaaauuagaagaaaacgaaaaacaucugauagucgacaaaguaaaaacaucuaauacaaucaacaugagaaaaauuauagcugacgcgaugggagagaaaauagaagaauuuuauggagcucgaauagacaaaucagaaaaagaaauauuccauaaauucgaaguauacaauaaaaugagaaaagcacuugcagccauacauguaaauauagaggaguuuagccgagacgaucuagacgaaauaggauacaucuugacaauuaauacagauaaagaagcaaugauggaagcauuugauaauagcagacuagaacuaccaggggaaaucaaaaacugucuaaucuccuuaagaaaaacuaauggaacacuauauaguaaauggcacagcuucagccucaaaaucaugaaugagcugauuccagaaauguacagacaaccaaaagaacaaaugacuuuacuaacagaaaugggaguuaugaaaggccaaacagaugaguuugagaaaaauaaauacauaccuguagacguagccagcgaagauauauuuaacccugucgucagaaggaguguacggauaucauucaaaauccugaaugcacuaaugaagaaauauggaacacuggaugaaguaguaaucgagaugcccagggauagaaauagcgaugaacagaagaaaugggaaaaagaaacucagaagaaaaaugaaaaagaacaagaguacauagaaaacaaacuggcaaccgucuacgacauacgacuaucaucagcagauuucagcagucaaaaacaauugaaccuaaaauuaaaacuauggaaugaacaagacggcaaaugcuuauacucagguaaaauuaucgaaccugaagaccuaauaaaacacagcgaacucuucgaaauagaccacauaauaccaagaaguauaucauuugaugacucacgaucaaauaaagugcucguauaccguacagagaaccagaacaaagguaaccaaacgccauauuauuaccuaacacacacaaauagcaaauggucauuugaacaauauaaagcacuuguuauggauuuaagcaaaaagaaagaauauggauuaagcaagaagaaaguaagaaaccuuuuauauucugaagacauaacaaaagcagauguauuaagaggauucauaaaccgaaacauaaacgacacaucauacgcagccagaguuguacucaacaccguacaaggcuauuucagagcgaaagaaaugggaacaaaaguaaaagugauacgaggaucauauacccaccaaaugagaguaaacaugaaacucgauaaagacagagagaaaucauacgcccaccacgcaguagaugcaauguuaaucgcauucucacagcuuggguacgaagcauauagaaaauuacaaggugaguucauagauuucgaaacaggggaaauauugaauagcgaaaaauggaaagaccaaaugagugaugaaguauauaaacaauauuuauaccgaaagaaauggucuaauauaagaaacgagaucacaagagcagagaaaaacgucaaauacugguacuacguagaccacaaauccaauagaggccuauguaaccagaaaauacgagguacaagaguauacgauggaaaaauauauaaaauaaacaaacuagacauaaggaagaaagaaggcgcagcauuauuuaagaaauuagcauuuagcgaaaaagaaagugauagggaaaaacuauuaguauacaaaaaugacaagaaaaccuacgaagaccuaguaaggauuaugcaagacuacagcgacagcaaaaacccuuuuguacaauaugaaaaagaaaccggagacuacguacgcaaauaugccaagaaacacaaugggcccaggauagacaaacuaaaauauauagacggcgaggucggaucaugcauagacauaagucacaaauacggauacgaaaaaggcaguagaaaaguuguacuagaaagucugguuccauauagaauggauguauauuauaagaaagaagaacaaacguauuacuuaguagggauaaaacaaagugacguaaaaugccaaaaaggagaguaugugauagaugaggacgcauaugcaauaaaucugguaaaagagaaaaugauucaacaaggacaaaaacgaagugauuuagaaucauuaggguucgaauuucaacuaaguuucuacaaaaacgacauaauagaauacgaaaaagacggaaagaucgugagagagagauuucuuuccagaacaaugccaaaagucaaaaacuacauagaaacgaaacccaucgacagagcaaaguaugaauggcacgaucggaaauuaguaggacuaggaaaaacaaaaaggauacggaaauaucgcauggacauccuaggaaacuacuacuuaugcaauaaagaagaguucuccaaguauugcuga

SEQ ID NO: 8560 - RNA, 3324 nt, Artificial Sequence
  Cas9 variant
augggguacacaguuggacuagacauaggaguagcaagugugggaguagcaguauuagacgaaaacgacaauaucguagaagcaguuucaaacaucuucgacgaagcagauaccaguaacaauaaaguaagaagaacauuaagagaaggacgccgaacaaaacgaagacaaaaaaccagaaucgaagacuucaaacaacuaugggaaacaucugguuacaucauaccucauaaacuacaucucaacauaaucgaauuaagaaacaaaggacucaccgagcuauuaucccuagaugagcuauacugcguauuacucucaauguuaaagcacagaggaauaaguuaccuagaggaugcggaugauggugaaaaagggaaugcauauaaaaaaggauuagcauuuaaugaaaagcaauuaaaagagaaaaugccgugcgaaauccagcuagaaagaaugaagaaauacggaaaauaucacggagaauucauaauagaaaucaacgacgaaaaagaauaccaaucuaacguuuucacaaccaaagcuuacaaaaaagaacuagaaaagauauucgaaacucagagauguaaugguaacaaaauaaacaccaaauucaucaaaaaauauauggaaaucuacgaacgaaagcgggaauacuauauaggaccugggaacgagaaaucaagaacagacuacggaauuuacacaacaagaacagaugaagaaggcaacuucauagaugaaaaaaauauauucggaaaacuaauagguaaaugcucaguauauccggaagaauaucgagcaagcucagcaucauacacagcacaggaauucaaccuauuaaacgaccuaaauaaucugaaaauaaauaacgaaaaacuaacagaauuccaaaaaaaagaaauagucgaaaucaucaaggaugccucauccguaaacaugagaaaaauaauaaaaaaaguaauagacgaagacauagaacaauacagcggagcuaggauagacaaaaaaggaaaagaaauauaccacacauucgaaaucuauaggaaacuaaaaaaagaacuaaaaacaauuaacguagacauagacaguuucacacgcgaagagcuagauaaaacgauggacauccuaacacuaaacacagaaagagaaucaauaguaaaggcauuugaugaacaaaaauuuguauacgaagaaaaccugauuaaaaaauuaauugaauuucgaaaaaacaaccaaagguuauuuagcggcuggcauuccuucaguuacaaagccaugcuacaacuaauaccagucauguauaaggaaccuaaggaacaaaugcaauuacuuacugaaaugaacguauuuaaaaguaaaaaggagaaauacguaaacuacaaauacauaccagaaaaugaaguagucaaagaaauauacaaucccguaguaguuaaaucaauuagaacuacaguaaaaauacuaaaugcauuaauaaaaaaauauggauauccagaaucaguuguaaucgaaaugcccagagacaaaaauucagaugacgaaaaagaaaaaauugacaugaaccaaaaaaaaaaucaagaagaauacgaaaaaauacuaaacaaaauuuaugacgaaaaaggaauagaaauaacaaauaaggacuauaaaaaacaaaaaaaacuuguacuaaaauuaaaauuauggaacgaacaagaaggacucugcuuauacucuggaaaaaaaauagcaauagaagaccuccuuaaccacccggaauucuuugaaauugaccacauaauaccaaaaucaauuagccuagacgauucccgcuccaauaagguuuuagucuacaaaacagaaaauagcauaaaagaaaacgacacaccauaccauuaucuaacccgaauaaacggaaaaugggguuucgacgaauauaaagcaaaugugcuagaguugagaaggagaggcaaaauagacgacaaaaaagugaacaaucuguuauguauggaagauauaacgaaaauagacguagucaaaggauucauaaauagaaacuugaacgauaccagauacgcgucuagaguaguccuaaacgaaaugcaaagcuucuucgaaucaagaaaguacugcaacacaaaaguuaaaguuauacgaggaagccuaacguaccaaaugaggcaagaccuucauuuaaagaaaaauagggaagaauccuauucacaccaugcaguagacgcaaugcuuaucgccuuuagccaaaaaggauacgaggccuacagaaaaauacaaaaagacuguuaugacuucgaaacuggggaaauucuagacaaagaaaaauggaauaaauauauagaugaugaugaauuugacgacaucuuauacaaagaacgaaugaacgagaucagaaaaaaaauaauagaagccgaagaaaaagucaaauauaauuacaaaauagacaagaaaugcaauagagggcuuugcaaccaaacuauuuacggaacacgugaaaaagaugggaaaauacacaaaauaucaagcuacaacauauacgacgauaaagaaugcaacagucuaaaaaaaaugauuaacagcggaaaaggaagcgaucuauuaauguauaacaacgacccaaaaacguaucgagacaugcucaaaauccuggaaaccuauucaagugaaaaaaacccauuugucgcauacaauaaagaaaccggagacuauuucagaaaauacucuaaaaaccauaauggaccaaaggucgaaaaaguuaaauacuacagcgggcaaauuaacucaugcauugauauaucucacaaauauggacacgccaaaaacagcaagaaaguaguacuaguuucacuaaauccauaucgcacugacguauacuacgacaacgauacaggaaaauacuaucuaguagguguaaaauacaaccauaucaagugcguagggaauaaauauguaauagacagugaaacauacaaugaauuacuaagaaaagaaggaguauuaaauagcgaugaaaaucuagaagacuuaaacucuaaaaacauaacauacaaauucagccuauacaaaaaugauauaauacaauacgaaaaagguggagaguauuauacagaaagauuccucaguagaauaaaagaacaaaaaaaucugauagaaacaaaaccuauaaauaaaccaaacuuccaaagaaagaacaagaaaggagaaugggaaaauaccagaaaccagauagcuuuagcaaaaaccaaauauguuggcaaacugguaaccgaugugcuuggaaauugcuacauagucaauauggaaaaauucagcuugguaguugauaaauga

SEQ ID NO: 8561 - RNA, 3324 nt, Artificial Sequence
  Cas9 variant
augggauacacacuuggacuagauauagguaucgcaagugucggauucggccuaauugacaacguagacggcaaaauccuugaaucaggaguaagauuauuuaguucagcugacccugauaacaaccagacacgacgaucuucaagacaagcacgaagauuaaauagacgaaaaguacauagacuagaaagaguagcgcaccuacucgaagaagcuggauucgaaaaaggagaaguacuagcaccuacaccauaucaucuuaggguaaaagguuuaacagaaaaacucucaaaaccagaaguauacgcagcacuauauaauuuaaugaaacauagaggcauaagcuacuuagaagacguggaauuagacgaagcugacucaagcucgguaucccaaaauguagaacucuuaaaagaauacuacccaugugaaauccaauuagaaagauaugaagaauauggacaaaucagaggcauaaucgaaacuuacaacaaagacggugaaaaagaaagucuaguaaacaucuuuccaacaggugcauacaagaaagaagcugaagcaauaauucucaaacaaggacaguuuuaucccgaacuagauaaaguuuuucuagaaaaauuuacagaaauucuuacaguaaaacgccccuacuauguugguccuggaaauaagaaaucaagaacggauuacggaauauauagagaaaacggcgagacacuagaaaaucuuuucgacauauuaauaggaaaauguacaaucuacccacaagaagcacgcgcagccaaauucagcuauaccgcacaacuauuugauuuucuuaaugacaugaacaacauaucaauagccggcgaaaaauuaacugaaguacagaaaagggagaucuaccaucaaauaaugucaucuaaaacaguaaacaugaugaaaaucaucacaaaagucacaggaugccuuaaagaagaagugacagguuacagagucgacaguaaauauaaagccgaauuucacucuuucgcgucauaucgacaauucagaaacaaaaugcuagacuauggauucgacguacaaacacugaacguugaaauguucgauaaauuagcugcaaaacugacgcuaaacacagaauaucaccaaaucauaacccaauuagagucacucaaccuaggauuauccaaagaacuaauagagaaaauugcggauuuccgaaagaaaaaccgcagccuauuuucaaaauggcacucacugucauugaaagcuaugaacgaagucguagacgaacucuggucuacaagcaaaaaccaaaugcaaauauuuagugaauuaggcggauuuaaaucgaauauagaaguauucaaaggacugaaauacauaccacucgacgcaauggucgaugaaauuuacaacccuguaguaagaugcuccauacgagaauccauuaaaauaaucaaugcacuacugaaaaaguauggagcuuuagacaaaguagucauugaaaugccgcgagacucaaaugaaaaagaagaaaaagaccgaauaacaaaacuuaauaaagagaaugacaacaaaaagaaacaagccauugaaaaagcacgcaacgaauacggcuuuggggaagaggcuuacagacaacaaaacgaccugaacacaaaacuaagauuaugguacgaacaaaaacaacguugcuuauacucuggagaaauaauaaaaaucuuugacuuaauuaaaaacccccaccuauuugacauagaucauauaauaccuaaaaguauaucauacgaugacagucucucaaauaaaguccucugcuacgcaacugaaaaccgcgaaaaaggcaacuuaaccccauaccgcuacuuuaaaagaaaagcaucacuaacauggaacuacgaggcuuauaaaaguuauguaaucgaacuuuacaaagacggaaaaggagaucuaucacgcacaaaacuagaacuccuacuauucgaagaagacauaaacaaauacgaaguuagacaacgauuuaucaaucguaaucuaguugauacacgcuacgccuccaaaguuguucuaaauacauuacaagauuuuaugaaagaaaacuaccccacuacaacaguagaaguaguaagaggaaaauuuacagcgcaacuucguagacacugggggauaagaaagaaccgagacgaaaaucaugcccaucacgccauugaugcauuaaucauugcaugugucccacauuuaucauuauggaaagaacaaaagaaaguauucucuaccgacgaauuuagaguagaugaaaccacuggagaaauaauagaacaaucauacaaccaacuaacauaucaagaaccauucucacaauucuucuaucaacucgaaaaaguaucuaucgacuguagauacagcuauaaaguagauagaaaauucaacagacaagucgcggacgcaacaauauauucaacaagacaaggaauaguaaaacaaacaaguggagacaaaaguuuuacacuagacuccaauucaaaagaacacuauguuauagcaaaaaucaaaaauauauacgaagacgucgaugcgaaaagauuuauggaccgcuauaagaaagacaaaacacaauucuuaauguaccaccaugacccacaaaccuucuccauauuagaagacguaaugaaaacauauccagacaagaaaaauccauuccaagccuauagacuugaauacggaccuauaagaaaauacuccaagaaaggcaaugggccacaaauacaaucuauaaaauacuacgauuccaaacuaggccaacacauagaacuaaaacaagcaaaucaauccacuaagaaagucgucuuacaaucacuaaacccauggagaugugacaucuacuacaauaagaaagacaaaagauauaucgccgcagguuuaaaauacgccgaucuaaguuaucaaaaaggaacuggacuuuacgguauaucauugcaaagauaucaacaaauacuaaacucagagaaaauagaauuauccauagaacaaauagaacuccuauuagaaggaagguuaaacgaaucuaauuuugaguucuguuuuucacuauauaaaaaugauuuuauacaauggaacgaugaaaauaaccaaacauuucaauacagauuccuagcacgaaauuuaagcagucccaacagaauagaagucaaaccaauaaauaaaucuaaauacgacaaacaagcagaaggacuaaaaaccuuaaagaaaggacuaaacagauucuauaaaaucuccguagacguauuaggauaucaacacuuuauaaagaaagaaaaauuaaaacuaacauuuaaauga

SEQ ID NO: 8562 - RNA, 3330 nt, Artificial Sequence
  Cas9 variant
augucacacuacguauuaggucuagacauugggauaaccaguguaggcuacggaauaaucgacuuagacacgaacgauuucauagacuauggcguaagacuguucaaagaaggaacagcagcaaauaacgaagacagacgaaacucaagaucucguagacgacuacuaagucgaaaacauacucgauuaauggauaugcaaaaaguuuugaaggaagcaggcauaaugacugaauccuauaguccacuuagcaaugucuaugaaauaagaaaaaaaggacuaacaaaagaacugacgaaugaugaacucacagcagcaauauuacauauaacaaaacacagaggaucagugauagaaacaguugaagacgacgaagcagcagcaaaagaaaccggagaacuaaaaagcacacuacacgaaaacgcacuauuacuagcgaacaacaaauuuguaugugagauacaauuagaaagacucaauacugaaaacaaaauaagaaaucauaaaaauaauuucaaaacaaaagacuacguagccgaauuaaaagaaauccugaaccaccaaaaccugucagaagaagucaaaaauaagaucauacaaauagucgaacgaagaagagccuacuaugaagggccaggaucauuuaauagcccaacaccauauggaagauuuauagaagucaacggacaggugcaagaaauagaccuaaucgaaaaaaugagagguaaaugcucuguauacccugacgaauucagagcgcccaaaaugaguauuagugcggaccuauuuaacauccugaacgacuucaacaacuuacuaguacaaggagaaaaacuacaagaggaagauaaaaaaaauuuacuaaaaauaauuaaugauaaaggaaguaucacacucagacaaauuaguaaaaaacuagaagugaacgaagaugaaaucaaaggauauagaauagauaaaaaaggcaaagcacuauuuacagaauuuaaaggauacaaaauccuaaagaaauuauucuuaaauugcgggcaauccaucucacuagaagacuaugaaaugcuagacgaaauaauagaaauaguuacaaagaaaaaaggaaucgaugagaggaaagacgcgcuaaaagaacuuaaaugggaccuaagcgaugauauaauaaauagccuaagcgaagugacaggcaucguuggcuaucauucacucucuuuaaaagcaauccgggaacuagauuccgagcuuuauaaaacaucacuaaaucaaaugcaguuacuucacgaacuaaagauguucgauaaaaauagacccuccuacaaaggaaaaaagaauaucguugcagaccccgaagcaauucuaucaccaguugcaaaaagagcgcaaaacgaaacguucaaaguaauuaacgcauuacguaaaaaauacggagaauucgacagcauaguaguugagaugacccgagauaaaaacagccaagaacaaaaaaaaagaauaaacgacagccaaaaagcacucgaaagcuuaaacaaagaggucgaucaauuauuacaacaaaaaggauacgacccacaaaaagugaaaggaaaaaccaaacaaaaaguaagauuauacaugaugcaagagggaaaauccgcauacacacuacaggagcuugaccuacaccgaguaauaaaagacgacaaauauacagaaaucgaccacauaauaccaauaucuaucagccuagacgacucacaaagcaauaaaguacuagcgcugcacagcgaaaaucaacaaaaaggaaaccuaaccccauuuauggcauuccauacgggcagauucgcagacaugggaugcaccuggaacaaauucaaggaaaacguauuaucaaauaaaaacuauaaacauaaaaagaaaaauaacuuacuugaugaacgagacaucaauaaauuuagcguaauccaagaauucauuaacagaaaccuaguugacacaaguuaugcaaaucgaguuguauuaaacacucuuacagacuacuucaaagacaaugaaaucgauacaaagguacacacagucaacgguaaauuaacugaccuauucagaaagcgaauaaauuuaaaaaaagaucgaaaugaagauuacuugcaucacgccauagaugcucuaauaguggcaucaauaaaaaaguuacgauuacuagaugguuaucuggcaaaauacggauuugaaacauuauacgaugaaaugacaggagaaauaaaagaaauuccagaagauaaagcauuuuucgacgacaaauauauacgguacauacucaaccuaaagacaauauaugagaguucaaacauguauuaccgaggcauacuggaacgcgaagaacucauauaccagcccauaaaaauaagucauaagauugacaccaaaccaaacagaaaaguaagcgacgaaacaauauacuccacacgaauuauagauaaugaagaucaucucauagaaaaauacucagauauauacgaccccaaauuuaagaacuuaacagaggacauacuaaauggagaaaaaaacaaguaccuaauggaaaaaaacgauccacaaacauucaauauauuaaaacaaauaauauuuaaucacuacaacacauauaaagacuccaaagaauacuauaaaauagaaaaaaaaaaagaaaaagaaauuauaaaacuagucggaauaaacccacucucacucuacaaagaagaaaacgguccaaucaaaaaauacucaaagaaaggaaacggccccgucauaaugucaaugaaauacgacagcgaaaaauuggguaaccauauagauaucacaccagacuccgcaaaaaauaaaaaaguaauacuaaaacaaauaagcccguaccgcaccgauuuuuacaagugcagcgacgaaaaauuucguuucguaacgguaagauacaaagacguacacuaccaaaaaaguaucgauaaauauugcauagacaaagaaugguaucaaaaugaaaaaaaaaacaaaaaaauagacgaaaaagcagaguuucuauucagcaugcaccacgaugaacuaauaggcauaacacgaaaggaaagcgaacaguucaucuaugacgaaagcaaagagaaccacggugacccuagauaucaugauggaguaaaaccagaaauucuaaaauuuacugcaacuaacaacgauacuaaagggaucauagaaguaaaaccacuauacacauauucagcauacagacucaaacccacaguacuaaaugucaaaaacauaaaaaaauaugcaaccgacguacuagguaaccuauaugaaguaaaacaaaacgagcuaaaacuagaauucuga

SEQ ID NO: 8563 - RNA, 3333 nt, Artificial Sequence
  Cas9 variant
auggcagaagguaaaaagaggauauggaggcuaggagcugauuuaggagcaaacucauuaggaugggcagcaauagaauuaucugcaccugugaauggaaaacccauagcaauucuagcugccggaagucgcauauuuagugacggacgcgauccaaaaucaggagcaucauuagcaguagauagaagagaugcacgggccaugagaagaaggcgagaucgauucaaacagagacaaaaggcauuaauuaaauaucugauagcagauggucuauuuccagcagacgaagcugcaagaaaugcgauggcugcaauagauccauaugcaguacgugcaagagcauuagaugaagcgcuuucacucccagaacuuggccgcgcacuauuccaucugaaucaaagacgaggcuucaaaucgaauagaaaggccgauagaaaagcagacgaugaugcggguaaaauagcaauaggcauagacagaacaagagaugcuauagcagaagaugaagcagacgcaggagccgaaccuggaucauggacauuugguaaaugguuacaugaaagaagacugaaaggucaaagcgugagaacaagacuaagaccagaaucuggcgaagaugcaaaaggcgacggauaugauuuuuauccugacagagcacuaauggaagaggaauuugaugcaauaugggcugcacaggcuccgcaucauccagaugugcugacaaaugauguucaugauagauuacaugagauaauauuuuaucaaagaccauuaaaagcuccacaaguaggaaugugcagucuaauaccuggugauagacgauuaccaaaagcacacccauuauuccaaaggcguagacuacuagaagaauuaaacgcauugaugauaguuagaccgggugaaguugcucaaagacuaaccagagaggaaagagauauauuacuauuaaaauuaaaagauaagaauaagguaucauuugcuacccuuagaaaagcauuaaaacucgacccugaugcaagauuuaauaaagaaucggaagauagaacagauuugaaaggagaugaaguagccgcugucauggguucuaagacaagauucgguaaucuauggguacaucuaaguauugaagcucaaugggauguauuagcgagauuagaugcaguagaaagcgaugcagaggacgcggcauuuugcgcaugguuaguagaaacguaugcucuuacaccagagcaagcgagagccguugcuaacgcgccacuuccaccgggcuacggaagauuuggggaaacagcuacaagaaaauuaauagaagccuuaagagacggaaagaaagaugacagaguacuuguauacucagaggcaguaaccgaagcaggucuaggacaccacucugaucgcaggacgggcgaagucuucgaagaugcaaaaggacgaccgcaguugccuuauuauggcguagcacuagaaagacacauaaugccuggaacaggagacccuucagauccagaagaaaugagaguaggucgauuaacaaacccaacuguacacauagguuuaaaucaauuaagaaggauuuuaaauguauuaauaagagcuuaugguccgccugcggaaauagcaauagaacuugcuagagaauugaaacuaacggaugaagacaaaaagagaauaaaccgggaaaauaacgauaacaggauagcagcugaacgaaggagcgaaaaauuauuagcuauuggccaagcugacucaggggcuaaucgggcucuauugaaauuaugggaggaauuaaacccagcaaacguacuggauagaagauguauauauagcggucgacaaauaucuauagauauguuauuuucugcagcuguagagguugaccauauauuaccuuuugcugcaacgcuagacgauucuaauggaaacaagaucguaugcuuaagagaagcaaaucgagagaaaaggaaacgcucaccacacgaugcauggggucacuccgcacgaugggaugaaaucgcagcaagagcugcucaauuaccaagaaacaagagauggagauucgaacccgacgcaauggacaaauuccgggacgaaggcggcuuucaagcaaggcaucuuguugacacgcaauauuuagcgagauuaucgagagaauauuuagcaacauuguauccugaaaaaggagaaggcaguggucacauuuggguaucuccgggucggcuaacagaaauggugcgacggaaauuaggauuaaacgauuuguuacccgaucauaauuucggagguggagcggaucaagccaagaacagacuagaucaccgacaucacgccauagaugcaguaguaguagcaauaguugauagaggaauguuaaacgcaauagcaagagcuucaggucaagaaggagcagagggacgcgaaaggauaauuauaccugaaccaugggacggguuuagagaugccuuacgugaaacagugaacagaauuacgguaucacauagaaccgaucaugggaccgcauccaaagcgggacuuccaaaaggaaaagaugcgacggcugguagauuacauaacgacacagcauauggauuuacuggagauacagaugcaaaagguaauaguauaguaguaagaaggguccccuuguccaguuucaagaaauuagcggaccuugacagaauaagagaugcugaucuaaaggcugcguuauaucaacacuuaaauggcuuggaaggaaaagcauuugagaaggcuuuagcggaguuccauaaauuggaauggcauaacuuuggagggguaagaagagugagaguaacagaacccuuaacaguuauaccaauaaaagauagaaauggaagaauauacaaaggcuacaaaggcgauucaaauuaucgauaugacguuugggaacuuccagauggaaaauggguaacaaacuggaaaaaugaagcaggggaagccaugucaagcguaauaaguauguucgacgcacaucaaagcagcgaacccccucggccacacccagcagcacgaaaaauacuaagucuucaucaaaacgaccuacucgcaauugaacgagaaggugaagauagaaaacuuaugagaguaguuaaauucggacagucaggacaaauaacacuagcagaacaucaacaggcuggugaccuuaagaaaagagaugccguaaguaaugacgaugacccauuuaaauacuucgcuccaaccucaggugguuugaaaaagguaaaagcaagacaaguaaggauagacgaaauaggcagaguucuagacccgggauuuccagcaaggacagcuagacgaaaaacaagaggauga

SEQ ID NO: 8564 - RNA, 3333 nt, Artificial Sequence
  Cas9 variant
augaccgcuagaacacauaagauauggcgcuuaggggcagauuuaggagcaaacucauuaggaugggcugcgauagaacucucagcaccgguggauggcaaaccaauugcaauacugcaugcugguagucguauauuuagcgauggaagggacccuaaaucaggugcuucuuuagccguugacagacgagacgcacgagcaaugagacgaagaagagaccgauuacaacaaaggcagagagcacucauaaaauaucuaauugcagacggacuuuuuccugcagaugaaaaugaacguaaagcaauggcaacuauugacccauacgcaguaagggcaagagcacuggaugaagcacuuacucuaccugaaguagguagagcauuauuucacuuaaaucaaagaagaggauuuaaaaguaacagaaaggcugacagaaaagcugacgaagacgcaggaaaaauagcaauaggaauagacagaacaagagacgcaauaagacaagccgaagaagaagcaggagcugaaccaggaucauggacauauggaaaauggcuguacgagagacgagcaucggcaacugacgcaaaugcaauaccaucaguaagaaccagauuaaggccugaaacagacgaacaugcaaaaggugacggauacgacuuuuaucccgguagagcgcuaauggaagcagaguucgcugcaauaugggaagcccaagccgcacaccauccagaugcucucacuaaugaaguacacgauagauuacaugaaauaauauuuuaucaacguccauuaaaagcgccucagauuggaguauguacacuaauuagaggggaucaaagacuacccaaagcucauccacuauuucagaaaagaagauuacuugaagaacuaaaugcacugacaaucguaagaccaggugaaauggcacaaagacucacacgugaggagcgagacacccuauuucuuaaacuuaaagacaaagcuaaaguaucuuucguaucacuaagaaaaacgcuaaaacuagauccggaugccagauuuaacaaagaaucagaaaauagaagugaccuuaaaggggaugaagucgcagcugccaugggagcaaaaacaagauuuggcaauagauggguacacuuaucuauagaagaacaaugggauguuauugcaagauuggaggaaguagagucugacgcagaggacgcagcuugccgagcgugguuagcugccacauuugauuuaaccccugaacaaauaagagcgguaacaaaugcaccacuaccaccuggauauucuagauuuggaaaaguagcaacccaaagacugauagacgcauuaagggauggagaaaaagauggacggguccucguauauagugaagcaguggcagcagccggguuaggacaccauucagaccuaagaacaggagaaauauuugaggaugcacaaggaagaccacaauugccauauuaugguguagcucuagagcgacauauaaugcccggaacaggaaacccugaucacuccgaugaaaugagaauuggacguuuaacaaacccaacaguucauaucggauugaaucaacuaagacgcauaguuaacacauuaauucgcgcauacggcccaccggcagagauagcaaucgaauuagcaagggaauugaaauuaacagacgaugauaagaaaagaauaaacaaagagaacaaugaaaacagacuagcagcagagaaaagaagugaaaaauuauuaacaaucgguagacccgauacaggugcaaauagagcauuauuaaaacuaugggaagaauuaaauccggcaaauguucuggacagacgauguauauacacaggaacacaaaucucaguugauauguuauucuccgcagcagucgaaguggaucauauauuacccuucaccgcuacauuagaugacucaaauggaaauaaaauuguaugcaugagggaagcaaacagaacaaaaagaaaacaaucuccauaugaagcauggggucauacagacagaugggaagaaauugcagcucgugcugcacaauuaccaaggaacaagcguuggagauuugaaccagacgcuauggaaaaauucaaggacgaauccggguuucaggcuagacacuuaguagacacccaauauuuagcaagauuaucaagagaauaucuagaaacacucuauccagguucaggcgaaggaucuucgcauauaugggugucuccuggacgauugacggaaaugguaagacgaaaauuaggccugaaugaucuuuugccagaucacaacuuuggaggaggugcagaucaggcuaaaaaccguuuagaucauagacaucacgccaucgaugcuguaguaguagcaauaguagauagauccauguuaacagaaauuuccagaguuaguggccuagaaggagcugaaggaagggaaagaauaauaauaccaccaccgugggacgaauuuagaaacgaucuaaggacagcaguaaacgcaauaacagucagucaucggaccgaccacgguacaauuagcaaagccggauuaccaaaaggaaaagacgcaaccgcagguagacugcauaacgacacugcguacggauucacuggagaaacagacgcaaagggaaauuccauuguagucagacggguuccacuagcuaguuuuaagaaauuggccgaccuugauagaauacgagauacggaccuaaaagccgcgcuuuaucaacaccucgaaggauuagaggguaaagccuucgaaaaagcaguaauggauuuuccaaaucuagaauggcauccauucgguaaugucagaagaguaaggguaacagaaguauuaucaguuauacccauauccgaucaaaauggcagaaucuauaaagguuacaaaggagacuccaauuacagauaugauguuugggagcuaccuggaggaaaaugggaagcugaaguugucaguaccuuugaugcacaucaaccagauuggguuucgaaaaucaggucaagaucaccaacugcaagaaaaguuuuaucuuuacaacaaaaugacuuaauagcuguugagagagcucacgagacgagagaauuaaugcgaguuguuaaauuccgacaaaacggagaaauuacauuugcaccuccucaagaggcaggaucuuuaaaaagaagagacgcuacgccaaacgaagaugaccccuucaaguacuuugcgguugcagccucuucucuacaaaaagcuaaagcacgacaaguucgaaucgaugagcuaggcagaguacucgacccaggauuuccagcacguacagcccgacguaaaacacguaaaucgacuuga

SEQ ID NO: 8565 - RNA, 3333 nt, Artificial Sequence
  Cas9 variant
augagaauccucggauucgacauaggaauaaccucuauagguugggcauauguggaaggagaagaacuaaaagauugcggagugcggauauucacgaaagcugaaaacccacaaaauggagacuccuuagcagcaccaagaagagaagcuagaggcguaaggagaagacuagcaagacgaaaaguccgacuaaauguaaucaaaagacuacuaugcaaagaguucggacuaaaucuaucagacuauuucgcaaaugauggcgaauuaccaaaggccuaugaaacaacaaaagacacaaaaaguccauaugaacuaaggaguuuagcauuagaacagaaacuagaaccuaaagaacuagcacgaguuauauuacauauagcaaagcauagaggauauggaaacaaacacgcgaaacgggacuuagaagcagaagaaaaagcaaagaaagcagccgaaaaagcaccacaagaaaaggaaucaacaacaaccaacggagacucuaagaaagaacaagaaaaagucuuaaaagcguuauaucaaaaugaaacauuacucaagaaguaucagacaaacuaccaaaccaauaauaaaacgaacgacgaaacaaauaauaaaacaauauuccuggucggaaaauacuuauauaaagaauuucaagacaaaggccaaagaaucagaaacacaacuaacaauuaucaacauacaaugcgacaagaauggcuaaaagaugaacuugaauuuauauucaagaaacagaaagauuucggagccacauucucagaaaauuucgaaagucaaauccuggaaacagcuuucuaucaacgcgaucuaaagagcuucgaagauaaagucggcaaauguguauuuuacgagaaugaaaaucgcgcaccaaaagauucccuaucugcaauggaauuuguagcacuaaccagaaucaucaauacacuaaagaaucuagaaaagaaaaguaaaaaucugggaauaggugaaacauacggcaaagacaaaauacaagaaauauuaaaaauagugcuagacaaaggggaaaugucauacaaagaacugagaaaaauuuuaaaauugaaugagagcauacuuuucgcaaaagacucaaaauuagauuacacaaaagggaugcaagaagcagaaaaagcgaaauucaucgagcuaaagaaucuaaaagccuuuaagaaagccaugggaggagauuuuucaaaauuuccaagagaagaacuugauaaaauagcuaccgauauaguauuaaucaaaucaaaagaaaacuuagcuaagaaauuacaaaauuacucagcacuauccaaagaacaagucgaagcccuaucaaaucucaacuucgcuaaacauaucgaccucuccuuaaaagcacuugacaaaaucuuaccuuucaugagagaaggauuaaguuaugacgaaguuguuaagaaagucggacuacaagaacacagaaaauacaaacaaaaaggagaguucuugauaccguuaaaagaauaugaaccauauuuagcaaauccaguggucgcuagagcauuaagugaauacagaaaaguauuaaaugcacuauuaagaaaauacgggaauguacacaaaauacacuuagaauuuaccagggaagccgguaaaaauuacgaugaaagaaagaaaauagaaaaagaacaacgagaacacuucgaagccaaucaaaaagcaauaaaacaacgagaaauacucggauuaccuauaaacggagcaaauauauuaaaaaugaaauuauggaucgagcaaggagaauguugugucuauaguggagagaaaauaacuuccaaacacuucuuugauuccaaugcucuacaaguagaucauauauaucccuauagcagaucauuugacgauagcuacaugaauaaagugcuaguauucgcuaaagaaaaucaaaacaaacucaacaaaaccccauuugaagcauucggaagugacaaagaaaaaugggauagaaucuugagcuuaucggcaaaauuaccaaaacaaaaacaaagaagaaucagcaacaaagauuucaaagacaaagaacuaggcuuuauagcaagaaacauuaacgacacuggauauauugcaaggcucgcgucacaauggaccaacaacugucucaaauucgaagacuuaagggaaaacgaaguaacuauagcaggagaaaaagguaguaaaaaccaccuagaaguaaucuccggccaacugacaagcaugcuaagacacuacuggggacucggagacaaagacaggaacaaucaucugcaccaugccguagaugcuguaauaauagccuacacaaacgcuaaaaccauuaaagcauuugcagacuucaagaaaaaucaagaacaaaaucgcgcuaaauuuuaugcaaaacaaaucucagaacaagaauacaaacgacaacggaauccauucgaacccugcgcaaacuuuagacagcgaguagaagagaaaauaaacaaaauauuuguaucaaaaccaccgagaaaaagggcgagaggcgcacuacacaaagaaacauuuggaagcaucuguuuagauggaaacaacaauuggguagcaagguuuaaaauaaaaucuaagaaagaacaagaagauauaaccaaagaaaaagcaacaaaagcaaaauauaaagacgaauuuaaaggagaagaaaauaucaggaaagcauugaaacuugguaaaauaaggagaaucaauaacacacaaaaagacaucgcaauaggagauaagauaguuaaaaacgaaacaaugguaagagucgauauauucaaagauaagaaaggaaaauucuaugccguuccgaucuauacaauggacuucgcacucggaauccucccgaacaaagcaguggcgacaggugaagaugaagauggaguaauaaaagauuggaucgaaauggauaaaacaaaauacgaguucuguuucucacuauuuaaagacgauuuaauaaaaguaagaaagaagaaaaugaaagaagcagaacuauguuacuuugucggauucgacacagacggaucaagaauaaucguagcaaaacauaauaaugacuaucaaacaaugacagaaaacgaauguaaacuauuuacacucaaagaaaagaagaagaaacagaaaacacuaaacgacgaagaagacaaucaagaacgaauagaaaccgaauauaaaauaaucggcggcagaacugguauacaaaacuuagaaacauuugaaaaacaccaggugagccccuuaggggagguacaaaaagcugaguucgaagaucggcaagaaaucaaacuaaaaucuucaccaaaaggaaaagauuga

SEQ ID NO: 8566 - RNA, 3333 nt, Artificial Sequence
  Cas9 variant
auguccgagaaauaucguuugggguuggacguagguaccaauagcuuaggaugggcuguaauagggcuuaaagaagacguaccaucguccguauuagcaacaggaguuagaauauuuagugaaggacgagacgcaaaaacuaaaagcacacuaaaagcgucgagaaccgagaaaaggucagccagacguagaagagacagauuuuuacaaagacaaacuuucuuaauuucugaaauggucaaaagcggacucuucccaaaagauauaguagaacagaaaaaccuggaguuguuagacccauacgaaauuagauuuaaagcgcuaacagaacaaguaccacuacaucaucuagggagagcauuauuucauauaaaucaacgaagaggauucaaaaguucaagaaaagauaaaucagaagaaacaacuucgggaguagugucaaaaagcguuagagcauuauaugaagaaaugcaauuaauuaauccagcaccagugauugacgauccaaaagcguuaaguaaagaagaaagaagagaaauaagaguacaagaggcaagcagccgagaagaagcucuaguaacucuugcggaacaaaaaggggucacauucggagcuuuccuauauagaagauugcaaucaggaaaaagcguaagggcaagaaaagaugcggauucacaauuauaugacguauauccaaccagagaacuucuaaaagacgaguauucaaaauuaaugcaacaucaagcccaauauuauccaaauguaauaaacgaagcauuaaucucgcgacuacaugacguuauauuuuuccaaagaaaacuaaaagaacaagaaagaggguucugcacauauuauccgucagagaggcgcacauuuagaugcaugcccagcuuucaacaauaccggaugguacaagaguuaaacgcucuagaauggguagaugcugcaggaaaacauugccuaagagauuauccagaaucacgcgaucuaauauuaagugaauuagaaaauauaaguacgaaggcaggagaauuuacauuuggaaauaugaaaaagauccuuaagaaaauggggguaauugauggagaagugucuuuuaauuucgaaggaccuaaaagaaaaggguuccaaggaaauguaacaaguagggaaaugagacaugaggauuguuucggaacaaggugggacgaauuaagucuagaugaaaaagaugauaucauagauaaaauaaaugacgaucaucuagacgaugaagacauggaaagauacuuaauagauacauacggacuaucgaguuuuuccgugggaaaugcaauaaaugcgagauuauuagaagggacagccaacguuagcaggaaagcagcacgaacacuuuaugaaacaaugcuaucagccaauugucugcaaagugacgcuguaauagcuguuagugagcaagacgauacuuuuguaaauccuuauucuagaacuggacguggugaacuuuuaucugaacuaccauacuauggggaagcguuccaagacgggcgccacauaauaccagggaaaagagagccaaaaguuucgcaugaucaacuaaaauuuuauggcggagucagcaauccuacaguacauauagcucuuaaccaaauuaggcuuguggugaaugaaauuauaaaacgcuacggucuacccaguucaauauccauagaauuagcuagaaauuuaccagaaggacaagacggcagaaggaaaauagaaaagaugcaaagugaaaaccagaaaaacaaugaacgauacgaucaaauauuaacagaaaauggacaaagcccgaaucgagauaacagguugagauuagcauuaugggaggaacuaggagaagggcccacagauagacuauguguuuuuacugggaaauuaauagaauuagcagacuuauuuaacggaucgguagaaauagagcaccuuauaccauuuagcguaucacuagacgauagcaaagccaacaaaacgguuugcuggaaagaagcuaauagauucaaaggaaacaaaacaccuuaugaagccuucgccaacaacucaggugauuauuccugggaagaaauuauggaaagagucagagcuuuaccuaauucuaaacaauggagauuucaagaagaugccuuaaagauuuggaacagugaccacagugacuuuucaggcaggcaccuaaacgacacaagauacauaucuagauuagcgagagaauaccuugaaaauaucuguccguuuaauaaaauugaugugguaaccggaagacuuaccgcacuccuaagaggacauugggguuuaaauaacaucuuaagagggcacaaugaaccagaaacggcaacaccaaagaaaaugagggacgaucauagacaccacgcaauugaugcuguaguaauagcaaugacaucgcugacaauacuacaaaaaguaagcagugccgcuggcaaagcagaagaacuugauguuggaaaacucuuugcaaaggaugaaagcgggcgaaguguaauagauccaugggacgguuuucgagaugaaguagcagaaaaaguaaggaauauaauaguuucucacaaaacaaaaaggaaaacuauaggaaacagcggcaaaagcacugacagagcauuacauaaugaaacagcuuacgguuuaauagauggaccagaugaaaaaggcuuauacucaguaguuacgacaaaacccauaaguuauuucgacaauagggauaaaauagaaaagauacgcgaugaaaaacuaagagaugauuucuuaacagcaugggauggugaaggugauaauaaagccagucaauuagcaguccuugauaaagcuagcggguuaaauguaaagaaaugccguuauguugaaagaaagaaagucauaccuaucaacggcccagaugggcaaccauauaaagcauacgaugguaacucaaauugggggauggaaauuuaugaguucccaaauggacauccaaaagaaaagaaauggaacggagugguaauaagcacuuacgacgccaauaaaagugaauuuaaaccaggagaaacauuuagaccacacccggcugcaaaauuaguaaugagacuucauauuaaugauauuguagaagugcaaaaugauggagaaccuauucucuauagagugcaacugauaucagcaggaacacuaacggucucaccauuacaugaagcuaauguagauucuagaaauagagauaaacacgaugaguucaaauauaaaaguuuaagcguaacaccuaugcagaaaaugggagcgaagaaagucaauauaaguccaacaggccugaaaaauuacucgcgauga

SEQ ID NO: 8567 - RNA, 3345 nt, Artificial Sequence
  Cas9 variant
augggaauaauuauugggcuagauauagguauagcuucaguaggaauagcaguaguagacaaagacacacuugacauaaaauguguaguuagcgaucuauucgauucagcagaugcaucuaaaaacauagaacgacgaaauaaccgacaagcaagacgauuaaacagaagaagaaaaacacgaauaggcgacuuuaacacucuuuggguauccauguucggcgaacuacccgaagaaguagauucgaauguacuacuacuacgaaaugcaggccuugaugaacaacuaacacuagacgaaauuuacuguguacuaaaauacaugcuuaaacauagaggaauuucauaccuagaagacgcacuuaaugaagaaaauguaaccggaagcuaccaaaaaggaauagccauaaaccaaagagaauccgaauauauguugccaugcgaaauucaacucgaaagguuucgaaaauacggucaauaccgaggugaaugugaagcagaaaaugaaaauggagaaaagaucacacugaguaacgucuuuaugacaaacucauaucgaaaagaaauagacaaauuccuaaacacacaaggaaaauacgguauacuaaaucaaaaauucaucgacgaauaccuuaaaauuuuuaaccgaaaacgaaaauauuacgaaggccccggaaacgaaaaaucacgaaccgauuauggaaaauacacaacaggaaaagaccuagauggaaaauacauaacagagaaaaacauauuugaaaaacuaauagguaaaugcucagucuauaaagaagaauugagagcggcaggagcuucuuacacagcacaagaauuuaacauacuaaaugaccuaaauaacauuacaguaaauaacaagaaacugacaacacaacagaagaaagacguaauugaaaucguccaaaauagcgaccgaauuaacauggagaaaauuauaagcucaugcauaggagagaaaauagagaaaauagaaggagcgcgaaucgauaaaaaugagaaaaacauuuaccauacauuugaacaauacaauaaaaugcgaaaaauauuugcagagaaaaauuacgauauaaaagaauuaacaauugaacaacuagaugaaaucggccguauacuaacaauaaacacugaacgcgaaggaauaaaagaugcaaucauggaauccgagcuauugcacuuaaauaacgaacaaauaaaccucuuaauagaacuaagauauaaaaacucuucccuauuuaccaaauggcaaagccuaucaauaaaagcaaugagagaaauuauacccgaucuauaugauagaaacguuaaccaaaugaauauauuagcagaacgcgguguauucaaagauaaaauaaaccuauucgaaaauucaguuuaucuaccuaaagaaccaguacucgaagagauauauaacccaguggucagacgaaguauaucaaugacaaucgacgcauuaaacgcucuaauuaagaaauauggauacccagaagacauaguaaucgaaaugccuagagauagaaacgaugccgaacaaaaagacagaaucaagaaauuccagaaaacaagagaaaacgaacucaaaaauaucaaaaagaaaauaaaagaggaauauggcauagaaauaacagacgaauauuuucgaaaacauaaaggauuagaauuagaguuaaaauuauggguggagcaaaacgaaaaaugucccuacucagguaaauauauaaacgugcaagacauccuauaucaccaugaacuguucgaaauugaccauauaauaccauuaaguauaucauacgacgauucaagaaauaacaaaguccugguauacaaagaagaaaaucaagauaaaggcaacagaacaccacuuauguaccucagcacggucaaccgccaauacgaccagcacgaguucaugaacuacguacuaucaacaaaaacauugccaagaaagaaaagggaacuacuacugaauuaugaggauauaacaaaaauagacguacuaaaaggguucauuaacagaaaccuaaaugacacacgauaugcaucaagaucagucuuaaaugcaauacagcuguucuucggaggaaaagaaugcgauacuaaagugaggguaauaagaggagcggucacuaaucaacucaggauuaaacuaaaucuaccaaaagauagagaaaaauccuacucacaucacgcaaucgaugcagcaauaaugugcuacucccaaaugggcuuaaugaauuuuagaaacauacaaaauaaauuuauagacuucgaaaaugaaacauaccugucagacgaaagagauaguugcuuugacaacaaauacuacgacgaagcacuauucggacaaguacuaaaaaugcguaaaaaccuacucaaagcagaaggcaaaccacaaagauccguacagaguaaaggcguauuugacgaagaagagaaaaauaaugguauaguaagauaccaccacaaaguagauaagaaaccaaauagaggcuuaucaaaugccuccaucuauggcacaagaaaaauagacgauaaaauauacaaaaucgucggauaugauauuagaaacaacaaagacgcagaagcaaucauaaacauuauaaagaaaggaaaaucagacaacuuuuuaauggcaaaacacgauccagaaacauuuaaaaacuuaauggaaauauacgaacaauauaaagaagagaaaaauccguuucuggcauacgaacaagaaacuggagacuacauaagaaaauacgccaaaaaccauaauggaccaauaaucaagaaaauaaaauacguagacucagaaguaggaucauguaucgauauaucagcuaauuauggauauaaaaacggcgacaaaagaguaauaauggacacacuaacaccguacagagcagauguauauuacaacuacaaggauggaacauauaggaucauaggcguaaaauaugcagacuucaaauacaguaacgccaaauauguacuagaugaagaagccuacgcucuaauuuuaauaaaagaaggucuucucaaaauaggagauucauuagaaaacauaucaucaucaggauacgaauaucgacuauccuuuuacaaaaaugacauaauagaauauaccaaaaaugacauaguauacaaagagagauuucucagccgaacgaugcccaaagucaaaaauuacauugaaacuaaaccaauuucugcagcuuuauaugagaaaaggaauccgauaggacucaccaacgcuacuaacauauguaaaauauauacagacguacucggcaacgaaaccaaaauauacaaagaaaaauucaaacuaagcguagacuga

SEQ ID NO: 8568 - RNA, 3345 nt, Artificial Sequence
  Cas9 variant
augaacuacacggaaaaagaaaaacuauucaugaaauacauauuagcacuagacauaggaauagcaucaguugguugggcaauacuugacaaagaaucagaaacagucauagaagccggaucaaacauauuuccagaggcuucagcagcagacaaucaacuuaggcgagacaugagaggugcaaaacgaaauaauagacgccuaaaaacacgcauuaaugacuucauaaaacuaugggaaaauaauaacuuaagcauaccacaauuuaaaucaacagaaaucgucggauugaaagugcgagcgauaacagaagaaauuacacuagaugaacuuuaucuaauauuauacucauaccuuaaacacagaggaauaaguuacuuagaagacgcguuagacgacacaguaaguggauccucagccuacgcaaauggccuaaaauuaaacgcaaaagaauuagaaacacacuaucccugugaaauacaacaagaaagacugaacacaaucggaaaauaucgaggucaaagccagauuaucaaugaaaacggagaagucuuagaccuaaguaauguauucacgaucggugcauaccgaaaagaaauacaacgagucuucgaaauacaaaagaaauaucaccccgaacuuacagaugaauuuugcgauggauacaugcuuaucuuuaauagaaaaagaaaauacuacgaaggacccgguaaugaaaaaucaagaaccgauuauggaagauucacaacuaagcuggacgcaaacggcaauuacauaacagaagauaacaucuucgaaaaauuaauuggaaagugcucagucuacccagaugaauuacgcgcagccgcagcaucauacacagcacaagaauauaacguccuaaacgaucuaaauaaccuaacaauaaaugguagaaaacucgaagaaaacgaaaagcacgagaucguagaaaggauaaaaagcagcaauacaauaaauaugagaaaaauaaucagcgacuguaugggagaaaacauagacgauuucgcaggagcuagaauugacaaaucaggcaaagaaaucuuucauaaauuugaaguauauaacaaaaugagaaaagcacuccuugaaaucggcauugacauaaguaacuauucacgugaagaacuagacgaaauagguuacauaaugacuaucaacacagacaaagaagccaugauggaagcauuccaaaaaucauggaucgacuuaucagacgacgucaaacaaugucuaauaaacaugagaaaaacaaacggcgcacuauucaauaaauggcagagcuuuucauuaaaaauaaugaaugaauuaauuccagaaauguaugcgcaaccaaaagagcaaaugacacuacucacugaaaugggaguaacuaaaggcacucaagaggaguucgcaggauuaaaauacaucccagucgauguaguaucagaagacauauuuaacccaguaguaagaagaucaguaagaauuucauucaaaauauuaaacgcuguauuaaagaaguacaaagcauuagauacaauaguaauagaaaugcccagagaccgaaacucagaagaacagaaaaagagaauaaacgacucacaaaaauuaaacgaaaaggaaauggaauacauagaaaagaaauuagcuguaacauacggcauaaaacuaagccccagcgauuuuucuucccaaaaacaacucagcuuaaaauuaaaacuauggaacgaacaagacggaaucugccuauacucaggcaagaccaucgaucccaacgauauaauuaauaacccucaacucuucgaaaucgaucauauaauacccaggucaaucagcuuugaugacgcaagaaguaacaaaguacuuguauaucgaucugaaaaucaaaagaaagguaaccaaaccccauacuacuaucuaacucacucacauagcgaauggucuuucgaacaauauaaagcaacagucaugaaccuaaguaaaaagaaagaauacgcaauaucgcggaagaaaauacaaaaucuucuuuauucugaagacauuacuaaaauggauguauuaaaaggauuuauaaaccgaaauauaaaugauacguccuacgcaucacgacugguacuaaacacaauacaaaacuucuucauggcaaaugaagccgauacuaaaguuaaaguaauaaaaggaucuuacacucaccaaaugagaugcaacuuaaaacuagauaaaaacagagacgagagcuacagccaccaugcaguagaugcaaugcuaauuggauacucagaacuaggguacgaagcauaccacaaacuacaaggcgaguuuaucgauuuugaaacaggagaaauacugagaaaagauaugugggacgaaaauaugucggacgaagucuacgcugauuauuuauacggaaagaaaugggcaaacauaagaaaugaaguaguaaaagcagagaaaaacgugaaauauuggcacuacguaaugagaaaauccaauagaggacuaugcaaccaaacuauaagagguacaagagaauaugauggaaaacaauauaaaauuaauaaacuagauaucagaaccaaagaaggaauaaaagucuucgcaaaauuagcuuuuucuaagaaagacuccgacagagaaagacuauuaguauaucuaaacgaucgaaggacguucgacgaccuauguaaaaucuaugaagauuauuccgaugcagcaaacccuuucguacaguaugaaaaagaaacaggagacauaauaagaaaauauaguaagaaacacaauggaccccgaauugacaaauuaaaauauaaagacggagaagugggagcaugcauagacauaucgcacaaauacggauuugaaaaagguucaaagaaaguaauccuagaauccuuaguaccauauaggauggauguauacuacaaagaggagaaucacucauacuaucuuguaggcguaaaacagagcgacauaaaauucgagaaaggacgaaacguaauagacgaggaggcauacgcacgaauccuagucaaugagaaaaugauacaaccuggacaaagccgugccgauuuagaaaaucuaggauucaaauucaaacugucauuuuacaaaaacgacauaaucgaauaugaaaaagauggaaaaauauacacagaaagacuuguaagccgaacaaugccaaaacaaagaaauuacaucgaaacuaaaccgauagacaaagcaaaauucgaaaaacaaaauuuaguaggucuaggaaaaaccaaauucauaaagaaauacagauacgauauacuuggaaacaaauacaguugcucagaagaaaaauucaccagcuucuguuga

SEQ ID NO: 8569 - RNA, 3348 nt, Artificial Sequence
  Cas9 variant
augagugcuacauauacaaucggacuagacaucggaauagccucugucggauggugugcguuuggagaaacacacauauuagaucuaggagugcgagccuuugacaaagcagaaacagcuaaagaaggagaaucacuaaaccuagcacgucgaaaugcuagacuaaugcguagacgacuauuccguagaacuuggagacugaagaaauuggcacgucagcuaaaaagugaaggcuuaauagccgacacaaaacuauuuaaaccagaacugccauuuucaaaaaguuuauggcaauuaaggguagacggccuggauagaagacuaaaugacgaagaaugggcaaggguaauuuaucaucuauguaaacaucgugguuuccacuggaucucaagagcagaagcaaaacaggcggaaggagauagcaaaucagaaggaggcaaaguaaaacagggacuagcaggaacagcuaaauuaauggaugaaaaaggauauaggucagcagcggaaaugguccuagccgaauuuccacaagcucaaaggaauaaacaaggggaguaucaaaaagcacucucacgggaauuacucgcaaaagaacuagcacuauuauuugcucaacaaagagaauauggaaauuuacauacgccaggagcauuagaaacagccauauuagggaacggggacaagaaaagugguuuauucuggcaacaaaaaccagcauuagcuggcacggaucuucuaaaaaugcugggcacuugcacuuucgaaaaaggggaauauagagcaccaaaagcauccuucacggcugaaagacauguauggcuaacuagauuaaauaauuuacgaaucguaacagauggaguaacuagacaacuaacagaacaagaaagacaacuaugccuaccauuaccguaucgacaagcuggugauuuaaccuacaaacaauuaggaagcgcacuugcaaaagcuggacuuuuagaagcagggggauuuaaauuuaccggguuagcauauccaacagaagcacaaaaagcagaagguaaagcgaaagaucccgaaagugcgacguuaguaaaaauaccggcauggcacgaacucagacagacacuaacaaaaggaggauugaaugacgaaugggaaaaacuagcuggggacgcccuauguggacaaccagaaauauucgacaaaauugccuggguacuaagcguauauaaagaugaugaugaaguacgggcagaacuagcaaaauuggcauugccaaauccacaagcauuaacugaagcacuacuaaauauaagguucgacaaauuucauagccucucucuaaaagccuuacgcgcaauagucccacacauggaacaaggauuacguuaugaugaagccuguguccaagcgggauaccaccauucccaacucuuaaaaguaggagaaggagaacacaaguaucuaccuccauuauaugauggcagggacggagauggaagaaugauauuugcagaagaugccgauauaccuaggaacccaguuguucuacgaaguuuaaaucaagcaagaaaaguuguuaacgcaaucauaagacgauacgggagucccucagcaguccauauagaaauggcacgggacuuaucaaggccuuucgacgaaaggaacaaaauaaagaaagaucaagacgaauaccaagcuagaaaucaaagagacagagaacaauuuucugaauuauuuggacauccuccgaaaggcuuagaauuugaaaaauggaggcuauauagagaacaaaacggccaaugugcauauagucagcgaccacuaacggcaucuggaaacguagcagaaaucuuuuuagauggcucaacugaaauugaucaugcacuaccauauucacguaguuuugacgacaguaaaaauaauaaaguauuaguauugacaagagaaaacagagacaaaggcaauagaaccccuuaugaauaucugggaggggcugaaaacucagaaucauggcaacgauuuguuucauuuguagaaagcaauaaagcguauagauuagcaaagagaacaagauuacucagaaaggacuucggggcuaaagaaucagaagaguucagagagagaaaccuaaaugauacuagauauguuugcagauucuuuaaaaauuauguugagcagcaccuaaaacuugcagaaggaucugagacaaaaagaugcguaguuguaaguggacagcuaacaaauuuucuacgcgcaagauggggacuacucaaaguaaggagugauagcgacagacaucaugcauuagaugcagcuguuguagcggccugcucacauagcaugguucaaagacuaagcaauuacuccagaacucgagaauuggaacaagucagagauggauuuguugauauugaaacgggugaaauaguaaaccccgcuaugcaucaacaacucagagaacacuuuccugaucccuggccauauuuuagacacgaacuugaagcuagacucaagauagacaguccagaacuacuuagagaggaaauggcaagacuaggcucauauagcgaagaagaauuaaaaguacuaaaaccgcuauuugucucucgagccccacagagaagaaaugguggagcagcacacaaagauacaauauacgggcagccagaaaaauuaaagaaaaacgguaguguaacucagaaaguugcacuuacaucucuaacauuaaaagauauagaccuccuugcugauccccauagaaaugcuaaauuauauggugccauaagagaaagguuagaggcacauggaggcaaaggagauaaagcauuuccugcaaccaauccucuaagaaaacccgacaaagaaggaaauccaaccggacccauaguccgaacagugaccaaagucauagauaaauuaucaggaauaccaguuagagguggaauugcuaaaaaugacaccauguuacgaguugauguauuuacuaagggaggaaaauuccaucuuguacccguauacguccaucauagaguaacaggccuuccaaacagagcaauuauagcauuuaaagacgaggaugaauggacauugauagacgacucauucgacugguguuucucacucuauccaaacgaucuuuuaagaauaaaauuaaagaaagaaagccauucgggcuauuauucaucauguaauagaaguacaggagcaguuaaucuaugggcccacgacagaaauguaaauguuggaaaagacggauuuaucgaaagcaucggcgucaaaauggcaguauccauagaaaaauuacacguagauacauuagguaauauauaucccgcaccaccagagaaaaggagaggacuagcuuga

SEQ ID NO: 8570 - RNA, 3351 nt, Artificial Sequence
  Cas9 variant
augucacaaaaccaaaauccuaacacacagagucaccuuaacccaacgacucagucaagcacgcaaaguaacccacaacccacuacgcaggaaagccuaaaaauacuuggauuugacauaggaguugcgucaauaggaugggcuuucguagaaggaggagaauuaaaagacugcggcguaagaauauuuacgaaagcagaaaacccuaaagauggaagcucacucgcgcucccucgacgcgaagcuagaggcguacgaagacgacuagcaagacgaaaaggaaggcuaaacgcacuuaagguacuaauauguaaagaauuuggacugaauagaagcgacuaccuggcuacugcaggagaacuaccaaaagcauaugcaacaucaaaagaaacaaaaucccccuaucaauuaagagccgaaagccuagaaagaaaacuaagcgcugaugaguucgcgagagucauauuacacauugcaaaacauagaggauacggcaauaagcacgcaaaagaaucaucggaugacgacucuggcaaggucaagaaagccauaagugaaaaccaaaaaguaauguccgaaaaagguuauacaacagcuggacaauauuuauauggugaauuuuaucaaaaagcaagaaauuucucagaagcugaaccaaaaucaccuaaaaaugcccgaggcacccaagaauuuaaaaacgucagaaauaaaagugaaaauuaugccagaugucuagcccaaagugaacuacaaaaagaauuagagauaaucuuugcaaaacaacgugaguucggauuucaauucagcgacaagaaacauaaaacuauaaacgcaaacggaaaacucaaagaacuagacuuugcagacgcagucuuagaaauagccuuuuuacaaagacccuuaaaaaguuuugcugacaaaguagguaaguguaccuucuaugaagauaaaccuagggcuccuaaagauaguuuaucagccauugaguucguagcccuaacuagaauaaucaacacgcuugcaaacaucacaaaacgaucaggagaaguauacucagccgauaaaguuagagaaauauuaaguauaguacuagauaaaggagaaauaacauauaaaaaccugcgaaagguuauagcauuagaugaaagauuacaauuuccaaaggacucaaaauuagauuacgcaaaggaagacgccgaaaaggccaaagcaauagaguucucaaaacucaaggcuuuuagaaaagcguugggcggaucuuuugaaggauucauaagagcugaacuagacaguaucgcaaccgauauagcacuaaucaaaucuaaagacgaacucaaagccaaacuugcaaacuaucagagcuuaaaugaugaacaaagggaaaaguuaagugaauuaaguuucgauaaauucauagaucuuagcuuuaaagcauuagaagcaauacuacccuuaaugcgaggcgauaaagaugauaaaauauauagauacgacgaagcauggagagaagcaggucuuguagagguagccaagaaaacacaaaaaggagacucacucccaccucuuauagaauaugaaaaagacuuagcaaacccuguaguagcacgugcauuagcagaauaucgaaaaguucuuaacgcacuauuaaagaaacauggaaaaguucacaaaauacacuuagaguuuacacgucaagcaggaguaaguucgaaagaacgaggcgaaauaaucgccgagcaaaacaaacgacuuaaagcgaacgaagaggcaagaaaaagaugcgaagaauacggacuaauaccaucagggaaaaacauccugaaacuaaaacuauggcaagaacaaggagaguucuguguauauuccggaaagaaaauaacacagucagaucuuagagacgaaagcaccuuacaaauagaccauauauauccauacuccagaucauaugacgauagucaaaacaauaaaguauuagucuuuacagacgcgaaccaaaacaaauuaaaucaaacaccauaugaagccuucggcaaagacauuuccaaauggaaucaaauacuaggacgaauagaaaaauugccaaaagcaaagaagaaccggauaaccaauaaaaacuucgcaaacaaagaagcaggauuuauagcaagaaauauagucgacacaagcuacaucgcaagauuaagugcuucauacacugacgccuucauugaauuuuguccgcuagcugaaaaugaagauacuacauuaggcaggggagaaaagggcucaaagaaacacauaucaguuguaaacggaagccuaacagcgaccaugagacauuauuggggccugaacacgcuauuggauggcgaaaacuccgaaucaaaagacagaagcaaccacuuacaucaugcccuagacgcuauaauaauugcauauguaaaugauuccguuauaaaggcuuucucagacuuuaagaaaacacaagaacagaacaaagcuagauuaauugcaaaagaaauagaaucugcggaauacaaaauaagcagacgcuucuucaguccgagcggguuugaaaauaacgaagcauuccgccaagccauaaaaagaaaaauacuuggacagucacuugaaagcagagaaaacgauaugacuauuaacucagaagcauuaggagaaaaaguaggaggaauauuugucagcaaacccccaagaaaacgugccagaggagcguuacacaaagaaacauucuccucuauagaugauaaagacuuacucaaaacauacggaggaaaagaaggugucaacagagcaauaaagcugggaaaaguaagacaaauuggaaguaagauagcugacaacggaacuauggugagaguagauauauucagacacaaagucucgggcaaguucuauggaguaccaaucuauacuauggauuucgcuuuagguauuuuaccaaauaaagcaguagucggcggaaaagauaagucuggaguuauuaaagacugguuaccaauggauucaaauuacgaguucugcuucucauuauucaaagacgaccuaauuuugguucagaagaaagaaaugaguaaagcagaacucuguuauuucgcuggauucgacacuagcggcggacaaauaaaaguagaaaaacacgacaaccacuucgcgacucuaacagauaaucaacgucuauuauuuaacaucgccacccccaaagaaguagcaggaaaauccaucggaauccaaaauuuaaaaguauucgaaaaauggcaaguuagcccauuaggagaaguauccaaagcagaguucaaagaaagagaaccuauugcguuaaaaaguacaccaaagagauuccuucaaggguga

SEQ ID NO: 8571 - RNA, 3354 nt, Artificial Sequence
  Cas9 variant
augaagcacauacuaggacucgaccuuggaucaaauaguauaggcugggcguuugugcaacaagauuuugaaaacaagcaagguaaaauaauugcaacuggaagcagaaucauuccaauggaccaaggaauacuaggugauuuugagaggggaaauacaguaucacaaacagccgagagaacaacauaccgaagcaugagaagacuaagagaacgacauuuauuacggcgugaacgacuacauagaguacuacaccuucuuggcuuucugccaccacacuacgacgcccaaauagacuucacaaaaagauauggaaaauuuauagacaacgcggaaccuaaaauagccuacaauaauggaaacuuuauuuuuaugaauuccuucaaugaaaugguugaagauuucaaaaaacaccaaccacaauuauuuuacaaaaaaucaaauggagaagaaagucgaauaccauaugauuggacaaucuacuaucuacgcaaaaaagcacuaagucaaaaaauaacacaacaagaacucgcaugguuaauccuccauuuuaaccaaaaaagagguuauuaccaauuaaggggagaagaagaaacagagaacccaaacaaggaagucgcuuuccauucgcuaaaggucgucgauguagaagcagaggcaccuaacaaaaaaggagaaauaugguacaccauaagacuugaaaaugguuggauauauagaagaacuagcaaaaauccgcuagaugacuggaaaggaaaaacaagagauuucauugucacaacagaccuaaacgacgacggaacgauaaaauuagacaaggaagguaaagaaaaaaggucguucagagcaccagacgaaaaugacuggaaccuucuaaaaaaaaaaacagaacacgacauagacuucuccgguaaaccagucggaacuuacauauaugaucaucuguuacagaacccaaaucaaaaaauaaaaggaaaacuuguccgaacaauagaaaggaaauacuacaaagacgaauugaaagccauauuagcaaagcagauagcacuccaaccagaguuauucacggaaacucuauuagcggacugcauaagagaacuauaccggaaaaaugaaacacaacaacaaaaucuacuaucaaaagauuuccuacaucuauucguugaagauauaauauucuaucaaagaccucuaugcagcaagaaaucaacaauagccaauugcacacuagaaaaaagauccuacauagacaaagaaaccaaugaacgcaaagaugcaccaauaaaaguaugugccaagagcaauccuuauuaucaagaauucagggucuugcaaugguuacaaaaccuaagaaucuacgaaauagaaaccgauagagaaguaaccgcagaauucauugaaacaccucaagacuacgaagcucuuuuuaauuucuuaaugagucaaaaagaaaucgauaaugaaggacuauuaaaauacuuuuuauucgcaaaaaauccacaaauaaaagacaaagcggcaaaauccgaauuaaaaaaauggcuuacgaccuauagauggaauuacguauacgacgccgcagacaauaguucaaaaaaauacccaaugaaugaaacgggauacgaauuacaacguuaccuucaaaaagucgaaggccuuccugcaaacuuucucaccuuugauauaacauaucaacucuggcaccuacucuacagugugaaagacaaaguugaauucgaaaaagcacuaaaaaaauucgcuaaaaaaaaacaauuagauaaaacuagcuucgucgacuccuucaagaacuuuaaacccuaccccaacgaguauggaaguuuuucagaaaaagcaauaaaaaaacuacuuccauuaaugcgauuuggaaaccacugggacuucaauagaauagacguaagcacgcaaaaacgaaucgacgaccuaauaaacggugucgcaaaugaagauauucgcacgauaauaagggaaaaagcggaaaaauaccaguuaaauuccgaaacauguuuucaagaucuuccacuauggcuagcacaauacguagucuauaaucgacaugcagaagcuacggauaucgaaaaguggacaucaguaucagaucucgaagccuaccuagaagacuuuaaacaacacagccuucgaaacccaauaguagaacagguaguaacagaaacauuaagaguggucagagauauauggcaacaauacaguggaggacaagcgaacuuuuuugaugaaauacauauagaacuagggcgagaacuuaaaaagaccgcagaagagagaaaacaacuuucugauaaaaaccaagaaaacgaaaacacaaaccucagaauaaaaaaauuacucgcagaauuaaaagaagaugccucaauacaaaauguaaggcccuacucacuaguacaacaagaauuacuuaaaauauacgaagaaggagucuuuagcagcacugacgaaauagaagaagauauacaaaaaauaagaaaaaaaguugagccaaccccacccgaaauacaacgauacaaacuauggcuugaacaaaaauacaaaaguccauacacaggcgaaguaauaagccuaaccaaacucuuuacugaagaauacgagauagaacacauaauaccgcaaagcagauauuaugaugauucauuaucuaacaaaguuauaugugagucugcaguaaauaaauuaaaaacgaaucaacuaggucuagaauuuauacaaaaccaucacggugaaaagguccgaaucaccgcaaacaaagaaguaaccaucuucaccgaggaacaguacaaggaauucguuaaaaaacacuacgcuaacaauagugccaaacaacagaaacucuugcuaaacgaaauaccagaaaaaaugguagcucggcaauuaaacgacacaagauacauaagcaaaugcauuucagaaauauuaagcaaaauaguacgcagugaugaaaaagacgaaggaguaaauucuaaaaacauaauacccuguacuggaaagaucacaacugccuuaaaacaagacuggggucuaaacgacguauggaaugaacuaauuuuaccgagauucgaaagaaugaaccaauuaacgcaaacacaacuauuuacaucauauaaugauagauuacaaaaaaaucuacccacuguaccaauugaauacucacaaggauuccaaaaaaaaagaaucgaccaccgacaccacgcaauggacgcacuaguaauagcuugcgcaacuagagaacacauuaauuacaugaauaaucaacacgcacucgacaaaaguaaagacaaaaaagagaaacaacagucuagaaucgaucuacauccacuauga

SEQ ID NO: 8572 - RNA, 3354 nt, Artificial Sequence
  Cas9 variant
augcaaaccaaaaacuuguuauauacacuaggauuggauauuggaauagcuaguguaggcugguguguacuaggagaaaauagaauuauagauuuaggaguaagauguuuugacaaagccgaaacacccgauagaggagagagcuuaaacaaaguuagacgagaugcaagauuaaugagaagaagacuuagaagacgugcguggcgguuaaccaaauuagcaagacuacuaaaacacgcaggauuaauagauucaacacgcaucguaagagaucgacacgacggcgcaguaucuccauggcagcugaggguagaaggauuggacagaaaauuagcacccgaagaaugggcgagagucauuuaucauauaguuaaacacagaggguuucacuggauaaguagggcagaagaacgaaaagcagaaagugauaaaggcgaaggaggaaaaguaaaacagggacugucagcaacaaaacaacuaaugguagagaaaaauuaucguucagcugccgaaaugguacuaacggaguucccaggagcacaacguaauaaaagaggagaauauacaaaagcacucagccggauauuacuagcugcagaacuuacuaccuuauuugaacgucaacaagaauuaggcaauccucaugcaggcccagauuuacaaacaaaaauuuuaggaaauggcgaccgcaaaagcggucucuuauggaugcaaaaaccaccauuaucuggaucagcacuauuaaaaaugcuagguaaauguacauuugaacgcgaagaauacagggccccaaaagcgucuuuuacugcugaacgccauguauggcuaacaaaauuaaauaaccugagaguacuuguugacggugucaccaggccacugucagauccagaacgucgauuagcacuuucacugccauaucaacaagcauccgacuucacuuauaaacaauuaagggcugcauuauguaaaaauggacucuuaccagacaguuuucaguuuagugggcuugcuuauccaacaggugcacagcagccagacggaaaagcuaaaaauccugaaaacgaccgccuaguaaaacuuccagcuuggcaagaauuuagaaaaacuuuaagggaugcgggauuagaaaccgagugggaaagcauugcaggaauggccgccgguggacaaccagacuuacuagaccaaauuggauggguacucagcguauucaaagacggugaugaaguacuaagggaauuaaggaaaauuccauuaccagguggagagaagaugguacaggcgcugagcggcguaucauucgacacuuuucacaaccuaagucugaaagcauuaaggaaaauaguaccacauauggaagcaggccugagauaugacgaagccugccuagccgcuggcuaucaucauucggauuuaagaaaggauacagaugagaggaguuuauauuugccaccacuauauucugguagaacaacagacggaaggaugguauuuagagaugauauagacguaccaagaaauccaguuguauuaagagcuaucaaucaagcacguacuguuguaaacucaguaguaagaagauacggaagcccaagcucaaugcauauagaaauggcaagggaucuaaguagaccuugggacgagcgcaauaaaguaaaacgagcacaggaagaauaucgagaucgaaaugaaaaauuaaaaauagauuucgcagcagaguauggaaucgaaccaaaaucuagagaguucgaaaaauuuuuacuuuacagagaacaagggggaaaaugugccuacucauuaaaaccucuagauuuagaccgcguauuaagggacuuggguuaugcagaaguagaccaugcucucccuuauucacguucuuuugaugacucaaagaacaauaaaguauugguacuugcugaagaaaauagaaacaaagguaaccguacaccuuacgaguaccuagaugguacaagugaaagcccacgauggagagaguucaaagcauucgucgaaacuaauaaagcauacagacuugcaaaaagagcaaggcuacuacgaaaagauuucucaggaaaaggaagugaagaauuuagagaccgcaaucuuaaugauacaagauauauaucaagauucuuuaaaaauuacguagaaagauuuuuaaaacuugcagaagaaucagaagaacgaacaugcguuguauuaucaggacaauugacagcguuucuccgugcgcgauggggcuuagcgaaaguacgaggagacucagaucgccaucaugcauuagaugcggcaguaauagccgcauguuccagaaguaugguaaaaagacuaucggauuaugcacgaagacaugaacuagaaaaaguaagaacaggauuuguggacuuugaaacaggagaaaucguugaugcagguaaauauaggcaaaucgaaagggauuuuccgucaccauggccguacuuccgggaugaacuacuaaccagauuaaauacagaugauccugcagaauuaagggaaagaaugcagucauuaggaucguauccaccagaagcauuagaaacauugagaccaauguucguuagcagagcaccacagagacgaaacgggggagcugcacauaaagauacuauuuacaggcaaacggaaaggcuaaagaaaguugggucaguuacucaaaaaguaccacuagcagcgcuaaaccuaagagauuuagaaaacuuaguggacccucacagaaacgaaaaauuauacgcagcuauucgggcucgacuagaagcacacggcgggaaaggugaaaaagccuuuccaccaaauaacccauuaagaaaaccagacagagaugguaaccccacaggcccgauaguacguacaguaacacuuguaauagacaaaaugaguggaaucccuguacggggaggcguagcuaaaaacgacacuaugcuucgcguagauaucuucagaaguaagaaagacggcaaauuucaucuaguuccccucuauguucaucacgcaguagcaaaacaacuaccuacacgcgcaguuauagcauacaaagaugaaggggaauggacuccaauaaauaaccaugauuuugacuuuuuauucgcauuauacccaaaugaucuaguaagaauaacacuaaagaaagaaaggcauuuugguuauuaugccggauguaauagagcaacuggugccguaaguauuugggcccaugauagaaaccaacguauugggaaagacggauuuauagacggaauaggggucaaaacagccuuaaguguggaaaaauuucacguggauacuuuagggaauguauaccccgcgccgccagaaacaagaagaggcuuagcauga

SEQ ID NO: 8573 - RNA, 3357 nt, Artificial Sequence
  Cas9 variant
auggggacaagauauaguuuugauauaggaacaaacucaauaggaugggcaguuuggaggacagggcgagaucccaaagguauuuuuggcgaaaaagacgcaccauuagaguuacuaggagcaggcguuagguuauuuaaagauggaagaaauccaaaagacgggcaaucacucgcgacaaugcguagaauaccacgucaagcaagaaaacgacgugauagauuuguuuuaagaagagaagcucuaguagcagcauuaauagaagcugggcuaaugccugcaagcgaaaaagaacgaaaggcucuagccgauuuagauccauaucaacuaagagcagcuggauuagauaaagcacuagcgccacaugaacuaggcagagcaauauuucaccuacaccaaagaagggguuucaaaagcaauagaaaaacagauagaaaaagugaugaucgagacaaagguaaaauagccacagcaucggccgcauuggcaaagaaauucgaagaugaaaaugcgagaaccuucggggaauuucuuuggcgacgacaucgagauccagacaugaaaaggcaagcaguauuaaaagcacaugacccagccaaaggaaaaccugauuuaagagcagcaaaacuaagacaacccaccaggauaaggcuagaaggacaaggagcuacugcacuauaugaauuuuaucccacgagagaaauguuaugccacgaguucgaugcauugugggaagcacaggcccgucaccaccccaugcuauuaacaagagaggcuggagauaaaauaagaaguauccucuucaggcaaagagaacuaaaaccaccuuuaaucgguuuauguacuuucgaauaugcugcaggcgaaaaagaaagccguuuaccaaaagcauugcccucaguccaggcaagggaaauauaugaacgacuugggcacauacgauuaucuaccgguucagggacagauagaccauuaaagucgagcgagagggaugaucuggcaacugccuuacuacacugugguuuaaccaaaauuaaaguaucuaaaacaaagggacuagcauucaaaacggaguucaggaaagcucuacgucuagggggcgaaguacgaauaaacuuugaagaaaugggagaggagggucuaguugaucuaagaaccaacagacuucuaguacaagaugaucacuauggaccaagauggagggcauuaagcuggucuggcaaagacgcuuuugugaagaaacuauuggaagcaaccgacgacgauaaacucguugcaagacuuaugacagaagacggucuaagcgcuguucaagcaagaaacgcagccaguauaccauuaccagacggauacucaagauuaggacccacagcaaaugcugcgauauugcaggcucuaauugacagucgagacgaaaacggauuugucguuacauacgauaaagcaguacggagagccggugaaagauugggcaaagacuggcaucauucagaugagagagacggagaaauacuagaugcacuaccuuacuauggcaaaguauugcaaagacauauacuuccagggaugauggauccggcagacaggaaagacgaagcaaaauuuuacggaaggaucaugaauccaucaguucauauaggauuaaaccaauuaagaagacuuguaaaugcacuuauagaaagauucgggccgccagaucaaauaguaguagaacuggcacgagaucuaaaaaugucagcacgagaaaaagaacaagaacaaagaagaaauagagauaaucgagaagcaaacgagaaaagaacuaaaaagcuaguggaauugggacaggauaauaauggagaaaaucgagcccgauuaaaacuauaugaugaacaacagagagccgggaauggaguagcgcauuguccauuuacguuagauccuauagggauaacucaguuguucaguccagaaauagaaauugaacauguacuaccuagaucaaggacacuagacgacucagccgcuaacaaaguauuauguuucaggaccauaaaccgaauaaaacgugguaaaacaccuugggaagcauuucaugccgauccgaaauggccagacaucgcagccaaugcagaaaaacugccaccgaauaaaagauggcgguuucgagaagaugcaauggauguuuucgaagcaagaacauccggcaaaauggacaaaacuacauuagaacaaauggguuuaacaacaggauuucaagccagacacuuaaacgaaacgaaacauaugucuagguuggcaaaagcguauuuaggaaaaauaugcgacccugaugcugucuauguuaccccgggagcauuaaccucauuacuaaggggaaaauggggucuaaauaguauacuaucagaugauaacuuaaaagacagaacagaccaucgacaucaugcaauagaugcaauaacaauaggagcaaugacaagauccuuguuacuagaacuaaauacuuuagccggaaaagcugagcaaagcgauuacgacgacguagugggaaaaguuccuuggccauucgacaacuuuagagaugcaguacgaagcguaguagauagaguaguagugagcaacaaaccagaacacggaaaacaaggugcuuuacacgaagacacggccuauggaaucguuggugaugaagcagaagcagaagaaauaggaaaucucgugagaagaaaauugcugguagaucuaacacccggugaaguugacaggauacgagaugcaggauugcguaaggccaugcaagcagccguagcaccaagccgagacgcccgaggaaaaguuagugacgcaaaaggauucgcugcagcacuugacacauuugcgaaagcacaaggcaugaggagaauacggguuggcaaagaagacaugagcgcaguaacuauccacgacaggcaaacugauaaggcguauaaagcaguugcaccaggggaaaaucaccauguggacguaguucaaaugagagauggagcauggaaaggauuugcggucacuguguuugaagcaaaccaaaaagauuucaggccacaaugggagagggaaaaauuaggagggaagcuaguaaugagacuacacaagggagacgccguagaauuagaaagcuccggaguacgauuagugaaguuuguacaacaaauauggaugaaaucaaaucuaguauugcuaacugagcauaaugagggaggagauuugcagaaaagacaccaagaugcagacgauccauuuagaugggauuuugcaaauauaggcaaauugaaagaaagaggcuguguagcaguuaaaguugaugaacuaggucgaguaacaaaaagaauaaguaauacguga

SEQ ID NO: 8574 - RNA, 3360 nt, Artificial Sequence
  Cas9 variant
augggauaucggauaggcuuagacguagguauaacaaguacaggauacgcaguacucaaaacagauaaaaacgggcuaccuuacaaaauauuaacacuugacucagucauauaccccagagcagaaaacccacaaaccggcgcuucccuggcagaaccaagacgcauaaaaagaggauuaagaagaagaacacgacguaccaaauuuagaaaacagagaacacaacaauuauuuauacauucaggacuacuaaguaaaccagaaauagagcaaauccucgcaacaccacaagcaaaauacagcguauaugaauuacgaguagcagguuuagaucgacgauuaacaaauagcgaauuauucagaguccucuauuuuuuuauagggcacaggggguucaaaucaaauagaaaagcugaauuaaacccagaaaacgaagcagauaaaaaacagaugggucaauuauuaaacuccauagaagaaauaagaaaagcaauagccgaaaaaggauauaggacuguuggggaacuguaucuuaaagacccaaaauacaacgaccauaaaagaaauaaagguuacauagacggauaccuaaguacaccuaacagacaaauguuaguagacgaaauuaaacaaauauuagacaaacaacgagaacucgguaacgaaaaacuaacugacgaauuuuaugccacuuauuuauuaggagaugaaaauagagcagguauauuucaggcgcaaagagauuucgaugaaggccccggcgcaggaccuuacgcaggagaccaaaucaagaaaauggucggaaaggacauauuugaaccaaccgaagaccgugcagcuaaggccacguauacauuucaauacuuuaauuuacuacaaaaaaugacaucauuaaacuaccaaaacaccacaggagacacuuggcauacucuuaacggauuagaccgucaagccauaauagaugccgucuucgcaaaagcagaaaaaccuacaaagaccuauaaaccaaccgauuuuggggaacuuagaaaauuacucaaauugccagaugacgcccgauuuaaucuggugaacuacgguagccuacaaacacaaaaagagauugagacaguagaaaaaaaaacaagauucgucgacuucaaagcguaccaugacuugguaaaagucuugccagaagaaauguggcaaagcagacaacuacucgaucauaucggaaccgcucugacccucuauagcagugacaaaagacggcgaagguacuucgcagaggaacuaaauuuacccgcagaacuaauagaaaaacuacuuccgcuaaacuucucaaaauuuggacauuuaagcauuaaaaguaugcaaaacauaauacccuaucucgaaaugggacaggucuauucagaagcaacaacgaacacgggcuaugacuuucgcaaaaaacaaauuuccaaagauacaauuagagaagaaauuacuaauccuguuguaagaagagccgucaccaaaaccaucaaaaucguagaacaaauaauucgcagauauggaaaaccagaugguauaaauauagaacuggcacgugaacuagguagaaauuucaaagaaagaggagacauacaaaaaaggcaagauaaaaacagacaaacgaaugacaaaauagcagcagaauuaacagaauuaggcauaccagucaauggacaaaacauaauacgauauaaacuacauaaggaacaaaacggagucgacccguauaccggagaucaaauaccauucgaaagagcauuuagcgaaggauacgaaguagaucauauaauaccauauucaauuucaugggacgacuccuacaccaacaaaguacucacauccgcaaaauguaacagagaaaaaggaaacaggauccccauggucuaucuugccaauaacgaacaaagacucaaugcauuaacaaauauagcagauaacauaauaagaaauucaagaaaacgccaaaaauuacuaaaacaaaaauuaucugacgaagaacugaaagauuggaaacaaagaaauauaaacgacacacgauucauaacucgaguucuauacaauuacuuccgacaagcuauugaauucaauccagaauuagaaaaaaaacaaaggguacuucccuuaaauggugaaguaacuuccaaaaucagaucacgauggggcuuucugaaaguaagggaagauggcgaucuccaccacgcaauagaugcaacugugauagcagcaauaacaccaaaauuuauucaacaaguuaccaaauauucacagcaucaagaaguaaaaaacaaucaagcuuuauggcacgacgcagagauaaaagacgccgaauacgcggcagaagcacaacgcauggacgcagaucuguuuaauaaaauauuuaauggauuuccguugccauggccugaauuucuagacgaacucuuagccagaauuagugacaaucccguugaaaugaugaaaaguagaaguuggaauaccuauacaccaauagagauagcaaaacuuaaaccagucuucguaguacgauuagcaaaccacaaaauauccgguccagcacauuuagauaccauaagaucagcaaaauuauuugaugaaaaggguauaguuuuaagucgagucaguauuacaaaauuaaaaauaaauaaaaagggacaaguagcaaccggugacgguauuuaugacccugaaaacucuaauaacggagauaaggucguauauuccgcuauaagacaagcuuuagaagcacauaacgguaguggagaacuagcauuucccgacgguuaucuggaauacguagaucacgguacaaagaaauugguaagaaaagucagaguagccaaaaaagucucauuaccaguccgcuuaaagaauaaagccgcagcagauaauggcucuaugguaagaauagacguauuuaacacuggaaagaaauucguauucguaccuauuuacauuaaagacacugucgagcaaguacuaccuaacaaagcaauagcaagaggcaaaucauugugguaucaaaucacagaaagcgaccaguucugcuucuccuuauauccaggcgacaugguucacauugagucaaaaacugguauaaaaccaaaauauucuaacaaggaaaacaauacgagcguaguaccaauuaaaaacuuuuacgguuauuucgacggagcagacauagccacagcaucgauacuaguaagagcacaugauagcagcuacacugcucguucuauagguauugcaggacuacugaaauucgagaaauaucaaguugauuacuucggucgcuaccacaaaguacacgaaaaaaaaagacaacuauuugucaaacgggaugaauga

SEQ ID NO: 8575 - RNA, 3360 nt, Artificial Sequence
  Cas9 variant
augaacgauaagaaaaauuugggcccacuaacuuuuggauuugauauaggcauugcgagcguaggaugggccguguugaguccgacuagaauaguagacuuggggguacgcuguuucgacaaagcugaaacugcgaaagaaggugaaagccuaaacuuagccagacgaucagcccguuuaaugcguagacgacugcguagacgagcauggagauuaauuaaauuagcaagacuacuuaaacaugaaggccuaauagcugauaccaagacuuuuauacagccaucagcaucgcaugcuucaccauggcaauuacgaaaagauggauuagaucgggcuuuaaguccagaagaaugggcaagaguuuuauaucauuuauguaaacauagaggauuccacuggguuucaagggccgaagcgagaaaagccgacggugauacaaaaggagaaggaggcaaggugaaacaaggauuagcaucaacaacaaaacugaugaaugacaaaucuuauagaacagcggcagagauggucuuagcggaguucccuagugcucaaagaaauaaaagaggugaauauacuaaagcacuaagccgugaacuacuagacaacgaauuaaaacaacuauuugaaagacaaagagaauaugguaacccccaugcagauacgaaucuugaggcaaagauaagagguucaggugaucauaaaagcggguuauuuugggagcaaaaaccagcacuaucagggaaugaccuuuuaaagaugcuugggaaauguacauuugaaaaacaggaguauagagcuccaaaggccagcuuuacagcagaacgacacguaugguugacacguuuaaauaacuuaagaauuauugucgaugggagaacacgaccuuuagcagaugcagaaagaacaauggcauuaaguuuaccauaugaacaagugggugacuuuacuuauaaacaacuaagagcugcucuuguuaaagcaggacuaaugccagauaguuucaaauuugccagucuagcauauccgagugaauuucaaaaagccgaagguaaagcaaaagauccagaaucagcagcccugacgaaguuagcugcauggcaagaacuucgagcaacacuuaaaaaggcagaucuagaaucagaauggcaacaaauuucuugugcagcauuagaaggacaaccagaaacauuagacgaaauagccggaguuuuaucaguuuuuaaggaugacgacgaaguuuuaaacgaacugcaaaaacuugguuuaccgggaggugcaaagacagaaaaugcauuguuagauauaagauucgauaaguuucaugcucucuccuugaaagcauuaagaaaaauuguuccguacauggagcgaggauuaagguaugaugaagcaugugagagagcagaauaucaucauucgcaacuacauaaaguuggagaaggaaauaggaaguacuugcccccuuuguauaaaagcagagauaaagacggacgaaugguauuuaaugacgaauuaggagauauaccacgaaauccuguagucuuaagaagucuuaaucaagcacgaaaaguacuaaaugcacuuauagcgcgcuacgguagccccuccuccguacauauagaaauggcuagagaauugucaaaaccuuuugaugaacgaaugaaaguggggaaagaacaagaagcauaccgggaaagaaaugagaaagacaaacaaacauucguugcagaguuugguauagugggagccgcuaagggaggugaguucgaaaaauggaaauuauacagagaacaacaaggaaaaugugcauauucuauacaaggaauagacuuaaauagacuauuggaaccaggauauguggaaauagaucacgcacuaccguacaguagauccuuugaugauuccaaaucaaauaaaguauuaguauuagcagccgaaaaucguaauaaagggaauagaacgccauacgaauaccuagauggagaacacaauucugaaagauggcgucaauucguggguuucguagaaucaaauaaacuauauaggcaagcuaaaagaucuagacuauuaaggaaagacuuuggcaaagaacaggcagaugaguuccgcgaaagaaaccucaaugauacaagguauguauguagauuuuucaaaaaccaaguggaacaauuuuuaaaacuugcagaaggaucagaaaguaaaagaugcguagugcuaucaggacaauuaaccgcauuccuaagagcaagauggggauuaauaaagguaagagacgaaagugaucgacaucaugcacuugaugcaguaguaguugcagccuguacgcauggaaugguuaaaagaaugucagauuaugccaggcgaaaagaauuagaucaaguagcugaaggauuuguagauguggagacgggagagauaauuaaugcagcaauguuucaacaauuacacgaacauuucccagacccauggccccacuuuagagacgaaguacagaugcgauuaaaaauagaugauccugcacaauuacguagugaucuccugagauuagggaauuaugcagaggaagacguccaugcuguaagaccauuguucguaucccgagcuccacagcgaagaaacucaggagcagcgcauaaggaaacaauauaugggcaaccagagagacuuaaagcacaagggggaguuacagaaaaagucgcacuaacagcauugacaaugaaagaccuugauagacuaauagacccacauagaaaugaaaaauuauacgcugcgauuaggaagagacuagaggaguucggagguaaagcagacaaagcauucgcagcaucaaauccauuacacaaaccagacaaagaaggaaaucccacaggaccuaucgucaggaccguuacauuagaaauagacaaacuaucaggaguaccagugaggggaggaauagccaaaaaugauacaaugcuaagaguagacguauuuaccaaagccggaaaauuucaucuugucccaguauauguacaucauaaagugacagguuuaccuaacagagcgauaguagccagcaaagacgaagaugaauggacagcaauagaugacaguuuugaauuuuuauuuucguuguauccgaacgaucuagucaccauaacccaaaaaggaaaagccccaguucgcggauacuacgcaaguugucauagagggacuggggcauuuucauuaugggcacaugauagggcuuccucagucggaaaagguggacagauagaaggaauuggaauaaagacggcauuagcaguccaaaaauauaauguggauguuuuaggaaccacauacgcagcuccacuagaacaaagaagaggauuagcauga

SEQ ID NO: 8576 - RNA, 3363 nt, Artificial Sequence
  Cas9 variant
augagaaaaguaacuauaggauucgacauugguguuaguucaguaggauggucaguaguugacaugaauaacggagcaauaguugaaacuggaguuagacucuuuucugcaucaucagcagaaaacaacguagaaagacgcaauaacagacaaacgagacgacuuaauagaagaaggaaaaacagauuaaaagacguaaaauacuuacuggaaacuaaccauuuuacauuugaccaagaacaaggaacaaauccauacgaacuaagagucgcuggacuccacagaaaacucacaagaucagaacuugcacgagcacuauaucauuuaguaaaacgaagaggcauaagcuaugacuugacagauaucgaagaagaagaaauaguaaccaccucugcauauaaaacggcacuagguaaaaaccaaagucaacucgcagagaaaacaccaggugaaauccaauucgcaagacuugaaaacuauggaaaaguaagaggaucaauugaaauaaacgaacaagauaucuuauuaaauauauucccgaccagcgcauaccuaaacgaagcaaaaagaaucuuagcaacucaaagaaaauucuauccagaaaucacagaagcauucauugaaaaauacuguacaauacuuacaagaaaaagggaauauuaugugggucccgguacugagaaaaauaggacagacuaugguaucuaccgaacaaauggagaaacacucgauaaccuauuugaaauccuaaucggaaaagacaaauuuuaccccaaugaagaaagggcagcaggaaauaguuauacagcacaauuauuuaacuucgucaacgaucuaaauaaccuaaaaauucaaacaauugaagaucaaaaacuuaccccaaaacaaaaagaagaaaucauugaacagguaaaaacggcggagaagaaaguaaguuuaauucaauuaauaucgaaaaucaccaaaacuccaaaagaccaaauaacaggauaccgaaccgacaaaaaugguaaaccggaucuucauucaauggcaguauuccguaaaguaagaaaacaauuccuaacaauggaaauugacauccuacauuggccggacgagcuucuuaaugaucuaggaagauuacuuacccuaaacacagaaaaaggagaaauaaggaaacaacuaacaaaagacuucaugaaaagauaucccauacugaacgaacagcuaguagaucaaauuauagaaaacagacacauauucgcaguaagcgguaaucauaaauggcauagguucagccuuagaacaaugaaugaacuguuacccgaaaugcuagccacaucaaaagaacaaaugacacuccuaagcgaaagaggaaugaucaaacaacacaaaagagacuauuuaaaaaugaacgaauuagaugcaagauuaauaagugaagaaauauauaauccuguaguaggaaaaucgguaagggaagccauaaaacuuuucaaugaacuaaugaagaaauaucaagagguacgcuacguaguuuuagagaugccaagggaugacaacgaagaaaaagccaagaaagaauuacaaaaauaccaaaaagaaaacgaaaacgaaaaagagauagcccuaucugaguuccaaagaaaaggcuuuuucagcgacgcacaauuggaacgagcacuaauuaaagacaggaaacuaaaaaccaaaauaagauucuggcaccagcaagaagggaaauguuuauauaguggccaaauaaucacaccagucgaacuacuaacaaauucauucaguuucgauauagaucacauaauaccccaaaguguaaguuucgaugauucacuaaacaacaaaguacuauguacaaaagaaaugaaugaccaaaaaggaaaacaaacaccguacggguuccuccuaaacggcaauggucaaggguucgacagguucaaagcaaugguaaacgcaaaccgacuaaugagcaaaggcaagaagaaaaauuuauuauucauggaagacuuaaacaacauagaaacacgaaaacgcuucauagcacgaaaccuaguagauacucgauacgcaagcagaguaguguuaaacgaaauucaacaauaccucagagccaaaaauaaagacacucaaguagccgucguuagggggaaauucacugcuacacuuagaaaacauuggaacauaaauaaauccagagaaacgcaucaccaucacgcucuagaugcaaguaucauagcuaucacuccauuacuaagcguguggaagaagaaacaaacccugauaccaaaaacauuaucagaagaaaaauuagaauuugaauaugacgacauaguagaagacacaauauucgaaaaagcacuauaccaacucccuaaagaaaacuuuaaagaacaacucaacaacagccaaccaaacaucaaauuuucauaccaaguagacaagaaaaugaacagaaaaguaagugaugcaacuaucuacagugucaagcaggccaaauuaagcucagacaaacaauccgaagaauauguacuagcgaaaauaaaagacauauauucugucgaaggauauaaaacauucgcuaaaauauacgaaaaggacaaaucaaaauuccuaauggcacaaaacgauccuaaaacguuugaaaaacuagaagaaauaauacaaucauacccaucaaccagagaaauaaucgugggagaaaagguuaaaguugucgacguaucuccuuuugagcuauaccguaaggaauacggcuauauaacaaaguacgcaaagaaaaacaacgggccaauaaucagacaacugaaauacuaugaucacaaaauaggaaugcaccuugacauaaccaaccagaaaaacaauggaaaagggaagaaaguaauacuacaacaacucaaaucauggagaaccgacguuuauuacaaucacgagaaacaagaauacgaaauaaugggauuaaaauacagcgaccuuagguuuaagaaagaccaguacggaauacccaaagaaagauaccaagaaguaaaacagauggagaaaauagcgccacaaagcgaauuuuguuucagcuuauacagaaaugauagaauaaaaguucucaauaaagaaacugaugaggaaguagaacuacuuuucggagcacgaaacuauacaagugccggcuacguagacuuaaaaccuauugauagaguagaauuuggcaagaaagaauggaucccgguauaccaauacgcgacauccgauggaaaaugcaagaagaaauucgccaagaaaggauacgaaaucuacaaagucaauacaaccauccucggcgaaucauacuacaucaagaaagaaagaauguuaccuaaaaauaucuuagauuga

SEQ ID NO: 8577 - RNA, 3363 nt, Artificial Sequence
  Cas9 variant
auguccgauuuaguacuaggcuuagacauaggcauaggaaguguaggaguagguauauuaaauaaagucaccggcgaaauaauucacaagaacucaagaauauuuccagcagcacaagcagaaaacaaccuuguacgaagaaccaauagacaaggacgucguuuaacaagaagaaagaaacauagacgagugagacucaaccgccuauuugaagaaaucggccuaauuacagacuuuaccaaaaucucaauuaaucucaauccuuaccaguuaagaguaaaaggccuuacagacgagcuaagcaacgaggaacucuuuauugcacugaaaaauauggugaaacaucguggaauaucauaucuagacgaugcaagugaugacgguaauucgucagugggggauuaugcacaaaucguaaaagagaacucgaaacaacucgaaacaaaaacaccaggacaaauucaacuagaacgauaucaaacauauggucaauuacgaggggauuucacaguagaaaaagacggaaagaaacaccgacuuauaaacguauucccaacgagcgcguacagaagcgaagcucuccgcauauuacaaacccagcaagaguucaauccacaaauaacugaugaguucaucaauagguaccuagaaauacuaaccggaaaacgaaaauauuaccaugguccgggcaacgagaaaaguagaacagauuacggucgauaccgaacauccggagaaacacuugauaacauuuucgguauacucauaggaaaaugcaccuuuuacccugacgaauuuagagcagcuaaagcaagcuauacagcacaagaguucaaucuucugaaugaccuaaacaacuuaacagucccaaccgaaacaaagaaacugagcaaagaacagaaaaaucaaauaaucaacuaugucaaaaacgaaaaagcuaugggaccagccaaauuauucaaauacauugcaaaacuccuuuccugcgacgucgcagacauaaaaggauauagaauagauaaaucagguaaagcagaaauacacacauuugaagccuacagaaaaaugaaaacauuagaaacacuggacauagaacaaauggaucgcgaaacauuagauaaauuagcauacguauuaacauugaacacagaaagggaaggaauacaagaagcgcuagaacaugaauuugcagacggaucuuuuucccaaaaacaaguagacgaacuuguccaauucagaaaagcaaauucgaguauuuucggcaaaggauggcacaacuucuccguaaaauuaaugauggaauuaauaccagagcuguacgaaacaucggaggaacaaaugacuauauuaacacgacuaggaaaacagaaaacaacaucaucuagcaacaaaacaaaauacauagacgaaaaacuauuaacugaagaaauuuacaauccagugguagcaaaaagcguaagacaagcgauaaaaauuguaaaugcagcaauaaaagaauauggagauuucgacaauauaguaauagaaauggcaagggaaacuaaugaagaugacgaaaagaaagcgauucagaaaauacaaaaagcaaacaaagacgaaaaagaugcagccauguuaaaagcagcaaaccaauauaauggaaaagcugaacuaccacacucaguauuccauggacacaaacaauuagcuacuaaaauucgacuauggcaucaacagggggaaagaugccuauacacuggaaaaacaauaaguauacacgaucuaauaaauaauccaaaccaauucgaaguggaccacauauuaccacuuucaauaacauucgaugauuccuuagcaaauaaaguucucguuuacgcuacggcuaaccaagaaaaaggucagagaaccccauaucaagcauuagauucaauggacgacgcauggucuuuccgagaacuaaaagcauucguaagagaaucgaaaacucuaucgaauaaaaagaaagaauaucugcuaacugaagaagauauaagcaaauucgauguccgcaagaaauucauagaacgcaaucuaguagacacaagauaugcaucacguguaguacugaaugcacuucaagaacacuuccgcgcccauaaaaucgacacuaaaguaucaguaguacgaggacaauucacaucacaauuacgucgccacuggggaaucgagaaaacuagagacacauaucaccaccacgcaguagaugcacuaauaauagccgcaucaagccaacuuaaccuguggaagaaacagaaaaacacauuaguaucauacucagaagaccaacuacuagacauagaaaccggagaacuaaucucagaugaugaauauaaagaaagcguauuuaaagcccccuaccaacacuuuguugauaccuuaaaaucaaaagaauuugaagacucaauauuauucagcuaucaaguagacaguaaauuuaaccgcaaaauuucagaugccaccauauaugcuacacgacaagcuaaaguaggaaaagauaaagccgaugaaacauacguacuaggaaagauaaaagauaucuacacccaagacggguaugacgcauuuaugaagauuuauaagaaagacaaaucaaaauuuuuaauguacagacaugauccccaaacauucgaaaaaguaauagaacccauacuagaaaacuaccccaauaaacaaaugaacgaaaaggggaaagaaguaccuuguaauccauuucuaaaauacaaagaagaacacggauauauaaggaaauacuccaaaaagggaaacgguccagaaauaaaaucacuaaaauacuacgacagcaaacuaggaaaccacauugacauaacacccaaggauucuaauaacaaagucguacuacaaucacuaaaaccauggagaacugacguuuauuucaacaaaaacacaggaaaauacgaaauacuuggacuaaaauacucagauaugcaauuugaaaaagguacaggaaaauauagcauaaguaaggaacaauacgaaaauauaaaaguaagggaaggcguagacgaaaacucagaauuuaaauuuaccuuauauaaaaacgaucuacuccuacuaaaagacagcgagaauggagaacaaauauuacuucgauucaccucgagaaacgacacaucaaaacauuauguggaacuaaaaccauauaaccgacaaaaauuugaaggcucagaauaucuaaucaaaucucuaggaacaguagucaaaggaggaagguguaucaaaggccuuggcaaaaguaauauaucuaucuacaaagucagaacggacguauuaggcaaccaacauauaauuaaaaaugaaggagacaaaccaaaacucgacuucuga

SEQ ID NO: 8578 - RNA, 3363 nt, Artificial Sequence
  Cas9 variant
augggacuagacauagguguagcaucaguuggauucucaguacuagacauagauaaaggaaaaguuauagaacucggagcgagacuauucucggcaacgguagccgcuggaaaccaagauagaagagauaugagaggagcaaggagacuucuuaaucgaaacaaacaaagacgacaagacacagguaaacuguuuaagaaauuuggacuaauugaugacuuugauaaaggaucauucuacgacaacuucaaucaaaaucuaaacccauacgaauuaagagucaaaggcuuaaccgaacaauuaaccaaagaagaacuagcagaaucacuauaucaaauaguuaaacaccgaggaaucucauaugcguuaaaagaugcagacguagacgaaggaggaacagauuacagcgugagcuuaaaaauuaauagccaggaacuugcugaaaagacuccagcgcaaauucaacuccaaagauuaaacgauuacggaaaagugcguggacaaguuguaauuggagaugacccagacaaucaaaaaguauuauuaaacgucuuuccuacaucggcauaugaaaaagaagcaaaacaaaucauugccacacaacagcaauucuacccagaaagucuuacagacaaauuuacagaagaauacugccaaauauuaacgagaaaacgagacuacuuuguaggcccaggcaacgaaaagaguaggacagacuauggaauauauaaaacagauggaagaacauuagacaaucuauuugaagaauuaauuggacacgauaaaauauauccagaagaauuaagggcaagugcagcaagcuacacugcacaacucuucaacguccucaacgaucuuaacaaccuacgcauauuaaacuacgaagauggaaaacuaacuaaagaagacaaagagaaaauaauagccgaaaucaaaaauaacacaacaacaauaaacaugcuaaauguaauaaagaaaguagccggaugcucaaaagacgacauaaaaggauuuagagugaacgaaaaagauaaaccugaaauaucaaguaugccuguauacagaaaaauucauaaagaccuacucaaagccggaguugauauauccgacuggccgguggaguucauagacgaacuaucauucauauuaacacucaacacagaaaacggagaaauaagaaaacaauuaaauaaccgacucgcaccaaaauucgacuuucuaaaugcagaccuaauucaacuaauuaucgacaauaaagauucguuugaaauaaaaacaaauaacaaauggcacagauuuagcgugaaaacaaugaacaaacucauaccagaaaugauggaaagaccaguagaacaaaugacacuccucaaugaaaugggauugguuaagaaagacaagaaaagguucgaaaauaacaaauacuugccauacaaagaaauagcaaaagacauuuucaauccagucgcuagcaaaucaguaagagaagcacuaaaaauugugaaugcugugcuaaagaaauacggacauauagacuaccuaguaguagaaaugccacgagacaaaaaucugaaagaagaacaagacaacauaaaagaguuccaaaauaaaaacaagaaagcaaaagacgcagcauucgaagcauuuguuaaaucaguaggaagugaacaacgcguaaaagaggcuuuaagcaaaaauagaaaauuacagaugaagaugagauuaugguaccaacagcaagaaauagacccauacaacgguaaaacaaucgacgccacagaccuaauaaacaaccccgauaaauucgaaauagaucacaucauuccccaaucaauaucauuuuaugauagcauaaacaauaaaacacuaugcuucgcaaguaugaaucaagugaaaggacagaaaaccccauacgaguucaugcuagaaggccacggacaaagcuaugacaaauucaaagcaaccguaauggcgaacaaaaauuuugggaaagcuaaacgagcgaacuaccuauuugaagaaaacguaagcgauauagaaacaagaaagagauuuuuaucacgaaacuugguagacacaagauacaguagcaggguugugcuuaauuccuuacaggacuuuuucagagagaaaagcgcagauacgaaaguaacaguaauaagaggaaaauuuaccuccaauaugagaaaacauuggcacauagauaaaaccagagaaacguuucaucaccaugcaauagacgcaaguauaauagcagcaacaccauuuuuaagaauguggaagaaaggaggaaccauauuccccguaaaaguuggugaagaaucaauagauauagaaacaggagaaauucuagaugacaaaaacuuugauaaagcaauguaugaagaaccauacucagguuuuguaucagaaaucaugaacgcagacgacagaauaaaauucagucaucagguagacaagaagaugaacagaaaggucucagacgcaacuaucuauucuacuagaaccggcaaacuagcaaaagacaaaaaggacgcagaguacauaguagcaaaaguuaaagauaucuacucaguagacggauucaagaaauuuaagaaagucuacgauaaagauaaaacaaaauuuuuacucuauaaauaugacccaagaacauuuucaaaacuagaacguauaauaucagauugcccagacaaagucgaaaagguacagacaaauggaaaaguuaaagcuguggacaucucaccguucgaaauguauaggagagaucauggaaugauaaagaaauauucaaagaaagguaacggaccagcuauaaaacaguuaaaauaccuggacaagaaauuaggaucacacauagauauaacaccggcaaacgccaauggcaaacacgugauauuacagagucuaaaaccuuggagaacagauguauaucuaaaccacgaaacuggugaauacgagauaaugggaaucaaauauucagaccugaaauucaauaaaaaugaaggcuacgguaucaaaaaggacaaauaucucgaaauaaagaaaguagaagaaguaucagagaaaagcgaguucauguuuucauuauaccgaaaagaccguguaaaagugcaggacaugaaaaccggggaaucaguagaacuacuauucuggucucgaaauuucagcaacaagaaauaugcagaauuaaaaccaaucucacaagcggaaaacgacaagaaacuaccaguauaugguaaaggaagacuaauaaaaaggcuaauaccuaaaaauuguaaaauauggaaaguaaacacaacaauauuaggcgauccauacuauuuagaaaaagaaucagauucacccaaagacauauuagacuga

SEQ ID NO: 8579 - RNA, 3366 nt, Artificial Sequence
  Cas9 variant
auguccgaucuaguucuaggucucgacauaggaauagguagcguuggugucggcauauuaaauaagguaacaggagagauuauccacaaaaauucccgaauauucccagcugcucaagcagaaaacaaucuaguaaggagaacaaaucgacaaggaagaagacucacaagacgaaagaagcauagaagaguucgacuaaauagacuuuucgaagaaucaggauuaauaacagacuucacaaaaauaucaaucaaucuaaauccauaccaacugagaguaaagggguuaacggacgaacuuucaaacgaggaacuauucauagcauugaaaaacaugguaaagcaccgaggaauaucauauuuagacgaugcuucggaugacggaaauagcaguaucggagacuacgcacaaauaguuaaagaaaauuccaaacaacuagaaaccaagacaccaggacaaauacaauuagaaagauaccaaacauacggacagcuaagaggagacuuuacaguagaaaaagacggaaagaaacaccgacuuauaaacgucuuuccaacaagugcauacagaucagaagcguuaagaauauuacaaacacaacaagaguucaacccacaaaucacagacgaguucguuaauagguaucuagaaauauuaacuggaaaacgaaaauacuaccauggaccaggaaacgaaaaaucaagaacagauuacggacgauaccgaacaaacggagaaacauuagauaauauauucggaauacucauuggaaaauguacuuuuuacccagacgaauuuagagcagcaaaagccucauacacagcccaggaauuuaaucuucuaaacgauuuaaacaauuuaacagucccaacagaaacuaagaaacuaucaaaagaacagaaaaaccaaauaauaaacuaugucaaaaaugaaaaagcaauggggccagcuaaacucuucaaauauauagcaaaacuacuaucaugcgacguagcagacauaaaaggauaucgaauagacaaaucgggcaaagcagaaauacauacauucgaagcauauagaaaaaugaaaacacuagaaacuuuagacauagaacaaauggauagagaaacccuagauaaauuagcguauguauuaacacucaauacagaaagggaaggaauacaagaagcccuagaacaugaauuugccgacgguagcuuuucacaaaaacaaguagaugagcuaguacaauucagaaaagccaacagcagcauauucggcaaagguuggcacaauuucuccguaaaauuaaugauggaacucauaccagaacuauacgaaaccagugaagaacagaugacaauauugacaagacuagguaaacaaaagacuacaucaucuucuaauaaaacaaaauauauugacgaaaaacuccuaacagaagaaauauauaacccaguaguagcaaaaucagucagacaagcuaucaagauuguuaaugcagcaauaaaagaauacggagacuuugauaauauaguaauugaaauggcacgagaaacaaaugaagacgacgaaaagaaagcaauacagaaaauacaaaaagcaaauaaagaugagaaagaugcggccaugcuaaaagcugcaaaccaguauaacggaaaagcugagcuaccucacuccgucuuucacggacauaaacaacuagcaacuaaaaucagguuauggcaccaacaaggagaaagauguuuauacacgggaaaaacaauaucaauacaugaccuaauuaauaauagcaaccaauuugaagucgaucauauacuaccguuaucaauaaccuucgaugauuccuuagcaaacaaagucuuaguauacgcaacagcaaaucaggaaaaagggcaaagaacaccuuaucaagcccuagacaguauggaugacgcaugguccuucagggaacuaaaagccuucguaagagaauccaaaacuuuaucuaauaaaaagaaagaauacuuacucacugaagaagacauaucaaaauucgacguaagaaagaaauuuauagaaagaaacuuagucgauacaagauacgcgucaaggguaguacugaaugcauuacaagagcacuucagagcccacaaaauagauacaaaaguauccguuguaagaggacaguucacaagccaacucagaagacauuggggaauagagaaaacaagagacacauaccaucaccacgcagucgacgcgcuaauaaucgcagcauccucacaauuaaaccuauggaagaaacagaaaaacacucuagugucauauuccgaagaucaacuauuagacauagaaacgggagaauugauuucagacgaugaauacaaagaauuuguguuuaaagcucccuaccaacacuucguagauacucuuaaaagcaaagaauuugaggacucgauacucuucucuuaucaaguagauaguaaauuuaaccggaaaauuagugaugcaaccauauacgcaaccaggcaagccaaaguaggaaaagacaaagcagaugaaacauacgucuuaggaaaaauaaaagauauuuacacucaagauggauacgacgcuuuuaugaaaauuuauaaaaaggacaaaaguaaauuccuaauguaccgacacgacccccaaacuuucgaaaaaguuauagaaccuauauuggaaaauuauccaaacaaacaaaugaaugaaaaaggaaaagaaguaccaugcaacccauuucuaaaauauaaagaagaacacggauauauacgaaaauacaguaagaaaggcaacggaccagaaaucaagagcuuaaaauacuaugauucgaaacuaggaaaucauaucgacauuacaccaaaagauagcaacaacaaaguaguccuccaaucaguauccccauggagggcugacgucuauuuuaacaacacaacagggaaauacgaaauacuaggacuuaaauaugcugaucuacaguuugaaaaggguacgggcacauacaaaauaucacaagaaaaauacaacgacauaaagaagaaagaaggugucgauucggacucggaguuuaaauuuacacuauacaaaaacgacuuacuuuugguaaaagaaacggagacaaaagaacaacaacuauucagauuucuuagccguacuaugcccaaacaaaaacauuacguagaauuaaaaccauacgauaaacaaaaauuugaaggaggcgaagcacuaauaaagguacuuggaaacguagcaaacggaggacaaugcauaaagggauuagggaaaaguaauauaucaauauauaaaguccgaacagacguacuagguaaucaacacauaaucaaaaacgaaggagauaagcccaaauuagacuucuga

SEQ ID NO: 8580 - RNA, 3366 nt, Artificial Sequence
  Cas9 variant
augaacgguuuagugcuaggauuagacaucggcauugcgucagucggaguagguauucuagagaaaaauucagguaaaaucauacacgcaaacaguaggcuauuucccgcagccaccgcagacaauaacguagaaagacgaaagaaucgacaagcaagaagauuaaauagaagaaagaagcauagaggcguaagauuccaagaccuauuugaagacuacggguuacuaacggacuucucaaaaguaaguauaaacuuaaacccauaucgauuaaggguugacggacucaacaaacagcuaacaaacgaagaacuauuuauugcguuaaagaacaucguuaaaagaagaggaauaaguuaccuagacgacgcuagugaagauggcggaacgguaucuagugacuauggaaaagcaguugaagaaaaucgaaaauuauuagcagaacagacgcccggacaaauacaauuagaacgauuugaaaaauaugggcaacuuaggggagauuuuacaguaguagaaaacggagaaaagugccgcuuaauuaauguauuuaguacaagugcauacaagaaagaagccgaaagaauacugaggaaacaacaagaguucaauucaaaaauuacagaugaguucauagaagauuaucuaaaaauauuaacugguaaaagaaaauauuaucacggaccuggaaaugaaaagucaagaacagacuauggaagauuccgaaaagacgguacuaccuuggacaacauuuuuggcauacuaauaggaaaaugcacauucuaucccaacgaauaccgugccaguaaagcgagcuauaccgcacaagaauuuaaccuacuaaaugauuuaaauaaccuaagcguaccaacugaaacaaagaaacuaucagaagaacaaaagaaaacaaucauagaauacgcaaaaucagccaaaacacuaggagcauccacauugcucaaauauauagcuaaaaugauagauacguccgucgaccaaauaagaggauacagaguugauguuaauaacaaaccagaaaugcauacauucgaagucuaucgaaaaaugcaaucacuagaaacaaucaguguaggagaauuaagcagaaaugucuuagacgaauuagcccauauacuaacacuaaauacagaaagagaaggaauugaagaagccauuaacacaaaacuaaaagacucauuuucccaggaccaaguccuugaauuaguccaauucaggaaaaacaacucaucacuauuuuccaaaggauggcauaacuucucccuuaaauuaaugauggaacugauuccugaacuuuacgaaaccagcgaagaacaaaugacaauauuaacucgccuaggaaaacaaaaaucaaaggaaacaaguaaaagaaguaaauauauagacgaaaaagaacuaacagaagagaucuauaaucccguaguagcaaaaucuguuaggcaagcaauaaagauaauaaaugaagcgacaaagaaauauggaauuuuugacaacauaguaauagaaauggcacgagaaaaugacgaagaagaugccaagaaagauuauaucaaaagacaaaaagcaaaccaagacgagaaaaacgcugcaauggaaaaagccgcauuucaauacaauggcaagaaagaacuaccagacaacauauuccauggacacaaagaauuagcaacaaaaauaagauuauggcaccaacaaggagaaaaaugucuauacacaggaaaaacuauaccaauuucagaucuaauacauaaucaauauaaauacgaaaucgaccacgucuugccgcuaagccuuaguuuugaugacagcuuaucaaacaaaguacuuguacuagcaacggccaaccaagaaaaaggucaaagaacaccauuccaagccuuagauucaauggaugauggauggucauauagggaauuuaaaagcuacguaaaagaaucaaaacuauuaggcaauaaaaagaaagaauauuuacugacagaagaagauauaagcaaaauagaaguuaaacaaaaauucauagaacgaaaccuaguugacaauagauacucaucaagaguuguauugaacgcccuacaagacuucuacaaagcccacaaauuugacacaacuauaagugucguaagaggacaauucacaagucaacucaggaggaaauggggucuagaaaaaucaagagaaacauaccaucaccacgcaguagacgcacuaaucaucgcagcaaguagccaacuucgucuauggaagaaacacaauaacccauuaaucaguuacaaagaaggucgauucauagacagcgaaacaggcgaaauaauaucgcugucagacgaugaauauaaagaauuaguauuuaaagcuccauaugaucacuucguagauaccuuacgaucaaaaaccuucgaagacagcauacuauuuaguuaucaagucgacagcaaauauaaucgaaaaauaucugacgcaacaauauacgcaacgcgaaaagccaaacucgacaaagacaaaagugaagaaacauacguacucggaaaaaucaaagauaucuauucacaagcugguuacgacgcauuuauuaaaauauacaacaaagacaaaucaaaauuuuugauguaccacaaagauccucaaacauuugagaaaguaauugaagaaauacuaaggacauauccuucaaaagaacuaaaugauaagaacaaagaaauaccauguaacccguuugaaaaauacagacaagaaaauggaccgauuagaaaauacuccaagaaaggcaacggaccagaaauaaaaagcaugaaauacuaugauaaaaacauaccugaauccuucauaaauauuacuccaucuaacaguaauaacaaaguacucuuaagacaacuguaccccuggagaacagacguauauuucaauccccagacugauaaauaugaauugcuuggacuaaaauaugcagaccuacaauuugaaaaagcaaccggaaaauacaguauaacaauagauaaauauaacgaaaucaaagaaaaggaaggaguaucgaaagaaucagaguucaaauucacgcuguacaaaaaugaccucuuacucauaaaagacaccaaaaauaaugaagaacaaauauucagauuuuuaagccgaacaaugccaaaccaaaaccauuacguggaacuaaaaccauacgacaaaggaaacuucgaagguaaagagaaaauaaaaguguucaaaaugaccucgaauggacgguguauaaaaggucuaggcaaaaaguauuugucaauauacaaaguaaaaacagacaucuuaggaaacaaacacuucauuaagaaagaaggagacgaaccaaaacuuaaauuuuga

SEQ ID NO: 8581 - RNA, 3366 nt, Artificial Sequence
  Cas9 variant
augaaugggcuaguuuugggucucgauauaggaauagcuagugucggggucggaauacuagagaaaaauucaggaaaaauaauucacgcuaacagccgacuguuuccugccgcaacagcagacaacaauguagaaagaaggaaaaacagacaagcaagaagacuaaauagaagaaagaaacauagaggaguacgauuucaagaccuauucgaagauuacggauuauuaacugacuuuuccaaaguaagcauaaaucucaacccauacaggcucagaguggacggauuaaaccaacaauuaacaaacgaagaacuauucauagcacucaaaaauauuguaaaacgacgagggauaucauaccuagacgaugcauccgaagacggaggcgcuguaagcucugauuacgggaaagcuguagaagaaaaucgaaaauuauuagcagaacaaacaccagggcaaauucaguuggaaagauuugaaaaauauggucaaguccgcggagacuuuaccguaguggaaaacggagaaaaacgacgccuaauaaaugucuucaguacuucugcguauagaaaagaagccgagaaaauauuacgcaaacaacaagaguucaacaaucaaaucacagacgaauuuauugaagauuaucuaaagauauuaacaggcaaacgaaaauacuaccacggaccaggaaacgagaaaagccgaacagauuacggacgauucagaacagacggaacaacacuugacaacaucuuuggaguacuaaucggcaaauguacauucuauccaaacgaauacagggccucaaaaucgaguuauacagcacaagaguucaauuuacuuaacgaucuaaacaacuuaacagucccgacagaaaccaagaaacuuagugaagaacaaaagaaaguaauaguagaauacgcaaaagaagcuaaaacacucggcgccucaacauuacucaaguacaucguaaaaaugaucgaugcuucaguagaucaaauauccggauauagaguugauguuaauaacaaacccgaaaugcauacuuuugaaguauauagaaaaaugcagucacuggaaacaauaucagucggugaauugucaagaaacguacucgacgaacucgcucacauauugacacugaacacagaacgggaagguaucgaagaagcaauaaacucaaaacuaaugggcgucuuuagucaagaucaaguuuuagaauuaguccaauucaggaaaaauaacaguucacucuuuucaaaagguuggcauaauuuuucacuuaaguuaaugauggaacugauaccagaacuauaugaaacaagugaagaacaaaugacaauauuaacuagacucggcaaacaaaaauccaaagaaacaagcaaaagaacaaaauacauagacgaaaaagaacuaaccgaagaaauauacaacccaguaguugcaaaaucaguuagacaagccauaaaaauaauaaacgaagccacgaaaaagcauggaauuuucgacaacauaguaauagaaauggccagggaaaauaacgaggaggacgcaaagaaagacuacauuaaaagacaaaaagcuaaucaagacgagaaaaacgcagcaauggaaaaagccgcauuucaauacaacggcaagaaagaacuacccggaaauaucuucaauggccacaaagaauuagcaacaaaaauaagauuauggcaucaacagggagaaaaauguuuauacacaggaaaaacaaucccaauaucugacuuaauccacaaccaauacaaauacgaaauagaucacauauuaccauuaaguuuaucauuugacgauucuuuaucaaauaaaguucuaguacacgccacagcuaaucaagaaaaagggcaaagaacgccuuuccaagcccuagacagcauggacgacgcuuggaguuauagggaguucaaaucuuacguaaaagaccuuaaaucacuaucaaacaaaaagaaagauuaucuacuaacugaagaagacaucaguaaaauagaagucaaacaaaaauucauagaacggaaucucguagacacacguuauagcucacgugugguauuaaacgcgcuacaagacuuuuacaaaucacaucaauuugauacgacaauuagcgugguaagaggucaauucacgagccaacuccgaagaaaguggggccuagaaaaaucaagagaaacauaccaucaccaugcuguugaugcucuaauaauagcagcaaguucgcaauuaagguuauggaagaaacaaaacaaccccuuaauaacauacaaagaaggccaauuuauugacucccaaacaggugaaaucauuagcuuaacagaugacgaauauaaagagcuaguauucaaagcgccauacgaucauuucguagacacccugcacucaaaaacauucgaagacggaauacuauuuucauaucaaguagauucuaaauacaauagaaaaauaucggacgccacaauauacgccacacguaaagcaaaauuagauaaagauaaaagugaagaaaccuacguacuugguaaaauuaaagacaucuacucccaagccggauaugaugcauucaucaaaauauacaacaaagacaaacgaaaauuccuuauguaccauaaagauccacaaacauuugaaaaaguaaucgaagaaauucuaagaaccuauccuaguaaggaaaggaaugacaaaaacaaagaaguaccauguaaccccuuugaaaaauauagacaagaaaacggaccuauaagaaaauacaguaagaaaggaaacggaccagaaauaaaaugucuuaaauauuaugauaauaaacuaggaaauuacauugauaucucaccagacggauccgacaaccaaguaguacuucagucccucaaaccauggagaaccgacguauauuuuaaccaccaaacaaagaaauacgaauuaaugggucucaaauauucagaccugucuuuugaaaaaggaagugggaaauacucgaucagcaacgaaaaauauaacuccauaaaaaggauugaaggaguaaaugaacagagugaguuuaaauucacuuuauacaaaaacgaucuaauccuuaucaaagauagcgaaaauaacgaacaaaaauuauuccgauuuaacucaaggaacgacacugcaaaacacuauguagagcuuaaacccuacgauaaagcaagauucgacggacaacaagaacuaauaaccauccugggaaauguagcaaaaggagggcaaugcuugaaaggguuaaacaaaucaaacauaaguauauucaaaguaaaaacggauguacuaggaaagaaacacaucauuaaaaaggaaggggaugaaccaaaauuaaaauucuga

SEQ ID NO: 8582 - RNA, 3366 nt, Artificial Sequence
  Cas9 variant
augucugaccuaguacuuggacucgacauaggaauaggaagugucggcguaggaauauuaaacaaaguaacuggagaaauuauacacaaaaacucaagaauauuuccagcagcccaagccgaaaauaaucuaguccgaagaacaaacagacaaggaagaagacuuacccgcagaaaaaaacaccgcauagucagacuaaacagacuauucgaagaaucaggauugaucacggacuuuaccaaaaucagcauaaacuuaaauccauaccaauuacgaguaaaagguuuaacugaugaacuuaguaacgaagaacuguuuauagcucugaaaaacaugguuaaacauagaggaauuagcuacuuagaugacgccucagaugacgguaauucaucaguaggagauuacgcgcaaauagucaaagaaaacagcaaacagcuagaaacaaaaacaccaggucaaauucaacuagaaagauaccaaacauauggccagcuaagaggcgacuuuacagucgaaaaagauggcaaaaaacauagguuaaucaacguauuucccacauccgccuacaggagcgaagcucuccgaaucuugaaaacacaacaagaauucaacccucaaauaacggacgaauuuaucaauagguaccuugaaauauuaacgggcaaaagaaaauacuaccacggaccggguaaugaaaaaucacgaaccgauuacggaagauaucggaccaacggcgaaacacuagacaacauauucggaauauuaauagguaaauguacauuuuauccugaagaauucagagcagcaaaagccucauacacggcacaagaauuuaacuuauuaaacgaccugaacaacuuaacggucccaacugaaaccaaaaaacucuccaaagaacaaaaaaaccaaauuauaaauuacgucaaaaacgaaaaagcaaugggcccagcaaaacuauuuaaauauaucgcaaaacuccuaaguugcgaugucgccgacauaaaaggauacagaauugacaaaucaggaaaagcagaaauucacacuuucgaagcauauagaaaaaugaaaacucuugaaacacuagauauugaacagauggacagagagacauuagauaaacuagcauauguacuaacacuuaacacagagagagaaggaauacaagaagcauuagaacacgaauuugcagauggcuccuucucacaaaaacaaguagacgaguuaguacaguuccgaaaggcaaacucaucaauuuucgguaaaggcuggcacaacuucucaguaaaguuaaugauggaguuaauaccagaauuauacgaaaccagcgaagaacaaaugacaauccuuacacgucuaggaaaacaaaaaacaacuagcucuucaaacaaaacaaaauacaucgaugaaaaauuacucacagaagaaaucuacaauccgguaguugcaaaauccguuagacaagccauaaaaauagucaacgcugccauaaaagaauauggagacuuugacaauauaguaaucgaaauggcuagagaaacaaaugaagaugacgaaaaaaaagccauacaaaaaauucaaaaagcuaauaaagacgaaaaagaugcugcuauguuaaaagcagcaaaccaauacaauggaaaagcagaguuaccccacagcguuuuccacgggcacaaacagcuagcaaccaaaaucagauuguggcaccagcaaggagagcgaugcuuauacaccggaaaaacuauaagcauccacgaucucauaaauaacccuaaccaauucgaaguugaccauaucuuaccucuaucuauuacauuugacgacucacuagcaaauaaaguauuaguauacgcgacagccaaccaggaaaaaggacaaagaacaccauaccaagcauuagacagcauggacgacgcaugguccuuuagagaauuaaaagcauucguacgagaaaguaaaacguuaucaaauaaaaaaaaagaguaccuccuaacggaagaagauauaagcaaauucgacguacaaaaaaaauuuauagaaaggaaccuaguugacacaagauaugccucacguguuguauuaaaugcacuacaagagcacuuccgagcacauaaaauugauacuaagguauccgucguuagggggcaauuuacaucacaauuaagaagacauugggguauagaaaaaacaagagauacauaucaccaccacgcaguugaugcacucauaaucgccgcguccucccaacuaaaucuguggaaaaaacaaaaaaauacacuaguaucauacucagaagaccaauuacucgacauagaaaccggagaacugauauccgacgacgaauauaaagaaagcgucuuuaaagcaccuuaucaacacuucguugacacauuaaaaucaaaagaauucgaagacagcauuuuauuuuccuaccaagucgacucaaaauucaacaggaaaauaagcgaugcuacaauauacgcaacgagacaagcuaaaguuggaaaagauaaaaaggacgaaacuuacguucucgggaaaauaaaagauauauauacccaagacggauacgacgcauucaugaaaauauauaaaaaagauaaaucaaaauuucucauguacagacaugacccucaaacauuugaaaaaguuauagaaccaauccuugaaaauuauccgaauaaggaaaugaacgaaaaaggaaaagaaguacccugcaauccauucuuaaaauauaaagaagaacacggauacauaagaaaguauucaaaaaaaggcaacggaccugaaauaaaaagccugaaauauuacgacucaaaacucggaaaucacaucgacauaacaccaaaaaauaguaacaauaaagucguucuucaaucaguuuccccauggcgagcagacguauacuucaauaaaacuacaggaaaauacgaaauauuagggcuaaaauacgcugaccuacaauucgaaaaaggcacagguacauauaagauaucacaggaaaaauacaaugacauaaaaaaaaaggaggguguagacucagauuccgaauucaaauuuacuuuauacaaaaaugaucuuuuacuaguaaaagacacagaaacgaaagaacaacaguuauuuagauuucucucacgaaccaugccaaaaaaaaaacauuacgucgaauugaaaccauaugauaaacaaaaauucgaaggcggagaagcacuaauuaaaguccuaggcaacguugcuaacucaggacagugcauaaaaggacuugcaaaaagcaacauaucaauauacaaaguucgaacagacguacuugggaaccaacauauuauaaaaaacgaaggagauaaaccaaaacuggauuuuuga

SEQ ID NO: 8583 - RNA, 3366 nt, Artificial Sequence
  Cas9 variant
augagugaccuuguauuaggucuggauauaggaaucgguucgguuggugucggaauauuaaacaaaguuacaggagaaauaauucacaaaaacagucguaucuucccggcagcacaagcagagaacaaccuaguaagaaggacaaacagacaagguagaagauugacaagaagaaagaaacacagacgaguacgauuaaacagauuauucgaagagagcggccuaauuacggauuuuacaaaaaucucaauaaaucuaaacccguaucaauuaagagucaaaggauuaacagacgaacucuccaacgaagaacuauucaucgcacucaaaaacaugguaaaacaucguggcauaucauaccuagaugaugcauccgaugaugguaacucaucgauaggugauuaugcucaaauagucaaagaaaauucaaaacaacuugaaacuaaaacaccaggacaaauacaacuugaacgauaucaaacauacggacaacuccguggagauuuuacaguagaaaaggacggcaagaaacacaggcucauaaacguauuuccaacgucagcuuaucgaagcgaagcauuacgaauacuacaaacacaacaagaauuuaauccucaaauaacagacgaguucauaaaccgguaucuagaaauacuaacggguaaaagaaaauacuaucacggcccaggaaacgaaaaaucaaggacagauuacggaagauauagaacuucuggagaaacccuugauaacauuuucggcauccucauaggaaaauguacauucuacccagaugaauuuagggccgccaaagccuccuauaccgcucaggaguucaaucuacuuaacgaccuaaauaacuuaacaguaccaacugaaaccaagaaacuaucuaaagaacagaaaaaccaaaucauaaauuauguuaaaaacgaaaaagcuaugggacccgcaaaacuauucaaauauauagcaaaacuauuaagcugugaugucgccgacauaaaaggauaucggauagauaaaucaggaaaagcagaaauacauacauuugaagcauaucgaaaaaugaaaacacuugaaacacuggauauagaacaaauggaccgugaaacucuagacaaacuugcauacguccucacacucaauacagaacgagaaggaauacaagaagcauuagaacacgaauuugcggaugguucguucucacaaaaacaagucgacgagcuaguacaauuuaggaaagcaaacaguucaaucuucggaaaaggcuggcauaauuuuagcguaaaacuuaugauggaacuuauaccagaauuauaugaaacuucagaagaacaaaugacaauacucacaagauuaggaaaacagaaaaccacaaguucaaguaacaaaacaaaauacaucgacgaaaaacugcuuacugaagaaaucuauaauccaguaguagcaaagucugugagacaagcgauaaagauagucaacgcagcaauaaaagaguauggagauuuugacaacauaguaaucgagauggcuagagaaacuaacgaagacgacgagaaaaaggcaauacagaaaauacaaaaagcaaauaaagaugagaaagacgcagccauguuaaaagcagcaaaccaauacaacggaaaagcagaacucccacauucaguauuccauggucacaaacaacuagcaacuaaaauaagauuauggcaucaacagggcgaaagaugucuauauaccggaaaaacaaucucaauacacgaucuuauaaacaauagcaaucaauuugaaguagaccacauacugccauuaagcauaacauucgaugauucauuagcaaauaaaguucuaguauaugcaacugcuaaccaagaaaagggccaacgaacaccauaucaagcucuagacucaauggacgaugcguggucauucagagaauuaaaagcauucguaagagaaucaaaaacucuuucuaacaaaaagaaagaauaucuguuaacggaagaagacaucuccaaguuugacguaagaaagaaauucauagagagaaaccuggucgauacuagauacgcgucacgagugguacuaaaugcguuacaagaacacuuuagagcacauaaaauagacacaaaaguaucgguuguaagaggacaauuuacuucacaacuaaggcgacauuggggaauugagaaaacgcgugacacauaucaccaccaugccguugacgcacuaaucaucgcugccucaucccaacucaauuuauggaagaaacagaaaaauacacucgucagcuacagugaagaccaacuacucgauauagaaacaggagaauuaauauccgacgacgaauauaaagaaucaguauucaaagcuccuuaucaacacuucgucgacacacucaaaaguaaagaguucgaagacucaauauuauucucuuaccaaguugacucaaaauucaaccguaaaauaagcgacgccacuauuuacgcaacaagacaagcaaaaguuggaaaagacaaagcggaugaaacuuacguacuagguaaaauaaaagauauauacacacaagauggauaugaugcauucaugaaaauuuauaagaaagauaaaaguaaauuccuaauguacaggcacgacccacaaacauucgaaaaaguaauagaaccaauucuagaaaauuaccccaacaaacaaauaaacgaaaaaggaaaagaaguaccaugcaauccauuccuaaaauacaaagaagaacauggauacaucagaaaauauuccaagaaagguaauggaccggaaauuaaaucauuaaaauauuaugacucuaaacuaggaaaccacauagacauaacaccaaaagauagcaacaacaaaguaguucuacaaucuguguccccauggagagcagaugucuacuuuaauaaaacuacuggaaaauacgaaauacuaggauuaaaauacgcagaucuccaauucgaaaaaggaacaggaacguauaaaauaagccaagaaaaauacaaugauauaaagaagaaagaaggcguggacucugacagcgaguucaaauuuacacuauauaaaaacgacuuauuauuaguaaaagacacagaaaccaaagaacaacaacuauuccgguuuuuaucaagaacaaugccaaaacaaaaacauuauguagaacuaaaaccuuaugacaaacaaaaauucgaaggcggagaagcacuaaucaaaguccuaggcaacguagccaacaguggacaguguaagaaaggacuaggaaaaagcaacauaucaaucuacaaagucagaacagauguguuagggaaucaacauaucauuaaaaacgaaggagacaaaccaaaacuagauuuuuga

SEQ ID NO: 8584 - RNA, 3366 nt, Artificial Sequence
  Cas9 variant
augucagaucuaguccuaggacuagacauuggaauaggaagcguaggcgucgguauucuaaacaaaguaacaggagaaauuauacauaaaaauucccgaauauuuccagcagcccaagcagaaaauaauuugguaagaagaacaaaucgacaaggaagaagauuaaccagacgaaagaaacacaggagaguucgauuaaauagacuauuugaagaaagcggacuaauaacagauuucaccaaaauaaguauaaaccuaaauccauaccaacuacgcgucaagggacuaacagacgaauuauccaacgaggaacuauucauagccuuaaagaacaugguaaaacaccgaggaauaaguuaucuagacgaugcuagcgaugacggaaacagcucaguaggugauuaugcacaaaucguaaaagaaaacucaaaacaauuagaaacaaaaacacccggacaaauucagcuagaaagauaucaaacauauggucaguuacgaggagacuucacaguagaaaaagauggaaagaaacacagacuaauaaauguauuuccaaccucagccuaccgaagugaagcacuaagaauccuacaaacacaacaagaguucaauccacagauuacagacgaguucguuaacagauaccucgaaauccuaacuggaaaaaggaaauacuaucauggaccuggcaaugaaaaaucucgaacagacuacggaagauacaggacaaacggagaaacacuagacaacauauuuggaauauuaauaggaaaauguacauuuuacccugaagaauuuagggcagcaaaagccaguuacacagcgcaagaauuuaaucuauuaaacgauuuaaacaacuugaccguuccaacugagacaaagaaacuaaguaaagaacaaaagaaccaaaucaucaacuauguuaaaaacgaaaaagcaauggggccggcaaaacuauuuaaauauauagcaaaacuacuaagcugcgacguagcugauauaaaaggauauagaauagauaaaaguggaaaagcagagauacacacguuugaggcuuaccgcaaaaugaaaacacucgaaacacuagacauagaacaaauggaccgagaaacacucgauaaacuagcauauguauugacacuaaacacagaaagggaaggcauacaagaagcacuugaacacgaguucgcugacggaaguuucagucaaaaacaaguggacgaauugguucaauuccguaaagcaaauaguaguauauuuggaaaaggguggcauaauuuuucaguaaaauuaaugauggaauuaauacccgaacucuaugaaacaagcgaagaacaaaugacaauauuaaaacgacuaggaaaacagaaaacaacauccaguagcaauaaaacaaaguacauagaugaaaagcuacuuacagaagaaauuuauaacccgguaguagcaaaaucaauaagacaagcaaucaaaauaguuaacgcagcaauaaaagaauacggagacuucgacaauauaguaaucgaaauggcaagagaaacaaacgaagacgacgagaaaaaggcaauacagaaaauacaaaaggcuaauaaagaugaaaaagacgcagcaauguugaaagcagccaaucaauacaacggcaaagcagaauugccacacucaguauuucacggccacaaacaacuagcgacaaaaauacgauuauggcaccaacaaggggaacguugccuauacacaggaaaaacuauaagcauccaugaucuaauuaacaacccuaaccaauuugaagucgaccauauauuaccucuaagcauaacuuuugacgauagcuuagcgaacaaaguauuaguauaugcuacagcuaaucaagaaaaaggacaaagaacaccauaucaagcacuagacagcauggacgacgcauggagcuuccgagaacuaaaagcguuugucagagaaucgaagacccuaucuaacaaaaagaaagaauauuuguuaacagaagaagacauuucaaaauucgauguccgaaagaaauuuauagaacgaaaucuaguagacacaagauacgcaucccgaguuguauugaaugcauuacaagaacacuuucgagcgcacaaaauagauacaaaagucucaguaguucggggacaauucaccucacaauugagaagacacugggguauagagaaaacacgagauacauaccaucaucacgccguagacgcguuaauaauagcagcaucuucccaacucaaccuauggaagaaacagaaaaauacacuuguaaguuacagugaagaccaauuacuugacauagaaacaggcgaauuaauaucagaugaugaauauaaagaaucaguauucaaagccccauaccaacauuuuguagauacccuuaaaucaaaagaguucgaagauagcauauuauucuccuaucaaguagauucuaaauucaaucgaaaaauaucagaugccacuauuuacgcaacacggcaagcaaaaguaggaaaggacaagaaagacgaaacguauguauuaggaaaaauaaaagauauuuauacacaagacggauacgacgcauucaugaaaauauacaagaaagacaaaagcaaauuuuuaauguaucgccacgacccacaaacuuuugaaaaaguuauagaacccauuuuagaaaacuacccuaacaaagaaaugaaugaaaaaggaaaagaaguaccauguaacccauuccucaaauauaaagaggaacauggauacaucagaaaauacagcaagaaaggaaacgauccugaaauaaaaagccucaaauacuaugacagcaaacuaggcaaucauauagauauaacgccgaaagacucaaauaauaaaguaguucuacaaucagugaguccauggagagcagacguguauuucaauaaaaccacugguaaauaugaaauauuaggcuuaaaauacgccgacuuacaauuugaaaaagggacaggaaccuacaaaauaagccaagaaaaauacaaugacaucaaaaagaaagaaggaguagauagcgauucagaauuuaaauuuacauuauacaaaaaugaccuacuacuugugaaagacacagaaacaaaagaacaacaacucuuuagauucuugucacgaacaaugccaaaacaaaaacacuacguagaacucaaacccuacgacaaacaaaaauuugaaggaggcgaagcacucauuaaagucuugggcaacguagcuaacucagggcagugcaagaaaggcuuagguaaaucaaauauaucaauauacaaaguacgaacagacguauuaggaaaucaacacauuaucaaaaacgaaggagauaaaccaaaacuagacuucuga

SEQ ID NO: 8585 - RNA, 3366 nt, Artificial Sequence
  Cas9 variant
augaacggauuagugcuaggacucgacauaggaauagcgucaguaggaguaggcauuuuggaaaaaaacuccgggaaaaucauacacgcuaauucucgcuuauuuccugcagcaacugcugauaacaauguugaaagacgaaagaacagacaagccagaagacuucacagacgaaaaaaacaccgaggcguacgauuccaagaucucuuugaagacuacggacuuuuaacagauuucaguaaaguaaguauaaacuuaaauccuuacagauuaaggguagacggauuaaaccaacaauuaacaaaugaagaacuguuuauagcauuaaaaaacauaguuaaacgaagaggaauaagcuaccucgacgacgccucugaggauggaggaacaguuucaucugacuacggaaaagcuguagaagagaauagaaaacuuuuagcagaacaaaccccaggucaaauucaauuagaaagauuugaaaaauauggacaaguacguggagacuucaccgugguagaaaauggagaaaaaagacgucuaauaaacguuuucaguaccucggccuaucgcaaagaagcagaaagaauacucagaaaacaacaagaguuuaauucaaaaaucaccgacgaauuuauugaagacugccuaaagauauuaacaggaaaaagaaaauacuaucauggaccaggaaacgaaaaaagcagaacagacuacggacgauuucgaacugauggaacaacacuugacaacauauuugguauuuuaauagguaaaugcaccuucuacccagacgaauauagagcgucaaaagcaaguuauacagcucaagaauucaaucuauuaaaugaucucaacaaccuuacaguaccuacagaaacgaagaaacuaagugaagaacaaaaaaaaguaauaguagaauacgcaaaagaagcaaaaacucuaggagcuuccacauuacuaaaauacaucgcgaagaugaucgacgccagcguagaccaaauucgaggguacagaguugacgucaacaauaaaccagagauucacacauucgaggcuuaucgaaaaaugcaaucauuagaaacaauaagcgugggagaacuuagucgaaauguacuagaugaauuagcacauauacucacccugaauacggaacgugaagguauagaggaagcuauuaacacaaaacugaaagacucguuuucacaagaccagguccuagaacuaguacaguucaggaaaaacaacucaucauuauuuucaaaaggguggcauaacuuuucucuaaaacuaaugauggaauuaauuccagaauuauaugaaacaucagaagaacagaugacaauacugaccagacuaggcaaacaaaaaagcaaagaaauaagcaaaaggacaaaauacaucgacgaaaaagaauuaacagaggaaauauauaacccaguaguagcaaaaagcguacggcaggccaucaaaauaauaaacgaggcaacgaaaaaacacggaauauuugauaauauaguuauagaaauggcacgugaaaauaaugaagaagacgccaaaaaagacuacauaaaaagacagaaagccaaccaagacgaaaaaaaugcagcaauggaaaaagcagcauuccaguacaaugguaaaaaggaacuaccagacagcauauuucauggucaaaaagaacuagcaaccaaaauaagauuauggcaccaacaaggugaaaaaugccuauauacaggcaaaaauauacccaucuccgauuugauucacaaucaauacaaauacgaaauagaccauauccuaccacuaagccugucauuugaugauucccuaagcaauaaaguuuuaguauuagcgacagccaaccaggaaaaaggacaacguacucccuuucaagccuuagacucaauggaugaugcauggucauaccgcgaguucaaaucauauguaaaagaaucaaaauuacuaggaaacaaaaaaaaagaauaccuacuaacugaagaagacauuucaaaaauagaagucaaacaaaaauucaucgaacgaaaucuuauagacacaagauauucaucaagaguaguccuaaacgcacuacaagauuucuauaaagcccacaaauucgacacuaccauauccgucguaaggggccaauucacuucgcaacuuaggcgaaaauggggccuagagaaaucacgagaaacauaucaccaucaugcuguugacgcacuaauaauagcagcaaguucacaauuaagauuauggaaaaaacaaaauaauccauuaauagcuuacaaagaaggccaguucguagauagcgaaaccggagaaauaaucagcuuaagugaugacgaauauaaagaacuaguauuuaaggcacccuacgaccacuucguagacacacuaaguuccaaaacauucgaagauaguauacuauucuccuaucaaguggauucaaaguuuaaucgaaaaauaucagaugcaacaaucuaugccacaagaaaagccaaacuugauaaagaaaagagugaagaaacauacguucuagggaagaucaaagauauuuacucucaggcaggcuaugacgccuuuauaaagauauacaacaaagauaaaucuaaauuucuaauguaccauaaagauccacaaacauucgagaagguuaucgaagaaauacuaagaacauacccgucaaaagaacuaaacgauaaaaauaaagaaaucccguguaacccauucgaaaaauacagacaggaaaacggacccaucagaaaauacaguaaaaaaucaaauggaccagagauaaaaucacuuaaauauuacgauaauaaacuuggaaaucacaucgauaucacaccagaaaguucagacaaucaaguuguacuccaaagucuaaaaccauggagaacugauguauauuuuaaccaccagacuaagaaauaugaacuaaugggcuuaaaauacagcgaucuaagcuucgaaaaaggaucaggcaaauauucuauuucaaaucaaaaauacaauuccauuaaaaggaucgaaggaauagaugaacaaucagaauuuaaauuuacgcuuuacaaaaacgaccugauacuuauaaaagacagugaaaacaacgaacaaaaacuauuuagauucaacucaagaaacgauaccgcaaaacauuacaucgaacuaaaaccauaugauaaagcaaaauucgacggggaacaagaauuaauaacaauacucggaaauguugccaaaggaggcagauguuuaaaaggucuuaacaaaucaaauauaucgauauucaaggucaaaacagauguauuaggaaaaaaacauauuauaaaaaaagaaggugaugaaccaaaauuaaaauuuuga

SEQ ID NO: 8586 - RNA, 3366 nt, Artificial Sequence
  Cas9 variant
augaacggcuuaguacuaggacuagacauaggcauagcaagcguaggcgucgguauacuaaacaaagauacaggagaaauaauacauacaaacagucgcauauuuccagcagcaacagcggauaauaaugucgaaagacgaaacagucgccaagaccgacguuuaaacagaagaaagaaacaccgaggaguaagacuucacgauuuguucgaggauuacgaccuccugaccgacuuuucaaaaguaucaauuaacuuaaauccauauagacuacgaguacaaggacuagauaacagcuugacaacagaagaacuauucauagcucuuaaaaauauagucaaaagaagaggaauaagcuaccucgaugaugccagcgaagacggaggugucgucaguagcgacuacggcaaagccguagaagaaaauagaaaacuauuagcugaacaaacaccuggccaaauacaauuagaaagauucaagaaauacggacaaguacgcggugauuucacaguaguggaaaacggugaaaaacgaagauuaauaaacguauuuucaaccucagcuuacagaaaagaagccgaaagaauauugcgaaaacaacaagaauuuaauaaucaaauaacagauaaauuuaucgaagacuaccucaaaauauuaacagagaaaagaaaauauuaccauggaccagggaacgaaaaaucacgaacugacuauggaagguucaggacagauggcacuaccuuagacaauauauuuggaauacuuauaggaaaaugcacauucuacccaaaugaauaucgagcaucaaaagcgagcuauacagcucaagaguucaaccuauugaaugaccuuaacaaucuaacagucccgacagaaacaaagaaacuuucagaagaacaaaagaaaacaauagucgaauaugcaaaaucagcaaaaacacucggagcuucuacgcuacuaaaauacauagccaaaaugauagaugcaagcguagaucaaaucagaggauacagagucgauguaaauaauaaacccgaaaugcacacuuuugaagucuaucguaaaaugcaaucauuagaaacaauaagcguaugggaacucucaaggaauauacuugaugaacuagcacacauauuaacauuaaacacagaaagagaaggaauagaagaagcaaucaacacaaaauuaauggacguauuuucacaagaucaaguucuagaacuuguacaauuuaggaaaaauaauuccaguuuauucuccaaagguuggcacaauuucucaagaaaacuuaugauggaguuaauuccggaacuauaugaaaccagugaagaacaaaugacaauauuaacacguuuaggaaaacaaaaaucaaaagaaacaucaaaaagaaccaaauacauagacgaaaaagaaguuacugaagaaauuuacaaccccguaguagccaaaaguguaagacaagcaauuaaaaucauuaacgaagccaccaagaaauauggaauauuugacaauauagucaucgagauggcaagagaaaacaaugaggaagaugcaaagaaagacuauauaaaacgacaaaaagcuaaucaagaugagaaaaacguagcgauagaaaaagccgccuuccaauacaacggcaagaaagaacuaccagacagcauauuccacggacauaaagagcuggcaacaaaaauacgacuauggcaucagcaaggagaaaaaugccuauauaccggcaaaaauaucccuauaagugauuuaauacacaaccaauacaaauacgaaauagaccauauauugccacucucuuuaucguuugaugauagccuaaguaauaaaguauugguacuagcaacagcuaaucaagaaaaaggacagagaacgccguuucaggcacuugauucaauggaugacgcauggucauaucgugaauuuaaauccuauguaaaagauucgaaauuguuaggaaacaaaaagaaagacuaccuuuuaacagaagaagacaucucaaaaauagaaguaaaacaaaaauuuauagagaggaauuuaguugauacaagauauucaucaaggguaguuuuaaacacucuacaagauuuuuacaaagcucauaaauuugauacaacaauaucagucgugagaggacaauuuaccagccaacucagacgaaaauggggacuagagaaaagcagagaaacauaccaccaucacgcaguggacgcauuaauaauagcagcuaguucucaacuacgacuauggaagaaacaagcgaacccacuaauaaguuauaaagaagaucaauucguagauucagaaacaggagaaauaauaucacuuaccgaugacaaauauaaagaacugguauucaaagcaccauaugcucacuucguagauacacuaucauccaaaaaguucgaagacucaauauuauucucauaucaaguugacucaaaauacaaucggaaaauaucagacgcuaccaucuacgcaacccgcaaagucaaacuagacaaagauaaaagugaagaaacuuauguacucggaaaaauaaaagacauauauucacaagcugguuacgaugcauucauaaaaauuuacaauaaagauaaaucaaaauuccugauguaccauaaagacccucaaacauucgaaaagguaauagaagaaauacucagaauuuauccaaguaaagaguucaacgagaaaaacaaagaaguuccaugcaaccccuucgaaaaauauagacaagaaaacggcccuaucuguaaauacucaaagaaaggaaacggacccgaaaucaaaucuuuaaaauauuacgacaaaaacauaccagaaaguuuuaucgauauaacucccaguaacagcaaaaauaagguuauacuaagacaacuaaacccauggaggacagacguuuauuuuaaccaucaaacagaaaaguacgaacugcucggauuaaaauaugcagaccuccaguucgaaaagaaaacagaaacuuacucaaucacaauagacaaauauaacgaaauaaaagaaaaagaaggagucggagaacacucugaauuuaaauucacacuuuacaaaaaugauuugcuuuuaaucaaggacauggaaaucaaagaagaacaaaucuuuagguuucuaucccgaacgaugcccaauaaaaagcacuacgucgagcuaaaacccuacuacaaaggaaacuucgaaggaaaagaaagaauaaaagucuuuaauacaacaucaaaugguagaugccuuaaaggccuuggaaagaaaggauuauccauauauaaaauaaaaacagacguacuaggcaauaaacacuuuauaaagaaagaaggagaaaaaccaaaacuaaaauuuuga

SEQ ID NO: 8587 - RNA, 3366 nt, Artificial Sequence
  Cas9 variant
auggacagaacagaaguaaauauuggauucgacaucggcauauccucagucggauggucgguaguagcaacuaaauccggacgaauauuagaaucaggaguaagucuauuuaguggagcaagcgcagccaaaaacgaagaacggcguaacuuuaggcaaucaagacgccuacucagaagacgcaaaaacagaauaagcgaccuaaagaaauaccuaaaagaacaaucauucacauauaacggagaauuacucaaugaaaacccuuaugagaucagagugaaagggcuuacugaaaaacuaucaaaagaggaaauagcauuagcauuacuacauauaguaaaaagacggggaguaucauacgaucucggcgacaucgaggaagaaggcacaacaggcagcuacaaagagggaguuaagaaaaaccaaaaacuacugaaagagaaaacaccagcagaaauacaauuucaaaggcuuaagaaauuucauaaagugagaggacaaauagcaauagacgaaaaugauguuuuguuaaauguauucccaaaccacgcauacgucgaugaagcucaacaaauauuauauacacaacaagaguucuaccccgaaauaaaugaaacauucauuaaucaagucaccgauuucauaagucgaaaacgagacuacuucaucggaccaggaucagaaaaaucacgaaccgauuacggaauauaucguacugacggaacaacacuacaaaaucucuucucaauacuaauuggaaaagacaaaauauucccagacgaguuccgcgcugcaggaaauagcuacacagcucaagucuacaacuuacucaaugaccuaaacaaucuugcaaucgaugacacagaaacaggcaaauuaacaaaacaacaaaaagagaaaauuaucauggaacucaaaacuaccgagaaaaguguaaacaugaugaaguuaauagcuaagacagcaggggucaccguagaacaaauuaguagauaccgaauaaacagggauggaaaaucagaaauccauaacauggcagucuacagaaaaauuagaaaaguauuucuagaauuaggcuacgaaauaaacgaauggcccucucaauuauuagacgaacugggagacgcacuaucacuaaauaccgaaaacggcgaaauaagaaggauauuaacugacaaucuagccaacaaauacaaaauacuagaucagcaguuaaucaauuuaaucauagaaaacaaaaaugcuuuuacccuuaguaccaaucaaaaauggcaccgauuuagcuacaaaacaaugaaaauccuuauaccggaauugcuagaaacgaacaaagaacaaaugaccauacugacagaaaugggauuaaugaagaaagaccagagaaacuaugucggcaaaaacaaaauagacagugaagcacuauuagaaaauuuauacaacccagucguucgaaaaucaacgaggcaaacaaugaaacucuucaacacccuucuaaagaaauacccuaacauagcuuacguaguaauagaaaugcccagggaagacgaugaagacaaagcaagaagggauuauguaaaauuccaaaaagacaaugaaaaagaaaaagacgcugcacucaaaaacuucauaauggaaaguggaaaaucggaagcggaaguuauagcaaaauacagacaaucaaagaaauuuagaucaaaaguaagauuaugguaccaacaaaugggaagaugccuauacucaggaaaagcaaugccagcagaaagaguauuccgagacgaccauuucacggacauagaccacgugauaccauuaucugucaguuuugacgacgguaugaacaauaaaguuuugugucuggcggagaugaauagacaaaaagauaaacaaacaccauacgcauucuucaacgccggacacggacaaggcuuccaagcaaugaacgcgaugcuuaaaaacaauaacagaauaucaucagcgaagaaacgaaaucucuuguuuacggaaaacuuaaacgaccucgaaguuagaaaacguuuuauagaacgaaaucuaguagacacacgauacgcaucacggguaguauuaaaugaacuccaacaauucguaaaagcaaaacaauuagacacuaaaguaacggucauacgaggcaaauucacgucaaaacuaagggaaaaauggaauauaaauaaaagcagagacacacaccaccaccacgcaguugaugcagcaguaauugcggugucaccuauguuaaauuuaugggaaaaaggugccagcauaauucccaacaaaguaggagaaaacguaauagacaucaaaacaggcgaaaucauaacugaccacgacuaugaagccgacguauaugaauuaccauacgccaaauucuuagaacaaaucccaaaaguaaagaaagauauaaaauuuaggcaucaaguagacaaaaagaaaaauagaaaaguaagcgacgcuacaaucuacacaacaagaaaagccaaaguaggaaaagacaaagaagaaacagauuacguauuagguaccauaaaagauauauacuccuuagaaggcuauguaucuuucaagaaaauuuauaacaaagacaaagcaaaauuuuuaauggcgagaaucgacccaaaaaccuuugaaaaacuagagaaaauaguagcugaauauccagaaucaauagaaguaguucaggauaacgggaaaguagacguacagaaaauuagcccauuugaauuauacagaaaagacaacggguucguaacgaaauucgcuaagaaaaauaauggaccggcaguuaaaagucuuaaauacuacgauucaaaauuaggaucaucaauugaugucaccccugauaaugccaaaaacaagaaagucauacuacaaaguuuaaaaccauggagaacagauguauauuucaacgaagaaaaccaagaauacgaaauaaugggacucaaauauagcgauuuaaaauuugggaaaaacggaaaguacggaguaccaaaaguacgauaugaagaaauuaagcaagaagaagaaauauccgaaggcucaaaauuccuguucucacuauaccguggagacagaauaaaagucacuaacgaacuuggcgagaaucuagaccuauuauucucaagccguacacuaccagcacaaaaaggauacguagaacuuaaaccaauagauaaaaccaaguucgacggaaaagaaaaaguuuccuucuaugguaccguaacaccaaauggacaauucgucaagaaauucgcuaagaaaggauacaaaaucuuaaaacuaaacacagaugaacuaggaaacacuuauauagaaaauggugagaaagaacccucagauauacuugacauguga

SEQ ID NO: 8588 - RNA, 3366 nt, Artificial Sequence
  Cas9 variant
augaacggccucguacucggacuugauauaggaauaggauccguaggaguggggaucuugaacaaggacacaggagaaauaauacaugcuaauucaagaaucuucccagcagcaacugcagacaauaacguggugaggagaucaucacgccaaggcagaagacuaaaccaucggaaaaaacacagauccguaagauuaaaagauuuauuugaauacuaugaccuucucacagauuucucaaaaguuuccaucaacuuaaacccauauagacucagaguaaacggacuuaaccaacagcugacaaaugaagaguuauuuaucgccuuaaaaaacauaguaaaaagacgcggaauauccuaccuagacgaugcaucagaagaugguggagcaguuagcuccgauuauggcaaagcuguagaagaaaacagaaaacuacuagcagaacaaacacccggacaaauccaacucgaaagauuugaaaaauauggacaagugagaggagauuuuacuguaguugaaaacggcgaaaaacgacgacuaauaaacguauucaguaccagugcauacaagaaggaagcagaaagaauacuaagaaaacaacaagaauauaacaaccaaauaauggaugaauuuauagcagauuaucuaacaauacugacaggaaaacguaaauauuaucacggacccgggaacgaaaagagccggacagacuacggccgauuuagaaccgacggaaccacacuagauaacaucuucgguauucuuauaggaaaauguacguuuuauccagagaaauaucgugcgucaaaagccucauauacagcacaagaauucaaucuacuaaaugaucuaaacaaucuaacaguccccacagaaacaaaaaaacuaagugaagaacaaaaaaagacaaucguagaauacgcaaaaagugcgaaaacauuaggugcauccacucuacuuaaauacaucgcaaaaaugaucgaugcaagcguagaccaaauaagagguuacagaguagauguaaaaaacaagccagaaaugcauacauucgaaguauacagaaaaaugcaaucauuggaaacaauaucaguaggcgaauuuucccgagaagugcuagacgaacuagcacauguucuaacuuuaaauacagaaagagaaggcauagaggaagccaucaacacaaaauuaagagacagcuucagucaagaccaaauauuagaacuuguacaauuuagaaagaacaacucaucucuauucucgaaaggcuggcacaauuuuuccuuaaaauuaaugauggaacuaauuccagaacucuaugagacaucagaagaacagauggccauucuaacacgucucggcaaacaaaaauucaaggaaacuucaaaacguacaaaauauauagacgaacaagaaguuaccgaagaaauauauaaucccgugguagcgaaaucgguacggcaagcuauuaaaauaauuaacgaagcaacgaaaaaauacgguauauuugauaauauugugauagaaauggcaagagaaaacaaugaggaagaagcaaaaaaagacuacaucaagagacaaaaagccaaucacgacgaaaaaaacgcagcaauggaaaaagcggcauuccaguacaacggagaaaaagaacuaccagacucaauauuccauggacauaaagaacuugcaacaaaaguaagacuauggcaucaacaaggagaaaaauguuuauauacagguaaaaacauaccaaucagcgaucucauacauaaccaauauaaauacgaaaucgaccacauacuaccacuauccuuaucauucgacgacucacugaguaacaaaguauuagucuuagcaaccgcaaaccaagaaaaagggcaaagaacccccuuucaagcauuagauaguauggacgaugcguggucguacagagaauucaaaucuuacguuaaagacucaaaaucauuaggaaacaaaaaaaaagacuaccuuuuaacagaagaagauaucucaaaaauugagguuaaacaaaaauucauugaacgaaaucuaguagauacacgauacucaucacgaguaguacuaaacacccuacaagacuucuacaaagcacacaaauuugacaccacuauauccguuguacgaggccaauucacaagucaacuacguagaaaguggggccuagaaaaauccagagaaaccuaucaucaccacgcaguggacgcucucaucauugcagccucuucccaacuacgauuguggaaaaaacaaaauaacccauuaauaaguuacaaggaaggacaauucguugauagugaaacuggagaaauaaucagccuuaccgaugacgaauacaaagaacuaguauucaaagcaccauaugaucacuucguagacacacucaggagcaaaaaauucgaagauaguauacuauucucauaccaaguggauucaaaauucaauagaaaaauauccgaugcaaccauauaugcaacgcgaaagacaaaacuagacaaagauaaaucagaagaaacuuauguccucggaaaaauaaaagacauuuacucacaaaguggauaugaugcauucauaaaaauauauaacaaagacaaaaguaaauuucuaauguaucacaaagacccgcaaaccuucgaaaaaguaaucgaagaaauccuccgaacuuauccuuccaaagaauucaaugaaaaaaauaaagaaguaucauguaauccauucgaaaaauauaaacaagaaaaugggccaauucguaaauacaguaaaaaaggcaacgggccugaaauuaagucauuaaaguauuacgauaaaaauauaccagaaucauucaucaacauaacaccgaguaacucgaaaaauaagguaauacuaagacaauugaacccuuggagaacagauguuuacuuuaaccaccaaacagaaaaauacgagcuccuaggccuaaaauacgccgaccuacaauuugaaaaaaaaacuggaacuuauucaaucacaauagacaaguauaaugaaauaaaagaaaaagaaggaguaagugaacacucagaauuuaaauuuacuuuguauaaaaacgaccuauuacucauuaaagacacagaaaucaaagaagaacaaauauuuagauucuugucaagaacaaugccaaaucaaaaacacuauguugaauuaaaaccauacuauaaaggaaauuuugaaggaaaagaaagaauaaaaguauuuaacaccacgucaaacggacgcugcuuaaaaggauuaagaaaaaaagguuuaucuaucuacaaaauaaaaacagauguccuagggaauaaacacuucauaaaaaaagaaggcgaaaaaccaaaacuaaaguucuga

SEQ ID NO: 8589 - RNA, 3366 nt, Artificial Sequence
  Cas9 variant
augucagaccucguacuaggacuggauaucggcauagguaguguaggaguuggcauuuuaaacaaaguaaccggcgaaauuauacacaaaaacucaagaauauuuccugcagcacaagcugaaaacaaucuuguaaggagaacaaacagacaaggaagaagacuaacacgacgcaaaaaacauagaauaguccgauuaaauagacuauuugaagaauccggccugaucacagacuucacgaaaauaucuauaaacuuaaacccauaccaacucagaguaaaagggcuaacggaugaacuaaguaacgaagaacuauuuauugcauuaaaaaacaugguaaaacaccgaggaaucagcuaccuagacgacgcauccgacgacggaaauucuagcgucggagacuacgcucaaauuguuaaagagaauaguaaacagcuagaaacgaaaacaccaggccagauacaauuagaacgcuaccaaacauacggucaacuacgaggugacuucacuguagaaaaagauggaaaaaaacacagauuaauaaacguauucccgaccuccgcguaucgcucagaagcacuccgaaucuuacaaacccaacaagaauucaacccucaaauaacagaugaauuuauaaaucgauaucuagaaauucuuacaggaaaacguaaauacuaucauggacccgguaacgaaaaauccaggacagauuauggaagauaucgcacaaguggagaaacucuugauaacauuuuuggaauauuaaucgguaaaugcacauucuacccagacgaauuccgagccgcuaaagccaguuauaccgcacaagaauucaaccuucuaaacgaccuaaacaaccuaaccguaccaacagaaaccaaaaaauugucuaaagaacaaaaaaaccagauaauaaacuacgucaaaaacgaaaaagcgaugggaccagcaaaacuuuuuaaauacauagccaaacuauuauccugugauguagccgacaucaaagaguaccgaauugauaaaucaggcaaagcugaaauacacacauucgaagcuuauagaaaaaugaaaacacuugaaacccuugacauagaacaaauggacagagaaacucuugacaaacucgccuauguguuaaccuuaaacacugagcgugaaggcauacaagaagcacucgaacacgaauucgcagauggaaguuuuucacaaaaacaaguagaugaauuaguccaguucagaaaagcaaauucgucaauauuuggcaaaggcuggcauaauuucucaguaaaacuuaugauggaacuaauacccgaauuauacgaaaccuccgaagagcaaaugacaauacuaaccagacuaggcaaacagaaaacaaccaguaguagcaacaaaaccaaauacauagacgaaaaacuauuaacagaagaaauuuacaacccugugguagccaaaagcguaagacaagccauaaagauaguaaacgcagcaauuaaagaguauggugauuucgacaauauaguaauagaaauggcuagagaaacaaacgaagacgacgaaaaaaaagccauacaaaaaauccaaaaagccaauaaggaugaaaaagaugccgcaaugcuuaaagcugcaaaccaauauaacggaaaagccgaauuaccacacucaguauuccauggacauaaacaauuagccaccaagauaagauuauggcaucaacaaggagaaagaugccuauacacaggcaagaccauaagcauacaugaccucauaaacaacagcaaucaauuugaaguagaccauaucuuaccacugaguauaacauucgaugauagccuugcaaacaaaguacuuguguaugcaacagcaaaccaagaaaaaggucaaagaacacccuaccaagcacucgauucgauggaugaugcauggaguuuccgcgaacuaaaagccuucguacgugaaucaaaaaccuuaucaaacaaaaaaaaagaauaucuccuaaccgaagaagauauaaguaaguuugacguacgcaaaaaauucauugaaagaaaucuugucgacacaagauaugcgucuagaguugugcuaaacgcacuucaagaacacuucagagcacauaaaauugacaccaaaguaucuguagucagaggacaauucaccucacaauugagacgacauugggguaucgaaaaaacacgugauacuuaucaucaccaugcaguagacgcuuuaauaaucgcagcguccauacaacuaaacuuauggaagaagcaaaagaacacacuaguaaguuauagcgaagaucaacuacucgacauugaaaccggugaacucauuagugacgaugaauauaaggaaagcguuuucaaagcaccauaccaacacuucguagauacacuaaaaucaaaggaauucgaagacucuauccuauucucauaccaaguagauucaaaauucaacagaaaaauaucagacgcaaccauauacgcaacaagacaagcuaaaguuggaaaagacaaagcagacgaaacuuauguauugggaaaaauuaaagauauauacacucaagacggcuacgacgcauuuaugaaaauauacaagaaagauaaaucaaaauucuuaauguaccgacacgauccucaaacuuucgagaaaguuauagaacccauacuagaaaacuauccaaacaaacaaauaaacgaaaaaggaaaagaaguuccagugaauccauucuuaaaauacaaagaagaacauggauauauccguaaauacagcaaaaaaggaaacggacccgaaauuaaaagccuaaaauauuaugacaguaaacuaggaaaucacauugauauaacaccaaaagacuccaacaacaaaguaguacugcaaucaguaucaccuuggagagcagacguguauuucaauaaaaccacaggaaaauaugaaauucucggccuuaaauacgcagaccuucaauucgaaaaaggaacuggaaccuacaaaauaucacaagaaaaauauaacgauauuaaaaagaaagaaggaguagacuccgauucggaauucaaauuuacacuuuauaaaaacgaccuacuuuuaguuaaagacacagaaacaaaagaacaacaauuauucagauuccuuagcagaacaaugccaaaacaaaagcacuacguggaacuaaaaccauaugauaaacaaaaguuugaagggggagaggcgcuuauaaaaguacuaggaaacgucgcaaacucagggcaaugcaaaaaaggacucggcaaaucaaacaucucaauauauaaaguaagaaccgacguacucggcaaccaacacauaauaaaaaacgaaggagacaaacccaagcuugacuuuuga

SEQ ID NO: 8590 - RNA, 3366 nt, Artificial Sequence
  Cas9 variant
augaacggauuaguauuagguuuagauauaggaauagcaagcguaggcguugggauacuagagaaaaacucgggaaaaauaauacacgccaauaguaggcuauucccagcugcaacagcagauaauaacgucgaaagacguaaaaacagacaggcaagacgauuaaaucgccgcaagaaacauagaggcguaagauuccaagacuuguucgaagauuacgggcuauuaacggacuuuagcaaaguuagcauaaauuuaaaccccuaccgauuacgcguagauggacuaaaucaacaacugacaaacgaagaacucuuuaucgcccuaaagaacauaguaaaaagaagaggcauaaguuaccuagacgacgccucagaagauggcggagccguaaguucagacuacggaaaagcaguagaagaaaauaggaaacuauuagccgaacaaacaccaggacaaauacaacucgaaagauucgaaaaauauggucaagucagaggugacuucacgguaguagaaaauggagaaaaaugcagauuaaucaauguauuuucaacaagcgcauacagaaaagaagcagagaaaauacuaagaaaacaacaagaguucaauaaccaaauaacagacgaauuuauagaagauuaccucaaaauacuaacaggaaaaagaaaauacuaccaugggccuggaaacgaaaaauccagaacugacuauggccguuuuagaaccgacgguacaacacuagacaauauauucgggguucuaauagggaaaugcacauucuauccaaaugaauacagagcgagcaaaucuaguuacacagcacaagaauuuaacuuacucaacgaucuaaacaaucuaacaguuccaacugaaaccaagaaacuaucggaggaacaaaagaaagugauaguagaauaugcaaaagaagcaaaaacacucggagcaaguacauuauugaaauauaucguaaaaaugauagacgcaucaguagaccaaauaagcggguaccgaguagacguaaauaauaaaccagaaaugcacacauuugaagucuacagaaaaaugcaaucacuugaaacuauaucaguaggagaacucucaagaaacguguuagacgaauuagcacacauacuaacauuaaacaccgaaagagaaggaauagaagaagcaauaaauagcaaauuaaugggcgucuuuucacaagaccaaguucuagagcuaguacaauuccggaaaaacaacuccucacuguucucaaaagguuggcacaacuucucccuaaaacuaaugauggaacugauuccagaacuauacgaaacaucggaggaacaaaugacaauauugacacgacuaggaaaacagaaaaguaaagaaacuagcaaaagaacaaaauauauugacgaaaaagaauuaacagaagaaaucuacaaccccguaguugccaagucaguucgacaagcaauaaaaauaauaaacgaagcaaccaagaaacauggaauuuucgacaauauaguaauagaaauggcacgggaaaauaacgaagaagacgcgaagaaagacuacauuaaaaggcaaaaagcaaaucaagaugagaaaaacgcagcaauggaaaaagcagcauuucaauacaacggaaagaaagaauuaccaggaaacauauuuaacggacauaaagaacuagcaacuaaaauccgccucuggcaucaacaaggcgaaaaaugucuauacacaggcaaaacuauuccuauaucagauuuaauucacaaucaauauaaauacgaaauagaucauauccugccacugucacucaguuuugacgauucuuuaucaaacaaagugcuuguacacgccacagcaaaucaagaaaaaggacaacggaccccauuucaggcgcuagacucgauggaugacgcguggucauauagggaguucaaaucauaugugaaagauuuaaaaucauuaagcaauaaaaagaaagacuaucuucuaacagaagaagacaucucaaaaauagaagucaaacaaaaguucaucgaacgaaaucucgucgacacaagauauuccucacgaguaguacuuaacgcacuucaggacuucuacaaaucacaccaguucgacacaacaauaaguguuguccguggccaguucaccagucaauuaagaagaaaauggggauuagaaaaaucacgagaaacuuaccaccaccacgcuguagaugcccuaauaauagccgccucuucucaauuaagacuauggaagaaacaaaacaauccccuuauaacauacaaagaaggccaauuuguagauucucaaaccggagaaauaauaucacuuacagaugaugaauacaaagagcuaguguucaaagcaccauacgaccacuuuguugauacucuucauucaaaaacauucgaagacgguauacuauuuucuuaucaaguagauagcaaauacaaccgaaaaauauccgacgccaccauuuacgccacaaggaaagcgaaauuggauaaagauaagucagaagaaacuuacguauuaggaaaaauuaaagauaucuacucacaagcaggauacgacgcauuuaucaaaauauacaacaaagacaaacgaaaauuucuaauguaucacaaagauccacaaacauuugaaaaagucauagaagaaauacuacgcacauacccaucuaaggaaagaaacgacaaaaauaaagaaguaccuugcaauccauucgaaaaauacagacaagaaaacgggcccauccgaaaauacucuaagaaaggaaauggaccagaaauaaaaugcuuaaaauacuaugacaacaaacuagguaauuauauugauaucucuccugacggauccgauaaucagguaguucuacaaucauuaaaaccauggcguacagacguauacuucaaccaucaaacgaaagaauacgaacucaugggguugaaauauucagaccucucauucgaaaaaggcuccggaaaauauucaauaagcaacgaaaaauauaauucuauuaaaaggauagaaggaguuaacgaacaauccgaauuuaaauuuacacuauauaaaaaugaucuaauauuaauaaaagacagcgaaaauaaugaacaaaaauuauuucgauucaauagcagaaacgauacugcaaaacauuacguagaauuaaaaccauaugauaaagcccgauucgauggccaacaagaacuaauaacgauuuuaggaaauguggccaaaggcggccaauguuuaaaaggauuaaacaaaucaaauauuucuauauucaaaguaaaaacagacguacucgguaagaaacauaucaucaagaaagagggggacgaacccaaauuaaaauucuga

SEQ ID NO: 8591 - RNA, 3366 nt, Artificial Sequence
  Cas9 variant
auggcugauaaaacacuaggugcacuaaccuucggauucgauauaggaaucgcgaguguuggauggugcguauuaggugaaaacagaauaguugauuuaggaguaagagcauuugauaaagcagaaacagcaaaggagggagaaucacuaaaccuagccagaagaacagcaagacugaugcgaagaagauuaagaagacgagcguggagacuuacaaagcuagcaagauuauuaaaaagggaaggccuaauagcugacgcauuccaaaugcaucaaccaagugcuacaagucccuggaaacugagggucgaagcacuugauaggcgauugacagaugacgagugggccaggguaauuuaucauuuauguaaacauagaggauuucauuggauaagcagagcagaagagaagaaagccgaaggagacgccaaaggagaaucaggacgaguaaagaaagguuugagugacacacaacguagaaugggagaaaaagguuauagaagugcagcagaaaugguucuagcagaguuuccagaagcacaaaggaacaaacaaggugauuauggaaaagcauugaguaggguauugcucagugaagaacucgcguuacuuuuuagaagacaacgggaauuaggucauacgcaugcuaguaaagaauuagaagcagcaauauuaggaaauggugacaggaaagguggauuauuuugggcucaaaaacccccauuagcgggugcagauuuauuaaaaaugcuuggaaaaugcaccuucgagaaagacgaauauagagcaccaaaagccagcuucacagcagaaaggcacguaugguuaacucgucugaacaauuuaagaguuguaguagaugguacgacaaggccguuaacagaagacgaaagaaggguggcauuaccauuacccuaugguuaugcagaugcaaaguuaacuuauaaacaauuacgagcagcauuaaguaaagcaggauuaucaaacuucuccuucgcaggaauagcugaugauaaagaaaaagacaccuuaacaaaguuaccugcaugggaaaccuuaucuaaaacauugaaaggaaaagguuuagaaacagaaugggaaggaauggcaggagcagccaccggaggagauccaacauuacuagaugaaauaucaagaguauugucuguauauaaagauggagaugagguugauguugaacuaagaaagcuaccucucccagguggagagaaaaugguagaaacacugucagaaauuaguuuugauaaguuucaugcacuuucgcugaaagcccuuagaaaaauuguaccacauauggaaacagguuugagauaugaugaagcaugcgcugccgcggguuaccaucauagccaauugcaugaagcaggagccggaggucaaaaauaccuaccaccauuuuauacuagaagagacaaagauggaagaaugguauuugacgaagaauuagauguaccuagaaauccgguaguuuuacgagcuuuaaaccaagcaaggaaaguuuuaaacgcauuagucagagcauaugguagcccaucagcaguccauauagaaauggcucgagacuuaaguaaacccuugguuggccauccaacaccuaauggaggauauauagagggaagacgagacauagaaaaauuacaaaaagaauauagagaaagaaacgaaaaagauaaagcugcuuucgcagcagaacacgguauugcggccaagucaagagaguucgaaaaauuucaauuauaccgagaacaacaagggaaaugugcuuauucacuaaaaccacuggauuugcaucgaguacuccacgacauaggcuacgcagaaguagaucacgcacuuccauacucgcgaaguuaugaugaugggaaaaauaauaaaguccuaguacuuacagaagagaauaggaauaagggaaacagaacagcuuacgaauauuuaugcgcguucccagguggagaaaauggagaaagauggcgcaauuucguagcauacgucgaaucaaacaaaaguuacagacuugcaaaaagaaccagauuauuaagaaaagacuuugguggaaaagcagcagaagaauuuagagaacgcaaucuaaacgauacaagauacauuuguaaauuuuucaaaaauuucguagagagguuccuccaauuaaaaguaggagcagacgguacagcagcaaaaagauguguuguucugagcggacaaacuacagcauuccuacgugcaagauggggacuacucaaaguacguggcgcuucagauagacaucaugcguuagacgcagcugucguagcagcaugcagucauggcauggucaagagguuagcggauuacaguaggacaaaagaacuagcaaaagugcgagauggguuuccggauccagagacgggugaaauagucgauccagcaauguuucaacaacuucacgcacacuucccagacccuuggccacauuuuaggggugaacuagaagcuaggcuacaacuagacgauagugcugaauuaagagcacaacuggagauguuugggacauacccagcagaagcauuagaaacgcuacgaccuuuauucguuucaagagcaccccaacggagaaaugguggagccgcucauaaagaaacuauauaugcccaaccugaacguuuaaaagaacaaggagggguaacacaaaaggucucucucgcaaguuugaaaccaaccgauauagauaaacucauugacccucauagaaacgagaagcuguacgcagcaaucagggcaagauuagaagcgcauggcggaaaaagugauaaagcauucccagcugacaacccguuaagaaaaccagacagggacggaaauccaacagggccgauaguaagagcaguaacuaugguuauagauaaacuguccggaauacaaauccgcggaggaaucgcgaaaaaugauacgaugcuacgaguagauguauucaggcauaagaaagacgguaaauuucaccuagucccacucuauguccaucaugcaguagcacaagaacuaccgaaucgagccauagucgcauucaaagaugaagacgaauggacguugauagaugacaauuuccacuuucuuuuuaguuuucacccaaaugauuucauaaggauaacucagaaaaauaaagcaccuauccuaggguacuaugcuagcugucaucgagggacuggaaaccuuaaccuaugggcacaugauaggaaucaaaaagugggaaaagacgggcaaauagaaggaauuggaguaaaaacagccguugcauuagaaaaauuccacguagauguacuagguaauauauaucccgcuccgccagaacaaagacauggacuagcauga

SEQ ID NO: 8592 - RNA, 3366 nt, Artificial Sequence
  Cas9 variant
augagugaucucgucuuaggucuggacauagggauaggauccguagguguaggaauccuaaauaaaguaacuggagaaauuauccacaaaaacagccgaauauucccugccgcccaagccgaaaauaaccuaguaagacgaacaaauagacagggccgcagacugacaagaagaaagaaacaucgaaggguccgucuaaauagacuuuuugaagaaagcggccugauaacagauuucacgaaaauaucuauaaaucugaacccguaccaauugagaguaaaaggcuuaacagacgaauuaucaaacgaagaacucuucaucgcacucaaaaauauggucaaacaccgagggauuagcuaccuagacgaugcaucugacgacggaaacagcaguguaggagauuaugcucaaauaguuaaagaaaacucgaaacaauuagaaacaaaaacacccggacagauccaacuagaacguuaccaaacauauggccagcuaagaggggacuucacaguggaaaaagacggcaagaaacacagacuaauaaacguauuuccaaccucagcauaccgaucagaagcacuucgaaucuuacaaacacaacaagaguucaacccccaaauuacagaugaguucauuaauagauaccuagaaauauugacagggaaaagaaaauacuaucauggcccagguaaugaaaaaucacgaacugauuauggaagauacagaaccaguggagaaacauuagacaacauauucgguauucuaauaggaaaaugcacauucuauccugaugaguucagagcagcaaaggcuucuuauaccgcacaagaauuuaaccuacugaaugaucuuaauaaucuuacuguaccaacugaaacaaagaaauuauccaaagaacagaaaaaucaaaucauuaacuacguuaaaaacgaaaaagcuaugggacccgccaaacucuucaaauacauagcuaaacuacuuuccugugacguagcagauauaaaaggauaccgaauagauaaauccggcaaagcagaaauacacacauuugaagcauaccguaaaaugaaaacauuagaaacacuagacauagaacaaauggacagagaaacacuagauaaacuagcguacguauuaacgcuaaacacagaaagagaaggaauacaagaagcucuugaacaugaguucgcagauggauccuucucacaaaaacagguugacgagcuaguacaauuuagaaaagcuaacaguaguauauuuggcaaaggauggcacaacuucagcguaaaacuaaugauggaauugaucccagaacuauacgaaacaagugaagaacaaaugacaauucucacuagacuuggaaaacagaaaacaacaucaucuaguaacaaaacaaaauacauagaugaaaaacuccuaacagaagaaauuuauaauccaguugucgccaaauccgucagacaagcaauaaaaauuguaaacgccgcuauaaaagaauacggagacuucgacaacauaguaauagaaauggcaagagaaacaaacgaagaugacgaaaagaaagcaauccagaaaauucaaaaagcaaacaaagacgaaaaagacgcagcaaugcucaaagcagcaaaccaauauaacggaaaagcagaacuaccgcacuccguauuucauggucauaaacaacucgccaccaaaauaagacuauggcaccaacaaggagaaagaugcuuauauacaggaaaaaccauauccauucacgaucuaauuaauaacucaaaccaauuugaaguagaucacauauuaccauuaucaauaacauucgacgacagcuuagcgaauaaaguucuuguauacgcaacagccaaccaagaaaaaggucaaagaacacccuaucaagcucuagacagcauggaugacgcguggucauuuagagaauuaaaagcauuuguaagagaauccaaaacacucuccaacaaaaagaaagaauaccuuuuaacagaagaagacaucucaaaauuugacguacgcaagaaauucauugaaagaaacuuaguagauacucgauacgcaucacgagucgucuuaaacgcacuucaagaacauuucagagcacacaaaauagacacaaaaguaagcgucguaagaggacaauucacaucucaacuaaggcgacauuggggaauagagaaaacucgagauacauaucaucaucacgcaguagaugcgcuuauaauagcagcaucaucccaacuaaaccuauggaagaaacagaaaaacacacucguaucauauagugaagaucaacuauuagacaucgaaaccggagaauuaauaucagacgaugaauauaaagaaagcguauuuaaagcaccauaucaacauuuugucgacacccuuaaauccaaagaguucgaagauucaauccuuuucucauaccaaguagacucgaaauuuaauagaaaaaucucagacgcuacaauuuaugcgacacgccaagcaaaaguaggaaaggacaaagcugaugaaacuuacguccucggcaaaauaaaggauaucuauacacaagaugguuacgacgcauuuaugaaaaucuauaagaaagauaaaagcaaauuccucauguacagacaugacccacaaaccuucgaaaaaguuaucgaaccaaucuuagaaaacuacccuaauaaacagauaaaugaaaaaggaaaagaggucccauguaauccauucuuaaaauacaaagaagaacaugguuacauaaggaaauauaguaagaaaggaaacggcccagaaauuaaaagucugaaauauuacgauuccaaacuaggaaaucauaucgacauuacaccuaaagacuccaauaacaaaguaguacuacaaagcgucuccccauggagagcugaugucuauuucaauaaaacuacaggcaaauaugaaauuuuaggucuaaaauacgccgaucuacaauuugaaaaaggaacaggaacauacaaaaucagccaagaaaaauauaaugacaucaaaaagaaagaaggaguugacagcgacucugaguucaaauucacucuuuacaaaaacgaucuauuacugguuaaagacacagaaaccaaagaacaacaacuuuuucgcuuccucaguagaacaaugcccaaacaaaaacauuauguugaacuuaaaccauaugacaaacaaaaauuugaaggcggagaagcucuaauuaaaguucucggaaauguagcaaacucaggacaauguaagaaaggucuagggaaaucaaacauauccauauauaaaguaagaacagacguauuagguaaccaacauaucauuaaaaacgaaggcgauaaaccgaaauuagacuucuga

SEQ ID NO: 8593 - RNA, 3366 nt, Artificial Sequence
  Cas9 variant
augaacgguuuaguauuaggccuagacaucggaauaggauccguuggaguaggcauauuaaauaaagacacaggagaaauaauccaugcgaacucccggaucuuuccugcagcaaccgcugacaacaacguaguaagacgaucaucuagacaaggacgacgucuaaaccauagaaagaaacauagauccguucgguuaaaagaucuauucgaauauuaugaucuacuaaccgauuuuucaaaaguauccauaaauuuaaacccauaccgauuacgggucgauggacuaaaccaacaauuaacaaacgaagaauuauuuauagcccucaaaaauauuguaaaaagaagaggaauauccuaccuagacgacgcuucagaagauggcggggcggugucaucggacuacggaaaagccguagaagagaaccgaaaauuauuagcugaacaaaccccaggccaaauccaacucgagcgauucgaaaaauauggacaaguaagaggagacuucacaguuguagaaaacggagagaaaagacgucucaucaauguauucagcaccucagcauacaagaaagaagcagaacguauacuuagaaaacaacaagaauacaauaaccagauaauggacgaguucauagcagacuauuugacuaucuuaacuggcaaaagaaaauauuaucaugggccaggaaacgaaaaaucucgaacagauuauggucgauuccgaacagauggcacaacacuagacaauaucuucggaauccucaucggaaaauguacauuuuaccccgaagaauacagagcaucuaaagcaagcuauacagcccaggaauuuaacuuauuaaaugauuuaaacaacuuaacuguucccaccgaaacuaagaaauuaagcgaagaacaaaagaaaacaauaguagaauacgcaaaaucagcgaaaacccuaggcgcaucaacucuacuaaaauacauagcaaaaaugauagacgcauccguagaucaaaucagaggauaccgcguugaugucaauaauaaacccgaaaugcacacauuugaaguguacagaaaaaugcaacuauuagaaacgauaccgguuggagaauuuaguagagaaguacuagacgaacucgcacacauacuuacccuuaacacugagcgcgaaggcauugaagaagcaauaaacacaaaacuaauggauguguucucucaagaccaaauauuagaauuaguccaauucaggaaaaauaauaguucacucuucagcaaaggauggcauaauuuuucauuaaaauuaaugauagaauuaauaccugaauuguacgaaacaagcgaagaacaaauggcuauccuaacaagacuaggaaaacaaaaauucaaagaaacaagcaaaagaacaaaauacauagaugaacaagaaguaaccgaagaaauuuacaauccuguagucgcaaaaucaguaagacaagccauaaaaauaauuaacgaagccacaaagaaauacggcauauucgauaacauagucauagaaauggcccgcgaaaauaaugaagaagaagccaagaaagauuacaucaaacgacaaaaagcaaaccaugacgagaaaaaugcagcaauggaaaaagcagcuuuccaauacaacggcgaaaaagaauuaccugacucaauauuucauggccauaaagaacuagcaacuaaaguaagauuauggcaccaacaaggugaaaaaugucuauacacagguaaaaacauaccaauaucagaccuaauacacaaccaauacaaauacgagauagaccacauauuaccauuaaguuugagcuucgaugacucauuaagcaacaaaguuuuaguacuggcaacugcaaaccaagaaaaaggacgcagaacccccuuccaagcacuagauuccauggaugacgcauggucauaccgagaguucaaaucauacgucaaagacagcaaaucauuaggcaauaaaaagaaagacuauuuguuaacggaagaagauaucucaaaaaucgaaguaaaacaaaaauucauagaaaggaaucuaguagacacaagauauuccucccgaguuguguuaaacacacuccaagauuucuauaaagcacacaaauucgauaccaccauuaguguaguaagaggccaauuuacaucccagcuaaggagaaaauggggauuagaaaaauccagagaaacguaucaucaccacgccguugaugcgcuuauuauagcugcuagcagucaauuaagacuauggaagaaacaaaauaaccccuuaauaucuuacaaagaaggacaauucguagacucagaaaccggagaaauaaucagucucacggacgacgaauacaaagaauuaguauucaaagcgcccuaugaucauuucguagacaccuuaagaucaaagaaauucgaagacagcauccuauuuucuuaccaaguagauucgaaauucaauaggaaaauaucagaugcaacuauuuacgcaacaagaaaagcaaaacucgauaaagauaaaagcgaagaaacauacguauuaggaaaaauaaaagauaucuacucacaaagugguuacgacgcauuuauaaaaauauacaacaaagauaaaaguaaauuucuaauguaccauaaagacccacaaacguucgaaaaagucauagaagaaauauuacgaaccuauccaucgaaagaguucaacgagaaaaacaaagaaguaucaugcaauccauuugagaaauauaaacaagaaaacgguccaauacgcaaauauucgaagaaaggcaacggcccagaaauaaaaucucuaaaauacuaugauaaaaacauaccggaaucauucaucaacauaacaccaucaaacagcaaaaauaaagucauacuaagacaacuaaacccauggagaacggacguauacuucaaucaucaaacagaaaaauacgaauuauuaggccuaaaauacgcagaccuacaauucgaaaagaaaaccggcacauacaguauaacaauugauaaauacaacgaaauaaaagaaaaagaaggcguaucagagcacucagaguuuaaauucacacuauauaaaaacgauuuauugcuaauaaaagauacggagauaaaagaggaacaaauauuccguuuucuaucaaggaccaugccuaaucaaaaacacuacguugaacucaaaccuuauuacaaagguaacuuugaaggaaaagagagaaucaaaguauuuaauacaacuucaaacgguagaugccucaaaggauugcgaaagaaagguuuaucgaucuacaaaauaaaaacagauguacuuggaaauaaacacuucauaaagaaagaaggcgagaaaccaaagcuaaaauuuuga

SEQ ID NO: 8594 - RNA, 3369 nt, Artificial Sequence
  Cas9 variant
augaaugggaaaauauuaggccuagacauagguguagcauccgucggaguggguauucuagacaagaaaaccggagaaaucauacaugcgaguagcagaauauuuccggcggcaacagcagauucaaauguugaaaggagaggauuuaggcaaggacgcagauuagggcgaagaaagaaacacagaaaaguacgacuagcagacuuauucagcgacacaggauugauaacagacuucagcaaaguauccauaaaccuuaauccauaugaauuaagaauaaaaggcuuaaacgaaaaauugacaaacgaagaauuauucauagcucuuaaaaacauaguaaaacgaagaggaauaagcuacuuagacgacgcaaaugaagacggcgaauccagcucaagugaauacggaaaagcaguagaagaaaaccguaaacuauuagcugauaaaaccccgggacaaauccaauuagaaagauuugaaaaauacggucaaguaagaggagacuuuacaaucgaagaaaauggagaaaaacauagauuauuaaacgucuuuucaaccagugcauacaagaaagaggcugaaagaauacuaacaaaacaacaagacuacaaucaagacauuacagaugaguucauucaagcauaccucacaauucuaacagguaaaaggaaauacuaucacggaccaggcaaugaaaaaucaagaacggacuacggaagauuuagaacggauggcacaacucuagacaacauuuucggaauacucauaggcaaauguacauuuuauccugaagaauaccgagccgcgaaagcaagcuauacagcacaggaguucaaccuauuaaaugaccuuaacaaccuuacgguuccaacagaaaccaagaaacuaucagaagaacagaaaaggcaaauuauugaauacgcaaaaggcgcuaaaacucuuggugcagcgacacuguuaaaauauauagcuaagcuaguagacggaucaguggaagauauaaaaggauaucgcaucgacaaaagcgaaaaaccugaaaugcacacauuugacauauaucgcaaaaugcaaacacuagaaacuguagacguagaaaaauuaucucgagaaguacuagaugaauuagcacauauacuaacgcuaaacacagagcgagaagguauagaagaagccauaaaagugagcuucauaaaaagagaguucgaacaagaucaaauugcugaauuaguaucauuucgaaaaucuaauucaaguuuauuuggcaaaggauggcauaacuuuucaauaaaauuaaugacagaacucauccccgaauuauaugaaaccucugaagaacaaaugacaauacuaacaagauuaggcaaacagaaaaccaaagcacgaucaaagcgcaccaaguacaucgacgaaaaagaauuaacagacgaaauauauaauccaguaguagcgaaaagcguaagacaagccauaaaaauaaucaacuuagccacaaagaaauacggaguguucgacaauauaguaaucgaaauggcaagagaaaacaaugaagaagaugccaagaaagauuauguaaaacgacaaaaagcuaaugaagaugagaaaaacgcagcuauggaaaaagcggcacaccaauauaacggaaagaaagaacuaccugauaauguguuccaugggcacaaagaauuagcaacuaaaauaagauuauggcaccaacaaggagaaaaaugcuuauauacagguaaaaacauaccaauaucggaucuaauucauaaccaauacaaauacgaaauagaucauauacuaccccuuagcuuaucauucgacgacucauuagcaaacaaaguucuagugcuugcaacagcgaaucaagaaaaaggccaaaggacuccauuccaagcccuagauagcauggacgaugccuggucuuauagagaauuuaaggcuuaugucagaggugcuagagcacuauccaacaaaaagaaagacuauuuauuaaacgaagaagacauaaauaaaaucgaaguuaaacaaaaauucauagaaaggaaucuaguugacacaagauauaguagcagaguaguucuaaacgccuuacaagacuucuacaaacuaaacgacuuugacacaaaaauaagcgucguuagaggccaauuuacaucccaauugagaagaaaauggagaauugacaaaucaagagaaacauaccaucaccaugcaguggaugccuuaauaauagccgcaagcucacaauuacgauuauggaagaaacaaggcaauccauuaauaagcuacaaagaaaaucaauuugucgauagcgaaacaggugaaauaauaaguuuaaccgacgaugaauacaaagagcuaguauuucgagccccguacgaccacuucguggauacagucaguucgaagaaauucgaagacaggauccucuuuagcuaucaaguagauucaaaauacaaucgaaaaauuucggaugcuacaaucuauagcacaagaaaagcaaaacuuggcaaagacaaaagugaagaaacauaugugcuaggaaaaaucaaagacauauauacucaaaccggauaugacgcguuuaucaaauuauauaagaaagacaaaucgaaauucuuaauguaccauaaagauccaauaacuuucgaaaaaguaaucgaagaaauacuaaaaaccuauccagacaaagaaauaaaugaaaaagguaaagaaguugcauguaauccuuuugaaaaauauaggcaagaaaacggaccacugcgaaaauacagcaagaaaggaaaaggaccggaaauaaaaucacugaaauacuacgauaacaaacugggaaaccacauagacauuacuccugauaacuccgaaaaccaagugauacugcaaucauuaaaaccuuggagaaccgacgucuauuuuaaucacaaaacaaaaaucuaugagcuaaugggcuuaaaauacucugaccuuagcuucgagaaaggaucaggaaaauauagaauaaguuuagacaaauauaauguaauuaaaaagaaagagggaguucauaaagaaucagaauuuaaauucacacuauacaaaaacgaccugauucucauuaaagaccucgagaaaagugaacaacaguuauuccgauacaacucacgaaacgacacaucaaaacacuacguugaacuaaaacccuaugacaaagcaaaauucgaagguaaccaaccuuuaauggcauuauucggaaauguagcuaaaggaggacaaugucuaaaaggcuuaaauaaagccaacauaucaaucuacaaaguacaaacagacgucuuaggaaauaaaagauucauaaagaaagaaggagaugcaccuaaauuagaauuuuga

SEQ ID NO: 8595 - RNA, 3369 nt, Artificial Sequence
  Cas9 variant
augagugacuuaguauuaggacuggacauaggaauagguucugucggcguuggaauacuuaauaaaguaacaggugaaauaauacacaaaaauucaagaauauucccggcagcacaagcagaaaacaaucuagugcggagaacaaaucgacaaggaagaaggcuaacacguagaaagaaacacagaauuguaagauuaaaucgacuauucgaggaaucaggacucauuacagacuuuaccaaaauauccauaaauuuaaauccauaccaacuaagaguaaaaggacuaacugacgaacuauccaaugaagaauuauuuauagcacucaaaaauaugguaaaacauagaggaauaagcuacuuagacgacgccucagaugacgguaauucaagcgugggagacuacgcucaaaucgugaaagaaaacuccaaacaauuagaaacuaaaacgccuggccaaauccaauuagaacgauaucaaacuuauggacaauuacguggagauuuuacaguagagaaagauggaaagaaacaccgacuaauaaacguauuuccaaccagugcauaccguucagaagcauuaagaaucuuacaaacacaacaagaauuuaacucacaaauuacagacgaauuuaucaaucgcuaccuagaaauacuaacaggcaaacggaaauauuaucacggaccaggcaaugagaaaagcagaacagauuacggaagauacaggaccaauggagaaacucuagacaauauauucggaauacucauaggaaaguguacguucuacccagacgaguucagagcagcuaaagcaagcuacacagcccaagaguucaacuuauuaaaugacuuaaacaaucuuacaguaccaaccgaaacuaaaaagcuaucaaaggaacagaaaaaccaaauaauaaauuaugucaaaaaugaaaaaguaaugggccccgccaaguuguuuaaauacauugcuaaauuacuuaguugcgauguagcagacauaaaaggccaccgaauagacaaaucaggaaaagcagaaauacauacauuugaagcauacagaaaaaugaaaacauuagaaacauuagacauugaacaaauggaccgcgaaacuuuagacaaacuugcguacguacuaacacuaaauaccgaaagggaaggaauacaagaagcacuagaacaugaauuugccgauggcaguuucagccaaaaacaaguagaugaauuagugcaauuccgaaaagcaaauucaucgauauucggcaaaggauggcauaauuuuucuguaaaacuaaugauggaauuaauaccagaacuauaugaaacaucagaagaacaaaugacuauucuaacaagacuaggcaagcagaaaaccacaagcucaaguaacaaaacuaaauacaucgaugaaaaauuacuaacggaagaaauauauaacccagugguagcuaaaucaguacggcaagcaauaaaaauaguuaaugcagccauaaaagaauacggagacuuugauaauaucguaauagaaauggccagagaaacaaacgaagacgacgaaaagaaagccauacagaaaauucaaaaagcaaauaaagaugaaaaagacgcugcuauguuaaaagcugcaaaccaauauaacggaaaagcggaauugccacauagcguauuccacggacacaaacaacuggcaacuaagaucagacuauggcaucaacaaggcgaaagaugccucuauacaggaaaaaccauaagcauucacgaccuaauaaacaauccaaaucaauucgaagucgaucacauccuaccacuaagcauaacauuugaugauagucuagcgaauaaagucuuaguuuaugcuacugccaaccaagaaaaaggacaaagaaccccauaccaagccuuagauucgauggacgacgcauggucauuuagagaacucaaagcauuuguacgagaaagcaaaaccuuaucaaauaagaagaaagaauaucucuuaacugaagaagauauuagcaaauucgacguacgaaagaaauucauugaaagaaaccuaguagauacaagauaugcauccaggguaguguugaaugcacuacaagaacacuuccgagcacacaaaaucgacacaaaaguaucagucguuagaggucaauuuacaucacaacuaagaagacauuggggcauagaaaagacacgcgacacauaucaucaucaugcaguagaugccuuaauaauagcggcuagcagccaauuaaaccuuuggaagaaacagaaaaacacuuuaguaaguuacagcgaggaacaacuauuagauaucgaaacaggagaacuuauaucagacgacgaauauaaagaaucaguauucaaagcucccuaccaacacuuuguggacaccuuaaaauccaaagaguucgaagacuccauauuauuuaguuaucaagucgauuccaaauucaauagaaaaauaagcgaugcuacaaucuacgcaacgagacaagcaaaaguagguaaagauaaaaaggacgaaacauacguccuaggaaaaauaaaagacauuuacacacaagacggauaugaugccuucaugaaaauauauaagaaagauaaauccaaauuucuaauguacagacacgauccacaaacauucgaaaaagugauagaaccaauuuuagaaaauuauccaaacaaagagaugaaugagaaaggaaaagagguaccauguaauccguuccuaaaauauaaagaagaacauggauauauaagaaaauacucuaagaaaggcaauggaccagaaauuaaaagccuaaaauacuacgauucaaaacuuuuaggaaauccuauagacauaacacccgaaaauucuaaaaauaaaguaguuuuacagagcuuaaaaccuuggagaacagacgucuacuucaauaaaaacacagguaaauaugaaauccuaggucuaaaauacgcagaccuacaauuugaaaagaaaacagguacuuacaaaaucucccaagaaaaauauaauggaauaaugaaagaagaagguguagauagcgauagugaguucaaauucacuuuauauaaaaacgaccuacuacucgugaaagacacagaaacuaaagaacaacaacuauuuagauuucuaucgagaacaaugccaaacguaaaauauuauguagaacuaaaaccauacucgaaagacaaauucgagaaaaaugaaagccuaauagaaauauuagguagcgcagauaaaucaggcagaugcaucaaaggacucgguaaaucaaacauuaguauauauaaagucagaaccgacguacugggaaaccaacacauaaucaaaaacgaaggugacaaaccaaaacuugauuucuga

SEQ ID NO: 8596 - RNA, 3369 nt, Artificial Sequence
  Cas9 variant
auguccaacggaaaaauucuuggacuugacauuggaauagcaagcguaggggucggcguuauagaugcacaaaccggcgaaauaauacacgcgucuucgcgaauauucccaagugccaaugcggccaacaacgcugaacgacgaacguuuagaggcucccgacgguuaauacgcagaaagaaacacagaauaaaaagacuagaugacuuauuuaacgacuuucauaucaacuuggauggggaaaugucaacggacaaucccuauguacugagagucaaaggucuaucucaaaaauuaacaguagaagaacuauacauuucaauuaaaaacauaaugaaacgcagaggaauauccuaccuagaugacgcagagucugacaacgaagcaggaagaagcgauuacgcaaaagcaauagagagaaauaggcaacuuuugacaucaaaaaccccuggcgaaauacaacucgaacgauuagaaaaauacggccaacugcguggaaauuuuacaaucauagacgaagaaggucaaagccaacaaauaaucaaugucuucagcacaucagauuacguaaaggaaguagagaaaaucuuagauugccagaaaauguaccacaaauuuauaagugaugaguucugcgacaaguuaauagaacuacuccgggaaaagagaaaauacuacguaggcccaggaaacgagaaaagccgaacagacuaugguaucuauagaacggacggcaccacacuagaaaaccuuuuugguauccucaucggaaaaugcacauucuauccugaucaauauagaagcaguagagcaaguuacacugcucaagaguucaacuuucuaaacgacuuaaauaaucuaacaguuccgacagaaacaaagaaauuaucccaagaacaaaaagaguuccuaguaaauuacgcaaaagaaacuucaguucuaggagcaggaaagaucuuacaacaaaucgccaaauuagcagacuguaaaguggaagauauaagaggauacagacuagauaauaaggacaaaccugaacuacacauauucgaaacauacagagcaaugaaaggguuaguaccucuagucgacauuggaguucuaucacgcgaacaacuagacauucuggccgauauacucacacucaacacagacuuugaagguauaagggaagcacugaagaaacaacuuccuaacguuuuugacgaaaaacaaguaaaaggacucgcgucauuuagaaaaagcaaaucacaacuauuugcaaaaggcuggcauaaucuaagucagaaaauaaugcuggaaguaaucccggaguuauacgcuacaagcgaugaacaaaugacaauauuaacgcguuuaggaaaauuugaaaaauccagcguugcagaauauccuaguuccaucaauguagacgaaauaacggacgaaaucuauaaccccguaguagcaaagucaauacgacaaacaauuaaaauaauaaaugcuagcaucaagaaauggggagaauuugaccaaauuguuauagaaaugccaagagaucgcaacgaggaugaagaaaagaaaagaauagcagacggucaaaaagcuaacgcaaaagaaaaagcugacucaauacucagggcagccgaacuauacugugcugguaaaguacuacccgauuacguauacaacggccauaaucaacuggcaacaaaaauaagguuaugguaccaacaaggcgagagauguauauacacaggccaaccuauaucgauacaugaucuaauacacaaccaaaaucaauaugaaauagaucauauacuaccgcuuucgcuuacauuugacgacucacuuucuaauaaagugcuaguacuagcaacagcaaaccaagaaaaagcacaaaggacaccauacaacuacuuaaaaagcgcaaccucagcauggaguuacagagaauuuaaagacuacguuacgaaaagaaaaggaaucgguaaaaagaaaugcgaauacuuaaccuucgaagaagauauaaauggauucgaggugcgaucaaaauucauccaaagaaaccuaguagauacgagauacgcaaguaaagugauacuaaacgccuuacaagauuauuuuaaaaucucaggaauccaaacaaaagucagcguaguaagaggacaauuuacgucccaacuccgacacaaauggggcauagagaaaacacgcgaaacguaucaccaccacgccguagaugcacuaaucaucgcagcuaguagccaauuacgcuuauggaagaaacaagaaucuccauuaguaguugauuaccaagaaggaagacaaguagaccuugaaacgggagaaauacuagaauuaacugaugaacaauacaaagagcuaguauaucaaccacccuaccaaggauuuguuaacacaauuucaaguagugcauuugauaacgaaauacuauuuucauaccagguggauucuaaaguaaauaggaaaauaucagaugcaacaauauacgccacacgaaaugcgcaauugggaaaagauaaaacugaaggaaucuauguauuaggaaaaauuaaagacauuuacacccaagccggguaugaagcauuuuuaaaacgauacacaaaagacaaaacaucauuccuaauguaccacaaagauuuagauacaugggaaaaagucaucgaaauuauacuaagagacuacagagaauaugaugaaaaaggaaaagaaauaggaaacccauucgaaagguaucgaagagaaaauggauauguaaagaaauacucacgcaaaggaaacggaacagcuauaaaaagucuaaaauacuacgauaacaaacugggaaaucauauagauauaacaccagaaaacagcagaaaugcaguaguacuccaaagccuuaaaccauggagaacagacgucuacuucaacaaagaaacaggaaaauacgaauuuuuaggaauaaaauauucagacuuauccuucgaaaaagggacaggagaauacggcauaagccaagaaaaauacgacagcauaaaaauagcugaaggaguagccaagaaaaguauauucaaauucacccuauacaaacaagaccuacuauuuauaaaagauauagaaaauaauuucggaaaacuauuaagauuuacuagcaaaaaugacacaaguaaacauuacguagaauuaaaaccauacgacaaaaauaaauuuggaacagaagaacccuuauuaccuguauuaggaaacguagcuaaaaguggccaauguauaaaaggccuaaacaaaagcaacauauccauauauaagguccgaacugacauacuaggauaccgacacuucauaaaacaagaaggagaacacccacaauuaaaauucaagaaauga

SEQ ID NO: 8597 - RNA, 3369 nt, Artificial Sequence
  Cas9 variant
augucuaacggaaaaauauuagguuuagacaucgggauagccaguguaggggugggaguaauagacgcacaaacuggcgaaaucauacaugcaucaucaagaauuuuuccuagugcaaacgcugcaaacaaugccgaacguagaacauuuagaggcuccagaagauuaauuagaagaaagaaacaucgaauaaaaagauuagaugaccuuuucaaugacuuucauauaaauuuagauggagaaaugucaacagauaauccauauguguuaagagucaaaggacuaucacaaaaauuaacaguugaagaauuauauaucucuaucaaaaacauaaugaaacgaaggggaaucaguuaccuagacgacgccgaaucagauaaugaagcugguagaagugacuacgcuaaggcaauugaaagaaacagacagcuucucacaucaaaaaccccaggagaaauucaacuagaaagauuagaaaaauacggacaauuaaggggaaacuucaccauaaucgacgaagaaggacaaagccaacaaauaauaaauguauucuccacaucagacuauguuaaagaaguggagaaaauacuagauugucagaaaauguaccacaaguuuauaucagaugaguucugugacaaacuuauagaauuguuaagagaaaaacgaaaauauuacguaggaccagguaaugaaaaaucaaggacggauuauggaauauacaggacagauggaacaacauuagaaaauuuauuuggaauacuaauagguaaauguacauuuuacccugaccaauaccgaucuagccgugcaucauauacagcacaagaguucaauuuucuaaacgaucucaauaaucuaacagucccgacagaaacuaagaaacucagucaagaacaaaaagaauuucucguaaauuaugcaaaagaaacauccguccuaggugcaggaaaaauacuccaacaaauagcaaaauuagcagacugcaaagucgaagacauaagaggauacagacuagauaacaaagacaaacccgaacuacacacauuugaaaccuacagggcaaugaaaggucuaguaccccuaguugauauaggcguccuaucuagagaacaauuagauauacuagcagauauccuaacauuaaacacagauuucgaagguauacgagaagcacuuaagaaacaacugccaaacguguuugacgaaaaacaagucaaaggcuuagcgagcuucagaaaaaguaaaucucaacuauucgcaaaaggauggcacaacuuaucacagaaaauuaugcuagaaguaauaccagaacuauacgccaccagcgaugaacaaaugaccauuuuaacuagacuuggcaaauuugaaaaaucaaguguagcagaauacccaucaucaauuaauguagaugaaauaacagacgaaauauauaaucccgucguagccaaaucaaucaggcaaacaauuaaaauaauaaaugcaucuauuaagaaauggggugaauuugaccaaauagucauagaaaugccucgagaccgcaaugaagaugaagaaaagaaacgaaucgcagacggucagaaagcaaaugcaaaagaaaaagccgauagcauacuaagggcagccgaauuauauugugcaggaaaagucuuaccagacuacguauacaauggacacaaucaacucgcaaccaaaauaagauuaugguaccagcaaggagaaagguguaucuacaccggacaaccaauauccauucaugaucuaauacacaaccaaaaucaauacgaaauagaucacauauuaccguuaucccucacauucgaugauucauuaucaaauaaaguucuaguauuagcaacagccaaccaagaaaaagcacagagaacaccguacaacuaccuaaaaagcgccacuucggcauggagcuacagagaguucaaagacuauguaacaaaaagaaaagguauaggaaagaagaaaugcgaauauuuaacauucgaagaagauauuaacggauucgaagucagaagcaaauucauacaaagaaaucuaguagacacaagauaugcaucaaaaguaauacucaacgcacuacaagauuauuucaaaauaucagguauacaaacaaaaguaagcguagucagaggccaauuuaccucccaguuaagacacaaaugggguauagagaaaacaagagaaaccuaucaccaucaugcaguggacgcuuuaaucauagcagcuaguagucaauuaagacucuggaagaaacaagaaucgcccuuagugguagauuaucaagaaggaagacaaguggaccuugaaacgggagaaauucucgaauuaacggacgaacaauauaaagaacuugucuaccaacccccuuaccaagguuucguaaauacuauaucaaguucagcauuugauaacgaaauauuauucagcuaccaagucgacuccaaaguaaaucgcaaaauaagcgacgccacuauauaugcaacaagaaaugcacaauuaggaaaagacaaaacggaaggcaucuacguuuuagguaaaauaaaagacauuuacacucaagcgggauacgaggcuuuccugaaaagguauaccaaagacaaaacaucauuucuaauguaucacaaagaccuagauacaugggaaaaaguaauugaaauaauauuaagagauuacagagaauaugaugaaaaagguaaagaaauagguaauccguucgaaagguaucgacgcgaaaacggcuacguaaagaaauacucacgaaaagguaauggaacagcuauuaaaucuuuaaaauacuacgauaacaaacucgguaaccacauagauauaacaccagaaaacucgagaaaugccguaguccuucaaucacuuaaaccauggcgaacagacguauacuucaacaaagaaacaggaaaauacgaguuccuagguauaaaauacagcgaucuauccuuugaaaaaggcacaggcgaauacggaauaucacaagaaaaauacgacucaauaaaaauagcagaaggaguagcaaagaaaaguauauuuaaauucacuuuauacaaacaagaucuccucuuuauuaaagacauagaaaauaauuucggaaaauuacuaagauuuacaaguaaaaacgauaccucaaaacacuacgucgaauuaaaaccauaugauaaaaacaaauuugguacagaagaaccauuauuaccugugcugggaaacguagcgaaaucaggacaaugcauaaaaggguuaaacaaaucaaauauaucaauauacaaaguaagaacagauauacuaggauauagacauuucauaaaacaagaaggagaacauccccagcuaaaauuuaagaaauga

SEQ ID NO: 8598 - RNA, 3372 nt, Artificial Sequence
  Cas9 variant
auggcuaaaauauuagggcuugauuuaggaaccaacucgauaggaugggcauuaauagacgauguucaaaacaaaauccuuggaguaggcagcagaauauucccaaugggcguagaaaaccuuggagauggggacggcgaaauaagcaaaaaugcaagcaggacgggaacacgaggcguaagaagacaauuuuucaggagacgauuaagaaagaaagucuuauuaaaagcacuuucugaaaacaacauguguccgaugauaaccuccgacuuugacaacuggaaaaagacgaagcaauuucccuccgaaaaacuagcaagcugguuugcccugaacccauacgagcuacguaauaaggcgcuuucagaaaaacuaacucuagaagaaaucggacgaaucuucuaucaccuuauacaaagacgugguuucuuauccaacaguagaaaagggggcacagacgauggggcaauauucaaagguaauccuaaagaagggaaaauaggaaucacagauacccaagaaagcauacaagacaagacacugggaucauaucuauuugaaauauacccuaaggaaaaccaacccuuccaaaacggacuagaaagaauaagaaaucgauauacuguucgaaaaauguauguagacgaguucgaaaugauaugggaaaaacaagcucaauauuauucaaacuuaaacgaagaucuaaaaacacuuuucggcggaagaaaauuagauggauauaaagaagacggaauuuuauuccaccaacgaccacuaagaucgcaaaaacacuuagucggaaacuguguauucgaacccaacaaaacaaaaugcccaauaucagcaauaccuuucgaacaauucaggguuuggcaauggguaaacacaguagaauacaauggaaagaaaauaagucaaguugaaaaagagaaaaucguugaguuccuguacgccaacgacaaaacagacuucaagaaaauaagaaaagccauagguaaagaaucaacagaguucaaauucaacuacaaagaugacgacaaaauaguaggaaccuacacaguaucccacuuaagcaauaagaaauauuuuggaaagaaaugguuugaguucagcgaaaaagaacaagaagauauauggcacauauuauauuucuuugacuccaaaucuaaccuaaaagaauaugcaauuaaaaacuggaacuuuacggaagaacaagcagaaucaauagcaaaauuuaauguuaaagauggguacucaagucugucaagaaaagcgaucucaaauaucuuaccauuuuugaaacuuggcuuuacauaugaugucgccguaguccuuggaggaaucaaaaacguuuuuggacaugaaugggaaaaauuaagugacgaaaaacgcaacuuccuaauagacaauguugaaggaauaguacgcucaaaaacuaaaggaggauucauagaugugaucaaagacauacuacgaaacgacuacaacauauccgacaaucagcuuagaaaacuuuaucaccacagugcuacuaucuacguugcagaacuauuagaaaaacuaccaguaggcaaagaagcagauaaagaaauacagaguauaaggaauccgauaguaauaaccgcauuauucgaacuaagaaagcuaguaaaugaacuaauagaugauuucggcucaaucgaugaaauaaaaguagaaauggcaagagaccuaaaaauauccaaaagccaacgaaacaaaauaagacgcgaacaaaaacguuuagaacgagaaaacgaucgcguaaaagcacgauuacuagaagaaggacagagaauaacacacgauaauauacuguuauacaaacuaugggaagaauguaagaaaacauguccauauaccggcaauccgauaccauuauauaaauuauuuacaggggaaauccaaaucgaacacauacacccaugguccagaucacuaaaugacagcuuugccaacaaaacacucugcuacgcagaugaaaacagaaagaaaggggacaaaacaccauaugaauuuuaugguaacgacgaaaguaacuggucagcaauaaaagaacgagcgcucaaacuauuuucugauacaaaagaauacccaaaugcauaccaaaaauucaaacgcuucguacaacacaaauucgacgacgauuuuagcucuagacaauugaaugacaccagguauaucagcaaagaagccaaaaauuaccucucuaaaauuuguaagaaaguagcagugaguccaggccaagcaacuucaaauuuaagacaaaaaugggggaugaacaauauccucaaugaugaaaacgagaaaacuagagaagaucaccgccaccacgcgauugaugcguuaguuauggcauguacaaaaauaagcuaugugcaagaacuuucuaaauggaauagauacaaucgaaaugcagaacucaagaaauuuccacuacccugggaaacauuuuggucggaugcuaauagagcgguugauaaaauccuaauaucccacaagaaaguuuccaacgacauaacagguagaacacacauaagugagaaaaacggaaagaaauauaaaaauguaggagucgcugcacguggucaauuacauaaagaaaccgucuauggaaaacgaaccuucaauggcgaagaagcauuccauguaagaaaaacgaucgauucuuuaacgacagaaaaacaauuagaaaaaguuguagacgaaucaauaaaacuauuaaucaagaaacgaguacaggaauuaggaggguuugucaaaggagccauaccagcuaauaccuuuuucgucguugaugaaaacggaauuaaacaaccucagauauuuuuaccaaacaaaaauggggcaccaguccccguuuuaaaagucagaaugaaagaaaauauaggaggcgcugaaaaacuaaaagaaaauguuaaucaauggguaaauccuaggaauaaccaucacguacuaauauacaaagacgaaaaagggaaucuaaaagaagagguaguaacauucuggacaguagucgaacgaaaaagaacaggacaaagugcauaucaguuaccauuugauggcaaagagauagugaccacuuuacauauaaaugauauguuucuauuaggacuuaacgaagaagaaauaaauugggagaaccccgauuaugaagucuuaaaagaacaucuauauagaguacaaaaauucacaaguggagacuacuacuuucguauagcaaaaacaagcucaauacaaaacgcaauagaaaaacaacagauuaauagcuuuggauucgguaaaaauggauggagcacccacaacccaauuaaaguuaaaauaucaguaagcggaaaaauaucaaaaguuuga

SEQ ID NO: 8599 - RNA, 3372 nt, Artificial Sequence
  Cas9 variant
augaauggacuaguauuaggacuggacaucggaauaggcucaguagguguaggcauacucaauaaagacacaggagaaaucauccauacaaauuccaggauauucccugcugccacagcagacaacaauguugaacgccgaaacagccgacaagcaaggcgacugaacagacgaaaaaagcacagaggcgcucgacuccacgaccucuuugaggauuacgaccuacuaauagauuuuaguaaagucaguauaaacuuaaaucccuacagacuaaggguacaaggucuugauaauccacuaacuacagaagaacuauuuauagcccuaaagaacauaguuaaacgaagaggaauaucauacuuagacgacgcuucugagaacggaggugcaguaucaagugacuauggaaaagcaguagaagagaacagaaaauuacuugcugaacaaacacccgggcaaauacaauuagaacguuucgaaaaauacggucaaguacguggagacuucacuguagaagaaaaaggugauaaacaucgacuaauaaacgucuuuagcaccucugcauacaggaaagaagcagaaagaauauuacgaaaacagcaagaauuuaacaaccaaauaacggauaaauuuauagaagacuauuuaaaaauuuuaacagaaaaacgaaaauacuaucauggaccaggaaacgaaaaaucaagaacugauuacgguagauuccguacagauggaacaacauuagauaacauauucggaauauuaauuggaaaauguaccuucuacccaaaugaauaucgagcaucaaaagcaucguauacggcccaagaauuuaaccuucuaaaugauuuaaauaaccuaacuguaccuacagaaacaaaaaaacucagugaagaacaaaaaaaaacaauaguagaguacgccaaauccgcaaaaacccuuggcgcgucaacacucuuaaaauacaucgccaaaaugauagaugccaguguagaccaaauuagaggauaccgaguagacguaaacaauaaaccagagaugcauacauuugaaguuuacagaaaaaugcaaucuuuagagacaauacccguaggcgaauuuucccgagaagugcucgacgaacuugcucauauauuaacacucaauacagaacgagagggcauagaagaggcuauaaacacaaaguugauggauguauucucacaagaccaaauacuagaguuaguccaauucaggaaaaacaauuccucacuauucucaaaaggauggcauaacuuuagucucaaauuaaugauggaacucaucccagaauuauacgagaccucugaagaacaaauggcaauucuuacgcgucuagguaaacaaaaauuuaaagaaacaaguaaaagaacaaaauacauagacgaaaaagaagugacagaggaaaucuauaacccaguagucgcaaaaucagugagacaagcaauaaaaaucauaaacgaagcaacaaaaaaguauggcauauucgacaacauaguaauagaaauggcccgcgagaacaacgaggaagaugcaaagaaagauuacaucaaaagacaaaaagcuaaccacgacgaaaaaaacgccgcaauggagaaagcggccuuccaauauaacgguaaaaaggaacuaccagauagcauauuucauggacauaaagaauuagcaacaaaaauaaggcuauggcaccagcaaggggaaaaaugcuuguacacuggaaaaaacauaccaaucagugacuuaauccacaaccaauacaaauaugaaaucgaucacauccuuccauugagucuaagcuuugacgauucccuauccaauaaaguacuaguacuagcaacugccaaccaagaaaaaggccaaagaacaccauuccaagcacuagauucaauggaugacgccuggaguuaucgugaauucaaaucauauguuaaagauucaaaacuguuaggcaauaaaaaaaaggacuaccuucucaccgaagaagacauaucuaaaauugaaguaaaacaaaaauucauagaacgcaaccuaguugauacacgauauucaucacguguaguuuuaaacacacuccaagauuuuuacaaagcacauaaauucgacacaacaauaagcguaguccgaggacaauucacaagucaacuuagaaggaaauggggacuugaaaaaucaagagaaacauaucaccaucacgccguagacgcacucauaauagcagcaucaucccaauuaagacuauggaaaaaacaagcaaacccauuaauuucuuacaaggaagaccaauucguggacagugaaacaggagaaauuauaucucuaacggacgacaaauacaaagaacuugucuucaaagcaccuuaugcucauuuuguugauacacuuucaucaaaaaaauucgaagacucuauucucuucucauaccaagucgauucaaaauacaaccgaaaaaucucugaugcuacaauauacgcuaccagaaaagugaaacuugauaaagacaaaagugaagagacauauguacucggcaaaauaaaagacauauacucacaggcaggauacgacgccuucauaaaaaucuacaacaaagauaaaucuaaauuucuuauguaccauaaagauccacaaacuuucgaaaaagucaucgaagaaauccuaagaacauaccccaguaaagaauucaacgaaaaaaacaaagaaguaccauguaacccauucgaaaaauaccgacaagaaaacggccccauacgcaaauacagcaaaaaagggaauggaccagaaauuaaaaguuuaaaauauuaugauaaaaauauaccagaaaguuucauaaauaucacaccaagcaauucuaaaaacaaaguaaucuuaagacaacuuaaccccuggcggacagacguauauuucaaucaucaaaccgaaaaauacgaacuacuuggucucaaauaugcagaucuacaauuugaaaaaaaaaccggaacauauucaaucacaauugauaaauacaacgagauaaaagaaaaagaaggaguaggcgaacaauccgaauucaaauuuacacuauauaaaaacgaccuucuucuaauaaaagauacaaaaaacaaugaaaaacagaucuucagauuccuuagucgaacuaugccaaacguuaaacauuauguggaacuuaaacccuaugacaaagcuaaauuugacggcaaccaaccacuaauaacaauauucggaaauguagcuaaaggaggacaauguuuaaaaggucuaaacaaaucaaacauuagcauauucaaaguuaaaaccgacguucuaggaaauaaacacuucauaacuaaggaaggagaaaaaccaaaauuaaaauucuga

SEQ ID NO: 8600 - RNA, 3378 nt, Artificial Sequence
  Cas9 variant
augaacggcuuaguccuaggccuugauauaggcaucgcaagcguaggagucggaauauuaaauaaagaaacaggagaaauaauacauguaaacucaagaauauuucccgccgcaacagccgacucaaacguagaaagaagaggauuucgacaaggaagacgacucggcagaagaaaaaaacaccguucagcucgauuaaaugauuuauucgaagaauucggauucauaacagacuucuccgcaguaccauuaaaccuuaauccauacgcacuuagaguuaaaggauuaucagaagaacucacaaaugaagaacuguuuauagcacuaaaaaauauaauaaaaagaagagggauauccuaucuagacgacgcaucagaagauggcgagaccgcaucaaacgaauacgguaaagcgguggaagaaaaccgaaaacuacucgcagacaaaacaccaggacaaauacaacuagaacgauucgaaaaauauggacaaguaagaggagauuuuacagucguagaaaacggagagaaccaccgauuaauaaauguauucaguacaagcgccuauaaaaaggaggcagaacgcauacuaagacgacaacaagaauucaauguaagaauaucugacgaauucauagaagcauacuugacaauacuaaccggaaaaagaaaauacuaucauggcccaggcaaugaaaaaucacgaacugauuacggacgauucagaacagacggcaccacgcuagauaacaucuucgguauucuuauuggcaaauguaccuucuacccagacgaguaucgcgcugccaaagccagcuauacagcgcaagaauuuaaccuacucaaugaucucaacaaccucacugucccgaccgaaaccaaaaaacucagaccagaacaaaaacgacaaauaguugaguaugcaagaacagcaaaaaccuuagguacacccaccuuacuaaaauauauugccaaacucguagacgggucaauagacgauauuaaaggcuaccgaauagauaaaucagauaaaccagaaaugcauacauucgacgcuuauagaaaaaugagaacauuggaauuaguagacguugauauacuaucuagagaaacucuugacgauuuagcauacauucucacacuaaauaccgaaagugaaggaauauuagaagcauuaaauucaaaaaugccuggcacuuuuaccaaagagcaaauagacgaacucauucaguuuagaaaaaaaaauucagcuguauucggcaaaggauggcacaacuucagucuuaaacuaaugaacgaguuaaucccagaacuuuaugaaacuucggaagagcaaaugacaauuuuaacgcgacuaggcaaacaaagaagccgagaaauaucaaaaagaaccaaauacauagaugaaaaagaauuaacagacgaaaucuacaauccgguagucgcuaaaagcguucgacaagcuauuaaaaucauaaaccuugcgacaaaaaaauacgggauauuugacaauauaguuauagaaauggcgcgagaauccaaugaagacgacgaaaaaaaagcaauccaaaauguucaaaaggcaaaugaagacgagaaaaaagcugcaauggaaaaagcagcagaccucuacaacggaaaaaaagaacuuccagauaguauuuuccacggccacaaggaauuagcaacuaaaauacgacuauggcaucaacaaggagaaagaugucuuuauacaggaaaaaauaucucaauacacgacuugauccacaacccacaucaauacgaaauagaccauauccuaccauuaucauuaucuuuugacgacggucucgcaaacaaaguacuggucuuagcaacugccaaccaagaaaaaggccaaagaacucccuuucaagccuuagauuccauggaugacgccuggaguuauauagaguuuaaacaauacgucagaaauagcaaaagccuuaguaacaaaaagaaagacuacuuacucacagaagaagacauaucaaaaauagaaguaaaacaaaaauuuauagaacguaaccucgucgauacacgauacucuagcagagucguacuaaacacguuacaagaauuuuacaaaacaaacgacuuugacacuaaaauaagcguaguaagagggcaguucacuagucaauuaagacgaaaauggaaaauagaaaagagccgugacaccuaccaccaucaugccguagaugcauuaauuauagccgccaguucccaacugcgacuguggaagaaacaaaacaacccucuuauaucguacagagaaggccaauuaguagauccagaaacaggagaaauacucagucuaacagaugaugaauacaaagaauuaguacuuagaccaccauaugauuacuuuguagauacgcuaaaaucgaaaucguuugaagacaguauuuuguucucauaccaggucgauagcaaauacaacagaaagauaagugaugcuacaauauauggaacacguaaagcacagcuaggcaaagacaaacaagaagaaacauauguacuaggcaaaaucaaagauauauauucacaaaaaggcuacgaagauuucauaaaaagauauaaaaaagauaccacccaauuuuuaauguaccauaaggacccacaaacuuuugcaaaaguaaucgaagaaauacuuaaaacauaccccgacaaagaacugaaugaaaaaggaaaagaaauacccugcaauccauuugaaaaguacagacaagaaaauggcccuauccgaaaauacagcaaaaaaggaaaaggaccagaaauaaaaucacuuaaauauuaugacaauaaacuagguaaucacauugacauuaccccuguaaauagccaaaaucaaguaguacuccaaagucucaaacccuggagaacagacguauauuucaacccccaaaccucaaaauacgaacuuaugggauuaaaauacucagaucuuagauucgagaaaggaagugguucauacggaaucagccccgaaaaauacaacaaaguaaaggccaaagaaggaguagacgaagauagcgaguucaaauucacucuguauaagaacgacuuaauacuuauaaaagacacagaaacaggagaacaacaacuauuucgcuacgguucaagaaaugacaccucgaaacauuauguagaauuaaaaccuuacgaaaaagccaaauuugaaggaaaccagcaacuaaugaauuuacuuggaacgguggcaaaagguggacaauguuuaaaagguaucaauaaacccaaucuaagcauauauaaagugaaaacugacgugcuaggaaauaaauauuucauuaaaaaggaaggcgaccaaccacaacuaaacuucaaaaaaaaaauuuga

SEQ ID NO: 8601 - RNA, 3378 nt, Artificial Sequence
  Cas9 variant
augacaagcaaacaagaaaaucuaggagcauuaacauuuggauuagauauaggaauagcgucaguaggaugggcugugcuuggagaaaacagaauaauugaucucggaguaagauguuucgauaaggccgaaacagcuaaagaaggagagagcuuaaaucuggccagaagaauggccagacuccugcgaagaagauuacgacgacgagcauggcgauuaaccaaauuggcacgacuucuuaaaagagaaggucuuauagcagacgcuaauuuauuuaaaaauaaaauagaaaagaauacaccaguacccaagaguagcuggcaauuaagaguagaugcauuagauagaaaguuaaaugcggaagaaugggcccgaguuauauaccaccucugcaaacacagagguuuccauuggauaucacgggcggaggaaaaggcagcagaaucagauagcaaaggcgaaucaggaaagguaaaacaaggucuggcaggaaccaagaagcugaugcaagaaaagaacuacagaacugccgcagaaaugguacucgcagaauuuccggaagcccaaaggaauaaacaaggagacuacucaaaagcgcuauccagaauauuauuaggcgacgaacuaaaaacauuauuugaacaucaaagaaaacucgacucaccguuugcuacagagaagcuagaggcagcaauacuaggaaauggagaucgaaaaucaggacuauuuugggcccaaaauccggcuuuagcagguagcgaccuacuaaaaaugcuuggauauuguacuuuugaaaagacugaauacagagcuccgaaagcuagcuucacagcagaacgacauguuuggcuuacaagguuaaauaauuugagaauuguuguugauggaacaacccggccacuaaaugaagcagaaaggcgaauagcacuucuaaugccuuaucagcaagccggugauuuuacauauaaacaauuaagaacagcguuaacaaaagcagguuuccuacccgaaaguuucagauauacgggauuaucauaugcaaguggacaaaaagcaggagagaaaacaaaagauccugaaagugccgcucucguaaaauucccugcauggcaagaacuacgcaaaacgcuagaaaagaaagaauuagcuucagaauggcagaaaauuucaacugaugcacuagacgggaaaccacaauugcuagaccaaaucgccuggguucuaucugucuauaaagacgaugacgaaguaaaagcagagcuaucuaaacugaaccuuccaaaugcugagaaaaugaucgacgcauuacuagacauaagauuugauaaauuuucaaaucuuagccuaaaagcauugugcaaaauugucccacuuauggaacaaggacaaagguacgacgaagcaauagcaaacauuccagaauauggacaccauagccaacuacauaaagucggugcuggagaacauaaauauuuaccaccauuuuauaaagaaagagauaaaaccgguaggauggucuuuaaugaugauauggauauaccacgaaauccuguaguauuaagagccuuaaaccaagcacgaaaaguugugaaugcacuaaucaaaaaguacgauaguccacaugaaguacauauugagauggcacgagaucuuucacgaccguuagaugaaagacgagaagucgaaaaguuacaaaaagaauuucgugacaauaacgaaaaaggaaaagcucaauuugcccaagacuuuaauauaguaggugcaguaaagggaaaagaauuugaaaaauaucaauuauacagagaacaacaaggaaagugcgcauauaguaucgaaccaauggacauccacagacuauuugaacaaggauacguagaaaucgaccaugcuuuaccguauagcagaaguuuugacgauagcaaaaacaauagaguauuaguccuagcaaaagaaaacagagauaagggaaauagaaccccauucgaauacuuagguggaaaagauaauucagaaccuuggcgacaauucguagcuuuugucgaaggaaauaaagcauauagacuagcaaaacgaagccgccucuuaaggaaagacuucggggauaaagaagcuaaagaguucagagaaagaaacuuaaacgauacacgauacaucuguaaauucuuuaaaaauuacguagaacaauaucuacaauuacacgaagacucagaagcaaaaagauguguaguccugagcggacaaaugaccucauuccucagggcgagauggggucuggugaaaguacgaggugauagugacagacaucaugcucuggacgcagcaguagucgcagcauguucacaugggaugguuaaaagacuaucagacuauagccgaaggaaagaauuggagcaaguaagggaaggguucguugauguagacacaggugaaauaguaaauccagcaauguuucaacaaguacaagaacauuuuccuaacccuuggccccauuucagagacgagguuaaacuaagguuaucuauggaugacccagccuuacuaagguccgaaauggaaaaauuugggacauauaccccagaagcacuacaagcauuacauccacuauuuguuagucgggcuccccaaagacgaaauaguggagcugcucauaaagacacaauuuacgcucaaccuaaaagauuagucgcccaaggcggugugacacaaaaaguagccuugacaucauuaacuuugaaagaucuagacaaauuaauagacccacacagaaaugauaaacuauacacagcaauaagggcgagauuagaacagcacggagguaaaggcgauaaagcguuuccaucguccaauccuuuaagaaaacccgauucugaaggaaacccgacuggcccuauagucagaggaguaaccaugguaaucgauaagcucucaggaauaccaauaaggggagguauagcuaaaaacgauucaaugguaagaguagauguauuuacaaaagcaaauaaauuucaccuaguaccuguguacgugcaucauaccguagcuaaagcacuaccuaaucgagcuguaguugcuuuuaaagacgaagaugaauggacucuuaucgacgauaguuuugacuuuugcuucucauuacauccaaaugaucuaguccaaguacagcaaaaaggaaaagccggaaugauuggauacuacucgagcugccauagaggaacuggaaauauaaaucuaugggcccaugauagaaaucuacaaguaggaaaggaugguaugauagaagguauagggguaaagacagcacuaucauuagaaaaauuuaauguagauguccuagguaauagauacccagccccaccagaaaaacgcagagaucucgcauga

SEQ ID NO: 8602 - RNA, 3378 nt, Artificial Sequence
  Cas9 variant
augacagaccgcauaagucucgggcuagauauaggaguagcuaguguuggauucagcgucuuagacauagauaaagggaaaguuauagaacuaggagccagacuauucaaugcaacuguagcagcaggaaaucaagacagaagagauaugagaggaagucgaagacuauuaaaccguaacaaacaacgaaggaaagacguaagcaaauuauuccaggaauacggauuguuagacaacuucgacagagauaauuuucacacagcuuuuaauaacaauuggaacccuuacgagcuuagagucaaaggacuuacuaaacaauuaaacaaagaagaauuagcagauucacuuuaccagauaaucaaaagaagaggaauaucauacgcauuaaaagaugcugaugcaaaugaagauggaacagacuacucaucaucacuaaaaauaaacagccaagagcuaauagaaaaaacaccagcccaaauacaacuucaaagacuaaacgacuauggaaaagucagagguaaaguuauagucggagacgauauagaugaccaaaaaguacucuuaaacguuuuccccacaaaugcguacgaaaaggaagcaagacaaauuauagcaacccaacagcaauucuauccugaaauacuuacaggcgaauuuguuaaggaauacugccaaauauuaacaagaaagcgagacuauuucgucggaccuggcaacgaaaagagccgaacagacuacggaaucuauaaaacagacggccgaacgcuagacaaucucuuugaagaacugauaggacaugacaagauauauccagaugaacuccgagcgucagccgcgucuuacacagcccaacuauucaacguccuaaacgaucuaaacaaucucagaauuuuauccuaugaagacgguaaacuaacucagauagauaaagaaaaaauuauagcagaaaucaaaaauaacacaacagucguaaauaugcucaauguaauaaaaaaagucacagguugccaaaaagacgacauaaaaggauuucgucuaaacgaaaaagauaaacccgaaauaaguucaaugccuauauacagaaaagcacacaaagacuuucuaaaaguagguauugauauaacagacuggcccaucgauuuuaucgacagacucuccuucauacuaacacuaaauaccgaaaacggcgaaauaagaaaacaaaucaacaaaagguuaguaccugacuucgacuuccuaaacgaugacuuaguacaacuuauaauagacaauaaagacaguuucgauauuaaaacaaacaacaaauggcacagauuuucacugaaaacgaugaauaaacuaauacccacaaugauagagagaccaguagaacaaaugacauuacuaacagaaaugggccuaauaaaaaaagacacaaaaagauucgaaggaaauaaauacuuaccguauaaagaaauugcgaaugacauauucaauccaguagcuagcaaaaguguucgagaagcguuaaaaauagugaacgcaguacuuaaaaaguacggacauauugaguacauuguaauagagaugcccagagacaaaaaucuggaugaagaaaggaaacaaauagcggacuuccaaaaaaaaaacaaaaaaaucaaagaugcagcauuuaacgcguuugucaaggccguaggaucuaaaaaaaacguaaaaaucgcccuuagcaaaaacagaaaauuacaaaugggaauaagauuauggcaccaacagcaagggauagauccauauaacggugaagagauaaacgcaaaugacuuaauaucaaauccagacaaauucgaaaucgaccauauaauaccacaauccauaucauuugacgauggaauaaauaacaaaacacuaugcuucgccuccaugaaucaaguuaaagggcaaaaaaccccauaugaauuucuuaaugaaggacacggacaaggauaugcuaaauucaaagcaauuguaagcaagaacaaaaacuucucuaaagcaaaaagggauaauuaccuguucgaagaaaaugucagcaauauagaaacaagaaaaagauucuuauccagaaaucuaguagacacaagauacucaagcagaguaguucuaaauucauuacaagaauucuuccaugaaaaaagcgacgauaccaaaguaaccguaauacgaggaaaauuuacauccaacaugaggaaacauuggcacauagauaaaacuagagacaccuuucaucaccacgcaauagaugcaucaauaauagccgcaacacccuuccuacggauguggaaaaaaggcaguacaauuuuucccacgaaaauaaaugaaacaaguaucgauauagaaacaggagaaauacuagacgauaaaaacuucgacaaagugauguaugaagaaccuuacucaggauuuauaucugaaaucaugaacgcugacgauagaauuaaauucucucaccaaguugauaaaaaaaugaauagaaaaguuagcgacgcaacaauauauaguacacgaauugguaaauuaagcaaagacaaaaaagacgcagaauacguaguagcaaaagugaaggauauauacuccguugauggcuacgagaauuuuaaaaaaguauauaaaaaagacaaaacaaaauuccuacucuacaaauaugauccgcgcacauuuucagaauuagaaaaaaucguaauugauuauccagauaaaauagaaaagguccaaaccaacggcaaaauaaaggccguagacauaucgccauuugaacucuacagaagagacaaugguaugguaagaaaauauucgaaaaaaacagguccugcaauaaaacaauuaaaauaucucgacaaaaaacuaggaucacacauagacauaacgccaaaaaacgcuaauaacaaacauguuguucuccaaagccugaaaccauggcgaacagacguauaucugaaccacgaaacaggagaauaugaaauaauggguauaaaauauagcgauuuaaaauucaacaaaaaugaaggcuauggaauaaaaaaagacaaguaucuuaaaauaaaaaauauagagggaguuagcgaaaauagcgaauucauguucagccuauacagaaaagaucguauuaagguucaagacauggaaacaaaugaauccguagaacuacucuucuggucacgcaacuucucuaacaaaaaauacgcugaacuuaaaccgauuucucaaauugacaaugacaaagucuuaccaaucuacgggcgaggcagacuuaucaaacgacucauucccaaaaauugcaaaauauggaaaguaaauacauccauacuuggagauaccuauuaccucgaaaaagaaucaaauuauccgcagaaaauacuagacuga

SEQ ID NO: 8603 - RNA, 3381 nt, Artificial Sequence
  Cas9 variant
augaaugggcuaguuuuaggacuugauaucggaauagcaagcguaggcgugggaauacugaauaaagaaacuggagaaauaauucacgcaaauuccagaauauuuccggcggccacagcggacagcaacguagaacgaagaggauuccgacaaggcagaaggcuaggcaggagaaagaaacacaggagugcaagacuaaacaaucuauucgaagaguucggauucaucacagacuuuagugcaauuccauuaaaccucaacccauacgcacuacgcguaaaaggauuaucugaagaauuaacaaaugaagaauuauucauagcauugaaaaauauaauaaaaagaagagguauaagcuacuuagacgaugcgucugaagacggggaaaccgcaaguaacgaauauggaaaagcuguagaagaaaacagaaaauuauuagccgacaaaacuccaggucaaauacaauuagaaagauucgaaaaauauggacaaguacgaggcgacuucaccguaguagaaaauggagaaaaccauagacuuauaaauguauucaguacuucugcauacaagaaagaagcagaacgaauacuccgaagacaacaggaauuuaauguucguauauccgacgaauuuaucgaagcauaucugaccauacucacagguaaaagaaaauauuaccacggaccaggcaacgaaaagaguagaaccgauuacggaagauuccgcacagauggaacgacgcuagacaacaucuuuggaauauuaauuggaaaauguacauucuacccagacgaauaccgcgcugccaaagccucauauacagcccaagaguucaaccuacuaaacgauuuaaacaaccuuacaguacccacugaaacuaagaaacuaucacccgaacaaaaacgccaaaucguagaauacgcaagaacugcaaaaacuuuaggaacaccaacacuacuaaaauauauagcaaagcuaguugauggguccaucgaugauauuaaaggauaucgaauagacaaaucugacaaacccgaaaugaugcacacguucgacgccuacagaaaaaugcgaacucuagacuuaguaaauauagacgcacuauccagagaaacauuagacgaucuugcccacauacuaacacucaacacggaaagcgaaggaauacuugaagcauuaaacuccaaaaugccaucaaccuuuacaaaagaacagauagaugaauuaauacaauuuagaaagaaaaacagugccguauuuggcaaagguuggcacaauuucucacuuaaauuaaugaacgagcuaauaagugagcuauacgaaacaagugaagaacagaugacgauacugacaagacuaggcaaacaaagauccagagaaauaagcaaacgaacaaaauauauagacgaaaaagaauuaacugaagaaauauacaauccuguaguagcaaaaucaguuagacaagcaauaaaaauaauaaacgaagcaaccaaaagguauggaauuuucgacaacauagucauagaaauggcacgcgaaaacaacgaggaagaugcgaagaaagauuacaucaaaaggcaaaaagcaaaccaagaugagaaaaacgcaagcauggaaaaagccgccuuucaauacaaugguaagaaagaauuaccugacucaauauuccacggacacaaagaauuagccacaaaaauaagacuauggcaucaacaaggggaacguugccuguacacaggcaaaaauauuucaauuagagaccugauacauaauccucaccaauacgaaauagaucacauccucccacugucguuaucuuucgaugacggucucgcaaacaaaguucucguacuugccacagcaaaucaagaaaaaggccaacgaaccccuuuccaggcuauagacagcauggacgaugccuggagcuauagagaauuuaaacaguauguucgaaauuccaaaucccuauccaacaaaaagaaagacuaucuacuaacggaagaggacauuaguaaaauagaaguuaaacaaaaauucauugaaagaaaucuuguagauacuagauauuccaguagaguaguauugaacacacuacaagaguucuauaaaacuaacgacuucgacacaaaaauuaguguagucagaggccaguuuaccucccagcuuagaagaaaauggaaaauagagaaaaguagggacacauaccaccaccaugcaguagacgcccuaaucauagccgccucuucacaacuacgauuauggaagaaacaaaacaauccauuaauaagcuauaaagaagggcaauucguggacccagaaacaggugaaauauuaucccuaacagacgaugaauacaaagagcuaguauuccgcccuccuuacgacuauuucguagacacauuaaaaaguaaaaguuucgaagacaguauccuuuucuccuaucaaguagauagcaaauacaaccgcaaaaucucagaugccacgauauauggaacccgaaaagcgcaauuaggcaaagauaaacaagaagaaacuuauguacuaggaaaaauaaaagacauauacucacaaaaaggauaugaagacuucaucaaaagauacaauaaagaugaaacacaauucuuaauauaccauaaagacccacaaacauuugaaaaagucaucgaagaaauccuaaaaacauauccagacaaagaauuaaacgaaaaaggcaaagaaaucccaugcaacccauucgaaaaauacagacaagaaaaugggccaauaagaaaauauucaaagaaaggcaaaggaccagaaauaaaaauucuaaaauauuaugacaauaaacuagguaaucacauagauauaacgcccgucaacucacaaaaccaaguaguuuuacaaagucuaaaaccauggagaacugauguauauuucaacccucgaacaucaaaauacgaacucaugggacugaaauauagugaccucagauucgaaaaaggaucuggaucauacggcaucagccccgaaaaauacaauaaaguaaaagcaaaagaaggcguaaaugaagacucagaguucaaauucacauuauacaaaaacgaucuaauucugauaaaagacaccgaaacuggagaacaacaacuauucagguacgggucaagaaacgauacaucaaaacacuauguagaacuaaaaccauaugaaaaagcgaaauucgaaggaaaccaacaacuaaugaaucuacuaggaacaguagccaaagguggccaaugucucaaaggaauaaacaaaccaaacuuaucaauuuacaaagugaaaaccgauguacuaggcaacaaguauuuuauaaagaaagaaggagaccaaccccaauuaaacuucaaaaagaaauucuga

SEQ ID NO: 8604 - RNA, 3381 nt, Artificial Sequence
  Cas9 variant
auggcaucaaaacacgaaaaucuuggugcccuaacauucggacucgauauaggaauagcaagcguaggaugggcaguccuaggagaaaacagaauaauugauuuagguguacgauguuuugauaaagcagaaacagcaaaagagggagaaucuuuaaaucuagcacgaagaacagcuagauuacuaagaagaagauugcggagacgagcauggcguuugacuaaauuagcacgacuccuaaagagagaaggucucauugcagacacaaacgucuuccaaaaacccuuuaaucuaaaagaugcaaaugaaaaaggacuaucauuuuggcaacuaagaguagaugcauuagauagaaaauuaagcgccgaagaaugggcacgaguaauauaucaucucugcaaacacagggguuuccauuggauuaguagagcugaagagaaagcagcugaaggagacucaaaaagcgaagggggaaaagucaaacagggacucgcagguacaaagaaauuaaugcaagagaaaaacuacagaaccgccgcugaaaugguucucacagaguucccagaagcccaaagaaacaaacaaggcgauuauaguaaagcacuuucucgcauuuuauuaggagaugaaaugacacaguuauucaaacaccaacgugaacugggaaauccgcaugccacugaaaagcuagaagcagcuaucuuaggaaauggagaucacaaaaguggacuauuuugggcucaaaauccagcguuagcaggaaacgauuuacuaaaaauguuaggccauuguacauuugaaaaggcagaauauagaguaccaaaagcuagcuuuacagcagaaagacacguguggcuuacucggcugaauaacuugagaauagucgucgacggcacaacaagaccacucaaugaagccgagagacacuuagcacuauuaaugccauaucaacaagcaggagaucuuacauauaaacaauuacguacagcacuuacaaaagccggauaucuaccagaaucauuuagauauaccggacuugcauaugcuuccgggcaaaaagcagacgaaaaagcaaaagauccugaaucugcaccucuaguaaaauuaccagcauggcacgaauuaagaaaaacacuagaaaagaaggaacuugcaucagaauggcagaaaauaaguagcgacgcauuggacgguaaaccucaacugcucgaccaaauagcauggguccuuucgguuuauaaagacgauacagaaguugaggcggaacuauguaaguuaaaccuaccaaaugcagagaaaaugaucgaugcacuauuagauauuagauuugacaaauuuuccaaccuaucacuaaaagcauuacgucaaauuguuccguuaauggaacaaggacaaagauacgacgaagcugucgcuaauauaccagaauaugggcaccauucccaauuacacgaagucggcgcgggugaacauaaauaccuaccuccguuuuauaaagaaagagacaaaacaggacgaaugguauuuaacgaugacauggauauccccagaaacccagucguacuacgcgcacuaaaucaagcccguaaaguaguuaacgcacuaauaaaagaauauggauccccacaugaaguucacauagaaauggcaagagauuuaucccggccacuagaugaaagaagagauguugaaaaacuacaaaaagaauuucgugauagaaaugaaaaagacaaggcgcuauucgcacaagacuuuaauauagucggagcaguaaaaggaaaagaguucgaaaaauaccaauuauacagagaacaacaaggaaaaugcgcauacucgaucgaaccaauggauauucacagauuauuugaacaagguuauguagaaaucgaucaugcuuuaccauacucaagaaguuucgacgauagcaaaaacaaccguguccuaguacuagcaaaggaaaacagagauaaaggcaaccgaacaccauuugaauaccucgggggaaaagauaauuccgaacgauggagacaauuugucgcuuuugucgagggcaacaaaucauaccgauuagcaaaaagaucaagacuauuaaggaaagacuuugguaaagaugaggccaaggguuuccgugaaagaaaucuaaacgauacacgauauauaugcagauucuuuaaaaacuauguagaacaauaucuacaauuacaugaagacucagaugccaaaagaugcguaguacuuuccgggcaaaugaccagcuuucuacgcgcgagauggggauugguaaaaguacgaggcgacucagacagacaucaugcacuagacggagcaauugucgcagcauguagucacucaaugguaaagagacuaagugauuacucaagaagaaaagaacuagaacaaguaagagcaggauuugucgauguagauacaggagaaauugucaauccggcaauguuucaacagguacaagaacauuuuccaaauccauggccccauuuucgugaugaagucaaacugaggcucaacguugaugacccagccuuacuacauagugaaaugaacagauuuggaacauacucaccggaggcacuaaaagcacuuaggccacucuucaucucuagagcaccacaaagaagaaacagcggagcagcacauaaagacacaauuuaugcucaaccagaaagacuuguagcacaaggaggaguuacccaaaaaguaccacuaacuucauuaacacuaaaagacuuagauaaacuuauagacccccauagaaaugaaaaacuuuacagcgcuauacguauaagauuggaacaacauggagggaaaggugauaaggcuuucccagcgagcaacccauugagaaaacccgacucagaaggcaauccaacugguccuauaguaagagguguaacaaugguaauagauaaacugagcggaauaccaauacgcggugggauagccaaaaaugacucaaugguacgaguagacguuuuuacaaaagcaggaaaauuccaucucguuccuguauacguacaucaugcgguagcgaaaguauuaccgaacagagcuguuguugcauauaaagaugaaacagaguggacacuaauagaugacggauuugauuuuugcuuuagcauguacccuaacgaucugcugagaauaaaauuaagaaaugccucacaccuaggauauuaugcaucauguaaccgaaguacaggcgcaauuaauuuauggagucacgauagaaaucagcaaguaggcaaagaugguaugauagaaucgauugggguaaagacugcuuuaaauguugaaaaauuaaacauagacguauuaggaaaucguuauccagcaccuccagaaaaacgaagagaucuugcauga

SEQ ID NO: 8605 - RNA, 3384 nt, Artificial Sequence
  Cas9 variant
augucugaucugguauuaggacuagauaucggaauagguucaguaggagucgguauacucaacaaaguuacaggcgaaauaauacacaaaaacuccagaauauucccagcggcucaagcugaaaauaacguugaaagacgaauaaaucgacaaggaagaagguuaacaagaagaaagaaacaucggagaguaagauuaaaucaucuguucgaagaaucaggacuaauaacugacuuuacaaauguaaguaucaacuuaaauccauaccaacuacguguaaaaggucuaacagacgaacuaaguaaugaagaguuguucauagcccugaaaaacauggucaaacauagaggaauuagcuacuuagaugacgcaagcgacgacggcaacucuucaguuggagauuacgcacaaaucguaaaggaaaauucaaaacaacuugaaaccaaaacaccaggucaaauacagcuggaaagauaccaaaaauacggacagcucagaggggauuuuaccguagaagaagauggcaagaaacauagguuaauaaauguauucccaaccagugcauaccgagcagaggcgcugcgaaucuuacaaacgcaacaagaguucaauccgcaaauaacagacgaauuuauuaacaguuaccuacaaauacuuacuggaaaaagaaaauauuaucacgggcccggaaacgaaaaauccaggacagacuacggccgauacacaacuaagaaagauagcgaagacgaauauauaacacuagacaacauauucggaaucuuaauaggaaaaugcaccuucuauccagaagaauacagagccgcaaaagcaucauauacagcacaagaguucaaucuauuaaacgaucucaauaaccuaacaguuccaacagaaacgaagaaacuaagcgaagaacagaaaaaccaaaucauaaccaauguuaaaaaugaaaaagcaaugggccccgccaaauuauuuaaauacauagcaaaacuucuaaguugugauguagcagacauaaaagguuacaggauagacaaaagcgacaaagcagaaauucacacauuugaagcauaccggaaaaugaaaacacuagcaaccauagauauagaacaaauggaacgggaaaaccucgacaaauuagcauauguacucacccucaauacggaaaaggaaggaauacaagaggcucuagagcaugaauuugcagacggcacauuuucacaagaacaaauagacgagcuaguacaauucagaaaagcaaacucaagcauauucgggaaagguuggcacucuuucuccguaaaauugaugauggaauuaauaccagaacuauacgcaacaucagaagaacaaaugacuauacucaccaggcuuggcaaacagaaaacaacaucaaguucaaacaaaaccaaauauauugaugaaaaacaauuaacggaagaaauauacaacccagucgcagcgaaaucaguacgucaagcaauuaaaauagucaacgcagcgauaaaggaauacggagacuuugacaacauaguaauagaaauggcgagagaaaccaacgaggacgaugaaaagaaagcaauacagaaaauccaaaaagcaaacaaagacgaaaaagacgcugcaaugcuaaaagcagccaaccaauacaauggaaaagcagaauuaccacacaguguuuuccacggacacaaacaacuagccacuaaaauaagacuuuggcaccaacaaggagaacgaugucuauacacuggcaaaacuauaucaauucacgaucuaauaaauaacucgaaccaauucgaaauagaccauauccuuccacucucaauuacguucgaugauucccuugccaauaaagucuuaguuuaugccacagcaaaccaagaaaaaggacaaagaacaccauaucaggcgcuagacaguauggaugaugcauggaguuuucgcgaacuaaaggcauucguaagagauagcaaagcccucucaaacaagaagaaagaauaccuguuaacggaagaagauauaaguaaauucgacgucagaaagaaauuuauagaacgcaaccucguugacacacgauacgccagucgaguaguacuaaaugcacuacaagaacauuuuagaguccacaaaacagauacaaaaguaucaguaguacgaggacaauuuacuucacaauuaagaagacauugggguaucgagaaaacaagagacacguaccaucaucacgcuguagacgcgcuuauaaucgcagccuccucacaacuaaaccuauggaagaaacagaaaaauacucuaguaaguuauucagaagaucaacucuuagacaucgaaacaggggaauuaauaagcgacgaugaauauaaagaaagcguauuuaaagcucccuaucaacauuuuguggacacauuaaaaaguaaagaguucgaagauucaauauuauuuucauaccaaguagacucaaaauucaaucgcaaaauauccgacgcaacaauauaugccacaagacaagcaaaaguagguaaagauaagaaagacgaaacauaugugcugggaaaaauaaaagacauuuacagucaaacaggauacgacgcauucauaaaaauauacaagaaagacaaaucaaaauuucuuauguauagacaugacccucaaaccuucgaaaaagucaucgaaccaauacuggaaaauuacccaaauaaagaauuaaacgaaaaaggaaaagaaguaccaugcaauccuuuccugaaauacaaagaagaccacggauauauacgaaaauauucaaagaaaggaaaugggccagaaaucaaaagucuaaaauacuacgauagcaaauuaggaaaccauaucgacauuaccccgaaaaauuccaauaacaaaguaguauuacaaucaguuucaccauggagagccgacguauauuucaacaaaacaacaggaaaauaugaaauuuuaggauuaaaauacgcagauuuaaaauucgaaaaaggaacaggaacauauaaaauaucggaagaaaaauacaaugauaucaagauaaaagaaggaguagacagcgauagcgaauuuaaguuuacacuuuauaaaaacgaucuacuacuaauaaaagacacagaaacuaaagaacaacagcuauuuagguuucuguccagaacaaugccaaacguaaaacacuacguugagcuaaaaccauacgauaaacagaaauucgacgauaacgaagaacucauaaagauacuaggaauuguugcaaaaggaggacaaugcaaaaagggcguaagcaaacccaacaucucaauuuauaaaauacgaaccgacguucuagguaaucagcacaucaucaagaacgaaggagauaaaccaaagcucgacuuuuga

SEQ ID NO: 8606 - RNA, 3384 nt, Artificial Sequence
  Cas9 variant
augaauggacuuguccuuggauuagauaucggaaucgcuucaguaggggugggaauacucgaaaaagacucugguaaaauuauucacgcuaacaguagaauauuuccugcagcaaccgcagauaacaacguagaacguagaaccucuagacaagcgcgaagguuaaaucgacgaaagaaacaccgauccguccgccuucaugaucucuucgaagaauacggguuauuaacagacuuuaguaaaguaagcaucaaccuaaaucccuaucaaauaagaguacaaggacucgacaaacgcuuaacaaacgaagaacucuucaucgcucuuaaaaauauuguuaaacgccggggaaucuccuaucuagaugacgcgucagaagauggaggugcagucucaagcgacuauggaaaagcaguagaagaaaacaggaaacuacucgcucaacaaacaccuggccagauacaguuagacagauuugaaaaauauggucaaguuagaggagauuucacaguaguagaaaacggagagaaacgacgauuaauaaauguauucagcacaucagccuauagaaaagaagccgagagaauccuccggaaacaacaagaauuuaacaauaaaauaacagagggcuucauagaagauuaucucacuauacucacagguaaaagaaaauauuaccacgggcccgggaacgagaaaucaagaacggacuacggaagauauacaacaaagaaagacagccaaggugaauacauaacacuugacaauauauucggaauacuaauaggaaaauguacauucuacccagacgaauauagagcaagcaaagcaaguuacacugcucaagaguucaaucuacugaacgaccuaaacaaccucacggucccaacagaaacuaagaaacuaucagucgaacaaaagaaaacaauaguugaauacgccaaaacugcaaaaacauuaggagcgucaacacucuuaaaauauauagcaaaacuaauuggaguaucaguagaucaaauacacggauaucgaaucgacccaaacgaaaaaccagaaaugcauaccuucgaaguguauagaaaaaugcagagcuuagaaacaauaagaguugaggaacuaccuagaaaaguaaucgaugaacuugcacauauacuuacacucaacacagaacgugaaggcauugaagaagccaucaaugcgaaacucaaagauauauucucucaagaucaaguauuagaauuaguccaauuccguaaaaauaauucgucauuauucucaaaaggauggcauaacuuuucccuaaaacuaaugauggaacuaauaccagaacucuacgagacaagcgaagaacaaaugacuauccuaacccgauuaggaaaacagaaaagcaaagaaacaucgaaacgaacaaaauacaucgaugaaaaagaauuaacugaagaaauauacaacccuguaguagccaaaucaguccgacaagcuauuaaaauaauaaaugaagcgacuaaaagauauggaaucuuugauaacauuguuauugagauggcucgcgaaaacaacgaagaagacgcaaagaaagaauauauuaaaaggcaaaaagcaaaccuagacgagaaaaacgcagccauggaaaaagcagcauuucaauacaacgggaagaaagaauuaccagacaauguauuccauggacauaaagaacucgcaaccaaaauaagacuauggcaccaacaaggggaaaaaugucuuuauacagguaaaaacaucccaauuagcgaucuaauacaaaaccguuauaaauacgaaauagaucauauacuaccccuaucuuuaucauuugaugacagccuauccaauaaagugcuaguacuagcaacagcuaaccaagaaaaaggacaaagaacaccauuucaagcacuagacaguauggauuacgccuggucguacagagaguucaaaucauaugucaaagauagcaaacuacuaaguaauaaaaagaaagauuaccuauuaacugaagaagauauaucaaaaauagaaguaaaacaaaaauucauugaaagaaauuuaguagacacacgguacagcucacgggucguccuaaacgcacuacaagauuuuuauaaagaacaccaauuugauacaacaauaucaguagugcgcggccaauucacuucacaacuuagaagaaaauggggaauagagaaaagccgagaaacuuaucaccaccaugcaguagacgcgcuaauaauagcggcuucaucccaacuaagacuauggaagaaacauaacaauccccucauauccuacaaagaagaacaauucguagauagcgaaacaggagaaauuauaucaaugagugacgacgaauacaaagaacugguauucaaagcacccuacgaucacuuugucgauacacuaaaaucaaagaaauucgaagauagcauuuuauucucauaccaaguagauuccaaauacaaucggaaaauaucagaugcaacaauauacgcaacacggaaagcaaaauuagacaaagacaaaagugaagaaacuuacguacuagguaaaauuaaagauaucuauucucaagccggauacgauacauucauaaaaauauacaacaaagauaaaucacgauuuuuaauguaucacaaagauccccaaacauucgaaaaaguuaucgaagaaauauuaagaacauauccuucaaaagaacugaaugagaaaaauaaagaagugccauguaaucccuuugaaaaauaccggcaagaaaaugguccaauacgaaaauauucacgcaaaggcaacggaccagaaauuaagagcuugaaauauuacgauaacaaauuaggaaaccacauagacauaaccccuaaugaaagcaugaaccaaguaguacuacaaucacuaaaacccuggcgaacagacguauucuuuaaccaucaaacagaaaaauacgaacugaugggucuaaaauauagcgauuuaaacuuugaaaaaggcucuggaaaauauuccauaucacuagaaaaauacaauucuauaaaaaugaaugaaggcguuagugaagaaucggaguucaaauuuacauuauauaaaaacgaccuaauacuaauuaaagacgcauuaacaaaagaagcucaaauauucagauacggaagcagaaaugacacaagcaaacauuaugucgaauuaaaaccauacgacaugagcaaauucgaaggagaugaacgacuaauaaaaguucuagggacaguugccaaagguggccggugcauaaaaggauuaaacaagaaagacauuagcauauucaaaguaaaaacagacguguugggaaacaaacauuucauaaagaaagaaggugaagaaccaaaacuaaaauucuga

SEQ ID NO: 8607 - RNA, 3387 nt, Artificial Sequence
  Cas9 variant
augaccaaacucggaaaacccuacgggauaggaguagacaucgguucaaauucuauaggauuugcagcaguagaugaaaacucucauuuaauuaggcucaaagguaaaaccgucauaggugcaagauuguucgaggaagguaaagccgcagcaaaaagacgagcaggcagaacaacacgucgacgauuaagcaggaaucguuggagacucagcuuuuuacgcgauuucuucgaaagccauauaacaccgacugauccaaacuuuuucaugagacaaaaauauagcgaaaucucacccaaagauaaagcacgguauaaauaugagaaaagauuauuuaaugacagaacagaugcagaguucuaccaacaauauucaacaauguaccaccugagaaacagauugaugacagauccaucuagagcagacguccgagaaauauauuuugcaauacaucauauacuaaaaaguagaggccacuuccuaacucccggagaugcaaaagacuucaacacaaaugauguagcuuuagacgaaaucuucccugcacugcaagacgcuuaugcccaaguauacccugauuuagggaucacauucgaugaagauaaagcaaacgaguucaaaacuaucuuacucaaugaaaucgcaacaaguauugacacacaaagagcucuuguaaaacuauuauuagccgaagaagaugacaaagauauuuuaaaacaacaaaaacaaguauuaacagaauuugcuaaagcaguggucggucuaaaaacuaaauuaaaccuagcacuaggaacagaagucgauucaagcgaagccacagcguggaacuuuuccuugggacaacuugacgauaaaugggcuggaauagaauccgcaaugacagaugaaggaacagaaauacuugaucagauaagagauuuauaccgcgcacgucuacuaaacgggauaguaccuacuggaaaaaccuuaucacaagcaaaaguagacgacuauacacaacaccaugaagaccuacaauuauuuaaagccuaccuaaaacaacuagaagacgacggaacagcuaaagcaauuagacaauuauacgacagauacauagacggugaugaugcagcuccauucuuacgcgaaaacuucguaaaagcacugaccaaagaugucacugcucauccaaauaccaaaagcccugaauuauuagaaagauuagcucaaccugacuuuaugcuuaagcaacguaacaaagcuaacggcgcuauaccgguacaaaugcaacaacgcgagcucgaucaaauuauaaagaaccaagcuguauauuacgauuggcuagcagcccccaacccagucgaaaaacaccgaaagagcaugccuuaccaauuagaugagcuccuaaacuuccgaauaccauauuauguuggaccccuaguuacagcaaaagaacaaaaggccgcucagggagguguauucgccuggaugguacgaaaggacccagaaggcaauauaacaccauacaauuucgacgaaaaagucgacagagaagcaucagcgaauacauucauacaacgcaugaaaacaacggauacauacuuaaucggugaagauguacuaccaaaacaaucacuucuuuaucagcgguaugagguucuaaaugaacuaaacaauguuagaguuaauaaugaaaaacuauccauagaacaaaaacaacaaguaauaagggaacuauuugaaagacauaauucuguaacuauaaaacaauuugcugagaaccuaagagcacacggagauuaugcacacauaccagaaauacgaggauuagcagacgagaaaagauuucuuucuucacuaucaacauacagacagcuaaaaucccuauuaccagaagccauagacgauccagcaaaacaagcugacauagaaaacauaaucgcauggucaacgguuuuugaagaugcagcaauauuuaaaacaaaauuaaaagaaaucucuuggcucgguagcgaggcaaucacaaaacugaguaacaucagguauagggguuggggacaguuuucucguaaauuuuuaaauggacugaccuugggaaacggacauacgauaauacaagaguuguuacuaucaacaaauaacuuaaugcagauccuaacagaugagacacuucaaaagaaaaugacggaauuaaacgccgacaaauuaaaaacagcaaauauuaaugacgcgauagauaacgcauauacuucaccaucaaacaagaaagcgcuaagacaagucuuacguguaguagaugacauuaaacgagcagcugauggacaagacccaucaugguuauacguggaaacagcagauggugggggcacgcccggaaagcgaaccagagcuaggcaacaucaauuacaagaaauuuaugcaaaugcagcgcacgaauuaauagauacagccguuagaggagagcuagaagauaaaauaagcgacaaagcagacuuuaacgacagauuaguuuuauacuuuaugcaagguggaagagauauauacacaggagcaccauuaaacauagaucaauuaaguuccuacgauaucgaucauaucuuaccacaaucacuaauaaaagauaauagucuagauaaucgaguguuaguacacgcuauaauuaaccgggagaaaaacgcaaccuuugccucaacaauauacgcucagaaaaugaaugcaaccuggagacaauggcaugaagccggacucauuucaggccgcaaauuaagaaauuuacaaaugaggccagaccaaaucgauaaauaugcaagugguuucgucgcaagacaauuaguugagacaagacaaauaauaaaacuaacggaacaaauaguagcagcccaauacccagacacaaaaauuauagcaguaaaggcaggguuaucucaccagcucagagaagaacuagaauuuccgaaaaauagagauguaaaccacuaccaccacgcuuucgaugcuuuucuagccgcacgaaucggcacguauuuauuaaaaagauuucccaaccuacaagcauucuuuacauauggaaaauucacaaaagcagauguuaagaaauugagagguuuuaauuuuauaagagacaucacucacgcagaagauaaaaucguugcaaaagauacaggugaaguugugugggacaaacaaagggauguagacgaacuagauaggauauauaacuucaaaagaaugcucauaacccacgaaguucgauuugaaacugcggaucuauuuaaacaaacuguauacggagcaagagauucaaaagaagccggaggcucuaaacaacuuauaccaaagaagaaagacauacaacugauauucaugggagcuauaagcgaaagaaccagaccuauucuaccccuuuga

SEQ ID NO: 8608 - RNA, 3387 nt, Artificial Sequence
  Cas9 variant
auggacgagaaaauggauuauagaauagguuuagacaucggaaucgcaaguguaggaugggcaguacuacaaaacaacucggaugaugaaccaguucguauuguagacuuagguguaagaauauucgauacagcagaaauaccaaaaacgggagaaagucuagcuggaccgagacgagcagcuagaacaacaagaagaagacuaagacgaagaaaacacagguuagaccgaauuaaauggcuauuugaaaaccaaggacucauaaacaucgacgauuucuuaaaaagauacaauauggcaggauuaccugacguauaccaauugagguacgaagcacuagauagaaaacucacagaugaagaacuagcucaaguauuauugcauauugcaaaacauagggguuucagaaguacaagaaaagcugaaaccgcagcuaaagaaaauggagcagugcuaaaagccacugacgaaaaucaaaaacgaaugcaagaaaaaggguaccgaaccguuggggaaaugauuuacuuagaugaagcauuuagaauaggaugcucauggagcgaaaaagguuacauauuaacaccacgaaauaaagcugaaaacuaucagcacaccauguuaagagcgaugcuuguugaagaaguaaaagaaauauucucaucacaaagaaggcuagggaauaagaaagcaaccgaagaacuugaagaaaaauauuuagaaauaaugacaucacaacgaaguuuugaccuaggaccuggaaugcaaccagauggaaaacccagcccauacgcuauggaaggcuuuagugaccggguaggaaaauguaccuuucuaggggaucaaggcgaacuuagaggagcuaaaggaacauauacagcagaauauuucguagcauuacagaaaauaaaccauacaaaacucguuaaucaagacggcgaaacaagaaacuuuacagaagaggagaggagagcccucacauuacucuuauuuacucaaaaagaaguaaaauacgcugcaguacgaaagaaauuaggccuuccagaagacauacuauuuuacaaccuuaauuauaagaaagcagcgacaaaagaagaacaacaaaaagaaaaccaaaacacagaaaaagcaaaauuuauagguaugccauacuaccaugacuacaagaaaugucuagaagaaagagugaaauauuuaacugagaaugaaguucgcgaucucuuugaugaaauaggcaugauacuaacuugcuacaaaaacgaugauagcagaacagaaagauuagcaaaacucggacugguaccaauagaaauggagggauuacuagcguauaccccuacaaaauuucaacacuuaucaaugaaagcuaugcgaaauaucaucccauuccuagagaaaggaaugacauacgacaaggcuugugaggaggcaggauaugacuucaaagcugacucaaaaggaacaaaacaaaaauuacuuaccggagaaaacguuaaccaaacaauaaaugaaauaacaaauccaguagucaaaagaucaguaagucagacagucaaagucaucaacgcgaucauaagaacauacggauccccacaagccauaaacaucgaauuggcacgugaaaugucgaaaaccuuugaagaacggagaaaaauaaaaggagauauggagaaaagacagaaaaauaaugaagauguaaagaaacaaauacaagagcucggaaaauuaucaccaacaggacaagauauuuuaaaauaccgauuauggcaggaacaacaaggcauaugcauguacagugguaaaacuauaccucuagaagaacuauucaaaccagguuacgauauagaccacauacugccauauaguauaacuuucgaugauucuuuucgaaacaaaguauuaguaacaagucaagagaauagacaaaaaggaaauagaaccccauacgaauauaugggaaacgaugaacaaagauggaacgaauuugaaacacggguaaaaaccacaauaagagacuacaagaaacaacaaaaauuacuaaagaaacauuucagugaagaagagagaagcgaguucaaagaaagaaauuuaacugauacgaaauauauaacuacgguuauauacaauaugauacgacaaaaccuagaaauggcgccucuuaaucgacccgagaaaaagaaacaagucagagcaguaaacggagcaauaaccgcauauuugagaaaacgcuggggacuaccacagaaaaauagagaaaccgacacgcaccaugcaauggacgcuguaguuaucgcuuguuguacagacggaaugauccagaaaauaagcagguacacaaagguuagagaaagauguuauagcaaaggcacagaauuugucgaugcugaaacuggagaaauauuucgucccgaagauuacaguagggccgagugggaugaaauuuucggaguacauauuccaaaaccaugggaaacuuuucgagcugaacuagauguaagaaugggagaugauccaaagggauuuuuagacacccacagugauguagcacuugaacuagacuacccagaauauauuuacgaaaaccuaaggccaauauuuguaagcagaaugcccaaucacaaagucacuggagcugcccacgcggacacaauaagaagcccucgacauuuuaaagaugaaggaauaguacugacgaaaaccgcauuaacagauuugaagcucgauaaagauggagaaauagauggguauuauaacccacaaagcgaucuacuacuauacgaggcauuaaagaaacaacuacuuuuauaugggaacgaugcuaaaaaggcauuugcgcaagauuuucauaaaccgaaagcugacgguaccgaaggcccaguaguuagaaaaguaaaaauacaaaagaaacaaacuaugggugucuuuguagauagcggaaauggaauagcagagaacggcgguaugguaaggauagacguauuuagagucaauggaaaauauuauuuugucccaguauauacagcagaugucgugaagaaaguucucccaaacagagcaucaacagccaacaaaccauacagcgaauggagaacaauggaagauaaagauuuucuauucagucuauauucccgagaccuuguacauauaaaaucuaagaaaggaaucccaauuaaaaacguagacgggagccugggagagaguaaagaaguauaugcauauuauauaggagcagauauaucaggugccaaaaucgaaggaaaagcacaugauucgcgauacaccuucagaggaauagggguucaaaaacuagaauuaauugaaaaaugucaaguagauauauuaggccacauaaguacugucaaaaaugagaaaagaaugggcuuuaguuga

SEQ ID NO: 8609 - RNA, 3387 nt, Artificial Sequence
  Cas9 variant
augaaugauaaaaaccaaaaauauaggcucgguuuagaucuaggaacuaacuccaucggauggugcauuuauucacuagaugugaauaacaaaccagaaacacuaaucgauaugggaguuagaauauuuagcgacggucgugaccccaaaacuaaagaaccacuagccguugaaaggagaacagcuagaggacuacgacgaauccuacauaggaggaaacugagaagacgacaaauguucagacuucuacaagaacaggggcuaaugccaaaugacgcuuccgaagcagccgcauuaaaaagccuuaaccccuaugaacuuagaguaaaagcgcuugacacaaaauuagaacccuaugaauugggcagagcuuuauuuaauuuaucaguaagaagaggauuuaaaaguaaucgaaaagaagccguacaagaaaaagaaaaagacucacaaaacgacgcaaaaucacaaaaugaaaaaugcgaacaccuagcaaaagcuauaaaagauucagguugcaggacccuuggcgaguuccuguggaaacauaagaauaccgaaacacaacaaaccgaaaacgaugcacgaaacaucggcaugagguucguaccaggaagaucgaauuauuaccccacgagaagaauguauguagaagaguucgaugcaauaagaaaggcucaagaaccauauuacagcggaguuaacugggacgcacuccaugaaaaauuauucuaccaaagaccuuuacgggcccaagaaagaggaaaaugcagauacaugccagauaaagaaagaacguuuaaagcaaugccaugcucacagaaaauaagaauuuuacaagaaguuuauaacauggauuauauagaugaauaugguaaaacuauaccuuuagaagaagcacaaacagauagucuaauaucauugcuugauaaaagggaaaaauuaaguuuuaaagcaaugaagaaagaauuaggaauugaugaaucgugcaccuuuaaccuagaaagaggcgguagagaauacuuacaaggaaacgcagccgcgguuaaacuaaggaacaaaaagagauuuggagaauuaugggacucuuuaucacucgccaaacaagacgcaauuguagaaaaguuaauaacugcagaugaagaugcagaaauuaucaguaugcuagcucaauacaaucuaacggacgaacaaaagaaaaauauagcuguaaccguuuuaccaucuggcaccgcaaugcuauguaaagaagucacagaaauguuaguacagaaaauggaacaaaacaaaauaccucuaaccgucgcagugcaaaugcugggauacacauaugccgaccaauccguaagggaagaagacacauuaccauacuacggcgcaauccuuaccggcucaacaaugggagcacauccagaagccgaugaaucagaaccggaacucaaauauggaaaaauaaguaaucccacaguacaugucgcccucaaccaaacuagaacugucguuaacgcuuuaauaaaagcauauggaaaaccacaacaaauuguuguggaauuaucccgagaucugaaagcaucaagagaagcaaaagcacgcauacagaaaacaauaacaaugaaccaaaaacgcaaugaaagagauaauaaaaacauaacagacauaaccaaaauaccauaucccaaccgaaacgaccgacuaaaauaucguuuaugggaagaauuaggaucaggcucaaacaguuuuaguagaaaaugccuuuauuguggaaaaccaauauccgguucagaaauauucacugaaaauauagaaauugaacacauucuaccauuuggaagaacccuauucgacggagaaacaaacaaaacagucgcgcacacggauuguaacagagauaaaggagacaggagcccauuugaggcuuucggaaguagcccaaacggauauaacuggcaugaaauaugugcaagagcaaauucuuuaaagaaucccgcaaaaaggacacuuuuugcagaaaaugcaauggaaaaauuugaaaaagauaacaguuuuauucaaagacaacugacagauaacgcauaucuaucacguagcgcacuaagauacuuacguuguauaugcaaagauguauggucaauaaaugguggcaugacaaaauuauuacgggauaaauggaauauagacucaauucucaaacggaaaauagacgauccugaaauagcgcauuuugaacuaaagaaugaccaaauuggccaauacaagaaaaaucgauacgaccaccgacaccaugcucuagacgcauccgucauagcacuaauagacagagcaaugguccaagaaauaucacaauuaaacaaaauaagacuuaaaaauagaauugaagcgccacaaaugccaguacuacgcucugaacuaauagaaaaagucaaacauauaacaguuucuuucaaaccggaucacgggagacaaggaaaauuaucaaaagaaacacucuugggaaaaauuaagaaaauagaaaaagucgauauagauucaauucaaaccgacgacauugccucaauaaaagaugaugcaauccgcacaagauucgaaacgaaaagaagagaacuaggugauauuaccaaagccaaagcagcacugaaaaccgaauuuccaaaacuugacguauucaaaacuuauuacguuagucgaacacccauagucucauuaacugagaaaaacauaaauagcauaguugacgagaaaauaaaagaaaaauugaaaacauucauuaaagaacacgcagacuuaaguuucgcggaacaauuacaaaaauucagugaaacagaauggaucggaaaaccaucagcagcagguaaaccaggcaagaaauacagaauagaaaaaguaagaugcauaaauuggggccaaacuccuauaaccauaacauccucagcaguaccccgauacuuaugcccagaagacuaccuagcugcagugguauggcaaauaccaucgaagaagaaagauacagaacccgaauauaaagcgaccuucuuaaggagagacgaauuugauguuaacaauaaaccuaagaaacucgaaaaaccccaugaugcagcacaauacauuugcauguuauauaaagaugacuacuuggaauuuacagaaaguggggcaacccaccuauguagaauagcaggacuucccgcaucccaaaauaauaaaaucgauauaagaccaauuuaugcaguaagugacugcaaagauuggauaauagcaacuaacgaaaacaugcuagaacccuguuggaaaccacaaaaagaagagaaaagaauaucuguaaacguauuauuugguaaacauaaagccagaucuguaacuguuaaucccauaggaagagucuucagaaaauga

SEQ ID NO: 8610 - RNA, 3387 nt, Artificial Sequence
  Cas9 variant
auguccgaucucguacuuggacuagauauagguauaggauccgucggagugggaauacucaacaaagucacaggagaaauaauccauaaaaauucccgaauuuuccccgcggcacaagcagaaaauaacguagaaagaagaaccaacagacaaggaagaagacuuacccgacgaaagaaacacagaagagugagacucaaucauuuauuugaagaaucuggacugauuacagacuuuacuaaagucucaauaaacuuaaacccauaucaauuacgagucaaagggcuaauagacgaauuaaguaaugaagaacuauucaucgcgcuuaaaaauaugguaaaacacagagggauuagcuaccuagaugacgccagugaugauggcaacaguucaguaggcgauuaugcacaaauagucaaggaaaauagcaaacaacuagaaacuaaaaccccaggacaaauacaacuagaacgguaccaaaaauacggucaauuaagaggugacuucacagucgaagaagacggaaagaaacauagguuaauaaacgucuuccccacgucugcauacagaagugaagcacucagaauacuacaaacucaaaaagaauuuaauccucaaaucaccgacgaauuuauaaacagauaucucgagauacuuacugguaaaagaaaauauuaccauggacccggaaacgagaaaucuaggacugacuacggaagauauacaacaaagaaagacucugagaacgaauacauaacguuagauaauaucuucggaauauuaauaggaaaaugcacauuuuaccccgaagaauacagagcagcaaaagcaucauacacagcacaagaauuuaauuuacuaaaugacuuaaacaaccugacgguaccaacagaaaccaagaaacuauccgaagaacagaaaaaucaaauaauaaauuacgucaaaaaugaaaaagcaaugggcccggcaaaacuauucaaauacauagcuaaacuccuaucaugcgauguagcagacauaaaaggauauagaauugauaaauccgauaaagcugaaauccauacauucgaagcauauagaaaaaugaaaacccuugaaacaaucgauuucgagaaaaugaguagagaccaauuagacaaguuagcauacguacuaacacuaaauacagaacgagaagguauacaagaagcacuagaccacgaauuugccgacggaaacuuuagucaagaacaaaucgacgaacugguacaauuccgcaaggcaaacucuucaaucuucggaaaaggauggcauaacuuuaguguuaaacucaugauggaacuaauaccagaacuauaugcaacgagcgaagaacagaugacgauuuuaacaagacugggaaaacagaaaacaacgucaucaucaaauaaaaccaaauacauagacgaaaaauuacuaacagaagaaaucuacaauccuguaguagcuaaaucaguccgccaagcaauaaagauuguaaaugcugcgauaaaagaauacggggacuucgacaacauagucauagagauggcaagagaaaccaacgaagacgaugaaaagaaagccauacagaaaauucaaaaagccaacaaagacgaaaaggaugcagccauguugaaagcagcuaaucaauauaaugguagagcagaauuaccacauucuguauuccacggacauaaacaauuggcaaccaaaauaagauuauggcaccaacaaggagagcgaugucuuuacacuggaaaaacaauaucaauacaugaccugauuaacaacccaaaccaauucgaaaucgaccauauacuuccacuuuccauaacauucgaugauucacuugccaacaaaguccucguauaugcgacagccaaucaagaaaaaggacaaagaacaccauaucaagcucuagauaguauggaugaugcuuggucuuuccgagaauuaaaagcauuuguuagagagucgaaaagccuaaguaauaaaaagaaagaauaccuuuuaacagaggaagacauaaguagauuugacguaagaaagaaauuuaucgaacgaaaccucguagacacuagauacgcgucacgaguagucuuaaacgcacuacaagagcacuuccgugcacacaaaaccgauacaaaaguaucgguaguccgaggacaauucacuucacaacugagacgacacuggggaauugagaaaacgcgagacacauaucaucaccacgcaguagaugcacuuauaauagcagcuucuucacaauuaaaccuauggaagaaacagaaaaauacucuaguaaauuauucagaaaaccaacuacuagauauagaaaccggagaauuaauaagcgacgaugaauauaaagaaucaguauuuaaagcuccauaccaacauuucgucgacacauuaaaaaguaaagaauuugaagacucaauacucuuuucuuaucaaguagacucaaaauuuaaccgaaaaauuagugaugcaaccauauaugcaacgagacaagcuaaaguaggcaaagacaagaaagacgaaacauacguacuuggcaaaauaaaagauaucuauucgcaaaccggauacgacgccuucauaaaaauuuaccaaaaagacaaaucaaaauuccucauguaucgacaugacccacaaacauucgaaaaaguaauugaacccauuuuagagaacuauccaaacaaagaaaugaacgaaaaagguaaagaaguaccauguaaucccuuuuuaaaauauaaagaggaacacggugacuacaucagaaaauauagcaagaaaggaaacggccccgaaaucaaaucccuuaaauacuaugacaguaaacuuggaaaccacaucgacauuacaccaaaagacucuaauaacaaaguagugcuccaaagcguaagcccauggcgagcugacguauacuuuaacaaaacaacagguaaauacgaaauccucggauuaaaauacgcagaucugcaauucgaaaaaggcacagggacauacaaaauuucccaagaaaaauacaacguaaucaaaaagaaagaaggaguggacucagacucagaguucaaauucacgcuauauaaaaaugaccuacucuuaauuaaagauacggaaacaaaagaacaacaauuguuuagauuucuaucacgcacuaaaccaaauguaaaacauuauguggaauuaaaaccauacgacaaacaaaaauuugaagguaacgaaagccuaauaaacguauuaggagccguggcaaaagggggccaaugucaaaaaggaauaaacaaaccaaacaucagcaucuauaaaguucgaaccgaugucuuaggaaaccaacauauuaucaaaaaugaaggcgauaaaccaaaacucgauuuuuga

SEQ ID NO: 8611 - RNA, 3387 nt, Artificial Sequence
  Cas9 variant
auggacgagaaaauggacuacagaauaggacucgauaucggaauagcaucaguaggaugggcaguucuucaaaauaauagugacgacgaaccaguacgaauagucgacuuaggaguaagaauuuucgauacagcagaaauaccaaagacgggagaaucacuagcaggaccgcguagagcagcgagaacaacuaggagaagacuuagaaggcgaaaacacagauuggacagaaucaaauggcuauuugaaaaucaaggucuuaucaacauagacgacuuuuugaaaagauauaauauggcaggauuaccagauguguaucaacuacgauacgaagcacuagauaggaaacucaccgaugaagaauuggcccaaguacuccuacauauagcgaagcauagaggauuuagaucaacaagaaaagcagaaacugcugcaaaggagaacggugccguguuaaaggccacugacgaaaaucaaaaacgaaugcaggaaaaaggauacagaaccgucggagaaaugauauauuuggaugaggccuucagaacgggauguucuuggagugaaaaaggauacauauuaacaccacgaaacaaagccgaaaauuaucaacauacgauguuacgagcaauguugguagaagaagucaaagaaauauuuagcucucaacguagauugggaaacgaaaaagcaacagaggaacuagaagaaaaauaucuagaaauuaugacaagccaaaggucauuugaccuagguccaggaaugcaaccagauggaaaaccaaguccauacgccauggaaggauucagcgacaggguaggaaaaugcacguucuuaggagaucaaggagaacuaaggggcgcuaaaggcacauacaccgccgaauacuucguugcacuacagaaaauaaaucacacaaaauuaguaaaccaggacggagaaacaagaaacuuuaccgaagaagaaaggagagccuugacuuuauuauuauuuacacaaaaggaaguaaaauacgcagcaguaagaaagaaacucggucuaccagaagacauauuauucuacaaucucaauuauaagaaagcagcgacaaaagaggaacaacaaaaagaaaaccaaaacacagaaaaagcaaaauuuauagguaugccauauuaucaugacuauaagaaauguuuagaagaaagaguaaaauaucuaacugaaaaugaaguaagagauuuauuugaugaaauagguaccauauuaacauguuauaaaaaugaugauaguagaacagaaagacucgccaaacuuggucuagugcccaucgaaauggaaggacuucucgcauauacuccuacaaaauuucaacacuuaucaaugaaagcaaugcgaaacaucauaccauuuuuagaaaaaggaaugacuuacgauaaagcaugcgaagaagcgggauaugacuucaaagcagacuccaaagggaucaaacaaaaauugcucacaggugaaaaaguuaaccaaacuauuaacgaaauaacgaaucccgugguuaaaaggucgguuucacagacaguaaaaguaauaaacgcaauuauacgaacauauggaaguccgcaagcaaucaacauugaacuagccagagaaaugucaaaaacguuugaagaaagacguaaaauaaaaggagacauggaaaaacgacagaaaaacaacgaagaugucaagaaacaaauucaagaacuggguaaacuaucaccaacaggacaagauauauuaaaauauagguuauggcaagaacaacaaggaauaugcauguauaguggcaaaacuauaccacuagaagaacuauuuaaaccggguuaugauauagaucauauacucccguacagcauaacauuugaugacagcuuccguaauaaaguguuaguuacgagucaagaaaauaggcaaaaaggaaauagaacaccauaugaauacaugggaaaugaugagcaacgauggaacgaauuugaaacccgaguuaaaaccacaauaagagacuacaagaaacaacaaaaacuacucaagaaacauuucagcgaagaagaaagaucagaauuuaaagaaagaaaccucacagacacuaaauacauaacaacugucauauauaacaugauaagacaaaaccuugaaauggcccccuugaauagaccugagaaaaagaaacaggucagagccguuaauggagcaauuacagcuuaccugcgaaaaagauggggacuaccccagaaaaauagggaaacagauacacaucaugcaauggacgcaguagucauagcauguuguacagauggaaugauccagaaaauuaguagauacacaaaaguccgagaaagaugcuacuccaaagggacagaguucguggacgccgaaacgggagaaauuuuuagacccgaagacuacucccgagcggaaugggacgaaauauuuggaguacauauaccgaaaccaugggaaacauuccgagcggaauuagacgugagaaugggagaugauccaaaaggauuccuagacacacacagcgauguagcucuagaacuggauuacccggaauacauauaugaaaaucuaagaccuauuuucguuucgcgcaugccuaaccauaaaguuacaggagccgcacacgccgacacgauaagaagcccaagacacuuuaaagacgaaggaauaguacucacaaaaacugcacuaacugaucuaaaacuggacaaagacggagaaauagacggauauuauaauccccaaucggacuuacuacuuuaugaagcccugaagaaacaacuacuuuuauauggaaaugacgcaaagaaagcauucgcacaagauuuucacaaaccaaaagcugaugguacagaagggccaguaguuagaaaaguaaaaauccaaaagaaacaaacuaugggaguauuuguagacagugguaacggaauugcggaaaacgggggaauggugcgaauagauguauuccacguuaacggaaaauauuauuucguaccugucuauacagcugauguuguaaagaaaguauuaccuaacagagcagcuacagcgcacaaaccauauggugaauggaaagucauggaagauaaagacuuucuguucagcuuauauucacgugaucuuauucauauaaaaaguaaaaaggauauacccauaaaaauggugaacgggggaauggaaggaauuaaagaaacauacgcauauuauauuggggcagacauaagcgcugccaauauucaaggaauagcacacgauaguagauauaaauuucgagggcuaggcauucaaaguuuagauguacuagagaaaugucaaauagacguucuaggacacguaucaguaguacgaagugagaaaagaaugggauucaguuga

SEQ ID NO: 8612 - RNA, 3387 nt, Artificial Sequence
  Cas9 variant
augagugaccuaguuuugggacucgauauaggcaucggaaguguaggaguagggauacucaacaaagucaccggcgaaauaguacacaaaaacgcacgaauauucccagcagcacaagcagaaaacaauguagaaagaagaaccaacagacaaggacgaaggcuaacccgaagaaagaaacacagaagaguaagacucaaccacauauucgaagaauccggccuuauaacagacuucaccaaaguauccaucaaccugaacccguaucaguuacguguuaaaggcuuaacagacgaacuauccaacgaagaauuauucaucgcacucaaaaacaugguaaaacacagggguauuagcuaucuagacgacgcaagugacgacggaaacagcagcguuggcgacuacgcccaaaucguuaaagaaaauagcaaacaauuggaaaccaaaacaccaggacaaauacaacuagaaagauaccaaaaauauggacaauuaaggggugauuuuacgauugaagaagacggcaaaaagcacaggcugauaaacguauucccaacaucagcguauagagcagaagcacuuagaaucuuacaaacacaacaagaauuuaauccccaaauuacugacgaguucauuaauuccuaccuacaaauacuaacaggaaaaaggaaauauuaucaugguccagggaaugaaaaaucacgaacugacuacggaagguauacaacaaagaaagauagcgaagacgaauacauaacacuagauaauauauucgguauauuaaucgguaaauguacauucuacccagaagaauacagagcugcuaaagcaucauacacagcccaagaguucaacuuauuaaacgaucuaaacaaucuaacggucccuacugaaacaaagaaacuaucagaagaacagaaaaaucaaaucauuacauaugucaaaaacgaaaaagcuaugggaccagcuaaauuauuuaaauauaucgcaaaacuacuagcaugugacgucgcagacauaaaaggauacagaauagauaaaucagacaaaccagaaauccauacuuuugaggcuuacaggaaaaugaagacucuagaaaccauagauguagaacaaauggaacgggaaaaauuagacaaauuagcauacgucuuaacacuaaacaccgaaagagaaggcauacaagaagccauagaacacgaguucagcgacgguacauuuucacaagaacaaguagaugagcuaguccaauuccguaaaucuaauaguagcauauucggcaaagguuggcacaacuucucaguuaaauuaaugauggaacucauaccggaacuuuaugcuacaucagaagaacaaaugacaauauugacucgcuuaggaaagcagaaaagaaccucaagcucaaacaagaccaaauauauagaugagaaaagauuaacagaagaaauauauaauccagucguugcaaaaucagugaggcaagcaauaaaaauagucaacgcugcuaucaaagaauacggggauuuugauaauauagucauagaaauggcaagagaaaugaacgaagacgaugaaaagaaagcaauaaagaaaauacaagaggcaaauaaaucggaaaaagaugcugcaaugagaaaagcugcaaaccaauacaacggcaaagcagaacuaccacacagcguauuccacggacauaaacaauuagccaccaaaaucagauuauggcaucaacaaggcgaaagaugccuuuacaccgggaaaacaaucucaauacaugaccuaauaaacaauccuaaucaauuugaaauagaccacauuuuacccuuaagcaucacauucgacgacucacuggcaaacaaagucuuggucuacgcuacagcuaaucaagaaaaaggucaacgaacuccauaccaagcguuagauucaauggaugacgcuuggagcuucagagaauuaaaggcuuucguacgagaauccaaaacacuaaguaacaaaaagaaagaguaccuauugacugaagaagauauaucuaaauuugauguaagaaagaaauuuauagaacgcaacuugguagauaccagauaugccucaagaguaguccuaaacgcacuacaagagcauuucagagcacggaaaauugacaccaaaguuucuguaguacgaggccaauuuacaagccaacuuaggagacauuggggaauagacaaaacuagggacacuuaucaccaccacgcaguagaugcucucauaauugcagccucaucccaacuaaaccuauggaagaaacagaaaaacacacuuguaucuuacucggaggaccaauuacuagacaucgaaacaggagagcucauuucagacgaugaauauaaagaaucaguauuuaaagcaccauaucaacacuucguagacacccucaaauccaaagaguucgaagacucaauacuauucuccuaucaaguagacucaaaauuuaauagaaaaauaagugacgcaaccauauacgcaacuaggcaggcaaaaguuggaaaagacaagaaagacgaaacauacguucuugguaaaauuaaagauaucuacucacaagcaggauacgacgcauucauaaaaauauaccaaaaagacaaaagcaaauuuuuaauguauagacacgacccccaaacuuuugaaaaaguaauagaaccaauacucgaaaauuaccccaacaaagaaaugaaugaaaaaggaaaagaaguuccaugcaauccuuuucuaaaauacaaagaagaacauggagacuacaucagaaaauacucuaagaaaggcaauggaccugaaauaaaaagccucaaauacuacgacucaaaauuaggaaaccauaucgauauaacacccaaaaauucaaacaauaaaguaguauuacaauccguaaguccguggcgagcagacgucuauuuuaauaaaacgacaggcaaauacgaaauccugggucucaaauaugccgacuuacaauuugaaaaaggaacaggaacauacaaaauaagucaagaaaaauauaacgauaucaaaaagaaagagggaguagacucagacucagaguucaaauucacauuauauaaaaaugaccuccuacuaauaaaagacacggaaacaaaagaacaacaacuauuucgguuucuaucgcgaagcaugccaaacaagaaacacuacgucgaauuaaaaccauacagcaaagacaaauuugagaaaaaugaaacauuaauagaaauacucgggcccacagacaaaucgggaagaugcaucaaaggauuagcgaaaucuaaucuaaguauauucaaaguaagaacagacauacuagguaaccaacauauaaucaaaaaugaaggagacaaacccaaauuagacuuuuga

SEQ ID NO: 8613 - RNA, 3387 nt, Artificial Sequence
  Cas9 variant
augacgaaaauuuuaggguuagaucuuggcacaaacagcauugggugggcagucgucgacgaaaagaaagagaaaauauuaggaaugggcucaagaaucuuucccgaaggagugguaaauauaggugagggugaagguagagaaacaaguaaaaaugcaucacgaacagaugcuagagguacccgaagacaauucuucagaagacgacuacgaaaacgauauuugcucagagaacuagcaaagaaaggguuaugcccuauaaacuacacauuaguuaaagaguggaacgaagcccaaauauuuaaaaacaaacaacuacaagaaugguucaaauuaaacccauacgaauuaagaucaaaagcaauccaggaaaagauaucucuggaagaauuaggaaggauauucuaucauuucauccaaagaagaggauuccaaaguaacucuagaucugccggaguagauaauaucgagaaaaguguuauauucaaaggcgacacgaaaacagguaaaauaggcauaagugaaacuuuagaaucaaucaaaaacaccaaaacauugggaucauacuuacacacaauauauccaaaacaaaauaaaccauacucaggacauaaagaaagaaucagaaaccgauauacgacccgucaaauguacaucuacgaauuugaaacuauuugggaauaccaaaaacaauuuuacucagaauuaaguaaugaauuaaaaacaguacuaggaggacguaaaaaggaugguuauaaagaagacgguaucuuauuccaucagaggccuuuaagaagccagaaacacuuagucggauacugcaguuuugaacccaaaaagacgaaaugucaaaucaacacuauacccuucgaacuauuuagaauauaucaaugggucaauacaguggauugcaaugaaaaaguaacaucagaagaccgaggcaaaaugguagaacuccuacuaucaaaagaaaaagugucuuuuaaagaaauaagaaaaguaauaaauaaaagcgacgguuacuaucaguucaacuauaaaaaugaugauaaaauaguaggaaguuauacuauuucaaaucuuucaaacaagaaauucuucggaaagaagugguuugacuucucagacaaagaacaagaggacauuuggcacguacucucguucuuugaugaucgcgauaagcuaaaacaauacgcaauaaaauauugggguuucaacgaagaaaaggcaguaaaaauaucaaaguucaacuugaaagagggcuacagcaauuuaucuaggaaagcaauacacaacauacuuccauuucuaaaacucgguuucauguacgauguagccguaggauuagggggaguuaaaaaugcacuagcggauaaauggauagaaaaugaacaauucauauuagauaauguaccaaguguaguaagaaguaauuuuaaaggaggcuauauagaaccacuaaaacaaaugcuaaaauacgaguucgauguaucagacaaacaacuccucaaacuauaucaucauaguuccgcaauagaaacaacagaacuccucaaaaaguuaccaauaaacucugaagccgauaaggaaauacaaucaaucaaaaaccccguugucauaaccgcacucuuugaaauaagaaagcuaguuaacgaaaucauagauacauacggaaaauucgacgaaaucaaaguugaauuagcaagagaccuuaaggcuuccaaauccaaaagauacgacacaagaagagaacagcucagacuagaaaaagaaaaugacagaauaaaaauagaauuagaaaauuugggacaaagaauaaaccauauaacuauauuaaaauacaaacuuugggaagaaugcgacaaaaggugcccauuuacggggaaaaacauagaaguaaaugaacuguucucaggagaaguccaaaucgaacauauuuuuccauggucgcgaaguuuaaaugacuccuucaugaacaaaacccuauguuuugccgacgaaaaucgugcaaaaggaaacaaaacuccauacgaauuuuacuccgaacaaggcgaacaaaaaugggaagaaauaaaaauacaagcauuaaguugcuucaaaaacaagccaaacuacccaaacgccuaucagaaauuuaaacaauucguuaaaaagaaacacgaugaagacuucaucucccgacaacuaaaugauacgagauacauauccaaagaagccaaaaacuacuuaucaaaaauaugcaacaacguacaaguagcgccaggccaaaugacagcaacccuaagacacaaauggggauuaaauacgauuuuaaacaaagaugacgacacgaaaacaagggacgaccacagacaccacgcgauagaugcuuuaguaauggccuguucaacucgcucccauuuacaagaacucucaaaaagaaacagauaucaaaaagauuacgaguucaaagauuucccaaugccuuggcaauucuuccggcaggacgcugagaaaagcguagaacaaaucuuaguaagucacaaaaaguuaaauacgauucucacuguacgaacccauaaaacaaagaaaaauggugucguguauaaaaauauuggcguagcugcaaggggacaacuacacaaagaaacuguuuuuggaaaacgaaccgcuccagacgguauagaagcauaccacguacgcaaaccaauagaaaguuuaucuacacauaaacacauaaacaaaguagucgaugaaacaauaagacucuuaauucuaaaacaaguaaacaaacuaggagguuucguaaaaggaaaaauacccgaagguaccuuuuacaacacagaugaaaacggaaauaaacaaccacaaauauucuuaccaaauaaaaacggcaacccggucccgauuaagaaaauuagauuacgagaaaauauuggaggugccgaacaacucaaaucaacggucaaucagcauguaaauccaagaagcaaccaucauguccugaucuacaaagacuucgaugacaaccugaaagaaaaaguagucacauuuuggaccgccgucgaacguaagaaacaaaaacaagcaguguuccaacucccagaaaacggaaaagaaaucguaacaacacuucaaauaaacgauauguuccuauugggauuaaaagacgaugaaauaaacugggaacacccuaaauuuacacuacuaaaagaacaucuauacagaguacaaaaauuuacaucaggagacuacuauuuucgaaaacacauagaaagcaacuuaaacggagaacuaggaaaagccuaccaauacauaaaagguuucggcgaaggcaaaacaggcuggaaaaccuucaaccccauaaaaauaaaaguaucaguaagcggcaaaauagaaaaaguauga

SEQ ID NO: 8614 - RNA, 3390 nt, Artificial Sequence
  Cas9 variant
augaacggacuuguacucggauuagauaucgguauagccagcguaggagccggaauauugaaaaaggauacaggcgaaauuauccacgcaaauucaaggcuguucccagccgccacagcagauaauaauguucuuagaagaucuucacgacaagcccgaagaagcacaagacgaaagcgacauagagcuguaagauuacacgaucuguuugaagacuacgggcuauuaaccgauuucaguaaaguuucuauaaaucuaaacccauacaaacuacgcgucgaaggaauggauauacaauuaacaacugaggaacucuuuauagcacucaaaaacauuauaaaacgacgaggaauauccuaccuagaugacgcaucagaagacggcgucacuguuucuagcgacuacggcaaggcaguagaagaaaauagaaaacuacucucagagcaaacccccggacaaauccaacuggaaagauuugaaaaauacggccaaguccgaggagauuucaccguggaagaaaauggugaaaaacgacgacucauaaacguauuuagcaccagcacauacagaaaagaagcagaaagaauacuaagaaaacaacaggaguuuaacaauaaaauaacagaugauuuuauugaugacuacuuaacaauccucacaggaaaaagaaaauacuaccauggaccagguaacaagaaaucaagaacugauuacggaagauauacaacgaagaaagacagugaaggaaaauacauaacucuagacaacaucuuuggcgucuuaauaggcaaaugcacguuuuacccagaugaauacagagcaagcaaggcuucuuauacagcccaagaguucaaccuucuuaaugaccuuaauaacuuaacaguuccuaccgaaaccaagaaacuaucugaaaaacagaagaaaacaauagucgaauaugccaaaacagccaaaacccuaggggcaagcacacuacucaaauacauagcaaaaaugguagaugcuucaguagaccaaauacauggauaccgaguggauguuaacaagaaacccgaaaugcacacuuucgacguauauagaaaaaugcaaucacuugaaacauucaacgugaaugaaaugccaagagaaguauuagacgaauuagcacacauacuaacucuaaacaccgaacgugaaggcaucgaagaagcgauaaacacaaaauuaaaaggaacauucaaccaagaucaaguauuagaauuaguccaauucaggaaaaacaacucaucucucuucuccaaaggcuggcacaauuucaguuuaaaauugaugauggaauuaauucccgaacuuuacgccacaagugaagaacaaaugacaauucucacaagauuagguaaacagaaaagcaaagaaauuucaaaacgaacaaaauacauagacgaaaaagaaaucacagaagaaaucuauaacccagugguagcaaaaagcguucgccaagcgaucaaaauaaucaaugaagccacgaaacaauacggaaucuucgaucauauuguaauugaaauggcucgauuaacaaacgaagaagacgccaagaaagauuacaucaaacgccaaaaagcuaaccuagacgagaaaaaugcagcaauggaaaaagcagcuuuucaauauaacggaaagaaagaacuuccagauucaaucuuucacggacacaaagaacuugcgacaaaaauaagacucuggcaccaacaaggagaaaaaugucuauauaccggcaaaaauaucccgauaucagaucucauucaaaaccaauauaaauaugaaauugaccauauacuaccacuaucacuauccuuugacgauagcuuaucaaacaaaguauuaguacuagccaccgcuaaccaagaaaaaggacaacggacuccauuucaagcacucgaccguauggacgacgcauggucauauagagaguucaaaaguuacgucaaagacucaaaacuacuaggaaacaaaaagaaagauuaccuuuugacagaagaagacauaagcaaaauagaaguaaaacaaaaauuuauagaacgaaaccuaguagauacgagauacuccagucgaguaguacuaaaugcccuacaagacuucuauaaaaaucaucacuuugacacaacuauaucuguagugagaggacaauuuaccucacaacuaagacgaaaauggggacuagaaaaaucaagagaaaccuaccaccaccacgcaguagaugccuuaaucauagcagcaucuucacaacuacgacuauggaagaaacaaaauaauccacuaaucuuuuacaaagaaggacaauuuguugauagcgaaaccggcgaaauuuuaucguuaaaugacgaugaauauaaagaacucguauucaaagcaccguaugaccauuuuguagacacccuuagaucaaaaacauuugaggacagcauccucuucucauaccaaguagacuccaaauacaauagaaaaaucuccgaugcaacaauuuacgcaaccagaaaagcaaaacuagacaaagauaaaagcaaagaaaccuauguccuuucaaaaauaaaagacauauauagccaagcaggauacgaugccuucaucaaaauauauaacaaagauaaaucuaaauuccuaauguaccauaaagacucccaaacauuugaaaaaguaauagaagaaaucuuaagaacauacccgucaaaagaguuuaaugacaaaaacaaggaaguccccuguaacccuuucgaaaaauauagacaagaaaauggccccauucgaaaauacucaaagaaaggaaauggacccgagauaaaaucccuaaaauauuacgauaaaaacauacccgaaucauuuauaaauauuacaccaagcaauuccaaaaauaaaguaauauuacggcaauuaaacccauggagaacagauguauauuucaaucaucaaacugaaaaauaugaacuucuaggacuaaaguaugccgaucuacaauucgaaaagaaaaccggcacuuacucaauaaccaucgacaaauacaaugaaaucaaagaaaaagaaggugucggcgaacaaagcgaguucaaauucacacucuacaaaaaugauuuacuauuaauaaaagauacgaaaaauaaugaaaaacaaauauuucgauuucuuuccagaacaaugccaaaugugaaacauuauguugaacuuaaaccauauaacaaggcaaaauuugacggaaaccaaccucuuauaacaauuuucggaaacguagcgaaaggcggacaaugccuuaaaggccuaaauaagccaaacauaucaauauauaaaauaaaaacagacguuuuaggaaauaaguauuuuauaaagaaagaaggagauaaaccuaaacuaaaauuuuga

SEQ ID NO: 8615 - RNA, 3390 nt, Artificial Sequence
  Cas9 variant
auggcagaccguauaagucugggacuagacauuggagucgcaagcguuggauuuucaguacucgauauagauaaaggaaaaguaauagagcuaggcagcagacuauuuaacgcaaccguagcagagggcaaucaagacagaagaagcaugcgcggugcacgaagguuacuaaaccgaaacaaacaaagaaggcaagauacuggaaaacuauuucaaaaauucggacugcucgacaauuuuaacaaagauaauuuuuaugauacauuuaaucaaaauuggaacccuuacgagcuaagaguaaaaggacuuacagaacaucuaacuaaaaaagaauuggccgaaaguuuauaucaaauagugaaacauagaggcauaaguuacgcucucaaagacgcugaugcagaugaaggaggaacagacuauucugccucacuaaaaaucaacucucaggagcuagcagaaaaaacaccagcacaaauacaauugcagagacugaacgauuacggaaaaguaaggggacaaguagugauaggagaugacccugacaaucaaaaaguccuacucaacgucuucccaacaagcgcauaugaaaaggaagcaaaacaaauaauagcaacacaaaaacaauucuauccagagauacuuacagaugaauucaccaaagaauauuguaaaauacuaacacgcaaaagagauuacuucguagggccaggcaaugaaaaaucacgaacagauuacggaaucuauaaaacagaugguagaacacuagauaauuuauuugaagaauuaauaggacaugacaaaauauauccugacgaauugcgagcaagugcagccucauacacagcacaacucuucaacguacuuaacgaccugaacaaucuacguauacuaagcuaugaagaugggaaacuaacaaaagaagacaaagaaaaaauaauagcggaaauaaaaaguaauacaacaacaaucaauauguuaaacguaauuaaaaaaguagccggcugcaguaaagaagauauaaaaggauuccgaguaaaugaaaaagacaaacccgaaauaucaucaauggcaguauauagaaaaguucauaaagauuuacuaaagguaggaguagauaucucagacuggcccgucgaauucauagacaaacucaguuuuaucuuaacgcuaaacacagaaaauggagaaauaagaaaacaacuuaacaauagauuaguaccagaauuugacuuccuaaacgaugaccucauacaguuaauaauagacaacaaagauagcuucgaaauaaaaacaaauaacaaauggcaucgauuuucucucaaaaccaugaacaaacuaaugccagaaauguuagaaagaccgguagagcaaaugacuuuacucaaugaaaugggucuggucaaaaaggauaagaaaagauucgagaacaacaaguaucuaccuuauaaagaaauugcaaaagauauauuuaacccaguagcaucgaagagcguaagggaagcuuuaaaaauaguuaacgccguauuaaaaaaauacggacauauugacuaccuaguaauagaaaugccacgcgacaaaaaccuaaaagaagaacaagacaacauaaaagaauuccaaaacaaaaacaaaaaagcaaaggacgccgccuucgaagcuuucgugaaaagcguugggagugaacaacgcguaaaagaagcauuaagcaaaaaccgaaaguuacagaugaaaaugagauuaugguaccaacaacaagaaauagaucccuacaacggagaaacaauagaugcaacagaucuaauaaauaaccccgacaaguucgaaauagaucacaucaucccccaaucaaucucauuugaugacuccauaaacaacaaaacguuauguuucgccucaaugaaucaaguaaaaggacaaaaaacgcccuaugaguucaugcucgaaggacauggacaaggauacgacaaauucaaagcaacaguacuagauaacaaaaacuucgaucgaaacaagaggaaaaacuaccuauuugaagaaaauguaucugauauagaaacaagaaaaagauuucuaucaagaaaucuugucgacaccagauacucaagucgaguaguguuaaauucacuucaagacuucuuccacgaaaaaucagcagacaccaagguuacuguaaucagagguaaauuuacuaguaacaugagaaaacauuggcauauagauaaaacaagagaaacguuucaucaccacgcaaucgaugcaucaauaauugcagcgacaccauuccugcgaauguggaaaaaaggaggaacaauauuuccagucaaagugggcgaagaaagcauugacauagaaacaggagagauauuagaugacaaaaaauuugauaaaguaauguaugaagaaccauauaacggguucguaucagaaauuaugaaugcagaugacagaauaaaguuuucacaucaaguagacaaaaaaaugaacaggaaagucagugacgccacaauauauagcacuagaacaggcaaauuagcaaaagacaaaaaagaugccgaauacauaguagcaaaagugaaagauauauacuccguugacggauucaaaaaauucaaaaaagucuacgauaaagacaaaucuaaauuucuauuauauaaauacgacccuagaacauucucugaacuagaaagaaucauauccgacugcccagauaaaguagaaaaaguacaaacaaacggcaaaguaaaggcaguggacguaagcccauuugaaauguauagaagauaucacgguaugauuaaaaaauauuccaagaaaggcaacggacccgcaauaaaacaauuaaaauaucucgacaaaaaauuaggaucacauaucgauauaacgccugcaaacgccaacggaaaacacguaaucuuacaaagucuuaagccauggagaacugacgucuaucuuaaccaugaaacaggagaauaugaaauaaugggaauaaaauacucagaccucaaauucaacaaaaacguaggauaugggauaaagaaagauaaauaucuugagauaaaaaaaaacgaagaagucagugaaaaaucagaauucauguucagucuauaccgaaaagauagaguacgcauacaaaacaugaaaaccggugaaucagucgaauuacuuuucuggagucgcaacuuuucaaauaaaaaauaugccgaacuuaaacccauauuuaaauucgucaccgaagacgaugacuggccaguauacggccacgcaaagacacaaauccuaaaaagacuagucccaaaagacuguaaaauuuggaaagugaauacuacaaucuuaggugacccauauuauuuagaaaaagaauccgauaauccaaaagauauauuagacuga

SEQ ID NO: 8616 - RNA, 3390 nt, Artificial Sequence
  Cas9 variant
augacuaacgggaaaauauuaggccuugacauaggcauagcauccguaggaguaggcauuauugaagcgaaaacagggaaagugguacacgcuaacaguagacuauucucagcugcaaacgcagaaaacaaugcagaacgacgaggauucagagguagcagaaggcuaaauagaagaaagaaacauagaguaaaaagaguaagggaucuauucgaaaaauauggcauagucacagauuucagaaacuuaaauuugaauccuuacgagcucaggguaaaaggacugacagaacaauuaaccaacgaagaauuauuugcggcucuaaggaccauuaguaaacgaagaggaauaaguuaccuagacgaugccgaagacgacucaacaggaaguacagauuaugcuaaaagcaucgaugaaaacagacgucuccuaaaaaccaagacgcccggacaaauacaacuagaaagauuagaaaaguauggacaacuaagaggcaauuuuacaguauacgacgaaaacggagaagcucacagacuuauaaacgucuucaguacaagugauuaugaaaaagaagccagaaaaauccucgaaacgcaagcggauuacaacaaaaagauaacagccgaguucauagaugauuacguggaaauauuaacacaaaagagaaaauauuaucacgggcccggaaacgaaaagaguagaacagacuacgguagauuuagaacugacggaacgacacuagaaaacauuuucggaauacuaauagguaaaugcucauucuauccugacgaauacagggcaucaaaagcauccuacaccgcacaagaauauaacuuuuugaaugacuuaaauaaccucaaaguaccuacagaaacagguaaauuaucaacagaacaaaaagaggcuuuaguagaguucgcuaaauccaccgcaacacuaggcccagcgaaauuacucaaagaaauugcaaaaauccucgauugcaaaguagacgaaaucaaaggauacagggaagacgauaaaggaaagccugaccuacacacguucgaaccuuacagaaaacuuaaauuuaaccucgauucagucaauauagaugaccucagcagagaaguacuagacaaacuagcagacauacuuacacuaaauacagaaagggaaggaauagaagacgccaucaaaagaaaucuuccaaaucaauucacagaagaacaaauaucagaaauaauaaacgugagaaaaucacagucaacagcuuuuaauaaagguuggcacucauuuuccgcuaaacuaaugaacgaacuaauuccagaacuauaugcaacaucagaugaacagaugacaauauuaacaagacuagaaaaauuuaaaguuaaaaagaaaaguuccaaaaauauaaaaacgaucgaugaaaaagaaauaacugacgaaauuuacaauccaguaguugcaaaaucgguucgucagacaauaaaaauaaucaacgccgcaguaaagaaauacggagacuuugacaaaauaguuauugaaaugccaagagauaaaaaugccgaugaugaaaagaaauucaucgauaaaagaaauaaagaaaacaagaaagaaaaagacgaugcacuuaaaagagccgcauaucuguacaacgguacagauaaacuucccgacgaaguauuccaugaaaacaaacaacuagagacuaaaauacgacuaugguaucaacaaggagaaagauguuuauacucagggaaaccgauaccaauucaagaacuuguacacaacagcaauaauuucgaaaucgaucacauauuaccauuaagucuuucauuugacgauucacuggcuaacaagguauuaguguauucauggacaaaccaagaaaaaggacaaaggaccccauaucagguaauagacucaauggacgcugcuuggaguuucagagaaaugaaagacuacguuuuaaaacaaaaagggcuaggaaagaagaaaagagacuacuuauuaacaacagaaaacauagacaaaauagaaguaaagaagaaauuuauugaaaggaaccuaguagacacacgcuacgcaagccggguuguacuaaacucgcuacagucugccuuaagagaauuaggaaaagacacgaaaguuagcguaguacgaggacaauuuacaagccaacuaaggagaaaauggaaaaucgacaaaucacgugagacauaccaccaccaugcuguagacgcauuaaucauugcagcaagcagucaacuaaaauuaugggaaaaacaagauaaccccauguucguagacuauggaaauaaucagguagucgacaaacaaacaggagaaaucuuaagcguauccgaugaugaauauaaagaacuuguauuccaaccaccguaccaaggauucgugaauacaaucucaucgaaaggauucgaggaugaaauucuuuucagcuaucaagucgacagcaaauauaacagaaaaguaagugaugccaccauauauucaacccgaaaagcaaaaauaggaaaagauaagaaagaagaaaccuauguccuaggaaaaauaaaagauauauacucacagaacggauuugauacauucguaaagaaauacaauaaagacaaaacacaauuccuaauguaccaaaaagauccauuaacaugggaaaaugugauugaaguaauauuaagagauuacccaacaacuaagaaauccgaagacggcaaaaaugauguaaaauguaaucccuuugaagaauaccgaagggaaaacggauuaauaugcaaauauucaaagaaaggaaaaggaacaccgauaaaaucacuaaaauacuacgacaagaaacuagguaacugcauagacauaaccccacaagaaucgaaaaauaggguaguacuaagacagauaucgccauggcgagcagauauauauuuuaaucccgaaacacuaaaauaugaacuuaugggauuaaaauauucagaccuaucuuucgaaaaaggaacuggaaaauaccauauuagccaagaaaaauacgacgccauaaaagaaaaagaaggcguaggaaaagacagugaguucaaauuuacccucuacagaaacgauuuaaucuugauaaaagacacccuuaacaauugugaaagaaugcuaagauuuggaaguaaaaacgacacaucaaaacauuauguagaauuaaaaccacuagaaaaagguacauucgacucagaagaagaaauacuaccggucuuaggaaaagucgcaaaaucuggccaauucauaaaaggacucaauaaaccaaauauaagcauuuacaaaguaagaacagauguauuaggcaauaaauauuuuguuaagaaagaaggagacaaacccaaauuagauuuuaaaaauaacaagaaauga

SEQ ID NO: 8617 - RNA, 3390 nt, Artificial Sequence
  Cas9 variant
augucuaaugguaaaauauuaggacuggacauagguguagcuagcguuggaguugguauaauagauaguaaaacaggcaacgugauucaugcgaacagucgacucuuuuccgcagcgaacgcagaaaacaacgcugagagaagaggauuccgaggagcaagaagacuaacaagacgaaagaaacauagaguaaaacgaguacgagaucuauuugagaaguaugauauuucaaccgacuuucgaaauuuaaaucucaauccuuacgaauuaagagucaaaggauugacagaacaacuuacuaacgaagaacucuucgcagcacucagaacgauugcaaaaagaagaggcauaagcuauuuggaugaugccgaggacgauucaacaggauccucagacuacgcaaaaucaauagacgaaaaucgacgacuuuuaaagacuaaaacaccaggccaaauccagcuagaaagacuagaaaaauacggucaauuaagaggaaacuuuacaguguacgaugagaauggcgaagcccaucgauuaauaaacguauuuuccacaagcgacuauaaaaacgaagcaagaaaaauacuagagacccaauccaacuacaauaaacaaauaacagaugaguuuauagaagacuauauagaaauacuaacucagaaaagaaaauauuaccaugggccaggaaaugagaaaagcagaacagacuacggaagauuucgaacagauggcacaacacuagaaaauauauucggaauauuaauaggaaaguguaguuucuauccugaagaauaucgagcaucaaaagcaucauauaccgcccaagaauuuaacuuucuaaaugacuuaaauaauuuaaaaguaccaacugagacaggaaaauuauccacggaacaaaaagaguaccuaguugacuuugcaaagaaauccaaagcccucggagcaagcaaauugcuaaaagaaauagccaagauaguugacugcucuguagacgacauaaaaggguaccgaguggacaacaaagauaaaccagauuuacacacauuugaaccguacagaaaauuaaaauucaaccugucaucgauagauauagaugaauuaagcagagaaacacucgauaaauuagcagauauacuaacauuaaacacggaaagagaaggaaucgaagacgccauuaaaagaaaucuuccaucacaauuuaccgaggaacaaauaagcgaaauaguacaaauccguaaaaaccaaucaagcgccuucaacaaaggauggcauucauucucagcuaaauuaaugaaugaauuaauaccagaacuguacguaacuucggaagaacaaaugacaaucuuaacaagacuggagaaauucaaagucaacaagaaaucuucaaagaauacaaaaaccauugaugaaaaagaaauaacagacgaaauauauaauccuguaguagcaaaaucagugaggcaaacaauaaagauaauuaacgccgcaguaaagaaauacggggauuucgauaaaauagucaucgaaaugccaagggauaaaaacgcagaagacgagaaaaaguuuauagacaaaaagcagaaagaaaauaagaaagaaaaagaugacucccuaaaaagagcagccuuuuuauacaacggaaccgacaacuugccagauggaguuuuucacggaaauaaagaacuuaaaaccaaaauaagacuaugguaucaacaaggcgaacggugccuauacucaggaaaauuaauuagcauacacgacuuagugcauaauuccaauaaauucgaaauugaccacauucuaccacuaucacuaucauucgaugauucacuagcaaacaaaguucuaguauacgccuggaccaaccaagagaaaggacagaaaacuccauaccaaguaauagauagcauggauacagccuggagcuucagagagaugaaagacuacguauugaaacaaaaaggacuaggaaagaagaaaugcgaauacuuacuaacaacagaaaacaucgacaaaauagaaguaaagaagaaauucauagaaagaaaucuuguggauacaagauacgcaucacgagugguacuuaauucacuacaaacagccuuaaaagaacugggaaaagacacaaaagucuccguaguaagaggccaauucacaagccaauuaagaagaaaauggaacauagacaaaaguagagaaacuuaccaccaccacgccguagaugccuuaauaauagcagcgucuucacaacuaaaauuauggcaaaaacaagaaaacccaauguucgaaagcuacggagaaaaucaaguagugaauaaagaaacaggcgaaauucuuucaauaagcgaugauaaauacaaagaauuaguauuccaaccgccauaccaagguuuuguaaauacaaucucuagcaaaggauucgaggacgaaauccuguucuccuaucaaguagacucuaaauucaaucgaaaagugucagacgcaacuaucuacaguacaaggaaagcuaaauugggaaaagauaaaaaggaugaaaccuacgucuugggaaaaaucaaagacauuuauucacaagacgguuucgacacuuuuauaaaacguuauaagaaagauaaaacccaauuuuuaauguaucaaaaggauccauuaaccugggaaaacguaauagaaguaauucuaagagauuaucccagcgaaaaacuaagugaagacggaaagaaaacaguaaaauguaacccauucgaagaauaucgcagagaaaacgggcuaauauguaaauacucaaagaaaggaaauggaaccccaauaaagagcuuaaaauauuaugauaagaaauuaggaaauugcauagauauaacaccggagaaaagcaaaaacagaguuguacuacgacaaauaucacccuggcgagcagauauauauuuuaauuuagaaacauuaaaauacgaauuaaugggcuuaaaauacucagauuuaucguuugaaaaaggaacgggaaaauaucacauaagucaagaaaaauaugaugcaauccgugagaaagaagggauaggaaagaaaagugaauuuaaauucacgcucuaucguaaugaccuaauacucauuaaagauacauuaaauaacugugagagaaugcuuagauuuggaagcaaaaaugauacaucuaaacauuacgucgaacuaaaaccacuagaaaaaggaacauucgauucggaggaagaaauccuaccuguacuuggaaaaguugcaaaaucaggucaauucauaaaaggacucaauaaaccaaacauaucuaucuacaaaguaagaacagauguauuagguaauaaauucuuuauuaagaaagaaggagacaaaccaaaacuugauuuuaaaaacaacaacaaauga

SEQ ID NO: 8618 - RNA, 3390 nt, Artificial Sequence
  Cas9 variant
augucaaacggaaaaauucuaggauuagauauuggcguugccaguguaggaguaggaaucauagaugcuaaaacagggaauguuauccaugccaacucaagacuuuucuccgccgccaaugcagaaaacaacgcggaaagaagagguuuccgaggggcaagacgacuaaccagacgaaagaaacaccgagugaaaagaguacgugaucuauucgaaaaauacgauauaagcacagacuuccgaaaucuaaaccuaaauccguaugaguuacgaguaaaaggacuaacagaacagcuaacaaacgaagaauuauucgcugcauuacgaaccauagcaaaaagaagaggaauaucuuaccuagacgaugcagaagacgauucaacuggcagcucagacuaugccaaaucuauagacgaaaauaggagguuauuaaaaaccaaaacgccaggccaaauacaacucgaacgccuagaaaaauauggacaacuaagagggaauuucacugucuaugacgaaaacggugaagcacaucgauugaucaacguauucucuacaagcgacuacaaaaacgaggccagaaaaauuuuagagacacaaagcaauuacaauaagcaaauaacugacgaguucaucgaagacuauauagaaauacugacgcagaaaagaaaauacuaucacggaccaggaaacgaaaaaucuagaacagauuauggaagauuuagaacagauggcacaacacuugaaaauauauucgguauacuaauuggaaaaugcucuuucuauccagaagaguaucgagcaucaaaagcaucauacacugcacaagaguucaacuuccuuaaugaucucaacaaucuaaaaguacccacugaaaccgggaaauuaagcacugaacaaaaagaauacuuggucgauuucgcaaagaaaucuaaagcacucggggcgucaaaacuacuaaaagaaauagcaaaaauaguagacuguucaguagacgacauaaaaggauacagaguagacaacaaagacaaaccagacuuacacacauuugaaccauauagaaaauuaaaauucaacuuaagcaguaucgacauagaugaauuaagucgcgaaacacuugacaaacuugcagacauuuuaacacuaaauacagaaagagaagggauagaagacacaauaaagcguaaccuacccagccaauuuacagaagaacaaauuagcgaaaucguacaaauucguaaaaaccaaaguucagcauuuaacaaaggcuggcacucauucagugcaaaauuaaugaacgagcucauaccagaacuauaugucacaucagaggaacaaaugacuauccucacaagauuagaaaaauuuaaagucaauaagaaaucgaguaaaaacacgaaaaccauagaugaaaaagagauaacagacgaaauauacaaucccguaguagcaaaaaguguaagacaaacgaucaaaauuauaaacgcggcagugaagaaauauggcgacuuugauaaaauagucauagaaaugccaagagacaaaaacgcagaggacgaaaagaaauucauagauaagaaagaaaaagaaaacaagaaagaaaaagacgauucauuaaaacgggccgcauuuuuauauaaugguacagauaaucuaccagauggaguuuuccacggaaauaaagaacuaaaaacaaaaauccgacuaugguaucaacaaggagaaagaugccuauacucgggaaaacuaauuucuauacaugaucucguccauaacucaaacaaguuugagaucgaucauauauuacccuuaagccucucauuugacgauucacucgcaaauaaaguuuuaguuuaugccuggacaaaccaagaaaagggacagaaaacacccuaccaaguaauugacagcauggaugcagcguggagcuuuagagaaaugaaagacuacguacuaaaacaaaaaggaaucggaaagaagaaaagagaauaucuacuaacaacagagaacauagacaaaauagaagucaaaaagaaauucauugagagaaaccuaguagacacgcguuacgcaucucgagucguucuaaauucacuacaaacagcucuuaaagaacugggcaaagacaccaaaguaucaguuguacgaggacaauucacaucacaacuaagacguaaauggaaaaucgacaaaucccgugaaacauaucaucaccacgcaguggacgcauugaucaucgcggcuuccggucaauugaaacuauggcaaaaacacgaaaaucugauguucgaaaauuacggugaaaaucaaguaguaaacaaagagacgggagaaauacuaaguauaucagacgacgaauacaaagaauugguauuccaaccaccuuaccaaggauuuguaaauacuauuaguucaaaaacauuugaagacgaaauccucuucaguuaucaaguagacucaaaauucaaucguaaaguaagugacgcaacgauauacuccacacgcaaagcaaaacuugguaaagacaagaaagaagaaacauacguccucggaaaaauaaaagacauauauacucaagacgguuucgauacguucauaaaaagauauaagaaagacaaaacucaguuccugauguaccaaaaagauccucuaaccugggaaaauguuauagaaguaauacuaagagacuacccauccgagaaacuauccgaagacgguaagaaaaccgucaaauguaaccccuucgaagaauaccgcagagaaaacggucuaauaugcaaauauagcaagaaaggaaacggcacaccuauaaaaucacugaaauauuaugauaagaaacuagggaacugcauagauauaacccccgaaaaaucgaaaaaucgcguuguauuaagacaaaucagccccuggcgagcagacauauauuuuaaccuagagacacuaaaauacgaauuaaugggccucaaauacucagauuuaucuuucgaaaaaggaacaggaaaauaucacauaagccaagaaaaguacgaugcaauaagagaaaaagaagguauaggaaagaaaagcgaauuuaaauuuacucuauacaggaacgacuugauacuaauaaaagacacuuuaaauaacugcgaacgaaugcuaagguucggcaguaaaaacgacacaucgaaacacuaugucgaacuaaaaccacuagaaaaaggaacuuucgacucagaagaagaaauacuacccguauuaggaaaaguagcaaaaucugggcaauuuaucaaaggacuaaacaaaccaaauauaaguaucuauaaaguacgaacagauguacuaggaaauaaauucuuuauaaagaaagaaggcgacaaaccaaaacuagacuucaaaaacaauaauaaauga

SEQ ID NO: 8619 - RNA, 3393 nt, Artificial Sequence
  Cas9 variant
augaacaagauucuaggacuggaucuaggaacaaauagcauaggaugggcccucaucgaaaauaauauaaucuuaggaaugggaagcagaguuuucccagaaggcguagugaaucuuggagaaggugaaggcagagaaaccucuaaaaaugcuucaagaacagaagcuagaggaguaagacgccaaauauuuagacgaagacuaagaaaaagguauuuauuaaaagaguuagcaaaacauaacuuaugcccaauaucgccuaccuuaaucaaagauuggaauggaacagauaucuucaaaaaugaauuaauaauacaaugguuccaacuaaaccccuaugaauuacgagcgaaagccauacaagaagaaauuacacuaauugaacucggcagaauuuucuaccauaugauccaaagacgagguuuccuaucaaauagccgcucggcuggagcggauguaaaagaaacaucaacaauauucaaaggcgaugcaaaaauuggaaaaauaggcauaucggauacacugaaaucaauugaacaaaacaaaacucuagggaguuuccuacacucaauccaacccaaggaaaacgaaccauuuaguggagaacuggaaagaauaagaaauagauacacaacaagacaaauguacaucgaugaguucgagacgauaugggaauuucaaaaacaguaccacagcgagcuaaauuccaaucuaaaaacaauccuuggaggcagaaaaaaagauaauuacaaagaagacggaguccuuuuucaccaaagaccacucaggucacaaaaacaccuaguuggcuucuguuccuucgaaccaaaaaaaaccaaauguaaauugagcgccauaccauucgaauuauucagaaucuaucaauggguaaacacacuuagcuacgauguaaauggaguaagacaaaaaauaacacaagaagaaaggaaaaaaauaauagaucuacugcuuagcaaagaaaaaccauccuucaaagaaauaagaaaagccauuggaaaauuggacggauccuaccaauuuaacuacaaagacgacgacaaaauaguugggucacauacaauaagcaacuuaucaaauaagaaauucuuuggaaacaaaugguucgauuucucagaaaaagagcaagaaaauauauggcacauauuauccuuuuuugacgacagggagaaacuaaaagaauaugcaauaaaaaacuggagcuucgaugaagaacgcgcggucaaaaucucuaaauucaaucucaaagacggguauucaaaccuaucaagaaaagccauacuaaauauuuuaccguuccuacaaaaaggguuuauguacgauguagcaguuggucuagcaggaguaaaaaauacccuguccguaaacugggaagagcaugaacaauuuguccuggacaauguuccugagauuguacgaucgaaucuaaaaggaggauauauagaaccacuaaaaaacaugcuaaaaaacgaauuuaacuguaacgacaaacaacuagaaaaauuauaccaccauucaucugcaauugaaaccgaaaacauccuagacaggcuaccuguaaaucuccacgcagacagggaaauccaaaaaauaaaaaaucccgucguuauaacugcuuuauucgaaauucgaaaauuagucaaugaaguaauagacaccuacgggaaacccaacgaaauaaaagucgaacuugcaagagacuuaaaagcaucgaaaaguaacagguuagaagcaagaaaaagacaaaaagauuuagaaaaacaaaaugacagagucaaacuugaauuagagaaccuaaaccagcgaaguaaucauaucaacauacuuaaauauaaacuaugggaagaaugcaaucauacaugucccuuuaccggacaaauuauaacuauuucacaacuuuucacaggcgagguacaaauugaacacauauucccauggagcaggucacuaaacgauaguuucaauaacaaaacacugugcuuugcagacgaaaaccgcgcaaaagguaauaaaacaccauacgaacucuauucugaacaaggugaccaaaaaugggaagcaauuaaacuacaagcacuuuccuguuuuaaaacaaaagcaaacuauccuaauugcuacaacaaauucaaacacuucgucaaaaagaaacaugaugaagacuucauaagccgccaauuaaaugauacacguuauauaucaaaggaagcaaaaaauuaccuuagcaaaaucugcucaaauguucuuguugcaccgggucaaaugacugccacuuuaagacaucauuggggacucaacucuauacuuaacuuagaagaugacacaaaaacccgcgacgaccaccgccaccacgcuauagaugcccucguaauggcauguuccacacgaucucacuuacaagaauuaucaaaaagaaauagauauaacaaaaacuacgacuuaaaagacuucccagacccguggcaaaacuuccgacaagacgcugaaaacgccguagcccaaauauuagucagccacaaaaaaagcaaauccuuauuaacaguaagaacacauaaaacuaucaaaaaaggcguagaacauaaaaacaucggaguagcagcaagaggacaacuacacaaagaaagcguuuacggucuaaggaaagcuccaaauagcaacaaagccuuccauauaagaaaaccacuagagucacuaacaacagaaaaacaauuggagaaaauuguagaugauagcauaagacucuuaauacuaaaacguauaaauauaauaggaggauuuaucaaaggcaaaauaccaaaagaaacauuuuucgucguagacgaaaauggaauaaaacaaccacaaaucuuuuuaccuaaucgaaaugguaauccagucccaauuaaaaaaguaagaauaagagaaaauaucggaggagccgaaaaauuaaaagaaaauaccaaucaauauguaaacccacgaucaaaucaucacguaauagucuacgaagacucaaacggaggacuaaaagacgauguagugacauucuggacugcaguagaacgcaaaagacagggacaagacguuuuuaaacuaccuaaugauggagaaaaaaucguaucgacucuucaaaucaacgauauguuucuacuuggauuaaaugacgacgauauaauuacccuaacaucaaaagaauuaaagaaacaucuauuuaaaguccaaacgcuaucuaguaguuucuaugaauucagauuaaguaccgacagcacccaaaacaaaaacacaaacucaacaguauucagaagaauucaaagcuucgguauggguaaaacaggguggaaagcauucaaccccauaaagguaaaauuaaauagcauuggcgaagucaaaaucauauga

SEQ ID NO: 8620 - RNA, 3393 nt, Artificial Sequence
  Cas9 variant
augacaaauggaaaaaucuuaggucuagacauuggaauagcuucuguuggaguuggcauaauagaagcuaaaacagguaaaguaguucaugccaacagcagacuguucucugcagcgaacgcagaaaauaaugcagaaagacgagguuuuagaggaagucgaagauuaaauagacggaagaaacaucgaguaaaacgcguaagagaccuauucgaaaaauacgguauaguaacugacuuccgcaaucuaaaccugaauccauaugaacuaaggguuaaaggacuaacagaacagcucaccaaugaagaacuguucgcagcacuaaggacaauuagcaaacgacgaggaauuucauacuuagaugaugcagaagaugacucaacugguucaacagacuaugccaaaagcauagacgaaaaucguagauuacuuaaaacuaaaaccccaggacaaauucaacuugaaagacuagagaaauacggacaacuaagaggaaacuucacaguauacgacgagaacggagaagcgcauagacugauaaaugucuucaguacuucggauuaugaaaaagaagcaagaaaaauccuagaaacacaagcagacuacaauaagaaaauaaccgcagaauuuauagacgacuauguggagauacuaacacaaaaacguaaauacuaccauggaccaggaaaugaaaaaucuagaacugacuaugguagauucagaacugacgguacgacguuagagaauauauucgggauucuaauaggcaaaugcucauucuaccccgaugaauacagagcaaguaaagcauccuauaccgcccaagaguacaacuucuuaaacgacuuaaacaacuuaaaagucccaacagaaacuggaaaauuaucaacagaacaaaaagaagcucuaguagaguucgccaaaaguacagcuacacuaggaccagcaaaacuccuaaaagaaauagcaaaaauauuagauugcaaaguagacgaaaucaaaggcuaccgugaagaugacaaaggaaaaccagaccuacauacauucgaaccauacagaaaauugaaauucaaccuagacagcguaaauaucgaugaucugagucgggaaguccuagacaaacuugcagacauacucacacuaaauacggaaagagaagguauagaagacgcaauaaaaagaaaucuacccaaccaguuuacugaagaacaaauaucagaaauaauaaacgugagaaaaucccaaucaacagcauucaacaaagguuggcacuccuucucugccaaguuaaugaacgaacuuauaccggaauuauacgcuaccuccgacgaacaaaugacaauacuaaccagacuagaaaaauuuaaaguaaagaagaaauccagcaaaaauaucaaaaccauagacgaaaaagaaauuaccgacgaaauauacaauccaguaguagcaaaaucagucagacaaacaauaaaaauaauaaacgcagcaguaaagaaauauggugacuucgauaaaaucguaauagaaaugcccagagauaagaacgcugacgacgaaaagaaauuuaucgacaaacgaaauaaagaaaacaagaaagaaaaagaugaugcacucaaaagagcagcauacuuguauaauggaacagauaaacuaccugacgaaguauuccauggcaacaaacaacuagaaacaaaaauuagacuuugguaucagcaaggagaaagaugccuguacagugguaaacccauuccuauacaagagcuaguucacaauucaaacaacuucgaaauugaucacauacuaccuuuaaguuuaucauucgacgauaguuuagcaaacaaaguguuagucuacuccuggacaaaucaagaaaaaggccaacgaaccccauaccaggugaucgacagcauggacgccgcauggucauuuagagaaaugaaagauuauguacucaaacaaaaagggcuagguaaaaagaaaagagauuauuuacuaacaacugaaaacaucgauaaaauagaaguuaaaaagaaauuuauagaaagaaaccuuguagacacacgauacgcgaguagaguaguauuaaauaguuuacaaucagcucuaagagaacucggaaaagauacaaaaguaagcguaguaagaggacaauuuacaagucaacuaagaagaaaauggaaaauagacaaaagccgagagacguaucaccaccaugcaguagacgcacugauaauagcagcaucgagccaauuaaaacugugggaaaaacaagauaauccaauguuuguugauuacgggaauaaucaagucguagauaaacaaaccggagaaauucucaguguaagcgacaacgaauacaaagagcuaguauuccaaccacccuaucaaggauuuguaaacaccauaagcagcaaaggauucgaagaugaaauacuuuucucauaccagguagauaguaaauacaauagaaaagugucagaugcaacaauauauaguacaagaaaagccaaaauaggcaaagacaagaaagaagaaacauauguccuaggaaaaauaaaagauauuuauucacagaacggcuuugacacuuucguaaagaaauauaauaaagauaaaacacaauuuuuaauguaccaaaaagacccccucacaugggaaaaugugauagagguaauauuaggggauuaccccacuacaaagaaaucagaagacggcaaaaacgacguuaaaugcaacccauucgaagaguacagaagagaaaacgguuuaauaugcaaauauagcaagaaaggaaaaggaacuccaauaaaaagccuaaaauauuacgauaagaaacuaggaaauugcauagacauaacgccugaggaaagcagaaacaaaguaauacuacaaucaauaaacccguggagagcagauguuuacuucaacccggaaacacuaaaauaugaauuaaugggauuaaaauacagugaucucaguuuugaaaaaggaacagggaacuaccauauaucgcaagagaaauaugaugccaucaaagaaaaagaagggauaggaaagaaaagcgaguuuaaauucaccuuauacagaaacgaucugauacuaauaaaagacauagcaucaggcgaacaagaaauauauagauuccucagcaggaccaugccaaaugucaaccauuauguagaauuaaaacccuacgacaaagaaaaauucgacaacguacaagagcuaguagaagcacuuggcgaagcugacaaaguaggaagauguauaaaagggcuaaauaaacccaacaucucgauuuauaaaguaagaacagacguacuaggcaacaaauacuuugucaagaaagaaggagauaaaccaaaauuggacuuuaaaaauaauaagaaauga

SEQ ID NO: 8621 - RNA, 3393 nt, Artificial Sequence
  Cas9 variant
augaccaacggaaaaauacuaggacuagacaucggaauagcaagcguaggaguaggcaucauagaagcuaaaacuggaaaggugguacacgcuaacucucgacuauuuucagcagcuaaugcugaaaacaacgcagaaagaagaggauuuaggggcucaagacgacuaaacagaagaaagaaacacagagugaagagaguacgagauuuauucgaaaaauacgagauaguaacagacuuccgaaacuuaaaccuaaauccauacgaauuacggguaaaaggacucacagaacaacuaaccaacgaggaacuauuugcagcacuacgaaccauaagcaagagaagaggaauuuccuaccuagaugacgccgaagaugacuccacuggcuccacugauuaugccaaaucgaucgacgaaaauaggagauuguugaaaacuaaaacgcccggacaaauacaacucgaaagacucgaaaaauauggacaacuacgaggaaauuuuacaguauaugaugagaacggagaggcccaccgguugauaaacguauuuucaaccucagauuaugaaaaggaggcuagaaaaauccuagaaacucaagcugacuauaauaagaaaauuacagcggaguucauagacgacuauguagaaauccuaacacagaaaagaaaauauuaccacgggccaggaaacgagaaaagcagaacugacuacggaagauuucgaacagauggcacuacauuagaaaacauauucggaaucuuaauagguaaauguuccuucuaccccgacgaauaccgagcuucaaaggcuucauacacggcacaagaauacaauuuucucaaugaucuuaacaauuuaaaaguaccaacagaaacgggaaaauuauccaccgaacaaaaagaagcccuaguagaauuugccaaaaguaccgcuacacuugguccagcgaaauuacuaaaagaaauagcaaaaauacuagacuguaaaguggacgaaauaaagggcuacagagaagacgacaaaggaaaaccagauuuacauacauucgagccuuaucgaaaacucaaauuuaaucuagauucagugaauaucgaugaccuuagcagagaagugcuagacaagcuagccgauauacuaacccuaaacacagaacgagaaggaaucgaagacgcaauaaggcacaaucuaccaaaccaauucacggaaggacaaauaucagaaauaaucaagguaagaaaaucucaaucaacugcuuucaacaaaggauggcacagcuucucugcuaaacuaaugaaugaacuuauaccugaauuauacgccacgagcgacgaacaaaugaccauacucacacgacuugaaaaauuuaaaguaaauaagaaaucaagcaaaaacacaaaaacuauagacgaaaaagaaguuaccgaugaaauauacaacccaguaguagcaaaaucagugagacaaaccaucaaaaucauuaacgcagcaguuaagaaauacggcgauuucgauaaaauaguaaucgaaaugccaagagacaaaaaugcagacgaugaaaagaaauucauagauaaacgaaacaaagagaauaagaaagaaaaagacgaugcauuaaaaagagcggcauacuuauauaauggcacagacaaauugccagacgaaguauuccacggcaauaaacaauuggagacaaaaauuagauuaugguaccaacaaggcgaaagaugcuuauacucuggcaaaccgauaccaauccaagagcuaguccacaacucuaacaacuuugaaauagaccacaucuuaccacuaagucuaucauuugaugauaguuuggcuaacaaaguccucguuuacgcguggacaaaucaagaaaaaggccagaaaacaccauaccaagugaucgauuccauggacgccgcuuggagcuuuagagaaaugaaagacuauguacuaaaacaaaaaggccuagggaaaaagaaaagagacuauuuacugacaacggaaaauauagacaaaaucgaaguaaagaagaaauuuauugaacgaaauuuagucgauaccagauacgcaaguaggguaguauugaauagucuucaaucagcacuccgagaauuaggaaaagacacaaaaauuuccguaauuagaggucaauuuacaagccaacuaagacggaaauggaaaaucgacaaaucaagggaaacauaucaucaccacgcgguagaugcacucauaauagcugcaagcucacaacuaaaacuaugggaaaaacaagauaacccgauguucgucgauuacgguaacaaccaagucguagacaaacagacuggagaaauauuaaguguaagcgaugacgaauacaaagaauuaguauuccagccaccauaccaaggauucguaaacaugauaucaagcaaaggcuuugaagaugaaauuuuauucucauaucaaguagauucaaaauauaaccgaaaaguaagcgacgcaacaauauauaguacacgaaaagcaaaaauaggaaaggacaagaaagaagaaaccuauguacuagguaaaaucaaagauauauacucucaaaacggauucgacacauucauaaagaaauauaauaaagacaaaacacaauuuuuaauguaccaaaaagacccauuaaccugggaaaacguaauagaaguaauacuuagagauuaucccacuacgaagaaaucagaagacgguaaaaacgacguaaaaugcaauccauuugaagaauaccgacgagaaaacggauuaguaugcaaauauaguaagaaaggcaaagguacaccuauaaaaucacuuaaauauuacgacaagaaauuagguaacugcauagacaucacuccagaaggcaguaaaaaugaaguaguacuacagaguuuaaacccauggagagcagauguauacuucaauccagaaacacugaaauacgaauuauuaggccuaaaauacagcgaccugucauuugaaaaagggacaggaaaauaucauauaucacaagaaaaauacgacguuauaaaagaaaaagaaggaauaggaaagaaaucagaguucaaauucacauuguaucguaacgaccuaauccuaauaaaagacacagcauccggcgaacaagaaauuuacagauuucuuuccagaacaaugccaaacguuaaacacuacgcagaauuaaaaccauacgacaaagaaaaauucgauaauguacaagaacuugucgaagcucuaggagaagcagauaaaguagggcgauguauuaaagggcucaauaaaagcaaucuuagcauauacaaagugaggacagacguauuaggaaacaaauauuucgugaagaaagaaggagacaaaccaaaacuagacuuuaaaaauaacaagaaauga

SEQ ID NO: 8622 - RNA, 3393 nt, Artificial Sequence
  Cas9 variant
augacgaacggaaaaauacuaggcuuggacauaggcauagcaaguguugggguugguauaauugaagccaaaaccggaaaagugguccacgccaauucgcgacuauuuucagcagccaacgcagaaaacaacgcagaaaggcggggauucagagggucacguagacucaacaggcgaaaaaaacacagaguaaaaaggguaagggaucuuuucgaaaaauauggcauaguuacagacuuccgcaaccuaaaucuaaauccauaugaguuaagaguaaaaggauuaacagaacaacuaacaaacgaagaauuauuugcggcacucagaacaauaagcaaaagaagggggauauccuacuuagaugacgccgaagaugacuccacaggcucgacagauuaugcaaaauccauagaugaaaacagaagguuacuaaaaacaaaaacaccaggacaaauacaauuagagagacuagaaaaguauggacaacuuagaggcaacuuuacaguauaugaugaaaacggagaagcacauagauuaauaaacguuuucagcacaagcgauuaugaaaaagaagcucguaaaauacucgaaacacaagcagacuauaacaaaaaaauaaccgcagaauuuaucgacgauuacguagaaauacuaacacaaaaaagaaaauauuaccauggacccgguaacgaaaaaucuagaaccgacuacggcagauucagaacagaugggacaacauuagagaacauuuuuggcauccuaauagguaaaugcaauuuuuaucccgacgaauacagagcaucaaaagccagcuacacagcgcaagaauacaacuuucuaaacgacuuaaacaacuuaaaagucccaacagaaaccggcaaauuaucaacugaacaaaaagaaucacuuguagaauuugccaaaaacacagcuauauuaggaccugccaaacuccugaaagagauagcuaaaauccuagauuguaaaguggacgaaauuaaaggguauagggaagacgacaaaggaaaaccagaucugcacaccuuugaaccauauagaaaauuaaaguucaaccuggacagcguaaauauagauuacuuaucaagagaaguauuagauaaacuugcagauauccugacacugaacacggaacgagagggaaucgaggacgcaauuaaacgaaauuuacccaaccaauucaccgaggaacaaauauccgaaauaauaaauguacguaaaucucaaucaaccgcauuuaauaaaggcuggcacucauuuucagccaaauuaaugaacgagcucauucccgaacuauaugcuacaagcgacgaacaaaugacuauccuuacgcgauuagaaaaauucaaaguuaaaaaaaagagcucgaaaaacauaaaaaccauagacgaaaaagagauuacagacgaaauauacaacccaguaguagcuaaaucagucagacagacuauaaaaauuauaaacgcagcagucaaaaaauacggugacuucgauaaaauagucauagaaaugccacgagacaagaacgcagaugaugagaaaaaauucaucaacaaaagaaauaaagaaaacaagaaagaaaaagaugacgccuuaaaaagagcagcauaccuauauaacgggacggauaaguuaccagaugaaguauuccacggaaacaagcaacuugaaacaaaaauaagacuaugguaccagcaaggugaaagaugucuauauagcggcaaaccaauaccaauucaagaauuaguacacaacagcaacaacuucgaaauagaccacauacuuccgcuaagcuuaaguuuugaugacagucucgcaaauaaaguacuaguuuacucguggacgaaucaagaaaaaggacaaaaaacaccauaccaagugaucgauagcauggaugcagcauggucauuucgagaaaugaaagaauacguacuaaaacagaaaggucuagguaaaaaaaaaagagacuacuuacuaacuacggaaaauauagauaagaucgaagugaaaaaaaaauucauagaaagaaacuuaguagacaccagauacgcgucgagagugguauuaaacucacuacaguccgcauuaagagaauuaggaaaagauacgaaaguaagcguaguaagaggccaauuuacuucucaacuuagaagaaaauggaaaauagacaaaucaagagaaaccuaccaucaccaugccguagaugcauuaauuauagcagccaguucacaacugaaacuaugggaaaaacaagauaacccaauguuugucgacuauggaaauaaccagguaguagacaaacaaacuggcgaaauacuaagcguauccgauaacgaguauaaagaauuaguuuuucaaccucccuaccaggguuuugugaacacuauaucuucuaaagguuucgaagaugaaauccuauuuagcuaucaaguugacaguaaguauaaccgaaaaguaucagaugcaacaauauacaguacacgaaaagcaaaaauagggaaagacaaaaaagaagaaacauauguauuaggcaaaauaaaagacauauacucucaaaauggcuucgacacauucgugaaaaaauacaacaaagauaaaacccaauuucucauguaucaaaaagauccacuaacgugggaaaauguuaucgagguaauuuugggagacuauccaacaacuaaaaaaucagaagacggaaaaaacgaugugaaauguaaccccuucgaagaauacagaagagagaauggauuaaucuguaaauauucgaaaaaggggaaagguacaccuauaaagucacuaaaauacuaugauaaaaaguuaggaaauugcauagauaucacaccggaagaaucaaggaauaaaguuauacugcaaucaauuaauccauggcgagcugauguguacuuuaauccggaaacacuaaaauaugaauuaauggggcuaaaauauagcgaccugucauucgagaaaggaacaggaaauuaucacauuucacaagaaaaauaugacgcaauaaaagaaaaagaaggcauaggaaagaaaagcgaauuuaaguuuacauuauauagaaaugaccugauccuaauaaaagauauagcgaguggagaacaggaaaucuaccgauuucuuuccagaacaaugccaaacguaaaccauuacguagaauuaaaaccuuaugauaaagaaaaauuugacaauguccaagagcuggucgaagcacuaggagaagcugacaaaguaggaagaugcauaaaaucacuaaacaaaccaaacaucucaauauauaaaguaagaacagaugucuuaggaaauaaauacuucguaaaaaaagaaggcgauaaaccaaaauuagacuuuaaaaacaauaaaaaguga

SEQ ID NO: 8623 - RNA, 3393 nt, Artificial Sequence
  Cas9 variant
augagcaauggaaaaauacuaggccuagacauaggcgucgcuaguguaggaguaggaauaauagaugcaaaaacaggaaaagucauccaugcauccaguagacucuucagcgcagcaaacgcugaaaacaacgcagaaaggcgagguuucagaggagcaagaagacucacuagaagaaaaaaacaccguauuaaaagaguucgcgacuuauucgaaaaauaugaaauaguaacagauuucaguaauuuaaaccucaacccauaugaauuaagaguaaaaggucuuaccgaacaauuaaccaacgaagaguuauuugccgcucuucgaacaaucgcaaagagaagagguauaucauaucuugaugacgccgaagacgacaguacaggaagcucagauuaugccaaaagcauagaagaaaaucgaagacuacuaaaaaauaugacuccuggucaaauacaacuagaaagacuagaaaaauacggccaacuacgaggcaacuucacaguuuaugacgaaaauggagaagcacacagauuaauaaauguauuuucaacuucggauuacaagaaugaagcgcgaaagauacucgaaacucaaucaaacuauaauaaacaaauaacagacgaauucauagaagauuacaucgagauacuaacgcaaaaaagaaaauacuaccaugggccaggaaacgaaaaaucacgaacagacuauggcagauaccgaacagauggcacgacacuugaaaauauauucggaauauuaauaggaaaaugcacauucuaccccgacgaauaccguacaaguaaagcaucauacacagcacaagaauauaacuucuuaaacgacuugaacaauuuaaaaguaccuaccgaaacuggcaaacuaucaacagagcaaaaacacuaucucguugacuuugcuaaaaguagcaaagcccucggaguagccaaacuacucaaagaaauagcaaaaauaguugaaugcucaguagacgauauaaaaggauacagagaagauaacaaaggaaaaccagacuuacacacguucgagccauaucgaaaacucaaauuuaacuuaucacuaauugacaucgacgaauuaucacgagaaacacuagacaaacuagcagacauacuaacacuaaacaccgaacgagaaggaauagaagaugccauaaaaagaaaucuucccaaucaauucacagaagaacaaauaguagaacuagucaauguacguaaaaaccaaucaucugccuucaacaaaggauggcacucauucagcguaaaauuaaugaaugaacuuauaccagaacuuuaugcaucaagugaagaacaaaugacaauauuaaccagauuagaaaaauucaaaguaaacaaaaaaaguuccgaaaacacaaaaaccaucaaugaaaaagaaauaacagacgaaauauacaauccuguaguagcaaaguccguuucucaaacuguaaaaauaauaaaugcugcagugaaaaaauacggagacuucgacaaaaucgugaucgaaaugccaagagacaaaaaugcagaugaugaaaaaaaguucauagauaaaaaacaaaaggagaaugcgaaagagguggaagacgcacuaaagagagcagcauaucucuacaauggcacugacaagcucccugacggagucuuccaugguaacaagcaacuaaaaaccaaaaucaggcuuugguaccaacaaggcgaaaggugcuuauauucggguaaaccaauaucaauacaagacuuaguacauaacagcaauaacuucgaaauugaucacauacuccccuuaucacuaucuuuugacgacaguuuagcaaacaaagucuuaguauaugcuuggacuaaucaggaaaaagggcaaaaaacaccauaccagguaauugauucgauggaugcagcauggucauuucgagagaugaaagacuauguacuaaaucaaaaagguauuggaaaaaaaaaacgcgaauaccuucuuacaacagaaaacauugacaaaaucgaagucaaaaaaaaauucaucgaaagaaaucuuguagacacaagauacgccucaagaguuguacucaacucaauucaagccgcacuaaaagaauuagacaaagauacaaaaguaucaguaauacguggacaauucaccucacaguuacgaagaaaauggaaaaucgauaaaucgagagaaacauaccaccaccaugcaguagaugcuuuaauaauugcagccucaagucaacucaaacucuggcaaaaacaggaaaaucccauguucguagacuacggagagaaucaaguugugaacaaggaaacaggagaaauccuguccgugucggacgacgauuacaaagaauuaguauuucaaccacccuaccaaggauucguaaacacaauaucuucgaaagcauucgaagaugaaauacuuuucuccuaccaggucgacucaaaauauaacagaaaaguuagugacgcaaccaucuauucaacaagaaaagcaaaacuggggaaagauaaaaaagaagaaacguacguacuaggaaaaauaaaagacauuuauucacaagauggauuugacgccuuuauuaaaagauacaagaaagauaaaacccaauucuuaauguaccaaaaagaccccguaaccugggagaacguuauugaaguaauacuccgagauuauccaagugaaaaauuaagcgaagacggaaaaaaaaaugucaagugcaaccccuucgaagaauacagaagagaaaauggccuaauaugcaaauacaguaaaaaagggaaagggaccccaauaaaaucauugaaauauuacgauaaaaagcuaggaaauuguauagacauuacgcccaaaggaaguaaaaaugaaguuguguuacaaaguuuaaauccauggcgagccgaccuauacuucaacccagauacacuaaaauacgaauuaaugggauuaaaauacucagauuuaucuuuugaaaaaggcacaggcaaguaucacauaucacaggaaagauacgacgaaauuaaagucaaagaaggaauaggcaagaacagcgaauuuaaauuuaccuuauaccguaaugaucuaauccucauaaaagauacagaaaguggagaagaagaguuauaccgauuuuuaucuagaacaaugccuaaugucaaacauuacguagaauuaaaacccuacgacaaagagagauacgacggaggacaggaacucaugaaaguguuuggaaauguagcgaaugguggacaaugucuaaaaucacucaauaaaaguaaccuuagcaucuauaaagugcgaacugauguauugggaaauaaauuuuucauaaaaaaagagggagacaaaccuaaauuagacuuuaaaaauaauaaaaaauga

SEQ ID NO: 8624 - RNA, 3393 nt, Artificial Sequence
  Cas9 variant
augacuaauggaaaaaucuuaggucuggauauaggaauagcaucaguaggaguuggcauaauagaagcaaaaaccggcaaaguuguacaugcaaacucacggcuauuuucagcggccaaugccgaaaauaacgcagaaagaagaggauucagaggaucacggagauuaaacagaagaaagaaacacagaguaaaacgagugagagaucuauucgagaaauacggcauagugacugacuucagaaaccuaaaucuaaaucccuaugaauuaagaguaaaaggucuaaccgaacaacugaaaaacgaagaacuauuugcagcccuacgcacaauuaguaaaagaagaggaauaucuuacuuggacgacgcagaagacgauucgacaggaucaacugauuaugcaaaaucaauagacgaaaacagacggcuacucaaaaauaaaacacccgggcaaauacaauuagaaagacucgaaaaauacggacaacuaagagggaacuucacuguauacgacgaaaacggcgaagcucacagauuaauaaauguauucagcaccagugacuaugaaaaagaagcaagaaaaauacucgaaacacaagcagacuacaauaagaaaaucacugcagaauuuaucgaugauuacguugaaauuuuaacacaaaaacgaaaauauuaccacggcccuggaaaugagaaaagcagaacggacuauggucgauuuagaacugacggaaccacacuggaaaacauuuuuggaauacuaauaggaaaauguaacuuuuacccggaugaauaccgugcuucuaaggcuucuuacaccgcccaagaguacaacuuccuaaacgaccuaaacaacuuaaaaguaaguacagaaacaggaaagcuaucaacagaacaaaaagagagcuuaguagaguucgcuaaaaauacagcaacacuaggcccagccaaauuauuaaaagaaauagcaaagauauuagacugcaaaguagacgaaauaaaaggcuacagagaagacgacaaagggaaacccgaucuacauacauuugaaccauauagaaaacugaaauuuaaucuugaauccauaaacauagaugacuuaagcagagaaguaauagacaaauuggcagacauauuaacauuaaacacugaacgagaaggaauagaagacgcaaucaaaagaaacuuaccaaaucaauucacagaagaacaaauaucugaaaucauaaaaguaagaaaaucucaaucaacagcauucaauaaaggauggcacaguuuuucagcaaaauugaugaacgaauuaauuccugaacuguacgcaacaagugacgaacaaaugacgaucuuaacucgucuugaaaaauuuaaaguaaacaagaaaagcucuaaaaacacaaaaacuauagacgaaaaagaagucacagacgaaauauacaacccgguaguagccaaaucaguacgccaaaccauuaaaauaauaaacgcagcaguuaaaaaguauggggauuucgacaaaauaguuauagaaaugccuagagacaaaaacgcugaugaugaaaagaaauucaucgauaaaagaaacaaagaaaacaagaaagaaaaagacgacgcucucaaacgagccgcauaucuauauaacaguucugacaagcucccugaugaaguguuucauggaaauaaacaacuugaaaccaaaauccgauuaugguaccaacaaggcgaaagaugccucuauuccggcaaacccauaagcauacaagagcuaguccacaacucuaauaauuuugaaauugaucacauauuaccguuaucuuugucauuugacgacucucucgcuaauaaaguccuaguguacgcauggacaaaucaagaaaaaggccagaaaacaccuuaucaagucauagauuccauggaugccgccuggaguuuccgagagaugaaagauuauguacuaaaacaaaaaggauuagguaagaagaaaagagacuacuuacuaacaacugaaaacaucgauaaaaucgaagugaaaaagaaauuuaucgaaaggaaccuugucgauacacgauaugcaagucgugucguauuaaacagcuuacaaagcgcacuucgagaauuagguaaagacacuaaaguaagcguagucagaggacaauuuacaagccaacuacgacgcaaauggaaaauagauaaaagccgcgaaacauaccaucaccacgcuguagacgccuuaauaauagccgcaucaagucaguuaaaauuaugggaaaaacaagacaauccaauguuugucgacuauggcaaaaaucaaguagucgacaaacaaacaggugaaauccuaucgguaagcgaugaugaauacaaagaauuaguauuccaaccaccauaccaagguuuuguaaacacuauauccagcaaaggauucgaggaugaaauacuauuuucauaucaaguagauaguaaauauaauagaaaaguaucugacgcuacuauauauucaacaagaaaagcgaaaauagguaaagacaaaaaggaggaaacauacguauuaggaaaaaucaaagauauuuacucacaaaacggcuucgacacauucauaaagaaauacaacaaggauaaaacccaauucuuaauguaucagaaagacagucuaacgugggaaaacgugauugaaguaaucuuaagagacuauccgacaacaaagaaaagugaagaugguaaaaacgauguaaaauguaaccccuuugaagaauauaggcgagaaaacggccuaauaugcaaauauagcaagaaaggaaaagggacgcccauuaaaucauuaaaauacuaugacaagaaacuugguaauugcauagauauaacaccagaagaaucacguaauaaaguaauucuacaauccauaaauccauggcgagcugauguauacuuuaauccagaaacacuaaaauacgaauuaauggggcuuaaauacagugaucuaucauucgaaaaagggaccggcaacuaccacauaucccaagagaaauacgacgcaaucaaagaaaaagaaggcauaggcaagaaaagugaguucaaauuuacauuauaucguaacgaccucauauuaauaaaagacauagcaucaggagaacaagaaauuuauagauuuuuaagcagaacaaugccaaaugucaaccacuacguagaauuaaaaccuuacgauaaagaaaaauuugacaacguacaagaacuuguagaagcccugggagaagccgacaaagugggaagguguauaaaaggacucaauaaaccgaacauaagcauauacaaaguccgaaccgauguacucggcaauaaauacuuuguuaaaaagaaaggagacaaaccaaaauuagauuucaaaaacaauaagaaauga

SEQ ID NO: 8625 - RNA, 3393 nt, Artificial Sequence
  Cas9 variant
augacaaauggcaaaauacucggucuggauauuggaauagcauccguuggaguagguaucauagaagcgaaaacaggaaaaguaguacacgcaaacucaagacuauuuucagcagcgaacgcagaaaacaacgcugaaaggagaggauucagaggaucacgcagauuaaaucgcagaaagaaacacaggguaaaaagaguacgagaccuauuugaaaaauacggcauagugaccgauuucagaaacuuaaauuuaaacccuuaugaacuucgaguaaaaggucuaacagagcaacuuacaaacgaggaacuguucgcagcacuaaggacuaucaguaaaagaagagggauaagcuaccuagaugaugcagaggacgacucuacaggaucaacggauuacgccaaaucaauugacgaaaauaggagacuacuaaaaacaaaaaccccagggcaaauucaacuagaaagauuagaaaaauacggacaacuacgcggaaacuuuacuguguacgacgaaaauggagaagcacauagguuaauaaacguuuucagcacaucugacuacgaaaaagaagcaagaaaaauacuagaaacccaggcggauuacaauaagaaaaucacagcagaguuuauagacgauuacguagaaauauuaacacagaaaagaaaauauuaucaugggccaggaaacgaaaaauccagaacagauuacggacgauuuagaacugauggcacaaccuuagaaaauaucuucggaauauuaaucggaaaauguucauuuuacccagaugaguacagggccucaaaagcgucauauaccgcacaagaauauaauuucuuaaaugauuuaaauaaccuaaaagucccaacugaaacuggaaaauuaagcacagaacaaaaagaggcucuaguagaguucgcaaaaucuacagcaaccuuaggaccagcuaaauuacuaaaggaaaucgcaaaaauuuuagacugcaaaguggaugagauaaaaggauauagggaagaugauaaaggcaaaccugaccuccauaccuuugaaccauaccgcaaauuaaaguucaaccuggauagcguaaacauagauuaucuaaguagagaaguacuagacaagcuagcaggaaucuuaaccuugaauacagaacgggaaggcauagaagacgcaaucaaaagaaaccugccaaaucaauucacggaagaacaaauaagcgaaauaauaaauguacgaaaaucccaaagcacagcuuuuaacaaaggauggcauagcuuuucagcaaaguuaaugaaugagcuuauaccagaacuauacgcaaccucagacgaacaaaugaccauauuaacuagguuagaaaaauuuaaagugaaaaagaaaagcagcaaaaacauaaaaacaauugaugaaaaagaaauuacagaugaaauauacaauccaguaguagcaaaaaguguucgacagacaaucaaaauaauaaacgcagccgucaagaaauacggcgauuucgauaaaauagugauugaaaugccacgagacaaaaaugccgacgacgagaagaaauuuauaaauaaaaggaauaaagaaaacaagaaagaaaaagacgaugccuuaaaacgagcagcauauuuauauaauggcacagauaaacuucccgaugagguguuccaugggaauaaacaauuagaaacuaaaauuagacuaugguaccagcaaggagaacgaugcuuauacuccggaaaaccaauaccaauacaagaacugguacauaauagcaauaauuucgaaauugaucacauucuaccgcuuagccuuagcuucgaugauucauuagcaaauaaagugcuaguauauucauggacuaaccaagaaaaaggacagaaaacuccguaucaaguaauugacucaauggaugcggcaugguccuuuagagaaaugaaagaauacguacuaaaacaaaaaggacuuggaaagaagaaaagagauuacuuacuaacaacugagaauauagauaaaaucgaggucaaaaagaaauuuauugaacgcaaccuaguagacacccgcuacgccagucgcguaguacugaacucccuccaauccgcauuacgagaauuaggaaaagacacgaaaguaucaguaguacgaggccaauucaccucccaauuaagaagaaaauggaaaauagauaaaucaagagagaccuaucaucaucacgcgguagaugcauuaauaauagcagcaagcucgcaacuaaaauuaugggaaaaacaagacaauccaauguucguagauuaugguaauaaccagguaguagacaaacaaacaggagaaaucuuaaguguaucagauaaugaauacaaagagcuagucuuccagccaccauaucagggauuuguaaauaccaucaguagcaaaggcuucgaagacgaaauucucuuuaguuaccaagucgacaguaaauacaacaggaaagugagugacgcaacaauauacaguacaagaaaagcaaaaauaggaaaagauaaaaaggaagaaacauauguguuagggaaaauaaaagacauauacagccaaaauggauucgacacauucguuaagaaauauaauaaagauaaaacacaguucuuaauguaccaaaaagacccguuaacgugggaaaauguaauagaagucauccugggggauuauccaacaacgaagaaaucagaagaugggaaaaaugacguaaaauguaacccguuugaagaauaccguagagaaaacggcuuaauaugcaaauauucaaagaaaggaaaagggacaccaaucaaaagccuuaaauacuacgacaagaaacuaggcaauuguauagacauaacaccagaagaaagucgaaauaaaguuauauugcaaucaauaaauccguggagagcugacguauacuucaacccagaaacccucaaauacgaauuaaugggcuuaaaauacucagacuuauccuuugaaaaaggaaccggaaacuaccacauaagucaagaaaaauacgacgcuauaaaagaaaaagaaggaauagguaagaaaucugaguucaaauucacuuuguauagaaacgaucuaauacuaauaaaagacauagcaucgggagaacaggaaauauacagauuccugaguagaacaaugcccaauguaaaucauuauguagaacuuaaaccguacgauaaagaaaaauucgacaaugugcaagagcuagucgaagcgcucggagaagcagacaaaguaggucgguguauaaaaggacuaaauaaacccaacauaaguauauacaagguaagaaccgauguauuagguaauaaauauuucguaaagaaagaaggggauaaaccaaaacuagacuuuaaaaacaauaagaaauga

SEQ ID NO: 8626 - RNA, 3396 nt, Artificial Sequence
  Cas9 variant
auggcucaacacguauuuggacuagauauuggcauagcaucagugggaugggcaaucuuaggagaacagcguauaauugacuuagguguaagaugcuuugauaaagcagaaacagcaaaagaaggagacccacuaaacuuaacaagaagacaagcuagacuauuacgucggcgacuuuacagacgagcauggcgacuaacacaauuauccagauuacuaaaaagaaaaggacuaauagcagacgccaaacuauuugcuaaagcaccaucauauggugauagcgcuugggaacuucgaagacaaggauuagauagauuauuaacucccuuagaaugggcgagaguaaucuaucaccaaugcaaacaucgcggcuuccacuggaccagcaaagcagaggaagcgaaagccgauagcgaugcagaaggagguagagucaaacagggccuagcucacacaaaagcacuaaugcaagcuaaaaauuauaggucugcagcagaaauggugcuugcagaguuuccugaugcacagcgaaauaaaaggggucaauaugauaaggcccucaguagaguacuuuuaggagaagaauuagcucuacucuuugcuacacaacgaagauuaggaaauccacaugccucagacuucuucgagaaacuaaucuuaggcgauggagaucguaaaucuggauuauuuuggcaacagaaaccggcgcuaaguggagccgaccuccuaaaaauguuaggaaaauguacauucgaaaaaggcgaauaucgugcaccaaaggcaaguuuuucuguagaaaggcauguauggcuaacacgccucaacaauuuaagaaucguaguagauggacguagucguccauuaaacgaagcagaaaggcaagccgcacuucuacuuccauaccaaacagaaaccucaaaauauaaaacauugaaaaacgcauucauaaaagcgggucuauggggugauggaguaagauucggagguuuagcuuauccaagccaagcacaaauugacgcagagaaaacaaaagauccugaagaccaauuucuuguuaaauuaccagcauggcaugaacuacgaaaggcauucaaagcagccggucacgaagcgcuauggcaacaaaucaguacuccagcgcuagacggagacccaacauuauuagaucaaaucgcuaccgugcuaaguguauacaaagacggagcugaaguuguccaacaauuaagacaauuagcuuuaccagaaccagcagcuucaauugcaguuuuggagaaaaucaguuucgacaaauuuucaucucugucauuaaaagccuuaagaagaauaguaccauuaaugcaaucagguuuacgauacgacgaagcaguagcucaaauaccagaauauggacaucauagucaaaggaucgaaccaggcgccgcuaaacaucuauaucuaccgccauuuuacgaagcucaaagaaaguaugcgggaaaaggagaucauauaggaucaaugcaauuuagagacgaugccgauauaccacgaaaccccguuguucugcgcgcuuuaaaucaggccagaaaagugguaaaugcccuaaucagagaauauggaucuccaauagccgucaauauagagauggcaagagaccuuuccagaccauuagaugaaagaaauaaaguaaaaagagcccaagaagaauuucgagaucgaaaugauagagcccgaucugaauuugaacgugauuucggcuacaaaccaaaagcagcagcauuugaaaaauggaugcuuuauagggagcaacuaggacagugugccuauucacaacaaccacuggauauacaaagaguauuagaugaccauaauuaugcacaaguugaucaugcgcuaccuuauagcaggucuuaugacgacaguaaaaauaauaaagugcuaguacuuacacacgaaaaucaaaacaaagguaacaggacagcauuugaguaccuaacaucuuuuccagauggcgaagauggagaacguuggagaacauuuguugcauggguacaaggaaauaaagcauacaggauggcuaaaagaaaccgauuacuaagaaagaacuacgguguagaugaaagcaaagguuucauugaccgaaauuuaaaugauacacgguauaucugcaaauucuuuaaaaauuauguggaagaacaccuucaacuggcagcaagagcagauggagauacugcgagacgcuguguuguaguaaauggccaauuaacagcauuucugagagcaagauggggguuaaccaaaguacguggagacagugaucgacaccaugcauuagaugcagcaguggucgcugcaugcacucauggaauggucaaagcauuagcagauuauucaagacgaaaagagauaucuuucuuacaagaagguuuuccagauccagaaacgggagaaauacuaaacccggcggcauuugauagagcgaggcaacauuucccagaacccuggacucacuucgcccaugaacuaaaagcaagauuauucacugacgacuuagcagccuuaagagaagacaugcaacgacucggaucauauacaacagaagauuuaggaagauugcgcacuuuauuuguaucaagagcaccgcaaagacgauccggaggcgcaguucacaaagaaacaauauacgcacaacccgaaucauuaaagcaacaaggaggaguaauagagaaaauauuacucacuagcuuaaaacuacaagacuuugauaaauuauuaaaccccgaaagcaaugaucauuucguagaaccacauagaaacgaacggcuuuaugcagcaauccgacagagacuagaacaauuuggagguagagcagauaaagccuuugguccagauaacuuauuucauaaaccugacaaaaauaaccaaccgacaggaccagucgucagaucaauuaaguuaguaagagguaaacagacagggauaccaauaagaggaggcuuggcuaaaaacgauucaauguuaagaguagauauauucacaaaagcggguaaauuccaucucguuccaguuuauguacaucaccgaguaacaggacugccaaaucgagcgaucguugccuuuaaagacgaagaugaguggacauuaauagaugaaucauucgcauuucuauucuccguauauccaaaugauuacgucaaaguaacauuaaagaaagaacaacagaguggauacuauaguggagcagaucgaagcacaggagcaaugaacuuaugggcacacgaccgagcugcaucgguagguaaagauggucuaauacgcggcauaggcguaaaaacagccuuaagugucgaaaaauuuaauguggacguccucgguaggauauauuuggcgccaccagaaacacgcucaggacuagcauga

SEQ ID NO: 8627 - RNA, 3399 nt, Artificial Sequence
  Cas9 variant
auggcacaauauguauucggcuuagauauagggaucgcaagcguaggaugggcaguauuagacgcgcaaagaauaguugaucucggaguaagaugcuucgauaaagcagaaacagcuaaagagggagacccacuaaauuuaacaagaaggcaagcaagacuucucagacgaagauuauaccguagagcauggagauuaacacaauuagcccgacuauucaaacgugaaggucucauagacgacgcaaaauuauuugcaaaagcuccuucauggaccgaaaaugccugggagcuaaggcuaagaggacuugaucacuuguuaacaccucuugaaugggcuagagugauuuaccacuuauguaaacaucgagguuuucacuggaccaguaaagcagaagaagccaaagcugaauccgaugcugaaggaggcagaguaaaacaaggucuagcacauacuaaggcacuaaugcaagucaaaaauuaccgaucaacagcagagaugguauuggcggaauuuccgggagcacagagaaacaaaagaggccaauaugauaaagcauuaaguagaguacuacucggcgaagaacuagcucuacuauuugcaacucagcguagauuaggaaauccacaugcuucagaacauuucgaacaacucauuuuaggacacggggacagaaaaagugggcuuuucuggcaacaaaaaccagcuuuaucuggagcagaucuacuaaaaaugcuaggcaaaugcacuuuugagaaaacagaauaucgagcacccaaagcuaguuucucagcugaacgccauguaugguuaacuagacuuaacaaucuaagaauuguaguagacgggagagcuagacccuuaaacgaugcugaaaggcaagcugcacuacuccuccccuaucagacagaaacuuuuaaauauaagacacuaaaggcugcuuucguuaaaguaggacuguggggagaugggguucguuuuggaggauuggccuacccuagccaagcacaagccgaagcagaaaaagcuaaagacccugaagaucaauuucuagugaaacuacccgccuggcaugagcuuagaaaagcguucaaagcagcaggacaugaggcacuauggcagcaaauuaguaugccagcgcuagaagaagauccaacacuguuagaucaaauagcaacgguacuaucaguauacaaagaugguacugaaguaguucaacaauuaagacaacucgcauuaccugaaccagacgcuucaauagcuguucuggagaaaauuagauucgacaaguuuucuucucuaucuuuaaaggcuuuacgacgaauagugcccuuaaugcaaggaggacuacguuaugaugaagcaguugcacagauaccugaauauggacaucauucacaaagaauagauccaggagcaacgagacacuuauauuuaccuccauuuuaugaagcacaacgaaaauacgcugguaaaggagacagaauugguucuaugcaauucagagaagaugcagacgugccuaggaauccaguuguacuaagagcacuaaaucaagcuagaaaaguaguaaaugcuuuaaucagggaauauggaucaccaguugcaguuaacauagaaauggcaagagaccuaucgagacccuuagacgaaagaaacaagguuaaacgagcucaggaggaauuucgugauaggaacgauaaggcaagaagugaauuugaacgcgauuuugguuacaaaccuaaaggagcaguauuugagaaauggauguuauauagagaacaacuaggucaaugugcauauucgcaacagccuuuagauauccaaagaguauuagacgacccaaauuacgcccaaguggaucaugcacuaccuuauucuagauccuacgaugauagcaagaauaauaaaguacuuguauuaacgagagaaaaucaaaauaaaggcaauagaacgccauuugaauaccuaacaaguuuucccggaggagaagacggagaaagguggagagccuucguagcauggguucagggaaacaaagcauaucgaauggcaaaaagaaacagacuuuuacgaaagaacuaugguacggaugaaagucgaggcuucauugauagaaacuuaaaugauacaagguauauauguaaauucuuuaaaaacuauguagaagaacacuugcaguuagcagcuagaacggacggagauacagcacgacgaugcguaguaguuaauggacaacugacagcauuuuuaagggcaagguggggauuagccaaaguccgaggcgauucagauagacaucaugcgcuagaugcagcagucguagcugcuuguacucacgguauggucaaagcacuugccgacuacaguagaaggaaagaaauugcauuuuuacaagaaggguuucccgauccagaaaccggagaaauauuaaacuuagcagcauuugaccgagcacgagaacauuucccagaacccuggccccacuuugcucaugaauuaaaagcacgacuuuucauagaugaucucguggcccucagagaagauaugcaacaucuaggaagcuaugcccaagacgauuuagacagacuuagaacauuauucguaucccgagcaccccaaagaagaaauggaggugcaguacacaaaggcacaauauaugcucaaccagagaaccuuaaacaacaggguucaacaauagaaaagauauuauuaacaggacuaaaguuacaagauuuugauaaauuacucaacccagaaucaucagaccauuuuguagaaccacacagaaaugaaagacucuaugcggcaaucaggagacgauuagaagaauuugguggaaaagcagacaaggcuuuuggacccgauaaaccauuuuauaaacccgacaaaaauggccaaccuacggguccuauuguaaggucaauuaaauuaguaagagguaaacaaacagguauuccaaucagaggagguuuagccaaaaaugauaguaugcucagaguagaugucuuuacgaaagcaggcaaauuucaucuuguaccaguauauguacaucacagaguaacuggcuuaccagauagggcaauagucgcauucaaggacgaagaagaauggacauugaucgaugaauccuacgcauuccucuuuagcguauaucccaaugauuuuguaugcguacaacaacguggaaagcccuuaaucgaaggauauuacgcuggauuagaucgagcaaaugggaauauaaacguaugggcucacgauagagcagcuaguguaggaaaagauggacuaauaagaggaaucggaguaaaaacugcacuaucgcuugaaaaauuaaauguggaugucuuaggacguauauauccagcuccaccagagacucgcagaggacuagcauga

SEQ ID NO: 8628 - RNA, 3399 nt, Artificial Sequence
  Cas9 variant
augaagaaaauccuaggaguagaucucgggauaacaucauuuggauaugccaucuuacaagaaacaggaaaagauuuauaucgaugcuuagauaauucaguaguuaugaggaauaauccuuaugacgagaaaagcggagaaaguucccaaucaauaagaaguacacaaaagucuaugagaagauuaaucgaaaagcgaaagaaaagaauaaggugcguagcccaaacgauggaaagauauggaauauuagauuacagugaaacuaugaaaaucaacgauccgaaaaauaauccaauuaaaaauagguggcaauuaagagcagucgacgccuggaagagaccacuaaguccccaagaacuauucgcaauauucgcacacauggcaaaacauagaggauacaaauccaucgcgacagaagauuuaauauaugaauuagaacuggaauuaggacuaaaugacccggaaaaggaaagugaaaagaaagcagacgaaaggcgucaaguauauaaugcacuuagacauuuagaagaauugagaaagaaauacggaggagagacaauagcacaaacaauacaccgagcaguagaagcuggugaccuacgaucauacagaaaccaugacgacuaugagaaaaugauaaggagagaagacauagaagaagaaauagaaaaaguccuucuuagacaagccgaacucggagcccugggauuaccagaagaacaaguuucagaacuaaucgaugaauuaaaagccuguauuaccgaucaagagaugccaacaauagacgaaucccuauuuggaaaauguacauuuuacaaagacgaauuggcagcacccgcuuacucuuaucuuuaugauuuguacagguuauauaaaaagcucgccgauuugaacaucgacggauacgaaguuacccaggaagauagggagaaggucauagaauggguggaaaagaaaauugcgcaagggaaaaauuuaaagaaaaucacacauaaagauuugagaaaaauacugggauuagcaccugaacagaaaauuuuuggaguagaggacgaaaggauaguaaaaggaaagaaagaaccaagaacauucguaccauuuuucuuuuuggcagacauagcaaaauucaaagaacuauucgcaucaauacaaaaacacccagacgcacugcaaauuuuccgugaacuagcugaaauauuacaaagaaguaaaacaccacaggaagcucucgauagguuacgagcccuaauggcaggaaaaggaauagauacagaugacagagaauuacuagaauuauuuaaaaacaaacgaucagggacucgugaacuaucacauagauacauacuagaggcgcuaccacuauuuuuagaaggauaugacgaaaaagaaguacaacgcauacuaggguucgacgaccgggaagauuacucaagguauccaaaaucauuacgucacuuacacuuaagagaaggaaaucuauucgaaaaagaagaaaauccaaucaauaaucacgccguuaaaucauuagcaucaugggcauuagguuuaauagcugaucuaaguuggcgguaugguccuuuugacgaaauuauacuagaaacaacacgggacgcccuaccagagaaaauucgaaaagaaauagauaaagcuaugagagaaagagaaaaagcguuagauaaaauaauuggcaaauacaagaaagaauuuccgucaauagacaaaagacuagcgagaaaaauacaacugugggagagacaaaaaggccucgaccucuacucuggaaaaguuauaaauuuaucccaacuacucgacggcagugcugacauagaacauaucguaccacaaucauuagguggauuaucaacagacuacaacaccauaguuacacuaaaaucuguaaaugcagcaaaaggaaaucgauuaccuggagacuggcuugcaggaaauccagacuacagagagagaauagguaugcucagcgaaaaaggacuaauagauuggaagaaacguaaaaauuuacuagcacaaucccuagacgaaauuuacacagaaaauacccauucuaaagguaucagagccacaucauaccuagaggcuuugguugcccagguacuaaaaagguauuacccauuccccgaccccgaacuaaggaaaaacggaaucgguguaagaaugauaccagggaaaguaaccucaaaaacuagaucauuacuagggauaaaaagcaaaucuagagaaacaaacuuucaucacgcugaagacgcuuuaauccuaucaacauuaacuagagguuggcaaaacaggcuucacagaaugcuaagggauaacuauggcaaaagcgaagcagaauuaaaagaauuauggaagaaauacaugccucacauagaaggacuaacccucgccgacuacauagacgaagcauuucgacgauucaugaguaaaggugaagaaaguuuauucuauagggacauguuugacacuauaagaaguaucaguuauuggguagacaagaaaccacucucagcgucaucacacaaagaaaccguuuauucuaguagacacgaaguaccuacauugaggaaaaacauauuagaagcauucgacucacuaaacgugauuaaagaucgucacaaauuaacuacagaagaauuuaugaaaagauaugauaaagaaauccgacaaaaacuaugguuacauagaauagguaauaccaaugacgaaucuuauagagcaguagaagaaagggcaacacaaauagcgcaaauuuuaacacgauaucaacuaauggaugcacaaaacgacaaagaaaucgaugaaaaauuucaacaagcacuaaaagaauuaauaacaucgccuauagaaguaacgggcaaauuacuaaggaaaaugcgcuuuguuuacgacaaacuaaaugcaaugcaaauagaccgaggccuaguagaaacagauaaaaauaugcuaggaauacacauuaguaaaggaccaaaugaaaaacuaauuuuuagaaggauggauguuaacaaugcacacgaguuacaaaaagaaagaucaggcauucucuguuaucugaacgaaaugcuuuuuauauucaacaagaaaggacuaauacauuauggcuguuuacgcucauaucuagaaaaaggacaaggaaguaaauauauagcacuuuuuaacccaagguucccagcaaauccuaaagcccaaccgagcaaauucacuucagauucuaaaauaaaacaagucgguaucgguucugcaacggguauaauaaaagcgcaccuagauuuagacgggcacguaagaucauaugaaguuuucggaacacuaccugaagguucaauugagugguuuaaagaagaaagcggauacgggagagucgaagaugacccacaccauuga

SEQ ID NO: 8629 - RNA, 3402 nt, Artificial Sequence
  Cas9 variant
auggaucugaacuaucguaucggacuagauauuggcaucgcaagcguaggaugggcagugcuugaaaacaacaguaaagaugaaccaguacguaucguagaucucggagugcguuuauuugaagcugcagaagucccgaaaacaggagcugcauuagcagaaccaagaagagaagcaagaacgacucgaagaagauuaagaagacgaaaacauagguuagaacguaugaaaugguuacuacaagaauauggacuaauucaaacagaagaguucaugaaaagguaucacucggcaggacuaccagauguuuaucgauuaagauaugaaggauuagaacgaaaacuaaaggacgaagaauuagcacaaauccuaauacauauugggaaacauagaggauuuaggucaacuagaaaggcugaguuaaaagacaaaaaugauaaagaaacaggagcuguacucucagcaacaagggaaaacgaaaaguuaauggaagaacacgguuauagaacugccggugaaaugauauacaaagacgauaaauuucguacagguuguacuuggaaagaagagggauauagauuaacaccacgaaacaaagagggagauuauaaaaauacuaugcugagagcacuauuagaagaugaaguaaaaguaaucuuugacugucaaagaaaauucggaaaucaaaaagcaagugaagaacuagaaaaagcauauuuagcaauaaugacaucacaacgaucauuugauauggguccugguaagcaaccagacggaucagcaucaccauaugcaauggaaggauuuggagauagaguuggacuaugcgcauuagaacccagagaaaaacaggaaccuagagcgcccaaagcggcauauacaagugaguuauucgucgccuuacagaaaaucaaucauuuaagaauaacagagaagaacggaaaaggaaggggacuaacaagugaagaacgagaaagguuaagugaucuacuucauaagaagaaagaauugaccuauggagcaguuagaaaagaacuccaacucgaccuuagguauagauucaauacauugaacuacucaucaaagaaaaugacagaagaagagaaaauaaaagaugcagaaaaagcuaaauuugucucaaugguuagucauuaugaauacagaaaacggaugagcggaauguuagaacaacugucaccagaagaacaagccgacuuaauggacgaaguaggaaaaauacuaacacuuuauaaaaacgacgacacaagaucacgcgaauuucaaaaacuagguuuagauucggaaauaacagaagaauuacuggaacugaacccacgcggauuucaacauguaucacucaaagcgaugaagaaacucaugccguauuuaaaagaaggauuaacauaugacaaggcuugugcagaagcaggauacgauuuccaaggaaguguacaaaaagaaagaucaaggcuacugaaagggaaagaaauaacagauauuauaaacgauauuaacaauccaguagugaaaagaagcguaucccaaacgguaaaaguaauaaacgcaauaauucagaaauauggaaguccacaggcagugaauauugaacucgcucgugaaaugaguagaaacuacgacgaaaggagaaaaauggaaaaacaaaugaaagacagacaaagugaaaaugaaagagccaaaaaggaaauacaagaauugggaaacgcauuuccaacaggccaagauauauuaaaauauaggcuguggcaugaucaagauggcauaugcauguauagcgcaaaaagaauaccacuagcagaauuauucacgggagcauaugauauagaucacauauuaccauacucaauuacguuugaugacucauacagaaauaaagugcuaguuacuucagaagaaaacagacagaaaggaaaucgaauaccguaugaguacuuugguucagauucagaacgauggucuaaguucgaaaccuuagugaauagcagaauacgcgauuacagaaaacaacaaaauuuacuuaaacaaaguuucacugaagaagaaagaaaggaguucaaacaaaggaaucuaaaugauacuaaguauauuacacguguaauauacaacaugauaagagaaaaucuagcauuagcaccuuauaauagcccaggaaagaagaaacaaguguuugcggugaacgguggaguaaccgcauaucuucgaaaacgauggggaaugucagcaaaagauagaucaauagacacccaucacgcaagagacgccgugguaauagcuuguugcacggacggaaugauacagaaaaucuccaggaauauacaaggucgugaacuguuauaugcuagagguuuuacugcaguugauguagaaacuggugaaaaauuuacuagggaugauuucacaagagaucaaugggaugaaauauucggaguacaaguacccaaaccaugggaguauuucaaugaagaacucgauauacgauuaggggaaaauccaguagaguuuauagaaacucacucugacguaaguaggaaauuagauuauccagcaugguucuaugaaaacaacauaauacgaccuguauucguaagcaggaugccaaacagaaaggucacaggagcagcacaugcagauacaauccgaucaccuagacauuaucaagaaacuggaucaguucuuacaaaaacagcccuaauugaucuaaaacugaacaagaaaacaggggaaauagaaaauuauuacaaaccagaaucagauacucuauuauacaacgcauugaaagaaagacuggaacuuuauggcggugauggcaagaaagcguuugaagaaccauuuuacaaaccaaaagcugauggcaguagaggaaacuugguacgaaaaguaaaaacauacgauaaauuaacguuaggaguauacguaaauagccaacauggcauagcagcgaaugcaaaugggucaaugguaagagucgacguuuucagaguaucagguaaguauuauuucguuccuguauauauagcggaugucguacggaaaagacucccaaugaaggcuguuguccaaggaaagcaauauauagauuggaaagaaauggaggauaaagacuuuauauuuucauuauauacaagagauuuaaucaguuucaagaguaaaaaugggaagaaagugaccuguguugacggaacaucgaaagcagucaaugaagagauugucuauuauuauggcgcaaacaucucaacggcuaguuucucgggaaaaagucacaauggcaguuucgaguuuacaagccuaggcauucaaggauuggaauacuuaaagaaauaucaaguugauguccucgguaauguaucugaagucaaaagagagaaaagaaugggauuccguuga

SEQ ID NO: 8630 - RNA, 3402 nt, Artificial Sequence
  Cas9 variant
auggggggauucgaaguugacagaaaaauaucacuuggacuugauauaggaguaucuucaguagguuauuccgucauagauguggacacaggaaaaguucucgaacucgguucaagacuuauaaaugguaaaauugguacagaaaaccaagcuagaagagaaaugagaggcacuaggagacuaauuaaccgaaaaaaacaaagaagaaaagauacuguaaaauuauucaaugaauucaaacuaaucgacaguaagaaagaugaacauuacuucgaccacuucgcaaacaacagcgacccauacgaacuaagagucaaaggacuaucugaaaaacuuaguuugucagaaauagcagacggacuauaccacaucgugaaacgaagaggaauaucauaugaccuaaaagacgcugaugaagaaucagaagguucagaauaugaaaaugguuuaaaaauaaauaacuccgaauuaaaaaaucaaacaccagcgcaaauucaacucaaaagacuaaacgaguacggcgcuaucagaggaaaaguagucauagaugaagaaaaaaucuuacuuaacguuuucccaaccaaagcuuaucucgacgaagcaaaaagaauaauugaaaagcaaagagaauucuacccaggaauccuaaccgaagaauucgaagaaaaauauugucaaauacuaacacgaaaaagggauuacuuuguuggcccuggcuccgaaaaaucgcgaacagacuauggaauuuauaaagaagacggacgcacucuuaauaacuuauucgaagaauuaauaggacacgacaagauuuauccagaagaacucagagcauccggcgcaucauuuacggcacaauuauuuaauguauugaaugaccuaaauaaccuucauauaucaucuuaugaagaccaaaaacuuacaacggaaaacaaagaacaaauaauaucagaauuaaaaucaacaacaucuaacguaaacaugaugaaacucauccagaaaauagccgguugcgaagaaucagacauuucagguuacagaacugacaaaaacuauaaacccgaaauuucaagcaugcggauauaucgaaaaguucacaagaaacucuuagaaucagagauagauauuacaaauuggccagacgauuuuauuaauaaauuaucauucauuuuaaccuuaaacacugaaaacggagaaauacgaaaccaacuaaaaaauagauugcagcccgaauacgacuucuuaaccgaugaacugauacagacgauaauagauaacaaagaaaguuucgauauaaaaagcaauaacaaauggcaucgguuuucaauaaaaacaauggaauuauuaaucccagaaaugauuaaaagaccuguagaacaaaugacccuaaucaacgaaaugggacucauaaaaaacucagguaaaaaauucuccaacuacaaauaccuaccauauaaaaaaaucgcagaagacauauauaauccuguagcaaguaaaaguguacgagaagcacucaaaauaguaaaugcaaucuuaaaagaauacggccauauugaauacauagucgucgaaaugccacgugacaaaaaugaagacgaagcaaaagaccaaauagaaaaauuccaaaaggcaaaugguagacuaaaagaugcagcccuugaagaguucacagaagcuauuggcgacaaaucaaccguagauaaaaaauuagguguucauagaucaaaauuacuauucaagauaaggcuaugguaccaacaacguggcauggauuuauaugaaggcaaaccuauaagugcuguagaccugcuuaauaaccccgacagcuuccaaaucgaucauauaaucccccaaagcguaucauucgacgauucauucaacaauaaaacacuuuguaauaguggccucaaucaaauaaaagauaagaaaacaccauuugaauacaugaacgaaggauauggacaagguuucgauagcaugaaagcaaugguaaugaagaacccaagaauagaucacaauaaaagaaaaaacuaccuauucagugaaaacguuagcgacauagaaacucgaaaaagauuuauuagcagaaaccucguagauacccgcuacgcaucaagaguaguucuuaauaauuuacaggaauuuuuuaaagaaaaggaaucagacacaaaaauaagcauaauacgaggaaaauucaccucaaaucuuagaaaacacuggaaaaucaauaaaaacagagauaccuaccaccaucaugcgaucgacgcaacaauaauagcugccacgccauuccuaaauauuuggaaaaaaggcuccucaauauuuccaucaaacguggaaucagaagacuuuuucgauauaaaaacaggaaagauaauaggaaaugacgaauucaauaaguaugcauacgaugaaccauacaauggguuuuacaacgaguuaagaaaugcaacagaccggauaaaauuuucucaucaaaucgacaagaaaaugaauaggaaagugucagacaguacaauauacucuacuagaguagcaaaaucaccaaaaaauaaaaaagaaagcgaauacaucgucgccaaaauaaaaaacauuuaugacgcagacgaauacgcaaaauucaagagaauauacgacaaagauaaaacaaaauuucuacucaauaaauacgauccacgaucauuuaaccacuuagaaaaaauaaugaacacauacccagauuccauagaaaggacaaugucaaacaacaagguaaaaguaguacgaauaagcccuuuugaauuauaucgacaggaccauggcccaguaaaaaaauacagcaagaaaaacaaugguccagagauaaagcaauuaaaauacuuagacaaaaaaguaggaagcaguauagaugugacuccagacaacgccaaaaauaaacaugucauacuaaaaucacuaaaaccauggagaacagacauauaccuaaaccacgaaaccggcgaauaugaaauaaugggaauaaaauacucggaccucaaauucaauaaaggagaaggguacggaauuaaaaaagcaaaauauuuagaaauaaaacauagagaaaaaguaagcgaugauucugaauuuauguucacauuauacaaaaaaaaccgaauaaaaguagaaaacauggaaacagaugaaagcguagaaauguuauucuggucaagaacuauggauucacaaaaaggauaugccgaacuaaaaccaauauacaaauacaaaacagaagacgacaacuggccgauauaugggaaugcaaagaaacaaauaauaaagaaauuaaucccuaaaaacugcaaaauauggaaaguuaauacagauguucuaggaaacccauuuuacguagaaaaagaaggagaauacccaaaagauguacuagacuga

SEQ ID NO: 8631 - RNA, 3405 nt, Artificial Sequence
  Cas9 variant
augaacggauugguccuuggcuuagauauaggaauagcaucugucggcguaggaauuuuagagaaaaacuccggaaaaaucguacacgccagcuccaggauauucccggcagcaacggcugacaauaauguagaacgaagaaagaacagacaagcacgacgacugcaucgacgaaagaaacaucguggcgcacgguuaaaagacuuauuugaauacuacggccuacuaacagacuucagcaagguuaguauaaaucuaaauccuuacagacuaaggguagacggacuagaucaacaauuaacuaaugaggaacuauuuauugcacucaaaaacauaguaaaaagacguggcauaucguaucuagacgacgcaagugaagacggagggacagucucuagcgauuauggaaaagcgguagaagaaaauagaaaacucuuagcugaacaaaccccaggccagauccaauuagaacgauucgaaaaauauggacaacuaagaggcgacuucacagucguagaaaacucagagaaauguagacuaaucaauguauucagcaccucggcauacaaaaaggaagcugaacgcauacuacgaaaacagcaagaguucaauaaucaaauaacagacgaauuuaucgaagacuaccucaagauacuaacagguaaaagaaaauacuaccacgggccaggaaaugagaaaagucgaacugacuacggaagauuccgaacagacggcgccacauuagacaacauauuuggcauccuaaucggaaaguguacauuuuaccccaaugaauacagagcuaguaaggcaagcuacaccgcacaggaguucaaccuacucaacgauuuaaauaauuuaacaguaccaacggaaacaaagaaauuaucagaagaacaaaagaaaacuauaauugaauaugcaaaauccgcgaaaacccucggagcaucuacacuauuaaaauauauagcgaaaaugaucgacgcaaguguagaucaaauacgaggguacagaguagauguaaacaacaaaccagaaaugcauaccuuugaagucuauaggaaaaugcaaucccuagaaaccauaucuguaggcgaacuaaguagaaacauacuugaugaacucgcucauauacuaacacuuaacacugaaagagaagggauagaagaagcuaucaauaccaaacuaagagauucguuuucccaagaucagguacuugagcuaguacaauuucguaaaaauaacucaagccuauucaguaaaggcuggcacaacuucaguuuaaaacuaaugauggaacucaucccagaacucuaugaaacauccgaagaacaaaugaccauacuuacaagacuaggaaaacagaaaaguaaagaaacaaguaaaagaacuaaauacauagaugaaaaagaaguaacagaagaaauauacaacccuguaguagcuaaaucagucaggcaagcaauaaaaaucauaaaugaagccacaaagaaacacggaauauuugacaauauaguuaucgaaauggcuagagagaacaaugaagaagaugcaaagaaagauuauauaaaacgacaaaaagcaaaucaagaugaaaaauacgccgccauggaaaaagcagccuuccaauauaaugguaagaaagaauuaccggacaacauauuucauggccacaaagaacuagcaacaaaaauacgucuuuggcaccaacaaggagagaaaugccuauacacaggaaaaucaauaccaauaagcgaccugauacauaaccaauacaaauacgaaauugaucacauauuacccuuaucucuauccuucgacgauagccuaagcaacaaaguacucgucuuagcaacugcaaaccaagaaaaaggacaaagaacaccuuuucaagcacucgacaguauggaugaugcuuggucauauagagaguucaaaagcuauguaaaagaaucaaaacuucuaggaaauaaaaagaaagaauauuuauuaaccgaagaagauauuucaaaaaucgaaguaaaacaaaaauucauugaaagaaaucuaguugacacaagauauaguagcagagugguucuuaacgcauuacaagacuuuuacaaaaaucacaacuucgauacaacaaucagcgucgucagaggacaauucaccagucaacuaagaagaaaauggggacucgagaaaagccgagaaacauaccaccaccacgcaguagacgcacuaauuauagcagcaucaagccaauuaagacuauggaagaaacaaaacaacccacugauagcuuauaaagaaggacaauuuguagauagccaaacgggcgaaauuaucucacucacagacgaugaauauaaagaauugguguuuaaagccccauacgaucacuucguagacaccuuaagcagcaaaaccuucgaagauucaauccucuuuucuuaucaaguagacuccaaauuuaauagaaaaauaucugaugcuacuauauaugcaacacgcaaagcaaaacuugacaaagaaaagaaagaauacacguacacacucggaaaaauaaaagauaucuauagcuuagguacgaaaacaccaagcaaaacaggauuuuauaaauuccucgaucuuuacaauaaagacaaaucucaauuccuuauguuccaaaaagacagaaaaacaugggaugaagugauagagaaaaucauggaacaauaccgaccauucaaagaauacgacaaagcagguaaauuaguagauuucaacccauucgaaaaauaucgccaagaaaacgguccgauacguaaauacucaaagaaaggaaacggacccgaaaucaaaagucuaaaauauuacgauauacuacuagguaaacauaaaaauauaacaccagaaggaucacgaaauacaguagcccuacuauccuuaaacccauggagaacagauguuuauuauaacauggaaaccaagaaauacgaguuccuaggacuuaaauacgcagaucuaccauucgaagaaggaggagcauaugggauaucaacagaaacauauaacgaauuacgugaaaaagagggaauuggcaaaaacucugaauuuaaauucacacuauauaaaaacgacuuaauauuaauaaaagauacggaaacaaacugccaacaauucuuuagguuuuggagucgaacaggaaaagauaaccccaaaucauuugagaaacacaaaauagaacucaaaccauaugaaaaagcuaaauuugaaaagggcgaagaauuagagguucuaggcaaaguuccuccaaguucaaaucaauuucaaaagaauaugcaaauagaaaacuuaagcauauacaaaguaaaaacagauguacuaggaaauaaacacuucauaaagaaagaaggcgacaaacccaaacucaaauucuga

SEQ ID NO: 8632 - RNA, 3405 nt, Artificial Sequence
  Cas9 variant
augaacgggcuaguguugggacuagacauuggaaucgcuucaguaggagucggaauuuuggagaaaaauucuggcaaaauaauacacgcaaacuccagauuauuuccagcagcgacagcagauaacaacgucgaacggcgaaagaaucgacaagcuagaagauuaaacagaagaaagaaacauagaggcgugagauuccaagaucuguuugaagacuacggauuacuaacagauuuuucaaaaguaaguauaaacuuaaauccuuacagacuaagagucgauggccuaaaccaacaauuaacaaacgaagaauuauuuauagcuuuaaagaacaucguaaaaagacgaggaauaaguuauuuagaugaugcauccgaagauggaggcgccgucuccuccgauuacggaaaagcggucgaagaaaaucgaaaauuacuagccgaacaaacgccaggucaaauacaauuagaacgauucgaaaaauacggucagguaagaggagacuucacaguuguagaaaacggugaaaaacuucgauuaauaaaugucuucuccacuucagcauacaagaaagaagcagaacgaauacuuagaaaacaacaagaguucaauaaucaaaucacagacgaguucauagaagacuaccugaaaauacuaacagggaaaagaaaauauuaccacggaccaggcaacgagaaaagcagaacggacuacggaagguucagaaccgacggaacuacauuagauaacauauucggcaucuuaauaggaaaauguacguucuacccugaagaauaccgcgcauccaaagcaucauauacagcccaagaauuuaaucuccuaaaugaccuaaauaauuuaacgguaccaacagaaacaaagaaauuaagugaagaacaaaagaaagugauaguggaauaugcaaaagaagccaaaacauuaggcgccagcacucuauuaaaauauaucgcgaaaaugauagacgcaucaguagaccaaauuagaggauauaggguugacgugaacaacaaaccagaaaugcauacauucgaaguuuaucgaaaaaugcaaucauuagaaacaauaucugugggcgaauuaucacgaaacguccuagacgaacuugcacacauauuaacacuaaacacagaaagagaagggauggaagaagcaauuaauacuaaacuaaaagacagcuucagccaagaccaaguccuagaauuaguacaauuccgaaagaauaacaguucuuuauuuucuaaaggauggcauaauuuuucauugaaacuaaugauggaauuaauaccagaacucuacgaaacuucagaagaacaaaugaccauccuaacacgauuaggaaaacagaaaaguaaagaaacaaguaaaagaacaaaauauauagaugaaaaagaauuaacagaagaaauauauaauccagugguugcgaaaucaguaaggcaagcaauaaaaauaauuaacgaagcgacuaagaaacacggaauuuucgacaacauaguuauagaaauggcucgcgaaaacaaugaagaagacgcaaagaaagacuacauuaaacgucaaaaagccaaccaagaugagaaaaacgcugccauggaaaaagccgcauuccaauauaauggcaagaaagaacucccagauaacauauuucauggacacaaagaacuagcaacgaaaauacgacuauggcaucaacaaggcgaaaaaugcuuauauaccggaaaaacuaucccaauaucagaucuuauacacaaucaauacaaauaugaaauagaucacauccuaccgcuuagcuuaaguuuugacgauucacuaagcaacaaagugcuggugcuagcaacagccaaccaagagaaaggucaaagaacaccguuucaagcacuggacucaauggaugacgcguggaguuacagggaguucaaaucuuauguuaaagaaucaaaacuauuaggaaauaaaaagaaagaauacuuauuaacagaagaagacauuucaaaaauagaaguaaaacaaaaauuuauugaacgaaauuuaauagauacucgauacucaucacgaguaguauuaaaugcucuacaagauuucuacaaagcacacaaauucgacacaacaauaagcguuguaagaggccaauucacaagucaauuaagaagaaaauggggguuagaaaaaucucgagaaacuuaucaucaucacgcagucgacgcuuuaauaauagcagcgucaagucaauuaagacucuggaagaaacaaaauaacucauuaauaagcuacaaagaaggacaauucguagauucagaaacuggugaaauaaucucacuaacagacgaugaauauaaagaacucguguucaaagccccauaugaccacuucguagacacucuucgaucaaagaaauucgaagacagcauucuauuuagcuaccaaguggauucgaaauuuaaccgaaaaauaucagacgcaaccauauaugcuaccaggaaagcgaaauuagauaaagaaaagaaagaauacacauauacccuaggaaaaauaaaagauaucuauucgcuaggaaccaaagcaccaucgaaaacuggauuuuauaaauuucuugaccucuacaacaaagauaaaucacaauuccugauguuccaaaaagaccguaaaacgugggaugaggugauugagaaaaucauggaacaauacagaccauuuaaagaauacgacaagacaggaaaacugguagacuucaauccguucgaaaaguacagacaagaaaacgguccaauccgaaaguacaguaagaaagguaauggaccugaaauuaaaucacuaaaauacuacgacauacuacuaggaaaacauaaaaacauaacaccggagggaucaagaaacaccguugcacucuuaagccuaaacccauggagaacggauguauauuacaacauggaaacgaagaaauacgaguuccuaggacuuaaauaugcagacuuaccauucgaagaaggcggggcuuacggaaucucaacagaaacguacaaugaacuccgagagaaagaaggaauagggaaaaauagugaguucaaauuuacauuguauaaaaacgaucuaaucuuaaucaaagacacagaaacaaacugccaacaaauuuuuagguucuggucaagaacagguaaagacaacccaaaaucauuugaaaaacauaaaauugaauuaaaacccuaugaaaaagcaagauuugaaaaaggagaagaacugaaaguuuuaggaaaaguuccaccuagcucgaaccaauugcagaaaaauaugcaaauagaaaauuuaaguauauacaaaguaaaaacggacguacuaggaaauaagcacuuuaucaagaaagaaggagacgagcccaaauuaaaauucuga

SEQ ID NO: 8633 - RNA, 3405 nt, Artificial Sequence
  Cas9 variant
augaauggacuaguccuaggauuggacaucggaaucgcaucaguaggagucggaaucuuagaaaaaaauucgggaaaaauaauacaugaaaacuccagacuguucccagcagccaccgcagacaacaacguagaaagaaggaaaaacaggcaggcaagacgauuaaauagaagaaaaaaacauagaggagugagauuucaagacuuauucgaagacuauggucuguuaacagacuucagcaaaguauccaucaaucucaacccauacagacugagaguagacggcuuaaaccaacagcuuacgaaugaagaacuguuuauagcauuaaaaaacauagucaaaagaagaggaauaaguuaccuagaugacgcaagcgaagacggaggcacuguaccauccgacuauggaaaagcgguuaaagaaaacagaaaacuauuagcagaaaaaacaccaggacaaauccaacucgaacgguuugaaaaauauggacaauuaagaggugacuuuacggucgaagaaaauggagaaaaaugcagacuaauuaauguuuuuaguacgucagccuacaaaaaagaagccgaaagaauucuccgcaaacaacaagaauuuaauaaccaaauaacaaacgaauucauagaagauuaccucaaaauuuugaccggcaaacguaaauauuaucaugggcccgguaacgaaaagagcagaacagacuauggaagguuuagaacagacggcaccacacuggauaauaucuucggaauucucauugguaaaugcacuuucuauccugaagaauauagaguaucaaaagcuucauauacagcucaagaauucaacauacucaacgaccuuaacaaucuuacaguccccaccgaaacaaaaaaauuaucagaagaacagaaaaaagauauagucgaguacgcaaaagaaacgaaaacccuaggagcaucaacacuacuaaaauauaucgcaaaaaugauagaugcauccguagaccaaauaagaggauauagaguugacguaaauaacaaacccgaaaugcacacauucgaaguauacagaaaaaugcaaagcuuagagacaauaucaguaggugagcuaucacggaacguccuagacgaacuagcacacauauuaacacugaauacagagcgagaaggaauagaagaagccauaaacacaaaauugaugggcguuuucucacaagaccaaguacuagaauugguucaauucagaaaaaacaacucaagccuauuuucaaaaggguggcauaacuuuucucuaaaauugaugauggaacugaucccagaauuauaugaaacaagugaagaacaaaugacaauauuaacuagauuaggaaagcaaaaaaguaaggaaacuucuaaaagaacaaaauacaucgaugaaaaagaaguaaccgaagaaauauauaauccuguaguagccaaaucaguaagacaagcaaucaagauaaucaacgaagcaacuaaaaaauacgggauuuucgacaauaucguaauagaaauggcaagagaaaacaaugaagaagacgcgaaaaaagauuauauaaaaagacagaaagcaaaccaagacgaaaaaaacgcagcaauggaaaaagcagcauuucaauauaaugguaaaaaagaauuaccugacagcauuuuucacggacauaaagaauuagccacaaaaauccgacuuuggcaccagcaaggagaaaaaugucucuauacaggaaaaaauauacccauaagugacuuaauucacaaucaauacaaauacgaaauagaucauauacuacccuuguccuuaucauuugacgacagccuaucaaacaaaguacucgugcuagccacagccaaccaagagaaaggacagcgaaccccuuuucaagcgcuagauuccauggacgacgccugguccuaucgagaauuuaagucuuacguaaaagacuccaaacuauuaaguaauaaaaaaaaagacuacuugcucacggaagaagacauuucaaaaauagaaguaaaacagaaauucauagaaagaaauuuggucgacacccgauacaguuccagaguaguacucaaugcucuucaagauuucuauaaggcucauaaauuugauacaacaauaaguguaguaaggggacaauuuacgucucaacuucgccgaaaauggggauuagaaaaaucacgagaaacauaccaucaccaugcagucgacgcauuaauaauagccgcgucaagucaacucagacuuuggaaaaaacaaaauaauccauuaauaacauacaaggaaggacaauuuguagauucugaaacgggagaaauaauaucacuaacagaugaugaauacaaagaauuaguauucaaagcacccuacgaucacuuuguagauacauuacgaucaaaaacuuuugaagauucaauuuuauucucauaccaaguagacucuaaauuuaauagaaaaaucucagacgccaccauauacgcaacccgaaaagcgaaacuagacaaagagaaaaaggaauacacuuauacucuaggcaaaauaaaagauauauacucacuaggcacaaaaacaccaaguaaaacuggauucuacaaauuuuuagaucuauacaauaaagauaagagccaauuccuaauguuucagaaagacagaaaaacaugggaugaagucaucgaaaaaauaauggaacaauauagaccguucaaagaauaugacaaaacuggaaaguuaguagacuucaacccauuugaaaaauauagacaagaaaacggaccaauaugcaaauacaguaaaaaaggaaauggcccagaaaucaagucguuaaaauacuacgacauacuacuaggaaaacacaaaaauauaacaccggaaggcucaagaaacacagucgcacuucuaucacugaacccauggcgaacugauguauacuacaacauggaaacuaaaaaauaugaauucuuaggucuaaaauaugcagacuuaccauucgaaaaaggcggcgccuacgggauaagcacagaaacauacaauaaacuaagagaaaaagaagguauagguaaaaacagcgaauucaaauuuacguuguauaaaaaugaccuaauucuaauaaaagacacagaaacgaauugucaacagaucuuccgauuuuggucaaggacaggaaaagauaacccgaaaaguuuugaaaaacacaaaauugaauuaaaacccuaugaaaaagcccgcuuugagaaaggugaggaauuagaaguauuaggaaaaguaccuccaagcucaaaucaauuccaaaaaaacaugcaaauagaaaaccucagcaucuauaaagugaaaacagauguauuagguaaaaaacacaucaucaaaaaagaaggagaugaaccaaaacuaaaauucuga

SEQ ID NO: 8634 - RNA, 3405 nt, Artificial Sequence
  Cas9 variant
augaaauacaucgaaucgguaucuauagguuuugauauaggcguuggauccguuggcuacgcuguaaucaacuccaaaacgaaacagauacuagaaucagguguaucaauauuccccgcggcuguugcacagaaaaauguggagaggagagaaucaagacaaaguagaagauuaagacggagaagaguaaauagauuaaacgaucuaaaaaaauuacuaaaaaaaaacggauucaucccauccccaaacaaaaauccauacgaaauccgaguuagaggcuuagaacaucagcucucacgagaugaaauagccaucgcaguuuuacauauugcuaaacgaagaggaauaucauacagcuuagaugaugugguugacgaaaacguaacugauuucaaaggaaaaauagcaaaaaaccaagaagcacuaaagaacaaaacgccuggagaaauucaauaugaacguuuguuaaaauacggaaaaguccgaggaacagucaccaauuacguagaauacgaugaacaaccagaauacuuuuuaaacguuuuuccaaacucagccuacgucgaugaagccaaaaggauauugacaugccaaaaacaauacuauccagaaauaacagacgaucuaaucgaaaacauaguaaaaauaauaucaaggaaaagggcauacuauaucggaccaggaaacgaaaaaaguagaaccgacuacggaauauaccgaacaaauggcgaaacacuagaaaauauauuugagauccuaaucggcaaagacuccguaaauccagacgaacucagagcuccagcaaauucacuaaccgcucaaguauacaaccuacucaacgaucuaacuaauauaagguacaacgguucugaacgccuaacacccgaacaaaagcaagacauacuaagugaacuuuuaaccacagaaaaaacaguacaaauguuaaaugucauagcgaaaaaaguuaaugucaaaaaagaagagaucucaggauuuagaacaaaaaaagacgacaagcccgacuuccacacacucgaaguauaucguaaaguacgaaaacacaugcuaaacaaaggcaucgacauuaacgaauggccaacagaaugcuucgacgaacuagccuucauauucaaucuaaacaccgaaauaggagaaauacgcaacaggauaucggaaaaaguaguaccaaaauaugauuucaucacuaaucaaauagucgacgaccuuuuagaagaccccaaaauauucgcaaucaguacuagucaaaaauggcacagauuuaguauaaagacaaugaacguauuaauaccagaacuuuuaaacggcuauaaugaacaaaugacaauucuaaccaggauggguuuauuagaagauagcaaaaacgacuauuccaauauugacaaaauagauauaaaaaacguaacugaaaacauauacaaccccguagucagaaagucaauaaaaaaaugucuaaaaauauucaacgaacuauacaaaaaauauccuaauaucucggacguaguuaucgaacuaccaagagaagauaacccugaagaugcuagaaaacuaauaaaaaaaaugcaaaaagaaaacuuagucgaaaaagacacaucacucgaagccuuucgcaaagaagcgaaccuaucagaaaacgguuuaaucgauuuccuaagaaaaggaaaaaauagggcucuaaaaauaagacuaugguaucaacaagaaggaaaaugccucuacacaggcgaaccaauauuagcagaagauuuaugcaaaaacgaagcuaacuacgauaucgaccacauaauccccaucucaguuaguuuugacgacucaauuaauaacaaaguccuaugcucuucacauuuuaaccgcuucgaaaaagaaaaaaaaacaccauucgaguacuucucaaacaaaagcucucaucuaggacgauauuccaauuuugaugaauuuagagccucuguaaaugcaaacaaaagaauuagcgacguaaaacgcaaaaauuuacuauccaaggagcuccucagcgaucucgacacacgaaagaaguucauagcaagaaaccuugucgacacacgcuaugccaguagaguaguauuuaacgaacugacucaauuuuucgcauccaaaaaagccgacacgaagguagcuguaauaagaggaaaauuuacgucgcaacuacgucgggcuuggcaacugaacaagagcagagacacuuaucaucaccaugccgucgacgcagcccuaauaggaguuaccccauucuuaaaaaucuggagaaguggaaaaacuauauacccaagaaaaaugacagaagcacaaacagacuucgaacuaaacgaaauaacaacaaacgaugaauucaaagaaucuuauuaucaacuaccauguccacaauuucuagacuaccucacccaaaugcaagaaaaccugaaaauaaauuucgaagucgacaaaaaaaugaauagaaaaaucucagaugcaaugaucuauucuucuagaaagaaaaaauuaaguaaagacaaaaaagaaaaagaauacucuuuaggaacaaucaaugacauauacucagacgcaggcuauaguaaauucaaaaauauauauaaaaaggacaaggaaaaauuuuuaauguaucaccuugaucauaaaaguuuugaaauccuagaagacauaauaagucaauacccagacaaagaggaguauaucgauucagagggaaaaguaaagcagcgugcagugagcccauuugaaauauauagaagaaaauauggcuauauucgaaaguacucaaaaaaaaauaauggacccaucauaaaaaauaugaaguauuacaaugaaaauuuaccaaaaauauacauagauauuaccccuaaacaaucaauagauaaaaaaguauaucuaaccaacauaagucccuggcguacggauguauacuauaauagaucccaaaacucauaucauauaaugggcaucaaauacucagaccuuagguauauagacggaaaauacggaauacccaaaaacgucuaugaaaaaauaaaauuacgcgaaaaaauaccuagcgaaucugaauuuugcuuuaguuuauauaaaaacgaucgaguuaaaauaauagauccaaauaaaaaugaagaaaucgaacuaagauuuaauucaagaacauugccuucuguccuaaacuacgucgaauucaaaccccuauuucaagaaagcuauaauucauugaccuuacuaccuguauucucaaagacuacuagcgaaggaagaauaaucaaaaaauuuacaagggaggacaacaucguauacaaagucaacaccgacgaacucggcaauccuuacuacaucuuaaaagaaucccagaacccaaaaaacauaauagacaacucuaacaagacugaauga

SEQ ID NO: 8635 - RNA, 3405 nt, Artificial Sequence
  Cas9 variant
augaacggauuggucuuaggacuagacaucggaauagcaucagaaggugucggaauauuggaaaagaacucugguaaaaucauacaugcaaacagcagacuauucccggccgccaccgcggauaauaauguagaaaggaggaaaaaccgacaagcaagaagauuaaauagaagaaagaagcacagaggaguacgauuucaagaucuauuugaagauuacgguuuacuaacagauuucaguaaagucagcauaaaucuaaacccauacagacuuaggguagacgguuuaaaccagcaauuaaccaacgaagaacuauucauagccuugaaaaacauaguaaaacgaagaggcauuaguuaccuagacgacgcuucagaagauggaggugcaguaucgucagacuacggcaaagccguagaagaaaaccgaaaacuucucgcagagcaaaccccagggcagauacaacuggaacguuucgaaaaguauggacaaguuagaggagauuucaccguaguagaaaauggcgaaaaacucagauuaauaaauguauucagcacuucagcauauaagaaagaagcagaaagaauacuccgcaaacaacaagaguucaacaaccaaaucacagacgaguucauagaagauuaccucaaaauauuaacaggaaaaagaaaauauuaccauggaccaggcaacgaaaaaucucgaacagauuauggacgauuccgaacggaugguacaacauuagauaauauauuuggaauacuaauaggcaaaugcacauuuuauccagaagaauauagagcuucaaaagcaucuuauaccgcccaggaauuuaaccuacuuaaugauuuaaacaaucucaccgucccgacagaaacaaagaaacuaagcgaagaacaaaagaaaguaauaguagaauaugccaaagaggccaaaacauuaggugcgucaaccuuacuuaaauauauagccaaaaugauagacgcaucaguagaccagauuagaggauaccgagucgauguaaauaacaaaccagaaaugcauacauucgaagucuauagaaaaaugcaaucacucgaaacaauaucuguaggggagcugucaagaaacguacuagacgaacuagcacauauacuaaccuuaaauacagaacgugaggguauggaagaggcaauaaauacaaaacugaaagacagcuuuucacaagaucagguauuagagcuaguacaauucagaaagaacaacaguagccuuuucucgaaaggauggcauaauuucucacuaaaacuaaugauggaauuaauaccagaacuuuacgaaaccagcgaggaacaaaugacaauauuaacacgacucggaaaacagaaaaguaaagaaacaagcaaaagaacaaaauacauugaugaaaaagaauuaacagaagaaaucuacaaucccguaguagcaaaaucaguaagacaagcuauuaaaauaauaaacgaagccacuaaaaagcaugggauuuucgacaacauuguaauugaaauggcgagagaaaauaaugaagaagaugcaaagaaagacuauauuaaacgacaaaaagcaaaucaagacgagaaaaacgcggcuauggaaaaagcagcauuucaauacaacgggaagaaagaacuuccugacaauauuuuccauggacauaaagaguuagcuaccaaaaucagauuauggcaucaacaaggagaaaaaugcuuauacacaggaaaaacaauacccauaucugacuuaauauacaaccaauacaaauacgaaauagaccacauauuaccccuaagucuauccuuugacgauucuuuaaguaauaaaguccuugcacuagcaacagccaaccaagaaaaaggccaaagaacaccauuccaagcacucgauuccauggacgaugcauggagcuaccgugaauuuaaaucauacgucaaagauuuaaaaucacuauccaacaaaaagaaggacuaccuacuaacagaagaagauaucucuaaaauagagguaaaacaaaaauucaucgagcggaauuuaguagacacgagauauaguucccgcguuguccuaaacgcauuacaagacuucuauaagucgcaccaauucgacaccaccauaucagugguuagaggacaauucacaagccagcuuagacgaaaguggggacuugaaaaaucaagagaaacauaucaccaccacgcggucgacgcccucauaauagcagcaucaucacaacucagauuguggaagaaacaaaauaauccauugaucacauacaaagaaggucaauuugucgacucacaaacaggugaaauuauaaguuuaacagaugaugaauauaaagaacugguauucaaagccccguacgaucacuucguagacacauuaucaucaaaaacauucgaagacucaauacuauuuucguaucaaguagauuccaaauucaaucggaaaauaagcgacgcaacaauauacgcaacucgaaaagcaaaacuugauaaagaaaagaaagaguacacauauacacuaggaaaaauaaaagacauauauucauuaggaacuaaaacaccaucuaaaaccggauuuuauaaauuucucgaccuauacaauaaagauaaaagucaauucuuaauguuccaaaaagauagaaaaacaugggacgaaguaauugagaaaauuauggaacaauacaggcccuucaaagaguaugauaaaacaggaaaacucguugacuuuaaccccuuugaaaaauaccgucaagaaaacgaaccaauucgcaaauacagcaagaaaggaaauggaccagaaauuaaaucccuaaaauacuacgacaucuugcuagguaaacacaaaaauauuacaccugaaggaucaagaaacacaguugcccuacuaucacuaaauccauggagaacagacguauacuauaauauggaaaccaagaaauacgaguuccuaggcuuaaaauaugcagaucuuccuuuugaagaagggggugcauacggcauuuccacagaaacauacaaugaacucagagaaaaagaaggaaucgguaaaaauuccgaguucaaauucaccuuauauaaaaacgauuuaauacuaauuaaagacacagaaacaaacugucaacaaauauucagguuuuggucacgaacuggaaaggauaauccaaaaucauucgaaaaacacaaaauagaacugaagccuuacgaaaaggccagauucgaaaaaggagaagaacuagaaguguuaggaaaaguaccucccaguaguaaucaauuacagaaaaacaugcaaauugaaaaucuaaguauauauaaaguuaaaacagauguauuaggaaauaaacauuucauaaagaaagaaggagauaaaccaaaauuaaaauucuga

SEQ ID NO: 8636 - RNA, 3408 nt, Artificial Sequence
  Cas9 variant
augagcgacuuaguacucggacuagacauaggcauaggcaguguaggagucggcauucuaaauaaaguuacuggagaaauaauacauaaaaacucacgcauauucccagcagcacaagcagaaaauaacuuagaacgaagaacaaacagacaaggaagaaggcuaacgcgacggaagaagcaccgaagaguaaggcucaaccacuuguucgaagaaagcggauuaaucacagauuucacaaaaguaucaaucaaucuaaauccuuaccaauuacgaguaaaaggacuuacugcugaauuaucaaacgaagaauuauucauagcucuuaaaaauaugguaaaacacagagguauaucauacuuagacgacgcuucagacgacgguaauucaucagugggagacuacgcacaaaucgugaaagaaaauuccaagcaauuagaaacaaaaacuccuggacagauacagcuagaaagguaccaaaaguauggucaacuaagaggggacuuuacuguagaggaagacggacgaaagcauaggcuaauaaacguauucccuacgucagcauaccacgcagaagcacuacgaauacuacaaacacaacaagaguuuaacccucaaauaacagaugaguucaucaacucauacuuagaaauacucacaggaaaaagaaaauacuaucauggucccggcaacgagaaaagucguaccgacuacggcaaauacacaacuaagaaagacgcacaaggacaauacauuacacuaaacaacauauuugguauucuaauaggaaaaugcacauucuauccagaagaauacagagcugcaaaagccucauauacagcacaggaguucaauuuacuuaacgaccucaacaaccuaacaguuccgacagaaacaaagaaacuaucagaagaacaaaaauaccaaauaauaacauauguuaaaaaugaaaaagcaaugggaccagcaaaacuauuuaaauacaucgcuaaauuacuagcgugcgacauugcagauauaaaaggauauagaauagacaaaagcgauaaagcugaaauacauacguuugaggcuuaccgaaaaaugaaaacacuagaaacaaucgauauugaacaaauagaaagagaaaaacuugauaaauuggcauacguacuaacauugaauacagaacgcgaaggcauacaagaagcccuagaucaugaauuugcugaugguacguuuucacaagaacaaguagaugaacucgugcaauuuagaaaagcaaacuccucaauauuugguaaaggguggcacagcuuuuccgucaaauuaaugauggaauuaauaccggaacuauacgcgacaucagaagaacaaaugacaauucuuacaagacucgguaaacagaaaacaacaucuuccagcaacaaaacaaaguacauagacgaaaaacaacugacugaagaaauuuacaauccugucgucgcaaaauccguaagacaagcaaucaaaauaguaaaugcugcgauaaagaaauacggagauuucgauaauauaguaauugaaauggcgagagaaacuaacgaagaugacgaaaagaaagccauccagaaaauccaaaaagcaaacaaagcagaaaaagacgcagccaugcgaaaagcagcaaaccaauauaacggcaaagcagagcuuccacacuccguauuccauggucauaaacaacucgcaacaaaaauaaggcuauggcaucaacaaggugaaagaugucuauacacaggaaaaacaauuagcauacaugaccugauuaauaauccaaaucaauuugaaauagaccacauauuaccauuaaguauaaccuuugaugacucacucgccaauaaaguucuugucuacgcaaccgcaaaucaagaaaaaggacaacgaacacccuaucaagcucuagauaguauggacgacgcaugguccuuccgagaacuuaaggcuuuuguuagagaaucaaaagcccuaucaaauaaaaagaaagaguacuuacugaccgaagaagauauaaguaaauucgacguaagaaagaaauucauagaaagaaaccuaguagacacacgcuaugccagcagagucguucuaaacgcacuacaagaacauuucaaagcccacaaaauagacacaaaaguaucaguuguaagaggacaauucacgucucaacugcgacgccacugggguaucgacaaaacaagagauacuuaucaccaucaugcgguggaugcauuaauaauugcagcuucaucucaacugaaccucuggaagaaacagaaaaacacuuuagugagcuacuccgaagaccaacuacuagacauagaaacaggugaacuuauaagcgacgaugaauauaaagaaucaguuuuuaaagcaccuuaccaacauuuuguagauacuuuaaaaagcaaagaauuugaagacagcauacuauucagcuaccaaguugauagcaaauuuaaccgcaaaauauccgacgcaacuaucuaugcaacacgacaagcaaaaguaggaaaagacaagaaagaugaaaccuacguauuaggaaaaauuaaagauaucuaugcauuagggacaaaaacgcccucaaaaacgggauucuauaaauucuuagaccucuacaacaaagacaaaucacaauuuuuagucuaucaaaaagauagaaaaacaugggaugaaguuaucgagaaaauuauggaacaauacagaccauuuaaagaaagcgauaaaaaugguaaagaaguggauuucaauccauucgaaaaauauagaaucgaaaauggaccaauacgaaaauauucaagaaaaggaaacggacccgaaauuaaaucccuuaaauacuaugccagcaaauuaggaaaucacauagacaucaccccgaaagauucaaauaacaaaguaguccuucaaucaguaaguccuuggagggcggacguauacuucaauaaaacuacagggucauacgaaauccugggacuaaaauacgcagaccuacaauucgagaaaggaacaggaacauauagaauaucagaagaaaaauacaaugacauaaagaagaaagaaggaguggacagcgacucugaauuuaaauuuacgcuuuacaaaaaugacuugcuacuuauaaaagacacugaaaccaaagaacaaagacuuuuuagauucuugucaagaucuaugccaaauaagaaacacuacgucgaauugaaacccuauucaaaagacaaauuugagaaaaacgaaagucuaaucgaaauacuaggauccgcggacaaaucuggcagaugcauaaaaggacuagcgaaaucaaaucugucaauauucaaaguacgaacagauguccuaggaaaccagcacauuaucaaaaaugaaggagauaaaccgaaacuagacuuuuga

SEQ ID NO: 8637 - RNA, 3408 nt, Artificial Sequence
  Cas9 variant
augggaguaauauuucuguaugaaaacauugucaaacccuuuccaucuagauacgacaaggcgauaaugaaacggcuaaaaggaagacaaaccaugggauauauccuaagccuagacauaggcauugcuucaugcggauacucuguucuugaaacagaugcauuaggaguaccauauaagaucaaaacgcuuaacucaauaauauucacuagagcagaaaaccccaaaacaggagccagucuagcagaaccacgacgaaaauauaggggcgccagacguagaaaaagaagaaccaguuuccgaaaacacagaacaagacaacuauucaucaccuccggucuacugucaaaacaagacauugcacgauaucucaaccaacaagaaccacacgaugauauaugggaacugagagucaaaggccucgacgaaccauuaacaaauuuacaguuauuucaaguuuuauauuauuuuguuacacauagaggauucaaauccaaucgaaaagcagaauuaaaagauaaagacauagggccgguccuaaauagcauaaacgcauucaaagaagaaaugcaaagucacgacuauagaaccauaggugaacuauaugcaaacgacccgagauuccgagacaggaaacacaacaaggauuacacaaauggauuucuuggaaccauacaaagaaguuggcuaguagacgaaauaaagaugcucuuaacaaaucaacaaucauucgguaauacgcaacuaacgagugaauuuauugaauuauauuuaaacauuuucacaucacagagaaacuuugaugauggaccagcaaguggaccauacuccggggaucugaucgauaagaugguaggacccgauacauucaacagguccaggaaaagggcuccgcgagcaacauauacauuucaauacuuuucuuuccuaucaaaacuuaauucccuaagaauagcuccuucgauaucagccccauuugaaacacuaaccgucgaucaacgagcacucauuacuaaaagacuauggggcccugacguuaaaucggcagaccuaaaauuuaaacagauacgcaugguauuaagccuaccggaaacagcacgauucaauuugguaaauuaugguaauacaccagaaaaagcacucgaaauagaagacaaaacaacauuuauaaguauuaaaccucuaagagaaauagaaaaagcucuaacagguacaacauuaccaguuagucacgaccaacucgaugcuauagccaggauauuaacuguuuacaaaucagauucaaacagaaaaacugcauuucauaaccagacaguacuuucagacgaaguaauugaacaacuuuugccauuaaauuuuucaaaauuuggacacuuaucgguugaaaccaugcaagaaauaauaccauaccuagaacaaggaauggucuauagugaugccgccacugcugcaggauaugacuucagaaauaaucaaauagauauggaauacauacgugauaaugucacaaauccuguaguaagacgagccguaucuguagcuaauaaauuagugaaagcaguuguaagaagauauggaaagccagauucaauacacauagaacucgcacgagaucuaucacaaaacuuccaggaaagaagacaggacgaaguaagacaacagaaaaaugccagagacaaugaaaagauagcgaaaagacuagaagaacuagguauaccagucaacggaguaaauauaacgaaaaugaaacuuuaugaugaacaacaugggauagaucuuuacgaucuauccacaaaugcaagcauggcuguaacagauauauuuucagaugacagguaugaaauagaucauauuauuccauacucgguaucauuugacgauagcuauacaaauaaaguccucguaagcgccaaagccaaucgagagaaaagagauagaauaccaauggaagucuuuggaaaugauucagaaagacgacgacaauuugaaaauagaguaaauacaaauauaacgaauuuacgaaagaaaagaaaccuacuaaaagaaacuuucuccgaugaagauaaagccaaauggaaaucacgaaauauaaacgacacaagauacuuaaacagaauccuaaugaacuauuugucacaaaacguagaguucaccgauguccuaagcgaugcaaaacacguuauagccuugaauggggcaguaacagcuaaaauacguucaagaugggggauaacgaaaguaagggcagcuggugaucuccaucacgcuguugaugcuguuguaauaggaugcgugacugacgcauuaauacaagcaguaacucgauacgcuaaauaccaagaacguagagauaacaaagcagccgccgaacaagaccuagcagagaauaacccagaagaacuggaugcaaaacaauuucgaaaaguguucaacgauuauccucucccauggcccgaauuuagggaggaauuaaugggucgaguaaguucagauccgagccaaauaauggccggacgacaauggucacauuauaccgcagaagaaauaucagaacuaaaacagccauucguuguccguguacccaaucacagaauagugggaccugcaacccucgauacgguauacgggcaaccuaauccggacgauggucuaauaacgcaaagaguaagaaucacagaccuuaaaccacagaaaaauaaagauggagaagacauaauaaaagcaggagcaaauguauaugaacuagcagcagauggcgguaauaaauuaguuuaugaaucaauacuagacgcacuacaaguagcaggcggagauggaaagaaggcauucccuaccgggagacuauuaguaagaucaccaauucaagacauacccgucgagagaguaagagucacauccaaagcaacacuggugguaccagucgguccaaaaagcguagcggcaaauggcucaaugguacgcaucgauguuuacaaaacaccaaagaaauacguauuuguaccuauauauguacgagacacaguaaaagcagaacuaccagaucgugcuguugcuccaguaaaaccuuacagccaaugguaucaauugcaaccaaaagaucaguuccuauuuucccuauucgccaacgacuuaauaagguucaaacauccaagaggugugucaacuaaagaaauauuaacggauggaucacaagaaaaaggcaaaagaacggauguugucggcuauuuuacgggcgccgauauagccacagcaagcaucgcaauugaaggucccgacagaucauuuucagcgagaggaauaggauucgcuucacuuaaaaauguagagaaguuaacagugaacuacuuuggagaauuacacagcgugcaugaaacccaaccuaugcaauuucgagggcaacgcggauga

SEQ ID NO: 8638 - RNA, 3411 nt, Artificial Sequence
  Cas9 variant
augaacggacuuguacuaggacuagauauaggaaucgcaucaguuggcguaggaauacuugaaaaagacacaggaaaaauaauacacgcauccucaagacucuuucccgcugcaacagcagacaacaacguagaacgacguucaaacaggcaaggaagacgcuuaaauaggagaaagaaacacaggucugucagacuccaagacuuguucgaaagcuacggauuauuaacagacuucucaaaauuaucaauaaaccuaaacccauaccaacugcggguucaaggaauggaaaaucaacuaaccaacgaagaacuauuuauagcacucaaaaacauagucaaacgaagaggcauuagcuacuuagaugacgccagugaagacggagggacuguaucaagcgacuacgggaaagcaguggaagaaaauaggcgacucuuaacagagaaaacaccaggacaaauacaacuugaaagauucgaaaaauacggucaacuaagaggugacuucaccguagaagaaaauggagagaaaagaagauuaauaaacguauuuucaacaucagcauaccgaaaagaagcagaacgcauauuaaggaaacagcaagaauuuaauaacaaaauaaccgaugaguucauagaagauuauuugacaauccuaacaggaaaaagaaaauacuaccauggccccgguaacgagaaaagccgcacugacuacggaagauuuaggacagauggcaccacuuuagacaacauuuucggcauuuugauaggcaaauguacauuuuaccccgaagaauacagagcaucuaaagcaaguuacacugcccaagaguucaaccucuuaaacgaccuaaauaacuuaacaguaccuacagaaacaaagaaacucagcgaagaacaaaagaaaaccauaaucgaauacgcuaaaagugccaaaacguuaggugcgucaacacuauuaaaauauauagcuaaaaugauagacgcaucaguagaccaaauacgcggcuaccgcguagauguaaauaacaaaccagaaaugcacacauucgaaguguaucgaaaaaugcagagcuuagaaaccauaaaaguagaagaauuaccucgaaaaguucucgacgaacuagcacauauacuaacacuaaauacagaacgagaaggaauagaagaagcaauaaauaguaaacugaaagauacauucaaccgggaccaaguuuuagaacugguucaauuccguaaaaauaacucuucacuguuuucgaaaggauggcacaauuuuagccugaaacuaaugauggaacuuauaccagaacuauacgaaaccucagaagaacaaaugacuauacuaacaagacuaggcaaacagagaucaaaagaaacaucaaaacgcacaaaauacauagaugaaaaagaauuaacugaagaaauauauaaucccguuguagcuaaaaguguaagacaagcaauaaaaaucauaaaugaagcaacaaagaaauacgguaucuucgauaacauaguaauugaaauggcaagagaaaauaacgaagaagacgcaaagaaaaauuacauaaaacaacaaaaagcaaaucaagacgagaaaaacgccgcuauggaaaaagcagcauuucaauacaacggcaaaaaggaauuaccagacaauauauuccauggacacauggaauuagccacuaaaauaagauuauggcaccaacaaggugaaaaaugccuuuacaccgggaaaaacauucaaauaagcgaccuuauacacaaucaauacaaauacgaaauagaccacauauuaccccugucacuaucuuucgacgacucacuaucaaauaaaguauuaguauuagcaacagcaaaucaagaaaagggccaaaggacuccauuccaagcacuagauucaauggaugacgcauggucauauagagaauuuaagucauacguuaaagaaucaaaacugcugggaaauaagaagaaagacuaucuucuaaccgaagaagacauaagcaaaauagaaguuaaacaaaaauuuaucgagaaaaaccucguagacacucgcuauuccucacgcguaguucuaaacgcacuacaggauuuuuauaagaaacaucaauucgacacaacaauaucuguuguaagaggccaauucacaagucaacuaagaagaaaauggaaacuggagaaaagcagggacacauaucaccaccacgcaguagacgcccucauaauugcagccucuucacaacuccgguuauggaagaaacauaacaacccgcuuauuucguauaaagacggacaauucgucgacucggaaacaggggaaauagucucguuguccaacgaagaauauaaagaauuaguauuuaaagcgcccuacgaucauuucgucgacacgcuacgcaguaagaaauuugaagacaguauauuauucucuuaucaaguagauaguaaauacaaccgcaaaaucagcgacgcaacuauauacgcuacaagaaaagcaaaacuagacaaagauaagaaagaauacacauauacauuaggcaaaauaaaagacauauacgcacucggaaccaaaacaccuagcaaaacaggauuuuauaaauuucuugaccuauauaaaacagauaaaucgcaguuccuaauguaccagaaagacagaaaaacuugggacgaaguuauagagaaaauaauugaacaauaccgcccuuucaaagaauacgacaaaaauggaaaagaaguagacuucaauccauucgaaaaauacaggauagaaaacggacccauaagaaaauacucgcgaaaaggcaacggaucaguaaucaaaucaaugaaauacuacgacaacuuguuaggaaaauuuguagacaucacaccauccgaaucgaaaaacccaguggcuuuauuaucacucaaccccuggagaacagacguauauuauaaccccgaaacaagaaaauaugaguucuuaggauuaaaauacgcugauuuauguuucggaaaaggcggaucauacggaauaucggaaguuaaauacaauaagauaagggaaaaagaaggaaucggaaaagaaucagaauuuaaauucacauuauacaaaaacgaccuaauauuaaucaaagacacagaaacaaacugccaacaauucuuuagauuuuggucaagaacagggaaagacaauccuaagucuuucgaaaaacacaaaauagaacuuaaacccuacgaaaaagccaaauuugaaaaaggagaagaauuagaaguccucggaaaaguuccuccuucgagcaaccaauuccagaaaaacaugcaaauagaaaaccuauccauauacaaaguuaaaacagacguacuuggaaacaaacacuucauaaagaaagaaggcgacgaaccaaaauuaaaauucaagaaauga

SEQ ID NO: 8639 - RNA, 3411 nt, Artificial Sequence
  Cas9 variant
augaauggacuaguccuaggauuagacauuggaauagcguccguuggagugggcauacuaaaaaaagauaccggcgaaauaauacacacaaacucaaggcuuuuuagugcagcuacagcagauuccaauaucgaaagaagacgacacagaggugguaaaaggcuaacuagacgaaaaaaacacaggucuauaagacuacacgaccuuuucgaagauucgggacuauuaacagacuuuaguaaaguuucaaucaaccuaaauccuuaucaacucagaguacaaggauuagacaaccaacucacaaacgaagaacuauuuauagcucuaaaaaauauaguuaaaagaagaggaauaucauaccuagacgacgcaagcgaagacggcggaaccguuucaagugacuauggcaaagcagucgaagaaaaccgaaagcuauuagccgaacaaacuccaggacaaauacaauuggacagauucgaaaaauacggccaaguaagaggugacuucacaguaguugaaaacggagagaagcggagauuaauaaacguguucacaaccagcgcuuauuccaaagaagccgaaagaauauuaagaaaacaacaagaguuuaacaaaaaaauaacagacgaguucauagaaaacuaccuaacaaucuuaacaggaaaaagaaaguauuaucauggaccaggaaacgaaaagagcagaacagacuacggaagguacacaaccaaaaaagaccccgaaggaaaauauauaacacucgacaacauauuuggaauucucauagguaaguguacauucuaccccgaugaauauagagccucaaaggcgucauacacagcucaggaauuuaauuuacuaaacgacuugaacaaucugacaguaccaacagaaacaaaaaaacuaagugaagaacagaaaaaaacaauaaucaaguaugcgaaaacagcuaaaacauuaggagcaaguacuuuauuaaaauacauagcaaaacuaauaggggccagugucgaucagauacaugguuauagaauagacccaaacaaaaaacccgaaaugcauaccuuugaaacuuacagaaaaaugcaaucauuagaaacuauaaguguagaggaaaucccaagaaaaguuuuggaugagcuagcacauaucuuaacacuaaauaccgaaagagaaggaauagaagaagcgauaaaugcuacuuuaaaagauacauucucccaagaucaaguccuagagcucguacaauucagaaagaacaacaguucgcucuuuuccaaaggauggcacaauuucagcuuaaaacuaaugauggaauuaauacccgaacuauacgaaacaucugaagaacaaaugacaauauuaacaagacucggcaaacaaaaaagcaaagaaacaucaaagagaacaaaauauauagacgagaaagaauuaacagaagaaauauauaauccaguagucgcuaaaucaguccggcaggccauaaaaauaauaaaugaagcaacuaaaaaauaugguauauucgacaauauaguaaucgaaauggcucgcgaaaacaacgaagaagacgccaaaaaagguuauaacgagcgacaaaaagccaacuuagacgaaaaaaaaucugccauggaaaaagcggcauuucaauacaauggaaaaaaagaguuaccagacaacguguuccacggccacaaagaacuagccacaaaaauucggcuauggcaccaacagggcgaaaaaugcuuauacacaggaaaaaacauaccgauaagugauuuaauucaaaaccaauauaaauaugaaauugaccacauucugccauuaagcuuaaguuuugaugacucacuuuccaacaaagucuuaguacucgcaacggcuaaccaggagaaaggacaacgaacuccauuccaagcucucgacucgauggaugacgcuugguccuacagagaauucaaaucauacguuaaagaccuaaaguuacuuucaaacaaaaaaaaagauuauuuacuaaccgaagaagacauaaguaaaauagaaguuaaacaaaaauuuaucgaacgaaacuuaguagacaccagauacucuuccagaguaguccugaacgccuuacaagacuuuuauaaggaacaucaauuugacaccacaauaagcguaguacgaggacaauucaccucccaauuaagaagaaaauggggucuagaaaaaucccgcgaaaccuaccaucaucacgcaguagacgcacuaauaauagccgcuaguucucaauuaagauuauggaaaaaacaaaauaacccacuaauaucauacaaagaaggucaauucguagaucaagaaacaggagaaauaauaucgcuaagugacgacgaauauaaagaauuagucuucaaagcaccauacgaccacuucgucgacacacuuaaaucaaaaaaauucgaagacucaauauuauucucauaccaaguagauucaaaauacaaccgaaaaauauccgaugccaccauauaugcuacaaggaaagcaaaauuagauaaagaaaaaaaagaauauaccuacacacucggcaagauaaaagauaucuacgcucuaggaagcgagaaacuaaaaacggguuuuuacaaauuucuucaccuuuauaaaaaagauaaaucacaauuucuaauguaccaaaaagacaggaaaacuugggaugaagucauagaaaaaaucuuagaacaauaccgcccauuuaaagaaaaagauaagaauggaaaagagguagauuucaacccauuugaaaaauaccggauagaaaacgguccaauacauaaauauucccgaaaagguaacgguccaguaauaaaaucacugaaauauuaugauaaaaacauaccugagucauucaucaauauuacaccgagcaacagcaaaaacaaaguaauucuaagacaacuuaacccauggagaacagacguauacuuuaaucaucaaacagagaaguacgaauuauuaggacuuaaguacgcacaucuacaauuugaaaaaaaaaccgggaacuauucgauaacaauagauaaauacaacgagauaaaagaaaaggaaggaguuucagaacaaucagaauucaaauucacccuacauaaaaaugacuuauuacugaucaaggauaccgaaacaaaggaacaacaacuguuuagauuucucucaagaacuaagccaaaugucaaacauuauguagaacucaaaccauacucacgggacgaauucgaaaaaaacgaaaggcuaaucgaaauuuugggaagcguagauaaaucgggccgauucgugaaaggauuaggcaaaucuaaucuaucaauuuauaaaguaaggacagacguuuuagggaaccaacacauaaucaaaaaagaaggcgaagaaccgaaauuaaaauuuuga

SEQ ID NO: 8640 - RNA, 3411 nt, Artificial Sequence
  Cas9 variant
augaacggauuaguauuaggcuuagacauaggaauugcaucuguuggaguaggaauacuugagaaagacacaggcaaaauaauacacgcaucaucaagacucuucccggcagcaaccgcagacaacaauguagaaaggcgcaguaacagacaggguagacgacuaaauagacgaaagaaacacagaaguguuagacuacaagaucuauuugaaggauacggauuguuaacagauuuuucaaaagucuccaugaacuugaacccauaccagcuacgcguccagggaauggaaaaccaauugacaaaugaagaauuauuugucgcacuuaaaaauauaguaaaaagacgaggcauaagcuaccuagaugaugcaucagaggacggaggaacaguaagcucggauuauggcaaagcuguugaagagaauagaaaacuauuagccgagaaaacgccaggacaaauccaacuagaaagauuugagaaauacggucagcuacguggagacuuuacagucgaagaaaauggugaaaaacauagacugauaaauguuuucaguacaagugcauaucgaaaagaagccgaaagaauauuaagaaaacaacaagaauuuaacagcaaaauaacggacgaguucauagaagacuaccuuauuauacuuacaggaaaaagaaaauacuaccauggaccuggaaaugaaaaaucaagaacugauuauggaagauuucgaacagaugguacaacacuggauaacaucuucggaauacuuauagguaaaugcaccuucuauaccgaagaauauagagcauccaaagcaaguuacacggcccaagaguucaacuuacucaaugaccuaaacaaucucacaguaccaacugaaacaaagaaacuuagcgaagaacaaaagaaacucauuauugaauacgcaaaaucagcaaaaacacuuggagcaucuacgcuucuaaaauacauagccaaaaugaucgacgccucaguagaucaaauuagaggauauagaguagauguuaacaauaaacccgaaaugcauaccuucgaaguauacaggaaaaugcaaucucuagaaacuauaaaaguagaagaauuaccaagaaaaguauuggaugaacuagcacacauacucacacuaaauacagaaagagaaggcauagaagaagcgauaaacagcaaacuaaaagacauauuuaauagagaucaaguacucgaauuaguccaauucaggaaaaauaacagcucauuauucucaaaagguuggcauaauuuuucaauaaaauuaaugauggaacuaauacccgagcuauacgaaacaucagaggaacaaaugacuauucuaacucgacuaggaaaacaaagaagcaaagaaacaagcaaaagaacaaaauauauagacgaaaaagaguuaaccgaagaaauauauaacccagucguagcaaagagcgugagacaagcuauuaagauaauaaacgaagcuaccaaaaaguacggaaucuucgacaacaucguaauagaaauggcaagagaaaacaaugaagaagaugcgaaaaaggacuacauaaaaagacaaaaagcaaaccaggacgagaaaaaugcagcgauggaaaaagcagcuuuccaguauaauggcaaaaaggaauuaccagacaauauuuuucauggacacaaagaacucacaacaaagaucagacuauggcaucaacaaggugaaaaaugccuauacacagguaagaauauacccauaagugaucucauacacaaucaauauaaauacgaaauagaccauauauuaccacucagcuuaucuuuugacgacucucuaaguaacaaaguucuaguauuagcgacagcgaaccaagaaaaaggacaaagaacgccuuuccaagcacuagacucaauggacgaugcuuggucauaucgagaauuuaaaagcuacguaaaagacucaaaauuauuaucaaauaagaagaaagacuacuuacugacagaagaagauauuagcaaaauagaaguaaaacaaaaauuuauagaacgcaaccugguagacacaagauacucaucaagagugguacuaaacgcacuacaagauuucuacaaaagucaccaauuagauaccacaauuucuguaguaaggggacaauucacuagccaauugagacgcaaauggggcauagaaaaaucucgugaaacauaccaccaccacgcaguagacgcacuaaucauugcagcaucaucgcaacuaagauuauggaagaaacacaguaauccacuaaucgcauauaaagaagggcaauucguagacagugaaacgggagagauaguaagucuaucagaugaagaauauaaagaauuaguauuuaaagcaccauaugaucauuuuguagacacauuaagaaguaagaaauuugaagauuccauauuauucagcuaucaaguggacucaaaauauaacagaaaaaucagcgaugcaaccauauacgcaaccagaaaagcaaaauuagauaaagagaagaaagaauauacguauacacuaggaaaaauaaaagacauauaugcucuagguacaaaaacuccuucaaaaacaggauucuauaaauuccuggauuuguacaaaacagacaaaucacaauucuuaauguaucaaaaagaccgaaaaaccugggaugaaguuauagagaaaauuaucgaacaauacaggccauuuaaagaauacgacaaaaaugguaaagaaguugacuuuaauccauucgaaaaauacagaauaggaaacggcccuauucguaaauacaguaagaaaggcaauggaccugaaauaaaaucauuaaaauacuaugacauccuacuaggaaaacacaaaaauaucacacccgacggcucaagaaacacaguagcguugcucagcuuaaacccauggcgaacagauguguauuacaauucagaaacaaagaaauacgaauuucuaggauuaaaauaugcugaucuauguuucgaagaagggggagcauacggaauaagcgaaguaaaauauaagaaaauucgagaaaaagaaggcauuggcaaaaacagugaguucaaauucaccuuauauaagaacgauuuaaucuuaauaaaagacacagaaaccaacugucaacaauucuuuagauucuggucacgaacaggaaaggauaauccaaagagcuuugaaaaacauaaaauugaacuaaaaccauacgaaaaagcaaaauucgaaaaaggagaggaacucaaaguacuaggaaaaguacccccuucaucaaaucaauuccagaaaaacaugcaaauagaaaaucugagcauauauaaagucaaaacggacauucuaggaaauaaacacuucauaaagaaagaaggagacgagccaaaauuaaaauucaagaaauga

SEQ ID NO: 8641 - RNA, 3420 nt, Artificial Sequence
  Cas9 variant
auguccgaccuaguccuaggacuugacauaggaauaggauccguuggcguagggauacuaaacaaaguuacgggggaaaucauacauaagaacagucguauauuuccagcugcacaagcagaaaacaacuuagaaagacgaacuaaccgccaaggacgaagacucacuagaagaaagaaacacagacggguucgacucaaucaccuguucgaagaaucaggccuaauaacagacuucacaaaagucagcaucaaucugaaucccuaccaauugagagugaaaggacuuaccgccgaacuaucaaaugaggaacucuuuauagcacuuaaaaacauggucaaacacagaggaauuucguauuuagacgaugcaucagacgaugguaacagcucaguaggugauuaugcgcaaauaguaaaagaaaacucuaaacaauuagagacaaaaaccccaggacaaauccaauuagagcgauaucaaaaauacggacaacuacgaggcgacuucacaguagaagaggacgguagaaaacaucgauuaauaaaugucuucccaacaagcgccuaucaugcggaagcacuuaggauccuacaaacacaacaagaguucaacccacaaauaacagacgaguucaucaacucauaucuggaaauauuaacaggcaaaagaaaauacuaucauggaccaggaaaugaaaagagucgaacagauuauggaaaauacaccacaaagaaagacgcucagggacaauacauaaccuuaaauaacauauuuggaauauuaauaggcaaauguaccuuuuacccugaagaauauagagcagcaaaagccagcuacacagcgcaagaguucaacuuauuaaaugaucuaaacaaccuaacaguaccuacugaaacaaagaaauuaagugaagaacaaaaauaucaaauuauaacauauguuaaaaacgaaaaagccauggguccagcgaaacuauucaaauauauagcaaaacuacucucaugcgauguagcggacauaaaaggauauagaauagauaaauccgacaaagcagaaauccacacuuuugaagcauacagaaaaaugaaaacacuagaaacacuagacguaaagaaaauggcacgcgaagaauuagacaaauuagccuacguauuaacccuaaauaccgaacgagaaggaauacaagaggcuuuagaucaugaauuugcugacggcacauucucacaagaacaaguagacgaacuuguacaguuuagaaaagcaaauucauccauauuuggaaaaggauggcacucauucucaguuaaauuaaugauggaauuaaucccagaauuauacgcgacgucagaagaacaaaugacuauacuaaccagauuaggaaaacaaaagacaaccagcuccaguaacaaaacaaaauacauagacgaaaaacaacucacagaagaaauauacaaccccgucguggcgaaaagcguuagacaagcgauaaaaaucguaaacgcagcaaucaaaaaguacggugauuuugacaauauagucauagaaauggcuagagaaaccaacgaagacgaugaaaagaaagcaauucagaaaauccaaaaagcgaacaaagcagaaaaagaugcagcgaugagaaaggccgcaaaccaauauaacggaaaagcagaacucccucacucagucuuccauggacacaaacaauuagccacgaaaauaagauuauggcaucaacaaggcgaaagaugcuuauacacaggaaaaacaauaagcauccaugacuuaauaaacaaucccaaccaauuugaaaucgaucauauauuaccacugucaauuacuuucgacgacagccuagcaaacaaaguuuuaguguacgcuaccgcaaaucaagaaaaaggucaaagaacaccauaucaagcacuagacuccauggaugacgcuugguccuucagagaacuaaaagcauuuguaagagaaucuaaagccuuaucaaacaaaaagaaagaauauuuauuaacagaagaagacauaucaaaauuugacgucagaaagaaauucauugaaagaaaucugguagacacacgauaugccuccagaguagucuuaaacgcgcuacaagaacauuuccguacucacaaaaucgauacaaaaguuaguguuguuagaggacaauucacaagccaguuacgaagacacuggggaauagagaaaacaagagacacauaccaccaccacgccgucgaugcauuaauaauagccgcaagcucacaacuaaacuuauggaagaaacagaaaaauaccuuagucuccuacagcgaagaccaacuucuagauaucgaaacaggcgaacucaucagugaugaugaauauaaagaaagcgucuucaaagccccauaccaacacuucgucgauacguugaaaaguaaagaauuugaagauagcauauuauucagcuaucaaguagauucaaaauucaauagaaaaaucagugacgcaaccaucuaugcaacacguaaagcaaaauuagauaaagaaaagaaagaauacaccuacacccucggcaaaauaaaagauauuuaugcauuaggaacaaaaacaccaucaaaaaccggauucuacaaauuucuugaucucuacaagaaagauaaaucacaauuuuuaauguaucaaaaagacagaagaacaugggacgaaguuauagagaaaauacuugaacaauaccgaccauucaaagaaaaagauaaaaacggaaaagaaguagacuucaauccuuuugaaaaauaucgaauagaaaauggccccauuagaaaauacagcagaaagggaaacggaccagaaauaaaaaguuuaaaauacuacgauaacuuacugggaagauuuguggauauaaccccauccgaaucuaagaacccaguagccuuacucucacuaaauccauggcgaacagacguuuacuauaacacagagacacgaaaauacgaauuucuuggccuaaaauaugcagauuuauguuucgagaaaggcggaaguuacggcauaagcaagguaaaauauaacaaaaucagagaaaaagaaggcauuggcaaaaacagugaauuuaaauuuacacuauacaaaaaugacuuaaucuuaaucaaagacacugaaacuaacagacaacaaauauuucgauuuuggagucguacuggaaaagauaacccuaagagcuuugaaaaacacaagcuagaacugaaaccauaugagaaaacacguuuugaaaagggagaagaacuaaaaguacuaggaaaaguaccuccaucaagcaaucgauuacagaaaaauaugcaaauagaaaaccuaucaauauacaaaguacgaacagauguacuaggaaaccaacauauaauaaagaacgaaggcgauaaaccaaaauuagauuuuuga

SEQ ID NO: 8642 - RNA, 3420 nt, Artificial Sequence
  Cas9 variant
augaauuauuauaacggguuuauaauaacagaaaacgcaauggcaucaaaacaugaaaaccuaggagcauuaacauuuggucucgauauugggauagcgaguguaggaugggcaguccucggugaaaacagaauaauugacuuagguguccgauguuuugauaaagcagaaacugcaaaagaaggcgagagcuuaaauuuagcgcgacgcacagccagacuauuaagaagaaggcuuagacgcagagcauggagauuaaccaaacuugcucgauuacuuaagcgggaaggacuaauagcagauacaaacguauuucaaaaaccauucaaccuaaaagaugcaaacgaaaaaggacuaucauuuuggcagcuuagaguagacgcguuggaucgaaaauuaucagcugaagaaugggcaagaguaauuuaccauuuauguaaacauagagguuuccacuggaucagccgugcagaagaaaaggcagcugaaggagacaguaaaagugaagguggaaaaguuaaacagggguuagcaggaacaaagaaacugaugcaagagaaaaacuauagaacagcagccgaaaugguacuuacagaguuuccagaagcacaacguaauaaacaaggagauuacucaaaagcauugucaagaauauuacuaggggaugaaaugacacaacuauuuaaacaccaaagagaauuagguaacccccacgcgacagaaaaacuggaagcagcuauauuaggaaacggggaccacaaaagcggcuuauuuugggcccagaauccagcgcuagcagguaacgacuuauuaaaaauguuaggucauugcaccuuugaaaaagcugaauauaggguaccaaaagcaucauuuacagcagaaagacauguuugguuaacuagauuaaacaaccuuaggaucguggucgauggaacuacucgaccgcuaaaugaagcugaaagacaucuugcccuccuaaugccauaucagcaggcaggagaucugacauacaaacaacugagaacagcgcuaacaaaagccggguaucuaccugaaucguuccgauacacaggcuuagcuuaugcuuccggacaaaaagcagaugaaaaagcuaaagauccggaaagcgcaccuuuagugaaauuaccugcauggcaugaauugagaaaaacuuuagaaaagaaggaauuggcgagugaauggcagaaaauaucgagcgacgcuuuagacggaaaaccucaacuauuagaucaaauugcuuggguacuuucuguguauaaagaugacacugaaguugaagcagaacuauguaaacuaaaccuuccaaaugcagagaaaaugauagaugcauuacuagacauucgcuuugauaaauuuuccaaccucucacucaaagcacuucggcaaauaguaccccuaauggaacaaggccaaagauacgacgaagcugucgcaaauauaccugaauacggacaccauucacaauuacaugaaguaggagcaggagaacacaaauaucuuccacccuuuuacaaagaaagagauaaaacgggaagaaugguguucaacgaugacauggacauuccccgcaacccaguuguucuuagggcacuaaaccaagcaaggaaaguaguaaacgcacuaaucaaggaguauggaagcccccaugaaguucauauugaaauggcacgcgauuugucacguccgcuagacgaacgacgcgacguagagaaauuacaaaaagaauuucgagauagaaacgaaaaagauaaagcauuauucgcucaagacuuuaauauaguuggugcaguaaaaggaaaagaguucgaaaaauaucaauuauaucgagaacaacaaggaaaaugugcauauucuauagaacccauggacauucauagacuauuugaacagggauauguagaaauugaucacgcguuaccauauagccgaucauuugaugacucuaaaaacaauagaguccuaguauuagcaaaggaaaauagggauaaaggaaauagaacaccauuugaauaucuuggugggaaagauaacagcgaaagguggagacaauucguagcuuuuguugaagguaauaaaucuuauagauuagcgaaacgaagccgauuacuucgaaaagauuucggcaaagaugaagcaaaaggauuuagagagagaaaucugaaugauacaagauacauaugcagauucuuuaagaauuauguagaacaauauuuacaacugcaugaagacuccgaugcuaagcgaugugugguauuaagugggcaaaugacaucuuucuuaagagcuagauggggauuagucaaagugagaggagauucagacagacaucacgcauuagauggcgcaauuguggcagcuugcucacacucuaugguaaaaagacuuagcgacuauucaagaagaaaagaauuagaacaaguaagagcugguuucguagauguagauacgggagaaauagugaauccagcaauguuccagcaaguacaagagcauuucccaaacccauggccucauuucagagacgaaguuaaauuaagacuaaauguggacgacccagcauuauuacacucagaaaugaacagauuuggaacauauucaccagaagccuugaaagcucuacgacccuuauucauaagucgagcaccacaaagacgaaauucaggagccgcacauaaagauacaauauacgcacaaccagaacgccuaguugcacaaggaggaguuacacagaaaguaccucuaaccaguuuaacucuaaaagacuuagauaaauuaauagauccgcacagaaacgaaaaauuauauucugcuauaaggauucgauuagaacaacacggaggaaaaggagauaaagcauuuccagcguccaauccauuaagaaaaccagauagugaagggaauccuaccggcccaauaguaagagguguuacaauggucauagacaaacuaucagguauacccauaagaggagguauagcgaagaacgacuccaugguucgugucgauguauuuacaaaagccggcaaauuucauuuaguaccaguauacguucaccaugccguagccaaaguacuaccaaauagagcaguagucgcuuacaaggacgaaacagaauggacucuuauagacgauggauuugauuucuguuuuaguauguacccaaacgaucuauuacguaucaaacuaagaaaugcuagucaccuugguuacuacgcuaguuguaacagauccacaggugcuauaaacuuauggagucaugacaggaaccaacaaguaggcaaagacgggaugauagaaucaauugggguaaaaacagcacuuaauguugaaaaauuaaauauugauguacuuggaaaucgguacccugccccaccagaaaagagaagagacuuagcauga

SEQ ID NO: 8643 - RNA, 3423 nt, Artificial Sequence
  Cas9 variant
augaaaaacaugacaaaggucaacguuggucuggacgugggaauuaguagcgcagguuggagcguaauaaacgcagagaccaaccagauucucgaaucaggaguaagacuauuuagugggucagaugcagacgagaauguaaaucgacgaaaccaaagacaaggacggagacucuuucgcagaaggaaacuucgaauacaagaagcaaaaaaguaucuagaaaauguauuccaauuaaaagauauagaaccuaaagaugaguggaacccauaugaaauucgcguacgcgcacucaaugaaaaagucucaaaagaagaacuaaguaucgcuuuacuaaacauagugaaacacagaggcauaucguaugaauuagaagaugucacagacgaagaaggaacaaauacacaauccuuccagaguggacucgauuauaacagacgauuacuaaaaacaaaaacaguaggcgaaauucaauaugauagacuacaaaaauauggacaaguaagaggacaaauacaaacagaagacggucuacuaauaaacaucuuuccaacaaaaaacuacguggaagaaguagaaagaauauuagaaacacagaagaaauaccaucccgagauagaugaugucuuuauagaaaaaauuaucaguuuugugacaaggaaacgagaauauuucguaggaccaggcaacgaaaagucaagaacagauuacggcaucuaucgagaaaacggagagacauuggacaaccucuuugaaauauuaaucggaaaagacaaauuuuauccagaagaauacagggccgcaggaagcagcuauacagcacaaauuuucaaucuacugaaugaucuaaacaacuuacgaaucccaacaacugaagaucaucauuuaaccaaggcgcaaaaagaagaaauaaucacggaacuaaaaaauacuagcagauuaaguggcggaauguuaaaauuaauaucgaaagugacaaaagcaccaaaagaagagauaagcgguuacaggaaagacgaaaaagauaaaccagaccuccacucucuggccuacuaucgaaaacaaaaaaacaugcucgaaaaagaaggcauacaaauugcagacuucagugaagagcuguuagaugaacuugcaacaaugaugacacuaaacacagaacccggagaaauaagaaaacaacuuaacaaaaucaccaaccaauacgacaucuuaacaccagaaguaauugagguacuaguuaagaaucacaccgcuuuuguagcuacaucuaaucacaaauggcaccguuuuagccucaaacuaaugaaagaauuuauuccugaacuacuagaaacaucaaaagagcaaaguacaauuuuaugugaaagaggguucauacaaaacagagcaucauacuuagacgaaaaccaucauuuuaacuaugcagaacuacgagaaaauuuguacaauccaguaguacggaaaucaacuugugaaaugcucaaaguuuucacagccauccaagaaaaauaccccaauauacaaaauguaauaguagaacuuccaagagaaacgaacgaagacgaacaaaagagaaaaauaaagaaaaucaacgacaacaacgcaaaacgcaaaaaagagauacuaaaagaagcacaagcacaaucaggacuaucagaagaggcguuggaagaaaaacuauuaaaaaccaaaggacuauauuuaaaacuuauguuaugguacgaacaagaaggcaaaugcguauauucuggucaggaaauaccauuauccgacuuacuacagaauaaaggaggauacgagguagaucauauaaucccuaucucaaucagcuucgaugauagacucugcaacaagguacuaguaagacaacaacuaaauagucagaaaucaaaucaaacuccauuugaguacaugacaacacauaccgauggucaccuuucauuucaugaacugaaagaauuaguaggcaaaaacaagcgauuuagcaaagaaaaaagagaacucuuacucgccgaaauauacaguaaugacaucgaaacuagaaagagauucauaaaucgaaaucuaguugacaccucauacacagcaagaauaguauuaaaugcuuuacaacaauauaaaaaagaaaaucaauuaaguaugaaugucaguguaguacgaggagcaaugacaaauauacuccggaaaaaaguaaaacuagauaagacaagagaaacauuccaccaccaugcgauagacgcaagccuuauggcagugauacccaauaucgaauucuuuaaagaaagaaaagaaugguugccaaaaagugccaacgaagaaguuguugaaguggaagugucagaagaagaaaccaugcccgaaaaagaauuuaaagugaaaaugagacuaccagagagcuuuauacaagauguacagauacuccaaagaaauucauuugcaaaagaagagguauccggaccgcagacaagagaacgcaacuuaaaaauuaaauuuagccaccaaguagaccaaaaaaugaacagaaaaguggcagacgauacgauuuauggcacaagacaagcucaauuaggcaaggacaaaaaggaagaaacauacguuauuggaaaaauaaaagauauuuauaauuacgaugaauacguaagauucaaaaaaagauacgacaaaaacaaagagaguuuccuaauguaucaccacgauccccagacauucgaaaaacuugaagaaauucuagcacaauaucccgaauacauugaagaugaaaaaggaaaaaaaaaaaaaguuucaccauucgcauuauacagagaagagaacggaccgguaacaaaauaugcaaaaaagaacaaugguccagugauaaaacaacuuaaauauuacgacucaaaacuuaacagaaaaauagauauaucucacaaauacucaacuaaaaacagacagguaguacuacaaucccuaaagccguaccgaaccgacguauacagaaaucaagacacaggagaauauacacuaguugguauagaccaaaaugacggaaaauuuguaaauggacacuauggaauaccuaaaagcagauacgaagagaucaaagcaaacaauaaacuaucggagcaugaugaauucguuuucucacuauauaaaaauucaauggucaagguaaucgaugaaaacggagagucuaucguagugagguaucuaucgagaucaaugcccaaucgaaaaaacaacgcagaaauaaaaccaguugaaaaauaccaauucgaagauggagaaguaguucccguauauggcaagugcagaaaacaaaugcagacuguauucgucaaaaaaggauggacccuauuaaaaggaaauacugauauucuuggaaauacauacuucguagaaaaagaaucagaaaacccaaaaaaaaugauagaugacaaauga

SEQ ID NO: 8644 - RNA, 3423 nt, Artificial Sequence
  Cas9 variant
augagggaaaaugggucagaugaaaggagaagaaacauggaugagaaaauggauuauagaauaggauuagauauagguauugcaucaguuggcugggcuguacuucaaaacaauucugaugacgaaccuguaagaauaguagacuuaggagugagaauauucgacacggcagaaaucccaaaaacaggagaaucacuggcaggaccacguagagcugcuagaacaacaaggagacgauuaagacguaggaaacauagacuagacagaaucaaaugguuauucgaaaaucaaggccuaauaaacauagacgacuucuuaaaacgauauaacauggcugggcucccugauguguaccaacuuagguaugaagcauuagaccgaaaacuaacugacgaagaacuagcacaaguauuguuacauauugcuaaacacagaggauuucgaucaacaagaaaagcagaaacagcagcaaaagagaauggagcaguauuaaaagcuacagacgaaaaucaaaaacgaaugcaagaaaaaggauacaggacaguaggagaaaugauauacuuagaugaagcauucagaacaggauguaguuggucagaaaaaggauacauacucacuccuaggaauaaagccgaaaauuaucagcauacuaugcuaagagcuaugcucguagaagaagugaaagaaauauucucaucccaaagaagacuaggaaaugaaaaagcgacagaagaacuagaagaaaaauaccuggaaauuaugacaagucaaagaaguuuugauuuaggaccugguaugcaaccagacgggaaaccaagcccguacgcgauggaaggcuuuucugauagaguagguaaaugcacuuuccuaggagaccaaggugaacuacgcggagcaaaaggaaccuacacugcugaauacuuuguugcauuacagaaaauuaaucauacuaaauuaguaaaccaagauggggaaacacguaacuuuacagaagaagaaagacgagcgcuaacguuacuacuuuucacacaaaaagaggucaaauacgcagccguaagaaagaaacuaggacuacccgaagacauauuguuuuauaauuugaauuacaagaaagcagccacaaaagaagaacaacaaaaagaaaaccaaaauacagaaaaagcaaaauuuauaggaaugccuuacuaccaugauuauaagaaaugcuuagaagaaagagucaaauaucuaacugaaaaugaagugagagauuuauuugaugagauagggaugauacuaacaugcuauaaaaaugaugacucgagaacagaaagauuagcaaaacuaggacuuguaccuauugaaauggaaggacucuuagcauacacuccaaccaaauuccaacaccuaucaaugaaagcaaugaggaacauuauaccauuccuagaaaaaggaaugacauaugacaaagcaugcgaagaagcaggcuacgauuucaaagcagauuccaaaggaacuaaacaaaaacuacugacaggagaaaacgugaaucaaaccauuaacgagauaacuaacccaguagucaaaagauccgugucacaaacuguaaaaguaauuaacgcaaucauaaggacauauggaagcccccaagcaaucaauauugaacuagcaagagagauguccaaaacuuuugaagaaagaagaaaaaucaaaggugauauggaaaaacgacagaaaaauaacgaagacguaaagaaacaaauacaagaauuaggcaaauugagcccaacuggucaagacauauuaaaauauagacuauggcaagaacaacaagguauauguauguauucaggcaaaacaauaccauuagaagaacuauucaaaccgggauacgacauagaucauauuuuacccuauucgauaacauuugaugacaguuuuagaaacaaaguccuaguaacaucacaagaaaaccgacaaaaaggaaauagaacacccuaugaauauaugggcaacgaugagcagagauggaaugaauuugaaacgcgaguaaaaaccacuauaagagauuauaagaaacaacaaaaauuauuaaagaaacauuuuucugaagaagaaagaucugaguucaaagaaagaaaccucaccgauacaaaauacauaacuaccguuauauacaauaugauaagacaaaauuuggaaauggcacccuuaaauagaccagagaaaaagaaacaaguacgagcaguuaacggagcaauaacugcauaucuaagaaaaagauggggacuaccacagaaaaaucgggaaacagauacucaucaugcuauggaugccguagucauugcuuguugcacagacgguaugauacagaaaauaaguagauacaccaaaguacgcgaaagauguuacaguaaagguacggaauuuguugaugcggaaacaggcgaaauauuuagaccagaagauuacaguagagccgaaugggaugaaauauucggaguacacauuccaaaaccuugggaaacauuucgggcagaacuugauguccgaaugggagaugauccaaaagguuuccuagauacucauagugacguggcauuagaacuagacuauccugaguauauauacgaaaauuuaaggccuauauuuguaagccgaaugcccaaccauaaaguaaccggagcagcacaugcagauacuauccggaguccuaggcauuucaaagaugaagggauaguacuaacaaaaacagcacuaacagaucucaaauuagacaaagauggagaaauagaugguuauuacaauccccaaagugauuuauuacuguacgaagcguuaaagaaacaauuauuauuauacggcaaugaugcuaagaaagcauucgcucaagauuuucauaaaccgaaagcagaugggacagaaggaccaguuguaagaaaaguaaaaauucaaaagaaacaaacuaugggaguauuuguagauucagguaacggaauugcggaaaaugguggcaugguaagaauagacguauucagagucaaugggaaauauuacuucguuccagucuauacagcagauguagugaagaaaguacuaccaaacagagcaagcaccgcucauaaaccauacggugaauggaaaguaauggaagauaaagauuuucuguucucucuauauucuagagaccuaauacauauaaaauccaagaaagauaucccaauuaaaauggucaacggagguauggaaggaauaaaagaaacguacgccuauuauauaggagcugauaucagugcagcaaacauccaaggaauagcgcaugauucaagauacaaauuuaggggacucggaauacaaucgcuugacgugcuagaaaaaugucaaauagauguccuaggacauguaaguguuguaagaucggagaaacgaaugggauuuaguuga

SEQ ID NO: 8645 - RNA, 3423 nt, Artificial Sequence
  Cas9 variant
augaacggccucguauuaggauuagacaucggaauugcaucagucggugucgguauacuagagaaaaacucaggaaaaauaguacacgcuucaucacgaauauuccccgcagcuacagccgauaauaacguugaacgaagaaagaaccgacaagcacgaagauuaaauagaagaaagaaacacagagguguuagauuccaagaccucuucgaagacuacgguuuacucaccgauuucucgaaaguaucuaucaacuuaaauccguauagacucagaguagauggauugaaccaacagcuaacgaacgaagaacuauuuaucgcauuaaagaacauaguuaaacgccgaggcaucucauaccuagaugacgcaucagaagacggagggacaguaucaagugacuacgguaaagcagucgaagagaauagaaaacuacuagcagagaaaacaccagggcaaauccaacuagaaagauucgaaaaauauggacaguuacgaggugauuucacaguaguugaaaacggugagaaaugcagacugauaaacguauucucaacgucagcauauaagaaagaagcggaacgaauauuaagaaaacagcaagauuucaacaaccaaauaacagaugaguucauagaagacuacuuaaaaauucuaacaggcaaaagaaaauauuaucacggaccaggcaacgaaaaaucuagaacagacuauggaagauacacaacacauaaagacucgaaaggugaauauguaacguuagacaauauauuugguguauuaauaggaaaauguacauuuuauccaaaugaauacagagccuccaaagcaucauacacugcacaagaauuuaacuuacuaaacgaccuuaauaaccuaaccguacccacagagaccaagaaacuaagcgaagaacaaaagaaaaccauaaucgaauacgcaaaaucagcaaaaacacuaggagcaagcacauuacuaaaauacauagcaaaaaugauugacacaagcguagaucagauuagaggguaccgaguugacguaaacaacaaaccagaaauacauaccuucgaaguauaucgaaaaaugcaaucacuggagacuauaucaguaggggaacuaucucgcaauguuuuagacgaauuagcccacauauuaacauuaaauacagaaagagaaggaauagaggaagccauaaauacuaaacugaaagauaguuuuucucaagaucaaguacuugaacucguacaauuccgaaagaacaacaguucauuauucaguaaaggauggcacaacuuuagccuuaaacucaugauggaacugauaccagaacuguacgaaacauccgaggaacaaaugacaaucuuaacacgacugggcaaacaaaaaucaaaagaaacaucgaaaagaacaaaauauauagacgaaaaagaguuaacugaagaaauauauaauccaguaguagcaaaaagcguaagacaagcuauaaaaaucauaaacgaggccacgaagaaacacggcaucuuugacaauaucgucauagaaauggcaagagaaaacaaugaagaagacgcaaagaaagacuacaucaaaagacaaaaagcaaaccaagacgaaaaauacgcagcaauggagaaagcugcuuuccaguauaacgguaagaaagaacucccagauaauauuuuccacggacauaaagaauuagcuacaaaaauaagauuguggcaccaacagggagagaaaugucuauauaccggaaaaaguauaccaauuagcgauuuaauacacaaucaauauaaauacgaaaucgaucacauacuuccauuaagccucuccuucgacgacagccuaucaaacaaaguccuaguacucgccacugcuaaccaggagaaaggccagcggacuccauuccaagcacucgauaguauggacgaugcauggagcuacagggaguucaaaucauauguaaaagaaucaaaauuacuaggaaacaaaaagaaagaauaccuacuuaccgaagaagacauaaguaaaaucgaaguuaaacaaaaauuuauagaacgaaauuuaguagacacacgauacagcucccgugugguccuaaacgcacuccaagacuuuuauaaaaaccacaacuuugauaccacaauuucagucguaagaggacaauucacaucacaacuccgacgaaaauggggguuagaaaaaucucgagaaacauaccaccaucacgcaguagacgcacuaauaauugcagcgucaucccaacucagauuauggaagaaacaaaacaacccacuaauugccuacaaagaaggacaauuugucgacucucaaacgggagaaauaaucucucuuaccgacgaugaauauaaagagcuaguauucaaagcacccuaugaccacuuuguagacacccuaucaagcaaaaccuuugaagacaguauccucuucaguuaccaaguagauaguaaauuuaauagaaaaauaagcgacgccaccauauaugcaacacgaaaagcaaaacuagacaaagaaaagaaagaauauacguacacacuaggaaaaauuaaagacaucuauagcuuagguacuaaaacaccaucuaaaacaggguucuacaaauuccuugauuuguauaacaaagauaaaucacaauuccucauguuucaaaaagaccgcaaaacaugggaugaaguuauagagaaaaucauggaacaguacagaccuuuuaaagaauacgacaaagcaggcaaacucguugacuucaaccccuuugaaaaauauagacaggaaaauggcccaauaagaaaauauaguaagaaaggaaacggaccagaaaucaaaagccugaaauacuaugauauuuuacucgguaaacacaaaaauauuacaccagaaggcucacgaaauaccguagcauuauuaucguugaacccauggcguaccgauguuuauuacaacauggaaacuaagaaauacgaguuccuuggccuaaaauacgccgaccuaccauucgaagaaggaggugcauauggaauaagcaccgaaacuuauaaugaacuaagagaaaaagaaggaauagggaaaaauucagaauuuaaauucacacuuuacaaaaaugaucuaauauugauaaaagauacagaaacaaauugccaacaauuuuuccgauuuuggucaagaacaggaaaagauaacccuaaaucuuucgagaaacacaaaauagagcuaaaaccauacgagaaagccaaauuugaaaaaggagaggaacuugaaguacuaggaaaaguuccaccaucaucaaaucaauuucagaaaaacaugcaaauagaaaaucuaucaauauacaaaguaaagacagacgugcuggguaauaaacauuuuauaaagaaagaaggcgacaaacccaaacugaaauucuga

SEQ ID NO: 8646 - RNA, 3423 nt, Artificial Sequence
  Cas9 variant
augaauggacuggugcuaggacuagacaucgggauugcaucaguugguguaggaauauuaaaaaaagauauuggagaaauaauccacaccaauagucgacuauucagugcagcaacagcagauucaaauauagaaaggagaggacaucguggaggaaaaagguuaaccagaagaaaaaaacauaggucaaucagguuacacgaccucuucgaagacuucgggcuccuaaccgacuucucuaaaguaaguaucaacuuaaacccguaccaauuaagaguacaaggacucgacaaucaauuaacaaacgaagaacuauucauugcacuaaaaaauauaguaaagagaaggggaauaagcuaucuagacgaugcgagcgaagacggagguacaguuucaagcgauuacggaaaagccguagaagaaaaccgaaaacucuuagccgaacaaacccccggccaaauacaguuagacagauucgaaaaauauggacaaguaaggggagauuuuaauguaguugaaaauggagaaaaacggaggcuaauaaacguuuuuaccaccucagcauacuccaaagaagccgaaagaaucuuacgaaaacaacaagaauucaacaaaaaaaucacagaugaauuuauagaagacuaccuaacaauacuaaccggcaaaagaaaauacuaucacggaccaggaaacgaaaaaucacgaacagacuauggccgcuacacaacaaaaaaagauccagaagguaaguauaucacuuuagacaauauauuuggcauccuuaucggaaaaugcacauucuacccugacgaauacagagcaagcaaagcaaguuacacagcccaagaauucaaucucuuaaaugaccuaaacaaccuaacuguuccaacagaaacuaaaaaauuaagcgaagaacaaaaaaaaaccauuaucaaauacgcaaagacagcuaaaacacuaggcgcaucuacuuuacuaaaauauauugcaaaacuuauaggugcaucgguagaucaaauucauggauauagaauugauccaaauaaaaagccagaaaugcacacauucgaaacuuaucgaaaaaugcagucacuagaaacaauuagcguagaagaacuuccaagaaaggucuuagaugaauuagcacacaucuuaacuuuaaacacugagcgagaagggaucgaagaagccaucaacgcuacacuaaaagacacauuuucucaagaucagguacuugaacuaguacaauuuagaaaaaacaauucgucccuauuuucaaaaggauggcacucuuuuagucucaaacuaaugauggaauuaauaccagaauuauaugagacuucagaagaacaaaugaccauucucacacgauuaggaaaacaaaaaucgaaagaaacaagcaaacgaacaaaauacauagacgaaaaagaguuaaccgaagaaauauacaauccaguaguagccaaaaguguacgacaagcaaucaaaauaauaaaugaggcaacgaaaaaguacggcauuuucgauaacauagugaucgagauggcaagggaaaacaaugaagaagacgcaaaaaaagaauauauuaagagacagaaagccaacuuagacgaaaaaaaugcagcaauggaaaaagccgcauuccaauacaacggaaaaaaagaacuuccagacaauguauuccacggacacaaagaacuggcgacaaaaauacgauuauggcaccaacagggagaaaaaugcuuauacacaggaaaaaauauaccaaucucagaucuuauacaaaaccaauauaaguacgaaauagaccauauccuaccguuauccuugucuuucgaugacagccuaaguaacaaaguacucguccuagcaacagcaaaccaagaaaaaggccaaagaacaccauuccaggcauuagauagcauggacgacgccuggaguuauagagaauuuaaauccuaugucaaagauagcaaacuccuaggaaacaagaaaaaagaauauuuacuaacggaggaagacauuagcaaaauagaagucaaacaaaaauuuauagaaagaaaucuuguagacaccagauacuccagccgagucguauugaaugcacuacaagauuucuauaaagagcaccaauucgauacaacaauaucaguuguaagaggacaguuuacgucacagcuacgacgaaaauggggacuagaaaaaucuagagaaacuuaccaccaucaugccguagacgcacuuauaauagcagccucaagucaacuuagauuauggaaaaagcaaaacaauccacucauaagcuacacugaaggacaauucguagaccaaguaacaggagagauuauaucauuaagcgaugacgaguauaaagaacucguauuuaaagcaccguaugaccacuucguagacacccuaaaaucaaaaaaauuugaagauucaauauuauucucauaucaaguagacaguaaauauaauagaaaaaucucggaugcaacaaucuacgcaacccgcaaagccaaacuagacaaggaaaauaaagaauacaccuacaccuuaggaaaaaucaaagauaucuacgcacuaggaacgaaaucgccaucaaaaacaggguuuuacaaauuucuugaccuuuacaauaaagacaaaucucaguuccuaauguuccaaaaagaucgaaaaacaugggaugaaguuauagaaaaaauuauagaacaguauagaccauuuaaagaauacgacgaaaauggaaaagaaguagauuucaauccauuugaaaaauaccgaaucgaaaauggcccaauuagaaaauauucaaaaaaaggaaacggaccugaaauaaaaagucucaaauacuacgacaaucuuuuaggaaaauucguagauauaacaccaucagaaucaaaaaaccccguagcucuccuaucauuaaauccguggcgaaccgaugucuacuauaacacagaaacaucaaaauaugaauuucuaggacuaaaauacgcugaccuuugcuuugaaaaagguggcgcauacggaauaucagaaguuaaauauaauaaaauccgugaaaaagaaggaaucggaaaagaaucagaauucaaauucacacuauacaaaaaugaucuuauucuuauuaaagacacagaaacaaacugccaacaaauauuuagguuuuggaguagaaccggaaaagacaauccaaaaagcuuugaaaaacauaaaauagagcugaaaccauacgaaaaagccagauucgaaaaaggagaagaacuugaaguucucggcaagguaccaccauccucaaaccaacuacaaaaaaacaugcaaauagaaaaccucucaauauacaagguaaaaacagacguauuaggaaauaagcauuuuauaaaaaaagagggagaagaaccaaaacugaaauucuga

SEQ ID NO: 8647 - RNA, 3423 nt, Artificial Sequence
  Cas9 variant
auggaagaaaacuuccaauaucguauagguuuagacauaggaauaaccucaguugguugggcagugcuucaaaauaauucacaagacgaacccgugagaauuacugacuuaggcguaagaauauucgauguagcagaaaacccaaaaaacggagacgcucuugcugcaccaaggagagacgcuagaacgacaagaagaagacuacgacggagacgacacagguuggaacgcauuaaauuuuuacuacaagaaaauggacucauagaaauggauaguuucauggaaagauacuauaaagggaaucuaccagacguauaucagcuaagauaugaaggccuagauagaaaauuaaaagaugaggaauuggcacaaguuuugauucauauagcaaaacacagaggguuuagauccacaagaaaagccgaaacaaaaggcaaagaagguggggcaguuuuaaaagcuaccacagaaaaucaaaaaauaaugcaggaaaaagguuacagaacagucggagaaaugcuauaccuagaugaagcuuuucauacagagugcuuauggaaugaaaaaggcuauguacugacgccgcgaaauaggccagacgacuacaaacauacaauacugagauccauguuaguagaagaaguacaugccauauucgccgcucaaagagcacuggguaaugagaaagcaacagaagaauuggaaaacgcuuaugucgaaauuaugacuucccaaaggagcuucgauauggguccaggccuacaaccugacggaaaaccaucaccauaugcaauggaaggauuuggcgacaggguaggaaaaugcacguucgaaaaagaugaauauagagcaccaaaagcaacauauaccgcagaacuauucguagcauuacaaaagauaaaucauacaaaguuaauagaugaauucggaacaggccgguucuucaccgaagaggaaagaaaaacaauuauugaccucuuacuaucaggcaaagaacucaaauaugguacaauuagaaaaaaacuaaauauagacccuucacuaaaauucaauaguuuaaauuauucggcgaaaaaagaaggcgaaacggaagaagaaagagucagagacacagaaaaagcuaaguuugcaagcauguucuggacguaugaauacucaaaaugcuuaaaagaucggaaugaagaaaugacaguaggacaaaaagcggaucuauuagaucgaauaggugaaauacuuacugcauacaaaaaugaugacucuagaaguucaaggcuggaagauuuaggcuuaagccgagaagaaauagacggccuucuagaauuaagcccugcaaaauaccaaagggucaguuuaaaagccaugagaaaaaugcaaccauaucuagaagacgguuuaauauaugauaaagcaugugaagcagcaggcuaugacuuuagggccuuaaacgacggaaauaaaaaacaccuuuuaaaaggggaagaaauaaaugcuauagucaaugacauaacaaauccaguuguaaaaagaaguguaucucaaacaauaaaaguaauaaaugcgauaauacaaaaauacggcucaccacaagcaguaaacauugaguuagcaagagaaaugagcaaaaauuuucaagauagaacuaacuuagagaaagagaugaaaaaacggcagcaagaaaaugaacgugcaaagcaacaaauaauugaauuaggaaagcaaaauccgacaggacaagauaucuuaaaguacaggcuauggaaugaucagggaggauacugcuuauauaguggaaaaaaaauaccccuagaagagcuauuuggaggggguuacgacauagaucauauauuaccuuauucaauaacauucgaugauagcuaucgaaauaaaguacuuguaacggcacaagaaaaucgacaaaaaggaaacaggacaccauaugaguacuuuggggcggaugaaaaacauugggaagauuacgaggccagaguaagguuacuaguucgagauuauaagaaacaacaaaaacuacuaaaaaaaaauuucacagaagaagaaagaaaagaauuuaaagaaagaaauuuaaacgauaccaaauauauaacaagagugguauacaauaugauuagacaaaaucucgaauuagagccguucaaccauccagaaaaaaaaaaacaaguuugggcuguaaauggagcagucaccaguuaccuuaggaaaagguggggauuaaugcaaaaagauagaaguacggauagacaucacgcuauggaugcaguagucauagcauguugcacagauggaaugauacauaaaauaucccguuacaugcaaggaagagaauuagccuacagucgcaauuucaaauucccugacgaggaaacaggagaaauccuaaaccgagauaauuuuacacgagaacaaugggaugagaaauucggaguuaagguuccacuaccguggaauaguuuccgugacgaauuggauauaagacuauugaacgaagaucccaaaaauuuucuccuaacgcacgcggauguacagagggaacuagauuacccuggcuggauguacggggaagaagaaagcccgauagaagagggaagauacauuaacuauauacgccccuuauuuguaagucguaugcccaaccacaaaguaacaggcagugcacacgacgcuacaauaagaucagcgcgggauuacgaaacgaggggggucgucauaacgaaaguaccacuaaccgaucuuaaauuaaacaaagauaaugaaauagaagguuacuaugauaaagauucagaucgauuacuauaucaagcacuaguaagacaguugcuacugcacggcaaugauggcaaaaaagcguuugcagaggacuuccauaagccuaaagcagacggaacugagggaccaguaguucgaaaaguuaaaauugaaaaaaaacaaacaagcgguguaaugguaagagguggaacaggaauugcagcuaauggagaaaugguaagaauagauguguuuagagaaaauggaaaauauuauuucguaccuguauauaccgcagacguggugcguaaaguauuaccuaauagagcagcuaugaacgguaaaauagcaucagacuggaagacaauggaagauaacaauuuuguauucagcuuauauucaagggaucuaauacauguaaaaaggaaaaaagcaauaccaacaauacuaucaucaggugcgacauuugagcaggaagaauuuuacgcuuauuucacaggagccgauauauccacaguuucaauagcaggcauaucaaaugacaacucauucaaauucaggggguuaggaauacaaggacuagaaauauuugagaaaugucaaguugauauucuaggaaauauuucaguggucagacaugaaaauagacaaggauuucacuga

SEQ ID NO: 8648 - RNA, 3426 nt, Artificial Sequence
  Cas9 variant
auguacaguauaggcuuagacauagggauagcaaguguaggcuauucaguaaucgaaacuaauagcggaagaauaguagaacuaggagccagaauauuugaagccagaaacagugauaauaauaaagauagaagagacuuuagaggaggcagaagauuaauuaggagaagaaagacgagacuugacgacgcaaaacgauacuuagacgaccaaggauuuaaaaacgacaaaucauuaauuaacgucugcccauauaguuuacgaguuaaagguuuaacagaagaacugucaaaaucagaaauucgcaaaguaauacuccacauauuaaaaaaacgaggagucaguuaccuaaguucagaagacuuagauacaaguaguguggauaauaaagacuccuuuaaacaagcuguaacaaaaaaucuacgacaacuugacgacaaaaccccugggcaaauccaauaugagcgacugcaggagucagggagaguucguacagggauaaaccagaauggacaauaucaacuuaacguauuugaugucgcaucguacgcaaaagaauuaaaauuaauacuugaaacacaacaacaguaccaccaagaaauagaugaucacuucuuagauuucuucacuaaagacgguuaccgcgaagacgcagguuuaauuuacagaaaacgaccauacuaugacggaccaggaaacgcagcacagaauucaucuuacggaagaugggcgaauuaccagguagauggaaaacccgcggaaaauaucuucgaccaacuaauaggaaaagacuucacugguaaaauuagagccuccaacuuaggaccaucagcccaaaaauucaacuuacuaaacgacuuaaacaaccuaagaauaacaacaagagaagaggaaaaauuaacguucgaagagaaacaagaaauauuagaaguacuagaaaacgaucgucccaaaacuuuugguccaagaaacaucgcaaaaaugcugaaagucgacauggacgacauuaaaggauggagauuaaacucuagugacaaaccagaaauucauacaaugaaagaguauaacgauaugagauuaguccuagaagcaggaggcuucgauauuaaagcaauagaucucgaccauauugaagaaauagcaagcuuaauuacacucaacacagagcgcgaagcguuugaacuaaguuuaaguaaugaaaucgauaauaauuuaaaacaauuccuugucgaaaauuuuaacgcacuaagaaaaugcaaaccaaacaacucuuggcauagcuucucaaaggagaacuuacaaagguuaaucaccgaauuagaacauaccucagaugaacaaaauacaauacucgaaagacuuggucuaaaauuugacuuaagauccaaauauucagacagagauacuuuaccaauacacgaaguacuagaagaaaucuacaaccccaccguaagcaagagcgugagacaaacauuuagaguccuaaaugcccugguaaaaaaauacggaaaagaaaauauugacuacguaacaauagaaaugccuagagauaagaaugaagacgaccaaaaaaaaaccauccgcgaaauacaaaaagucaacaagaacagaaaagauaaaaguaaagaauacuuucuaaaaaaaucaggauggagcgaggagaaguucgaagaaaaauuaagaacaagucgaagauuugcaucaaaacuauacuacuuuuacgagcaagacggauuaugcgcauauacaggucagcaaauacagcccgaagacuuauuaacagaacggguagaaguagaccacauuaucccgcucucaguuucauuagaugacagcauaaacaacaagguacuaguaacaagugaagcuaaucaaaaaaaaggacaacggaguccuuaugaugcuuucaugucaggcgauuuuucaaaauauagaacauaugacgaauacaaggcauggguauuaucaaauaaauacaaaaaauacaaaaaggcauuacuacuagaagaacgaaacaucuucgacccagagcuugcaaaaaaauucaggcagagaaaccucaacgauacaagguaugccagcagaaucgugcucaacgcaguacaaagcuuuuucuauaaaacagauacaaaaacaagaguaguaaauggagcauuuacacauaccuuaaggaaaaaguggaaucucgcagauaaagaucgagaaacacaucaccaccacgcaauagacgcaacgcuuguagcaguuacucccuucguuaaagcagaaagguaugaguacuacaaggacucagaaggaaaagcuaguaugguugacacaguuacaggcacuauaaucccguacucugaauacaaaaaaaaaaaccuauaugauagaucaaacuauuuacugauguuugguaaugaaaguacuaucaaccaagaaaaagaggauaaaucagcagaguucauaagaaaucucauaccugcaaagauuuauccagaaauaaaauucucgcaccaagucgauagaaaaucgaacagaagacuaucagacgccacaauauauucaaccagaaguuacacaguugaaaaaggaaggggcaaaaauaaacgggaaguaauagaaagagauauuaucggaaaaauaaaagacauauauacagccgaugguuacgcagaauaugucaaauauaaagacucauuacuagucaaagaaauagaugaaaaaaccuucgaaaaauuagaagcuauaauagaagaauuuucagacacaguagaaguaacagaccaacaaggcaaaguuaaaaaagucagcaaaagcccauuucuacaauacugugaaaaauaugauguaccaggagugacuaaauacucgaaaaagaauaacgguccagugauaaggagccuaaaauacagauauacaaaacucagaucacacauagacaucucaccaaaaaauaguaaaaauacaguagcucuuuuaacauuagcaccuuggaggacagacguauacuacucgcaagaaaccgcaaguuaucauuuacuaggauuaaaauacauugacuuaucguucagagacggaggauacggaguaucucguaaaagauacgaagaaauuaaaaaaaacgaaagaauaccagaagauggcgaauucaaauucucucuuuauaaaaaagauuacauagaaauagaauuugacaaaaaaauacuaccagguuuauaccaaucuagggacgucagugcuagaaauaaauucuccaugaaaccaaucgacaaagcucaauggacaaguaaagaagaugugcuuauguuuggcaauguaaaagccagcggaguauucgaaaaaacuuuaaaaaagaacuacguuuugagaaaauaucacguggauguacugggaaacaaauucgaaguaaaagaugagauucuaaaagacauacuggaauga

SEQ ID NO: 8649 - RNA, 3429 nt, Artificial Sequence
  Cas9 variant
auguacucaguaggguuagacaucggaauagcauccugcggauacucaaucauuaacgacguaaacggaaauaucguugaguuagguacauuacuauucaaaucacgaaauucugacaacaacgaagaaagacgaacuaauaggggaucaagaagauuaauaaaccgucguagaacacgucuagaugacggaaaaaaacuauuagcugaaaaaggauucaaacaagauucaaagcuuaaacauguaugcccauaugaauuaagagugaaggguuuacaugaaaaauuaacgcaaggcgaaauuuacaaaguuguacuucacauacuaaaaaaaagagggauaagcuacuuagacgaauccgacgaaaauucauccgguaucgacggugcuucuuacaaggaccaaguaaaucuaaaccuaaaccuacaaaaagaacuuacuccuggucaaauucaauugaaaagacucaaagaaaacggaagaauaaaaaguggcgucacauuugaaaauggauaccaacuuaacguauucagcgugucagcauacgcuaaugaauuaaauaagauauuaacaaaacaaucagaguacuacuccgaaaucgaccaaauuuggauugauagauuuacaaaaaacggauauagaaaagaagcaggauuaguauaccgaaaaagacccuauuacgauggaccaggaaacgaaaaaaacaacuccauauacggaagaugggcaaacuucaaagaagauggacacccaaaagaaaauauauucgaccaacuaauaggccuggauucgguagauuccacgcaaguacgagccucagcaagcacccuaacagcucagaaauacaacuuacucaaugacuuaaacaaccuaaccauaauagaagacgacagaaaauucacaaccgacgaaaaagugucuauaauuaauuaccuaaugacacaagacauaacacgauuuggaccaaaggaauuagcaaaauucuaucaacuagaaguagaccaaauacgaggauggcgcauagauaauaaaggcaacccagaaauacacucucucaaaguauacagagacuggaaaaaaauuuucaacaccucaagcauagauuuaaccucaauucagaccuggguaguugacgaauuagcaaacguaaucacucuuaauacagaaauacccucuacucucgcaacacuuaaaauaaagauaccggacauagaucaacaaauccuaaauuuuguugaaaauaacuucuaugaacucaagaaaaaaacaucaaaaaacucguggcauagcuucagucuaaagacacugaacauucucauuccggaacuguuaaacacaucugaagaacagaacaccauccuagaaagacucaacuuaaaguuugaucucaagaauaaauacgcagagaaaaaucaaaucccgguuaaagagcucuuagaacaaauauacaacccaacaguaacaaaaucaguucaccagaguauuaaacuauuuaaugaaauaauagaaaaauauggcaaaaauaacauaucguacguuaccauugagaugccucgagacaaaaaugaucaagaccagaaggacaccauaaaaagaauaaacaaauuaaacagugaaagaaaaaaugauucagaaaaauacuucuuagaacgcucaggcugggacacaauuagauucgagagcgcauuaaaaaaaccaagauucgcagaaaaauuauuauucuauuacgaacaaaaagguaaaugcgccuacucaggccaagauauacuagcagaaucacuccuaaaugaaucaugcgaaguagaucacauaauaccuuuguccauaagcuuugacgacagcauucauaacaaaguacuuguaacggcgagcucaaaccaagaaaaaggacaacgaacccccuauauggcauuuauagacggagcuaaauugggccaaucaugggaugauuuuguugcaugggucaacuccuguggauuccaucgaaagaaaguacaaaaccuucuauacgaggaaaacauuuucaacccagauguccaaagaggcuuuguaucacgaaauuuaaacgacacaagauaugcaucgagaauaguacuaaaugcaauucaauccuucuucuauaaacaaaaagauuugaccaaaguaaaaguugucaacggaagcuucacgcacacgcuuagaaaaaaauggggaucaucauuagacaaaaauagagauacauaccaccaccaugcuguggaugcaaccuuaugcgcuguaacaccuuucauaaacauuguaaaauaugaauuuuucgaagaagauggaaucaaauauauggucgaucugaccacaggagaaaaaguugcauauucagauuacaaaaaaaugaaauuuuacgacaaaagagcauacguacccaucugggauggauuuauaaaacaauuaacaccggcaaaccuauaucccaaaauaaaauucucacaucaagucgacuccaaauggaaucgaaaaauaucggaugcaacaauauauucaacaaggaaaauuguugaaaccaaaauaaacaagaaaggaguugcgaaagaaaccgugaaagauauaguaaucgacaaaaucaaggacauauauacuccagaaggauggcguaaauucaaagaaaaacaagauaaauuacuaaugaaaaacuucgaugaaaaaacauacaauaaacuuaucaaaauagcuaaagaguacccagaaaaaaaagaaguccaaacaagcaacggaaaagugagcuuagucgagguaucuccuuuuaaaauguauugugaggagcaaaacguaccagccauaaggaaauacaguaaaaaaggaaauggcccauacauuagaagcuuaaaguuuuacgauaaagaacuaggaaaacacauuaauauaacaaaagacucauacggaaaugacauagaacgcacaauaagaaacaaaaaaaucauuuuaaaaaaucaaaacucuuggagaaccgacguauacuauaacucagucaauaauuguuacgaacuacuaggcauaaaguacugccauuuaaaauucuacaggggcaaauacggaauaccgaaaucuauauaugacgaacuaaaaaaagaagacgaaauaagcucagaauccguauuuaaauucucauuauacagacacgacagaguuagauucgaaaaagauggcgaauacauagaagcauuauucggaucaaaaaacgaaucaaauaaaaacuaccucgaacucucucccauagacaaaaacaaaugguuaucgaaagaaaacguaaaauucuucggagaggucgcugcauccggacguuuuaucaaaggauuaaaaccagguauaaaaguaaucaagcaaucgaccgauuauaugggacacguauaugcaauacaccaagaaaaauuaaaauucguacuaucagacgcguga

SEQ ID NO: 8650 - RNA, 3435 nt, Artificial Sequence
  Cas9 variant
augacaucuaaacaagaaaagcauggugcauuaacuuucggguuagauauaggaaucgcuucagucgguugggcaguauuaggggaaucucgaaucguagaccucggaguacguuguuucgauaaggcggaaacagcaaaagaaggggagaguuuaaacuuaaccaggagaauggcaagacuauuaagaagaagauuaagaagacgagcauggcgguuaacgaaacuagcccgccuacuaaaaagagaaggguuaauugcagacgcuaacuuauuuaaacauaaaauagagaaaaacaccccagugccuaagaguucguggcaacuuagaguugauggcuuagacagacaacuaaacgccgaagaaugggcucggguaauauaucauuuauguaaacacaggggauuucacuggauaagccgagcugaagaaaaagccgcggaaggugacaguaagggagaaggagguaaaguaaaacaggguuuagccggaacuaagaaacuaaugcaagaaaaaucauaccgaacugcagccgaaaugguauuagcagaguuccccgacgcacaaagaaacaaacaaggugacuacucaaaagcauuauccagaauuuuacucggagacgaauugaaagcccuguuugaacaucaacgcaaacuagguaauccuguagcaacagaaaaacuugaagcagcaauacuaggaaauggagacaagaaauguggucuauuuugggcacaaaacccggcacuagcaggaaacaaauuauuagaaaugcuaggucgaugcacauuugagaaaacuggaggcgaugauggaaaaggcgaauauagggcuccaaaagcaaguuucucagcagaacgacauguuuggcuaacacaccuaaauaaccuaagaauaguaguggaugguacuaccaggccucuaaaugaagcggaaagaagaguagcauuacccaugccguaucagcaagcaggagaucucucauauaaacaacuuggaggugcuuuaauuaaagaaggguucuuacagaaagauggcuuuaaauuugcuggacuaccauauccaacaaaacaagcaagugaggagaaagcaaaagacccagagacaucagucuuauguaaacuaccagccuggcauacgcuuagaaaaaccuuagagaaacauggacuggaaucagaauggcaaaaacuaucaaccgaugcuuuggacgguaaaccacaacuacucgacaauauagcuuggguauuaagcguuuacaaagaugaugaugagguaaaaaccgaauuggguaagcuaaaucuuccuaauacagagaaaaugauagaugccuuacuggauauaagguucgauaaauucucaaauuuaaguuuaaaagcauuaucuaaaauaguaccauuuauggaacaaggucaaagauacgacgaagcuguagcaaacauucccgaauaugggcaccauucacagcuacauaaaguaggugcuggggaacacaaauaucuuccacccuuuuauaaagaacgagacaaaaccggaaggaugguguuuaaugaugacauggauaucccgcgaaacccagucguccuaagagcacuaaaucaagcaagaaaaguuguaaaugcucuaaucaaggaauaugguucaccacaugaaguucauaucgaaauggcaagggaucucucacgcccacucgacgagcgccgugacaucgaaaaacuccaaaaagaguucggagaaagaaacaagaaagauaaagaauuauucgcucaagauuuuaauauaguaggaacaguaaaaggaaaacaauucgaaaaauaccaauuauaccgagaacaacaaggaaaauguaucuauccauccauggaugaaaaacaaggcauauguugcuauucucuaaaaccauuagauuuacauagaguacuguaugaagaaggauaugcagaaauagaucaugcauugccuuacaguaggucauucgacgauagcaagaauaaccguguauuaguucuugcaaaagagaauagagauaagggaaaucggaccccuuuugaauaucugggggauaaagauaacagugaaccuuggagacaguuuguagcuuuuguugaagguaauaaagcauauagguuggccaaacgaaguagacuauuaagaaaagauuuuggagacaaagaagcaaaggaauuucgagagagaaaucucaaugauacacgcuauauauguaaauuuuucaaaaauuacguggaacaauaccuccaacugcaugaggauuccgaagcaaaaagauguguaguccuuucgggacaaaugaccaguuucuuacgcgcucgauggggauuaguuaaaguaagaggugacucagacagacaucacgcauuagaugccgcuguaguagcagcauguagccauggcaugguaaaaagacucuccgacuacagcagaagaaaagaacuagaacaaguuagagaaggauuuguugauguugauacuggggaaauagucaacccagcaauguuucaacaagugcaagaacauuucccaaauccauggccacacuuuagagaugagguaaaauuacgccuaaguauagaugacccaacuuuauuaagaucagaaauggaaaaauuugguacuuacacacccgaaucauuagaagcgcucagaccauuauuuguaucgagagcaccucagagaagaaauaguggcgcugcccacaaagauaccauauacgcacaaccgaaaagauuaguagcacaaggaggugugacacaaaaagucgcacuaucgagucuuacacuaaaagaucuagauaaacuuauugauccucaucgaaacgaaagacuauacgcagcaauacgagcacgacuugaacaacacggaggaaaaggcgacaaggcauuuccagcaucaaacccauuaagaaaaccagauagcgaaggcaaccccacugggccaauaguuagaggaguuacuaugguaauagauaaacuaagugguauacccauaagaggcggaauugccaaaaaugauucgaugguaagaguagauguauucacaaaagcaaacaaauuucacuuaguaccaguauauguacaccacucgguacuuggcuuaccaaaccaagcaauaguuggaggcaaagaagaaucagaauggacacaaauagacgauucuuuugauuggcauuuuucaauauauccuaacgaccucauacgagugacacuaaaacaagaaggaagguuuggauacuacgcaggcugcgacagaagcacugcagcaauucaucucugggcacacgaccgaaaccaacaagucggaaaagauggacucauccguuccaucggaguaaaaacagcucuauccauagaaaaauuuaaugucgacguacuaggaaacagauacccagcaccaccagagaaaagaagagauuuagccuga

SEQ ID NO: 8651 - RNA, 3435 nt, Artificial Sequence
  Cas9 variant
augacaucaaaacaagaaaacuuaggggcguuaacauucggauuggauauaggaauagcaucaguuggaugggcuguucucggugaaaauagaaucauugauuugggagugagaugcuuugauaaagcagaaacagcgaaagaaggcgaaucccucaaucucacaagaagaauggcaagacuuuuaagaagacguuugcggagacgagcuuggagauuaacgaaacuagcuagacuucuaaaaagagaaggacuaauagcagaugcaaauuuauuuaaacauaaaauugagaaaaacacucccguuccaaaaucaucuuggcaauuaagaguugauggacuggacagacaauuaaaugcagaagaaugggcaagaguuauauaucauuuguguaagcauagaggauuucacuggauaucgcgcgcugaagaaaaggccgcagaaggcgacuccaaaggugaaggagguaaaguaaaacaagguuuagcgggaaccaagaaacuaaugcaagaaaaaucguauagaacggcugcagaaaugguguuagcugaguucccggaugcgcaacgcaacaaacaaggugauuauaguaaggcuuuaucgcgcauacucuuaggagacgaacuaaaagcauuauucgaacaucaacguaaacucggaaauccaguagcaaccgaaaaacuggaagccgcaauauuagguaauggugacaagaaaugcggauuauuuugggcucaaaauccugcauuggccgguaauaaacuauuagaaaugcuuggaagaugcacguuugagaaaacaggaggugaugacggaaaaggugaauauagggcgccaaaagcaucauucucugcagaaagacacguuuggcuaacacauuuaaauaaucuaagaauaguaguagacggaacuacgagaccauuaaacgaagcagaaaggagaguagcauuaccaaugccauaccaacaagcaggggaccuaucauacaaacaguuaggaggagcauuaauaaaagaaggauucuugcaaaaagauggauucaaauucgcaggacuaccuuacccaacaaaacaggcuucagaagaaaaagcaaaagauccggaaacuucaguucuauguaaacuuccagcauggcauacuuuaagaaaaacacuagaaaaacauggucuagaaagugaauggcaaaaauugucgacagacgcauuggacggaaaaccccaauuauuggacaacauagcauggguacugagcguauauaaagaugaugaugaagucaagacugaauuagggaaauuaaacuuaccgaauacggagaaaaugauagacgcgcuuuuggauauuagauuugauaaauuuucaaauuuaagccuaaaagcacuaucaaaaauaguaccauucauggaacaaggccaaagauaugacgaagcaguugcuaacauacccgaauauggacaucauagccaauuacauaaaguuggugcaggagaacauaaauacuuaccaccauuuuauaaagaaagagacaaaacaggaagaauggucuuuaaugaugauauggacauaccaagaaacccaguggucuuaagagcccuuaaccaagcgaggaagguaguuaacgcacucauaaaagaauacggaucuccacaugaaguacauaucgagauggcacgggauuuaucuagaccuuuagaugaacgaagggauauagaaaaacuacaaaaagaauuuggcgaacggaauaagaaagacaaagaacucuuugcccaagauuuuaauauugucgguacaguuaaaggaaaacaauuugaaaaauaucaacuauacagagaacaacaagggaaauguauauaccccaguauggacgaaaaacaaggaauauguuguuacaguuuaaagccauuagacuuacaccgaguccuauaugaggaagguuacgcugaaauagaucaugcccuccccuauucacguucauucgacgauaguaaaaauaacagaguacuuguacuagcaaaagaaaacagagauaaaggcaauagaacgcccuuugaauaccucggugauaaagacaauagcgaacccuggcgacaauuuguugcauuuguagaaggaaacaaagcauauagauuggcaaaacgaucaaggcuccucaggaaagauuucggagauaaagaagccaaagaguuccgagaaagaaauuuaaaugacacuagguauauuuguaaauucuucaaaaacuauguugaacaguacuuacaacuacaugaagacagcgaagcgaaacgauguguaguauuaaguggacaaaugacuucauuucuacgcgcgcgauggggucucguaaaaguuagaggagauucagaccgacaucaugcucuugaugcagcuguaguagcggcaugcagucacggaaugguaaaaagauuaucagauuauucaagaagaaaagaacuugaacaaguaagagaaggauuuguggacguagauacaggagaaauuguuaauccagcaauguuucaacaaguacaagaacauuucccgaauccuuggccgcauuuuagagaugaaguaaaacuaagacucagcauagacgauccaacauuacuaagaucggaaauggaaaaauuugguaccuacacuccagaaucgcuagaagcacuaagaccucuguuugugucaagagcaccucagagaagaaauucaggugcugcccauaaagacacaauuuaugcccaaccuaaaagauuaguagcucaaggcggaguaacacaaaagguagcacucucaucauugacauugaaagaucucgauaaauugauugauccacacagaaacgaacguuuauacgccgcaauacgagcaagauuggaacaacacggaggcaaaggagacaaggcauucccagcaucuaauccccuucgaaaacccgacuccgaaggcaacccuacagggccaauaguaagaggagucacaaugguuauagauaaacuuuccgggauuccaauacgaggcggaauagccaaaaaugauaguaugguccgcgucgacguuuucacaaaagcaaauaaauuccauuuagugccaguauacguacaccauucaguacucggauuaccaaaucaagcaauaguaggaggaaaggaagaaagugaauggacacaaauagacgauagcuucgauuggcacuuuaguauauauccaaacgacuuaaucagagugacccucaaacaagaaggcagauuuggauacuacgcaggaugcgacaggucaacugcagcaauacaucuaugggcucaugaucgaaaccaacaaguaggcaaagauggacuaauacguucaauugggguuaaaacagcauuaucaauagaaaaauuuaauguggacguuuuagguaauagauauccggcucccccagaaaagcguagagaucucgcguga

SEQ ID NO: 8652 - RNA, 3438 nt, Artificial Sequence
  Cas9 variant
augaaaacaauauuagguuuggauuuaggaacaaauaguaucggcugggcacuaguaaaagaaacagaaaacucaaacgaaaaauccgagauaauaaaauuagguguacggguaaacccacugacaguggacgaaaaaacaaacuucgaagcaggaaggccauuaucaacuaacgcugaccgaaccgcaaaaagaagcgcuagacguaaccuccaacgauacaaacugcggagaaaaaaucuaauagaucuauugauaaaacacagacuuaucgauaaagacacuccccuaacugagaucgguaagaauaccacacaucaaacccuagaauuacgugcaaaagcugccagagaacguauagaacucgaagaucuagccagaguauuccuugcaaucaauaaaaaacgaggauacaggaguagcagaaaaguuaauaacgaagaagaaggacagguagucgacgguauggcaguugcaaaaaagcuauaugacgaaaacuuaacuccaggacaauacgcauaugaacugcugucaaaaggaaaaaaauauguuccugacuuuuaccgaucagaucuucaagccgaguuugauuccauaugggaauaccaaaaacaauuuuacgccgacauacuagaugacgaacuauacaacgcacuuaaaggacaaggacaacagaacucaaggaagagauuccuagcaauaaaaggcguuuacacagcagaaaacaaaggaaaaagagacgaggucaaguuacaacauuauaaauggagaagcgaagcuauuacccaaaaacuuucgauagaagagguggcguacguucuuguagaaauaaacaacgacuuaaauaaaucaucaggauauuugggagcaauaagugacagaucgaaagaacuguacuucaacaaagaaacaguaggagaaaaucuuuggaaacaaauacaaaaaaacccacacacaucucuaaaaaaucaaguuuucuaccggcaagauuaucucgacgaauucgaacaaaucugggaaacccaagcacaauuccauccgcaacuaacccuagcauuaaaagagcaaauccgagacguaguaauuuuuuaucaaagaaagcuuaaaucccaaaaaggacuucucucauucugccaauuugaaucaugggaaauagaaaggaaagaugaaaaugguaauguaauacuaaauaaaacaacucaacugccaaagagacaaaccguaggacgacgaguagcaccaaaaaguucuccauuauuucaagaauucaaaauauggcaaaacauaaacaauuuagaaaucgcaaaaauaucagacgguaacaguaaaaauaaaaaagaaacugaagcacuaagugaugacgaaaggaaacuccuauuugaagaacuuaaucuaagagggaaucugagccaaaaagaaguacuacaaauacucggucugaaagauaaggaauacaaaacaaacuucccagaaggcuuggaagguaacaggaccaaugcagcauuauucaauauuuaucagcaaauagcugaaaaugaaggauacggcgauuggacaaaaaaaagcgcacaagaaauaaaagaggaguuaaaagcuguuuuuccacaaauuggaauacaggcagacauacuggacuucaacgcagagcuugauggaaaggaauuugaaaaccaagcaucauaccagcuguggcacuuguuauauagugcagaagaagacgacaaaaucaacgaagaagaucagauaauauacggaaauucagccguaucuuuaaaaaaaaaacuaugcgaaaaauucggcuucacaccggaauacgccaaauggauagcaaacguaaguuuacaggaugacuauggaaauuuaagcacaaaagccaugagaaaaauaauaccauaccucaucgauggaaaugauuacuccgaagccugcgcauuagcagguuauaaccauucaaacagcuuaacgaaagaagaaaacgacaaccgagaaagacucaacaagcucgaauuauuaccaaaaaacaguuuacgcaauccugucguagaaaaaauacuuaaccaaaugguaaauguuguaaaccaaguaauugaaacuuacggcaaacccgaugaaguacgcauagaacuugcacgugaacuaaaaaaaucagcagaagagcgugcagaaaugacuaaaggcauaaacgaagcaacgagaagaaacgaagauauaaagaaacuaauaacaaagaacuucggaaucccaaauccaacaaagaaugacguugucagguauaggcuaugggaagaauuagccccacuagccuauaaagauguauucaccggaagacaaauaaaaaaagaagaccuauucucgagcaaaauagauauagaacacauaauaccgaaagcacuguuauucgaugacucauuuuccaacaaaacucuagcauucagagaaacgaaucucaaaaaagcugacagaacagcauauggcuuuauugaauccgacuacaaugcaacacuagaugacuacauacaaaggguagagacacuauauaauaacgcaaaagguacaauauccaagggaaaaagaaauaagcuacuuauggcucaaaaaaaccuaccagacgguuuuauagaacgagaucucagaaauucgcaauauauagccaaaaaagcaaaaucaaugauagaaaaaguuuucaacgauguaaacguaacaagcgguucaauaacggacagauuaagagaagauugggaucugauuaacgucaugaaagaauuaaacuucccaaaauauaaagcucuaggucuaacagagauagaagaaagauacgacauaggacaagaaaaaacgaaaaaaguagaaguaauaacugacuggacaaaacgaaacgaccauagacaucacgcaauggacgcauuaacaguugcauuuaccacaaaaucacacguacaauacuuaaauaauuuaaacacaauacauagucuaaaaggagaugaaguagaccuagaauuaucaaaacuuuaugggcucaaaaacacaauaacagaaguaguuaacaaaaaaagaaaauuuauaccaccaaugccuaauuuucgggaagaagccaaaaagcacauagaaaccauacuagucaguauaaaaaauaaaaacaaaguguauacaaaaaacaucaacaaaaccaaaaaagaauccgguuaccacacaaaagaacaacuaacaccgagaggacagcuucacaaagagacuguauacggaaaaagcaaaagaccaaugaauaaacccaccaaaaucaauaaaaacuuuucauuagaacaagcgcaacugauaaucaauguccaagaaaaagaacuaguguuaagacacuuagcgcaauucgacaauaaccccgcaguggcuuucgacacaaaaacauuaaaaaaaugccauuaucucaagaugguuaacuuguga

SEQ ID NO: 8653 - RNA, 3441 nt, Artificial Sequence
  Cas9 variant
auguccggaaacacacacgggccauuaacauuuggauuugauauagguaucgcaucaguagggugguguguacuaggagaaaauagaauaguaaauuugggugucagauguuuugauaaagcugaaacugcaaaagaaggagagagcuugaaucuggcgcgaagaacugcaagauuaaugagaagacgacuacgaaggagagcuuggagacuaacaaaacuagcuagacucuuaaaaagggaagguuuaauugccgaagcauccaggauacauauuccuagcccagucaguccauggcgauuacguguagaaggcauagacagacgucuaacugaugacgaaugggcgcgaguaaucuaccacuuauguaagcauaggggauuccacuggauaagccgugcagaagaaagaaaagcagaaucggacgccaaagaagguggaagaguuaaaaagggguuaucagauacccaacgaaggaugaccgaaaaaggcuacagaucugcugccgaaaugguacuagcggaauuuccugaugcacaaagaaauaaacagggggacuacggaaaagcauuaaguagaauauuauugucagaugaguuggccuugcuauuucgaagacaaagagaauuaggaaauccaaacgcaggaaaugaacucgaagcaacaauacuaggaaauggaaauaggaaauccggguuauuuugggagcaaaaacccccguuagcaggagcggauuuauuaaaaauguuaggcagauguacauuugagaaaaacgaauacagagcuccaaaagcgucauucacggcagaacgacauguaugguuaacacgauugaauaaucuaaggguagucguagauggaacaacuagaucauuagaugacgcagaacauaggcuaguacuaccacuccccuauaaacaagccggugacuuuacauauaagcaacugagaacagcauuaaccaaggcaggacuucuaccugaagguuucaaauucgcaggauuaagcuacccgaccggccggcaacuagacgacccuaaagcaaaagauccagaaucagaaaaauuaguaagacuuccugcuuggcaagaauuaagaaaaacguuaaaagauaagaaccuugaaacagagugggaaggaauggcuggugcagcaaccggcgguaacccggaauuacuggaugaaauugcaagaguacuuaguguauuuaaagauggcgacgaaguaaccgccgaacuauggaaguuaccauuaccaggugguaaagcaaugauagacgcuuugagcgaaaucagcuucgauaaauuucaugcucuaaguuuaaaagcauuaagaaaaauaguuccccauauggaaagcggacuucgauaugaugaagcaugugcaguugcgggauaucaccauucccaguuacacgccgcaggagcaggggaacacaaguucuuaccaccauuuuacucaagaagagauaaagauggaagaaugguauuuaaugaagaacuagacguucccaggaauccaguaguacuaagagcccuaaaucaagcuagaaaaguucuuaaugcauuagucagaacauauggaucaccaacagcaguccauauugaaauggccagagaccuaagucgaccacuagacgaaagaaauaaagugaagaaagcacaagacgaauacagagaaaggaaugaaaaagacaaagcagcauuugcggcagaauaugguauagcaccaaaaagcagagaguucgaaaaguuucaauuauacagagaacaacaaggcaaaugugcauacucacucaagucucuagauuugcaucggguauuacacgacauuggauacgccgaaguggaucacgcauuaccuuacucaagaucuuacgaugacagcaagaauaacaaaguauuagcacuaaccgaggaaaauaggaacaaggggaaucguacagcguaugaauacuuaacuucuuucccuggaggugagaacggcgaacguuggagaaacuuuaguguggcaguagaaacaaauaaggcuuacagacuagcgaaaagaacacggcuauugcguaaagacuuuucaggucgagccgcggaagaguucagggaaagaaauuugaaugauacacgauauaucuguagauucuuuaaaaauacagucgaacgauuuuuaaagcuagaugcuaaaguaggugccggagauacagcugaaauaucagcaaagagaugugucguauugagcggucaaacaacggcuuucuuaagggcuagaugggguuuacuaaaaguuagagguaacuccgauagacaucacgcuuuggaugcagccguaguugcagcgugcagucauggaaugguaaaaagguuaggugauuauagcagaacaaaggaauuagcaaaaguccacgauggauuuccagauccagaaacgggagaaauaauagauccagucauguuucagcaacuccaugcccauuuccccgaucccuggccacauuucagagcagaacuagaagcaaggcuaaauguugaugacaccgccgaucuaagagcaagaauggaauuguuuggaacauaugcaccagaagcauuagaaacacuuagaccacucuucguuaguagagcaccucaacgacgaaacaguggagcagcucauaaggacaccaucuacgcacaaccagaacgccugaaagaacaaggaggagucacccaaaaaguuccgcucacgucauuaacacuaaaagauuuagauaaauuaauagauccacauagaaaugaaaaauuauaugcggcuaucagagcaagauuagaagcacacggaggaaaagcagauaaggcuuuuccugccggaaauccuuuacgaaaaccagaucgagagggaaauccaacuggaccugucgucagaacagucaccaugguaauugauaaauuaucaggaaucccaguacgagggggaauagcuaaaaaugauacuauguuaagagucgacauauuuagacacaagaaagauggaaaauuccaccuuguaccgguauauguguaucaugcaguagcaaaagaauuuccaaauagagcaauagugcaggcaaaagacgaagacgaauggacauuaauagaugacaaauucgauuuuuguuuuucagcccauccuaacgaccuauuaaaaauaacucagaaaagcggagaaacaaucuuuggauacuauagagggugucauuccggaacagcagcaauaaacauugcuuuacacgacagauaugcuuaugcagagaaaaccaccagucuagcuuucagcaaaaagaauccgggaaaaccuauucccaaugauaaauuaggacuuauagaagguauaggaguaaaaauggcagccaauauggaaaaauuccacguugauacauuagggaauauuuauccagcaccaccagaacaaagacgaggcuuagcguga

SEQ ID NO: 8654 - RNA, 3441 nt, Artificial Sequence
  Cas9 variant
auggcauaccgcuugggacuagauauuggaauaaccucaguuggcugggcgguugucgcuuuagaaaaggaugaaagugguuugaaaccaguacgaauacaagauuuaggcgugaggauauuugacaaagcagaagauucuaaaacuggagcaaguuuggcacuuccgcggagggaagcaagaagcgcccguagaaggacacgucgcagacgacauagguuauggagaguaaaaagacucuuagaacaacauggaauacuaucuauggaacaaaucgaggcuuuauaugcacagagaaccucaaguccagauguuuacgcgcuacgaguagcaggcuuggauagauguuuaaucgcugaagaaauagcacguguguuaauacauauagcacauagaagaggguuccaauccaauagaaaaucugaaauuaaggacucagaugcaggaaaacuauuaaaagcaguacaagaaaaugaaaacuugaugcaaucgaagggauaccguacaguagcggaaaugcucguaucugaagcaacuaaaacagaugcugaaggaaagcuagugcacggcaagaaacacggcuauguuaguaauguuagaaauaaagcgggugaauauagacacacggucucuaggcaggcaaucguugacgaaguucgaaaaauuuuugcggcucaaagggcacuaggcaacgacgucaugucagaggaacuggaagauaguuaucucaaaauucuauguagccaaaggaauuuugacgauggaccagggggcgauagcccauauggacauggaagcguaagcccagauggcguacgacaaaguauuuaugaaagaaugguagguucauguacguuugaaacuggagagaaaagagcaccaagaucuagcuauaguuuugaaagauuucaacuguuaacaaaaguagucaaccuaaggauauauaggcaacaagaagacggcgggagauauccaugugaauuaacgcaaacagaaagagcccgaguuaucgacugcgcauaugaacaaaccaaaauuaccuacgguaaacuaagaaaauuacuagauaugaaagacacagaaaguuuugcaggacuaaccuacggucugaauagaagcagaaacaaaacagaagauacuguuuuuguugaaaugaaguucuaucaugaaguucgaaaggcacuucaaagagcaggaguauuuauacaggauuuaucaauagaaacacucgaccaaauuggauggauacuuucaguuuggaaaagcgacgauaacagacgaaagaaauuaucaacucuaggauugagcgauaacguuauagaagaauuacuuccguuaaauggaucaaaauuuggccauuuaucuuuaaaagcuauaaggaaaauccucccuuuucucgaagauggcuacucauaugauguagcaugugaguuagcuggauaucaauuucaaggaaaaacagaauacguaaaacaaagacuguuaccaccguuaggagagggagaaguaacgaauccaguaguaagacgagcacuaagucaagcaauuaaaguaguaaaugcaguuauaagaaaacaugguucaccugaaagcauucacauugaacuagcacgagaauuaaguaaaaaucuagaugagagacguaaaauugaaaaagcacaaaaagaaaaccagaaaaacaaugaacaaauaaaagacgaaauaagggagauacuggguagcgcccauguaacagggagggauauaguuaaauauaagcuauuuaaacaacaacaagaguucugcauguauagcggggaaaaacuagaugucacaagauuauuugaaccuggauacgccgaaguggaucauauaauaccauacggaauauccuuugacgauagcuaugauaacaaaguccuaguaaaaacagaacaaaaccgacaaaaaggaaauagaacaccauuagaauacuuacgugauaaaccugaacaaaaggcaaaguuuauugcccuaguagaaaguauaccuuuaagucaaaagaagaaaaaccacuuacuuauggacaaacgcgcaauagacuuagaacaagaagguuuuagagaaagaaauuuaucagacacaagauacauaacaagggcauugaugaaccauauacaggcauggcuauuauuugacgaaacagcaucaacacgauccaaaaggguggucugugucaauggagcaguaacagcuuacaugagagcaagguggggacuaacaaaagauagagaugccggagauaaacaucaugcugcagaugcaguuguuguagcuugcauaggggauagcuuaauacaacgaguaacaaaauaugacaaauuuaaaagaaacgcacuagcagauaggaacagauacgugcagcaaguaaguaaaagcgaagguauuacacaauauguugauaaagaaacaggagaaguauuuacuugggagaguuucgaugaaagaaaauuucuaccaaaugaaccacuagaaccguggccauucuuuagagaugaauuauuggcuagacuaucagacgacccaaguaaaaauauuagagccauaggucuguuaacguauucagaaacagaacaaauagaucccauauuuguaucacguaugccaacuagaaaggugacaggagcggcucauaaggaaacaauuaggucucccagaauaguuaaaguagacgacaauaaaggcacagagauacagguaguagucaguaaaguagcauuaacugagcuaaaauuaacaaaggauggugaaauuaaagacuauuucaggccggaagacgauccacgucuuuauaacacacucagggaaagauuagugcaauuugggggagaugcaaaagcagcauuuaaagaacccguuuauaaaaucaguaaagacggaaguguaagaacuccgguacgcaaaguaaaaauacaagaaaaacuaacauuggguguaccaguacauggaggaagagguauugcagaaaacggaggaaugguaagaauagacguauucgcuaagggcgguaaauauuauuuuguuccaaucuacguagccgauguacuaaagcgagaacuaccuaaucgauuagcuacggcacauaaaccauacagugaauggagaguaguagaugacucauaucaauuuaaauuuagcuuauauccaaaugaugcaguaaugaucaaacccagccgagaaguagacaucacauauaaagaucguaaagaaccuguagguugcagaauaauguauuuuguuucugcaaacauagcaucagcaagcauaagccuacgaacgcaugacaauucaggagagcuagagggacuaggaauacaaggauuagaaguauuugaaaaguauguaguaggaccacucggcgauacucacccaguguacaaagaaagacgaaugccauuucgaguugagagaaaaaugaauuga

SEQ ID NO: 8655 - RNA, 3441 nt, Artificial Sequence
  Cas9 variant
auggcauaccgacuagguuuagacauaggaauaacaaguguaggaugggcugugguagcuuuagaaaaagaugaaucaggguuaaaacccguacguauucaagaucuagguguuagaauauucgacaaagcagaagacucuaaaacaggagcaagccuugcacuuccuagacgggaagcaagaucugcacgaaggcgaacaagaagaagaagacauagacuauggcgcguaaaaagacucuuagaacaacaugggauauuaucaauggaacaaauagaagcacucuaugcacaacguacaagcagcccagacguauacgcacuaagaguagccggccuagauagaugucuuauagcggaagaaauagcucgaguacucauacacaucgcacacagaagaggauuucagucaaauagaaagagcgaaaucaaagauagcgacgcaggaaaauuauuaaaagcuguucaagaaaaugaaaauuugaugcaaucaaaaggcuauagaacaguagcagaaaugcugguaucagaggcaacaaaaacggaugcagaaggaaaauuaguucacggaaagaaacaugguuacguuaguaauguuaggaauaaagcgggagaauacaggcacacaguaagucgacaagcaauaguugaugaagugaggaaaauuuuugccgcccaacgagcacuaggaaacgauguaaugucggaagaacuagaagauaguuaccuuaaaauuuuaugcucacaaagaaauuuugaugauggaccaggaggggauucaccauacggacauggaucaguaagcccggauggagucagacaaagcauauacgaaagaaugguagggagcugcacguucgaaacaggagaaaaacgagcaccaagaucaagcuauucguuugaaagguuccaauuguuaacaaaaguuguaaauuuaagaauauauagacaacaagaagaugguggaagauauccaugugaauuaacgcaaacugagagagcacguguuauagacugcgcauacgaacaaacaaaaauuacuuauggaaaacuaaggaagcuauuagauaugaaagauacagaaucauuugcuggauuaacauacggacuaaauagaucacgcaacaaaacagaagacacggucuucguugaaaugaaauucuaccacgaaguaagaaaagcgcuucaacgcgcuggaguauuuauucaagauuuaagcauagaaacacuagaccagauaggauggauuuuaagugucuggaagagugaugauaaucggcguaaaaagcuaaguacacuaggauuaagcgauaaugugauagaagaacuucuuccauuaaauggaaguaaauuuggacaucuaaguuuaaaagcaaucaggaaaauuuuaccguucuuggaggauggauacucguaugauguagcuugugaacuagccggcuaucaguuucaaggaaaaacagaguaugucaaacaacgcuuauuaccaccacuaggugaaggagaaguaacuaacccagugguaagacgagcguuaagucaggcaauaaaaguugugaaugccguuauuagaaaacauggcucuccagaaagcauacauaucgaauuagcgagagaauuaucuaaaaauuuagaugagagaagaaaaauagaaaaagcacaaaaagaaaaucagaaaaacaacgaacaaauaaaagacgaaauaagagagauauuaggaagugcacacguaacuggaagagauauaguaaaauauaaguuauuuaaacaacaacaagaguucugcauguauucaggagaaaaacuagauguuacacguuuguucgaaccgggauaugcagaagucgaccacauaauaccauaugggauuuccuuugaugauaguuacgauaacaaagucuuaguaaaaacugaacaaaauaggcaaaaaggaaauaggacgccacuggaauaccuacgagauaaaccagaacaaaaagcaaaauuuauagcacugguagaaucuauaccgcugucacaaaagaagaaaaaucaucuacugauggacaaacgagcgauugaucuggaacaagagggauucagagagagaaaucuuucagauacuagguauauaacccgggcauuaaugaaccauauacaggcuugguuauuauucgacgaaacugcaucuacaagaagcaaaagaguaguguguguaaauggcgcuguuacagcauauaugagagcgagauggggacugaccaaggacagaaaugcgggagauaaacaucaugccgcagaugcaguaguuguggccuguauaggagacaguuuaauucaaagagugacgaaauaugacaaauucaaaagaaaugcacuugccgauaggaacagguauguacaacaaguaucaaaaagcgaaggaauuacucaauauguagauaaagaaaccggggaaguauuuacgugggagagcuuugaugaaagaaaauuuuuaccaaaugaaccauuagaacccuggccauucuucagagacgaacuacuagccagauugagcgaugacccguccaaaaacauacgagcuaucggccugcuuacguauucagaaacagaacaaauugauccaauuuuuguaucaagaaugccuaccagaaaaguaacaggagcugcacauaaagaaacaauaagaucaccuagaauaguaaaaguagaugacaauaaggggaccgaaauacaaguuguagugucaaagguggcucuaacagaauuaaaacuuacuaaggacggagaaaucaaagacuacuucagaccagaagaugaccccagauuauacaauacacucagagaaagacuuguacaauucggaggagaugcuaaagcagcuuuuaaggaaccuguuuauaaaauaucaaaagauggaucaguaagaacaccgguaagaaaaguuaaaauacaagaaaaacuaacccuagggguaccaguacauggaggcagaggaauugcagaaaaugguggaaugguaagaauugaugucuucgcaaaagauggaaaauauuauuuuguaccgauauauguugcugauguccuaaaaagagaauuaccaaauagguuagcgacagcucauaaacccuauucugaauggcgagugguagacgauaguuaucaguucaaauuuagucuauauccgaacgaugcgguuaugaucaaaccaaguagagaaguagauauaaccuacaaagacagaaaagaaccagucggucuaaggcuaauguauuucgcaggggcagauauuucaggugcgacucuaacacuaaggacccaugauaacucuggagaauugaaaggccuaggcauucaaggucuagaaguauuugaaaaauacguagucgguccauuaggggauacgcacccaguuuauaaagaaagacgaaugccauucagagucgagagaaaaaugaauuga

SEQ ID NO: 8656 - RNA, 3447 nt, Artificial Sequence
  Cas9 variant
augacuaaauuaaaucaaccauaugguauagguuuagacauaggaaguaacucaauaggauucgcggucgucgaugcaaauucucaccucuuaagacuaaaaggagaaacugcgaucggugcgcggcuuuucagagaaggccaauccgcugcagaucgaaggggcaguagaacaacacgaaggagauuaucaagaacucgcuggagauuaucauuccugagagauuucuuugcuccacauauuacuaaaaucgauccggacuuuuucuuacgacaaaaauacagcgaaauuucaccaaaagauaaagacagauucaaauaugaaaagagauuauuuaacgauagaacagacgcagaguucuacgaagccuauccaucaauguaucaccuaagauugagauuaaugacagaugcgagucaagcagacccaagagaaauauuccuagcaauacaccacauacuaaaaucuagaggucacuuucugacaccuggagcagcuaaagacuucaauacugauaaaguggaucuagaagauauauucccugcauuaacugaagcauacgcacaaguuuacccagacuuggaacuaacauucgaccuugcaaaagcagacgauuucaaagcaaaauuacuagacgaacaagcaacccccucagacacccagaaagcccugguaaaucuauuacuuucaucagauggugaaaaagaaauagugaagaaaagaaaacaagugcucaccgaauuugcaaaagcaaucacagguuuaaaaacaaaguuuaaucucgccuuagggaccgaaguagacgaagcugaugcuucaaacuggcaauucucgaugggacaacuagacgacaaauggucaaacauugaaacuuccaugacugaccaaggcacagaaauauuugaacaaauucaagaauuauauagagcccgcuuacuuaauggaauuguaccagcaggaaugucauuaucacaagcaaagguugcagacuacggccagcacaaugaagaucuugaauuauuuaaaacauaccucaagaaacucaacgaucacgaacuagcaaaaacuauaagaguaauauaugaucgauauauaaacggagacgacgcuaaaccguuccuaagagaagacuuugucaaagcacuaacaaaagaagucacagcucacccaaacgaaguuucagaacaacucuuaaauagaauggggcaagccaacuucauguuaaaacaacgaacuaaagccaacggggcuauaccagugcaacuacaacagagagaacuagaccaaauuauagcaaaccagucaaaauauuaugauuggcuagcgaaaccuaacccagucgaaaaacacagagcuuccaaacccuaucagcuagacgaacuacuaacauuucguauacccuacuacguaggcccauuaauuacaccaaaagaacaagcaaaaucaggagaaaacguauuugccuggaugguaagaaaagacccaagcgguaacauaaccccauauaacuuugaugaaaaaguagaccgagaagcaagugcuaacguuuuuauacaaagaaugaaaacuacagauacauaccuaauaggagaagauguccuaccaaaacaaagccuauuauaccaaaaauaugaaguacuaaaugaacuaaacaauguacgaguaaacaacgaagcauugggcacagaucaaaaacaacgacuaauuagagaaguauuugaaagacauaguucaguaaccauaaaacaaguugcugacaaucuaguugcacacggggacuuugcacaaagacccgaaauaagaggacucgcggaugagaaaagauuccuaucgucacuuucaacauaccaccaacuaaaagaaauuuuacacggcgcgauagacgauucaacaaaguuacaugauauugaaaauauaauaacauggucuaccguauuugaagaugcugcgaucuuuaaaacaaaacucgcugaaaucgacuggcuugaugcagcaacaaucaagaaauuaucaaacauaagauauagaggauggggccaauuuagucguaaauuauuggacggauuaaaacucggaaauggucaaacuguaauacaagaacuaaugcucucaaaccacaaucuaaugcaaauucuaacagacgaaaccuuaaaaacgacaauggcagaauugaaccaagauaaacucaaagcugaugauauagaagacguaauuaaugacgcuuauacaucaccaucuaacaagaaggccuugagacaagucuuaagaguaguagaagauauuaaacaugcggccaacggccaagacccaucauggcuauauauugaaacagcugacggucccgggaccgcugguaaaagaacacaaagccgacaaaaacagauacaaacaguauaugcaaacgcugcacaagaacuaauugacagcgcagugagaggagaacuugaagauaaaaucgcagauaaagcaucauucacagaccgccuaguuuuauauuuuaugcaagguggcagagauauauauacgggagcaccacuaaacauagaccaauuaagucacuacgacauagaucacauauuaccccaaucguuaauaaaggaugauagucuagacaacagagucuuaguaaacgcuacaauuaacagagagaaaaacaauguauuuacaagcacuuuguucgccucuaaaauggcugccaccuggagaaaauggcacgaagcgggucuaaucaguggaagaaaacuucgaaaucuuauguuacggcccgacgaaaucgauaaauuugcacacgguuuugucgcaagacaauuaguagaaaccagacagaucauaaaauugacugaacaaauagcggcugcucaauauccaaauacaaagaucauagcaguaaaagcaggccuaucucaccaacuaagagaagaauuagauuucccuaaaaacagggaugucaaucauuaccaucaugcauucgacgcauuuuuagcugcccgaaucggaacguaucucuugaaacgauaugcuaaacucgcaccauuuuucacauacggagaguucgcaaaaguagauguuaaaaaguuuagagaauuuaauuucauaggagcucuaaagcaugcuaagaaaaauauaguagcaaaagacacaggugaaauugucugggacaaagaaagagacauacaagaauuagaucguauuuauaacuuuaaaagaauguuaauaacucacgaaguuuauuuugaaacggcagaucuauuuaaacaaacaauauaugcagcaaaagauucaaaagaaagagggggaucaaaacaauuaauaccaaagaaacgcggcuauccaacacaagucuacgguggaauacacggcaaaaucagauuaaccuggagaugguuaaaauuacuaagaaggaagaaaaugagcauagaacucucagaauuacaacuacuuaaauga

SEQ ID NO: 8657 - RNA, 3450 nt, Artificial Sequence
  Cas9 variant
auggaaagguaucacauaggacuagacauagggaccucaucaaucggcugggcaguuauaggagacgacuuuaaaaucaagagaaaaaaaggcaaaaaccuaauaggcguacgauuguucaaagaaggagauaccgcagcagaaagaagagguuuucgcacacaaagacgacgccuaaacagacggaaauggaggcucaaguuacucgaagaaaucuucgacccuuauauggcagaaguugacaaauacuucuucgcacgauuaaaagaaucaaaccucuccccgaaagacaguaacaaaaaauacuuaggaagccuacucuucccagacauuuccgacucgaauuuuuacgacaaauacccaacuauauaucaucuaagaagagauuuaauggaaaaagacaaaaaguucgaccuaagagaaauauauuuggcuauacaccauauagucaaauauagaggcaacuuccuggaaaaggugccagcaaagaacuauaaaaacuccggcgcguccauagguuuuuuacucgaagaaguaaacgaucucuacggcaacauaauaggcaacgaagauguagcaauacuugauaaugacaaauucgaagauguagaaaaaaucauuuuaaacgaugaaaucagaaacauugacaaacaaaaaaauguaggucgccucuuagucaaagacaaaaaagaaaagaauauaguaacugcauucucaaaagcaauuuucggguacaaauucaaucuagaagaccuucuauuaaucgaaagugaugaaaaaaauaaacugaccuucaaugaugaaaacauugacgauauauucaaugaauuaagucauucacuaaacgacaaucaaauggaucugcuaaccaaaacucgugaaauauacuuuaaauucaaacuaaauaugauaguccccacgggauauacuauuagcgaaucuaugaucgaaaaauacgaaaugcacaaagcacaccuaaaaauguacaaagaauucauaaacacucuaaacgcaaaagauagaaaaauacuaaaaaaugcuuacagugacuacauaaauaaugagaaagcaaaagcagcaaaugcucaagaaaacuucuauaaaacaguaaaaaaaacgauaaaggaaaacgacuccgacaccgcaaaaaaaaucaucggcuuaauagaugaaggaaacuuuaugccaaaacaaagaacaggcgaaaauggcguaauaccacaccaacuacaucaaauugaacucgacagaaucauagaaaaucaagcaaaauacuacccauggcuggcagaagaaaacccuguagagaaaaacagaaaauucgcaaaauacaaacuagacgaacuggucacuuuccguguuccuuacuacgugggcccccuuauagacaaaacugaaagcaacaaaaaugaaaaagaaacuaaauucgcuuggauggucagaaaggcaaaaggaacgauaacaccauggaauuuugaaaacuuaguugauagaacagaaagugcaaacagguuuauaaaacgcaugaccagcaaagauaccuauaucauaggggaagauguacuacccgccagcagucuacuauaugaaaaauacaaaguauuaaacgaacuaaacaauauuaaagugaacaaaaaaaaacuagacgucgaacaaaagcaacacguauaucuagaccuauucacaacaagaaaaaacgugacaaaagacgaucuagcaaccucuuuaaauugcgauguagaaaguauuacaggcuugacagacaauaaaaaauuuaauucaucauuaucuaguuauaucgaccuuaaggcaauacugggcaacauaguagaugacuacagcaaaaaugaagaucuugaaaaaauaaucgaauauucaacaauauucgaagaugguaauauauacaaggagaaacuuagugaaauaaguuggcuaacagaugaacaaauagaaaaacucucaaacauacacuuuaagggguggggaagauuaucaaaaaaauuguuaacacaaauaacaaaugaaaauggagaacgcauaauagacacuuuauggaacaccagcaauaacuuuauccaagucauaucugacgaaucaauacaagcaaaauuagcugaaauaaauggagaauacgcaaacaaauacaaccuugaagacauauuagaugaagccuauacuagcccacaaaacaagaaggcaauaagacaaguaaugaaagucgucgaagauauagaaaaggcaaugaaaugugaacccacaucaauagcaauagaauucacaagagaaaaaaggaaaagcaaacucaccaacaccagauacaaaaagauauccgaaacuuacgaaaaaauaacggaugaacuuaucucagaguacgaauuaggaaaacuacaaucagaacuugauucaaaaguaaacaacaugagagacagauauuacuuauacuuuaugcaacugggacgagacauguacacaggugaaaaaaugaacaucgaugaacugcaucaaaaguacgacauagaucacauacuaccacaaucauucauaaaagacgacagccugaacaaucgaguucuuacgagcaagagugucaacaucaaagaaaaaagugauaaaacagcagcagaccuauacgcagcaaaaaugggagacuuuuggcgaaaacuacgcaaacaaggauuaaugacagaacaaaaauacaaaaauuuacucacacgaacugacagcaucaauaaauauacuaaacaauccuucauaaaacgucaacuagucgaaacaucacaaguagucaaacuagcugcaaacauuuuacaagacaaauacagaaauacaaaaauaauagaaauaagagcaagauuaaacucagaucuacgaaaaaaauaugaacucauaaagaacagagaaguaaaugacuaccaccacgcaaucgacgguuauuuaacaacauuugucggccaauaucucuauaaaguauaucccaagcuaagaaguuauuucguguaugaugauuuuaaaaaacuagauucaaacuaucuuaaacauauggauaaauucaacuuuauuuggaaacuagaagacaaaaaagcugaagacguauaugauaaaguaaacgaugaauucguauuaaacgucccagaaaugaaagaauacauccgcaaaauuuacaacuauaaauauauguuaguaucuaaagaagucacaacaaaaaauggagcauucuaugaucaaacaaaauauaacgccaaaacgauaaaccuuauacccauaaaaaaagauaaaccaaccaacauauauggugguuauaaagggaaagucagcagcuacaugaugcuuguaaaaauccaaaaaaaaaaagaaguaauauacaaauuuguaggaguaccaagguuauggacagacgaauuagauagauuaauagauacugacgagaagaaagcuuuacucaagaaauga

SEQ ID NO: 8658 - RNA, 3459 nt, Artificial Sequence
  Cas9 variant
augaacgcagaacauggaaaagaaggccuguugaucauggaagaaaauuuccaauauagaaucgggcuagauauuggaaucacaagcguaggcugggcugugcuacagaauaauucacaagaugaaccaguacgaauuacagauuuagggguacgaauauuugacguagcagaaaauccgaaaaacggugaugcauuggcagcaccaagaagagacgcacgaaccacaaggaggcgauuaagacguagaagacaccgauuagaaagaauuaaauucuuacuucaagaaaauggauuaauagaaauggacucauucauggaaagauacuauaaaggaaaucugccagacguuuaucaacuccguuaugaaggucuugacagaaaauuaaaagacgaggaauuagcacaagucuuaauacauauugcaaaacauagaggauuuagaagcaccagaaaagcagaaacaaaagaaaaagagggaggagcaguguuaaaagcaacuacagaaaaccagaagauaaugcaagaaaagggauaccgaacugugggugaaaugcuauaucuagaugaagcauuucacaccgaaugucuauggaaugaaaaagguuauguauuaacuccgagaaacagacccgaugacuauaaacacacaauccuaagaucaaugcuaguagaagaaguucaugcaauuuuugcggcucaaagagcgcauggaaaccaaaaagcaaccgagggacuagaggaggcauauguugaaauaaugacaucacaacgaucauuugauaugggcccaggucuacaaccggacggaaagccaagcccauacgcaauggaaggauuuggcgacagaguuggaaaauguacauuugagaaagacgaauacagagcgccuaaagcaacuuacacagcagaacuauuugucgcacuacagaaaauaaaccauaccaaauuaauagaugaauuuggaacagguagauuuuucagcgaagaagaaagaaaaacgauaaucgggcuauuauuaaguucaaaggaguuaaaauacggaacaauaagaaagaaacugaauauagacccuagucuaaaauuuaauaguuuaaauuauagugccaagaaagaaggcgagacugaagaagaaagaguauuagacacagaaaaagcaaaauuugccucaauguucuggacguaugaauauucaaaaugucuaaaagauaggaccgaagaaaugccaguaggggaaaaagcagauuuauuugauagaauaggagaaauccuaacagccuauaaaaacgacgauaguagaucaucuagacugaaagaauuaggucuaagcggugaagaaauugauggacuguuagaucuaaguccagcaaaauaucaaagagugucauuaaaagcaaugagaaaaaugcaaccuuaucucgaagauggauuaauauaugacaaggccugcgaagcagcagguuaugacuuccgggcucuuaacgauggaaauaagaaacacuuguuaaaaggagaggaaauaaacgccaucguaaaugauauaacuaauccaguaguaaaaaggucaguuagucaaacaauaaaaguuauaaacgcaauaauacaaaaguauggaagcccacaggcgguaaacauagaauuagcccgagaaaugagcaagaacuuccaagauagaacuaauuuagaaaaagaaaugaagaaaagacaacaggaaaaugaacgagcaaaacaacaaaucauagaacuaggaaaacaaaauccuaccggacaagauauacuaaaguauagauuauggaaugaucaggguggcuauugucucuauagcggaaagaaaauuccacuugaggaacuuuuugauggaggguaugauauagaccauauacuaccauauucaauaacuuucgacgauucauauagaaacaaaguauuagugacagcacaagaaaaucgacaaaaagguaauaggacaccuuaugaauauuuuggagcggacgagaagcgaugggaagauuaugaagcaucggugagacuacucgugagagauuauaagaaacaacaaaaacuucuaaagaaaaauuuuacagaagaagaaagaaaagaguuuaaagaacgaaaucugaaugauaccaaauauauaacuagagucguauauaauaugauaagacaaaauuuggaauuggaacccuuuaaucauccugaaaagaagaaacagguaugggcagucaacggagcaguuaccaguuaucuaagaaaaagauggggguuaaugcaaaaagacaggaguacagaucgacaccaugcaauggacgcaguuguaauagcaugcuguacagauggcaugauacauaaaauaaguagauauaugcaaggaagggaacucgcauacagccguaauuuuaaauucccugaugaagaaacaggcgaaauauuaaaucgcgacaauuuuacaagagaacaaugggacgaaaaauucggagucaaaguaccacuuccauggaacucauuccgggacgaacuagacauaagauuacuaaaugaagauccuaaaaauuuucuacuaacacaugccgauguacaaagagaauuagacuauccaggcuggauguauggggaagaagagucgccuauagaagaaggaagguacauuaacuauauaaggccauuauucgugaguaggaugccaaaucacaaaguuacaggaagcgcgcacgaugcaaccauaaggagcgcacgagacuaugaaacacggggaguuguaaucacaaaaguaccuuuaacagaucuaaaacucaauaaagauaaugaaauugaaggauauuacgacaaagauucagauagacuauuauaccaggcucuaguuagacaacuauuauugcauggaaaugacggcaaaaaggcauucgcagaagacuuccauaagccaaaagcagacggaacugaaggaccagugguaagaaaaguaaaaauagaaaagaaacaaacuagcgguguaaugguucggggagggacuggaauagcagcaaacggagaaaugguucggauagacguauuucgagagaauggaaaauacuauuuuguuccgguuuauacagcagauguagugcgcaaaguacugccuaauagagcggcaacgcauacaaaaccauauucugaauggagaguaauggacgaugcaaacuucgucuuuucacuauauagucgagauuuaauacauguaaaaucgaagaaagauauaaaaacuaaucuuguaaacggaggccuacuacuucaaaaagaaauauuugcguacuacacaggagcagauauugcaacggcaucgauugcagguuuugcuaaugauagcaacuucaaauucaggggacucggaauacaaucauuagaaauauuugagaaaugccaaguugauauauuggguaauauaagcguuguaagacaugaaaauagacaagaauuucauuga

SEQ ID NO: 8659 - RNA, 3462 nt, Artificial Sequence
  Cas9 variant
augaaaaauauccuaggguuagaucucggacuuuccucuauagguuggaguguaauaagagaaaauucggaggaacaagagcuaguggcaaugggaagcagaguuguaucauugaccgcagccgaauuaucaucauucacacaaggaaauggugucucaaucaauagucaaagaacccaaaagagaacccaaagaaaaggauaugaccgauaucaauuaagaaggacauugcuaagaaauaaauuggauacauuaggaaugcuaccggacgacagucuaucauaccuaccuaaacuacaauuaugggggcuaagagcuaaagcaguaacccaacguauagaacuaaacgaauuaggccgaguauuacuucaccuaaaucaaaaacguggguacaaaagcaucaaaucagacuucaguggcgauaaaaagauaacugauuauguaaaaaccguaaaaacaagguacgacgaacugaaagaaaugaggcuaacaauaggagaauuauucuuuagacgacuaacagaaaaugcauuuuucagaugcaaagaacaaguuuauccaaggcaggcuuacguagaagaauuugauuguauaaugaauugccaaagaaaauucuacccugacauauuaaccgaugaaaccaucaggugcauuagagaugaaauaauauauuaccaacggccucuaaaaagcuguaaauaucuaguaagcagaugugaguucgagaaaagauuuuaucugaaugccgcaggaaagaaaacagaagcaggaccuaaaguaucuccuagaaccucaccccuauuucaaguauguagauuaugggaaaguauaaauaauauaguaguaaaagauagaagaaaugaaauaguauuuauuucagcagaacaacgcgcagcauuauucgacuuuuuaaacacccaugaaaaacuuaaaggaagugaucuacuaaaacuccuuggauuaagcaaaaccuacggauauagguuaggugaacaauucaaaacuggcauacagggcaacaaaacaagaguagaaauagaacgagcauuggggaacuacccagacaagaaacgacuacuccaauucaaccuacaagaagagucaagcaguaugguuaauacagaaacaggugagauuauuccaaugauaucucugucuuucgagcaagaaccacuauacagacuguggcacguauuauauagcaucgaugauagagaacaauugcaaucaguacuaagacaaaaauucgggauugaugacgaugagguccuagaaagacucucggcgaucgaucuuguaaaagcuggauuugguaacaaauccucaaaagccauaaggaggauucuaccguuuuuacaguuggggaugaacuaugcagaagcaugugaagcggcaggauacaaccauucuaacaauuauacaaaagcagagaacgaagcaagagcacuauuagacagauuaccugccauaaagaaaaacgaacuaagacaaccggugguggagaaaauccuaaaucaaaugguaaauguagucaacgcccuaauggaaaaauaugguagauuugaugaaaucagaguagaauuagcacgagaacuaaaacaaaguaaagaagaaagaucaaauacauacaaaaguauaaauaaaaaucaaagagaaaacgaacaaaucgcaaaaagaaucguugaauaugguguaccuacaagaagccgaauacaaaaauauaaaaugugggaagaaucaaaacauuguugcauuuacugcggacaaccaguugauguuggagacuuuuuaagaggauuugauguagaagucgaacacauaauaccaaaaagccuguauuuugacgauucauucgcgaacaaaguaugcucaugcaggaguugcaauaaagagaaaaacaacaggaccgcauacgauuacaugaaaucaaaaggugaaaaagcucuuucagauuacguggaaagaguaaacacaauguacacuaacaaucaaauaagcaaaacaaaauggcaaaacuuguuaacaccaguugacaaaauuaguaucgacuucauagaucgucaguuacgagaaagccaauacauagcucgaaaagcaaaggaaauauugacaaguauaugcuauaacguaacugcgacaaguggaucgguaacuagcuucuuaagacacgucuggggaugggacacaguuuuacacgaucuaaacuuugaccgauauaagaaaguagggcuaacagaaguaauugaaguaaaucauaggggaucuguuauaaggagagaacagaucaaagacuggucaaaaagauuugaucaccgccaccacgcaauagacgcauuaacaauagcaugcacaaagcaggcuuacauacaaagacuaaacaaccuaagagcagaagaagguccagauuucaauaagaugagccuugaaagauauauacaaucacagccacacuuuagcguagcacaggucagggaagcaguagaucguauucuggucagcuucagagcagguaaaagagcaguaaccccuggaaaaagauauauaaggaagaauagaaaaagaaucucaguacaaucgguauuaauaccuagaggagccuuaucagaagaaagcguauacggaguuauccauguaugggaaaaagaugaacagggacauguaauacaaaaacaacgagcagucaugaaguauccaauuaccagcauaaacagagaaauguuagauaaagaaaaaguagucgacaagcgaauacaucgaauuuuaaguggaagacuagcccaauauaacgacaacccgaaagaagcauuugcaaaaccaguauauauugauaaagaaugcagaauacccauuagaacgguucguuguuucgcaaaaccagcaauaaacacauuaguuccuuugaagaaagaugacaaaggaaacccggucgccuggguaaacccuggaaacaaccaucacguagcaauuuaucgcgaugaagacgggaaauauaaagaaagaacaguaaccuucugggaagccguugacagaugccgaguaggaauaccagcaauaguaacacaaccggacacuauaugggauaauauucuacaacgaaacgauaucuccgaaaacguuuuagaaucguuaccagacguaaaauggcaauuuguacuuuccuugcaacaaaacgaaauguuuauacuuggaaugaacgaagaagauuauagguaugcaauggaucaacaagacuacgcucuacuaaacaaauaucuauaucgaguacaaaaauuaucuaaaagugacuacucuuucagauaucacacggaaaccuccgucgaggauaaauacgauggaaaaccaaaucucaaacuuucaaugcaaauggguaaauugaaaagaguaucuauaaaguccuuacuaggccuaaacccacauaaaguucauauuucuguacugggcgaaauaaaagaaauuucauga

SEQ ID NO: 8660 - RNA, 3474 nt, Artificial Sequence
  Cas9 variant
augaauuacuauaacgguuucauaauuaccgagaaugcaaugacuuccaagcaagaaaaacacggagcucuuacauucggccuagacauuggcauugcauccguaggaugggcuguacuuggugaaagucgaauagucgaccuuggaguacgaugcuuugauaaagcagaaacugcaaaagaaggagaaucucuaaaccugacaagaagaauggcaagacuauuacgcagacggcugagaaggagagcauggagacucacaaaauuagcaagacuccuaaaaagagaaggacucauugccgacgcaaaucuguuuaaacauaaaauagagaaaaacacaccaguaccaaaaucaucauggcaauuacguguagauggauuagaccgucaauuaaaugcugaagaaugggcacgaguaauauaucaccuauguaaacauagagguuuucacuggauaucaagagcggaggaaaaagcagcagaaggcgauaguaaaggagaagggggcaaagucaaacaaggauuagccggcacaaagaaauuaaugcaagagaaaaguuaucgaacugcugcggaaaugguauuagcugaguucccagaugcccaacgcaacaaacaaggugacuauuccaaagcauuaucaaggauuuuacuuggagacgaauuaaaagcucuuuuugaacaucaaagaaaauuaggaaauccaguagcaacugaaaaauuagaagcagcuauauuaggaaacggagacaagaaauguggacuguuuugggcccaaaacccagccuuagcugguaauaaacuccuugaaauguuaggaagauguacauuugagaaaacaggaggggaugauggaaagggagaauaucgagcaccaaaggcuucuuucagcgcagaaagacaugucugguuaacacacuuaaauaaucugcguauaguaguagaugguacaacgaggccauuaaacgaagcggaaagaagaguagcacuaccuaugccuuaccaacaagcuggagauuuaucuuauaaacaauuaggaggagcgcuaaucaaagagggauuuuuacaaaaagauggcuuuaaauuugccggacuaccauaccccacaaaacaagccuccgaggaaaaagccaaagauccagaaacgagcguacucuguaaacuuccagcuuggcauacacuuagaaaaacacuugaaaaacauggacuagaaagugaauggcaaaaauuaucuacagaugcauuagauggaaaaccccaauuacuagauaacauugcauggguacuaagcguauauaaagaugacgaugaaguaaaaacagaauuaggaaaacucaauuuacccaauaccgagaaaaugauagaugcguuauuagauauaagguucgacaaauucagcaaccugaguuuaaaggcauuaagcaaaauuguuccauucauggaacagggacaaagauaugaugaagccguagcuaauauaccugaauauggacaccauagccaacuacauaaaguaggagcgggugaacauaaauacuuacccccauucuauaaagaaagagacaagacaggcaggaugguauucaacgaugacauggacauaccaagaaacccuguaguauuaagagcacuaaaccaagccagaaaaguagucaacgcccuuauaaaagaauacgguucuccacacgaaguccacauagaaauggcgagagauuuauccagaccacuagaugaacggcgagacaucgaaaaauuacaaaaagaauuuggagagcguaauaagaaagauaaagaauuauuugcacaggacuuuaauaucguaggaacaguaaagggcaaacaguucgaaaaauaucaauuauauagagaacaacaagguaaaugcauauacccaucuauggaugaaaaacaaggaauaugcugcuauagccuaaaaccucuugaucuacauagaguacuauaugaagaaggcuaugcagagauagaucaugcauugccuuauaguaggagcuuugaugacagcaaaaacaacagaguuuuaguauuggcaaaagaaaauagagauaaagguaauaggaccccauuugaguaccuuggagauaaagauaauagugagccuuggagacaauucguagccuucguagaagguaauaaagcauauagacuagcaaaaagaucgagauuauuaagaaaagauuuuggugauaaagaagcgaaagaauuuagggaaagaaauuugaaugauacaagauauauauguaaauucuuuaagaacuacguagaacaauacuuacaauugcaugaagauucagaagcaaaaagauguguaguacuuucaggacaaaugacuagcuuuuuaagggcuagguggggccuaguaaaagugcgaggagacagugaucgacaucacgcucuagacgcggccguaguagcagcauguagucacggaaugguuaaaagacuuagugauuauucuagaagaaaagaacuugaacaaguaagagaaggauuuguagacguagacacaggcgaaaucguuaacccugcaauguuucaacaaguacaagaacacuuuccuaauccauggccccauuuuagggacgaaguaaaauugagguuaucaauagacgauccaacuuuauugaggucagaaauggaaaaauucggaacauacaccccagaaucacuagaggcauugcgaccccuauuugucaguagagccccgcaaagaagaaauucgggggcagcacauaaagacacaauauaugcacaaccaaaaagguuaguagcgcaaggcggaguaacucaaaagguagcuuuaucaucauuaacacuaaaagaucuugauaaauugauugacccccaccguaacgagcgacuauacgcagcaaucagagcaagauuagaacaacacgggggcaagggugacaaggccuuuccugcaaguaacccauugagaaaaccugauagcgaaggaaauccaacaggaccuauuguucgaggaguaacaaugguaaucgauaaauuaagugggauuccaauacggggaggaauugcuaaaaaugacucgaugguaagaguagaugucuucacaaaagcaaauaaauuccaccuuguaccgguauauguccaccacucaguacuagggcuaccaaaucaagcaauaguaggaggaaaagaagaaagugaguggacacaaaucgacgauucauuugauuggcauuuuucuaucuauccaaacgaucugaucagaguaacacuuaaacaggaaggaagauuuggcuacuaugcggggugugacagaucuacggcggccauacauuuaugggcucacgaccguaaucaacaaguuggaaaagacggacuaaucagaucaauagguguaaaaaccgcuuuaucaauagagaaauucaauguagacguuuuagguaacagguacccagcaccgccugaaaaacgaagagaucuagcuuga

SEQ ID NO: 8661 - RNA, 3486 nt, Artificial Sequence
  Cas9 variant
augaagaaaauauuaggcuuagaccuaggaucagcaaguauagguugggcgcuaguagaggaaacugaacaaaugcaauauaacauagucucauugggaucgcgaauaauaccauauaacggaacugaaggacaagaguuugaaaaaggcaccggagaaucgaggaauagccuacgcacaaaagcacgaacggcacgaaaaggguaugacagauaccaacuaagaagaaagaaucuagagaaaauauuauuacaaaacggaauguacccgaacgaacaaguaagagcacuacaaaaacuagaauuauggaaauuaagagcagacgcaccuaacguacagauaucauugccugaauuagggcgacuuuuauuuuggcuaaaccagaaaagaggcuauaaaucaucaagaucagaugcaaaccuagauaagaaagauacggaauauguugccacaguaaaaagcagacaccagaaaauaaaagaugccgggcaaacaguuggacaauacuuuuauggccaaauacuagaaaacgaauaccacagaauaaaagaacaagucuucccgcgagaagccuauauagaagaauuugaugccauaguugcuagacaaaaagaauacuaccccacaauacuaaaacaagaauuaauagauaaaauaagaaacgaagugauuuauuuccaaagagggcuaaaaagucaaaaaggucuaguuucggugugcgaguucgaaggcagagaguucaauggacauuucggaggaccaaaaguagcacccaaaucauccccuauuuuucaauuagggaaaauaugggaaaauauaaacaauauaaaaauagccgauauagaauuaacagcagaacaaaagcuaguauucuuuaacuacuuaaacugccacgaaagaauaacagaagcaaaaauucgagaacuauuaaaacuaucaaaagauagccgguuaaacggacaacucaaaaauggcuuaacgggaaauaaaacauauagucaaauugcaucaugcuuuggaaauaaaauaggagaauaugaacgauuauucaaauucgaauuagaaguuauagaaagcgaaaaacuugaauauacauaccaccccaaaagccacauaccugucggugaaaagagacguaaauauaucucagaaaacgucgaaaaagaaccauacuaccgucuauggcauacaaucuacaguauuaaagauaaagaugaauguagagcagcacucaucaaaaauuuuggaaucgaggaggaaauagcagaaaaauuggcaagucucgacuucagugcaggcggauuuggaaacaaaugcgccaaaguuauacgcaaaauccuaccguauuuaauggagggagacaaauauaacgucgcuauggacuaugcgggauauaaucacaguuuuucucaaacaaaagaugaaaacuuacaaagaguucuauuagauagcaucaaccacuugccuaaaaauagcuuaagacaaccaauuguagagaaaauauugaaucaaaugauaaauuuaguaaacgaaguaauaaaacaauggggccgaccagacgaaauacgaguagaacuagcaagaaaacuuaaacaaaguaaaacugagagaaacgaugaugauaauuuuaugagaaaaagagagagggagaacgaaauuauaaaagccgaucuagccaaauauggacuaaaagcaacaagaaauaauguaauaaaauggagauuauaucaugaaaucgaugauaaagacaagaaacuaaacgcaagaugcauuuauugcggacaaccuaucagcuuaacagaggcuauacucggaaauaauguagauguagaacauauaauaccuaaagacaaacucuuugacgacagccagagcaacaaaacucuagcucacagaaguuguaacaguggaaaaggcaacaaaacagcauaugauuuuaugaaagacaaaccacaauucgaagaauacguugcucgaguagaagaacuauacaagaaacaucuuauaagccuuacaaagaaaagaaaauuccucaugucagaagauaaaauuccaucagacuuuauagacagacaauuaagagagucgcaauacauugcgaggaaaucaagagagauauuacaaacugucugucgaaacguuuggucaacugauggagguguaacagcucaccucagaaaauuauggggaugggaugauguuacaaugaaccuacagaugccgaaauauaaaggaauaggcaugacagaaauaguagaaugggaaaguaaucacggaaagaaccaacauacacaagaaguaauaaaagacuggucuaaaagagaugaccacagacaucaugcaauugacgcuuuggugguagcgugcaccagacaaggguauauacaacgaauaaacacccuuaauuccagugaaacaaaagacgagaugcauaggaagguagcuggcucucuaguagaguuuaaccagaaacacaccuuacuaaacaaauaccucauaacggaaaaaccauucacaacgucagaaguagaagacgugguaaguaaaauucucgugagcuuuaaagcagguaagaaagcagcuacaccaggaaaaagaaaaguaggaaaacgaggaaacaaacaaguaguacaagacggaauaauaauaccuagaggagcacuccacgcugacagcguaaguggaagcaucaaacaauacgacccaacugggaacuuugaaaaucacaauguaauaaaauacaaagucggaguaggaaaaggauaccucuuugauggaaaggacgacaaaaagaaaauagauaaaacaauagacuguauuguagacaagaaaauaagggaccucauaaaacaaagagcagaagaaucaaacuacagccuaaagaaaauguuugaaacgccgauacuauuuaaucaacgagcagucuucucagugaggugcaaaacaggaaacaaagcgguaguuccaauucggaacggcuacguaguaccugacaacaaccaccauaccgcaauauauaaauaugauggaggacuaaaagaacagugcguaucccuaaugcaagcaaucgaaagaaaacgauacaaucuaccaauaauaaucaaaaacccaaaagaaauauaugauaaaauaaccgaaauagcgaacauaaaccaauuacuauucgacucccucccgaaacuagauugggaauuugugacuacucuucagaaaaacgacauguucauacuagguauggacuauagugcaaccgaagaagcgcuagcagacggaaacuauagauuacuaucagaauauuuauacaaaguccaaaacauaucagauggaaucuacagacuaugucaucacacaauaacgaaguucgaucuaucuaaggccaauaagccagacaagcgcuucuacaauauacaaucauuaaaggcuuggaauacacuuaauccucaaaaaguuaaaauaaauauccuaggacaaauagagagacaauga

SEQ ID NO: 8662 - RNA, 3501 nt, Artificial Sequence
  Cas9 variant
augcaugucgaaauagauuuuccgcauuuuuccaggggagauagucauuuagcuaugaacaaaaaugaaauucuaagaggcuccucaguccuauacagauuaggauuagaucuagguucgaauagucuuggaugguuuguaacacaucuagaaaaacgaggagaucgccacgaaccuguagcguuagggccaggagggguacgaauuuucccagauggacgagacccacaaucaggaacaucaaacgcaguagauagacguauggcaagaggugcaaggaaaagaagagaucgauucguagaacgaaggaaagaauugauagccgcccucauaaaauacaaucuacuuccggaugaugcuagggaaaggagagcacuagaaguacuugauccauaugcacuacgaaaaacugcccuuacagacaccuuaccagcacaucauguaggcagagccuuguuucaucuaaaccaaagaagaggauuccaaaguaaucgaaaaacagauagcaaacaaagugaagauggcgcaaucaaacaagcugcaucgcgauuagcaacagacaaaggaaacgaaacacuaggaguauuuuucgcagauaugcacuuaagaaaaucauacgaggacaggcagacagcaaucagagcggaacucguaagauuagguaaagaucauuugacagggaacgcacgaaagaaaauaugggcaaaaguacggaaacgacuauuuggcgaugaaguauuaccacgagcagacgccccacauggcguaagagcucgggccacaauaacagguacuaaagcaagcuaugauuacuaucccacccgugauaugcuucgagacgaauuuaaugcaauaugggcaggacaaucagcacaucacgcuacgauaacugaugaagcaagaacagaaauagaacauauaauauuuuaccaaagaccuuugaaaccagcaaucguagguaaauguacauuagaucccgcaacaaggccauuuaaagaagacccugaaggcuaucgugcuccauggucccauccacuagcccaaagguuuagaauauuaucagaggcaagaaauuuagaaaucagagauacgggaaaaggaaguagacgacuuacaaaagagcagucagaucuaguaguagcggcuuuguuagcaaaccgagaaguuaaauuugacaaacuucgaacucugcuaaaauuaccagcugaagcaagguuuaacuuggaguccgaucgacgggcggcauuagacggagaccaaacagcagccagauuaucggacaaaaagggauuuaauaaagcauggagaggauuuccaccagaaaggcaaaucgcgauaguagcacgacuugaagaaacagaagaugagaacgaauuaauagccugguuagaaaaagaaugugcuuuagauggagccgcagcagcucgagucgcaaacacaacuuuacccgauggccacugcaggcuugguuuaagagcaauuaaaaagauaguaccaaucaugcaagacggauuagaugaagacgggguugccggcgcaggauaucauauagcagcuaaacgagcaggcuacgaccaugccaaacuaccaaccggagaacaguugggaagacuucccuauuacggacaaugguuacaagacgccguaguaggaaguggugacgccagagaucaaaaagaaaaacaauauggacaguuuccgaauccaacuguucauaucggauuaggacaacuaagacgaguaguaaaugacuuaauugauaaauauggaccaccaacagaaauaaguauagaguucacacgggcacuuaaacuaagugaacaacaaaaggcugaaagacaaagagaacagagacguaaucaagacaagaauaaagccagagcagaagaacuggcaaaauuuggucgaccagcaaauccacgaaaucuacuaaaaaugcgauuaugggaagaacuagcacacgauccacucgacagaaaaugcguauauacaggggaacaaauaucaauugaaagacugcuaagcgaugaaguggacauagaucauauauuaccaguagcaaugacacuagaugacagcccggcaaauaaaauuauauguaugagauaugcuaauagacauaaacgaaaacaaacuccuagugaagcguuugggaguaguccaacauuacagggacauagguacaauugggaugacaucgcagcaagagcaacugggcuaccaaggaacaaaagguggagguuugacgcaaaugcuagagaagaguucgauaaaagaggaggauuucuagccagacaauuaaacgaaaccggcuggcuagcaagauuggcaaaacaguaccuuggugcuguaacggauccuaaccagaucuggguagucccagggcggcucacaucuaugcuacgagggaaauggggccuaaacggacuucuuccgucagacaauuaugcugguguucaggauaaagcagaagaguucuuggcaagcaccgaugauauggaauuuaguggcgugaaaaauagagcagaucauaggcaucaugccaucgauggacugguaacagcucuaacagaucgaaguuuacuauggaagauggcgaaugcauacgaugaagaacaugaaaaauucguaauagaaccaccuuggccaacaaugcgagaugaccuuaaagccgcauuagagaaaaugguaguaagccauaaaccggaucacgguauagaagguaaacuacacgaagauagugcauaugguuuuguaaaaccucuagaugcuacaggcuuaaaagaagaagaagcaggaaaucuuguuuaccgaaaagcaauagaaagucuuaacgaaaaugaaguggacagaauaagagacauccagcucaggacuauaguacgagaccacguuaacguagagaaaacgaagggaguugcacuagcagaugcacuacgacaauuacaagcuccuuccgaugauuacccucaauuuaaacauggauuaagacacgugagaauuuugaagaaagaaaaaggugauuacuuaguacccauugccaauagagccaguggaguagcuuauaaggcuuauucagcaggagaaaauuucuguguugaaguauuugaaacagccggcggaaaaugggauggagaagcaguaagaagauuugaugcaaauaagaaaaaugccggaccaaaaauugcacacgccccacaguggcgcgaugcaaacgaaggcgcuaaauuaguaaugcguauucauaaaggugauuuaauaagguuagaccacgaaggcagggcgcgaauaaugguuguacauagacuggacgcugcugcagggagguuuaaacuugcagaucauaaugaaacaggaaaucuugauaaaagacaugcaacaaacaacgauauagauccauuuagaugguugauggcaaguuauaauacuuuaaagaaacuagcagcuguaccaguaagaguugaugaacugggaagaguguggagaguaaugccaaacuga

SEQ ID NO: 8663 - RNA, 3507 nt, Artificial Sequence
  Cas9 variant
auggcuagaccagcauuuagggcacccagacgagaacauguaaauggauggacgccagauccacauagaauaucgaagccauucuuuauuuuagugucauggcacuuauuaucccgaguuguuauagauucaucaagugguuguuuucccgguacuucgcgggaccauacagacaaauuugcagaaugggaaugugcuguacaaccguauagguuaucuuuugacuuagguacaaauucaaucggcuggggauuauuaaauuuagaccgucaagguaaaccuagagaaauuagagcgcuugguagccguauauuuagcgacggacgcgacccucaagacaaagcaaguuuagccguggcgagaagguuagcacgacaaaugagacgacgaagagacagauaucucaccaggaggacacgacuaaugggggcgcuaguaagauuuggacuaaugcccgcagacccugcagcccgaaaacgccuugaaguugccguagaucccuauuuggcaagagaaagagcaacacgagaaagacuagaaccuuucgaaauugggcgugcauuauuucauuuaaaucaaagaaggggauacaaaccaguaagaacagccacuaagccugacgaggaagcaggaaaaguuaaagaagcuguagagcgacuagaagcugcaauagcagcagcgggugccccaacccuuggugcgugguuugcauggagaaagacaagaggagaaacauuacgugcucgacuugcaggcaaaggaaaagaagcagcauauccuuucuacccagccaggagaaugcuagaagcagaauuugauacucuuugggcagaacaagcaaggcaucaccccgaccuccuuacagccgaggcaagagaaaucuuacgacacaggaucuuucaucaaagaccauugaaaccuccaccaguaggaaggugcacguuauauccagaugauggacgagcgccgagagcguuaccaagcgcgcaacgccugcgacucuuccaagaauuagcuucucuaagaguaauccaucuagaccugagugaacggccacuaaccccugcagaaagagauagaauaguugccuuuguucaagguagaccaccaaaggccggaagaaaaccuggaaaaguccaaaaaucaguaccuuuugaaaaacuucguggauuauuagaguuaccaccugguacaggauucuccuuagaaagcgacaaacguccugaacuuuugggggacgaaacaggugcucguauagcucccgcauuuggacccgguuggacugcccuaccauuagaggaacaggaugcccuaguagaauuacuauuaacagaagcagagccagaacgggcaauagcagcucuaaccgcaaggugggccuuggacgaagcaacagcagccaaauuggcaggcgcaacgcuaccagacuuucacggaagauacggcagacgggcaguugcagaauuauuaccaguguuagaaagagagacaagaggagauccagauggaagaguuaggccaauaagacucgacgaagcugugaaauuacuaagaggaggcaaagaccacagcgauuuuucacgcgaaggagcauuguuggaugcuuuacccuauuauggagcaguucuggaacgucaugucgcuuucggcacgggaaauccagcggauccagaggagaaaagaguggggcguguagcuaauccaacaguacauauagcacuuaaccaauuacgucaucuagugaaugcuauauuagcuagacauggcagaccggaagaaaucgugaucgaauuagcgcgugauuuaaaaaggucagcagaagaucgacgucgugaagauaaacgucaagcagacaaucagaaaagaaacgaagaaagaaaacgauugauuuuaagucuaggagaaagaccaacuccuagaaacuuauuaaaauuacgauuaugggaagaacaagguccuguagaaaacagaagauguccuuauagcggagaaacgaucagcaugcgaauguugcuuucggaacaaguagauauagaucauauauuaccuuuuucagucagcuuagaugauagugcugccaauaagguaguaugccuacgagaagcuaaucguauaaaacguaaucgaaguccaugggaagcguuuggccacgacagcgaaagaugggcaggaauauuagcuagagcagaagcguugcccaaaaacaagagauggagauuugcaccagaugcauuagaaaaauuagaaggagaagguggacugcgagcacgacauuuaaaugauacuaggcauuuaucaagauuagcagucgaauaucugaggugugucuguccuaagguaaggguuagucccggcagacugacagcacuuuuacgacgaagaugggguauagacgcaauucuagcugaagccgacgguccaccaccagaaguuccugcagaaacucuagauccuucaccagcagagaaaaauagagcagaccacaggcaccaugcgcuagacgcaguagugauuggauguauagacaggucaauggugcagagggugcaacuugcagcugcaucugcagaaagggaagccgcagcuagggaagauaauauacgaagaguguuagaaggguucaaagaagaaccaugggauggauuucgugcagaacuagagaggagagcaagaacaauaguagugucccacagaccagaacaugguauaggaggagcacuacacaaagaaacagcauauggacccguagauccuccggaagagggauuuaacuuagugguaagaaaaccuauagaugggcuaaguaaagaugaaauaaauucuguuagagauccacgacuuagaagggcacuaauagaucgacuggcaauuagaagaagggacgcaaacgacccggcgacggcacuugcaaaagccgcugaagaucuagcagcacaaccagcgaguagggguauuagaaggguaagaguacuaaagaaagaaaguaacccaauuagaguagaacauggagguaaucccucugggccaagaucaggugggccauuucauaaacugcuauuggcuggggaaguucaccacguagauguagcucuuagagcagacggacgaagauggguaggacauugggugaccuuauuugaagcacacggagggagaggagcagauggugccgcugcacccccgagauuaggagacggagaacguuuccuuaugagauuacauaaaggagauugcuuaaaacuagaacacaaaggaagaguaagaguaaugcaagucgucaaauuagagccauccaguaauucaguuguuguugucgaaccucaccaaguuaaaacagaucggucaaaacauguuaaaaucaguugugaucaacuacgagcacguggagcgagacgaguuacaguagauccauuagggcgaguacgaguacacgcuccuggagcaagaguaggaauagguggugaugcaggccguacagcaauggaaccagcagaagauauaucauga

SEQ ID NO: 8664 - RNA, 3513 nt, Artificial Sequence
  Cas9 variant
augaguaaauacaaugucggacuggauaucggaauagcaaguguaggauggagcauaguugaugcagacaaaaaaaaaauuauagaccuagguucaagaauauuuuccuccggcaaugcagcagcgaaccaggaaagaagaggcuuucgaggaacacggagauuaauaaggcgaagaaaaaauagacuaacagacguaauuaacuuuuucggugaaaaaaaauucauagacaccaaaguaguagacaaaaacgggcacguacauuauaaauuuucaguaaacaauacagaaucaccauaugagcuacgcgugaagggacuaucagagauauuaaccaaacaagaacuaguaauagcacuauaccauauagucaaacauaggggaauaagcuacgauuuaggcgacuuagaagaugauggcaccagugggguaacagacuacaaaacuucaauaaauaucaaucgucaacugcucaacgaaaaaacaguaggacaaauacaauuagaaagacuaaacgaguuugguaaagucagaggacagguugaagagaaugaaaacguuacauuacuuaaugucuucccgagugcagcuuauguaaaagaagcaacgcaaaucuuaacaaaacaaagagaauucuauccagagauuacagacgacuuuauagccaaauuuauguuauucauaacuaggaaaagagauuacuuugucggaccaggaaacgaaaaauccagaacagacuaugggauauauaaaaaagacggaagaacauuggacaacuuauuugacgaacuaaucgggauugacaaaauaaauggagagaaacgagcaagcgccagcagucuaaccgcacagauauacaauaugcuaaacgaccuaaacaaccuuacagugccuaacacagaagauggaagauugacgauccaaacuaaaaaagaaauauuggaggcagcaaagacaacaaauggauuauucggaauagcacaaauuugcaaaaucauagggugcaaaaaagaugacauaaaagguuucagaauagacaagucggaaaaaaaaaucaugcauacacuaucagguuauagaaaauucagaaaagaacuagccgaugucaacauagaagcaaacgauuuaaauauaaaucugguuaacaagauagccgauauucugacauuaaacacagaaaaagcagaaauucgcaaacaauuagacaaauccaacauggauauuucuaacgaaaugaaggaaauaguaauaaacaaaaauaaagaauuucuagucgacggacgagcaacauggcauaguuucucuuauaaaacacugaacuuauuaauaccagaacuccugaauacaccagaagaacagaugacaaucuuaacacgucuagggcuuguaaaaccuaauaauaaaaaauacgaaggucuaaaaaacauaccagcaaggagaauaacagaagaaauuuauaauccaguagucgcaagagcaacaagagaagcaguaaacguauucaaugccaucacaaaaaaagucggacgagauaauauaaaagauguuauaaucgaacuaccaagagaagacaacgaaguagauauaaaaaaaggaauaguaaaaagacaaaaacaaaacgaagucgaaaaagaaaccgcagaugcgcuaguaaaacaacauaugacaauaucagauagugcgcuuauagcccaauacagaaaaauaagaggccuuucucaaaaaguacgauacugguaccaacaagacacuaucuguccauauuguggcaaaaaaauagaagcaguacaauuaauaaacaauaacgauagcuuugaaguagaucacauaguaccaauaucaguaucuuuugaugauucacaaaacaacaaaguacuaguacacagccaaugcaaccaggcaaaagaaaaacaaacaccauuaggaugguuaaauaauggaggaggcuucgggcaaucgaaagcagauuacaucgcaagagugaaaucuaacaaaaacuaugcaaaaaauaagaucgauaacuuacuaaaugaaacagaccuuaaugacauagcuacucaaagaggauucauacaaagaaaucugaaugacacgagauaugcgucacguauagucuuaaacgaauuuuacucuuucuucagaaguaacaacuuaucaacaaaagucaaaguaguacgcgguaaauggacuucucaaaugcgaaaaaaauggaauggcgucggagguuuaucaaaaacgagagauacuuaccaucaucaugcuaucgacgcuugcaucauagccugcuuuccguuauuaaaagcguucgauaaggcaauaaaacuaauagaugucgauggugaaacaggcgaaauauuacaggauaaaaaagcaauaaaauuggcacaggaagcagaaauagucgaaaagauaucaguaauaaaaaauaaaaaauuugaaaauaugguaaacgaaauauacaacuucccgcuauucaaacaaguagaauuagcuaaugauauaacaaaucuagaaaauccaguaaaauucucacaccacguugacaagaaggcaaauagggccguagcaaaccaaacuauauacggcaccagaaucaaagaaaaagaagugacaaaaaggggcaagaaagaaaaaauucaagaaagauacacauuaggaacaauuaaaaacauauaugauauagauggauucaugaacuucaagaaauuauacgacaaaaucuccaagaacgacgacguuaaauuucuuaugcaaaaaaaugaccccaagacaugggaaaaacuaauagacauuuucaacagcuauccugauagugaagaagugacgcaaguagacggaaaaguaaaacggguagcaguaaguccauucaaauuauauuacagggaaaaugguuuuauaacaaaauauucaaaacauaaugacgguccaaaaguaguaaguauuaaauauuacgacaguaaagucggaagucauauagacauaacuccaaaagacgcacgaaauaaaguaauucuucaaaguuuaaaaccauggcguacggacguauauuuuaauucaauaacacaacaauaugagcuauuaggcuuaaaguacagcgaucuaaaauuuacaaacggaguguauggaauuacaagagacgccuacgaaaaacuuaaacacggaguuucggaagauggaguaacggcauggaagccuauaucaaaaaacagcgaguucagauucagucuuuauagaaaugacagaguacgaguaauagacgaaaaaggagacucaauagaguuauuauuugcgucaagaacgacaucaaacgaaggguauguagaacugaaaccaauauauaaagcuaaguucgacucaaaagaagaaguaggauuuuacgggcucguaagcaacgguagguuaaucaaaaaaaugagcaaaggcggguauaaacuuuauaaaguaaauacagauauccuaggaaaaccauacuaugugacaagagaaucugaugaaccgaaauuaagccuauga

SEQ ID NO: 8665 - RNA, 3516 nt, Artificial Sequence
  Cas9 variant
auggcaaaguauagcgucggacuagacauaggaauuucuagcguuggaugggcaauaauagauauagaaaccaaacaaauaguaaaccucggaucuagaauuuuccccucgggaaacgcagccgguaaccaagaacgaagaggauuccgcgguauacgaagauuaauaagaagaagaaaaaauagacuaacugaccucaaaaaacuccugggggaaacauucuuuucagacuuaaagaaaaucgacaguaacggauacgaauacuacgacauugacuuccaaauaaacgccaaucccuaugaacuacgaguuaaaggaauaaccgaaaaacucagcaaaaaagaauuagcuguuguccuacaucauauaaucaaacacagaggaauauccuacgaccuuggagaccucgaggacgauggaacaucaggcguuucagauuacaaaaacaguauaaacauuaauaggcaacuauugcgggaaaaaacagucggacaaauacaauuagaaagacuuauagaauuuaaccaaguucauggccaagucaaaaaagcagaagacguaaguuuacuaaacguauucccaucaucagccuaccgggaugaagcuaacaaaaucaugauaaagcaacaggaauuuuauagcgaaauaacaaauuccuucauggaacaaguugaucaguuagugucucgcaaaagagauuauuucauuggaccuggaaaugaaaagucaagaacagauuaugggauauauaagucugacggcaggacacuugauaaccuauucgcagaacucauagguacagacaaaaucaauggugaaaaacgcgcguccgcaucuucccuaacagcacaaguauacaaucuauuaaacgauuuaaauaauuuacauguauccaacaccgaagacggaaaacucacaacgucaacuaaaaaagagauaaucaaagcagcgaaaaccacugauggagucuucggaauaucacaaauuugcaaaaucauaggauguaaaaaagaagaaauaacugguuucagacaagauaaaucugaaaaaaaaguaauccacacacucgcaggauacagaaagauuagaaaggcauuagcaaccauaaauauagaggcuaaugaguugaacccuacagucuucgaucaaaucgcagacauccucacacucaauaccgaaaaagcagaaauacgaaaacaguuagacaaaguacaauuagauaucacagacgaaaugaaagagcuuguaauagauaaaaacaaagacuuccucguggacggaagagcgacauggcacuccuucucuuaucaaacucugaauaugcuaauaccagaacuucuaaauaccagugaagaacaaaugacaauauuaacccgaaugggcuuaaugaaaucagacaacgaaaaauacagaggucucaaaaaaaucccagcagagaaaauagcauccgaaauauucaaccccgucguagccaaaagcacccgagaagcaauaaaaguauucaacgcgauaucaaaagaaauaggaaaaaacaauauagaacacguaguuaucgaauuaccacgugacgacaaugaagaagaugagaaacgaaaaauccaaaaacuacaaaaagcaaacgaaacagaaaaagaagccgcagauaaucuagugaaacauaagcuaggcauaagcgauucugcccucauagcacacuacagaaaauucaaaggcuuaucacaaaaaguccgauacugguaucaacaagaaaccuacuguccauauugcggaaaaauaauagaagcaacacaacuaauaaacaacaacgauaauuuugaagucgaccauaucaucccaauaaguguaaguuacgacgacagccaaaacaauaaaguacuaguccauucacaaugcaaucaagcgaaagaaaaacaaacaccacucggauggaucaacaauggaggggguuucggccagucaaaaaaugaauacaccaaucgaguuaaaaauaacaaaaaauacagcaaaaacaaagucgacaaccuacuaaaugaaacagacuuaacggacauaaucacacaaagaucauucauacagcgaaaccuuaacgacacaagauacgcagccagaacaguccuagacgaauucuauaguuuuuucaaauccaacgaucucccaacuaaaguaaaaguugucagaggaaaauggacaucgcaaaugcgaagaaaauggaacaauguaggaggucuaaggaaaacaagagauacacaucaccaucaugcaaucgacgcaucuauaauagcaaguuucccacuacuaagagcauucgauagagcuauaaaauuaaucgacguugauaaagaaacaggcgaaaucguacaauacggaaaagcuagcuuaaauggagacguaauagaagaaaaaucagugauacaagcacccauaauaaaaaaugaaaaauucgaaaagcuaguagacgaaauauauaauuuuccccuuuuuaaacaaguugaacuagccaacaauauagaaaaccccgaaaauccuguuaaauucucacaccaugucgacaaaaaagcaaauagaacaguugcaaaucaaacaauuuacucuacaagaauaaaaaaaacagaaaaaaucguacgaaaaaaaguaacagcaaaagaagaagaauacguaauaggaaccauaaaagacauauacgacguaaccaacuucgaaaaauucaaaaaauuauacgaugaaucgucaaaaaaagaugacauaaaauuucuaaugcaaaagaacgacccaaagacaugggaaaaacuaguagagaucaugaacacguauccagacuacgaagaaaucucacaacuagacggcaaaguaaaaagaguaaaaguaagcccauuuaaacuuuauuuucgagaaaacggauuuauaacgaaauacgcaaaacacaacaacggaccuaaaguaguuuccauaaaauacuaugauaguaaacuaggaaaucacauugacaucacaccagucaacgccaauaacaaaguaauacugcaaucccucaaaccauggcgcacugaugucuacuacaacaaugaaacacaacaguaugaacuacugggauuaaaauacagugaccucaaguucacuaaaggaguuuacggcauaaccagagaagccuaugaaaaauuaaaauauggauacaccgacggaguaccagccuggaagccuauaucuaaggaaucagaguuuaaauucagccuauaucgaaacgacagagugcgcaucauuaacgaagcaggagaaaaaauagaccugcucuucgguagcagaaaugaaacaucugaaggauacguagaaaugaagccaauauucaaaacaaacuucgaugacgcagaagaagccucauucuauggaaaaaccagcaacaaaaggcuaauaaaaaaaauggcccggaaagguuaccaaaucuauaaaguaaauacggauauccuuggaaaccuauacuacacagcaaaagaaucuaacgaaccgaaauuagaucuauga

SEQ ID NO: 8666 - RNA, 3519 nt, Artificial Sequence
  Cas9 variant
augaggaaaccguacucuauuggauuggacauaggcacuaacucaguugguugggcaguaauaaccgaugacuauaaaguaccaucgaaaaaaaugcggauacaaggaacgacagacagaacguccauaaaaaaaaaccuuauaggagcacuacucuuugauaacggagaaacggcugaagcuacaagacucaaacguacaacaagaagacgauacacacgccgaaaauaccgaauaaaagaauuacaaaaaauauuuaguuccgaaaugaacgaauuagacauagcauucuuuccucgccuaagcgaaagcuuccugguaagcgaugauaaagaauucgaaaaucaccccaucuucggaaaucuaaaggacgaaauaacauaccacaacgauuacccaacaauauaucaccuaagacaaacucuagccgacuccgaccaaaaagccgaccuacgacucauauaccuggcauuagcacacauaauaaaauuccgaggacacuuuuuaauagaaggcaauuuagacucugaaaacacagauguacaugugcuuuuuuuaaaccucguaaauauauauaacaaccuguuugaagaagauauaguagaaacugcaucaauagacgcagagaaaaucuuaacauccaaaacauccaaaagccgaaggcuagaaaauuugauagcagaaauccccaaccaaaaaagaaacaugcuauucggcaauuuaguuucccuugcauuaggucuaacacccaacuucaaaacaaacuucgaauuauuagaagacgccaaacuucaaauaucaaaagauucauacgaagaagaccuagauaauuuauuagcccaaauaggugaccaauaugcagauuuauucauagcagcaaaaaaacuuucugaugcaauacuacuaucggauauaaucaccguaaaaggagcuucaaccaaagccccucuuucugcaaguaugguacaacgcuacgaagagcaucaacaagaucuagcacuccucaaaaacuuaguaaaaaaacaaaucccugaaaaauauaaagaaauuuuugacaauaaagaaaaaaauggauaugcaggauacaucgauggaaaaacuucucaagaagaauucuacaaauacauaaaacccauccucuuaaaacuugacggcacagaaaaacuaaucuccaaacuagaaagagaagacuuccucagaaaacaaagaacauucgacaacgguagcauuccacaccagauacaucuaaacgaauuaaaagccauaauacgaagacaagagaaauucuauccauucuuaaaagaaaaccaaaaaaaaauagaaaaauuauuuaccuucaaaaucccauacuacgucgguccccuagcaaacggucaaucuucuuuugccuggcuaaaaagacaaagcaaugaaagcauaacacccuggaauuuugaagaagucgucgaccaggaagcaagcgcccgugcauuuaucgaacgaaugacaaauuuugacacauaucucccagaagaaaaaguacuucccaaacauucaccuuuauaugagauguuuaugguuuauaacgaacuaacaaaaguaaaauaucaaacagaaggaaugaaaagaccuguuuucuuaaguuccgaagacaaagaggagaucguaaaccuccuauucaagaaagaacgaaaaguaacaguuaaacaacuaaaagaagaauacuucucuaaaaugaaaugcuuccacaccgucaccauacuaggggucgaagaucgauuuaacgcuagucuaggaacauaccaugacuuacucaaaauauuuaaagacaaggcauuucuagacgaugaagcgaaccaggauauacucgaagaaauugucuggacccuaacuuuauucgaagaucaagcgaugauagaacgacggcucguaaaguaugccgauguauuugaaaaaaguguucuaaagaaacugaaaaaaagacauuacaccggauggggaagauuaucacaaaaacucauaaauggaauaaaagauaaacaaacaggaaaaacaauacuaggauuccucaaggaugacggagucgcaaacagaaauuucaugcaauuaauaaacgacuccucuuuagacuucgccaaaauaauuaaaaaugaacaagaaaaaacaauuaaaaacgaaucucuugaagagacaauagcaaaucucgcuggcuccccagcaauaaaaaaaggaauccugcaaucuauaaaaauagucgaugaaauuguaaaaaucaugggacaaaacccagacaacauaguuauagagauggccagagaaaaucaaaguacaaugcaagguauuaagaacucaagacaacgccuaaggaaacucgaggaaguucacaaaaauacuggaucaaaaauacuaaaagaauauaauguuaguaauacacaacuacaaucagauaggcuguaccuauaccuacuccaagacgggaaagacauguauacgggcaaagagcuugauuacgacaauuuaucccaguacgacauugaucauauaauaccgcaauccuucauaaaagacaauuccauagacaauacaguauuaacaacccaggcgucgaauagaggaaaaagugacaaugucccaaacauagaaacagucaauaagaugaagucauucugguacaaacaauuaaaaucgggagcuauaucucaaagaaaauucgaccaucuaacaaaagcagaaagaggcgcauuaucggacuuugacaaagccgguuucauuaaaaggcaauugguugaaacacggcaaauaacaaagcacgucgcacaaauauuagacucaagauuuaacucaaaccuaacagaagacucuaaaucaaauaggaacguuaaaauaaucacacuaaagucuaaaaugguaucugauuuuagaaaagacuucgguuucuacaaauuaagggaagucaaugacuaccaccacgcacaagaugcauacuuaaaugcagugguaggaacugcauuacuuaagaaauauccaaagcuggaagcggaauucguauacggagauuauaagcacuaugacuuagcaaaauuaaugauccagccagacagcagccuagguaaagcuacaacuagaauguucuuuuacagcaaccuaaugaauuucuucaaaaaagaaauaaagcucgcggacgacacaauauucacgcgaccacaaauagaagucaacacagaaacaggagagauaguaugggauaaaguaaaagacaugcaaacuaucagaaaagucaugucuuacccccaaguuaacaucguuaugaaaaccgagguacaaacugguggauuuucuaaagaaucaauauggccaaaaggugauagugacaagcuaaucgcacgaaaaaaaucaugggacccaaaaaaauacggcggcuuugacagcccaauaauagcauacucuguacucguaguagcuaaaaacugcaaaagaaaaaauaguaaaacaaaaaacuaucaacgaaccugcgguaacaaaaacaauggaacacgcuga

SEQ ID NO: 8667 - RNA, 3522 nt, Artificial Sequence
  Cas9 variant
augcgcccaauagaaccauggauacuugguuuagacauugggacagauaguuuagguugggcaguauuuaguugugaagaaaaaggacccccaaccgcaaaagaauuacuaggaggaggagucagauuauuugacucugggagagaugcaaaagaccacacgucucgucaagcugaaagaggugcauuucgacgugcgagacgacaaacaagaacauggccuuggagacgggacagauuaauugccuuguuccaagcagccggauuaacaccuccagcugcagaaacaaggcaaauagcacucgcccuacgacgugaagcuguuucgcgaccacuagcaccagaugcacuaugggcagcacuucuacauuuagcucaucauagaggauuuagaucaaaucgaauagacaaacgugaaagagcugcagcaaaagcauuagcgaaagcgaaaccugcaaaagcuacagcaaaagcaacggcuccugcuaaagaagcagacgaugaagccggguucugggagggggcugaggcggcacuaagacaacgaauggcagcaaguggugcuccaacagucggagcacuacuagcagaugauuuggauagaggucaaccugugagaaugagauauaaccaaagugaccgugauggaguaguagcucccacacgggcauuaauagcagaagaauuagcagagauuguggcaagacaaucaagugcauauccaggccuugauuggcccgcaguaacaagauuaguacuagaucaacgaccucuccgaucaaagggggcaggaccuugcgccuuuuuaccgggcgaagaucgagcuuuaagagcacuaccaacgguacaagauuuuauaauaagacaaacacuagcaaaccugagauuaccaucgacaagcgcugacgaaccgagaccacuaacagaugaagaacacgcgaaagcauuagcccuccuaucaacggcaagauucgucgaauggccagcucugcgacgugcccucgguuugaaacgcggaguuaaauucacagcagaaacugagagaaauggagccaaacaagcggcacgaggaacugcgggaaaccucacggaggcaauacuugcaccauuaauaccaggauggagcggaugggacuuagauagaaaagaccgaguauuuagugauuuaugggccgcuagacaagauaggucagcauuacuugcauugauaggggauccacguggaccaacacgaguaacagaagaugaaacagcagaagcuguggcugaugcaauucagauaguguuacccacugggagagcuucuuuaagugccaaagcagcuagagcaauagcacaagcaauggcgccaggaauugguuacgaugaagcaguuacguuagcauuaggccuacaccauagucauagaccaagacaggaaaggcuagcaagacuaccauauuaugcugcugcucuaccagacguaggcuuagauggggauccggugggaccuccgccugcugaagaugauggagcugcagcugaggcuuacuaugguagaauuggaaacaucaguguacauauagccuuaaaugaaacuagaaaaauagucaacgcacuccuacaucgacaugggccuauauuacgauuagucaugguugaaaccacacgcgaacuaaaagcgggugcagaugaaagaaaaaggaugauagcagaacaagcagaaagagaacgagaaaacgcagaaauugacguagaacuacgaaaaucagauagauggauggcuaaugcucgcgaaagaagacaacguguaagauuagcacgaagacaaaauaaucugugucccuacacaucaacuccaaucggucacgcugaucuauugggagacgcauaugauaucgaucacguuauuccgcuagcccggggaggacgagauagcuuagauaauauggucuuaugucaaucggaugcuaacaaaacuaaaggagauaaaacaccaugggaggcuuuucacgauaaaccugguuggauugcgcaacgagaugacuuuuuagcacgauuagauccacaaaccgccaaagcacucgcauggagauuugcagaugacgcaggagaaagaguagcaagaaaaagugcugaagacgaagaucaaggauuuuuaccuagacaauuaacugauacggguuauauugcaagaguagcauuacgauauuuaucucuaguaacaaaugaaccaaaugcagucguagcaacgaaugggagauuaacuggacugcuccgguuagcuugggacauuaccccggggccagcaccgagagauuuacuuccgacuccuagagacgcuuuacgugaugauacugcagccagaagguucuuagauggacugaccccucccccauuagcaaaagcaguagaaggagcaguccaagcaaggcuggcggcucucggaagaucaagaguagccgacgcagguuuagcagacgcucuaggucuuacgcucgcaucuuuaggagguggagguaagaauagggcugaucauagacaucacuucauagaugcagcaaugauagccguuaccacuaggggguuaauaaaccaaauaaaucaagcaaguggagcaggaagaauauuggauuuaagaaaguggccccgcacgaauuuugaacccccauauccuacauuuagagcagaaguaaugaaacaaugggaccauauacauccaucaauuagaccagcucaucgagacggagguagcuugcacgcagccacuguauucggugucagaaaccguccggacgcgagaguucuaguacaaagaaaaccaguagaaaaguuauuccuagacgcaaaugcuaagccauugccugcggacaaaauagcggaaauuauugauggcuuugcuagcccucgcauggcgaaaagauuuaaagcucuauuagcucgcuaucaagcugcacacccggaaguaccuccagcauuggcagcucucgcaguagccagagauccggcuuuuggaccaagaggaaugacugcuaacacuguuauugcaggucgcagugacggugacggggaagaugccggccugaucacaccauuucgugcaaauccuaaagcagcaguaagaacuaugggaaacgcagucuaugaaguuugggaaauccagguaaagggucguccgagauggacucaucguguauuaacacgauucgaucgaacacagccagcaccuccaccaccaccagaaaaugcaaggcuaguuaugagauuaagaagaggugaucuaguauauuggccacuagaauccggggaucgccuauuuuuaguaaagaaaauggcuguagacggacgacuggcauuauggccagcaagacuagcaacaggaaaagcgacugcauuguaugcgcaauuaaguugcccgaacauaaauuugaauggggaucaaggauauugcguacaaucagcagaagggauaagaaaagagaaaauuagaacuacauccuguacagcucucggaaggcuuagacuuaguaagaaagcaacauga

SEQ ID NO: 8668 - RNA, 3525 nt, Artificial Sequence
  Cas9 variant
augggaaaauauucaaucgggcuagauauugggaucucgagugugggcuggagcauaauagauaucgaaaagaagaaaauaguagaccuaggaucacgaauauucccaucaggcaacgcagcugcaaaccaagaccgaagaggcuauagagguacaagaagacuaauaagacgacguaaaaauagauuagcugaugucauaaauuuucugggugaagaaaauuucauagauacuaaaguagucgaccagaauggaaauauccacuauaaauuauuaguaaauucaacggaaucaccauacaaacuaagaguaaaaggacuaucuaaaaugcuaacaaaacaagaacucgucauagcauuauaccacauaguaaaacacagaggaauaucauacgauuugggcgaucuagaagacgacggcacaucaggugucacugacuacaaaacuuccauaaacaucaacagacagcuauuaauaaagaaaacuguaggacaaauccaacuugaacguuuaaaagaguucggaaaaguacgaggacauguaaagaaagacgaaaacauaacacuauuaaacguauuuccaucaagcgcauacgucaaagaagccacucaaauacuuacaaaacaacgugaauuuuaucccgaaauuacagacgauuucaucacuaaauucauaccuuuuauaucaagaaaacgggacuauuuuguaggcccaggaaaugaaaaaucacgaacagauuauggaauauacaagaaagauggucgaacgcucgacaauuuauucgacgaacuuauagguauagacaaaauaagcggcgaaaaacgagcauccgcaucguccgucacagcacaaauauacaauaugcuuaaugaccuuaauaaccuuacagucacaaauaccgaagacggaaaacuaacaacacagacaaaaagggagauuaucgaagcggacaaaaccacaaacggccuauucggaaucacacaaauauguaaaaucauaggauguaagaaagacgacauaaaaggguucagaauagauaaagucgagaaaccaaucaugcacacauuaagugguuauagacgauucagaaaagaguuagcaaaaauaaacauagaagccaaugauuuagauauaaauuuaguuaacaaaauagccgacauucuaacuuuaaacaccgaaaaagccgaaauacguaaacaacugaacaaaucaaacauugacguauccaaugaaaucaaagaacuaauaauaaacaaaaacaaagauuuccuaguagauggcagagccacuuggcauucuuucagcuacaaaacacuuaauuuacuuaucccagagcuaaugaauacaucagaggaacaaaucacaauacuaacaagacuuggccuaguaaaaagcaauucagagaaauauaaaggacugaaaaauauuccagcaagacggauaaccgaaggaauuuacaacccaguagucgccaaagcaacaagagaagcaguuaacguauuuaaugcaauagcuaagaaaauaggaagagauaacauuagcgauguaguaauugagcuaccacgugaagauaacgaagccgacauaaagaaaggaauaguaaaaagacaaaaacaaaaugaacuagaaaaagaggcagcagaugcauugguaaaacaacagaugacaauuucagauagugcgcuaguagcccacuacagaaaagucagagggcuuucccaaaaaguuagauacugguaccaacagggaacauguugcccauauugugguaaaaacauagaagcaguccaacuaauaaacaacaacgauaguuuugaaguagaccacauaaucccaauaagugugagcuucgacgauucccaaaauaacaaaguacuuguacauucacaauguaaucaagcaaaaggaaaacagacaccuuuaggauggcuuaacaacggaggaggauuuggacagaacaaaacugaauacguagcaaaaguuaaaacaaacaaaaacuacagcaaaaauaaaauggauaacuuguugaaugauauggaucuaucagauauaguuacacaaagaggauuuauacaaagaaacuuaaaugauacaagauacgcaaguagaaucguauuagacgaguucuauaguuucuuuaaaucaaacaaucuuucaacuaaagucaaaauuguucgagguaaauggacaagccaaaugagaaagaaauggaacggagucgguggccugaagaaaacgcgagauacauaccaccaucacgcaauugacgcaucuauaaucgcgagcuucccgcugcuaaaaguguuugacaaagcaaucaaacuaauagacaucgacagagaaacaggggaaauacuucaagacaaagaagcaauaaaaaugucacaagaagcaaagcuacuagagaaaauuccagucauacaaaaugaaaaauuugaagaauuaauuaaugaauuauaugacuucccauuauucaaacaaguagaauuagcaaacgacauaacgaacccugaaaacccaguaaaguucagccaccaugucgauaagaaagcuaaucgcucuguagcaaaucaaaccauauacgguacaagaauaaaggaaaaagaaauaaauaaaagaggaaaagucgaaaaagugcaagaaagguacauucuaggcacaaucaagaacauauacgauauagauagcuuuacaucuuucaaaaagauuuacgacaaaaugagcaaaacaggcgacguaaaauucuuaaugcaaaagaaagauccaaaaacuuggggaaagcuaguagaaaucuuaaauagcuauccggacagcgaagaaauaacccaaguagacggaaaaguaaaacgaguaaaaguaagcccuuuugaguuguaccgcagagaaaacgacuuuauaacaaaauacgcuaaacacaacgauggaccuaaaauaguauccaucaaauacuacgauagcaaaauaggcucacauauagauauaacaccgauaaaugcuaaaaacaaaguagugcuacaaagucucaaaccauggagaacugacgucuacuucaacucagaaacaagacaauaugaauuacucggacuuaaauauagugaucucaaauuuacaaacgggguuuacggcauaaccuccgaagcauacgaaaaauuaaaacauggaaucucagaagacggaacuaaaaccuggaaaccaauagguaaaaacagcggauucagauuuagucuuuaccgaaauaacaggguaaaaauaguagacgaaaaaggugaaucauuagaacuacucuucgcaagucgaacaaccucaaacgaagguuaugucgaacuaaaaccgauauauaaaagcaaauucgacucaaaagaggacgucggcuucuauggacaaaugaccccgaguggacaauucguaaagaaaauggcuagaguaggguacaaacuauacaaagugaauacagacguacuggggaacccauauuacauuacaaaagaaucugacgauccagaacucagccuguauaagaaauga

SEQ ID NO: 8669 - RNA, 3528 nt, Artificial Sequence
  Cas9 variant
auggaagaaaugaaacagacaggaaggaaaaaugaagcuccaaaacuaacggauuuaaacuauagaauaggacuugauauuggaauagcuaguguaggaugggcuguauuagagaacaauagccaugacgaaccuuuccgaauuauagaucucgggguaagaauauuugacacagcagaacaaccaaaaacuggcgcuagucucgccuuaccuagaagagaggcacgaucagcuagaagaagaauaagacgaagaagggauagaauagagcgaauaaagaaauuguuucaagcagaaggguuaauuaauaucgaugaauuugaagcgagguauaaaauagcaggccuaagugauguguauaaauuaagauaugaaggacuagaucgaaaacucacagaugaugaauuagcacaaguacuccuacauauagcaaaacaucguggauucaaaagcacguccaaggcagaagaagcagaaaaugagaaugaugcagcaaagaagaaagaagcaggagcguuaaagaaagggauuucaaauaauaagaaauuaauggaagaaaaaggauacagaacaguaggagaaaugauguacuuagaugaaaacuuucggaccgauugucccuggaaugaaaacggauauauacucacuccaagaaacaaaucaggagacuacaaacauacuguacuaagagacaugcucguagacgaaguaagagaaaucuucaaaagucaacgaucacuagguaauauacaugcaucagaagaacuagaaaaugcuuaucuagauauaaugcuaucacaaagaucguuugacaugggaccaggagcaccuagcaaauaugcaauggaaggguuugaagaccgaguaggcuuauguacauucgagggcaaaaauggagagaaaagagcagcaaaagcggcauauacaagugaguuauuuguggcguuagagaaaaucaaucauacaaaaauaguaucagacgauggagcaacgagguuuuuaacaacuuaugaaagaaaaucaauaaucgaacuaaugcauaaacagcaaacaguaaaauaugcagcagucaggaaagccaucggauuggcagaagaggacaaauuuuauaaucugaacuacucuccuaaagcuggaagcaagaaaagcccagaagacacagacuuuguuaaacuagaaaauuaucacaaaauuagaaaagccuuaggagaagauauaguaagcgaacauuuaccagcagagaaaauaaaacuauaugacucuauagcuaccauauuaacucuuuuuaaaaacgaugacucuagaauaaaaagauuuaucgaacuaggaauaggcgaagaauguuuugacggacuucuaucacuuucgccaaguaaauuucacaaccugucauuagucgcaaugggaaaaauaauuccguuuuugcuagacggaaacacuuaugacaaggcuugugaacuggcagguuaugacuuuaaagcggacaacaaaggggagaaaagcguacugcucaaaggcaaaaauauaaccgauaugguaaaugacauaacaaacccagucguaaggagaagugugucacagacaauaaaaguaauuaaugcaaucauauuagaauauggaagcccccaagcugucaauauagaacuugcacgggaaaugaguaaaaauuuugaugaacgucguaaacuaaaaucagauauggaaagcagagaaaaagaaaauaacaauguuauaaaaagagucaaagaauacaaacuuaauccgacaggucaagauaucguaaaauuccgacuuugggaggaacaagauagacguugccuguauucaggagaaaagaucgauauuaacgaccuuuucucaagagaugguggauaugaugucgaucacauacuaccguacagcauaacauuugacgacacauauagaaacaaaguauuaguaaaagcaagcgaaaauagacagaaagguaacagaacaccauaugaauacuucauggcggagaaagaugaugacgaauggaauguauaugaaaccuuagugagaaacacugucaaagacuauaaaaagguuuuaaaauuauuaaagaaacauauaacugaagaugaaaaaucagaguucagagaaagaaacuugaccgauacaaaauauauaacccguauuauauacaauaugauaagacaaaaccuaguguuaaagccuuaucuuagucuagaaaaagaacgaaagaaacaaguaauggcaguuaacggaucaaucacacauuaucuuucaaaaagaugggggcuagaaucaaaagacagacgaacggacacacaucacgcacaggaugcgguaguaauugcuugcacaacugauggaaugaucaacaaaaucucaagauacaguaaaggacgugaauuauuauacucacgaggauuuaaauuuguggacgaggaaacuggcgaaauauuaaguagggacaacuuuacuagagaggaaugggacgagaaauacggcguaaaaauacccauacccugggaacauuuucgagaugagcuugacauacgaaugagcagauauaacgguaccggagacgacaguaucgauaaaacaacaccaagagacuucauacucucacaccgagacgcacauaaauggauaaauuauccagaauggauguucguugaaggaaggcccgguagaagaggaguauuggauggaauauuugugaguaggaugccaaagcauaaagugaguggacaagcacaugaggaaacuguaagauccgcaaaauauuauaaugauggaggaaguguauuugaaucaggaggauauguaguaacaaagaaaagcauacaagauauaaaauuaaaagauggagaaauuaaagaguucuucaauccugauagcgaucgucuguuauauaaugcacuuguagauagacugaacaaauuugaaaaugauccaaagaaagcauucgccgaaccauuuuauaaaccgaaagcagacggaacccaaggcccaauagugaagaaaauuaaaguuuuugaaaaacaaucgagcggagucuuuguaagagauggaaaagguaucgcagcuaauggcgcaaugguaaggauagauguauucugugaagaagauaaagguaaaaagaaauacuauuucguaccaauauauacagcagaugugguuaaaaagaaauuaccagacagggcagcgacugcaaacaaauuaauuucagaguggagaguaaugaaagaagagaacuuuauauuuucucuuuauucaagagauuuaauuuauauagaaagugauaaaggaguacaaguaaaagauauugaugguaaaauaaguaaaccaguaaauuuauuugcguauuauuuaggagcagauacgucaacagcauccauaagugguaaacuacaugauucaagugcuaacuuccgcucuauuggaauccaagguuugcguagauuugacaaaugucaagucgauguuuuaggaaacauuagcuuuguuaacaaagagaaaagaaugccauucaauuga

SEQ ID NO: 8670 - RNA, 3531 nt, Artificial Sequence
  Cas9 variant
augaauaaaguccaagaagauuguuacaaaaaaauuaaagagaaauuagcagacagggaauaccgcauaggccuggaucucggcguuggcucaauagguuacgcuguaguaucacuaaaaggcgauaugccagaagaugucauacuggcaggaucccgcauauuuaaaucgaguauaggcgcggcagaaagaagacacuucagagcgcagagaaacacccauagacaccacagagaaagaaugcguuaccuauggaaauuauuagcagaaaaaaauuuagcacuacaauugccagaaaaucugucuaaaaaggagaacuuuaccgacuuugacacaucaagaaaacgguucccuauagaaguucucagaaacgacccauacaucuuaagauacaaagcacuagaugaaaagcuaucauuguuccagcuaggauaugcucuauaccacauugcaaaccauagaggaacagcaaguguacgcaguuucuuagaagacgacgaagccaaagugaaagagaacaaagaaacagcaaaacuagccaaaaauacaaaaaaaauaauguaugagaaaaaauacagaacauucggggaguacuuauauagggaaagaauugaaaaauuucgacagaacgaaagaaugaaaguaacaaauaaaaacgaaaauaaagaauucgcagucacccgcgauauuaucgaaaaagaaguagaaaugauccuaggagcccaaaaacgcuauaauacagcaguccuagcagaugauuacauagaaagaauuaaaaaagccaucuucuacgaaacggagaaauuaauaccagaaccagaauacugcccauacuuuaaagacgacaaaagguuaccuagaucucauaagcuuaaugaauaccgccgcaucuacgaagcauugaacaacacccgauacuauauaccagaaauagaggaaaaaaccggcgaaauacuaaguagaaaagaaaaagaacaacuaucaaaagaagaaaaagaaaaauuauucaauuuucuacuaaaaaauaaagaauuaacagaagcaaaaguaaaaaaacuccuaaaucuuagcgaaauggcaaaaguacaauuacaaggaagagacaaaaaaaaucaaaaaaucaaaggauaugcauuaauaacucuagaaucgcuaccauuuuggucaaaacugccagaacaacaacaagacgaauuuuuguacgacuggaacaaacucccggaugaaaagcuaaaagaucggcugagaaacuacuauaaauuaaccgacgacgaaauagaugaaacauuucagaacauagugcuaccaaguaauuacgcaccacuaggcaaaaaggcgauggaaauacuacuagaguacauaaagaacggacuaaguuacauagaagccuuagauaaagcagcagacgaaaauaaaauaaaaguagaaaaacaugaaauuaacgacuuacucccauacuauggaaaaauacuccaagaaaguacgcaaaugccaaucggcaaggcuuuuucuaaacaauucgcugcaaagaauuauaaaaaaccggacauaaacaaaaacgaacaagaauucggacgaauagcuaauccagucguccaucaaacccucaaugaauuaagaaaacuaauaaaugaaauaauaaccguauucggaaaaaagccacuagaaauuucuuuagaaacaucaagagaacuaaagaaaucacagaaggaaagagaacuaauagccaaacaacaggacauagaugaggaaaaaagaaaaaaaauauggaagaccuacauagagccacaucuacaacaaauaaaaucuagaucagauaaauuaaaaaaacuguuuguauucgaacuaugggaagaccaaaaacacaacugcccauucugcuuagaaaaaauaaauguagacgacauauacucaagaggaguagacaaagaacaccuuuuuccucuuaaaaaaagugaagacgauuccgaaaacaauuuaguaauagcacacaauaagugcaacgcgaggaaagcagaaagagcuccauucgacgcauucggacaugaaucaauauggaaugacauauucucuaacgcagaaaagaacuuaccaagaaagcuauggcgauucagacaaggaucauucgaaaaauuccuagaaaaaccuccaauguugaaaagauucgaaacagacaauuccuauauaaguaaaauaagugcaagauaucuagcaugccuauucgacaaaccauccaaaauauuuugcguaaaaccauucuuaaccgcccaacugcgaauagcauggcaacuagacgaaauuaugauacgccuagcagaaaauaucaucuuagauagcgaaaaggauucguuuaacaaaggagguuuacaaaagaaaaagagaauugacaauagacaucacgccuuagacgcgguugucauagcauaugcaucaagaggguaccauaauuuuuuaaauaggguccacgccaaagguuacaaaauaaauuacgaugaaaagacauggcuaucagaaacucuacgacccccaggaaauaaaaaucuugaggacuuuaaaucuggaauaauaaauguaaugauaaaugcuaacaucucgaucaaacacgaccacaauaacaagggacaauuaguaaaaucgaaagcauauaaacuguacuauucagaaauugguaaauauauaauuacuaccuuaaaaagcgucagcgaaauauuauucaaacaaaaagagaaaccacaagacacuuugagacgagcacuaugcaaauuugaagacagacuaucagauauaaaagauaaaaaacuacgaaaaaaauuagaagauaauaucacaaucuauaaaaguauagaaaacgaguccgcccuauccaaagcaaaacaggaacuagaagaguuugaccuaaaagccaaaaaagaaggcaaaaaaggauacgaaaagauuacugacauacuaauuuacaaaaaagcaugcucaaugcauggagguaaauacauccacgucaaaaauagaaucgaaaauaaauucuuugcauuaaaagagccuacggaaauagaaacaggcuuuggcuaugauaccgcagauaaccugucucuugaccuauaucaugauaacaauggaaaauuaugcggagaaguaauaaggaaaauagacuuuaacagaaacagaguaccuaacuauaaaaaagaaggguauaucuuacuagaaagaauauaccaaggagacacccuagaaguagacauaagugacgacaaaaucucgcuaaaaaacaaggucggaagcgcaccugauaaaagaacauucguaaaaguacuaaccuucacagagagcgacagauacuuaaaaaacaagcgcgaccaaauacaaauauuuuucugcaaucuacuuaagagcacauuaaaacaugacgacagcucaaaacaugaugauucauuuuauguuagcucaaugcagaaauauaacguccgaaagguaauccuaacaucauuaggaauaauaaaguacagauccaaaauccucaaaaauaaagaaaucuga

SEQ ID NO: 8671 - RNA, 3531 nt, Artificial Sequence
  Cas9 variant
auguuauucccuaaaaaacucaguaaagaagaaguagcguacguccucgucgaaauuaacucuaaccuuaauaauaguuccaauuaccucggcaacaucucagacagaagcaaagaacuauauuucaacaaacaaacaauuggacaauuccuauacaccaaauuaaaagaagaccgacacuauucacuaaaaaacaaaguuuuuuacagacaagacuaucuagacgaauucgaaagaauaugggaaacacaagcuaucuuucacaaagaacuaacugaagaccuaaaaaaacaaauaagagauacaauuauauuuuaucaacgccgauuaaaaagccaaaaaggacugaucucccuaugcgaauuugaaaauaaagaaauaaccaucgaaaaagaaggcaagacugugacaaaacaaauaggaguacgaguuauuccuaaaucaucuccucucuuccaagaauucaaaauuuggcaaauacuuaauaaugucaucugcaaaaaaaaaggcacucguaagaaaaaagcaguaacaccagcuccacuucucuuugaacuuuucgguacaccgucugagacuuucuucucacuggacauggaaugcaaacaacuauuauucgaagaacuaaaccuaaaaggcaaccugaaggcagacaaagugauaagacuacuaggauacauaccccaggaaugggaaaucaacuauaaccaauuagaaggaaaccgcacacaaaaaagucucuacgaagccuauuuaaaaauaaucgaaaucgaaggauaugacaucaaaaccuuucuuagaauaaaaagcgacaaagaagacugggaccuagaagaaucacccuuaucggcaaaagaaauacgugaaaauauacagcauauauucgaaaccuuaggcaucucaacagcaauuuuauacuucgaugccacacuucccauuaaagacuuugaaaaacaagcaucuuaccaacuauggcauuuacuuuauucuuacgaaucagauaacucccccagcggaaacgaaacacuauacaaacuacuacaggacaaauucggauucaaaagagaacaugcaguauuucuuagcaacauuaguuuccaggacgauuauggaagccugucagcaaaagccauaaggaaaaucuauccuuacauaaaggaaaaccaguauagcacagcaugcgaauuagcuggauacagacauuccaaacuaagucuaacaaaagaagaacugaacaaccgcccuuuaaaagaccuaauaucgccccucaaaaaaaacucacuuagaaacccaguaguagaaaaaggccuuaaucaaaugauaaacguuguaaacgcacuaauagaaaaaaauucagaaaaagacgcugaaggaaacauaauaaaauacuuccacuucgaugaaauaagaauagaacuagcuagagaauuaaaaaaaaacgcucaagaaagagcagaaaugaccuuaaacauaaaaaaugcaacuauagagcaagagaaaauaaaauccauacuaauaagugauuucggaauuaaaaauccuacaaaaaaugacauaacucgauaccgucuauaccaagagcuagcucacaacgauuauaaagaucuauauacaaacaccgacauaccaaaagaacuacuauuuucaaaaaacaucgauaucgaacacauaguaccgaaagcucgaguuuucgaugacucauucucaaacaaaacuuuagcauauagagacuuuaaccuaaaaaaaggagaaaauacagcguucgacuucauagacucaucucuaggugaagaagaauuaaaccaguacauagcaagaguagaaaacgcuuucaagaccaaaaacauuagcgcaacaaaauauagaaaucuucucaaaaaagcaacagaaauuaacgacgguuuuauaaaucgugauuuacgugaaacccaauauauagcaaaaaaagccaaagaucuacuauuccaaauaacacguucuguuguauccacaagcggaaguauaacagauagauuacgugaagauuggggucuuauugacauaaugaaggaacuuaacaugccaaaauauagggaucucggacuaaccgaaaucauagagaggagagauggucgcaaaguugaaguaaucaaagauuggacaaaaagaaaugaccacagacaccaugcgauggacgcauuaaccguagccuuuacaaaaccaaguuacauucaauaucucaaucaucuaaacgcaagaaaagacgaaaauaauaaauuauaugccgacauacuaggcaucgaaagaaaagaaaccacaaaaauucacgacgaaaacggaaaugaaaaaaggguauucauugaaccuauaccaggauucagacaaauagcaaagaaauacuuggaagaaauauuaauaucacacaaaacaaagaauaaagugguaacaaaaucaauaaauaaaauagccggaacaaacaagaaacaagaaacccuaaccccacgaggucaacuacacaaagaaaccauauauggaaaauaccacuacuacucaaacaaagaagaaaaaaucgguaccaaauuugacaaagaaacaauaucaaaaguaaguaaucccauuuauagauacgccuuacagaaacgacucgaagccaaugaaaacaacccaaaaaaagccuuuacaggaaaaaacgcacugucaaaaaaccccaucuaccuagacgaugcaaaaacaaaaauccuacccgaaaaaguaaauuuaauauaccucgaagaagacuuuuccauaagaaaaaaaauugucucagaaaacccaacaucaaaggaauucguuccuaacuccauauccauugaaaaaauugucgacgaaggaauaaaaaggauacuuaaagaaagacuagaaacauauaacaacgacccaaagaaagcauuugcugauuuagacaaaaauccaauauggcuaaauaaagaaaaaggaauaagcauuaagagaguuaccaucagcggaguaaaaaacacucaggcgcuacacucuaaaaaagaucacuugggaaaaccaauacuugauaaagaaggacaagaaauucccguagacuucguaucaacagggaacaaucaccauguggcgaucuacagagaccaaaaagggaaucuacaagaacaaauuguaagcuuuuuugaagcuguaguacgggcucaacaagguuuaccaaucauagacaagaccuacaaacaagaagaaggcuggcaauucuuauucaccaugaaacagaacgaaauguucguauuucccaaugaaauaaccggauuuaaucccagcgagauagauuuacucgacccaaaaaacaaaaagcucauaagucccaauuuauucaggguacaaaaaauaagcauuaaagacuacuuuuuuaggcaucacuuagaaacaaacguugaaacaaacaacauacucaaagauauuacauggaaaagaggaggauuaucacuacucaaaggaaucauaaagguccgaauuaaucauuuaggaaauauaguaucuauaggugaauauuga

SEQ ID NO: 8672 - RNA, 3534 nt, Artificial Sequence
  Cas9 variant
augaauaaaguacaagaaauugaauauaaaaaaaucaaggaaaaauuagcugauagagaauacaggaucggauuagauuuagguguaggaucaauaggcuacgccgucguaucgcuaaaaaaguaugaugaucuguccuaucucccagaagacaucauacuagcugguaguagaauuuucgccucaucgauaggagcaguagaaagaagagaauuccgucuacaacguaauagccacagacaucgacgagaaagaaugcguuucuuauggaaacuauuagcugaaaagcaacuagcacuucaaccuagcaaagaccucgaaaaaaaagaaaacucagcagacugugaaacaucucaaaaacgauuuccaauaaacauacugaaaaacgaucccuacauucucagauacaaggcauuagaugaaaaacucucacucuuucaguuaggauacguacucuaccauguagccaaccacagaggaacagacuccauaaggucauuucuugaagauacagacgauaaaaucaaagaaaacacaaaaacugcgaaacuugcuacggaaacaaaaaagauaauugacagcaaaaaauacagaacauucggggaauaccuauacaaagaacgcauacaacagaaugaaagaaaaaaaguuucgaaucgaaaaacagcaggcaauaaaaacaaagaguuugcagucacucgagacaugauauuuaaagaaacagaaaaaauucuggcaagucaaaaacaauacuacacaaauguacuaacagacgaauauauaaaggagauagaaggagcgauauuuuaccaaacagaaaaacuaauaccagaaaguggcuacugucccuauuucaaagacgaaaaacgucucccuuguucgcacaaauuaaaugaauacagaagaauauaugaagcacucaauaacgcccgauacucugcccccguacuagaugaaaaaacaggugaaauucucaguuaccaagaaggagaggaauucucaagugaagaaaaaaaaauacuauucgaugaaguacuccuaaaagguaaaaaguuaacagaaucagaaauuaaaaaacuccuccauuuacccgacggaugcgaaauacaacuacaagguagagacaagcgaacgcaaaaaauaaaaggauacgcguuaacagcccuagaagcacuuccauuuuggucaaaauuaagccaacaacagcaagaugaguuccuguacgacuggaacggucucccagaagaaaaacucaaacccaaacuuauagacugcuacagucucacagaaaacgagguagaugaaacauuccaaaaaauaagacuacccucuaauuacgcucccguagguaaaaaagcaauggaaauucuauuaacauauauaaaagauggauauucauacacugaagcucuagacaaagcagucuccgaaggaaaauucaaaguggauaaacaaaccacuaucuacgacucuuuaccauacuacggcaaaauacuccaagaaaguacacagaaacuaaucggaaaagcauucucaaaacaauucgcaaaacgaaauuacaagaaaccgaacaccaaccgaaaugagcgugaauucggaaaaaucgcaaacccagugguacaucaaaguuuaaacgagcuccgaaaguuaauaaaugaaauaauuacaguauucggaaaaaaacccuuagagauaggacucgaaacugccagagaguuaaaaaaaucaagcaaggacagagagucucuagugaaacaacaaaaugaaaacgaauauaaccgaaauaagauauacaaggauuauguugaaccacaccuaucacaaauaaaaucuagacaagagaaucccagucgauauauauuuaaguucgaacuuuuugaagaacaaaaaaguaucugcccauucuguuuaaaagagauaaccccagacgacauaauaaacucaaaaguagacauugaacacauauucccaauagaagagucagaagacgaugcaaaaaacaaucucguaauagcucauaacgaaugcaaugcggacaagggcaagaaaagcccauucgaugccuuuggagacaaaacaucaggaaaauacguauggaacgacauacuacacaaugcuaagaaaaaucuuccacacaaaauauggagauuuuaucaaggaucauuagaaaaauuucuugaaaacaaaccaauguuaaaaagguuuggaacagauaauucauauauuagcaaaauagcugcaaaauacuuagcaugucuguucaacaacucaucuaaaauuuucugcaucaaaucaagccuaaccgcacaacuccgaauagcaugggaacugaacucuauaaugauaccacuagcaaaaaacauacugucugaaaaggaguuggaagaguuuaaaacacuaaaaaacaaaaaaauacgaauggacaaccgccaccaugcauuagaugcuauaacuauugcauacgcaaacagaggauaucauaauuuuuuaaacaaaauacaugccaaaggauacaaaauagauuaccgcgaaaaaaauuggcuuucuaaaauccuucuaccaccguuaaauagagacuuagaagauuuuaaaaucucagucaaaaacucaauagaaaaagcuaacguaucaauaaaacacgaucacaaaacaaauggaucccuaguaaaaggaacagcauacaagguauauuacucaggaacgggcaaauacauaaucacaacacuaaaaaacguagaagaaauaucauucaaagaaaaagaggauccugaagacacuuuaagaagagcucucugcggcuucgaggacaguaacauuaaagacgaaaaacuuauaaagaaauuaaaauauaauucagacuuauacaagaaaauucuaaacaccaaaccaaaagccaaacaagaauuggaacaagcaaaccaagagaccaaagaagaagguaaaaaaacccaaaaaaucacagauguacucauuuauaaaaaagccugcagccuaguaggagaacaauauauacaaugcgcaagcagauuggaaaacaaauucuucgcaguaaaagaaccgacugaaauaagaacaggaauuggauacgauacaggagacaaccuauuuuuagauuuauauuaugauaagacaagaaaauuaugcggcgaaaucauaagaaaaauugacuucaaucaaaacaagauuccaaacuaucaaaaagagggauacauauuauucgaaagaauauaucaaggcgacacauuagaagcagauacaucagaagauaaaauaagccuuaaaaauaagacaggaucagcccuagacaacagaacuuucgugaaaguucuaacauucacagaaucagauaaauacuucgauggaaagaaagacaagauacagauauucuuuggaaacuugcuaaaauccaacuacaaacaagacgauucauuuuauauauccucaaugcaaaaauacaaugugcgaaaaguaauacucaccucucucggaauaaucaaauacagaagucaaauacucaaaaacaaagaaguauga

SEQ ID NO: 8673 - RNA, 3540 nt, Artificial Sequence
  Cas9 variant
augucaaagaaaguaucacgaagauaugaagaacaagcgcaggaaauuugccagagacuugguuccagacccuauucaaucggacuagauuuagggguuggcucaaucggaguagcaguagcagcuuaugaucccauaaagaaacaaccaagcgaccuaguuuucguaucauccaggauauucauaccuuccacgggugcagcugagagaagacagaaaagaggacaaagaaauucauuaagacauagagcuaauagauuaaaauuuuuauggaaacuacuagccgaaagaaaccucaugcugucguacucagaacaagaugucccugauccagcgagauuaagauucgaagacgcaguagugagagcgaacccuuaugaauuacgucuaaaaggguuaaaugaacaauugacacuuuccgaauuaggauacgcgcuauaccauauagcaaaucauagaggaucaucuaguguaagaacuuuccuugacgaagaaaaaucaagcgaugauaagaaacuugaagaacaacaagcaaugacagaacaacuagccaaagaaaaagggauaagcacguucauagaaguguuaaccgcauucaacaccaacgguuuaauaggauacagaaauagcgagaguguaaaaucaaaaggaguaccagugccaacacgagauauaauuaguaaugagaucgauguuuuacugcaaacacaaaaacaguucuaccaagaaauacucucagaugaauauugcgaucgaauagugucagcuauacuauucgaaaaugagaaaauaguccccgaagccgggugcuguccuuacuuuccagaugaaaagaaacuaccaagaugccacuuucucaaugaagaaagaagacuuugggaagcaauaaauaaugcaagaauaaaaaugcccaugcaggagggagcagcaaaaagguaucaaucugcaucauucagugacgagcagcgccauaucuuauuccauauugcccgaucaggaacagauaucaccccaaagcuaguacaaaaagaauuuccagcuuuaaaaaccuccaucauaguacuacaaggaaaagaaaaagcaauacagaaaauagcaggcuucagguucagacguuuagaagaaaaaucuuucuggaaaagguuaucagaagaacaaaaagacgauuucuuuucugcauggacaaacacacccgaugacaaaagauuaucaaaauauuuaaugaaacaccuucuucuaaccgaaaacgaaguuguagacgcguuaaaaacaguuucauuaauuggagauuacgguccaauuggaaaaacugcaacacaacuacuaaugaaacaucuggaagacggacuaacauauacugaggcacuugaaagaggaauggaaacaggcgaguuucaagaacuuagcgugugggaacaacaaucguuacugccauauuauggucagauccucacuggaucuacacaagcccucaugggaaaauacuggcauagugccuucaaagaaaagagagauucagaaggauuuuucaaacccaauacuaauucggaugaagaaaaauaugggaggauagcaaauccaguuguccaucaaacauuaaacgaacuuagaaaacugaugaaugaacuaauaacaauacugggagcuaaaccacaggaaauaacaguagaacuugcucgugaacuaaaagucggugcagagaaaagagaagauauaauuaaacaacaaacuaaacaggaaaaagaagcaguacuagccuauucaaaauauugugaaccaaacaaucuagacaaacgcuauauagaaagauucagacuucuagaagaucaggcauuuguauguccauacugcuuagaacauauaaguguugcagauaucgcagcagguagagcagaugucgaucacauuuuuccuagagacgacacagcugacaacucguacggaaauaaaguaguagcacacagacaauguaaugacauuaaaggaaaacgaacuccauaugcagcauuuagcaauacaucagcauggggaccgauaaugcacuaccuagacgaaaccccaggaauguggcgaaaacgacgaaaauuugaaaccaacgaagaagaauaugcaaaauaccuacaaucuaaaggauuugucagcagguuugaaucagauaauucauauauagcaaaagcagcaaaagaauaucuaagaugucuauucaauccaaacaauguaacugccgugggaagccuaaaaggaauggaaacguccauccuaagaaaagcauggaacuuacaaggaauugaugaucuuuuagguaguagacacuggucaaaggacgccgacacaagcccaaccaugcgaaagaacagggacgacaaccgccaucacggauuagaugcaauaguugcccucuacugcagccguucauuaguacaaaugaucaacacaauguccgaacaagggaagagagcuguagaaauugaagcaaugauaccaauaccugguuaugccagugaaccaaaucuaaguuucgaggcacaacgggaauuauuccguaagaaaauccuagaauuuauggauuugcacgcauucguuucaaugaaaaccgauaaugaugcaaauggggcauuauuaaaagauacuguauauaguauauuaggagcagauacccaaggagaggacuuaguauuuguaguaaagaagaaaauaaaagacaucggagucaaaauaggcgauuaugaagaaguagccucggcaauacgaggaagaaucacagauaaacaaccuaaaugguauccuauggaaaugaaagacaagauagaacaauuacaaucuaaaaaugaagcugcccuacaaaaauacaaggaaagucuaguacaagcagcagcaguccucgaagaaagcaaucguaaauugauagaaagcggcaaaaagccaauacaauuaucagaaaagacaaucagcaagaaagcacuggaacuuguaggagguuauuacuauuuaauuucaaauaacaaacgaacgaaaacuuucguuguuaaagaaccaaguaaugagguaaaagguuucgccuuugauacuggaucgaaucuuuguuuagauuucuaucacgaugcucaaggaaaacuauguggugaaauaauaagaaaaauacaagccaugaacccuaguuauaaaccugcauauaugaaacaaggauauucuuuauauguacguuuauaucaaggugauguaugugaguugagagccucggauuugacugaagcagaaucaaaccuagcaaaaaccacacauguccgacuaccaaaugcgaaaccaggaagaacauucgugauaauuauaacauucacagaaauggguucggguuaucagauauauuuuucaaaucuagcaaaaucuaagaaaggacaagauacaucguuuacccuaacaacuaucaaaaauuacgaugugagaaaaguacaacuaaguucugcaggucuaguaagauacguauccccguuauuaguugacaaaauugaaaaagacgaaguugcucuuugcggagaauga

SEQ ID NO: 8674 - RNA, 3567 nt, Artificial Sequence
  Cas9 variant
augaaauauaucuuaggguuagauaucggaguaucaucaguaggaauugcaguaauaagugaagaaaaucagaagaaaacaauagaaaacuuagcaguacguaucguacccgaggaucccgacuuucauggcaaauucuacucaggaaacaccgcaagcaaaaauuuagaaaggacagcaaaaaggggaaaucggaaaaauaaucaaagauucaaagcgagaagagauaaacuuuaucaaucacuaaaagaaaacaacauguucccaacauccaaccucuucgaucuaucugcuguugaauuauauggcuuaagagccaaagcagucagcgaacaaguaucguuacaagagcuuggaagaauccuaauauuauuaaaucaaagaaggggauuuuugagcaaccggaaauccgucagcgaagaaaauuccacugaguacaaagaacgcauagcaggacucgaaaaagccuuaggaaacaagacaauaggacaaaaacuauauucagaacuccaagaaaacaacaaugucuuugagguauugcuacgagagagaaccuaucaacguagcucuuauacagaagaauuugaucgaauaugggaugaacagaagaaauauuacuuaauauuaacgggaucaagcaaugaagacgauaauaaaggaacauuauacgaucuaauaagaaauagaaucauauauuaucaaagaccacucaaaucacaaaaaggacuaauaagcgaauguuuauuugaaaagcaccacaaagccguagcuaaaaguucaccauauuuugaacuuuucagaaucuggcagaaaauaaacgaucuaucauggaaaacaccaaauggugaacuauuuaaacccacagaugaacaaaagcaaaaacucaaaaacgcacuuuggaacggagauaacuuaaauccuaaacauaaacucacaguaagcaaaauaaaagaaauccuuggcuauacuuccagagagaaaauauaccuaaacuuuacagaacuggacggcucucgaacuuacucuauauuaaggaacgcccuaaucgaagcaggcauugaaaaaccagaacaauacuuauucuuuaacauggaaacgaaugacgaaaaaggaggauuauuugaacuauggcacauaacauacucauuacccauagaaaaagaagucauuaacgcucuuaaaaacagguucgguuucgauaagaaacaagcagaaauaauagcacgaagaguugguuacaguagcgauuauggaaguuuaaguacaagagcaauacgaaaauuacucguacaucuggaaaaagguuuagguuacacagaugccugcgacaacauagguuacgaccacucaggcuauaaaacuaaaauagacuuacaaccaaaguuaaaacaauuaaaaagaaaugaauuacgcaacccagucgucgaacaaauacuaaaccaagucguaaaugcugugaauuuaauuauagaaaaauacgggaagaucgacgagaucagaguagaacuagccagagaauuaagaaauaaugcaaaaacaagaaagaauaucagcuuacuaaauucuaaaaacaagaaaaauaacgacaucauacgaaagaaauuacaagaagaauacggauuuaaauucguaaauggaagagacguuacaagauacaucuuaugggaagaaaauucaaaagaaugccuauauugcaauaaaacaauuaacggaucagacaugcucacagguaacgcagacauagaacauauauuaccgaaaucacguucauucaacaacgcuaugaauaacuacauaauaacacacagaaaaugcaacucagacaaaggacagaaaacagcauaugacuucaugagcucaaaaggugaaguuauucugcaacaauauauagaaaaaguaaaugauuuauacaaagauggcaaaggaagcauauccaaaacaaaauucgaaaauuuacuuuguaaaggagaggacauaccaucagauuucguggaaagaaugaagaaagauucccaauacauagcaaaagaagccguaaaaaugcucaaaacaguguguccuaauguuuauacaacaaccggucaagugacugacuuucuacgcgaagaauggaaacuuaaaaacuuauuacaagaauuaacauuugagaaauacaaagccauaggccaagugaaagagaaaauuauuaaaacaaacaacgggcaaacaaaaaccuucaaaguaauagcggacuggagcaaacgagacgaucaccgacaccacgccauugacgcccuaauaugcgcccugacagaccagaaaauaauuuucaaauuaaauaaccuaaacaaaaucuaccaauacgaacgaaacgcauugagccaaaaagaaauugaagaaauugaagaguuccuugaaggaaaauuuuccauaaaagaguucucugcucaacaagggaacauuaucgaaugcagcauaccaaacauucguaaagacgcacaaaaacaccuagaaaacauauuaauaucauucaagaaagaaaacucaaaagugcuuacuaugaaccggaaucaaccgaaaaauugcaaagaacaaauuacguggguaccaagagcccgacuacacgaagauacaauaauggggcguguuaaaagaauaccagagaagaaaaugaaauuaaaugacaaaguaucauucgaacagauaaaaaugauaguaaaucccgaaauaaaagaaauauuauuauacagacuagcuaaauuuggugauaacccaaaaguugcuuuugcuacgaaagccuuaaagaaagaaccuauuuucuaccgcgaaaaugaacuaaaagaagugaguauauaugaauggguaaacacaaaacgggucgcacuaaaugaaaauauaacagauagucaaauagagaaaauaauagaucaagcuaguaaacgagcugugaaagaacgccuuaacggaggaaaaaucaaagaaguauucaagaaccuaacggaaaacccaauccaacucaaaaacggaaugauacuuaaaaauguaacagugacagacgaaucaaaaguggaaaagauuagaaauggcuuugcuauaaccgguaaaaaucaccaugcauuaguauacaaagacgaaaacggaaaauauaacgauaaagucguuucauuuugggaagcaguagcgauaggauuacgaaacguaaccgaauacgguaauccguauccaauaauuaacagaaaucacaaugaugaauuaggagaguucuacuucucaaugcaaaucaaugaccuuuuugucuuugaccuaaaacauagugaaaauccacaggaagaaaaugaaauaaacuucuucgacguagaaaaucgcaaacaaauaagcgacaaacuuuuuagaguccagaaaaugucaaagaaaaguaacggacaguucguaucagacuucagacaucaucucgaaacaagcguaauaagaaacgacaugauacugaaaaacauaacuuggaucucaauaaguaaaaacucagauuuagaacgacuaacaaaaauacgagugaaucacuuaggagaaauaauaaaaguaggagaauga

SEQ ID NO: 8675 - RNA, 3585 nt, Artificial Sequence
  Cas9 variant
auggacuucacagcagauguaucugaauugaacgagagcuuuaugcaaauucacacagaaucuaaauuugaaauagauacagcaaaaguucaagaaauaagucaacugcuacuggacaacaaaauaacaagaauggaucgacaaaaacaaguagcaaacguuuuagcgaaaaacaguggcgauaaagaagccgauaaaauaaacaagaaaauagcgacugaauuuugcaaagcaguacuuggaaacaaagcaaaguucaacguaauucuaggagaagacgccguagacagcgauuggagcuuuaaaauggacgaugaaaacucagacgaggaaauugaaauucuaaugggucaaacaaacggacaacaacaaaacguucuccgaauaauucaucaaugguauucacaaauaacauuaaacgggauaguaccugacggacaaaugauaagcgagucaaugauagauaaauacgaauuacaucgaaaacaucuacuacuacuaaaacaacaaauuaaaguaacuaaagacaaaaagaaagcacaacagcuacacgaggcuuaugaacaauacgugcacggcacuggagccaaaaagaaacuuacacaagacgacuucuacucuaaagugacgaaaaaucuagaaacaagugacuuuucugacgaaauaaagaaacaaauuaacgcagaaacauucaugcccaaacaacguaccucggcaaacggugucauaccucaucaauuacaccaacaagaacucgacaaaauaauugaaaaacaagccaaauauuaccccuucuuagccgaacucaacccagacacaaaaaggcaaaacaucgcaaaauauaaauuagacgaacuuauagcuuuuaaaaucccauacuaugucggaccauugauaacaacagaagaccagaagaaaacauccgguaaaucguuugcguggauggucagaaaagaaccuggaaaaauuacaccuuggaauuuugaccaaaaaguagacaaaauggcuagcgcugaucaauuuauacgacgaaugacaaccaaagauucuuaccuaaucaccgaagauguacuaccagcagagagcuuaauauaccaaaaauauaaaguacucaaugaacucaauaugauacguguaaauggaaacaaauuaacaaaacacgauaaacaaaacaucuaccaacaaguauucgaaaaauauaaaaccguaaacguuaagaaaguccaaaacuacuucuuaacggauggaagauaucaacacgcaccaaaaauaacaggauuaucagacgacaacaaauucaacuccaaccugucuacauacauagacuuuaagaaaaucuuucaagauguaguagaugacccacaaaaacaaaaagacuuugaacgaauaauugaauggucaacuauuuucgaagacagacacauauaugaagucaaacuaaaagaaaucucuugguuaaacgacgaacaacgaaaagaacuuaaaaagaaacgacaucaaggaugggguagacuguccgccaaacuccuaacaggaaucuucgaugaaaacggauauucaauaauggaccaacuauggaacacucagaaaaauuuuaugcaaauacaagccgaagaaggauucaauaagaaaauacaagcagaaaacagcaaacaucuagagaaaaaugacuucgaagauauacuagaagaugcuuauacaucuccgcaaaauaagaaagcaauaagacaaguaauaaaagugguggaagauauacagaaaacaaugggcacagccccucagaaaauuagcaucgaguucacaagguccgccgacaaaaauccuagaaggucgauagaaagacaacgacaauuagaagaaauuuacuauaacgacgcaaaagaaauaguuucugaaggaaugcaagauaauuuacaaaacuucaccgacaauaaacaaacccuaacagacaaauacuucuuauauuuuacucaauuaggaauagacauguacacagggaagaaaauaaacauagaugaaauagggaacuaccaaauagaccacauucuuccacaagcguucauaaaagaugacuccaucgauaacaaagucuuggucucaagcgccauuaacaauggcaaaucagauaacguaccgcuaucaauguacgcuucagucaggauaaaaagugaagugcaaaacaaauggaaaaauuuugcagaacauggacucauaagccaacgaaaacuaaacaaucugaugacagacccugaaagcaucgauaaauauaaagccagaggauucaucaaacgacagcuaguugaaacaucacaagugauuagacuuguagcagaaauauugaacgaaaaauaucaaggcgagacagaaaucaucgagguacgcgcaaaaaugaacucacaacuacguaaagacuucgacuuauugaaaaacagaaauguaaaugauuaccaucacgccuuagaugcauaccuaacaacauuuauaggcaauuacuuauaccgaagauacccaaaacuuagaucauacuucacauacggacacuucaagaaaauugacgaugcaaaacuuaaacaauucaauuuccuacaugauauagaaaacgacaaagacccaaaauaugucaacgacaacggagaguuauuaugggacagagaaaaagacauugcauauuuuaagaaaauauacaacuucaaauacauguuaguaucacaugaaguaucaacacgacaaggcgccauguucaaacaaacaauauucccagcagcagcggaugcaaaaaguaaacuuauuccaauuaaaaacgauaaaccaacagccaucuauggcgguuauacaaacaacaaugacgcauaccuagcaauuauaaaacuagcaaaaacaggacaauuuaaaguagugggaguaccacaacgagccaucgucaaacuuaaacaggcuuaugauaaagaaacaggagacuauucaaauguauuauauaaaguucuagaaccuaaauucguuaaaaagaaaguaaaucgaaaaacaggagaaauuacauaccaaguugaaaaauuuaaaauaguuguaccaaaagucccauacagacaacuuguuauugacggagaccaaaaauuuaugcuaggaaguucaacauauaaauacaaugcaaaacaacucguacuaucagaaaacgcaaucaaaauucuugauaagaaaucauucgaucagagcgguuauaaaucaagugauuuagauacaguauacgaugaaaucuuaagccaaguagaucgauauuuuucaauguaugauaaaaacaaauucagagaaggccuacauaauggaaagaaauauuuccaaagauuacccaugaucgacaaugucgaaaaagggaaaauaaaagaaaacggcaaauucaaacuccuuaacgaaauacuuaucggauuacaugcuaauccuagcuucgggaaucucaaaucacuaggaauaagcaccccauuugguaugaugcaauucgcgagugguauuucgcuaagcgaaaacgcgauauuauguuaccaguccccuaccggaauauuugaacgcagggucgcacuaaaagaucuauga

SEQ ID NO: 8676 - RNA, 3588 nt, Artificial Sequence
  Cas9 variant
augcagaaaaauauaaacacaaaacaaaaucauauauacauaaaacaagcacaaaaaauaaaagaaaaacuaggugacaaaccguaucggauaggacuggaccuaggggucggaucuauuggauucgcgauagucucgauggaagaaaaugacggaaacguccucuuacccaaagaaauaauaaugguaggaagcagaauauucaaagcauccgcuggugccgccgacaggaaacuuucuaggggacagagaaacaaccacaggcacacuagagaaagaaugagauaucuuuggaaagucuuagcagaacagaaacuggcacuccccguaccagcagaccuggaccgaaaagaaaacucguccgaaggugaaacauccgccaaaagauuccucggagacguauuacaaaaagauauuuacgagcuacgcguaaaaucauuagacgagagacugagccuucaagaacuaggguacguacuauaccacauugcaggccaucgagguaguucugccaucagaacauuugaaaacgauucugaagaagcacaaaaggagaacacagaaaauaagaaaauagccggaaacauuaaaagauuaauggcuaaaaagaauuaccgaacuuauggagaauaccuauauaaagaauuuuucgaaaauaaagaaaaacauaaaagggaaaaaauuagcaaugcagccaacaaucauaaauucagcccaacaagagaucuaguaauaaaagaagccgaagcaauacucaaaaaacaagcaggaaaagacggauuccacaaagaacucacagaggaauacauagagaaacuuacgaaagcaauuggcuacgagucggaaaaguuaauaccugaaucaggguuuugccccuacuuaaaagaugaaaagagacugcccgcuucccacaaauuaaaugaagaaaggagacuaugggaaacccugaauaacgcaagauacagcgauccaauuguagacauugucacaggcgaaauaacaggauauuacgaaaaacaauucacaaaagaacaaaaacaaaaacucuucgacuaccuccuuacaggcucagaacuuacuccagcacaaacuaaaaaacuguuaggacuaaaaaacacaaacuucgaagacauaauccuucaaggucgagauaaaaaagcccaaaaaauaaaaggauauaaacuaaucaaauuagaaagcaugccuuucugggccagauuaucugaagcucaacaggauagcuuuuuguacgacuggaacagcuguccugaugagaaacuauuaacagaaaaauuaucaaacgaauaucacuuaaccgaagaagaaauugauaacgccuuuaacgaaaucgucuuaucauccagcuacgcuccucuagggaaaagcgcaaugcucauaauauuggaaaagauaaagaaugaccuuucauacacugaagcaguagaagaagcucuaaaagaaggaaaacuaacaaaggaaaaacaagcaauaaaggacaggcuuccauacuauggagcaguacuacaagaaucgacccaaaaaauaaucgcuaaaggguuuuccccacaguucaaagacaaagguuauaaaacaccccauacgaauaaauaugaauuagaauacggaagaauagcaaauccuguaguacaccaaacacuaaacgaacuacgaaagcuaguaaacgaaauaaucgacauauuaggaaaaaaaccaugugaaauuggauuagaaacggcacgagaacuaaaaaaaucagccgaagauagaucaaaauuaucgagagaacagaaugacaacgaaucaaaccguaacagaauauacgaaaucuacauacgcccacagcaacagguaaucaucacaagacgcgagaacccaagaaacuacauccucaaauuugaacuacuagaagagcaaaaaucacaaugcccuuucugcggaggacaaaucaguccaaaugauauaauaaacaaucaggcugacauagaacauuuauuuccaauagcagaaucagaagauaacggaagaaacaacuuaguaauaucccacagugcauguaaugcagacaaagcuaaacguucaccaugggcugcuuucgcgucagccgcaaaagacucaaaauacgauuauaaucguauacugucaaacguuaaagaaaacauaccacacaaagccuggcgcuuuaaucaaggugcauucgaaaaauuuauagaaaacaaaccaauggcagcaagauucaaaacugauaacucuuauauaucgaaaguagcacacaaauauuuagccugccuguuugaaaaaccaaauauaauauguguaaaaggaucacucacugcacaacuucgcauggcauggggauugcaaggauuaaugauuccguucgcaaaacaauuaauaacggagaaagaauccgaaucauucaauaaagacgucaauucuaacaaaaaaauucgccuugauaacagacaccacgcuuuggacgccauaguaauagccuacgcgaguagaggauacgggaauuuauuaaauaaaauggcaggaaaagauuauaaaauaaauuauuccgaaagaaauuggcuuucaaaaauacuuuuaccccccaacaauauaguaugggaaaacauagacgcagacuuagaaaguuucgaauccuccguuaaaaccgcauuaaaaaaugcauucauaagcguaaaacaugaccauucugauaauggagaacuaguaaagggaacaauguacaaaauauucuacucggaaagaggauauacacucacaacuuauaaaaaauuaagcgcucuaaaacuaaccgacccucaaaaaaaaaaaacaccaaaagacuuccuagaaacagcguuauuaaaguuuaagggaagagagucagaaaugaaaaacgaaaaaaucaaaucagcuaucgaaaacaauaaaagacucuucgauguuauacaagacaacuuagaaaaagcgaaaaaacuccuggaggaagaaaaugagaagucaaaagcagaaggaaaaaaagaaaaaaacauaaaugacgccucgauuuaucaaaaagcaaucaguuuauccggcgacaaauauguccaauuaucaaaaaaagaacccggaaaauuuuuugcaauaucgaaacccaccccuacaacuaccggauauggauacgauacgggagauucacuaugcguagacuuauauuacgacaauaaaggcaaauuauguggugaaauaauuagaaaaauugacgcacaacaaaaaaauccauuaaaauauaaagaacaaggauucaccuuauucgaaagaauuuauggaggcgauauucuagaaguugacuucgacauacauucagacaaaaacucuuucaggaauaacacgggaagugcgccugaaaacagaguauuuauaaaagucggaaccuuuacagaaaucacaaauaauaacauacaaaucugguucggaaacauaauaaaaucuacagguggccaagacgauagcuuuacuauaaacucgaugcaacaauacaacccacgaaaacuaauauuaucgucguguggauucaucaaguaccggucaccaauuuuaaaaaacaaagagggauga

SEQ ID NO: 8677 - RNA, 3594 nt, Artificial Sequence
  Cas9 variant
augucaaaacauguacuaggauuagaucuaggaguaggcucaauaggauggugucuaaucgccuuagacgaacaggaccaaccugcagagauacuaggaaugggcucaagaauagucccucuaacaacagacgacuuaaacgaauuuucucagggaaaggcaauuagcaaaaaucagaaaaggacuacucaaagaacaauaagaaagggauuggaucguuaucaacuacgcagaaagguacuuagugaaaaacuagcaggacauggaaugcuccccgauaaagauuuaaugcaauuacccgugcuugauuuaugggaacuacgagcgcgcgcagcaucaccgggagaaaaacuaucauuaccagaaaucgggagaguuuuauaccacauaaaucaaaagagaggauacaaacaugcgaaaagcgaugaagcagaagaaguuacuaaaagaggcaaggaacaaggguauguugcaacugucaaaggacguuacgcagagcuucaacgugaaggagccaccgucggacagcauuucgcgugcaaacugaaagaacauagacaagaaucaccaagcggaggguucuucuauaacuaucgaauaaaagaccaggucuauccgcgugaagcauacauagaagaauuugauaggauaauggaaguacaaucuguauucuacccagaaguauuaacaccagcguucauucaagaauuaagagauaagguaauauucuuccaaaggccauugaaaucauguaaaggucuaguaucauuuugugaguucgaaaaacaagaaagaguaguucaacucaaaagagucaacagggaaggaaaagaggaacuccaagaacguaaaaucacuaucgguccaaaaguagcuccaaaauccucgcccauagcccaacuguguaaauuaugggaaaguauucauaacaucaggauauauuauccagacggaaaagaacgccccauaacauuagaagagaaaagaaaauuauuagcauacuuacaaacacaugauaaguuaacauuuacggcacuaaagaaagaauuaaaaauaagcgacaaagagagauuguggugugauaaacuguuaaaaggcggaauaaaaggcgauaccacuagagucuugcuacgaaaagcauuagcaggauacaaaagauacgaaccccuccuaagaauggaccuagaacuacgagauuuccaagaaauaguaagcggaaaaagacuaauaagaccaaucguagaugagucauacuugucccaaccccuuuaccgucucuggcacauucuauauaguaucgaggaaagagaagccaugcgacgcgcauuaauugaucaacuuggauuuuuagaagaagaucuagacggaggucuacuagacaaacuauaccagaucgauuucgcuaaacaaggauauucaaauaaaucugccaaauucauaugcaaauuacuaccucaccuacaaggaggucauggguacucgcaagcaugugaacuagcagguaaaagacacuccgcaggaagccuuacgaaggaagaauuagaagaaagaccacuucuagaacacauuccacuauuacaauguaaugaauuaagacaaccaauugucgagaaaauacugaaucaaaugauuaauuugguaaaugcauuaagacaaaaauauggaaguauagaugaagugagaguagaauuagcgcgagaacuaaagaugagcagggaagaaagagaagaaacaaguaaaagaauuagaucaagagaaaaagaaaacaaagaaauugcggagagaauaaaagaguacgaacuauacccaacuaaauccagaauacaaaaauauagguuauggcaagaagccggagaacaaugucuuuauugcggaagaaguauagacguaguccaauuccucagaggcgacggcgucgaaaucgaacacauaauaccaaaaucgauacuauaugaugacaguagcgcaaauaaaacaugcgcauguucucgaugcaacaaagauaaagguaaucgaacagccuaugaauacauauuagccgaaggaagagaagcagaauaccuagauagauuagaaacuuuauuccacgauggaaaguuaaguuauucuaagagaagacgccugcaguggaagaaagcugauauucccguugauuucauagaacgacaacuacgauugacacaauauauagcacgacaagcacaagaaauauuaagacaaggaaucaggcgugucggagcaagcgaaggaagcguaacugcaaaauuaagacaucucuggggguacgacgauauacuaagagaacuaaacuuugaaagauaucagagcaugggggaaacagaaauuguaucccaagaagaaaaagauggaagcauuaccaaaucggaaagaauaaaagacuggucaaaaagaaaagaucauagacaccacgccauugacgcacuuguuguggcaugcacaagacaaggauacauacaaagguuaaauagucuuaacucagaggaagacagucugcaaaugcaagaagauucaaaacagaugcgugagaaaaugggaggucagaaaagaccuacagcagauaaacacaguauauuagaaaauuggcuuauuuuacaaccccacuucucccaccaagaagugaagucaaaaguagcggaaauacucguuucauuucgaccaggaaaaagaacaguuucgacaggaagaaacacuuaccuaagaagugguaagaaaguuacacaaaguggaguacuaaucccaagaggaccauugucagaagagagccuguaugggcaaauacucagaaauggugaacccaccuauguaaagaaaguggcacuugagagccuaucagaagcacagaucgaacaaauaguagacccaaaacuaagacgagaaaugguugcuagaacacaaccuagcgaaggagcuaaauuaaauccuaaacuacuacuugccacaccauucuauucagacgcugcagguacacaacgcguccgcucagugagaguagcgaucgaaaaugguaaaaauagcauaguaccacugagauacaaugaaucaggaaaagcgauaacauucguaaacccaggaaacaaccaucauguaggaaucuauaggaccucugaaggcaagcuaguugaaagcugugugaccuuuuggcaagcuguggauaggguaagauacgguauuccgacuaucauaagaaaaccaagagaaguauuagaucagcuacugcuacgggacgacauaccagaagcauuauuagcccaucucccagcauccgacugggaguucguagaauaucuacaagcaaacgaaauguuucuaauuggacuaacagacgaagaaauacaaacagcccuggccgaaagcgauuuacuuacacugucaaaccacuuauacagaguacagaaaaugucuucugaauauuacguauucagauaccauuuagaaacagaaguugcugauaauaaaaauaauacuggaauaaucccuaaauuuuauaggcuaagaggaccaaaugauacauaucugaaagcuaacccacgcaaaguaaaaguaaaucuguuaggagaaaucaguuuaccauga

SEQ ID NO: 8678 - RNA, 3615 nt, Artificial Sequence
  Cas9 variant
auggaaagaauacuaggcauugacaccgguacaaacucauuaggcugggcaauaguagauaaagacgaaaaucaauaccacuuaguagcaaaaggaaccaauauauuuucagaaggcguaaaaauagaaaaaggaauagaaagcaguaaagcagcagaacgaacagaacaucgaucagugcguaaacacuauuggaggagaaaaauaagaaaaaucagauuguuaacuauacuuucagacaaugaccuauguccaagacuaaaacaugaacaguuacgucaauggagguuaaagaaaguauacccaacagacgacacauuuauggaauggcaaaggacagaggauaaagcacaaguaaauccuuacaaauuccgauacauaugucucacacaaaaauuagacuuaucagacauuacucaacgauucauauuagguagggcccuuuaucaccuaaaccagcgaaggggauuccuaucaaacagaaaagaagccacuaaagagagugaaggaacagugaaagaaggaauaucaaguuuaucgaaagacaugaaagacucaggaugugaauaccuuggagaauacuucuaucaacuuuaucaacaaggaaagaaaaucagaaaucauuacacugcaagaaaagaacacuacuuaaaagaauuuaaagcaaucuguucgaaacaagaacuagacgaugcacuaauagaaaaacuagaaaaagccauauuugaccaaagacccuuaaaaucacaaaaaggucaagucgggacuuguacauucgaaaaaggaaaaagcagauguccuucaagccauccgcuauaugaagacuuuagaauguacucauuuauaaauaacauaaaaguacaagucgacacuuuauacgacaaaggagagagaagccuaacagaugaagagaaacaauuaauuauuccccuuuucaaaagaaaaucgaaaaggacauucccauucgaagacauagccaagaaaauagcaggcaaaaacaauuauugcuacauaaaaaguaaugaagaaaaggcuuauaaauuuaauuaucaaauggacacucaaguuuccggaagcccuguuaaugcacaauuggaggaaaucuucggagaagacugguuaucaagcguuugcgaaguauauacucuagcaaauaacaaaagucgauuucaaauaaugaaugauguauggcacguacuauucuucuaugacgaugaagacaaauugaaagaauuugcuaaagaucgacuacaacuggacgacgaacuagcagaaaaauuuaguaaaauaaguaucccuaaugauuaugcagcgcugagccucaaagcaauaaggaaaauaaugccuuaucuacgagacuacggucuaauauacuccgaagcagucuuuuuagcaaaccugguugauguacuaccacaacauguguggggaaucaaagaaaugagagaggcagcaauagaaaaugucauagacguaaugcacucauacgacaaaaauaacauagacggaauuacacuggagggaugcguaaaaacauucuuaaaagaacgauaccaaguaucagaugacaacuuaaagaaauuauaucauccaagcaugcuagauccauauccaagacaacgaccaaaugacgagggaguauuucaauuaggaucaccaagaauuucauccguuaaaaacccaauggcuaugcacucuuuauuuagacuccgaaaagucguuaaucuaauguuaaagaaaggauauauaaccccagauacuaaaguacacauagaguucucaagagaucucaacgaugcuaauaaaagaugggcaauccaaacauggcaaagagaaaaugaaaaagaacgagaaagauguaggaaagaaauagaaaaauacaucgcgagcccuagcgacacugauauacucaaauaucaacuaugggaagaacaaaaucacaaaugucuuuacacgggagacgaaauaagaaucacagacuuucucggagauaauccaaaauaugacauagaacacacaauaccuagaucugcugguggagauucaacgaaaaugaaccucacacuauguucaaguagauucaacagagacgagaaaaagacaaaauuacccgcagagcuaguaaaccacgaugaaauccuagaaagaauaucaaauuggaaagaaaaauaugaagacauagacaaacaaauacgaaaaauauccaccaaaggagcaacaaguaaagaagacaaagacuccaaaauccgaagacgccauuaucuuauacuccaacgagacuacuggagagguaaauaucaacgauuuacaaugacagaaguuccagaaggauuuucacgacgccaagguacggacauaagcgugauaucacguuacgccagaauguaccuaaaaucgguauuuaaacaagucuauauaguaaaaggaauugccacuuccgacuuuagaaaaauguggggcauccaagacgaauaugcaaagaaagaaagagucaaucauguacaucacuguaucgaugccaucacuauugcaugcauaggaaaagcagaauacgauaaacuugcagauuauaggcaccaauacgacgacuaccucuuccaagguaaaacaaaaccaacauuugauaaaccauggccuagcuuuguaauagauaucaaacacauucaagacgaacuacuaauagcucacuaugcaaaagacaaucuagaaaaauucacuaagaaaaaccuaagagguaaagacggacggauaauaagagacaaauucggcaauaaacuccaaaugaagggagauacuucaagaaacucauuacauaaugauaaauuuuauggagcuaucaaucaugagggagaaauaaaauacguauacagaacaaacauugaagcucucgaugcuaaaagcauuggcaacauaguagacccaacaguaagaucaauaauagaaagcgcaaucgcaauacaugguagccuuaaagcugcaauaaauaaaggaauauggaugaacgaagaaaaacauauaccaaucaagaaaguucgaguauuuagaaacgaugucaagaaaccuauagaauuaaaagaccaacgagacuuaucagauaaagacuauaaacaacacuauuauguaacgaaugaugggaauuauaugaugcuaauauucaguaaacuaaacaacaaaggaagagaaaucagacaacauguaguuaucaauucacuugaagcaaccgaaguaaucaaaucccauaaaaggucccaaguaggaaaagucgucugggaauccuacuacucaaaagagggguucgauuuaauauauaaacuaaaaagcggaacgaugauauuacucuacgagaauaacagagaugaagucugggaucuagauauccgcaauuuacaaaaacgauuauauauaauuacuaaaaugaaauaugacggccgaauuuacaugaugcaccaucaggaagcaagagaaaagaaagaucuagaagaaaaaucuggaucuuucaaaauuaaugaagacuacagacccuuaaucguaaacucuuauaaucaauucaaugcauuagugcaagaccuagauuucgaaaucaaugaccucggagagauacgucgacuaauauga

SEQ ID NO: 8679 - RNA, 3630 nt, Artificial Sequence
  Cas9 variant
augaagaaagacuauauauugggguuggauauaggaauaaguucaguagguugggggcuucuagaacuagaugauaacaacaauccauacaaaauaauagaugucggcagccggauauuuacaccgggcgaaguugaaaagacaggagauaguagggcgaaagaacguagagaaaaacgcggugcgagaagaauagcaagaagacgcgaauuucgacuagacagagucaaaaauuuacuauaugaaaauggauacuuaaaagguaauauaaacucuaacauaguaucugagaaaaacgaagaacuaucaauaauauucaauaauaugauaaacaauuauuacaacgguaaaaacacaaacccauauauacucaaaguagaagcacuagacagaaaacuaacugaugaggaacuaucuaucauauuaguccacuaugccaagaaaagaggcuacaaaagcaacagagaagaagcaagcgacaaagaaucagggaaaguauuaacugcaauuaaagaaaacgagaaaauaaugaaagacaauaacuacaggacuauaagcgaaauguacauaaaagaugauaaauuuaaaaauaaaauuaaaaacuccccaaacgacuauaaaauuagcguaacaaacgaaauguacuuagaagaaauaaauaaaguccuagauucacaaauaaaauucggacucauuacagacgacuuuaaaaaccaauaccuagaaauauauaauucacggcgaucuuacgccaaaggcccaggcggaaauuccccauacggcggagaucuaauagaacgaaugacugguaaauguaacuucgauggcaauccaagagccccgaaacgagcguucagcagcgaaauuuauguagcgcuaacaaaacuugucaaucuaaaauacaaaguaaacgacggagaauauauaaaauuaagcgaaaaagaaaucaaaaacauaauagaaaaagcaaaagaaaagaaaucaauaucuuauaaagacuuaacaaaaaugauagguaauaacauugauuucaaagaccuuacacucuccaagaaagaauauauaaaauuaauagaagaacucaaaaagaaacuaaauaucaagaaagacacaaaaauaaacaucaaugaacuauccagugaagauaaagaacuauauaacaaauuauguaaugauaaauugcuaucuaaaacacuaauagaauuaaaaggauaucacaucuuaaaagauuccguaauaaaagcguauaguaaagacaucugggaugaagucaaagauaauauguacuugcuagaugacuuggcacuauacuguacuaacuacaaaguaaaugaagauaucuuaaauaaaaucaaagaaagcgaaaacauagacaacauauuuaacgacauacacuucguugaacuucugccuaauuucaaagaccaucuaaugcuuuccacagaacuaauaagaaaacuaauaccuauaauguauggagguaauaccuacgacaaagcaaugaauauauuagguuauaaccacucagauauuaacggagauaaagagaagaaagacuuauugguaccuauaugcguagacgacaacauaacaaaucaacgaguaauaagaucauuaacacaaacacgcaaagucauaaacucaauaauuaagaaauacgguaugcccaaaaucauaaauauagaaacagccagagaacuugccaaaagcaggcaagaaagaaacgaaaucgccaaaaauaacguagaaaagcaagcagaaaaugagaaaaucaaaaaucaauuaguggaauuaggcuuauuugucagcacagacaaaauaucaucaacagaccuacuaaaauauaaacuauggaaagaacaaaaugaauuuugcggcuacucaaugaagaaaauaucaauagaagacuuauuugguaauaacauaguccaaauugaccauauacuaccauauucaagaaccuacaaugacaacuacuuaaacaaaaccuuaguauauacaaaggaaaaccaggaaaaaggaaacagaacucccuacgaaugguucgguaaaacagacaaaugggaugaauaugaaacauauauaaacaaucuaacgauuagucagaagaagaaagauaacuaccuucuaaagaaacuagacuucgacacagaaagagaaaugagaagucaaaaucuaaacgauaccaaauacauaagcaaagaauugaguucacuaaucaaagcauacuuaaauguggaaaaaguuaacauguauccuggagcaauuacagccaaauuaagagcuagauggggauuuaauagacuaacacacuccuaucuuucuaaaaacuauauacuacccaaaaacauaaaagaagacauaaacaaagacagagauaaucaucuacaccaugccauggacgcgcuaguaauagcuuccauuacaccaagccuacaacagaaaauuacgcuguacgaaaaauucagcagauacauagaugggcugacagaauuacaaaucaaaaacauaucauauauaaaaauagaggauucagaggggcaauacuauaacgacgacacagaugaaguagaaaccauagauaucagagaguacauaaaacaacagcuugccgaaaauaauauauacuauaacagacauaacauaagcaaacucgaguucccacuaccauacgaaaacuuugacaaagaagcaaaacugagagucuacgaacaagaucuagauacgcucaaauggaaucuaaaauccuacaauacauacacccaaaaagauaucgacaauguacauacacucaucccaucaauagcaaaaaccaaagucucaggcaagaugcacgaagagaccuacuauggaauaaaagaaauagggaaagacgaagacaagaaaauauauaaaacccucagaacaccaaucgaaaaaguaaaacgaaaagauuuagauaacauaccugauagacuaggaggcucaaaggauguguaugaaagucuaguagaaugguuuggcgacuaugaagugggagaagaaguacuaaaggccaauggaaacaaauacccagucagcaaaucagacaaggaacacaaagaaauuaagaaauuaaaauuauauagcgaguacaaaaacacaggacauaugauaaacaaaucuaacguagaaaaaggaggaauauaccgcauagauguauuuaaauccaaagacaaagaagaugacaaauuauauuucgcagcauacgauauacucgaaauuaaaaagauaaacaccuuaaaggagaaaaacaggguagacgauaauuuuaauauaaaacucgacuacggccaaggcaaaaacuccaaaaucaugaguuacacagacauaauaaacaacuaugaccuauacauaucucuaaauaaaaacgaccuaauaaaaauaaccacgaacgauggaaaagaaucagucgcuuacguaguugggugcagcagcggaaugcuagaagucaaaaguaaacuaggagacggauaugacauaaucaaaacagaucuaaacgaaaauaacauauucuccaaacaaagagcacaauaucagauuacaguaaguacaauaaaagaaaucaagaaauuaucaauuucaguacuaggugaaauuagcggacuauga

SEQ ID NO: 8680 - RNA, 3633 nt, Artificial Sequence
  Cas9 variant
augagaaccauccuuggacuagaccucgguacuaauagcauaggaugggcaguaauaaauucggugaucaaagaacaaacagaaagaauauggauagaaauggcuggcucgagaauaauaccuauggaugcagcgauacugggagauuuugacaaagguaacagcauuucccaaacggcagaacgaacaagauuucgaggcgucagacgacugagggaaagacaacuuuuaagaagagaacgucuucauaaaguacuaaaaauccucggauuccugccagagcacuaucuaaaaggaauugauuucgagaagcauacaggaaaauuucuauccgguagugaaccuaaacuuccauggguaaaagacagauggggaaaauauuccuuuuuauuccaaacggcguuuaaugaaaugcuagcagacuucgcaaaacaccaaccgucauuagucuucgauggcaagaaaauaccuuaugauuggaccguguacuaccuaaggaagaaagcauuaaccgaaaugauaucuaaagaagaacuagccuggauacugcuaaauuuuaaucagaaaaggggauacuaucaacuuaggggagaagaggaggaagauaaugccggaaaaucuguagaguucuaugccuuaaaaguucuaucaguagaagcaacagaugaaaagaaaggaagagacauaugguacaauguucaucuugaaaauggauggguauauagaaggaguagcaauguaccucuagacugggaaggaagaguaaaagaauuuauaguuacaacugacuuaaaccccgauggcacaccaaaauuagauaaauauggagaaguuaagcgaaguuucagggcaccgaaagaagaugauuggaugcuaauaaagaaaagaacggaagcagacauaacuggaacccauaaaaccauagguagcuauauauaugacgcucuccuacaagaaccccaacaaaagauaauuggaaaauuaguaaaaacagucgaaagaaaguucuauaaagaagaacugaauuuuauacuacaaaaacaaugugcauuucaugcugaacuacaagauagagacuuauauaugcgcugcauagaagcauuauauccuggaaaugaaguacaacgaaggaauaucgcaaauagagauuucauauauuuacuuauagaugauguccucuucuaccaaagaccccuaaaaacaaagaaaucacucaucgcaaacugcccauaugaagaaaaugaauacguaaacaggaaaacaggagaaauaaaaacagcaccacuaaaaugcauagcaaaaagucacccuuuauuucaagaauuuagacuaugguacuucuuaagcaauauaagaguauaccaaaaagaaagagaagugaacggaacauuacaucucgacguagauguaacaacagaguucuuaaaaacugaagaugacuauguugcacucuuugacugguuaaauucccgaaaagaaauugaccaaaaagcauuccuacgcuacccagcuuuugggcuuaaaaaggaaauaaauaacuaccgauggaauuacgucgaagacaaauuuuaccccuguaaugaaaccagacaugcaauacucucacgacuagaaaaagcaggaauagguauagacuuucuaucagacgaaaaggaaacagcccuuuggcacauacuauacucgguaagcgauaaacaagagauagaaaaagcauuagcuacuuuugcagugaaaaauggauuaaaugagagcuuugucgaaguauuuaagaaauucccaccauucaaaagcgaauauggcgcauauagugcuaaagcaaucaagaaacuauuaccacuuaugagaugcggaaaauauugggacaugucccuaauagauggaacaacaaaagaaagaaucgaacgaauaauagcaggggaaugcgacgagucuauaggggcaaaaguaagggaaaaagcaaugaauuuaagcgacauauccugcuuuaaacgauuaccccucuggcuagccuguuacguaguauacaacaggcauucagaagacaaagaaaucaccaaaugggaaacaccagcagauauugaugcauaucuugcagcuuucaaacaacacagucuaagaaauccaauagucgaacaagucauuacggaaacguugcgaguaguuagagacauauggaaacaaguaggaaaaauagacgaaauuagaauagagcuagguagagaaaugaaaaauccagccgacaaaaggaaacgaaugacaacucaaauauuagaaaaugaaaaugcaaauuuaagaauaaaagcccuguuagcugaguucgucaauccagaguauggaguagaaaaugugagaccauauucaccaucccaacaagaaauuuuaagaauuuaugaagaugcaguacuaaaaggugaagaacaaauaccggaagauauagauguaauacucaagaaauuuaacaccaguaaacugccuacuaaaagugaguucuugagauacaaacuaugguuagaacaaaaauacagaucaccauacacgggugaauuaauaccgcuagcaaaauuauuuacagcagccuaugaaauugaacauguuauuccucaaagcagauauuuugaugauagcuuuucaaacaaagugauaugcgaaagcgcaguaaauaaauuaaaagauaaccaacugggcuaugaguuuaucaagaaucaucauggacaaaaaguagaaguaggauucggaaaaacggucgaaauauucagugucgauaguuaugaaagauucgucaaggaacaauaugcgaaaagcggcauaaaaaugaagaaacuuuuaauggaugacauccccgaacaauucauugaacgacaauuaaaugauucacguuacauauccaaaguaguaaaaggauuacuaucaaacauaguacgugagaaaaacgacucgggcgaauaugaaccugaagcgguuaguaaaaacauucuaguuugcacuggaucaguaacagauagacucaagaaagacuggggcaugaaugacgucuggaacucgauaguaagcccacgauucgaaaggcucaaugcauuaacugaaacgcaaugcuucggccacugggaaaauaaagauggaaagaaaguauuucaaacagcuguaccauuagaauaccaaaaaggauuuucaaagaaaagaauagaucaucgacaccaugcgauggaugcaauaguaauagccugugcaaccagaaaucauguaaacuaccuaaauaaugaaagugcuucuagaaaugcuaaaauauccagauacgacuuacaaaggcuguuaugcgacaaaucgcguggagaugguaacgggaacuacagguggauaauaaagaaaccauggacaacauuuacucaagaugcucgugaagcgcucagcggaauaaucguauccuuaaaacaaaaucuaagaauaauaaacaaaacaacaaauauauaccaacauuuugacgcaaaugguacaagagucuaugaaaaacagaaaauaggagauucaugggcuaucagaaaaccgaugcacaaagauaccguguucggagcaguaaaucuccgaaaagcacuuauuccccaacacuacaaucucacacuauuuauaucgagcuga

SEQ ID NO: 8681 - RNA, 3642 nt, Artificial Sequence
  Cas9 variant
auggagaaaagguuagggaucgacguaggcacuaauaguuuagguugggcaauuguugaaguagaugacgaaggaugcacacuguuagauaggggaguagauauuuuucaagaaggcguagccagggagaaaaaccaagaaaaaccugccgugcaagacagaacagacgcacgagcacuacgaagacacuacuuuagacggagacuuagaaaaauugcgcuguuaagaguuuuaguaagacacgaucuaugcccggcauuaagcgaagaacaauuaaaugcauggcaaggaaaaggaauuuauccgcuagaugacgcauucauacgauggcaaagaacagaugauaaugcagacaggaauccauauagagacagguucaggugccuuacugaagaguuagauuuagcaugcagagaggaaagauacguuuugggacgagcuuuauaucauuuaugucaacgacgagguuuucugucaaauagaaaagaugcaggaaacgaagccgaagaaggaaaagugaagcaagaaaucaaaacgcuaagcgcggauauggcagcagcggguugcgaauaucuaggggaauauuuuuacagauuauaccaaaggaaagaaaagauaaggaaacacuacaccgcaagaaaugaacauuacuuggcagaauuucgagcgauaugccgaaagcaacgacucgacgaggaauugcgacaagcgcucgaaaaagcuaucuucuaccaacguccgcucaaaagccaaaaaggauuaguugguaaauguacguuugaaaaggacaagucaagaugucccguaucgcauccgagauuugaggaauuuagaauguuacaauucauaaauaauguaaggguuacaggaccgggggaugccgaaccaagacccuugucaccagaagaaguugaaaucguaagaccuuuguuucuaaggaaaagcaaaccacauuuugacuuugaagauauagcuaaaaagaucgcaggaaaagguaacuacgcuugucgaggcgagcuuuugcaagcaccauauagauuuaacugugcagggaaaucaacaguaacuggauccccaguaucagcucuguucgcaucuguuuuuggagaugauuggcaaagagaaaucugcagccuauacacacuaggagcgggcaaaaaugaagaacaaauccuaaacgacguuuggcauguucuguuugcuuuugaagacgaggagagguuacaagcaugguuacaagaaaaacuacaauuaagcgcagacgaugccaagacucuagcugcuuuucgacuaccgcaaggauacgcuaguuuauccuuaaauguaauaaacaaaauacuacccuauuuacgaagaggauacagguaugacgaagcaguauucuuugcaaaccucggcaaaguauugccagcagaaguguaugcugauccagcgagaagaagagagguagaacaaggaauaagcgcacaaauggaugaucuaggggacggagagaaaaccaggaaagaagaaagaauacgagauuaucuaagaagauauugggguguagaagagaaaagauuggaaagacuauaccauccaucuaugauagaagccuauccuagugcaucaccaaauggccaaggguuauuacaacuaggaaguccaagaauaccagcuguacgaaauccgauggcaaugcgagcacuuuuuagauuaagaguauuauuaaacgaauuguuaagagaaggcaaaauagaucgagguacaaagauaaacaucgaacuagcacgcgaauuaaacgacgcuaauaaaaggaaagcuaucgaaagauaucaacgugaaagagaagcagaaaacagaaaauaugcagaagaaauaagacagcaguacguagaagcgacaggucauucgauagaaccuagugaagaagauauauuaaaauauagauuauggguagaacaaggacauuguagccuguauacagguaagaccauugguauaucagaauuuuugggugacggacgaagauacgauauugaacauacaguaccaagaagcagaggaggugaagacgcgcaauacaauaaaacacuaugcgaggaagaauuuaacagagacauaaaaagagacaaacuaccaagugaacuagcgaaucauacggcuauucuagcuugugucgaaagcuguggaugguucgaacgcauagaaggauuggaacacagagucuggggagcggacagacgagcaaaaucagcuacaacaaaaucagcaaaagacuuugcuauacaagacagacauuacuggagaaugcaucuagacuauuggcgacguaaaugugaagcauuuacuaugacagaaguaccagaagguuuuucaaacagacaagguguagacguuggcauaaucggaagauaugcuagacuauaccuccaaacaguuuuugauagaguauauacgguaaagggagcgacaacagcggcauucagaagaaugugggggcuacaagaagaauaugcugccaaggaacgcguaaaccaugugcaucauuguaucgaugcuauaacaauugcgugcauagguucucgggaguaugcauuaugggcgcaguacguaagacaagaugaguuauaccguuggggagaagcggacaaaccacgaugcgggaaaccuuggccaacauuuacggaagauguaagagccaccgcagaugaacuuuuaauaucacaucacacaccagacaauaugccaaaacaaucaaggaaaagauuaagagugagaggaaaaguucaaagaaaugacaggggagaagugaaauauaugcaaggcgauacagcaagaggcgcuuuacaccaacaaacuuucuacggugcgauagagagagauggagagauuagauauguagugaggaaaucgcuagaucaauugcucccagcggauguugagaaaauaguagaugaagccguaagacaaaaagucagagaagcaguugaagcauacggauucaaagaagcgacggacccaacuaagcacacuguauggaugaacgaagaaaagcagaucccaauaagaaaaguaagaauauugacuggcgucaagaauccgauauuacuaaaaccccauagagauguuaguguaaaggaauacaaaagauacuaccauguagucaacgacgguaauuacuguauggcaauuuacgaaggaagagauaggcaaggaagauuaaaacgaacauucgaaaucguaaacaaacucgaagcugcuagauauuucaaacgaagugccgauagagaaagcagaccagauuuaguaccacuauccgauguaaacggauauucucuaaaauauuuguuaaaaacuggaacaaugguacuuuucuaugaaaacagcccggaugaacuguacgaaugcucuguaggugaacucgcuaaaagauuauauaaaguaguaggaauggcacaagauggaaggguucaauuccucuuucaccaagaagcucgagaucaaaaagcaguaacggcagaaugcgggaugggaauaaguguauuugacgcacgucauccggcaccaaaacuaagaaucagagucaguaacuucaaaauguuugucgaaggauaugauuucgaauuaacaguaacuggggagguuaaauuuaaacgguga

SEQ ID NO: 8682 - RNA, 3642 nt, Artificial Sequence
  Cas9 variant
auggaaaaacgucuaggaauagaugugggaacaaacagcuuagguugggcuauuguagaagucgacgacgaaggauguaccuuauuagaccguggaguagacauauuccaagaaggaguagcaagagagaaaaaccaggaaaagccggcagugcaagauagaacagacgcaagagcgcuaagaagacauuauuucagaaggagguuacgaaaaauagcacuauuaagaguucuaguccggcaugauuuaugcccagcacuaucggaagaacaauugaacgcauggcaaggaaagggaauuuacccguuggaugacgcauuuaucagauggcagcggacagacgauaaugcagauagaaacccauacagagaccgauucagaugucuuacagaagaacuagauuuggcauguagagaagaacguuauguuuuggggcgcgcauuauaccacuuaugucaacgaagaggauuucugaguaacagaaaggaugccggaaaugaggccgaagaagguaagguaaaacaagagauuaaaaccuuaucggcagauauggcggcagcagguugcgaguaccugggagaauauuuuuaucggcuguaucaacguaaagagaaaauucgaaaacacuacacggcuagaaacgaacacuaccuagcagaauuuagggcuauaugucgaaaacaacgcuuagaugaagaacuaagacaagcacuugaaaaagcaauauucuaccaaagaccacuuaaaucacagaaaggguuggucggaaaauguacauuugaaaaagacaaaucaagauguccaguaagucacccaagauucgaagaguuuagaaugcugcaauuuauaaacaaugucagaguaaccggaccaggugacgcagaaccgaggccuuugagucccgaagaaguagaaauaguaagaccccuauuucuccgaaaaucuaaacuacacuuugacuucgaggauauagcuaagaaaauagcggguaaagggaacuaugcgugucgcggugaauuauuacaagcaccauacagauuuaacugugcaggaaaaucaaccguaaccggaucaccuguuuccgccuuauuugcaagcgucuuuggagacgacuggcaaagagaaauaugcagucuuuacacgcuuggagccgggaaaaaugaggaacaaauccuaaaugauguauggcacguguuauuugcuuuugaggaugaagaacgauuacaaacuuggcuacaagaaaaauuacaauuaucugccgacgaugcgaaaacauuagcagcuuuuagacuaccccagggauaugcaucuuuaaguuuaaauguaauaaauaaaauacuaccauaucucaggagaggauauagguaugaugaagcaguauucuuugcaaacuugggcaaagugcuuccagcggaaguauaugcugacccugcgagaagaagagaaguugaacaaggcauaagcgcacaaauggacgauuugggagauggagaacagacacggaaagaagaaagaauuagggacuacuuaagaagauacuggggaguggaagaaaaacgucuugaaagacuauaccacccaagcaugauagaagcauaucccuccgcaagcccgaacggacaaggacuauuacaacuugguucaccgagaauacccgcaguuaggaauccgauggcgaugagagcauuauuucgauugaggguuuuauuaaaugaauuauuaagggaaggaaaaauagauagaggcacaaaaauuaacauagagcuagccagagaacuaaacgaugcaaacaaacgcaaagcuauugaacguuaucaaagagagagagaagcagaaaauaggaaauacgcagaagaaauacgacaacaauacguagaagcaacaggacacaguauagagccaucagaggaagauauccuaaaauaucggcucuggguagagcaaggacacuguucguuauauacuggaaaaacaauaggaauuucagaguuccuaggagauggucgaagauacgauauagaacacaccguuccucgaaguagaggcggcgaagaugcacaauauaauaaaacucuaugugaagaagaguucaauagagauaucaagcgagacaaacuccccucagaacuagcuaaccauacagcaauauuagcaugcguagaaucuugcgguugguuugaaagaauugaaggauuagaacaccguguauggggagcggaucguagagcuaagucagcaaccaccaaauccgcaaaagacuuugcaauacaagauagacauuauuggagaaugcacuuggauuauuggagaagaaaaugugaagcauuuacaaugacagaaguacccgaaggauuuucaaaucgucaaggaguagaugugggaauuaucggaagauaugcaagauuguaucuacaaaccguuuuugaccgaguauauacaguaaaaggagcaacaacugcagcauuuagacguauguggggauuacaagaagaauaugcagcaaaggaaagagugaaccacguacaucauuguaucgacgcgauaacaauagcgugcauaggaagcagggaauaugcacugugggcucaauauguaagacaagacgaacuuuauagaagaggagaagcagauaaaccacgaugcgguaaaccauggccaacauucacagaagacguaagagcuaccgcagaugaacuguuaauaagccaccacacucccgauaacaugccaaaacaaucgagaaaaagacuccgcguaagagguaaaguccaaagaaaugacagaggggaaguuaaauauaugcaaggagauacagcuaggggagcauuacaucaacagacauuuuacggcgccauugaaagagacggagaaaucagauauguaguacgcaaaucacuagaccaauuauuaccagcagacguagaaaagauaguggacgaagcgguuaggcaaaaagucagagaggcuguagaggcguauggcuuuaaagaagcuacagaccccacgaaacauacaguauggaugaaugaagaaaaacaaauaccaauucgcaagguaagaauacuaaccggaguuaaaaacccgauauuacuaaagccgcaucgagacguuagcguaaaagaauacaaaagauauuaccauguaguaaaugacgguaacuauugcauggccauauaugaaggacgggacagacagggaaggcuuaaacgaacauucgaaauaguuaauaaauuagaggcugcucgauacuucaaaagaucugccgauagagagagcagacccgauuuaguacccuugucugacgugaauggauauagcuuaaaauauuuauuaaagacuggaacuaugguauuauuuuacgaaaacucacccgaugaacuguacgaauguaguguuggugaauuagcaaaacgacuuuauaaaguaguuggcauggcgcaagaugggagaguacaauucuuauuucaucaagaagcgagagaucaaaaagcagucacagcugaaugcggaauggggauaaguguuuuugacgcaagacauccagcgcccaaguuaagaauaagaguuucgaacuuuaaaauguucguagaagguuaugauuucgaauuaacaguaacuggugaaguaaaauuuaagagguga

SEQ ID NO: 8683 - RNA, 3651 nt, Artificial Sequence
  Cas9 variant
augaccaaaauccuaggaauagauacgggaacaaacucacuaggaugggcaauaguagauaaaaccgcagacaauuauaaucuauuagacaaaggaguaaauauuuuccaagaaggaguuaaaauagaaaaagguauagaaucaucaaaagcagcagaaagaacagaacauagagcaaccagggucagauacuauagaauaaaacuaagaaaaauaagacuacuuagaauacuaucugauaaccauuuaugucccccacuaucacaagaagaacuaucaaccuggcgcuuaaagaaagucuauccuaaaaacgaacuauuuaugcaauggcaacgaacugacgaugacacggagaaaacaccauaugcauaccgacauaaaugcauacaugaaaaacuagauuugucagauguuacggacagauacauacucggcagagcauucuaccauauuauucaaagaaggggauuucucucuaacagaaaagaacaaggaggugaggacagugguaaagucaaagaaggaaucuccacacuaacacaugagaugaacgaggcaggauaugaauaccuaggugacuauuuuuaugcccuuuauaauaaaggugagaaaauuagaaaacauuauaccgcacgaaaugaacauuuccucagcgaguucaaagcgauaugugaaaaacaagacuuagaaaaagaacucggaucagaaguuguuagaaauauagaaaaagcaauuuuugaucaaagaccacuaaaaucacaaaaagggcagguuggcaaauguguauucgagaaaaacaagacuaagugcccaucuucacauccaauguaugaagaauuuagaaugcuaacuuuuaucaauaauaucaaaauaaaaacaccaaacgacgacguacugagaccacuuaauaccggagaaagagagaaaauaaugccauuguucuuuagaaaaagcaagaaacaauuugacuuugaagauauaacaaagaaacuugccccaaagaaaauguacggauucuacaagaaagaagaagaugcggaaaugccauucuuguucaacuauccgauggauacgucaguaucagguuguccaguaacagcagccuuaaaagauguuuuuggcgaugauuggaucacagcaauaugugaaacauacacgcuaggugaaggaaaaagcagauuugacauaguaaacgacaucuggcaugcacuguauuuuuacagcgacaaagauaaacuugcggaguucgcaauaaacagauuacaauuaagugaagaugaagccaaaaucuucucagaaauaucauuaccggcagacuaugcaaguuuaucucuaaaagccauaugcaaaauccuuccauaucucagaaggggauuaaucuacucacaugcuguauuucucggcaaccuaugugaaguaaugccuaaauacgaauggucaauaaaagaaaugagggaaacuauuauugacaauauaauaauggaaauggauaaaugcgauacaaaagauaaacgaaccuucgaaguaugcauaaaggacuacuuaaaagggcaauacaauguaucagacaauucacucaagaaacuauaucacccaucaaugauagaaaccuauccaagaguacaauacacuaacgaacacgguguauaccaacucggaagcccgagaauagacagcgugagaaauccgauggccaugagaucaauguucaggcuacgcaaacugguaaaucgacuauuaguggaaggcaaaauugaccaaaauacagaaguacacauugaauuugccagagaauuaaacgaugcgaauaaaagaaaugcuauagcacuauucguaaaagaaaaccagucagccaaugacgaagcaagaaaacaaauaauaacccuauuuaagaaagaaacagggacagacaucgaaccaacagauaaagacaucuuaaaauacguuuuaugggaagaacaaaaucacaucugucuauacacaggaaaacaaauaagaauaagugauuuuauaggagcaaauccaaaauucgauauugaacacacaauucccagaaguguagggggagacucaacgaaaaugaacuuaacacuuugugacuccagauuuaauagagaagucaagaaaacaaaacuaccaguagaacuaccgaaccacgaugagaucauggaaaggaucaaagaauggaagaaaaauuacgaacuucucgacauucagauuaggaaaaacaagaaauuaucaaaaggagcaacgacgaaagaacaaaaagauacaauaauaagaaaacgacaccuauuagaacuucguagagauuacuggagaggaaaauacgaaagauuuaccauggaaagcguaccagaaggauuuagccggaggcagggaacggauauaucaguaauaucuaaauacgcacgauuauacuuaaaaaguuuauuuaauagaguauacacaguaaaaggaauagcaacaucagauuuuagaaaaauauggggcauucaagauauauauaguaagaaagaacgaauaaaucacgugcaccacugcaucgaugcgaucgugauugcauguauaggacuagaugaauauaauaaauuaggagccuauuaucacgaugaagaaaacaauaaaugguauggaaugucaaaagcgaguuucaagaaaccaugggcgacauuuguagaagauauaaagaaaauucaggaugaaauucuaguauaccacuauacgccugauaauaugccaaaacaaggacggaggcguauuaaaaucgacggcaagaaaauacuaugcaaaggugaugcagcaaggggaagccuucacaaugacacguacuacggagcaauagaaaaugauggugcuguaaaauacguaaaaagaauagaucucgcuuccuuagaagaaaaagacgucaaaaauauaguagaugauacagugagaucuauaauugaagcagcaauaaaagagaaaggcuuuaaagacgccauggccucgacaauauggaugaacgaagagaaaagagucccuauaaagaaagucagauguuucaccccaucgauaacgaaaccuuuaaacaucaggaaacaacgagaugugucaaucaaagaauauaaacaacaauaucacguagccaacgauagcaacuaucuacucgcacucuauauuggaacagacaauaaaggaaaagaaaaacgagaguucgaaaucguaaauauacuacaagcugcacaguauuauagaaccaguaacgauaaagaagucguagacagacauauaguaccaauaaaaagcgaacacgauuauccauuugcauacacauuaaaaaucggaacaaugguacuacucuacgagaaaagucccaacgaagucugggaugcaacaauaaaagaacguaauagaagacuauacaaaguuacuggcuugucuacaaugagaaugaaagguagaaacggagaauacgccuaugcaacggucaaauuaauacauaaugaagaagccagaccaucaaaagacauaaaagccaaaaauggugaauacgaacagggagaagaguuccgacccgcaauaauaauguuacacacacaacuaaacgcauuaguacaaggguaugauuuugaaauaaaugaacugggagaaauacgacgacuuagauga

SEQ ID NO: 8684 - RNA, 3654 nt, Artificial Sequence
  Cas9 variant
auggaaaaacaacgaauauuaggacucgaucccggaaccaauucacuaggcugggcaguccuagauuuugacaacucaaaacaagaauacaaccucguaagaaaaggcgaagucauauucgaagaaggaguagggaaaagugaaagaggugaauucaguaaagcagcauauagaacauucuacaaaucaacaaggaaacauuacuuccgaaggagacuacgcaaaaucgaaguacuaaaaguacuaguuaaauacgauuucugcccauaucuuagugacgaccuauuaaagcaauggcacgagaaaaaaauauaccccgcgguaaaagaauucauggacuggcaaagaacaucagaugcugaaggcaaaaauccauacuacgauagacacuguuguuuaaacgaaaaacuggacuuaucauuaaaaagcgacagauauaucuuagggagagcacuauaucaccuaacacaaagaaggggauucaaaucuaacagauuaauacaaaacaacgaugaaaacgaagaaggcaaaguaaaaaaaggaauaucugaauugagcacagaaaugcaagaagcaaauuguaacuaccuaggagauuauuucuacaaacuguacacagaaaagggaaacacaguucaaauccgaaaacgauacacagacagagaaaagcacuacaaaaacgaauuuaacgcaauaugcgaaaagcaagagcucaacgaaacuauaguaaaagaacuagauaaagcaauauuuuuccaaagaaagcucaaaccccagcgccaugguguaggaaaguguacauucgaaccuaauaaucgaagaugcgcaauaagucacccagacuuugagagauucagaauguuaugcuuuauaaacaauauaaaaauaaaaacccccuucgaggaaaaucuaagaccacugaacaacgaggaaaaagcgcuaauagaaccccuuuuuuacaggaaaagcauaaagaacuucgacuuugaagaaauugcaaaaaaacucgcuggaaaaaauaacuacugcuacaucaaagacgauucaucaaaacaauacaaauuuaacuauagaaugucccaaggugcuucaacaugucagacgauagcaaaacucaagaguaucuucggagaagaauggaaaaacgguauagcugagacauauacaaaucgacgaaaaaaagaaggacuaaaaaaacaagcagaaaugguugaugacauauggaacguauuauacucagucagugaaugcgauguauuaaaagacuucgcaauaaacaaacuucaauuagacgaaaaaacggcggauaauuuuucuaaaacaaaacucgcgcaaggcuucgcaacacuguccuugaaagcaauaagaaaaauacuaccuuuucuggaacaagguuucggauacacagaagcugucuucuuagcgaacaucccaaccguagucggaaaagaauauuggaacaacgaagauauuagaaacgacauuauggaagaaauaaaaacuauauuuuaccauaauacacuaaaaacuaaugauagccacaauacaauucuuuuuuguauuaaagauauacuaucuaauaauuuugaucuagcccccggagcaauugacaaauuauaccacccuucaaugauuaauguauauaaagauguuauaccaaacgaggacgggauacuacagcucgguucacccaaaaucgacgcuguaaaaaacccaauggcaaugagaagucuacauaucauaagaaaaguagucaaugaacucuuaagggaaggcauaauaaauagugauacagaaguaagaaucgaauacgcucgagaacucaaugacgcaaacaaacgacacgcaauagcggauuggcaaaaaaaacaauacgguaagcaucaaaaauauagaaaagaaauaaaagagcuuuucaaggcagaaacaggauuugaaauagaaccuaaugagacagacauacuaaaauucgaacucugggaagaacaaaaccauauaugucuauauacgggccaagaaauaggaaucuccgaauucguuggugaaaacccaaaguaugauauagaacauacauuuccaagaucacuagggggagauaguacuaagaugaacaugacacucugugaaaacaaauucaaccgagagaauaaacaaaaaaaacuacccuccgagcuagcaaaucacucagaaauacuagagagaauagacgauuggaaaaaaaaaauuuacauauuacaaaagaaauacgacucgauacguacacauaacggaauggauaaagaaaauaaagauaaaaaaauaguaucccgacacaaaauuaaacuagaacucgauuacuggaaaggaaaguacaauagauuuacaaugacagagauaccagaagguuucucacgaagacaaggaaugggcauagguuuaauaucccgcuaugcuggacuauauuugaaaacaauauuucacaaaaaggacaauccucaaaaaucaaauguuuauauaguaaaagguaguauaacagcugaauucagaaggauauggaacauucaggaugauuacgaaaaaaaaugcagagauaaccauauacaccacuguauagacgcaauuguagugggauguauuggaaagagagaauacgaucuaauggcucaauucuaucgagacgaagaaaaauauaggugggaaaaaaaaaaaaaaccuuuuuucaagaaaccgugggaaacguucacgcaagacaugcuaagcuuaaaagaugaaguccucacaguacauuucaacccgagcaacuucacaaaaaaagcacacaaaaaggucuuuacaccaaaagggauauuugucgcacaaggugacugugcuagaguaaaacuacacaaagguaguuauuuuggagcaaucgaacaaaaaggcgaaauaaaguacguuaugcgcaaggaacuaucagcacuuaaaauugaagauauaaaaaacauuguagacgcaguaguaaaagaaaagguacucgccguuguaaaaaaaaaaggcuucaaacaagcuauggcagaaccaaucuauaugaacgaagacaaaagaauauuaauaaagaaaguaagacuauucgugagccaagcaaacccacucauagucaaaaaacaccgagaccuaucaaguaaagaauauaaacaaaacuauuacguagacaacgaaggaaaccuaaugauagcaauguacgaaggaguaaaaaaaaauggaaaaauagacagagaaauaacaguaguaaacaaccuggaagcagccaaauuuuuuagacaaagucaaaaaaauaacgcugaaaaacaguuaauaagccaccuaucaccuaaaaacgguuacccguuaaaaaccgugcucacucaaaagcaacuaguacuaauguaugaagauagccccaaagaaauaaaacuacgagacacaaaaaauaugguaaaaagacuauaccaaguauucggaauagaaaaagacggaagaguaaaacuaaaauuccaccaagaagccagaagcgaaggacuaaauauuaauagugcagcauuuaagauacaggacacaccagagucccuuuacagacauacaaaaagcaaucuuaagguccugguuaaugguguagacuucaaaauaaauauacuaggcgaaauaagccugaucuga

SEQ ID NO: 8685 - RNA, 3654 nt, Artificial Sequence
  Cas9 variant
auggaaaaacaaagaauacuaggacuagauccagguacaaauagccuggggugggcaguuuuagauuuugacaauaguaaacaagaauacaaucuuguacgaaaaggagaaguaauuuucgaagaaggaguuggaaaaucagaacgaggugaauuuaguaaagcagcauaccgaacauuuuauaaauccacccgcaaacacuacuuuaggagacgucuaagaaaaauagaaguacucaaaguacuuguaaaauaugacuucugcccuuauuuaucagaugauuuacucaaacaauggcaugagaagaaaauauauccagcaguaaaagaauuuauggacuggcaacgaacgagugacgcagaaggcaaaaauccauauuacgacagacacuguugccuuaacgaaaaacuagaccugucacuaaaauccgaccgauacguacuagguagagcacuauaccaucuaacccaacguagaggauucaaaucaaacagauugauacaaaacaaugaugaaaaugaagaaggaaaaguuaagaaaggaauaucagaauuaucaacagaaaugcaggaagcuaauugcaacuaucucggagauuauuuuuacaaauuauacacugaaaaaggaaacacaguucaaauaaggaaaagauacacagacagagaaaaacauuauaaaaaugaguucaaugcaaucugcgaaaaacaagaacuaaacgaaacaauugucaaagaacuagacaaagcaaucuucuuccaaagaaaacuaaaaccacaaagacacgguguagggaaaugcacguuugaacccaauaauagacggugcgcaauaagccauccugauuuugaaagguucagaauguuauguuuuauaaauaacauaaaaauaaaaacgccuuuugaagaaaaucuccgacccuuaaacaaugaagagaaagcauuaauagaaccauuauuuuauagaaaaagcaucaaaaauuucgacuuugaagaaauagccaagaaauuagcaggcaaaaauaauuacugcuauauaaaagaugacucaagcaaacaauacaaauucaacuacaggaugagccaaggagccucuaccugccaaaccauagcaaagcuaaaaucaauauucggagaagaauggaaaaauggaaucgcggaaacauauacaaauaggaggaagaaagaaggacuuaaaaaucaagccgaaaugguagaugacauuuggaacguucuauauucaguaucagaaugcgacgugcucaaggauuucgccaucaacaaacuucaacuagacgagaaaacagccgacaacuuuucaaaaacaaaacuagcacaaggauuugcgacccuauccuuaaaggccauuagaaaaauuuugccauucuuagaacaaggcuuuggcuacacugaagcaguauuuuuagcgaauauaccaacggucgucggaaaggaauauuggaauaaugaagacauaaggaacgacauaauggaagaaauaaaaacaaucuuuuaucacaacacacuaaaaacaaacgacucacauaauaccauucuguuuugcauaaaagauauauugagcaacaacuuugaucuugcaccaggagcaaucgauaaauuauaucauccaucgaugaucaacguauauaaagacguaauacccaaugaagauggaauccuacaauuaggauccccaaaaauagacgcagucaaaaaccccauggcuaugcgaucccuacacauaauaagaaaaguaguuaacgaacuucuaagagaagggauaauaaacagugacacagaaguaaggauagaauacgcaagagaauuaaaugaugcaaacaaacggcaugcaauagcagauuggcagaagaaacaauacggaaaacaccaaaaauacagaaaagaaauaaaagaacuuuucaaagcagaaaccgguuuugaaaucgaaccaaacgaaacagauauacuaaaauuugaauuaugggaagaacaaaaccacauaugccuguacacgggacaagaaauuggcauuucggaguucguaggagaaaauccuaaauacgacauugaacacacaauaccuagaagucuuggaggagacucuaccaaaaugaauaugacgcuaugugaaaauaaauucaauagagaaaauaaacagaagaaauugccaagugaauuagcgaaccacucugaaauacuagaacgaaucgacgauuggaaaaagaaaauauacauacuucagaagaaauacgauucaauaagaacccauaacggaauggauaaagaaaauaaggauaagaaaauaguaucaagacacaaaauaaaacuagaauuagauuacuggaaaggaaaguauaacagauucacuaugacagaaauaccggaaggauuuucaagaagacaaggaaugggaauaggacuaauauccagauacgcuggccuauaucuuaaaacgaucuuccauaaaaaggauaacccacagaaaagcaacguauauauuguuaaagggagcauaacagcagaguuuagaagaaucuggaacauacaagaugacuacgagaagaaaugcagagacaaucacauccaccacugcauagaugcaaucgucguuggaugcauaggaaaacgagaauacgaccuaauggcacaauuuuacagagacgaggaaaaauaucgaugggagaagaaaaagaaaccuuucuucaagaaacccugggaaacuuuuacacaagauaugcuauccuuaaaagaugaaguauuaacaguacacuuuaacccaagcaacuucacaaagaaagcacacaaaaagguauucacaccaaaaggaauauucguagcucaaggagacugugcaagaguaaaguuacacaaaggcuccuacuuuggggcaauugaacaaaaaggagaaauuaaauacguaaugagaaagaaacugucagcgcuaaaaauagaagacauagaacacauuguagacgcaguaguaaaagaaaagguauuggcggucguaaagaagaaaggauucaaacaagccauggcugagccaaucuauaugaaugaagauaaaaggaucuuaaucaagaaaguaagacuauucguaucccaaacuaauccauuaauaguaaagaaacacagagacuuauccuccaaagaauauaaacaaaauuacuauguggauaaugagggaaacuuaaugaucgcaauguaugaaggagucaagaaaaacggcaaaauagacagagaaauuacuguuguaaauaacuuagaagcagcaaaauucuucaggcagucacagaaaaacaaugcagaaaaacagcuaauaucucaccuaucucccaaaaacggauacccccucaaaacgguauuaacacaaaaacagcuaguacuaauguacgaagacagcccgaaagaaauaaaacuucgagacaccaaaaauaugguaaaaagacuauaucaaguauucgguauugaaaaagacgguagaguagaacucaaauuccaccaagaagcaagaucagaaggacuaaacaaaaauucagcagccuuuaaaauacaagauacuccagaaagccuauauagacauacaaaaagcaauuugaaagucuuaguaaacggaguagacuucaaaauaaauauacuaggugaaauaucccucaucuga

SEQ ID NO: 8686 - RNA, 3654 nt, Artificial Sequence
  Cas9 variant
augaaauacaacuauguacuaggacuagacauaggaaucaguagcguaggguggggucuacuagccuuggaugaaaacaacaaccccuauaaaauaauagaugugggaucaagaauauuuucuccuggagaaguagagaaaacuggagacaguaaagccaaagaacgucgcgaaaaacguggaacaaggcgaguaaucagaagacgcgaguucaggcuagaucgcgugagaaaucuucuauaugaaaaagguuaccuuaaaggcaacauuaccagcaauauaguuagugucaaaaacgaagaacuuaccauaauuuucaacgauaugguaaauaacuacuacaaaagcaaagauacuaauccuuacaaacugaaaguagaagcacuagacaggaaacuaacaaacgacgaauuaaguaucaucuuaguacauuaugcaaagaaaagaggguacaaaucaaaccgagaagaaaguagugacaacgacaacgggaaaguaaaagaagcaauaaaagaaaauacaaaccuuauggaagaaaagaaauaccgaacaauuucagaaauguauauuaaaaaugaaaaauucaaaaauaaaauuaaaaauggaccagacgacuauaaauuaagcguaaccaaugaaauguaccucgaagaaauuaacaaaguacuagacagccaaauugguuuuggguugaucgaugacaacuuuaaaaacgaauaucuagaaaucuacaauagucgaagacacuacucugaaggaccuggauacuauuaugcaaaagaugcaaacggaaauaaagucaaggucaggagcccauacgguggagauuuaauaaagaaaaugacaggcguaugcucuuucgacaagaaagcuagagcaccaaaauacgcauucaguagugaauuauucgucucaauuucaaaauuaguuaacuuaagguauaaaauugacgacgacucguacaaacaauuaacaaaagaacaaauuaacgagcucauugaugaagcuaaaaauaaaaacaaaguaacauacaaaagccuaauaaaaauucuagguauuaaaaacauaaaaguaaaagaccuaaaccucaguaaaucugaauacauaaaaguaaucgacgaacuaaagaagaaauugaauaucucaaaagaagagaaaauugacauauauucccuagacgaagaaaauaagaaaauauaugacgacauauacaaugaaaaacucuuuaguaaaacacucauagaguucaaaggcuacaaccucuuaaagaaagcaauaacacucuccuauaauucaggaacauggaacgauguaaaagacaacauugaguucuuggacgaacuagcuuuauacuguacagauuacaaaguaaauaaugaaauacaagaacacauccacaacucuuuaauaauagacucacgauucgaugacagcaauuuuguagaaaacuugccaaacuucaaagaccaucuaaugcuauccacagacauaauaaggaaacucaucccaauaaugcuugaaggaauaaccuacgacaaagccauggacaaaauaggauacaaccacagcaacuuauacaaagacacaauaaaagaagacuuauuagucccaguauauguuucuaaaaacauuacaaaucaacgagucauaagaucacuaacacaagcuagaaaaguaauaaaugcgauuaucaagaaauacgggucaccaaaaaucaucaauaucgaaacugcaagagaacucgcaaaaacacagaaagaacgacguauaauagagaaaaaucaacaagacaaacaauaugaaaaugaaaggaucaagaaacaccucguugaauuggaauuauuuucagacgaaucaaaaauuacaggcaaugaucuccuaaaauauaaacuauggcaagaacaaaaagaguucugugguuauagcaugaagaaaauuaaacuugaagaccucuucucaaacaacauaguacaaaucgaucacauccugcccuacucgagaaccuacaacgacaacuaucucaauaaaacccuaguuuauacaaaauacaaccaagacaaaggcaauaaaacaccauacgaaugguucgggaaaacagacaaauggcaagaauacgaagcauuuauaaacucacuaagcaucagucaaaacaagaaagauaacuaucuauugaaaaaucuagaccaagacgcagaaagggaaaugagagaacaaaaucuaaacgacacaaaauauauaucaagagaacuacuaagccuaauaaaagcauaucucaacguagaugaaguuaacgcuuucccgggcgccauaacagccaaacuccgcgcgcguuggggauucaacagauuaacacacucguauauaucaaaaaccuauauaaugccugaagacaugaagaaaggaauaaauaaagacagagacaaucaccuacaccacgccauggacgcacucguaauagcaaguaucacaaaaagccuacaacagaaaauaacuuuauacgaaaaauuuaguagauacguagacggaauaaccaaaaaugaauuaggaaaaauaagcacagggaacauuaaugacgaccuauacaacuauuacgacgaagaaacaggagaaauaaaagagcuggaacuacgacaauacaucaaaaaucaaguagcacaaaauaacauauauuucagcaaacacaauguauccaaauuaauauuuccaacaccauauaacaacuuuguagaagaggcaaaacuaagaguuuacgaaagggaccuagaaguacucaaauggaaucugaaaaaccuugggacuuacacaucgagugaacucaacagaauccauguccugauucccucaguagccaaaaauaaaauaagcggaagacuacacgaagagacauauuacggauuaaaagaggucggcauuggagaagauaaaguaacguauaaaacauuaaaaacaccaauaaguaaagucaaaaagaaagaccuugauaacauaccagacugcaaaggaggaucuaaagacauauauaacgcuuuaguaaaaugguucggcaauugcgagacaggcgaagaagcccuaaaaaugcaugauggcaaauaucccguaaacccaaaugacaaagagcaaaaagaaauacgcaaaauuaaaguauacacaaaauauaacgcaacuggacacguuguaaauaacggcaacguagaaaaagggggaauauaucgaauugacguauucaaauccaaaaacaaagaagauaacaaacuauauuucacaucuuaugacauauuugaaauagaacaaauaaaagcauacgaaaaaggcaaaaacauuaauuucucaauaaaacuagaauacggccaagguaaaaauaacaaaauacuacuauauaaagaugucaaaaacgaauaugaccucaucaugucaaucuacaaaaaugacuugaucagaauaaaaacgaaaaccggaaacaaaagcacagcauacguaguuggauucagcggaggaaaacuagaaauuaaauccacaauaggagacggauacgacauaaucgguaacaauaacauuuucgauaaaucaauggaaagauaucgagucacaucaaguacaauaguaaaaaucgauaaacuaagcauuucaauacuaggagaaguaucaggacuauga

SEQ ID NO: 8687 - RNA, 3657 nt, Artificial Sequence
  Cas9 variant
augaacaaaagaauacuagggcuugacacaggaacaaacaguuuaggaugggcuguaguugacugggaugaacacgcgcaaagcuacgaacuaauaaaauacggugacguaauuuuucaagaaggagucaagauagaaaaaggaauugaaucuucaaaagcagccgagcgaagcggauacaaagcuaucagaaaacaauauuuuagaagaaggcuacguaaaauacaaguauuaaaaguauuaguaaaauaccaucuauguccguauuuaagugaugaugauuuacgacaauggcaccuacaaaaacaauauccaaagagugaugaauuaauguuguggcagagaacuucugacgaagaaggcaaaaauccauauuaugacagacaucgaugucuacaugaaaaauuagaucuaacgguagaagcagaccgauauacuuuagggagagcacuauaccacuuaacacaacgaagaggauucuuauccaauagguuagacacaagcgcagacaauaaagaagacggagucgucaaaagcggcauaucacaauuaagcacugaaauggaagaagcuggaugcgaauaccuaggagacuacuucuauaaacuuuaucaugaacaaggaaauaaaguaagaauacgccaacgcuacaccgauagaaagaaacauuaccaacacgaauuugaugcaauaugcgaaaaacaggaauuaucaagugaauuaauagaggacuuacagagagcuauauucuuccaauuaccccuaaaaagccaaagacacggcguuggaagaugcacguuugagcgaggaaagccucgaugcgcagacucucauccagauuacgaagaguucaggauguuaugcuuuguaaauaauauccaagucaaaggaccacaugaccuagaacuuaggccacugaccuacgaagaaagagagaaaauagaacaccuguucuuuaggaaaucgaagccaaacuuugauuuugaagacauagcaaaagaauuagcggguaagaaaaauuacgcguggauccaugacaaagaagaacgcgcauauaaguuuaauuauagaaugacacaaggaguaccuggaugcccaacuacugcacaauuaaagagcaucuucggggacgauuggaaaacaggaaucgcugaaacauauacguuaauacagaaaaagaacggauccaaaagccugcaagaaaugguugaugacgucuggaacguuuuauacagcuuuaguucaguagaaaaauuaaaagaguucgcacaccauaaguuacaguuagaugaagaaaacgcagaaaaauucgcuaaaauaaaacuuucgcauucauucgcugcacuaucauuaaaagcaauaaggaaauuucucccauucuuaagaaaagguauguacuauacacaugcaucauucuuugcuaauauaccaacaauaguaggcaaagaaauauggaacaacgaacaaagcaggaaauauauaauggaaaauguaggagaauuaguuuuuaauuaucaaccuaagcacagagacguccaaggcaccauugaaauguugauuaaagacuuucuagccaacaacuuugaauuacccgcgggagcuacagacaaacuauaccauccguccaugaucgagacauauccacacgccuugagaaaugaguuugguauauuacaacucggaagcccgagaacaaacgcaauacgcaacccaauggccaugagaucacuccauguauuacggaggguuguaaaccaacuuuuaaaagaaagcauuauagacgaaaauaccgaaguacauguagaauacgccagagaauugaacgaugcaaacaaaagacgugcuauugcagaucgacaaaaagaacaggauaaacaacacaagaaauauggugaugaaauaagaaaauuauacaaagaagaaacaggaaaagauauagaaccuacucaaaccgauguauuaaaauuccaacucugggaggaacaaaaucacuacugucuguauacaggcgaacaaauagggauuaccgauuuuauaggaucaaacccaaaauucgacauagagcacacuauaccacaaucaguaggaggagacuccacccaaaugaacuuaacuuuaugugauaauagguuuaaucgagaaguaaagaaagcaaaauuacccacagagcucgcaaaccacgaagaaaucuuaacuagaauagaacccuggaaaaauaaauacgagcagcucguuaaggaaagagacaaacaacgaacuuuugcaggaauggauaaagcaguaaaagacauaagaauccaaaagcgacauaaauuacaaauggaaauagacuacuggagaggaaaauacgaaagauucacgaugacagaaguaccggagggauucagucguaggcaagggacagguauaggucuaauaagcagguacgccggacuguaucucaagucacucuuucaucaagccgauucaagaaacaaaaguaacguuuauguagucaagggaguagcuacagcugaguuccguaaaauguggggacuucaaagugaauacgagaaaaaguguagagauaaucauagccaucacugcauggaugcuaucacuauagccuguauuggcaaacgagaauacgaccugauggcagaauacuaccacauggaagagacauuuaggcaaggaagaggcuccaaaccaaaauucucaaaaccuugggcuaccuucacugaagacguuuugaacauauauaaaaaccuauuagucguucaugacacccccaauaauaugccaaaacauacaaagaaauacguacagacuagcaaaggaaaaguacuagcacaaggcgauacugcuagggguagcuuacauuuagauacauauuauggagcaauagaacgagacggcgaaauacgauauguaguacgaaggcccuuaucaaguuuuaccaauccaaaagaauuagaaaacauagucgaugagacaguuaaacgaaccaucaaagaagcaauagcugauaaaaauuucaaacaagcaaucgccgaaccaauauauaugaaugaagauaaaggaauauugauaaagaaaguacgaugcuucgcaaacucuguaaaacagccaauaaacauacgacaacacagggaucuaagcaaaaaggaauacaaacaacaauaucauguaaugaaugaaaauaauuacuuauuagcaaucuacgaaggauuagucaaaaacaaaguaguaagagaguucgaaauagucucauacauagaagccgcuaaauacuauaaaagaucacaggacagaaauauauuuucauccauaguaccaacccacucaacaaaauaugggcuaccacucaaaacgaaguuguuaaugggacaacaaguucuaauguuugaagaaaacccagacgaaauacaaguagauaacacaaaggaucucguuaagcgucuauacaaaguaguuggcauagagaaagauggacguaucaaauuuaaacaucaccaagaagccagaaaagaagggcucacuauauacuccaccccauacaaaaauaacgacgauuacgucccaauauuuagacaaagcaucaaaaacauaaacauauugguagacggaauagauuucaacauagauauauuaggcaagguaacauuaaaagaauga

SEQ ID NO: 8688 - RNA, 3657 nt, Artificial Sequence
  Cas9 variant
augaauaaacgaauacuuggacucgacacaggaacaaacagccuaggaugggcaguaguagacugggacgaacaugcgcaaaguuaugaacuaauuaaauauggggauguaauuuuucaagaagggguaaaaauagaaaaaggaauagaaucaucgaaagcagcagagagauccggauauaaagcaaucagaaaacaguacuucagaagaagauuaagaaaaauacaaguccugaaaguuuuaguaaaguaucaccuaugcccauaccuuucagacgaugaccuaagacaauggcaccuacaaaaacaauacccaaaaucugacgaauuaaugcuauggcagcgaacuucagaugaagaagggaaaaaccccuauuacgacagacaucgauguuugcacgaaaaacuggaucuaacaguagaagcggaucgauacacacuaggacgcgcauuauaccacuuaacgcaacggcgaggcuucuuaagcaaucgccuagauacgagugccgauaacaaagaagacgggguagucaaaaguggaaucucucaauuaaguacagaaauggaagaagcaggaugcgaauaccuuggcgauuauuucuauaaauuauacgaugcacaaggaaacaaaguaaggauacgacaacgauauacagaccgcaauaaacacuaucaacacgaguucgacgcaaucugcgaaaaacaagaacuaucgucagaacuaauugaagaccuacagcgagccauauucuuccaacugcccuuaaaaucacaacgacacggaguaggaagaugcacauuugaaagaggaaaacccagaugugcagacucacauccugauuaugaagaguucagaauguuaugcuuuguaaacaauauacaaguaaaagguccacaugaccuagaacuacgaccacuaaccuaugaagaaagagagaaaaucgaaccgcuauucuuucgaaaaagcaaaccuaacuuugacuucgaagauauugccaaagcacuggcaggcaagaaaaacuacgcauggauccacgauaaagaagaaagggccuauaaauuuaacuaccgcaugacacaaggagucccaggauguccgacuaucgcacaacuuaaaucaauauuuggggaugacuggaaaacaggaaucgcagaaacauacacauugauacaaaagaaaaauggaucaaaaucauuacaggaaauggucgaugacguauggaacguauuauauucauuuagcagcgucgaaaaacucaaagaauuugcucaucacaaacuacagcuagacgaagaaucagcagaaaaauucgccaaaauaaaacuaagucacaguuuugcugcauugucgcuaaaagcuaucagaaaauuuuuacccuuccuaagaaaagguauguauuacacacaugcaucauucuuugcuaacauaccaacgauaguuggaaaagaaaucuggaacaaagaacaaaaucgaaaguauauuauggaaaacgugggugaauuaguauucaacuaccaaccaaaacauagagaaguacaaggaacaauagaaauguuaauuaaagauuuccuagcgaacaauuucgaacuaccagccggagcaacagacaaacuauaccacccaucaaugaucgaaacauauccaaaugcccaaagaaacgaauuuggaauauuacagcucggaaguccucgaacuaacgcuauaagaaauccaauggcuaugcgaucguuacacaucuuacgaagagucguaaaccaauuauuaaaggaaucuauaauugacgaaaauaccgagguacacgucgaguaugcgcgggaacuaaaugacgcuaacaaaagacgagcuaucgcagacagacagaaagaacaagauaaacaacacaagaaguauggcgaugaaauaagaaaacuauacaaagaagaaacaggaaaagacauagaaccaacacaaacagauguauuaaaauuucagcucugggaggaacaaaaucaccauuguuuguauacgggagaacaaauaggaauuacggauuuuauaggaucaaacccaaaguuugauauagaacacaccauaccacaaaguguaggaggugauucuacucaaaugaacuuaacacuaugugacaauagauucaacagagaaguuaagaaagcgaaacucccaacagaacuagcuaaccacgaggaaauacuaacuagaaucgaaccguggaaaaacaaauaugaacagcuaguaaaagaaagagauaaacaaagaacuuucgcagggauggauaaagcagugaaagacauaagaauccaaaagcgacacaaauugcaaauggagauagauuauuggagagguaaauaugagagauucacaaugacagaaguucccgaaggguucucuagaagacaagguacaggaauaggacucauaagucgguaugcuggcuuauaccugaaaucccuauuucaccaagcugacagcagaaauaaaagcaacguauacguaguaaaaggaguagcaacagcggaguucagaaaaauguggggucuacaaucggaauaugaaaagaaaugcagagacaaccauagccaccauugcauggaugcaauaacaauagccuguauaggaaaaagggaauaugauuuaauggccgaauauuacagaauggaagaaacguucaaacaaggucgaggaagcaaaccgaaauucucgaaaccuugggcaacauucacugaagacguacuuaacauauauaaaaaucuauuagucguacacgauacgccaaauaauaugccaaaacauacuaagaaauauguacaaacaaguauaggaaaaguuuuagcacaaggagauacggcuagaggaagccuucaucuagacacauacuacggagcaaucgaaagagacggcgaaauuagauacgucguuagaagaccacuuaguucauuuacaaaaccagaagaacuagagaauauaguugacgaaacagucaaacgaacuaucaaagaagccaucgcagacaaaaacuucaaacaagccauagccgaaccuauauacaugaaugaagaaaaaggaauacuaauaaagaaagucaggugcuucgccaaaucaguaaaacaacccauaaacauaagacaacacagagaucuuucaaagaaagaauauaaacaacaauaucauguuaugaacgaaaacaauuaucugcuagcuauauacgaagggcuagugaaaaacaaaguuguacgcgaauuugaaauuguuucauacauagaggcagcaaaauacuauaaacgaucccaagaccgaaacauuuucaguagcauagucccaacacauucuaccaaauacgguuuaccauuaaaaacaaaacucuuaaugggacaguuaguccuaauguucgaggaaaacccggaugaaauacaaguggauaacacaaaagaccuaguaaaaagacuauauaaaguagucggaauugaaaaagacggaagaauaaaguuuaaauaccaucaagaagccagaaaagaaggauuacccauauuuuccacgccauauaaaaauaaugaugacuacgcaccaauauuuagacaaaguaucaauaacauaaauauuuuaguugacggaauagacuucacaauagacauacuagguaaaguaacauuaaaagaauga

SEQ ID NO: 8689 - RNA, 3657 nt, Artificial Sequence
  Cas9 variant
augaacaaaagaaucuuaggacuugauacaggaacaaauagccuagggugggcaguaguagacugggaugaacacgcucaaagcuacgaguucaucaaauauggugauguaauauuccaagaaggaguuaaaaucgaaaaagguauagaaucaucaaaagccgccgaaagaucagguuauaaagcaauaagaaaacaauacuucagaagaagauuaaggaaaauacaaguacugaaaguucucgucaaauaccacuuguguccuuacuugucagaugaugaucuaagacaauggcaccuacaaaaacaauacccaaaaagcgacgaacucaugcuauggcaaaggacaagugauaagaaaggcaaaaacccauauuaugacagacaucgaugccuacacgaaaaauuagaccugacaguggaagcagauagguauaccuuaggcagagcuuuguaccaccugacacaacgacgaggcuuucuuucgaacagacuagauacaucugccgauaauaaagaagauggcgucguaaaauccgggauaucacaauuaucaacagaaauggaagaagcaggaugugaauauuuaggcgauuauuuuuacaaauuauaugacgaacaaggcaauaaaguaagaaucagacaacgauacacagaccgaaacaaacauuaccaacaugaauuugaugcuauaugcgaaaaacaagagcuaucgucugaacuaauugaagaucuacaaagagcaauuuucuuucaauuaccacucaaaucucaaagacauggcguaggaaggugcacguuugaaagaggcaaaccaagaugcgcagauagccaucccgauuaugaagaauuuagaaugcuauguuuuguaaauaacauucaaguaaaaggaccacaugaucucgaauuaagaccgcuaaccuacgaagagagggaaaagauagaaccacuauuuuucaggaaaucaaaaccgaacuucgauuuugaagauaucgcaaaagcauuagcuggaaagaaaaacuacgcauggauccacgacaaagaagaacgcgcauauaaauuuaacuaccguaugacucaaggaguaccaggaugucccacaacggcucaacuaaaaucaauauucggagacgacuggaaaaccgggauagcagaaacauacaccuuaauacaaaagaaaaauggguccaaaucacuacaagaaauggaagaugauguauggaacguacuauacaguuucaguagcguagaaaaauuaaaagaguucgcgcaucauaaacuacaacuagacgaagaaucagcugaaaaauucgcaaaaauaaaacugagucacucauucgcugcucuaucgcuuaaagcaauaagaaaauuuuuaccauuuuugagaaaaggaauguauuacacccaugccucauuuuucgccaacauaccuacaaucgugggaaaagaaauauggaacaacgaacaaaacagaaaauacauaauggaaaacguaggagagcuagucuucaacuaccaaccaaaacauagggaagugcaagggacaauugaaaugcuaaucaaagauuuucuagccaauaauuuugagcuaccggcgggagcgacagauaaauuauaccauccuagcaugauagaaacauacccacacgcacaacguaacgaguucggcauauuacaacuagguaguccaagaacaaaugcuaucagaaauccaauggcaaugagaagccuacauauacuuagacgagucguaaaucaacuauuaaaagaaagcauaauagacgaaaauacagaaguccauguagaauaugccagagaacuaaacgacgccaacaaacgcagagcaauagcagguuggcaaaaagaacaagauaaacaacacaagaaauauguagaugaaaucaggaaauuauauaaagaagaaaccggaaaagauauagaacccacccaaacagauguauuaaaauuccaauuaugggaggaacaagaccaucauugcuuauacacgggggaacaaauaggaauaacugauuucauagggucuaacccaaaauucgacaucgaacauaccauaccacaauccguuggaggagacagcacacaaaugaacuuaacacuuugcgacaacagauucaacagagaaauuaaaaaggcuaaauugccugcccaacucuccaaccaugaagaaauacucgcaagaauugaaccauggaaaaacaaauacgaacaaaagauaaaagagagagauaaacaaagaacauuugccggaauggacaaagcuguaaaagaccuacgaauccaaaaacgacauaaacuacaaauggauaucgacuauuggcguggaaaauacgaaagauucaccaugaccgaaguuccugaaggauuuagucgcagacaaggaacaggaaucgggcuaauaucacgauaugcugguuuauauuuaaaaucauuauuucaucaagcagauaguaggaauaaaucaaauguauauguuguaaaaggaguagcaacugcagaguucaggaagauguggggucuucaaagcgaauacgaaaagaaauguagagacaaccauucacaccacuguauggaugccaucacuauagcauguauaggaaaaagagaauacgaucuaauggcagaauacuauagaauggaagaaacauuuagacaaggacguggaagcaaaccaaaauucuccaaaccaugggcuaccuuuacggaagacguacuaaacauauauaaaaaucuccuuguaguccacgauacaccaaauaacaugccuaaacacaccaagaaauacguccaaaccucuaaaggcaaaguacuggcgcaaggggacacagcaaggggaucacuucaccuugacacauauuauggugcaauugagagagauggagaaauucgauacguuguacgaaggccacuuucuagcuuuacaaaaccaaaagaacuagaaaacauaguagaugaaacuguuaaaagaacaaucaaagaagccauagcagauaaaaauuuuaaacaagcgaucgcagagccaaucuauaugaaugaagacaagggaauccuuauuaagaaaguucguugcuuugcaaaaucagugaaacaaccaauaaacauacgacaacaccgagaccuuucuaaaaaggaauacaaacaacaauaucauguagucaaugaaaauaacuacaugcuaguaauauaugaaggacuggucaagaacaaagugguacgagaauuugaaauagucaguuacaucgaagcagcuaaauacuauaaaagaagucaagacagaaacaucuuuucaagcauuguaccaacacauucagccaaauauggucuaccucuaaaaacgaaauuauuaaugggccaauuaguacuaauguuugaagaaaauccagacgaaauacaaguggauaacacaaaagauuuaguaaaaaggcuauauaaagucguagggauuaaaaaggacggaagagucaaauucaaauuucaucaagaagcacgaaaagacgguuuacuaauauuuucuacucccuacaaaaauaauaaugguuacguaccuaucuuuagacauagcaagaaaaauauaaacaucuuagucgacggcaaagacuuuacuauagauaucuuagggaaaguuacguuaaaagaguga

SEQ ID NO: 8690 - RNA, 3660 nt, Artificial Sequence
  Cas9 variant
augaaagaagaaguacgggguaaaaaucguucacaaaccugggcgauauuagcuaaauucuuugucuggucugaaaaagaaagcguauggaaugaaaaagaagcacguacagaagaacgaguaaaagaauauaagcuaguuggacuaaaaagggacacaaaaggaaacgaacucaaacucgaaaacuacagauggagaguucaggcccuaagcgaacaacuaaacccugaaauaguugcaauagucuuacaggaaauaaauggucaaauaucagcuagcagcggauauuuaggagcaauaucagacagauccaaacaacuauauuuuaauagacaaacaguaggccaauaucuuaugucagaacucgaaaaagauccaaauguaucgcuaagaaauagaguauuuuaccgacaagauuaccuugacgaguucgauagaauaugggaaaaacaagccgaauuucacgaagaacuaacaguugaacuaaagaaagagauacgggacauaauaauauucuaccaaagacgacucaaaucccagaaagguuuaaucucauucugcgaguucgagaaaagggaaguaguaguugaagaagauggucggaagaaaaacaaaacggucggaugucgaguaaucccaagaucccauccacucuuccaggaauuuaaaauauggcaaacacucaaugauauugaaguguuugcaugggacaaacaaucaaaacgaaagaaagcagauaaaucaucuauacuauuugacaauagcgaagacgcauuacuuguugaagggaaacgauuucuauaucaagaagaaaaagaacuccuggcaaaagaauuauucguuaaagaaucaaugaagaaagcagaaguacuaaaauugcuauucgaaaacuaccaagaacuagauuuaaacuuuaaacaaauagauggaaaucauacaggcuuugcauuauucucagcauauuccaaaaugauagaaaaauaugguuacgaaccaguggauuuuaaacgaagugcagacgaaauuaucgaaaaacuagaaacuauauucacgaauuuagguuggaacacagaacuuuuaucuaucgacuuaucuaaggaagacaaagaguuagaaagacagucuuauuuccgauuguggcauuuacuauauaguuucgaaggagacaacacacccacagguaacggaaaauuacuagagaaaauuaugcaguuaugcgacguggaaaaagaauacgcuguagaacuugccaaugugaguuuucaagaagacuacggaucacuaagcgcaaaagcaaucaagaaaauauugccauauuuaaaagaaggaaaccaauacgacguugcaugcgacuacgcugguuaccgacauucacgaagcucauuaaccaaagacgaaauagaaaacaaaaucuuaaaagacaaauuagaaauacuaccuaaaaacucacugagaaacccaguaguagagaaaauauuaaaucaaauggucaaccuuauaaacacacuuaucgacaccuauggaaaaccggaugaaauacgcgucgaauuagcaagagaauuaaagaaaaacgccaaagaaagagaagaauuaacaaaauccauugcaagaaacacaagagaacacgacgaaauacgucaacuacuuagaacugaauuugguaugaugaauguuuccagaaaugauauaauaagauacaaauuguacgaagaacuaaaagauaacggcuacaaaacacuauauucuaacgaauacauaccuagagagaaaauauucucaaaagaaauagacauagaacacguaauaccccaagcacgacucuucgacgauaguuuaucaaauaaaacacuagaauaccgcgccauaaauauagaaaaagggaacaaaacugcauaugacuucguaaaagaaaaauauggaaacgacggauuagaaaaauuuuuaaauagaugcgaaacgcuauuuaaagacaaacgaacaaaacucagaaaacugaaaauggaagaaaaagacauaccagaagguuuuauugauagagaccuccgaaacacacaauacauaucuaaaaaggcuuuugccaugcuaaaugaaaucuccagaagaguuguagcaacaacaggaagcauaacugauaaguuacgagaagacuggcaacuggucgauuuaaugaaagaacuaaauuuaccaaaauacgaaaaauuaggaauggucgaaauguuugaagauaaagacgggagaaaaauaaagaaaauaaccgauuggacaaaaaggaacgaccaccgucaucaugcaguugaugcacucacagucgcauucacuaaagacguauucauccaauuuuauaacaacaaaaaugcagcauggaugccagcuagcaaagaacaugcuaauauaacagguauaaaagcacgauacuuugagaacggaaaagcacuagcgccuaugccacuagcacaauuuagagcugaagcgaaaaggcaucuggaaaaccuccuagucucaaucaaagcuaaaaauaaaguuauaacaagcaaugugaaucgaaccaaaaauaaaaauggagaaaauagaaaauuacaacaaacaccaagaggacaauuacaucucgaaacuguauacgguucacaucgucaauaugcaaccaaaaucgaaaaaguaaacgcugccuucgacguaacuaagaucgcaaccguuuccaaacuagccuaucgaaacgcguuauuaaagagauuggaggcuuucggcaaugaucccaagaaagcauuuacaggcaaaaacacguuagagaaaaauccucucuaccuggacgaaaaccaaacugaaaugguaccagaaaaaguucaaacaguagaauuugaaacaguauacacaauuagaaaacccauagauccaaaccucucuauagacaaaguuguagaugucaaaauaagaagcguauuagagaaaagacuaaaagaauauggaggagacgccaagaaagcauucguaaaucuagacgaaaacccaauaugguugaaugaagcaaaaggaauaagcauaaaacggguaaguaucagaggaauaucaaacgcacaaucccuucaugaaaagaaagauaaagacgguaaccuaauauuaggaaaagaaggaagaaaaauacccguagauuuugucaacacaggaaacaaccaccacguagcuaucuauaagaaaccaguauuagauaaaguaggccaagugguauuagacgaagaaggaaacccaaaauacgaacucgacgaaguagucguaucauucuucgaugcaguaacaagagcaaauuuaggacagccaauaaucgacaaagauuaucgacgaucugaaggauggcaauucuuauucagcaugaaacaaaacgaguauuucguauuucccaacgacaagacuggauuuaauccuaaagaaguagaccuacucaacccagaaaauuacgccuugauaagccccaaccucuuucgaguucaaaaauuugcauacaaaaauuacguuuuccgacaucaucuagagaccacgaucaaggacacaaguaguacccuaaaaggaauaacauggacggauuuccgaagcucgaaaggauuagacaaaauaguaaaaguucguguagaccauaucggucaaauagucagcauaggagaauacuga

SEQ ID NO: 8691 - RNA, 3663 nt, Artificial Sequence
  Cas9 variant
augaaaagaauccuaggauuagaccuaggaucagcaagcauaggaugggcucuaauagaagaagaugaaaaagggauaagaauaauagcacuaggcuccagaauaaucccguauaacggaacugaaggacaagauuuugcaaaaggagcuggugaaagcagaaauucccuucggacgcaagcacgaacaacucgaaaaggauacgauagauaccaauugcgaaggaaauaucuaauaaauguacuugaaaagaaucugaugaugcccagugaagaucuucgaaagaugccaaagaugaaccuauggcaacuaagaaguaaggcaguaacagaauauauuucuagacaagaacucggaaggcuauuacuauggcucaaccaaaagcgagguuauaaaaguagccggagcgaugcaaacuuagacaagaaagacacugauuacguaaaagaagucaaaucaagauuugacaaaauaaaagagaaaaaccaaaccauuggccaauacuuuuaugaaucacugcaaugugaugaauauuucagaguaaaagaaaaugucuucccaagagaagcauacauugcagaauuugaugcgauuugcucucggcaaaaagaucacuuaggucuaagcgaggaacuuauagcugaaauaagaaacgaaauaauauauuaucaacgaccacuuaagagccaaaagggcuuaguaagcguuuaugacuucgaagggaaauggaugaaucaaaaugguaaagaacuauuuauuggcccaaaaguggcgcacaaaucaagcccucuauuucaguuagccaaaauuugggagucaguaaacaacauaaaacuaucaacaaaauacggagauacaaucgaauuaacauuagaagaaaagaaacaauuagucgaauuucucgacaauaacgaaaaauuaaccacggcugcguuauuuaaaauacugaggaaagacaagaaagaauacauucucccaaaacaacuagaaaaaggacuacaaggaaacauaaccaaauguaaaauagcagauauccucggaaguaaauacaaucaauugcuacaguuaaaucuugaaaaacaagaaguaggaacacccuguuacuuauauacuaaaucgacaggugaagugcuuggagaaaaaccacuacaauacauagacaaaucagucgaaaaagaacuauuuuaccaauuauggcauacaaucuacucaauaucagacgaagaugaaugcugcaaagcacuacagaaaagauuugauauagaugcugaaacugcagggagacuagcuaaaauagacuucucuaaauauggauucggaaacaaaagugcaaaagcaauuaggaaaauacuaccauacuuaauggaaggugacaaauacagugacgcaauguguuaugcaggauacaaucacucuaacucacugacuaaagaggaaaaccacgaacguaaacucaacgacaaauuaaaacuacuaacuaaaaacaguuugagacagccuauaguagagaaaauuaugaaucaaaugauucaacuuguaaauaccauaaucgacaaauacggaaaaccugaugaaauacgacucgaauuagcuagagaauuaaaacaaucaaaagaagaaagaaacgacgcggauaaagccauguccaaaagacagcgagaaaacaaagaagcagaaaagaaacuugaggaacauggaauacgagccacacauaauaauauacucaaauacagacuuuucgaggagaugggagaaaagaaacacgaagcaauuuguauauacuguggaaaccccauuucauucucggcagccaugaauggugacgaaguagauguagaacacauaauaccaagaagcaaauuauucgaugacucacaaucaaacaaaacacuagcacaucguaaaugcaaugcaaacaaaaaugauaugacagcauacgauuucaugaaaacgaaaagcaaacaagacuuugauaaauauguagaaagaguaaaccaauuauacgcagaccguauaauuaguagaaguaaauauaauaaacuacucaugucugaagaugauauaccaucaaauuucauagauagacaacuacgagaaagccaauacauagcuacaaaagcacgagaaauauugcaaacaauuuguuauaauguauggucuaccaguggaacaguaacagcagaacuuagacacuuaugggggugggaugacauaacaaugaauuuacaaaugcccaaauacaaagaauuaggguuaaccgaaaugguagaauggacaagugaucaugguaaaaacguacacagcaaagaaguuauaaaaggauggacaaaacgcgaugaucacagacaucacgcaauagaugcccuaacaaucgcauguacuaaacagggauucauccaaagauuuaauacccugucaagcucuaaaaccagagacgacaugcaaaaagagcucgaaaaauguucaauucaauuucgcgagaaaagaucccuccuggaaaaauauauuauaucacaaagaccaauaucggugagugacguagccgaagcaguaucaaggauacuuaucucauuuaaagcaggaaagaaaguggcgacaauaggaaaacgcaaaguuaaaggaaaagucguacaacaaggaaucguaguaccacggggagcacuaucagaaggaucaguauacggaaaaauacguacaaucguaaggaaaaugccuguaaaauaucuguuugagaauccagacuugauauuuaaaccauauauaaaagcucucguaaaagaaagacuagcagaauuugacaaugauaacaaacaagcacucgcaucacugaagaaaaacccagucuauuuagacaaagagaaaacuaaauuacuggaauacggcacguguuuuaaagaugaauacguaaagaaauaugacguaaacccaaauuucacaaaaauugcagacguaauagauggaaaaguaaaacaaauauuggaagauagacuaucaaaauuuggaggaaaacccaaagaagcauucaaagacguuguaaaagacgguaaaacccuuaaaugguacgaagacgaaggacuagaacgaccaauaagauccguaagauguuuaacaggauugagcgcaguaguaccagucaagaaagacgaaaacggaauggacauaggauucguaaaaccaggaaauaaccaucauguagcaauauauguaggagcagauggaaaaggacaagaacacgucuguaccuuuuggaaugcuguagaaagaaagaaauacggacuaccaauaauaauaaaagacgcgaaugaaguaugggauaaaauaaccauggccggugacgaugucuacccacagagcuuuuuaucacucuuaccaaaaccagauuggacacuaaaacuaucaaugcaacaaaaugaaauguucauauuagguauggaggaagaugaaguaaaauucgcaauagaaagcaaagacuauaaauuauuaucagaccacuuguaccgaguacaaaaacuaucaaguucagauuacaacuuuauccaccauuuggaaacugauguccaaaagaaaacaaugaccuacagagucagaucguuaucaggcuuguuugcucucaggccauucaaaguccgcauugacuguuuaggaaacauaauccccagcuga

SEQ ID NO: 8692 - RNA, 3669 nt, Artificial Sequence
  Cas9 variant
augaagaaacguauacuaggacuagacucgggaacaaauagucuagguugggcagucguagacagagaugagaauaaucaauacucucuaauuaaauacggggaucuuauauucgaggaaggaguuaaaauagagaaaggaguagaaucaucaaaagcagcagaacgaacaucacaucgagcuuuacguaaacuuuacuuuagacgacgacucagaaaaauagaaguguuaaaagucuuaguaaaauauaacuuauguccucaagucagcgaagaggaacuacaucucuggcauacaagaaaauuauauccucaaaacaaagacuuacuucaauggcaacgcacagaugaaaaagcuggaaagaauccuuacauauauagauacagaugccuucacgaagaacucgacauguccguuucagcuaacagaaugacaguagguagagcuauguaucaucuugcacaacguaggggauuccuuucgaaucgccucgacaaugaagaagaugaaaaccaaauaggagcuguuaaaugcgguauaucuaaucuuacagaagaaauacaauccagugguuguaaauaucuaggagaauacuucuauaaacucuauaacgaacauggaaacacaguaagacuaagaaccagauauacaucaagagaauuucauuacaagaaagaguucuacgcaauaugcgaaaaacaaaaacucgacaagaaauuaauagaggaacucgcuucagcacucuauuuccaacggccauuaaaaagucaaagacauaccguaggucgauguacauuugaaccaaacaaaccacgaugugcugacagucauccagccuaugaagaauuucgaauguuaucuuucauaaauacaaucaaaguucagggaccauaugacacugaacuaagaguacuuaauacggaagaaagggacagcaucacuaaauuguucuguagaaaaucaaaaccuaacuuugacuuugaagauauagcgaaagaacuggcaggucgaaacaauuacuguuacauaggagauguuguagacaaagcauauaaauuuaauuauagaaugucgcagggaguaaguggaugcccaacuacuacauacuuaauuaauguauuuggucaggacuggcaaacagggauagccgaauccuaccaagcuaucgacacaaaacuaggacaaaaaucaguagaugcaaugauagacgacguauggaauguacuguauucauuuucaucaaaagauaaauuaagagauuuuggacguaagaaauuacaacuaggugauaaagaagccgauacuuuugcaaacauaaaauuaacacauaaauuugcaagucuaagccucaaagcaauuagaaaaaucaauauauuuuuacgaaugggccuaguauacagccacgccguaacauuagcaaauauacccacaauaguaggaaccgacaucuggcaaagaaaaagaaacuuuauuuuagcugaguuacuaccacugaucgaaaacuucaauccgaaagaaacaaaacuccaagaaacacuagauuucugcgugaaagacuucuuacaaaacaacuucgaacugaaaaauggagcaguugacaaauuauaucaucccucaaugauagaagcauauccagacgccggguuaaacaguaaugguauacuacaacuaggaucuccaagaacaaaugcaauacgcaacccaauggcaaugagauccuuacacgaaauaaggaaaguaauaaaccaauuacuaaaagauaaaaucaucaaucaagacacagaaauacacguagaauacgcucgcgaacucaaugacgcaaauaaaaggaaagcaauaagcauauggcaaaaaucccaagaaaaauuacacaagaaauacguggaggaaauaacaaauuuauacaaagaggaaacagguaaagcuauaguuccaacagacacagauauauuaaaauuuaaacugugggaagaacaaaaccauauuugucuauacacaggucaacaaauuggaauagcagaauuuuuaggagcuacuccaaaauacgacaucgaacauaccauuccacaaucuguagguggagauagcacagacaugaaucucacccuaugugauucaagauuuaaucgagaaaucaagaaagcucaauuaccaacacaacuggguaaucacgcagacauccuaguacgaauagcaggguggaaaaauucauaugagaaacuaagcaaagauauagaucguauacgaacacacaguggcauggcuaaagauauaaaagaucgauuaauacagaaacggcauuuacuaaaauuagaaagagauuauuggagggguaaauaugagagguuuacaaugaaugaaauaccagaaggauuuucaagacgacagggaguugggauaggacuaauaagcaaauacgcuggucucuaccuuaaaucauuauuccacgauaaaaacgaaagaaacaaaggccauguauucguaguaaaaggaacaacaacagccgaauuuaggaaaauguggggacuucaaaacgaauaugaaaagaaaagccguaacaaccacguucaccauuguauagaugcaauaacaauugcaugcaucggaaaacaugaauaugcccaaauggcccaauacuaccaugaugaagcugaauaucucuaccaucacgggauaaaaccaauauucccaaaaccauggaaaaccuucacagaagaccuucuagaucuagaacauagucuauucgugguacaucacucaccuaacaauauggcuaaacaagcccgaaaacgcauuauaacaucaacaggacaacauugggcacaaggagauucagcacacggcagcuuacacaaugacacauacuacggagcaauugaaagggauggagaaauaaaauacguggucaggagagcagucuccaguuucgaacaaaugucagacguagacucaauaguagaugauguaguaaaagaaacaguacguaaagccuuagaagguaaaaacuuuaaagaagccguaaacgcucccauauacaugaauaaagaaaaaggaguguuaauuaagaaaguaagauguuaugccaaaagcauuaagaaaccaauugacauaagaacacaucgagacagcucauccaaagaauauaaaagaaaauuccauguaucaaacgacaucaauuaccuaauagcaauauacgaagguacaguuaaaggcaaaguaaaaagagacuucgaaguaguuaaaaacauagaagcggcaaacuuuuucaaaagaucccaagauaggcgugauuacccaacgauaguaccagaaaaaucaauaaaacaugguuuuccacuaaaaacaaccuuaacgaauggcaccaugguaauauuauacgaggaaaauaaagaagaaauugacuucaccaagaaagaagauaucugcagaagacuuuauaaacugguaggaaugucaucaaugauaguuaguggaugugaauauggaguacuaucccuuagacaccaucaagaagcucgaccauccaaagauaucaaaagcaaaaauggagcauucaaaaacggagaggcccuaagacccgccauaacaauguuacacacacaauuuaaugccuuaguugaaaauauagauuucaacauagaugugacaggaaacauagaauuaauauga

SEQ ID NO: 8693 - RNA, 3669 nt, Artificial Sequence
  Cas9 variant
augaagaaacgaauacuaggucuugauagcgggacaaacucauuagguugggcaguaguagacagagaugaaaacaaccaauacagccuaauaaaauacggagaucuaauauucgaagaaggaguuaaaauagaaaaaggcguagaauccucaaaagccgcugaaagaacgucacaccgagcacucaggaaacucuacuuucgaagacgauuaagaaaaauagaagucuuaaaaguccuaguaaaauacaacuuauguccacaaguuagcgaagaagaauugcaucuuuggcauacacguaagcuauauccacaaaacaaagauuuauuacaguggcaacgaaccgacgaaaaagaaggcaaaaauccguauaucuaccguuauagaugccuacaugaagaauuagacaugagcguaucagccaauagaaugacagugggacgagccauguaucaucuagcacaacggcgaggauuucuuucgaacaggcuugauaaugaagaagacgaaaaucaaauuggugccguaaaaugcgguauuucaaacuuaaccgaggaaauacaaucaucgggauguaaauaccucggggaauauuuuuauaaacuuuacaacgagcauggaaacaccguaaggcuuagaacaagauauacaucaagagaguuccacuacaagaaagaauuuuacgccauaugcgaaaaacaaaaacucgauaagaaauuaauugaagaacuagcaucagcuuuauacuuucaaagaccccuuaaaagucaaaggcauacuguagguagaugcacauuugaacccaacaaaccacgaugugcagauucccaccccgccuaugaagaguucagaauguuaucuuuuauuaacacaauaaaaguacaaggaccauaugacacggaacucagaguacugaauacagaagaaagagacaguaucacaaaauuauuuugucgaaaaucaaaaccaaacuucgauuuugaggacauagcgaaagaacuagcaggaagaaacaacuacuguuauauuggcgacguaguagauaaagcauauaaauucaacuacagaaugagucaaggaguaucgggcugcccaacaacgaccuaucuaauaaauguguuuggucaagacuggcaaacugguauagcagaaucauaucaagcuauagauacuaaauuaggccagaaaagcguagaugcuaugauugaugauguuuggaacguccuauacucauuuaguagcaaagauaaauuaagagacuucgguagaaagaaacugcagcugggggacaaagaagccgacacauucgcaaacauuaaacuaacccacaaauucgcaucacuaucauugaaagcaauccgaaaaauuaacauauuccuucgcauggguuugguauacucacacgcggucacacuagcuaauauaccgacaauaguaggcacagacauauggcaacgaaaacguaacuucauacuagcugaauugcuaccgcuaauagaaaauuucaaucccaaggaaacuaaauuacaagaaacucucgauuuuuguguaaaagauuuucuacaaaauaacuucgaacuaaagaacggagcaguagauaaauuauaucacccaucaaugauagaagccuauccagacgcgggauuaaacucaaacggcauauuacaauuaggaucccccagaacaaacgcaauucgaaauccuauggcuaugaggucacuccaugagauaagaaaaguaauuaaccaauuacuaaaagauaagauaaucaaucaagauacagagauacacguagaguacgcaagagaauuaaacgacgcaaacaaaagaaaagcaauaucuauauggcaaaaaucucaagaaaaauuacauaagaaauacguagaagaaauuacgaauuuauacaaagaagaaacaggaaaagcaauagucccuacagacacggacauuuuaaaauucaaauuaugggaagaacaaaaccauauauguuuguauaccggacaacaaauaggaauagcugaguuccuuggagccacaccaaaauaugacauagaacauacgauaccacaaaguguaggaggugauucuacagauaugaacuuaacccuuugugacagccgguucaauagagaaauuaagaaagcacaauuaccaacacaguuagguaaucacgcagauauucuagugagaauugcaggcuggaaaaacucauaugaaaaauuauccaaagauauagaccgcauaagaacacacaguggcauggcaaaagacauaaaagauagauuaauacagaaaagacacuuacuaaaacuagaaagagauuacuggagaggaaaauacgaacgauucaccaugaaugaaauuccagaaggauuuucacgaagacaaggugucgggaucggucuaauuaguaaauacgcuggcuuauaucuaaaaucucuuuuccacgauaaaaaugaacguaauaagggacacgucuuuguugugaaaggaacuacaacagcagaauuuagaaaaauguggggauuacaaaaugaauaugagaaaaagucaagaaauaaccauguucaucacugcauugacgccauuacuauagcuugcauagggaaacaugaauacgcacaaauggcucaguacuaucacgacgaagcagaauaucuauaucaucauggaauaaaaccgaucuucccaaaaccauggaaaacauucacagaagacuuacucgaccucgaacauagucuguucgucguacaucauagcccaaacaauauggcgaaacaagcuagaaaacgaaucaucacaaguacuggucaacauugggcacagggugauagugcacauggaucguuacacaaugacaccuauuacggcgccauagaaagggauggagaaauaaaauacguugucagacgagcggucucuagcuucgaacaaaugagcgauguagacucaauaguagacgacguaguaaaagaaacaguuagaaaagcacuagaaggcaaaaauuuuaaagaagccguaaaugcacccauauacaugaacaaagaaaaaggaguguugauaaagaaaguaagauguuacgcuaaaucaauuaagaagccaauagacauucgaacacauagagacucaucgagcaaagaauacaaaagaaaguuccacguuucaaacgacauaaacuacuuaauugccaucuaugaaggaacagugaagggaaaaguaaaaagagauuuugaaguaguuaagaacauagaagcggccaacuuuuucaaaagaucacaagauagaagagacuauccaacaauaguaccagaaaaaucgauaaaacacggauucccauuaaaaacgacucucacaaauggaaccaugguaauacuuuacgaagaaaacaaagaagaaaucgacuucacaaagaaagaagauauaugcaggagauuauacaaacucguaggaaugucuucaaugauaguaucagguugcgaauauggcguacuaucucuaagacaccaucaagaggccaggccauccaaagauauaaaaucgaaaaacggagcauuuaaaaacggagaagccuuaagaccagcaauaacaaugcugcauacccaauucaaugcauuaguagaaaauauagauuuuaacauugacguuacagguaauaucgaauuaauuuga

SEQ ID NO: 8694 - RNA, 3678 nt, Artificial Sequence
  Cas9 variant
augucaaaacguauacuagggauagacguaggaaccaacagcuuaggaugggcuguuguagacagaacugacugcgacaauuacacacucguaaaaagaggagacguaaucuuccaggaaggaguaaauauugaaaaagggaauauugaaaaaucacgugcaagcgaaagaacaggccaucgaucaacaagaaaacacuacuuucgcaggagaauguugaaaauuaaaguucuagaaauacucguagaacaccaauuaugcccuuaccuaagucacgaagaacuacaccaauggaugacgcggaaagucuacccuacuaaugaagauuuccgucuuuggcuaaggaccaaugacgcaaacgaucaaaauccguaucaugauagacacgugugucuacacgaaagauuagauuuaagacuacaagaaaaccgauacagauuaggucgagcacuauaccacuuagcacagagaagaggcuuucuuaguaacagacuggaacaaaauucaaaaacugacgaaacaggagccguaaaaucagacauaagccaauuaaaugaagaaaugaagaaagccggaucacaauacuuaggagauuauuuuuauuggcuuuaccaagaauauggaaaucaagucacacuacgaauaagauauacagacagaaaacaacacuaucaaaaagaguucgaagcaauaugucaaagacaacaacuuucagacgaccuaguugacaaguuacgaagggcaauauacuuucaacguagucuaaaaucacaacgagccggagucggaaaaugcacauuugaaccagacaaaccucgaugcgcuuugucacaucccagauacgaagaauuuagaauguuaucauuucuaaacaacgucaaaguuaagggaccaucugacgauaguuuaagaccauuaucacccagcgaaaaagagaaaaucaaacccuuauuccucagaaaaucaaaagcaaauuucgauuucgaagacauagccaaagcaauugccggaaaaggcaaauacgcaugcauuagagauaaagaaggugcucaaaaaccauaucaauuuaacuacgcauuaucccaaggagucagcgguuguccuguaacagccaaacuaauagcugucuuuggggaaucuugggaaagaaaccuugugaaugccuacagaucacgcaaugauaugcgcaaaucagacgaagaaauaguaaaugaaguauggaauguauuguauuccuuuaguucgaaagaaaaacuaagagcgugggguauggaaaaauuaggguuagaugaagcaugugcuggugaguucgcagacaucacauugcccacagcauuugcugcauuaucacuaaaagccguaaauaaaauucugccauuuuugagacaaggauucaucuacucccacgcgguaaugcuagcaaauauuccuuauauaauagggauggauagauggaacgaaccccgccaacgacaauucauuauggauaaccuacaagaacuacuagacaacuucacggccucagacaaagcgcuccaacaaacacuugauuuuuguauaaaagauuucuuacugaacaauuaugaacuagcaccaggaaaggcagauagacuauaccaccccaguaugauagaaacauauccagacgcgaaagcagacggacaaggaauauaucaauuaggaagcccagcaaccaacgcaauaagaaauccuauggcgaugagaagccuucauaucuuacgccgggucguaaaccaacuccuaaaagagaaaacaauagauucagaaacagaaguccauauagaauaugcacgagaauuaaacgacgcaaaucgccgaugggcaauaaaucaauggcaaaggaaacaagaaacacaacgaaaagacuaugcagagaaaaucagaaaagucuaugccgacgaguucgaaaaaguaauugaaccaacacaagaagaacuuuuaaaauaucagcucugggaggaacaacaacaucuuuguuuauacacaggagaacaaaucggacuuacagauuuuauaggaccgaacccaagauaugauauagaacauacuauaccacaaucaauggguggggauucaacaaggaugaacuuaacauuaugcgaaagaacauauaacaggacaguuaaaggcaaccgaaugccgucucaauuagcagaacaugaaucaauauuaacuagaauaaagccauggaaggauaaguaugaagaacuaaccguaaaaauaaauaaacuaagaacucauccuggaauggacaaagcuaguaaagauaacauaauaagaaaaaggcauuuacuagaacucgaaagagauuacugguuucaaaaguaccaaagauuuacaaugaccgaaguuccagaaggauucucacuaagacaaggaacaggaauaggacuuauaggaaaauacgcaggucuuuuucuaaaaucacucuuccaucaugucaaggaaagaaacaggaagcaaguauacguaauaaaaggaccaauaaccgcugaguuccguagauuauggggauuacaaaauuuauaugaacaaaagucucgagauaaccaugcacaucacuguauagacgcuauuguaauagcaugcaucaauccggccgaauacgccagaauggcaucuuauuaucgacaagaagaagacuuucgccugaacaagggaaauaaaccgguauucccgaaaccuuggacaacguuuacccaagaucuacaggcauuagaagcagaacuguuaguuguucaugaaacaagaaacaaucuuacaaagaaagcacgaaaacgaguaagaaccaaagguggaaauguucuuucagaaucggauucugccagaggcagcuuacauaaugacacuuauuauggagcuauacaaaaagauggaguuauucgguacguaguaagaaaagcccuaaguucauuaucugaaaaagacguaaaagauauaguugacaaaaccgucagagaaaagguacaagcugcuauucaagaaaaaggagcuaaagaagcauuagcaggaacaaucuacaugaacgaagaaaagggcaucaccauaaagaaagugagauguuuuacgaaaauagcuagcccucuagcuauacgccgucaucgggacgcgucagccaaagaauauaaaagaccauauuauguuaccaacgaaaguaacuacguaaugggaauauacgaaggaugcauaaaagagaaaacaaaaagagaguucauccuaguaaacaacuuagaagcuguacgacagcucaaagcagcgagaaaacaaggaguagucucuucgauauuaccaccaguaucagcaaaaucucaguucccucuuaaauauagguuauauacaggaacguuggucuuauuauaugaaaacagcccagaagaaauagacuuuaccaaucaaguggacauaugcaaacguuuauacaaaguaacaggucucagcuccaugacagucacagguaaccaauacggaacaauccaauuaagauaccaccaagaagcaagacaagcaaaagaucuaaaagcucaaaauggcgcauauaaagaaggcgaagaacaccgacccgcaauaaugaugcuccauacacaauucaaagcguuaguagaaggaacggauuuuagaaugaauaucuugggagaaauagaaccccuacgcaaauga

SEQ ID NO: 8695 - RNA, 3690 nt, Artificial Sequence
  Cas9 variant
augggagacagaaaauauaacuuaggauuagauauaggaacaucaagcauuggauuugcagccguagaugaaaauaaccaacccauucgugucaaaggaaaaacugcuauaggaguaaggcuuuucgaagaaggaaaaaccgcagccgauagacguggauuuagaacaacgcgaagacgauuaucuagaagacgauggagaauaaaucuauuaaacgaaaucuuugaugcacaucuagcagagguagaccccacauuccuagcaagauuaaaagaaagcaauagaagcaaccuugacccaaaaaaaucauuucaaggcagucuauuauucccagagcgaaaagacuaccaauuuuaugaagaauauccaacaauauaccaccuuagaaaagcccucauggaaaaagaucgcaaauuugauauaagagaaauauaucuagcaguccaccauaucauaaaauaucgaggaaacuuccuuaauggaacaccgaugagaucauuuaaagucgaaaacauagaacugaauacacucuuugaccaacuaaaucaacuauaugccgaaauaguuccagauaacgagcucgcauuugaccuugcucaaguagccgacguaaaagacguacugagcucuaccacaauauacaaaauggauaaaaaaaaacaguuaguaaaaaugauguuacuccccgcaagcaauaaagcacugcagagugaaaacaaaaaaauaguaacacaauuugugaacgcaauucucaauuauaaguucaaauuagacguacuccuacaaguugagacagaugcagauuggucacuaaaauugaaugaugaaggagcugaugauaaauuagaagaauuuacuggagacuuagacgaaaacagacuagaaauaaucgaucuccugcaaagauuacauaauugguucagccuaaaugaaauaaccaaagacggaaacucacuaucagccgcgaugguagaaaaauacgaaaaucaccaccaccaucucggacuuuugaaaaaagugauagaaaaucacccagaugccaaaaaagcaaaagcacugaaagaaacuuauacagcauacguaggcaagaccgacgauaaaacacaaaaucaagacgauuuuuauaaagcaguugaaaaaaaccuggacgauuccccagaugcaaaaggaauaaaaagauuaauacaacucgaucaauuuaugccaaaacagagaacuggacaaaauggagcaaucccacaucaacugcaccaacaagagcuugaucaaauaauagaaaaacaaagcaaauauuaccccuuccucgcagaacccaauccaaauguuaaaagacgaaaagaugcaccauacaaauuagacgaacucauugcauuuaaaauaccuuauuacguagguccccucguaaccccagaagaacaagcucaaaauaaagaaaauguuuuugccuggaugaaacgcaaagcagccgguccuauaaccccauggaacuuugaugaaaaaguagauagaauggaauccgcaaaucgcuuuaucaggagaaugacaacaaaagacacauauuuauucggagaagauguacuuccugcagaaagcaugauauaucaaaaauucguaguacuaaaugaauuaaauaauuuaaaaauaaaugggaggcauuuaucucuaaaagacaaacaagacguuuauaaugaccuguuuaaacagcaaaaaacagucuccauuaaggcccuacaaaacuauuacguaacaaaaaagaaggccgccacggcaccuacuguaggagguuuagcagacccuaagaaauuccuaucuucucucuccacguacaucgauuuuaaaaauauguuuggagaacgaguaaacgacccccaauuccaagaagaccuagaacaaauuguggaaugguccacuauauucgaggauagagguauauuuaaggccaaacugcaagcacugggauggcucagcgaaaaacaaauucaacaacuuguagcaaaacguuauaaaggcuggggaagacuaagcaaaaaacuacuaacaggccucaaaaaugcggaaggauacuccauuuuagacgaaauguggagaucaacugaaaauuucaugcaaauucaaucacgaccugaauucgcagcuuuaauacaacaggccaaugaaaaacaauucgaggggaacgauccugacaauguaugggagaauauagaaaauauacuaggugaugcauauacaucaccucaaaauaaaaaagcaaucagacaaguagucaaagugguacaagacauugaaaaagcagucggaaacccaccugaaaaaauugccauagaauucaccagagaagccgcugcaaauccacaaagaacacaaagcaggcuacgaacacuagaaaaacuauacgaaagugcagaagaagucguagaugccggcuugaccgccgaauuagcagaauuuaaggaaaacaaacauguacucucggauaaauauuaccuguacuuuacccagcuagguagagacguuuauacaggagauacaauaagucuugacaaauuaaaugacuaugaugucgaccauauacucccacaaucuuuuauaaaagaugauucauuagauaacagaguccuaacuauuagggcuguaaauaacggaaaaagcgacaauguaccagcaaaaauguuuggaaagaaaaugggaucauucuggagacacuuguuagauaauggaaugauauccaaaagaaaauacaacaacuuaauaacagauccagacaauauauccaaauacgcacaaaaaggauuuauaaauagacaauuaguagaaacaucucaaguuaucaaacucacagcaaauaucuuaaacgggauauaugacaaagauacggaaauaaucgaaguuccagcaaaaaugaacagccaaaugagaaaaauguucgaccuaguaaaaguacgcgaggucaacgacuaccaucaugcauucgaugccuauuuaacaaucuucauuggaaauuaccuuuacaaauguuacccuaaacuccgaccguauuucguguaugacaacuuuaaaaaauuugggaacaaagaagacauaggacacaagagauuuaauuuccuagguaagauagaaagagaaaaaaaagucguagcuccagaaaccggugaaauccucuggaguaacguagcaccaaaugaaacgauuaaacaaauuaaaaaagucuauaacuacaaauuuaugauagucucccgcgaaauaacgacaagaagagcggaacuuuucaaccaaacaguuuauccaaaaaacuaucguggcaaauuaauaccaauaaaagaagauagaccaacagaucuuuacggcggauacagcggaaauacagaugcguaucuagccauaguugcauuagaagacaaaaagaaaggaaaauauuucaaaguaguggguauaccaacaagagccgcagccaaauuagaaaaacuaaaacaacaagacagccaacaauaucuucaagcacuccacgaaguaauagcuccacaauucacaaaaaguaccaaaaaagguauaaaaaaaaccgaauucgaaauaguacuagacaaaguacacuaucgccaauugguacaagacgguccuguaaaaaugauguuaggaucaucaacauauaaauauaacgcaaaacaacuugugcuauccgaaaaagcucuuuga

SEQ ID NO: 8696 - RNA, 3696 nt, Artificial Sequence
  Cas9 variant
augauaacuagaauuuuaggacuugauacugguacuaacucuuuagcgugggcaguaguagacagagaugcaaauggaaauuauacauuaguaaaaaggggagauguaauauucacugaagggguuaaaauagaaaaaggaaucgaaucaagcaaagcagcagaaaggacagcgcauaaagcauuacgcguacacuauaguaggagacguuuacacaaaaucgauacccucaaaguacuuguagaauuagauuuaugcccauaccuaucuaaugaacaacuaaauuuauggaaagcuaagaaaacauauccccuaacagacgacuuuaugcuguggcaacgaucuggcagugcugaagaaaauaacccuuacuacugucgacacagauguuugacccaaaaacuggauuuaacagaccaaagucaaagauucuugcuaggacgcgccuuuuaucaucuagcucaaagaaggggguuucuuucaaauagauuagauacaucugccgauucugaugaaucaggcaaaguuaaaucuggaauagcagaacuauccguagaaauggaaaaagcaggaugcgaauuucuaggagaauauuucuaucaguuauacaaacaacacggaaauacuauaaaacuacgcucuagauacacugacagggaagaacacuacaagaaagaauuuuuagcuauaugcgaaaaacaagaauuggacccaaaauggguagaagcacuacaacgggccaucuacuuccaacgaccucuaaaaagccaaagaaaaggaguaggaaaaugcacuuuugaaccuaagaaacccaggugugcagaaucacacccagauuaugaagcauucaggaugcuaugcuucuuaaacaacgugaaaauucaaacacccaaugacacgagcuuacgacccuuaaaugaagacgaaagagagaaaauuuggccauuauuuuuccgaaaaucgaaaccaaauuucgauuucgaagauauagcaaaagcccuagcaggcaaaaauaauuacgccugguacaaagaugccggugaaaaaccauucaaauuuaacuauagaaugcaacaagguguaucaggauguccaguaacagcacaacuaauagauauuuuuggaucagacuggcaaacugcgauugcagaaacguacacagcaguagagaagaaaaaugguacaaaaaccauagaugaaauggcagaugacguauggaacguauuauauucauucagcucaaaagacaaauuaaaggcuuucgcaacugaaaaacuacaauuagaugaagcaagcgcuacaaaauuugcuaaugcuaaacucccacauggcuucgcuagucuaagucucaaagcuauacggaauaucuuacccuuuuuaagacaaggauucauauaugcucaugccguacaucuagcuaaaauaccugauauuguaacaaaagcuguuuggaacgacgcagauaaaagagaaaugauccuaucagguuugauggaaauaauagaaaauuauaaucccaaagauagaggaguugaagguacaauagauuucuguauuaaaagucaucuacaagauguaauugaccugcgcccuggagcagcagacgcacuauaucauccuucaaugauagaaacauacccggaugcaaaauugaacaaaauggguguuuuucaacuagguagcccuagaacaaaugcaauacgaaacccaauggcaaugagaucucugcauauucuacgaucaguaguaaaccagcuuuugagagacggaauaaucgacagaaacacugaagugcauguagaauaugcgagagaacuaaaugaugcgaacaaaagaaaagcaauagcagauuaucaacgcgaacaagagaagaaacgaaaacaauauagggaugauauaauagcacuuuauaaaagcgaaugucacaaagaaauagaacccacggacaccgacaucuuaaaauuucaauuaugggaagaacaagaccaccuguguuuauacacagguacacaaauaggaaucugcgacuuucugggggauaauccaaaauucgauauugaacacacaguaccuagaagugucggcggagauaguacgcaaaugaacuuaacacuaugcgaugcaacguucaauagacaaguaaaaggggcacaauuaccaagucaacuaucaaaucacgccgauauacucguaagaauugaucacuggaaaaguaaaugugaagaucugcgaaaacaauuagacaaaauacgcacauacggagguauggaaaaagcaaugaaagaccgauugauucaaaaacgacauagauuaaaaauggauuuggacuacuggcaagggaaauauagucgauuuacuaugaccgaaguaccagaagguuuuagcagaaggcaaggugcuggaauaggauuaguauccaaauaugcaggcuuauuuuuaaaaucacuuuuccauaacgaacagaaucccaacaaaucuaacguuuauguagugaaaggaguaacaacagcagaauuuagacguauguggggcuugcaaggagaauacgagaagaaaagucgacuuaaccacugucaucacuguauagacgcaauaacaauagcaugcauagguaaagcugaauaugacaaaauggcacaauauuaccaugacgaagaguuauuccaauggagaggcacaaccacaaaaccacauuuuaauaaaccuuggccuacguuuaccgaagaugucuuagcaauagaacagucacuauuaguaaaacaucuaacaaaggacaacaugccgaaacaagcaaagaaaaggguaagaacagcaaccggaaaauaccuggcucaaggugauacggcacgaggaucacuacauaaagacaccuacuacggugcaauagaacaagauggagaaauacgauacguacuaaggaaaccacuaaacaaauucgagaaugaagcagaauuagagaaaauuguagaccaagcgguaaaagagaaaauuaaagaagccauagcagggaaaaauuuuaaaacagcaauaacagagccaauauuuaugaauaaagagaaaggaauccguauaaacaaaguccgauauuaugucaaagcccaagaaagacucaaaauaagacaacaacgugaccuaucaaguaaagaauacaaacaauucuuuugcguagaaaaugaaagcaacuauuuguuagcaauauacgagggagaauuaaaaggaaagaaagagagagauuuuugugugguaaacaaucuggagucagcggcauguuuaaaaagaaguaauaaagguaaagcagcuccacuuguuccagaaagaagugaagaaaggaauuuaccacuauuagcgguauuaaaaagaggcacacaaguacuauuuuaugaaaacuccccagaggaaaucuuguuugacaauccacaagacuuaguaagaagacuauacaaagucacagguauaaacacuaagaaagaugucaaaaaugguaaaacauauuuauacgggaauauagaguuaagauuccaucaaaaugcucaaaagaaagaugacgucaaaaugcaaaguggcguauacaaaaauaaugaaguguuacgacaaggaauaguauuaagucauaaacaguuuaaagcucuaguagaaggaguugacuucgaguucaacguauuaggagaaaucaaaaagaaagaaaggcaugcauga

SEQ ID NO: 8697 - RNA, 3699 nt, Artificial Sequence
  Cas9 variant
augacaaaaacacgaauacuuggacuggauacaggaacaaauagucuaggaugggcaauaguagaccgugacgaaguuucaggccaauaugagcuaguagacagaggagacuuaauauuuacagaagguguaaaaauagaaaaaggaauagaaucuuccaaagcaagcgaaagaacacaacacagagcacuacgaaagcaauauuucaggcgacgacuacgaaaaauagaaguacucagaguuuuaacauucuaccauuuaugucccccaguuucagaagaagaacuacauuuauggcacguaaagaaaauauacccgguugaaaaucacgaauuuaugauauggcaacguacuaacgacaaugaagguaaaaacccguauuauuacagacacauuugucuccacacaaaauuaaacuugacgcuaaugaaagauagauauauacuuggcagagcucuauaucaccuuucucaaaggagaggcuuccuaucuaacagacuagaccagucacaagacgaggaugacaaaggcacaguaaaaacuggaaucagcuccuuaaguaaagauaugaaugacgcgggauguacauaccuaggagacuauuuuuauaaacuauacucagaaaaugguaaucgaguaagaauaagaaaccacuacaccgcacgaaaugagcauuaucuagccgaauuugaagcaaucugccaaguucaaaaauuagaacccgaauuaguagaagcccuucgcagagcaauauuuuuccagcgaccgcuuaaaucacaaagaaaaggaguaggaaaaugcacauuugaaccacgaaaaccccgaugugcagacagccauccggauuacgaagaauuuagaaaauuauguuuuauuaacaacauuaaaauccaaacaucagaugacgacacaaugagaccacugaacaaggaggaacggcaacgaaucaacagucuguuuuacaggguaucaaaagcaaauuuuuauuuugaagaaaucgcaaaauuauuaggcggccgaaacaacuacuguuauuucaaagacgaaguacaaaaagacuuuaaauuuaauuaccgaaugucacaaagcguaagcgggugcccaacgacagcucaauuaagaaauaucuucggagaagacuggaaaaccggcaucgcagaaacauaucaacacucagcaaagaaagacggaucccucaaaacagucgaugaaauggcggaugacauuuggaacguacuguauucauucucuucaaaagauugcuuguauaauuucgcaguaaauaaacuacagcuagaagaagacaaagcaaagaaauucagcaaaauuaaauuaucacauggguuugcaucaauaagccuaaacgcaauacacaaaauauuaccguuucuaaggauggguaugauauauucucaugcuguccuuuuugccaacauuccuaccauaguaggaauggauguauggaaugaugaaucaaaacgacaacacauuaugacugaguugagcgauuuaguauuuaauuaugaucccaaaaauagagaagucgaagguacaauagaaaugugcaucaaagacuuuuugcuaaauaacuacgauuuaccagccggcgcuguaugccgauuauaucacccauccaugauagacacauacccagacgcuaaagcaaauaaauauggcguauuacaauuaggaucacccgcaacaaaugccauaagaaauccaauggcaaugagaucguuacacgaauuaagacacguaguaaaccucuuacuaagaaaaggaaaaauagaucaaaauaccgaaguacacgucgaauaugcuagagaguuaaaugaugcuaauaagcgaaaagcaauagcugacagacaacgcgagcuagacaaacuacacaagaaauaccaugaugauauuauaacacucuauaaagaagaaaccggaaaagacauaaauccgacacaagcagacauauuaaaauuccaacuaugggaagaacaagaacauguaugcuuauacacaggacggcagauuggcaucaguaaauuuuuagguccagacccagaguucgauauugaacauacgguaccaagaucaguuggcggggacagcacacagaugaauaugacucuaugugacaggcguuuuaacagagacguaaagaaagcaauguuaccaagccaacuaccuaacuaucaagaaauccucccacggauagaaaaauggaaaaagaaauacgaaaaacucacuaaagauauagaucauuguauaacacauucaggaaugacaaaagaagcuaaagauagcauuauacagaaaagacacaggcuuaccuuagaacacgacuacuggcguaacaaauacagcagauucaccaugacagaaguuccagaagguuucagcagaagacaaggagcaggaauuggauugguuuccaaauaugcaggauuguucuuaaaaucacuauuccacgauccaaccgacagaagacgaucacaugucuauguaguaaaaggaacgacuacagcagaguucagaaaaauguggggauugcaaagcgaauacgaaaagaaaaguagagauaaccacguacaucauugcguagacgcuauaacaauagcuuguauagggaaaaaugaauauaauaaaauggcaaguuuuuaucacgaugaagaagccuucgaaagaggagaaugugagaaaccucacuuugauaaaccauggcccacguucacacaagauguucuuggauuagaaaaacgauuaaucguaguacacaguacacaagacaacaugccaaaacaugccaagaaauacguaagaacaccacgaggaaaauuuauagcaaaaggagacugcgccagaggcagcuuacaccuugauaccuauuacggagcaauaaaacauaaagaugauacagaaccgagauacguuuugagacgcgaauuaucaucuuuugacuccguaaaugaucuagacauaauagucgacgaugcgguacgcgagaaaauaaaggaagcaguaaaaggaaaaucaggaaaagcauucaaagaagcacuagcaaauguauauaugaauaaagaaaaagauauaagaauaaagaaaguaagauguuacgucccaaguguaaaacgaccaauugacauacgacaccaaagagacaugucgcgauuugacuauaaacgacaauuccacguagccaaugacggaaacuacaugauggcaauauaugaaggagucgucaaaggaaaacugaagcgagauuucgagcuugucaaaaauauugaagcggcgucauauuuuaagguaagccaggacaacgaaucauuuaguucaauuguaccagagaaaucaucaaacggauuccccuuaaaagcaguacuaaaaauaggaacacauguacuauuguaugaaaacacugcuucagaaauagacuucucugauccaguagauuuaacucggagauuauauaaagugguaggacuaagcucagcuaucauaaauaacugcucauauggauuuaucacuuuaagguuucaccaagaagccaggcaagcgaagaacuuaaaauugacgaaaggaguauuuaaaaauguagacaauuauagaggagcaauuauacuuuaccauacucaauuaaaagcacucguugaaggauaugacuucgacauaaacauacucggagaaauaacaucaaaacaauga

SEQ ID NO: 8698 - RNA, 3705 nt, Artificial Sequence
  Cas9 variant
augccaaacuuuuggagcaucuuuacugaaaaccuacaaacauaccuuaugaaaacucguauacuuggacuugacacagguacaaauucacuaggcugggcaguaguagaucgcgacgaaaacaaccaauauacaccuaucugcagaggagaucucauauuuacugaagguguaaaacaagaaaaagguauagaguucucgcuugcagcagaaagaaccucuuaccgagcaaguaggagacauuauuuuagaagaagacugagaaaaguagaaguauugaaagugcuaguaaaacauaaacuaugcccaccauuguccgaugaagcacucaauagauggcacaccaagaaagaauacccacuggaugaagauuucauauuauggcaaagaacaaacgaggcagacaacaaaaacccauaucacgauagacauauuuguuuacacaggaaacuuaaucuuaaagauagccaaaccgauagguauacauuagguagagcucuguaucacuuaacacaaagacguggguuucuaagcaacagauuagaccagaacgaagaagccgaagaaacaggaaaaguaaaaagugcaauaucagaauuaucaaaagaaaugaaagaagccgguugcgaauuuuugggagauuauuucuaucuauuauauaggacagaaggcaaucgaguacgaauuagaucacgauauacagaccgagaaaaacacuacuuacaagaguucaaggaaaucuguagaguacaagaacuggacgaagacuuagccaaagcccuggagaaaacuauauucuuccaacgaccccuaaaaagucaaagacaaggcguuggaaaaugcaccauggaaaaaggacauucucguugugcuguaucacauccucucuaugaagaauacagauuauuaugcuaccuaaacaauauaagaauaaaaacaccaagcgacgacaggcuacguccucuaaaugcagaggaacgggagaaaauaaccccuuuauucuacaaagagaaaaauuuugacuuugagaaaauugcuaaaaagcuggccggaaaaacacccuucgguuggaucagggacgcugaagacuggcccuaucaguuuaauuacagaaugacacaagaagcuccugcuuguccaacuacagcacaguuaauaaaggucuucggagaagauuggaaagcugcacucgcagaaacguacacaauguccgcaaaacaagauggaacccugaaaaccgaagaugaaauuuguacagacauauggaauguuuuauacuccuuuaguaguaaagaaaaacucaaagaguucggacuaaagaaauuacaauuggacgaaguacaagcaaaagcauuuagugaaauacguuuaacaagagauuucgcuagcuuaucacuaaaagcgauaagaaaaauacucuucuuuuuaagaacaggagaagauuauagcaaagcaaucuuuuuagcuaauauaccaaccaucgucggugaagaaauauggaaugauaucgaaagacguagcaggcuccuauacaaaguagaucuugcauuaagaccgcaggaagaaagagaugcggaagaacaucgaacaauugcagaacgaaucaaagcagcgguagcagcggaaguaccagacgcacccauugaccucuuauaccacccaaguaugaucgaggcuuauccagaugcaaaaagaaaugaacguuuugacugcuaucaacuaggaucaccaaaaacaaaugcaguuagaaaucccauggccaugagaucacuucauaugguuagaaaaguaauaaaucauuuguuaagaaaacacauuaucgaugagaaaacagaaauacacauugaauaugcuagagaacuaaacgacgcaaacaagagacaagcuaucgccgacuggcaaagggaacuaagcaaacgacauacagcauaugcacaaaacaucagacaauuauauaaagcagaaacaggauuaguaauagaaccaacuaaagcagacauacuuaaauaucaacuaugggaagaacaacaacauguaugucuauauacagguaagaaaaucggcaucgccgacuuucucggagccaauccaaaauuugauauagaacacaccauaccuagaucuagaggaggagacuccacacaagaaaauuuaacacucugugaauccaaauuuaacagggauauaaaaagagauaaacuuccgacggaacuggcaaauuaugaagaaauucuggcaagaaucgaacauuggaaaaagcaauguuaugccuugaaacuuaaacgagaugguauaaggacucacucaggauuagaaaaaucaauaaaagacaguagaauuagaagacgacacuuaguagguuuagaauaugguuauuuaaaggguaaauacgaccgcuuuacuaugaaggaaguaccugaaggauuuagccgaagacaaggcgccgguauaggcuuaauaagcaaguacgcuggauuauuucuaaaaucccuauuuaaagaccccaaaaauccaaacagaaguaacgucuauguaguaaaaggcgcaauaacugcugaauuuagaaaauuauggggacuucagcaagcagaugaagcuaaaagccgagaaaaccacacacaccacugcauagacgcauauacgauagcauguauaggaccgugugaauacgcagcacuagcagccuacuaucgaagugacgaagaguucaaguacggaagaagacgggaaaaaccacaauucgaaaaaccauggccaaccuuuaccgaagaucuauuaaaauuacaagaagaauuauuaauaguacaucaaacgacagacaaauuagggaaaagagaucgaagaaagguuaaaacuccaagaggaaaauuucuuacaggcggagacagcgcaagaggcagacuacaccaagaaacauacuacggagcaauaaacuacgacggcaauauaaaauaugugguucgcaagccacuagauucucuaacugaaaaagaucucgacaagauuguagaugaaacaguaauggguauaguuaagggagcaguagaagcaaaaggaucacuaaaggaagcacuagcggaugguauauauaugaacaaagaaaaaggaauacuaauuaaaagaguacguauauuuagugauguaagugaaccuauaaaccuaaaacaauuaagagacgucucuacuaaagaauacaaaagacauauccauuuacgaaaagacgaaaauuaucucuucgcaauauaugaaggaauagauaaaaagaaaaacaagaaacaaacagaaacggcuacgguagacuacuuggacgcagcaaaauucuauaaagauucaaaacgacgcgauaaagccaacucccuaguuggagacuauagcaagaaaaacaaacuaccguuaaaauguauauuaaagaagcgacaaaugguacuuuucuacgaacacucaccagaagaaauaagguuuaaagauaagaaagacuugaguagacgcuuauacauagugaccucaauagcaaaagacggccggguaaaauuucuacaccaucaagcugcaacagcgaccggcauucaaagcaguccaucgccauucacuaaugauggagaacaccaaccauacuacagacuaucagcuucuaacauaaaaguacuuguagcaggaauagauuucgauauuaacauacuaggagaaauaacacccaaacuauga

SEQ ID NO: 8699 - RNA, 3711 nt, Artificial Sequence
  Cas9 variant
auguauuuuuacaagaacaaagaaaacaaguuaaacaaaaaggucguacucgguuuagaccuagguauugccagcguuggcuggugucucacagauauaucacaaaaagaagacaacaaauucccaauaauacugcacggcgucaggcucuucgaaacuguagacgacagcgaugacaaacuccuaaaugagacucgccgcaaaaaaagaggacaacgaagacgaaaucgccgacucuucacacguaaaagagauuucauaaaguauuuaauagauaauaacaucauagaacuagaauucgacaaaaaucccaaaauacuaguacgaaacuucaucgagaaauauauaaauccauucaguaagaacuuagaacuuaaguacaaaucagucacaaaccuaccaauaggcuuccauaacuuaagaaaggccgccauaaaugaaaaauacaaacucgacaaaucagaauuaauaguacuccucuacuuuuaccucagccuaagaggggcauuuuuugacaacccagaagacacaaaauccaaggaaaugaacaaaaacgaaauagagaucuucgauaaaaacgaaucaauaaaaaacgccgaauucccuauugacaaaauaauagaauucuacaaaauaucaggcaaaauacgcaguacaauaaaucuuaaauucggacaccaggauuaccucaaagaaauuaagcaaguauuugaaaaacaaaauaucgacuuuaugaacuacgaaaaauuugcaauggaagaaaaauccuuuuucucacgaauaagaaacuacucagaagggcccggaaaugaaaaaagcuucagcaaauacggacucuacgcaaacgagaauggaaacccagaacucauaauaaacgaaaaaggacaaaaaaucuauacgaaaauauucaagacuuuaugggaaagcaagauaggaaagugcaguuaugauaaaaaacuguaccgagcgcccaaaaacucuuucucagcaaaaguauucgacauaacaaauaagcucaccgacuggaaacacaaaaaugaauauauaucagaaagacuaaaacguaaaauacuacuuucccgcuucuuaaauaaagacagcaaaagcgcuguagaaaaaauacuaaaagaagaaaauauuaaauuugaaaaucuuucagaaaucgcauacaacaaagaugauaacaaaauuaaccucccaauaaucaacgcauaucacucccuaacaacaauauuuaaaaaacaccuaaucaacuuugaaaauuaccuaaucuccaaugaaaacgaucuuucaaaauuaaugucuuuuuauaaacagcaauccgaaaaacuguuuguaccaaacgaaaaaggaucauacgaaauuaaucaaaauaauaauguauuacacauauucgaugccauuagcaacauacuaaacaaauucagcaccauacaagacagaauucgaauccuagaaggauacuucgaauuuucaaaucuaaaaaaagauguaaaaagcucagaaaucuacucagaaauagcaaaauuaagggaauucagcggcaccucaagcuuaagcuucggcgcuuauuauaaguucauaccuaaccuaauuuccgaaggcucuaaaaauuauucuacgauuucauaugaagagaaagccuuacaaaaucaaaaaaacaauuucucccacagcaauuuauuugagaaaacgugggucgaagacuugaucgccuccccuaccguuaaacgcucauuacgacagacaaugaauuugcuaaaagaaauauucaaauacucagaaaagaauaaccuagaaauugaaaaaauaguagucgaggucaccagaucaucaaacaauaaacacgaaagaaaaaaaauagaaggaauaaauaaauacagaaaagaaaaauacgaagaacuaaaaaaaguguaugaccucccaaaugaaaauacgacacuacuaaaaaaacucuggcuccuaagacagcaacaagguuacgacgcauauucacuccgaaagaucgaagcaaaugauguaauaaacaaaccauggaacuaugacaucgaccauauaguuccuagaagcauuucauucgacgauucauucaguaaccuagucauaguaaauaaacuagacaaugcaaaaaaaucuaacgacuuaagcgcuaaacaguucauagaaaagaucuaugguauagaaaaauuaaaagaagcaaaagaaaacugggguaacugguacuuaagaaacgccaauggaaaagcauucaaugauaaagggaaguucauaaaacuuuacacaaucgacaacuuagaugaauucgacaauagugauuucauaaacagaaauuuaucugauacgaguuauauaaccaacgcuuuaguaaaccaccucacguuuagcaacaguaaauacaaauauucaguagugucuguaaacggcaaacagaccucgaacuuaagaaaccagaucgcauucguaggaauaaaaaacaauaaagaaacagaaagggaauggaagcgacccgaaggguucaaaucuauaaacuccaacgacuuccuaauaagagaagaaggcaaaaacgauguaaaagacgauguacucaucaaagauagauccuucaacggacaccaugccgaggacgccuacuuuauaaccauaauaucacaauacuucagaagcuuuaaacgaauugaacggcugaacgucaacuauagaaaagaaacuagggaacuagaugaccuagaaaagaacaacauaaaguucaaagaaaaagcaucauucgacaacuucuugcuuauaaaugcauuagacgaauuaaacgagaaauuaaaccaaaugcgcuucucucgaaugguuauaacaaaaaaaaauacccagcuauucaacgagacucuauacaguggaaaauacgauaaaggcaaaaauaccaucaaaaaaguugaaaaacuaaaucuacuagacaacagaacagauaaaaucaaaaaaaucgaagaauuuuucgacgaagauaaacuaaaagaaaaugagcuuacaaaacuucauauauucaaccaugacaaaaaccucuacgaaacacuaaaaauaauauggaaugaggugaaaauagaaauaaaaaauaaaaacuuaaaugaaaaaaacuacuuuaaauacuuugucaacaaaaaacugcaagaaggcaaaauaucauucaacgaauggguaccaauauuagauaacgacuuuaaaauaauaagaaaaauaagauacauaaaauucuccucagaagaaaaagaaaccgaugaaauaaucuucucccaaucaaacuuuuugaaaauagaucaacgccaaaauuuuagcuuccauaacacucuauacuggguacaaauauggguauacaaaaaucagaaagaucaguacugcuucauaucaauagaugcacgcaacucgaaauucgagaaagaugaaauaaaaauaaacuaugaaaaacuaaaaacacaaaaagaaaaauuacaaauaauaaacgaagaaccaauauuaaaaauaaacaaaggugaccuauuugaaaacgaagaaaaagaacuuuucuauauagucggacgagacgaaaaaccccaaaaacuugaaauuaaauacauacuugguaaaaaaaucaaagaccagaaacaaauacaaaaaccuguaaagaaauacuuuccaaauuggaaaaaaguaaaucucacuuauaugggagaaauauucaaaaaauga

SEQ ID NO: 8700 - RNA, 3717 nt, Artificial Sequence
  Cas9 variant
augacaaaaguauuagguuuagaccuaggugcugcuagcguaggcugggccaugauagaagaagaagaaaaaucccauaaaauauuaggacuaggaucgcguauuaucccuuaugaaggaacagagggaaaugacuucgcaaaagguaccggggaaaguagaaaugccuuacgaacaaaagcccgaacagcgaggaaaggauaugaccgauaccaauuaagaagaaaauaucucguugauacucuagugaaaaaugaaaugaugccagacgaauaucuuagaaaauuacccaaaaugcaauuaugggaacuucgauccaaagccguuacaacggaaauuacaaaacaagaacuaggccgauuguucuuaugguuaaaccagaaaagaggauacaaaagcagccgaucugacgccaaccuagauaagaaagauaccgaauauguaguagaagucaaaaguagacacgagaaaauaaaagaaaguggguucacaauuggccaauauuucuauucagaacuaaaauccaacgaauacuucagagucaaagaaaauaucuuccccagagaagccuacauagaagaauuugacgcuauuuguaaacaacagaaaagacacuuaacggauaaacucauauccagaauacgaaacgaaauuauauauuaucaacgaccauuaaaaucccaaaaaggauuaguaucaguauguagauuugaaggauucuucaagaaaggcauaaacggcaaagaauauuuuguaggaccaaaaguggcgccuaaaucaagcccacuguuucaaaccguaaaaauaugggaaaauauaaacagcaucaggcucagcgauagaaaugguaaagaaauaauguuaucauuagaacaaaagaaaugcauauucaaucaccuugauaacaaugagaaacuaacaccaaaagaucuauuuauaauaauaggagugaagaaagaaaacuguuucguaaauaaacaauuagagaaaggaauacaaggaaaugucacaaaaucuacaauauuaaaaugcuuuggagagaacaaugauuaugauaaauggcuaaaguuagaccuaaauauaauuguuaaaaaggacacauuuggcuaucuguacgacaagaaaacaggggagaucauaggcgaaaaacuuauuaaacauguagauucagcgguagaacgcgaacccuuauaccaauuauggcacaccauauauaguauaaacaacacugaugaauguucugcagcauuacaaaacaaauuuggcuucgauucagaaacugcagacaaacuaagcaauauagacuucggcaaagcaggauucggcaacaaaagcgcaaaagucauuagaaagauccuuccauaucuuauggaaggcgaugauuauagucaaaguaugucauaugcaggcuuuaaucauagugacagucugacaaaagaugaaaaucuaaaaagaaaauuacuugacaagcuaagaccgauugagaaaaauagccucagacaacccauaguagagaaaauucuaaaucaaaugguaaauguaguaaacgcaaucauagacaaauaugguaagccagacgaaauaagaaucgaacuagcccgagaacuaaaacaaaacaaagaagaaaggaacaagaccgacaaagauaugucaaaaaggcaaagagaaaauggugaaauaucgaaaagauuagcagaauauggguuacgcgcaacuaggaacaauauaauaaaauggcgacuuuaugaggaaauagauaaccaagauaaaaaguuaaacgcaaucugugucuacugcggacaaccaauaucacuaacagaagcaauaaaggguaacgaagucgacguagaacacauuauuccaaaaucaaaacucuuugaugacucccaaaguaacaaaacccuagcccauaggcgaugcaacucaacaaaaggggauaugaccgcguaugauuucauggaaaauaaaccagcacagguguuuaaugcauacaucgaacgaguaaauauguuauaugacaacaagauuauccggaaaguaaaaagagacaaacuacuaaugccggaaagcaaaauaccagacaacuucauagacagacaauuaagagaaagucaauacauagcauccaaggcccgcgaaauauuacaaacgaucugcuacaacguguggucaacaucugguacaguaacagcaagacuccgacaucuauggggaugggaugaugccacuaugucguuacaacucccaaaauacagagaguuagguuugacagaaaugguagaaugggaaagugaacauggcaaacaaaaacacaguaaagaaguaauaucagacuggagcaaaagggacgaccaucggcaccaugcuguugaugcccugacaauagcauguacgaaacaaggauuuauccaaagauucaauacauuaaacucaagcaaaacaaaggaagacauggaguucgaaaucgccaaaugcucaauugaauacagagaaaacuuaaguaaacuagaaaaauauauuauagcauugcgaccuauaccaguaagugaaguagaagacgccguugcaaauauauuaauuucauuuaaaucaggaaagaaaguagcagugaaaggaaaaagaaaaaucggaaaacggggcaacaagaaaauaauucagacagauauuauaauaccucacggcuccuuaucagaagaauccgucuauggcaaaauaaaaacaauagaaagagaaaaaccauuaaaauaccuauuccaaaauucacaacuaauauuuaauaacaaaauaaaaauccuugucgaagaacgccuagcuacguuugaaaaugacacaaagaaagcucuagccuccuuaaagaaagucccuguauaccuagacgaagagaaaacaauaguacuagaauaugcaacaugcuucaaagaagaauauguaaagaaauaugauguagacacaaacuuuagcaaaacagacaaaguaauagaugacaaaauaaaagaaauauuacaacacagacuaggaaaauucggcggaaaagccaaagaaaaagaagccuucaaagacguccagcaaggagauaaaacuauaaaaugguaugaagaugaaggccuagaaagaccgauacauagcgugaggugcuucacuggccuuagcgcuauuguacccgucaagaaagaugaaaacggaaucgacauuggauucguaaaaccuggaaauaaucaccauauugcuauuuacagcgacaaagaugggaaucgauaugaacauauauguaccuucuggcaugcuguagaaagaaagaaauacgacauaccaguaguaauaaaagauucaaaugaaauauggaacaaaauauggucaaaaccagaagguuccuauccgcaaucauuucuugauaaacugccccaagaaaauuuaacacuagauuuaucaaugcaacaaaacgaaaugcuuauacuaggaaugaguuaugaagacauaaaaacagcaauagacaacuccgacuauaaacaacuaagcucuaaccuguacagacuacaaaaacuagcaaaugcuaacuauauguuccgacaccaccuagagacgcaaauaauagacgacaacaacucaaaagccucaagacgauuuauaaacauucauagccuaaaagcauuauucgcauggaaccccuauaaaguaaacauuaacugcuuaggugacauccaaacuaacagccguuga

SEQ ID NO: 8701 - RNA, 3720 nt, Artificial Sequence
  Cas9 variant
augaccgaaaaacgaaaauucgauauccgcgaaguauaucuagcuauacaucacauuguaaaauacagaggaaacuuucugaauagugcuaccguugacagcuucaaaaccagcaacaucgacuuuacaagucaauucgaucgccuaaacgaacucuacagacaaguaauuuuagaagagccguuucagaucaacaugaaccaaguagacaaaaugacaaacaagcugcuagauaacgacgcuuugaaacuagauacacaaaaacaaguagcaaaacuuuuaccaguaauauacaacgacaaaccuguagauaaacaauauacccgacuagcaacagaauuuagcaaagcuauacuaggauauaaaacuaaacuagauguuauauuaaaccuugauacacaaaacgcaaaagauugggcaauaagacuagaugacgaagacauagacgauaaauuacccgcccuaguagaaaaucuagaugaaaguagacaagagauaguaacaauaauacgagauuuauacgcucaaaucacccuaaacgcaauagucccaaaaggaaagucguuauccgaaaguauggucgauaaauauaacgaucauaaagaccacuuagaccuccucaugggacuaauucaugaauuaggagacgacuccgcaaaagguauuaaacuccgcgaagcauauacacaauacguaggaaaaucaggagauaaaacacucaaccaagacgacuucuacgcagcuauaaaaaaaaaccuagacgaagacagcaaaagaucgccuaaaauacaacgccuuauugaacaagcuucuuuuaugcccaaacaaagaacaucagcaaauggaguuauuccacaucaacugcaccaacuagaacucgaucgcaucauagaaaaccaaggaagauauuacccauuccuaaaagaaccaaacucaaauacacacaaaccaaacggagggaaauacaaacuagacgaacuaguagcauuuagaauuccauacuauguaggaccacuaauaaccaaacaagaccaagaaaaaaccucaggagcagacuucgcauggaugauaagaaaaccuggacaagguggcgaaauaacaccauggaauuucgaccaagaaguagaccguauggcaucagcuaauacuuucauaagacgaaugaccacuaaagacucauacuuagucgcagaagauguacuccccgacucaucccucauauaugaaaaauucaaagugcuaaaugaacuaaacaugcuuaaagucaaugauaggaggcucagcaucucacaaaaacaagaucuauuuaauaaccuauucaaaaaacaaaaaaccauaagaacaaagaaacuccaaacauauauucguacaaaaugggaacucccaagugucaugauaucaggacucagcgaccccgauaaauucaauucuucacuagcaacguacaucgacuuccgugacgucuucggugaaaaagucgaugaccccaacagacaggcagauuaugaaaaaauaauagaauggucaacaguauuugaggauaggaaaauauaucaagcuaaacuuaaccaacuugauuggcucaccgagagucaaucaaaagcccuacuuaccaaacacuacacaggauggggacgacuuaguaaaaagcuauugacaggacuaaaagaccaaaacggcgacagcauuuuagaucaguuauggaaaacaaacgauaacuuuaugcaaauacaaucuagagaugaauucgcgaagcaaauccacgacgagaacgccaaacaauuccaugaagcaaauaacguagacgacauacuagacgacgcauuuacaagcccacaaaacaaaaaggccaucagacaagucgacaaagucguacaagauguaguaaaagcaguaggcuaugccccggauaaaauagccauagaauuuacacgcuccccucaagaucguccucaaagaacauuuagucgccaaaggcagcugcaaucaacauaucucaauguggcgaaagcccuuaugaagaguaaccucaaucaagaacucaaaucagucauagauagucaacaaacauuaacagauaaauuauauuuauacuucacacaacuuggacaagauauguauacaggcaaagaaauaaacuucgacgaauuaguaaacuaucaaaucgaccauauacucccucaagcauuuauaaaggaugacucauuagauaacaggguccucguaagugcgccaauaaauaacgcaaaaucggacaacguacccguaaaaaaauuuggugcuaaaaugggauacuucuggaaacaauuagcagaaaaccaucuaauauccaaacgaaaacuuaacaacuuaacaacagaccccgacaaaaucgguaaguuuacagcccaaggauucauacaccgacaacucguagaaacaucccaaguaauacgacuaguagcgaauauucucggaaaugaauauggacaugacggaacuacuaucaucgaaguaaccgcuaaaaugaaccaucaaaugcguaaagauuucgaccuaaucaagaucagggauguuaaugacuaccaccaugcaauggacgcguaucucacagcguacgugggagauuaucuauaucuaagauacccgaaacuuagaucuuauuucguuuauggagacuuuaaaaaacucaaagaccaaucacuuaaaaucagaaauuuuaauuuuuuacacgaucuaacaaacgacgaagcuggcgauaaaauagucgaccaggaaacaggagagaucauaugggauaaacacgaaucuguuaaacaauuaaaaaaaguauaucacuacaaauuuaugcuagucucacaagagguauacacucgacaagacgcccuauucaaccaaacaauuuauccagcaagugacgcugauaaacgcaaguuaauaccaauuaaaaauaacaaaccaguugacguuuacggcggauauagcggaaaugucgacgcuuacauggcaauugucagaauucauggaaaaaaagaagacaaguauaaaguuguuggcguaccaaugcgcgcaguagcggaucuaaaaaaagccgaaucaaaaggacgugacaauuacuuaaacgcaguacacgaaguucuaaaaccucaauucacaaaaaaaaaaaaagacaggaaaacaggcgaaaucacagaaaugauggaugauuuugacguccuauuagggaaaguuuacuaccgacaguuaauaguagacggaaauaagaaauucaugcuaggaucaucaacauaucaauacaaugcgaaacaacucguauuaucagauaaggcaaugcaaguccuuucuaaagacgauaaacuuaaaaaccaagaugaaaaccaaaacuugauagacguuuaugacgaaauauuggaaaaaguagaucaauacuucgagcuuuacgacauaaacaaauuucgucaaaaauuacacgacgggcggaaaaaauuuaucgaacuccccguugacaacgacuuuaauggaaaaaaauuaaucucauacggaaaacgggccacuauaauaucaauccuuaaugguuuacacgcaaacgccacaaugucaaaucuaaaauaccuuggcaucuccagcccauuuggaauguuacaaguuccuaacggaauaauauuaucacccgccucucguauuugcuaccaaucaccaacaggacuuuuugaacgaaaaguaaaacucuccgaccuauga

SEQ ID NO: 8702 - RNA, 3738 nt, Artificial Sequence
  Cas9 variant
augauaauauacuuuauauucgagaaaauuguuaacacuauccuaguuaugaagaaaauagucggacuagaucuagggacaaauagcauaggaugggcacuaaucaacgcuuauauagacgaauauaauaaagaacaucuauauggcauagaggccugcggguccagaauaauaccaauggaugcagcaauauuaggaaauuucgacaaaggaaacucaauaucgcaaacagccgacagaaccucuuaccgaggcauucgcagacuaagagaaagacauuuacuccgacgcgaacgacuccacaggauucuagaucuacucggcuucuuaccaaaacauuauucagacucgcuaaaucgauacggaaaauuucuuaacgauauugaauguaaacuaccauggguaaaagacgaaacaggaucauacaaauucauauuccaagaaucuuucaaagaaaugcuagccgacuucacagaacaccacccaaaacuaauagccaacaacaagaaaguaccauacgacuggacuauauacuauuuaaggaagaaagcccuaacacagaaaauuucaaaagaagaacuagcauggauauuacuuaauuucaaucaaaaacggggauacuaucaauuacggggagaagaagaagaaacaccaaacaaacucgucgaauauuauucacugaaaguagaaaaaguagaagacucuggugaacgcaaaggaaaagauacaugguauaauguucacuuagaaaacggaaugauauacagaagaacaaguaauauaccauuagacugggaagggaaaacaaaagaguucauaguaacaacagaucuagaagcagacggcucacccaagaaagacaaagaaggaaauauuaaaagaucauucagggcaccaaaagaugacgauuggacuuuaaucaaaaagaaaacagaagcagacauagacaaaauaaaaaugacaguaggggccuauauauaugacacacuacuacaaaaaccggaccagaaaauaagagggaaauuaguaagaacaauagaacguaaauauuauaaaaacgaacuauaucaaauacuaaaaacacaaucagaauuucacgaagaacuacgagauaaacaauuauauauagcguguuugaaugaacuuuacccaaauaacgaaccaagaagaaacucaauuaguacaagggacuucugccaccuuuucauagaagauauuauauucuaccaaagaccacucaaaagcaagaaaucacuaauagacaauugcccuuaugaagaaaacagauacauagauaaagaaucgggagagaucaaacacgcaucaauaaaauguauagcaaaaucccacccccuauaucaagaauuucggcuuuggcaauucaucguaaauuugcguauuuauagaaaagaaacagacguagauguaacgcaagaacuacuacccacugaagcggacuacgucacauuauuugaauggcuaaaugagaagaaagaaauugaccaaaaagcauucuuuaaauauccaccguuugguuuuaagaaaacaacaucaaauuaucguuggaacuaugucgaagacaaaccauauccuugcaaugaaacacacgcacaaauaaucaccagauuaggcaaagcacacauaccgaaagcauuccucagcaaagaaaaggaagaaacauuauggcacauuuuguacagcauagaagauaaacaagaaaucgaaaaagcacuacacucauucgccaacaaaaacaacuuaagugaggaauuuaucgaacaauucaaaaauuuucccccuuucaagaaagaauacggcucauauucagcaaaggcaaucaagaaauuacucccacuaaugcguauggguaaguauugguccaucgagaauauagacaacggaacaagaauaagaauaaauaagauaauagacggggaauaugacgaaaauauacgagaaaggguaaggcaaaaagcaaucaaccuuacagacauaacacauuuccgugcauuaccucucuggcuagcauguuaucuaguauacgaucgccacucagaaguaaaagauauaguaaaauggaaaaccccaaaagacauagaccuguaccuaaaaucguuuaaacaacacucauuaaggaauccaauagucgaacaaguaaucacugagacccuacguacaguccgggauauauggcaacaaguaggacauauugacgaaauacacauagaacuaggaagagagaugaagaauccagcagacaaacgcgcucgcaugagccaacaaaugauuaaaaacgagaacacaaacuuaagaauaaaagcucuccuuacugaauuucucaacccggaguuuggaauagaaaacguacgaccauacucaccuucucaacaagauuuauugaggauuuacgaagaaggaguucuaaauucgauuuuagagcuuccagaagauaucgguauaauccuuggaaaauuuaaccaaaccgacaccuuaaaaagaccaacaagaucagaaauacuaagauacaaauuauggcuagaacaaaaauacagaucaccguacaccggagaaaugauaccacucagcaaacuuuucacaccagcguacgaaauagagcauauaaucccccaaucaagauacuuugacgacucucuuucuaauaaggucauaugcgaaucagaaauuaauaaacucaaagacagaucucuugguuacgaguucauuaagaaccaccacggagagaaagucgaacucgcuuucgacaaaccaguggaaguguugucaguugaagcauacgaaaagcuagugcacgaaagcuauucacacaaccgaucaaagaugaagaaacuuuuaauggaggauaucccagaucaauucauugaacgucaacugaacgauucgagauacauuagcaaagucguaaaaucacuacuaucaaauauuguaagagaagaaaacgaacaagaagcuauuagcaaaaauguaauaccaugcacuggaggaauaaccgauagacuuaagaaagauuggggaauaaacgauguauggaauaaaauaguacuucccagauuuauuagacucaacgaacuaacagaaucaacacgcuucacaaguauaaacacuaacaacacuaugauaccaagcaugccacuagaacuacaaaaaggcuucaacaagaaaagaauagaucacagacaucaugcuauggacgcaauaauaauagcgugcgcuaaucggaauauaguaaacuaucucaauaauguaagugcaucuaaaaacacaaaaauaacacguagagaccuacaaacucuuuuaugccacaaagauaaaaccgacaacaacggaaacuacaaauggguaaucgauaaaccaugggaaaccuucacccaagauacguuaacugcuuuacagaaaauuacaguuaguuucaaacaaaacuuacguguaauuaacaaaacaaccaaucacuaccaacacuaugagaacggcaagaaaauaguauccaaucaauccaaaggagacucgugggccauacgaaaaucaaugcauaaagaaacaguacacggagaaguaaaucugcgaaugauaaaaacagucucauuaaacgaagcccuaaagaaaccgcaagcaaucguagaaauggaucucaaaaagaaaauacuagcaaugcuagaauuaggguacgauacaaaacgcaucaaaaacuauuuugaggaaaacaaagauacauggcaauga

SEQ ID NO: 8703 - RNA, 3741 nt, Artificial Sequence
  Cas9 variant
augagacuuguuuauuuagcacuugcucacaugauuaaauucagaggccauuuucuauaugaaggagaucuaaaagcagaaaacacagacguacaagcccuuuuuaaagauuucguagaagaauaugacaaaacaaucgaagaaucacacuuaagugaaauaaccguagaugcccucuccauacuaacagaaaaagugucaaaauccucaagacuggaaaaccuaaucgcgcauuauccaacugaaaagaaaaacacccuauuuggcaauuugaucgcuuuaaguuugggauuacaagcaaauuucaaaacaaacuuccaacuaagugaagacgcuaaauuacaauuuaguaaagauacguaugaagaagaucuagaaggucuccucggagaagugggcgaugaauacgcagaccuuuucguaucggcaaagaauuuauaugacgcuaucuuacuauccggaauuuugaccgucgacgauaacucaacaaaagcaccauuaucagcaaguauggucaaaagauacaaagaacauaaggaggaacuggccgcuuuuaaaagauucaucaaggaaaaacuuccaaagaaauaugaggaaauauucaaagaugauacuaaaaauggauaugcagguuaugucggagcagauaagaaauuaaggaaacguucagguaaauuagcaacagaagaagaauuuuauaaauaugucaaagguauauuaaacaaaguugaaggcgcugauuacuuccucgauaaaauugauagagaagacuuuuuaagaaaacaacgaacuuucgacaauggaaguauaccacaucaaauccacuugcaagaaaugcaugccauacuuagaagacaaggugaacacuauccauuccuaaaagaaaaccaagauaaaaucgaaaagauucuaacauuuaggauaccauauuacguaggcccacuagcaagaaaagguucaagauucgcuugggcugaauauaaagcagaugagaaaaucacaccauggaacuuugacgacauacuagauaaagaaaaaucagcagaaaaauucauaaccagaaugacacucaacgauuuauaucuuccagaagaaaaaguauuacccaaacacucaccacuauaugaaacguuuacaguauacaaugaacuaacaaagguaaaauauguaaaugaacaaggagaagcgaaauucuucgacacaaauaugaaacaagaaauauucgaucauguauuuaaagaaaaccgaaaaguuacaaaagauaagcuacucaauuacuuaaacaaagaauuugaagaguucagaauagucaaucuuacagggcuagacaaagaaaauaaagccuuuaaugcauccuuaggaacguaccaugacuuaagaaaaauacucgacaaaucauuccuggacgacaaagucaacgagaaaauaauugaagauauaauccagacuuuaacccuauucgaagacagagaaaugaucagacaaagacugcaaaaauacucagacaucuucacaacucaacaacuaaaagaacuggaaagacgacacuauaccggauggggcagacucaguuacaaauuaaucaacggaauuagaaacaaagaaaauaagaaaacaauuuuagacuaccuaauagacgacgguuaugccaacaggaauuucaugcaauuaauaaaugacgacgcacuaaguuucaaggaagaaauagcaagagcccaaauaauaggcgacgucgaugacauagcaaacguaguacaugaccuaccagggagccccgcaauuaagaaaggaauacuacaaucgguaaaaauaguugacgagcucguaaaaguaaugggucacaaccccacuaauauaauaauugaaauggcuagagaaaaucaaacaacagacaaaggaagaagaaacucucaacaaagauuaaaauugcuucaagacagccucaaaaaucuagacaauccuguaaacaucaaaaauguagaaaaucaacaacuacagaaugaccgucuauuuuuauacuauauacaaaacggaaaagauauguauacuggcgaaacucuugacauaaauaaucucucccaauacgacauagaccacauaaucccccaagccuucauaaaagacaacucauuagauaaccgaguauuaacucgcucagauaaaaauagagguaaaagcgaugauguuccaagcauagaagucguacacgaaaugaaaaguuucuggucuaaauugcuaagcgucaaacuaauaacucaaagaaaauucgauaaucuaacaaaagccgaaagaggagggcuaacagaaaacgauaaagcugguuucauaaagcgacaauuagucgaaacucgacaaauaaccaaacacguagcucaaguacuugaugcaagauuuaaugcaaagcacgacgaaaacaagaaaguaaucagagaugucaaaaucauuacacuaaaauccaaccugguaucucaauuuagaaaagacuucaaauuuuauaaaguuagagaaauaaacgauuaccaccacgcgcacgaugcuuaccuaaaugcuguaaucgguacagcccuacucaaaaaguauccgaaacucgcaucugaguucguuuacggagaguucaagaaauacgaugugcgaaaauucaucgcuaaaucagauaaagaaauaggaaaagccacggcaaaauacuucuuuuauuccaauuuaaugaacuucuuuaagaaagaaguaaaauuugcugauggaaccgucguagaacgaccugacauagaaacaucagaagauggcgaaauagccuggaauaaacaaacugacuuuaaaauaguacggaaaguacuuucuuauccgcaaguaaauauagugaagaaaacugaaguccaaacacauggauuagauagagguaaaccaagaggguuauuuaaugcuaacccaagcccaaaaccgaaaccagacucuagugaaaaccuaguuggaauaaaacgaaaucuagacccaaagaaauauggcggauacgcagggaucaguaauucuuaugcaguucuaguaaaagcaaucauagaaaaaggaguuaaaaagaaagaaacgaugguacuggaauuucaagggaucucaauccucgacagaauuacauucgaaaaagacaaacgagcguuccuauuagguaaaggauacaaagauauuaagaaaauaauagaacuuccaaaauauucacuauucgaacuaaaagacggaagccgaagaaugcuagcaucaauacucuccacaaauaauaaaagaggagaaauccauaaaggaaaugaauuguuuguaccgcaaaaauuuacaacucuuuuauaucaugcaaaacguauaaacaauccaaucaauaaagaucacauagaauacgugaagaaacaucgagacgauuuuaaagaauuauuaaacuaugucuuagaauuuaacgaaaaauauguaggcgcaaccaaaaacggagaaaggcuaaaagaagcaguagcagacuuugacagcaaauccaacgaagaaauaugcacgucauuccucggggcaguaaacaguaaaaacgcuggguuauuugaauuaacaucucuagguucagcaucagacuucgaguuccuaggaguaaaaauacccagauauagagacuauacuccaucuucacuauuaaaagauucaauacuuauacaucaaucaauaacugggcuauacgaaacgcgaauagaccuaagcaaacugggcgaagacuga

SEQ ID NO: 8704 - RNA, 3747 nt, Artificial Sequence
  Cas9 variant
augaagaaaaucuuaggacuugaccuaggaucugccucaaucggaugggcaguaauaacugaaaacguagaaaauggaauaacgaaaugcgacauacuggggaugggaucaagaauaauaccauaugaagguacugaaggaaaagauuuuacaaaaggaacuggagaaucuagaaacucauuacggacaaaagcaaaaacagcuagaaaagguuacgaccgauaccaacugcgcagaaaauaccuagucgauacuuuaauuaaaaaucaaauguauccagacgaagcaacaagaaaucuaccaaaaaugaaauuaugggaacuacgagauaaagcaguucauucaccaguaucccucauggagcuugguagauuauuauuaugguuaaaucagaaaaggggauacaaaagcagcagaucagacgcaaacuuaggaaagaaagacacagaauauguagcaacaguuaaaucuaggcacgagaaaaugaaagaacuagaugucacuauaggucaauauuucuaucgagaauuaucagcaaaugaauuuuucaaagucaaagaaaacauuuuccccagagaggcauauauugaagaguucgaugcaauaugcaaaacgcaacaaauagcgcaccccaugauacuaagaagcgaauugauagacaaaauaagaaaugaagugauauacuaccaaagaccacuaaaaucacaaaaaggucuaguauccguaugcgaguucgaaggauuuuggagaaucgggaaagauggcaaagaguauuuuguugguccaaaaguugcuccaaaaagcucaccucuauuccaacuugcuaaaaugugggagaauauaaauaauauaaaaaucgguucucguaccggugaggaucugaaauugacuacggaacaaaaaugggccauauuucaacauuuggacaauaacgagaaauuaacacccaccgaucuauugaaaauacuaaaucuaaagaaagaaaauuguuacgucaacaaacaaaugggaaaaggauuaaaugguaacauaacaaaacaugcaauccuacaaugccuaggaggaagcgauaaauaugaaaaccuccuaaaacuagaacuuaaaaugguagacggcgacaaagaagguuaccuauacgauagaaaaacaggcgaaguacucaacucuaaaaugaucaaauucauagacccgaugguagaacaagaaccauucuaccaacuauggcacauuauuuacagcauacacgaucaggaagagugcucaagaguacuacaagccaaauucgacaucgaacaacccaucgcagauaaacuugcagccaucgauuuuucuaaacacgccuuuggaagcaaaucggcaaaagucaucaggaaaauacuaccauauuuaauggauggcgacgguuauucagaagcaaugagcuacgcaggauaugaucacagcaacucucagacaaaagaggaaaaccuacagcgcaaacuccuagauuuacuaaaaccaauaccgaaaaauucuuuaagacagccaauaguugagaaaauauuaaaucaaaugguaaacguugugaacgcaaucauagaaaaauauggaaauccagaugaaauaagaguagaauuagcaagagaacucaaacaaucaaaagaagaaagaaacgaugcagacaaagcaaugaguaaaagacaaagagaaaaugaugccauaacaaaaagacuagaagaauuuggauuaagagccacaagaaauaacauaaucaaauggagacuauacgaggaaauagauaaucaagaaaagaaacuuaacgcuauguguguauauugcggucagccgauaucacuaacggaagcacuaaggggcaacgacguagacauagaacauauaauacccaaaagcaaacucuuugaugauagccaaagcaauaaaacacuggcacauagacacugcaacaaaaacaaaaacgauuuaacggcuuaugacuucaugaaaggaaaaccagaagcuguauucaaugaauacguagaaagagugaauuuacuauacgacaaucauauaauaagaaaagcaaaaagagauaaacugcugaugacugaauccaaaauaccggauaacuuuauagauagacaauuaagagaaucacaauacaucgccaagaaagccagagaaauacuacaaaccauaugucaugacguauggucuacaucugguacagugacugcagaauugagacaccuauggggaugggaugauguaacaaugaacuuacaaauggccaaauacagagaauugggcuuaacacaccaaguagaaugggaaagugaacaugguaaaaauaaacacgaaaaagaaguaauaacagauuggaccaaaagagacgaucauaggcaccacgcaguugacgcauuaacaauagccugcacgaaacaaggauucauacaaagguucaacaccuuaucagccgcaaaaacaagagaagacaugauguucgacauagaacaaaggucacaugaauuuaaagagaaacgcagcuugcucgaaaaauacauaauaagcgagcaaccauuaaaggucgaugaaguagaaaaagcuguaaguaauauuuuaauaucauuuaagagcggaaagaaagucgcaguaugggguacuagaaaaauagggaaaagaggauccaagaaaguaauacaaaagaaaauuauaguaccaagagguucauuaucugaagagagcguauauggaaaaauaaagaaacaagaagaaaaagauuacaaauaucuauuugagaauccccaacuaauauuuaauccaacgauuaaagcuaaagucgaggaaagacuccuaauguuugauggagacguaaagaaagcaaucacaucacuaaagaaaauaccaauuuaccuagauaauaauaaaaccguggucuuagaaaaagccauaugucuaaaagaugaguucguaaucaaauauaguguggacauaaacuucaacaaaguagacaaaguaguagacccaaaaaucaaagaaauauuacaaaaucgauuaaagaaauucggcgguaaagaaaaagaagccuucaaagacguacaacuagaagacaaaaugauaaucaaaugguaugaagaugaaggccuagaaagacccauaaaaucaguucggugcuucacgggucuauccgcaguagugcccguuaagaaagaugaaaacgguaacgauaucgguuuuguaaaacccggaaauaaucaccacauagccauauauacugacaccgaagaaaauaaacaacaacauguauguacauucuggcaugcgguggaaagaaagaaauaugauauaccaguuauuauuaaaaauacuaacgaggucugggacaaaauacaaucacaaccagacggaacauauccugacucauucuuagaaauguuaccgccaccaaauuuaaaucuauuaguaaacaugcagcaaaaugaaauguucauacuagggaccacaaccgaagacauaaaacuagcaauagauaaacgagauuacaaaauuauaggagacaaacuauaccguuuacagaaaauguccauaaaaccuaguuccggucaaauagauauaguauuccgacaucaucucgaaacgcaacuaauagacgacgaaaauagcaagaaauccaaacgguuuuauaacguccaaucacucggagcccuauucgcacuaaauccauucaaaguuagaauugauaaucuagguaaccucguaaaagaaaaauga

SEQ ID NO: 8705 - RNA, 3762 nt, Artificial Sequence
  Cas9 variant
augaaagcgcgaggcaauuuucuccaccaagauacgcccgggcuuacugcagcuaaugcaaacaugggagacgcuguugaaaaacucugcguagcauuagaagauuggugcacacucagaaauuuagaguguaacauaaggaaaaaccaaaagaauauacaaaacuuauuagaaggaaaaaccguggaaguuucagcagaaaaugcacugaaagaaucuuucgacucuaguagagccucaagaaaagauaaagcuaccauauugucaacuuggauagcaauacaaccuggagaauacuuagaugcuaaacaagccaaagacgcuucaaaagaaauagccaauguccuauuuggguuacaaggaaauaugaagaaaauauuuauugaguucgaagaagaucagaaaauccgacuagauaacgaugaacaaguagaagcguuuuacaguuuauguccagaugacggaguggcauuauuugaaaguuuccagagcauauauagcgcuuacauacuaauggguauucuuaaaaaugcgaaugguggaagcaucaguagcuguaaaguggccgcguaugaucaauacaaagaagauuuaaaauuauuaaaagaccuaguccgagaauuugcauccgaaaaauaugaugaguucuucagaggagauauauucgacaguaguaaaggauuuagggccagaaauuauaauccugccacagcuaaaggauauacaaaauauaacuccguacgaggagcaucauaugacgauuuuaagaaagaaguagagaaaauauucaaaggaacuguagcugaagaagauauuagguacguugauaugaugcaaagauuugcggaaggaacauucuuaagacgauuaaaaacgagcgauaacggaagcauuccauaccaacuacaucuugaagaaauggaugcaauaguugaaaaccagaagcaauuuuacccuuucuuagaaucggaaaaagaaaaauuagaaaguuugguaacauucagaaucaguuauuacguaggcccccuaacacagaaaaaugcacgacuagacaaucauaauaaugcacgcuucgcguggagucaaagaaaagaagguaaagaacacgcuagaguauauccauggaauugggaagaaguaauagaucggaaacaaagcgccgcaaaauuuauggaaagauugaccggaaccugcacuuacauacuugacgagcccguguuaccgcgaugcucuuuacuauaugaagaguacuguuuacuaaaugaauuaaauggcaguaaauggagagauaugggaggagauuggcauagguucgauuaugagaccaggauggaaauaauagaaaaccuauucaaaaagaagaaaggaaguguaaaauaugcagcagucgaagacugguuaaaaugugaaaaacauaaaucgugcgcagagguaaaagguggccagggugagacgggauuugaaaguaaacucuccaguuacguauucuuuaaagaaguauuacaugucgaugaaauagacgaagccgacaucccuaugauagaagaacuaauaugguggaacacuuuauucgaagacagaucgauauugaaagaaaguauugaagacaaauauggagacagauuaacggacgaucaaauaaaagcaaucuguaagaaacguuuuacuggauggggcagacuaucgaaagaacucuuauguggcauuaaaacacauacugauaauggacccuauagcauaauggacguacuacgcgaagguaacccaaauaauaacgcaagaagcgaaacaaugguauucauggagauucuacgagaugacaaauuuggauuugacaaauuaauagaagaagaaaacaugagaagaguaagcgaaguagauaauuucgacguaaaugacuuaccagggaguccagccguaaggcggacaguaaaccaagccaaaagaauagucgaugagauaguuggaauagcaggaugcgaaccgcaaaacauuuucaucgaaguaacgagagaugaagaugggcguaauaaaggaaggaggacaaaaagaagauaugauaauauuaaaaacgcuauagcagcacuaaagaaagaacagaaagaguauuucaauaaagauguaagugauaguuuaaauaaaacaaacccuucagauuuggauaacgaaagacucgcguuauauuuuaugcaaaacggaaaauguauguauuguggaaaagacuuagauauaaaacaacucgauaaauaccaagucgaucauauacuaccccaaagcuaugugaaagacgauaguuucgaaaauaaagcauuaguucauauggaagauaaccaaagaaaaagcgcuagcaugcuuuuagaugauaguauaauaaggaaaaugaaacccuauugggaagcucucagagcggcgggauuaauaggugaaaagaaauuuaaaaaucucacaagaguuagagugagcgauaaagaauuaggugguuuuauagcaagacagaugguggaaacaucucaaucuaugaaauuaacgaguuuaguacuagagaaaacguacccgaauacaaacguaagaccuguaaaagccggauucucaagcgaucuuagaaagcgucuugaucugauuaaauguagagaaauaaaugauuaccaccaugcucaugacgcauaccuagcuugugaaauaggacaauuuauaacaaugagacacaauaaauuauacgaaaaucccauaucauauucacaugcgguaaaagauuucauagcaaaacgcgcaaaauacgcaaaugaccauggaacuccuaugaguacauaugggaugccggggucaagcucauucguaauaagcucguuuuuaacuucaggguuugacgaagaaacaggugaaauauucaaagaugcuuggagugcggaaguagcggcgguaaggaucagggaaagucuaaauagaaaagauugcuauauaucuagaaugccagaagaaacaucaggcgcauuuuggaaggaaaccuuaauaucuccuagggauccaagucuuggaaagaaucucagucucccaauaaagaaagggcuugauccacgaaaauauggcggcuauaacgaacagaaguucgcuuauuucuuuguguacgaagcaguaaaaaucaaaaagaaaggagaaguaaaagaguacguauuugccgccguaccgguacaagucgcagcaauaguagcgagagauccaaaugcuuuaacaggauuugcaaagaaagacgccgaagcaagaaagauaaaguuuuuacggauaauaagagaaaaaguguauaaauaccaacuaauagaaguuaauggugaaagacuauauauaaccggucuaaaaaguguaaggaaugcaagacaaauagcauuaucucaagacaugacaacgguauuuuugaaagcuauuaaugauaaagacgucgcagaagaugaauugaaaagucuauuugaagaaauagugcaaagauacagacuuugcgcuaacagauuaggaaaucaacuaaaaauauuuucacugucagacaguuucaauagugcgaacucagaaucuaagaaaagagcacugguuucauuaguagcaauaauagaugcuaaaacaaacaaaauagacuugucagguauaggcaguggaaaagcuguaggaaacaugagauuaaguuucagcaaagaaaugucaaauaguaaaaaucauuuugcguucauagaucaaagugucaccggaauguuugaaaggaaaacuuacuuauga

SEQ ID NO: 8706 - RNA, 3777 nt, Artificial Sequence
  Cas9 variant
augaccgaagaaaaccccgacaucagaaaaguauuuuuagcuauccaccacauccuuaaaaaucguggucacuuuuuauuacaaggccaaaguuucaaagaagguaaucuaaacaaccuaaucaaagaacuacugaaccuagacauucuucauauaucaaucgaaaucacagaagaaaauaucaacaaaauaacagaaauugcacuagaaaagaaaacgcuuacagacaaagucaacgaccuaaagaaaaucuaccccaaagaaaaacaacuccuagaagccuucagacuaaucuucggcggaaaaacaucguuagacaaacucuucgcaauagaugaauauaaagaacucgacgccucagucaaaucuguuuccuuuaaagagaaaaucuacgaagaaguaagacaugacuacgaacaaguauuauccaacuacauagaacuacuagaccuggcaaaacugguuuaugacucaauuaucuuaucagacauuaaaaaggaagguaaaaccuuaagcgaauccaaaguagaacuauaccacaaacauagagaagaccuaacaaaauuaaaaacacucgucaaaaaugauuccaaacugagcgaagacaagaaaguagaacucuauagugcuauuuuuaaagaagauaaagacaaaggaacuaauuacguaaauuacauacgaaaauccgaagaaggaaaaggguguaacuacgaagacuucaagaaauuucuugugaaagaacuagccaaacuagaagaauccagugcuaaagaagaaauacuacgugaccuugagcuggaauuauuucucccacuacaaagaacaaaagacaauucaguagugccauaccaaauacacaaagaagaauugguaaaaauauuagauaaugccgcaaaauaucacaaauuucuuaacgaaaaagaugacucaggauacucaaucauagaaaaagucauacaacuccuagaauuuagaauaccuuacuauguaggaccacuaaacagcaguaagaaagcaaaaguagauggauucgcuuggucuguaagaaauaaaggauaugaaaacaccccagugacuccauggaacuacgaaaaaguuaucgaugagucagcaucagcugaaaaauuuaucacaaacuuaaccaauaaaugcacauaucuaaaaggcgaagacguacuacccaaaucaucguuacucuauagcgaguucgcccuauuaaacgaacuaaacgcacugaaauacgauggcaaccgaaucucacuagaagcaaggaauguaauaaucgaaaaacuauuuaaagaacaaggaaagaaagucaccaaaacaucgaucaaaaaucuauugaaagccgaaggauauauagauggaaaaggagaaaucaccggaauugauaucacagucaaaaacgaucuaaagucauaucgugauuuuaagaaaauauuaggagauaaauuuaacacagaacacguagaaaacaucauccuuuggauaacacuuuauggagaauccagaaaacugauaaaagccaaaauagaggcaguauauggugacauuuacucaaaagaagagauagcaaagaugucccgccucguauauaaagacuggggcagguucucaagaaaacuacuaaccgaauuaguaucuaaaaaguuauauaacgaagaaacuggcgaaugccuaaacauaauaggugcaaugagacaaaacaauauacuauucauggaacugcuugcugacagauuugauuauucacaacaaaucauagauuacaacaaagaacuccagaaagaagucacagaaauaacuccugaaaucuuagaugaccucuacguuagcccaucagucaaacggaguaucuggcaaacaguaagaaucguugaagaguuaaagaaaauaaucggaugcgcuccagcaaagaucuuugucgaaacaacaagaucaaaccaagauaaaaagaaaccaacggauagccgaaagaaacaacuggaacuauuuuauaaagcggucaagaaagaugucaaagaccuagaaaaagagauuggcagucucaacuucgacaaauuaaaugaaagauuaagcagcguagaaccgucuaaacuaaaagcgaagaaacuauaucuuuacuauacacaacuaggaagauguauguacuccggcgaaacaauagacauuacccaacucaacaccacugcauaugauauagaccacauauauccacaaaguaaaguaaaagacgacucuuucacaaacacaguccuaguuaaaagagaauacaacgcagcgaaaacggaccgauacccacuagguuccgacauacaaacaccaagcaauagacgguuuuggaaauuuuuaaaagaaaaaggucucaucacagaugaaaaauacaaccgauuagugagaacagaagaauuuagcgaugaagaacuaaccggcuuuauagcaagacaacuuguggaaaccucccaaucagucaaagcagucgcuggaauacuuggggaacuuaauccaaaaacuucaauaugcuacaguaaagcugaaaacguaucauccuucagacaaaauuuuggaaaaauaaaagagggaaauagaaaaucagacaauacggaacaacucauaaaagugagagaaauaaacgacuaccaccaugcaaaagacgccuauuuaaauguuguaguggguaauguauacgacaccaaauucacacgaaacguauucaauuuuauaaaagauaagaaagacggcaggaaauacucucucaacaacguauuuuaugaaaauguaaguaauuccaauaacguagccugggaauuaaacaaaacuguacaucaaguagaaaagguaaugaacaacaauaacauucuaguaacacggagaaccuccgaacagaagggaggauuauuugacgcaacuguuuacaaagcaaagguagcagcaaaagcaaaggaaggaguauauuaccccuugaaaacaagcgacccaguagucaacgacguaaccaaauauggaggauuuacgaaaguaaaaauagccuacuauucgauauucgaauauacccucgucaacaagaaaggagaagagaaaauaacccgaauaauaccaauaccaaucuacguuagccaaaacauaaaagaugacucaaccuuacuagaauuuggaaaaacucaaauaaauaucaaaagcggggaagaaguaaaagauuuuaaauuaaaauaccgaaaauuaugcauaggagaccuugugaaaaucaacaacuuuuucaauuuuauaggaggaaaaacaaaugacagcuuuguauaugauggcgcuguacaaguaacccuggacacagaaucggaaagguacauuaaaaccuuaaguaaauaccaaaacuggaagaaagaaaauaaagacggagaauuaugggaaagcauaacaaaggagaaaaauacagaacuauacaaccuacucgucgagaaaaugaacagcggcauauucaucaaaaagaaaccaaacaaauucaacgaacuaaacuccgaagaaauaagaaauaauuuuucguccauaucauuagaagaacaagcaaaaguacuauuagaagugcucaaucuauuaacgaauaagaaaaguauauucgaucuaaaaagcauaaacaucaccgcagcacggggaaaaauaaguuucaaucuaaguaacuuaagucaauucuccauuauugaacagucaguugcuggauucuacgaaaaagaaauaacgauuauaggugacaaagaaaacgacauggaaaauaauaacugcuga

SEQ ID NO: 8707 - RNA, 3780 nt, Artificial Sequence
  Cas9 variant
augaaauauauauuaggacuagaucucggcguagccagcauaggaugggcugugacugaaaucaaugaaaaaggagaaccagugggacuaaucgacgcaaacuccguaaucuucaaaccauuagauaacgauaaagguaaacuauacaacguagagcgacgagacaaaagaggcucacgacgaauauuacgacgaaagaaacacagaguagaaagaacaaaaaugcugcucgucaacaguaguuuucucacaaaugaagaaauagauaaucuguauguagguaaacuagauaauauuuacgaagugagacuaaaaggacuaaaagaacaauugucgaaaaacgaaauagcucgauuaaugauauacuacuguaaaaaccggggcuucaaaucaaaucgaaaaacagaagacuuagaaauucuuaaaucccuaggugagaaaauaucagaaaaggacagcgacgaaaagaaacuaaaaccaauaauagccaaaaacacagaacugaucgaaucuaaaggacuaacaccgauagaagugauauauaugauuagagagaaugacaacagcauauuaggauucaaaaauaaagaagggaacuauaaauuuggcuuuaaaagaaaucaaguaauagaugaaguaagaaaaauuuuaggaacacaacaaauacuauccaaagagauaguagaugaauacauagacauacugucaucccaacgagacuucagcgacggaccaggaggagacagcaaauacaaaauagacuacacaaaauuagcagguaaauguaaauacacgggggaaguacgagcaguaaaaagugcaccaucauaugagauauucacaauguugcaaaaacugaacgacaucagguacguaaaauucacaucugaagauaagauugaaaagaaaaagcuaucaaaggaaguaauacacaaacuauacgacuuaguaguagagaaaaacaaaacgcuaaccuaugacuuaauagaaaaaucaauugacgaagaaaacaucaaacuacuaaauauaccaaaauuaaguaagucaaaauacgucgaacucagaaagucuuauuuuaaggaaaggaacgacaaugaaaaucuaacagaagaagaaaucaaugcauucaacgaaaaacuuaacaaugaaagaaugaaacaagaacuaauacgcaacaaccuaaaagcauauaaggaacuaaaaucaaaauucaaaaagaacaacauagacgaaaaccgcauuaaagaacucggcggaauauacuuuuuggauuuaguagcagaauuauuaaccuauucuaaaacagacgaaaaacuagaauacuuuguagagaacgucgaaagauauagcuuauucaaagaacaaagggacauaguagaaauaaucaaaacauucccaaacuauaccaaaaauggaaaccucucccuaaguuuaguaagagaauuaaacaaguugcuaauggaaggacacgauuacgaaagcagcuuaaguucgcuaaacuauuacauagacacagacguugauugggaaaaauucccgacaauuucugaaauagaagacuccuugucaacaaagauaacuaauccaaaugucaagcacauccucguuauucuaagaaaacuauauaacacacugcuauucaaauauggaagaccagaaaaaguucaucuagaacuaaguagagacuucucaaacgacuucucaacgagaaacaaaauucaaaaagaacaauuagagaacaaggugagaagagaaguugcugcauucgaaauguauggagcuaacaaagacauagucgcuggaaaggauagacuaucaaacgacgacuucguacgaauaaaguuaugggaagaacaaaauaaaguaugcauguacucaggaaggacaaucgagaaauaccaauugaccagugcagaaguacaaaucgaucauauacugccguauaguaaaucauucgacaauaguuauucaaauaaagugcuaguauucuccaacgaaaaccaagacaagaaagaacguacacccuaucaauggcuuaaagguacagaaaaauggaaugaauuuaaacaacgaguaagacuaaaucuaaacaucucaaacaaaaagaaagaaaaucuacuauuugaagacgaagucguaaacaacgaguucuuagaaagagaacuacaugcaacaucauacagcagccgguuagcccuaaacauauuccaaagacuaauaccuguaucagaugaagacaaauacgaugaacauggaaaugaaaaaguaaaauacuuauauaaccgaaauguaauagcauuucaaggaaaaaugaccucgaugcuacgaaaucuauacagccuaaacaaauauacccacucauuugaaagcgacacucuagacaucgauaacaaggcuuuuauucuuaaagaauuugaaaucaacaaagauaauuuaaaaaugacagcuuauaacguuaacacgggguuagaaauaacaagcgaaaccaaaguagagaaaaacaaaucgggagaauuuaaaacuauaaaagacgaacuccuuaagaaagaacuugauaagaaagaaaaucuaauagagaucucagacuacuucaaagacaaagucuuauucgaccuaaaaauaguagacuuugaagaaauagauaccgucgaaccggaaauuauaagcauuuuguacaaaaugauuaccgcacuaaaagaagaagucuacagcaaaaauagagaaaaccaucuccaccauucucuagacgccuuccuucuaaccauaaugaacagaucaaugcaaaugaaacuaauaaaauauaaccaauuaauaaguguauuaaagaacaaagaaaucgagauauucaaugaggaaaaaggagaauauauagauagcaaagaguucgcugaagaacuacaaaaacagaaaaucauugacauagauggaaaugaaaggggaaucaaguuuaacguaaauggaaaaacccauagacuaaaccuaguaaaaccauaugaaaauuuucucgaugacauuaaaaacaaaauauucgacaaaagagaaaacaauaaacuaccauaccacgucguaaagaguaaaguaucaggcgcuuugcacgcagaaacaauauuaggagaaaguaaaggcgaaauaacaaaacggauaucuguuuucgauauuaauuacaaaaaccuuggaaaaauauucgauaaagauggaagccaaaaagaaauuuacgaaacguuagucaaaugguuagaagcaaaaagcaaagacuauccaaaacuuaaaaacgggaacaucauaaagaaaguaaaaauugucgauggaaacaaggauaaacuaauaaagcucggaaacaaaagauacguagaaaugggaagaacaacaguaaaaauauuaguauuaaagaaagaagcagaagagggacuaaaauuugccuccaucgggagauauaaauauaaucuacugaaaucagaaaaagacguaaacauaagcaucuggaaagacgcuauacacuucuguaaaguaagguacaauaaacuaaaggaaaaugguuauagacuaauacacgaacuaauaccaggagagacgauagaauuagaacucaacaaaggaaacauaagcaaaugccuaguagugggauuuuccggaggaaaaauagaaauaagcucaguaauaggugacgcauuggacuuaauaaacgacaaaauaucaacaagaauuaaagagagauacuacauaacaguaucaaccauuaagagcauuaagaaaauaaauaaaaacauacuuggagauuga

SEQ ID NO: 8708 - RNA, 3792 nt, Artificial Sequence
  Cas9 variant
augcacaaaaacaacccagacauaagagaauuauucuuagcaauacaccauauucucaaauacagaggucacuuucuauucgcaggccagcaauucaaagguucagaaaucaaagacaacauuagggaauuacuccaauacaauucauuaaacauaaaaauagauauaacggaugaauuaauaaacaauauagccgaaauauuauuaaaaaaaaaaaacagcaccgauaaaauaauagaauucaaaaaacuauuugcagacgaaaaacaacucaucgaagcucuaaggcuagcguuaggaaauaaaacacaacuagcaaaauuauucgauaucgaagccuacaaagaacuugauaucucuaucaaaacaaucagcuucaaagaaaaaaucuacgaggauguucggaguaacuaugaagaaauucuaggcgaauacauaaucguacuagauaccgccaaacuuauauaugacgcaauuauacuauccgaaauaaaaauaaaaaauaugacaaucucagaaaguaaaguaauauccuacgaaaaacacggcaaagauuuaaaacaacuaaaacaauuaauaaaggaagacaguaaacuaagcaaaaaagaaaaacgacaacuauucgaaaacaucuucguaaaggaagaugaaaaagaagcuaacuacguaaacuauauaggaaaaaauaaugucgggucaucaaaaucaaguugcucauacgaagacuuuaaaaaaagcuuaauuaaagaauuaaaauacugcgaagaaucgaaacuuaagcaagauauccuagccgaacuagaacuagaaacguuucuaccuaggcagagaacaaaagauaacucaguaauacccuaccaaauacacaaagaagaacuugaaaaaauuuuaaacaacgcuguccaauaccacccauucuuaaauaauacggacgaguaugguauaaguauaaaggaaaaaauaauacaacuacuggaauucagaauaccauauuauguaggaucccuaaauacuucgcauaaaguagggaacggugguuuuucaugguccguucgaaauaaaggauacgaaagaacagccguaacuccauggaauuucaacaaaguaaucaauaaagaagagagcgccaaaaauuuuauagaaaaucucacuaaccaauguacauaccuacuauaugaagacguauugccaaaacacagccuguuauacagcgaguuuacccuguuaaacgaauuaaauuccaucaacuacggagguaaaagacugacuguagaacauagaaaucucauaauugaacgguucuuuaaacaaucagccccuaaagcaacaggaaaagaacucaaaaaauuccucauguccgaaggcguuauagacggcaaagacgaacuaaguggcuucgacauaucaauuaaaaaugauuuaaaaucuuacagagauuucaagaaaaucuugggagaaaaauucgacucagaaaaaguagaaaaaaugaucagauggaucacacucuucggcgaaagcaaacaacuacucguagacaaaaucacaaaagaauacggcgauauauauucgucugaagaaauuaaaaaaaucagcggacuaaccuacaaagacugggggagacuaucagagaaauuacugacagagauaguauccucccaauuauacgaugaaaguacaggugaauguuuuaacaucauuaacgcuaugcgcaauaacacacuacuuuucauagaauuacuaggaaccaacuaugauuacuuugaaaaaauaaacacauacaacgguaaacucagaaaagaaauaaccgaaauaacaccccauauacuugacgaucuauacguaucaccagcuguaaaacguucgauauggcaaguuguaagaauaguagaagaacucaaaaagguaaucggcagcgagccaaaaagaaucuucguagaaacaaccagaaguaauaaggaaaaaaaaggcgacgacggacgaaaagacucaagaaaaaaagccuuacuagaacucuacaaaaaaauaaaaacaucggauaucgccgaacuugaaaaagcauuaggacacaccgucgauuucgacaaaaaaaagcaagaucuuacagacauagauaauaauaaacugaaagccagaaaacuguaccucuacuauacacaauuagguagaugccuauacaccgggaaggcuaucgaucuuaauaaccuuuucggcagcaauucggaauaugacaucgaucacauauacccacaaagcaaaacuaaagacggaucuuggaacaaccuagugcuagucaacaaaaccgaaaacucaaaaaaaagcaacggauuaauuagcgaaaguauacaaagaaaaaauaaacacuucuggagauuccucaaagcaaagaaccuaauaucagaagaaaaauauaaaagacuaacuagaacagaagauuucaccgacggagagcuaucuggauucauagcacgacaacuuaucgaaacgucacaauccguaaaaguaguuaguaaaauacuacaaaaucucaacccgacaacagaacuaugcuuuuccaaagcagagaaugucagcgacuucagacaagaauucggaaaaauaaaaguagguaaaagaaaaaauuuaacagaagaagaacaaaaaaaagccaaagagggucaguuaaucaaagugcgagaucuaaaugaccuccaccaugcaaaagacgcauauuuaaacauaguagucggaaacguuuaccacauaaaguucacacgaaacccaaaaaacuucauacgaaaaaacuucaaaaacagagaauauacacugaacacauuauucuacucagacaaaguagaaagaaauggagaaguagcaugggaaaaaggaaagacagaagaaauuguuuccagcgucauguguaacaauuuaaucaauguuacaagaagaacgucugagcagaaaggagcuuuauacgaagcaacuauauauaaagcaaacgcagcuaaggaagguuccuacuaccccgugaaaacaaacaacaagaauuuaaaaaauguuacacgauacggcgguuucacaucuauaaaaauagcuuacuauaguauuuucaaauacgacauaagaaacaaagauaaaguaaaagaaaacauuaaaaucauuccaauaccaauauacauuucacaaaauauaaaaacagaucuagaccucauuaauuucgcugaaaaacaaauuaaauuaaaaaaaggcgaaaacauagaaaaucuccaauuaauauacaaaaaacuaaacauaggagcucuaguaaaaauagaccacuacccauacuauauaggcggaaaaacugaugacaacuucuauguugauggcgcaguacaaguccuguuaagcagcgauaucgaaagauaccuaaaagaagucguuaaauuuguaaacuuucaaagagagaacaaggaagcaaagguaagcaaagaacacauaucccucgaagagaacaucaaacuauacaacaccuuaguaugcaaaauggcaacuaaaauauuuacccacaaaaaaaacaauaaguauaacgaccucacacaagacaaagccaaaaacacauuuaacaaauuaagccuagaagaacaaugcaaagucuuauuagaaauauuaaauuuacuaacaaacaaaaaaacuacuuucgaccuaucacuuauaaaugagaaaacaaguagagucaaaugcggauucaacuuacugaaucagaaacaauuuucaaucauagaacaauccgugacugggcucuacgaaaaggaaauuaagauuauugaagacuga

SEQ ID NO: 8709 - RNA, 3795 nt, Artificial Sequence
  Cas9 variant
augaaaaauguucuaggacuggauuuaggaacaaauaguauaggaugggcacuaauagaaguagaugaaaacaaccugccaauaagaauaaucgcaaugggaagucgcauaaucccucuuucuacaucagacaaagaagaguuccaacgcggauugaguauaaccaaaaaccaaucaagaacaguaucaagaacacaacggaaaggcuacgaucgaaagcaacucaaaaagagcgauuuaaagaaaauuuuaaacaaauacaacauauuuccaucagaagaacucuuaagauugccgaugcuagaccuauggaagcuacgcagugauuccgcaaacccagacgaaaauauuagcgccgaacaauuagggcgaauccuauacaugcucaaccaaaagagaggauauaaaagcgcacgaagcgaagcuaacgcagauaagaaagauucagacuacguacaagcuguaaaaggaagauacgaccaauuaaaagacagaaaacaaacaauaggacaauauuuuuaugacgaacuuuacaaugccaacgccaauaacucauacuuucgaaucaaagaagaaguauauccacgggaagcauacauugaagaguucgauacgaucauaagcgcacaaagagaaaaacaugauuuccuaacugacgaaguuguacaccaacuaaggaaugaaauaauauauuuccaaagaaaacugaaaucacaaaaagguuugguaagcauaugugaauuugaaggcuucgagaaaacaguguuugauaaagagaaaaacaaaaauaaaguaguuuucgucggaccaaaaguagcucccaaaacuucaccacuauuccaauuaugcagaauaugggaagugguuaacacaauuacgcuaaaaauuaaaaacccagaaggaagcaaauauaaauggggagagaaaauaccagacauaaaagaaaaagaaauuuuagcagauuaucuuuuuaaaaaugaaucacugaguuucucaaaacuauuagaaauacucgaacuaaagaaagagaacguauacguaaauaaacaaauacucaaagguauaaagggaaaugaaacuuacucagcguuacauucaauccucggagauaacgaauuauuaaacuucgauguuuccaucaugacuucuaaucaaacagcauugcucguagaucgaaaaaccggugaaauucuagaagaaagagcaggacuggaauuggacgcaucacuagaaaaagagccacuguaucaacucuggcacacgauauauucauuaaaagaucucgacgaauguaagaaugcucucauuaaacgcuuugacuucgaugacgaaacagccgaaaaacucaguaggauagacuuuaacaaacaagccuuuggaaauaaaucuaauaaauccaugcgcaaaauacugccauuccuuauggaaggauaugacuauucacaaucaucaucauuagccggcuauaaccacagcaacucuuuaaccaaaaacgaacgcgagcaacaaauuacauuagauagacuagaacuacuacccaaaaauucauuacgacaaccaauaguggagaaaaucuuaaaccaaaugauaaacgucgugaaugcuauacuagacgaauacggaaaaccgucagaaaucagaguagaacuagcacgagaacuuaaacaaucaaaagacgagagaaacgaaacagacuugcaaaacaguaaaaacaagaaauuaaaugacgaaauaggaaaaagacuagaagaacuuggacuacccgugaccaaaagauauauucagaaauacaaguuuauuuucccuucauuaaguaaaaaucuaaaagaagccaaaguuaacaaucaauguauuuauugcggggagaccuucaaccuaacagaagcccuauccggcgacgcauaugauguagaucauauaguucccaaagcccuccuauuugacgauagucaaacuaacaaaguccuaguacacagaaaauguaacucgacaaaaacaaaucaaacagcauacgauuauauugcaacaaaaggggaugaacauuuaaaacuguauucagaaagacuugacgauugguucgaaagaggcaucauauccuacaguaaaaugcaacgccuaaaaguaucacauaaagaauaucucgaacgcaagaaacuaggaaaagaaaccgaaacggauaagaaacucugggaaaauuucauagauagacaauuaagagacacgcaauacauaucgagaaaaucaagagaaauccuacagaaaauaugcaaugacgucaaaacaaccgagggagguguaacagcuaaacuaagaaaccuaugggggugggacgacguacuaaugaauuuacaaaugcccaaauacaaagaauuagggcaaacgauaaccaaagaauggaccucugagcacggaaaacgaaaacaccaaaaagaagaaauagacaacuggacgaaaagagacgaucauagacaucacgcgauagacgccuuagucauugcauguacaaaacaaggguucauucaaagaauaaacacacugaauagcucagacacgaaagacuuaaugauuaaagaagucgaagaggcaaaaauagaguucaacgaaaagacaacucuacucgaaaaauaccugaaaacgcaaaaaccauucagcacccaagaaguaaugaaagaagcagauaaaauucuuguaucauucaaagcaggaaagaaaguagcaacuauaacaaaauucaaagcaacuggcaaaaauaaagaaaccggaguaauaguaccaagaggagcccuccacgaacaaaguguuuacggaaaaaucaaaguaauugaaaaagacaaaccacuaaaauacuuauuagaaaauagcgauaaaaucgucaacccacgaauuaaaaaccuuauagaaaucaaacuaucagaaaacaaaaaugauccaaagaaagcccuauuagcguuaaagaaaauuccaauauuuuuagacgaagaacaaucaauaacauuagaaaaagcaucauguuacaaugacgcaacaguacucaaauauaaacuacaaaaccucaaagcagcucaagucgaugacaucguugaugaaaaaguuaagaaaauagugagagaacgccuaucacaauuuggaaacaaagaaaaagaggcuuuuaaagauacgcuaugguucaacgaagaaaagaaaauaccgaucauaacaguaagacuauucgccaggccagaugcuaacaacuuacaaacaaucaaaaaggacgaaaauggaaacggcauaggauucguagucacaggaaauaaccaucauauagcuauauacgaagauaaagauaacaaaccaguucaacacucuugcacuuuuuggcaugcagucgaacgaaagaaauauaacauaccagcugugauacgagacucaucagaaguauggaacgacuuacuacgaaaagaacuaccagaaucauuccugaauaaacuaccugcugacaacuuaaauuuaaaauucaguaugcagcaaaaugaaauguucauacuuggacuaagccaagacgaguucguuaaagcaaucgcgaacaaugauaaaaguuuacugucaaaacaccucuacuugguuuggaguaucucagaaaacaacuauugguuucgacaucaucuagaaaccaaaaauucugaucuaaagaaaacagauggcguaaaagaaucaaaaagguuauacaacaucagaucuuugggaagccuguuuucucuaaauccaauaaaaguaagacucaacuaucuuggagaaauaacaaaaaucggugaauga

SEQ ID NO: 8710 - RNA, 3801 nt, Artificial Sequence
  Cas9 variant
auggcaaaauauauauugggauuagaccuaggaaccaacucaauaggaugggccuuaaucgaaguagacgagaauaauauaccaauuagaauaaucguaaugggaucgaggauuauaccacucagcucaaaugaucgagaagaauuucaacguggcuuguccauuacuaaaaaucaaaaccgaacaauaucaagaacacaaagaaaaggauacgaccgaaaacaacucaaaaggaacgaucucaacaaagugcuuaauaaauacaauaucuuccccucaaaaaugcuucugaaccuuccaauguuagaucuguggaaauuaagauccgacucugcaaauucaaacaaagauauuuccgcagaacaacuuggucguauacucuauauguuaaaccagaaaagaggauauaaaagcguacgauccgaggcaaacagugacaagaaagauacagacuacguacaagcaguaaaaggcagauacgcacaauuaaaagacagaaaccaaacuauaggucaauauuucuacgaagaacuauacaaugccaacguaaacaauucauauuuuaaaauuaaagaagaaguguacccccgagaagcauauaucgaagaauuugauacgauaauuaauucucagaaaacgaaacacgaguucuuaacagaccaauucguacaucaacuacgaaacgaaauaauauauuuccaaagaaaauuaaaaagccaaaaagguuuaauaagcaucugugaauuugaaggauuugagaaaacagucuucgauaaagagaaaaauaaacacaaaaucguauucguagguccaaaagucgcaccaagaagugcaccuuuauuucaacuaugcagaguaugggaagucauaaacacaauuagcauaaaagucaaaaacccugaagguaguaaauauaaguggggagaacgaauacccuccaucaaagaaaaagaaaucuuagcggacuaucuauuuaaaaacgaaguacugucauucacaaaacuccuagaaauccuuggacuaaauaagaaugacgucuaugucaacaagcaaauauuaaaaggcauaaaaggaaaugaaacuuacgcaacacuauauaacauucuuggcgaaaacgaauuuuuaaauuucgacgucucaauuauaccuuccaaucauacaucaaugcuaguugacaagaaaacuggggaaauauuagaagaaagagcaggauuagaacuugacguaaguuuagaaaaacaaccuuuuuaccaacuauggcauacaaucuacucauuaaaagaccuugacgaaugcaaaaaugcacuaauaaaacgauucgacuuugaugaugaaacugcagaaaaucuaagccgaauugacuuuaacaaacaagcauucggaaauaaaucaaauaaaagcaugcguaaaauauuaccauuccuaauggaaggcuaugacuacucacaaaguugcucacuagcaggcuacaaucauucuaauucucuaacuaaagacgaacgagaacaacaagugacacucgacagacucgaauuacuacccaaaaacucccuacgacaaccaauaguagaaaagauucuaaaucaaaugaucaaccucgucaacgcaauccuagaucaauacggugagcuaucagaaauaaggguagaacuagcuagggaacuuaaacaaucuaaagaugagcgaaacgaugcggaccuccaaaauacuaaaaauaagaaacuaaacgaugaaauaggaaaacgacucgcagaacuaggacucccaauuacaaaaagguacauacaaaaauacaaauuuauauuuccuucauuauccaaaaaucugaaagacgcacauguaaauaaccaauguauauauuguggagaaacauuuaaccuaucagaagcguuaagcggcgaugcauacgacgucgaccauauaguaccaaaagccuuauuguuugacgacucucaaacaaauaaaguucuaguacaccgaaagugcaacucaacaaaaacgaaucaaacugcauaugacuacauauccacaaaaggagaugaacaaguaaggauauacuuugagagaguggaugacugguucaaaagcggaauaaucagcuacucaaaaaugcaaagguuaaaaguuucucauaaagaauaucucgagagaaagaaaauaggaaaagaaacugaaacagacaagaaacugugggaaaauuuuauagaucgacaauuaagggacacucaauauauaucacgaaaaagcagagaaauauuacagaaagugugcaauaauguaaccacaacggaaggaggcguaacagccaaauuaagaaaucucugggguugggacgauguacucaugaaccuucaaaugccaaaauacagggagcuuggccaaaccgugauaaaagaauggacaagcgaacacggcaaacguaaacaccaaaaagaagaaguugaaaacuggacaaaaagggaugaccacagacaccacgcaauagaugcccucguaaucgccuguacaaaacaaggauuuauacaacgaauaaauacacuaaacagcagcgauacaaaagaucucaugcuaaaagaaguagaagaggcaaaaguuaaauuuagugagaaaacaacuuuauuagaaaaauaccuacgaacacaagaaccauucucgacacaagaaguaaugagggaagccgacaaaguauuaguuucauuuaaagcaggcaagaaagucgcaacaaucaccaaauuuaaagcuauaggcaaaaacaaagauagcggaguaauagucccccgcggagcccuacaugaacaaagcgucuaugguaaaauaaaaguaauagaaaaagauaaaccuuuaaaauaccuauucgaaaacucugaucgcauaguagacccaaaaguuaagaaauuaguagaaguaagauuaagcgaaaacgaaaacaacagcaaaacugcaauaagcacccucaagaaagcaccuauauucuugaacgaagagaaaaccgaagucuuggaaaaggcuucuuguuacaaugacgcaacagugcugaaauacaaacuccaaucgauuaaagcaucacaggccgacgauaucgucgacgaacguguuaaauuuuuagucaaagaaagauuagcucaauucggcaacaaagaaaaagaagcauuuaaagacauacuaugguuuaacgaagaaaaacaaauaccaauaauaaguguucgcuuauucgcuagaccagacgcaaauaaccuccaaguuaucaagaaagacgaaaauggcaaaagcauagguuucguacucacaggcaauaaucaucacauagcaauauacgaagacaaagauaacaaauuaauacagcacucaugcacuuuuuggcacgcaguagaaagaaagaaauacaacauaccagugguuaucaaaaauucaagugacguauggucccaacuucuggauaaacaauuaccagaaucacucuuaaauaaauuaccaacagauaaacuaaaucucaaauuuucuaugcaacaaaaugaaauguucaucuuaggcuuaagccaaaaagaguucgacgaagcuaucaaaaacaaccauaaaucauucuuaagcaaauaucuuuacuugguaugguccauaucaaacaacgacuauuauuucagacaucaucucgaaacuaaaaacacagaacucaaaaacauaagcaccgcaaaagaaaguaaaagauauuucagauuuaaaagugugggugcccuaguuggaacaaacccaauuaaaauaagacuuaaucacuuaggggaaauaaacaaaguuggagaguacuga

SEQ ID NO: 8711 - RNA, 3807 nt, Artificial Sequence
  Cas9 variant
augacuaagaauauacugggacuugacuuaggcaccaacaguauuggcugggcacuaauagaaguggaugaaaauaacacaccgaucagaauaaucgcuauggguucacgcauaauaccuuuaaguacauccgauaaagaagaguuccaacgaggacuuagcauuaccaaaaaucagagcagaacgguaagccgaacacagcgcaagggcuaugacagaaaacaacuaaagaaaagcgauuuaaagaaaauccuaaacaaauauaauauauuuccaucagaggaacuauugaaauuaccgauguuagaccuauggaaacuacgaagugauagcgcaaauccuaacgaaaauaucuccgccgaacaacuuggcagaauacuauauaugcuuaaccaaaaacgugguuauaaaagugcaagaucagaagcuaaugcugauaagaaagauacagacuauguacaagccgucaaagguagauacgcucaacuaaaagaaagaaaucagaccaucggacaauacuucuacgaagaacuauacaacgcaaauacuaacaacucauauuuccgaauaaaagaagaaguauauccaagagaggcauauacagaagaauuugauacgauaauaaaugcccagaaaaacaaacacgauuuccuaacugacgaaguaguccaccaacuaagaaaugaaaucaucuauuuccaaagaaaacuaaaaagucaaaaaggauuaguuagcauaugugaauuugaaggauuugagaaaacuguauucgauaaagagaaaaauaaagauaaagucgucuuugugggaccaaagguagcaccaaaaacaucgccacuauuucaauuaugcagaauaugggaagucguaaauacgauaucauuaaagauuaagaacccagaaggcaguaaauauaaguggggcgagaaaauuccaaacuuaaaggaaaaacaaaucuuagcagauuaccuauucaaaaaugacagcuuaucauuuacgaaacuacuagaaauccuagaccugaauaaaaacgacguuuacgucaacaaacaaauucuaaaaggcauuaaaggaaacgaaacauuuagcaccuuacacacaguacuuggugacaacgaacuauuaaauuucgauguaaguauaaucccgucgaaucauacgaguauguugguagauaagaaaacaggagaaauauuagaagaacgagcuggucuagaacuggaugcaucacuagaaaaagaaccuuuguaucaauuauggcacacaaucuauucacuaaaagaccuagaugaaugcaaaaacgcacuaauaaaaagauucggguuugacgaugaaacagcggaaaaacucagccacaucgacuuuaacaaacaagcauucgguaacaaaucgaauaaaucaaugagaaaaauccucccauuuuuaauggaaggauaugauuacagccaaaguuguagccuagccggcuacaaucacucaaauagucuuacgaaagacgaaagagaacagcaaauaaccuuagaucgcuuagaauuauuaucuaaaaauucauuaagacaacccauaguggagaaaauccuaaaccaaaugauaaacguaguaaacgcaauacuagaacaauauggaaaauuaucagaaauaagaguagaauuggcaagagaacuaaaacaaucaaaagacgaaagaaacgaugcagauuuacagaacuccaaaaauaagaaacuaaacgaagaaaucgggaaacgacucgcugaauuaggauuaccuguuacgaaacgcuacauacaaaaauacaaguuuauuuuuccuaguuugagcaaaaacuugaaagacgcacacguuaacaaucagugcauauacugcggggaaaccuuuaaucuaacagaagcccugucaggagacgcauuugacguagaccacauagucccaaaagcacuacuauuugaugauucccaaacgaacaaagucuuaguacacagaaaauguaacucaacaaaaaccaaccaaaccgcauaugauuauauaggaacaaaaggugaagaacaaguucgcguauacagcgaacgaaucgacgauugguucaaacgcgguauaauauccuacagcaaaaugcaaagacucaaaguaagccauaaagaauaccuugaaagaaagaaacuaggaaaagaaacagaaacagacaagaaacuaugggaaaacuuuauagaucggcaacuaagagacacccaauacaucucacgaaaagccagagagauauuacaaaaaguauguaauaaugucacaacaacagaaggaggcgucacagccaaacuaagaaacuugugggguugggaugacgucuuaaugaacuuacagaugccaaaauauaaagaauuaggacaaacagucaucaaagaauggacuucagaacacgggaaaaggaaacaucaaaaagaagaaauagaaaacuggacuaaaagagacgaccaucgacaccacgccauagacgcauuagucgucgcaugcacaaaacaaggcuuuauacaaaggauaaacacgcugaacuccucggacacuaaggaucuaaugcagagagaaauaaaggaagccaagaaacuacugggagaaaauuacaaugaaaaagaauuugaaaacgauaaugaauuuguuaaaaaccacaaagaaagacuaucacaacuagaugacuauuuacgauuacagaaacccguaaaauucgacacaaaauacgucgaacaagaagcugacaaagugcuaguaucauucaaagcaggcaagaaaguagcgacgauaacaaaauucaaagccacagggaaaaauaaagauacuggaguaauagucccacgaggagcacuccacgaagcaggacuauacggaaucagaacaauauacaguaaaggaggcauagcagaaaaacauauaauaaagaaauacaaaguugggguaucagcacaagaccacaucuuuaccgggaaagagacauacaguguaaagaaagacaaaaacggaaaugaaaaaguagaugauaaaauaaaaauaguucuugacucaauuguagacaacaaaguaaaagaagucguccuaaaucgauuaaaccgagguuucaauaacgaagaggauuacagaauagacgucaaaaaggcacucaacaauuuuaaaaaccuagacgaagacccauugugguacaacgaaucaaaagggauaaaaauauugagcauaaaacugaaaaccggauuaaaagauaguguaguaccucuacgcuuaaacgaaaagaacgaagucauaacacugguaaaaacaggaaacaaucaucauauugccauuuaugaagauaacgauggaaaacuuauucaauacuccuguaccuucuggcaugcagucgaaaggaagaaauacaacauaccaacgguaauuaaaaacucaucugaaguauggaaucagguacuagacaagaaauugccagaaaguuuccuaaaccgauuaccagccgacaaacucaacuuaaaauucucuaugcaacaaaacgaaauguucauacuagguuugcuagaagaagaguucgacaaagcaauaaaagauaacgacaaaucccuauuaucaaaauacuuauaccuaguuuggagcaucgcugaaggagacuacugguucagacaccaccucgaaacgaaaaacacagaacucaagaaaacaaacggagccaaagaaucaaaaagauacuuccgacucucaacaaaaggauuaauagauuuaaaucccgugaaaguaaggcuuaaucaucuaggagaaaucacaaaaauaggagaauacuga

SEQ ID NO: 8712 - RNA, 3810 nt, Artificial Sequence
  Cas9 variant
augaacaacaguauaaaaucaaaaccagaaguaaccauaggccuggaccuaggcgugggaagcguaggcugggcaauuguugacaacgaaacaaacauaauacaucauuuagggucuagacuauuuucacaggcgaaaacagcagaagacagacgaucauuccggggcgccagaagauuaauaagaagaaggaaauauaaacuaaaacguuuuaucaaucucauauggaaauacaacucuuauuuuggcuucaaaaacaaagaagacauacuuaacaauuaccaagaacaacaaaaauuacacaauacaguuuuaaauuuaaaacuagaagcacucaaugccaaaaucgauccgaaagcacuaagcuggauacuacaugacuaccucaaaaacaggggacacuucuacgaagacaauagggauuucaauguguauccaaccgaggaauuagcaaauuacuucggggaauacggauacuacaaaggaaucauagacucuaaagaagacaaugacgauaaacuagaagaaggucuuacaaaauacaaauucagcaaucaacacuggcuagaagaaauuaagaaaguacucucgaaucaaacaggccuaccagaaaaauucaaagaagaauacgaaucauuauucucauauguccgaaauuauucagaaggaccaggcucaauaaacucaguaaguccauauggaauuuaccaucuagacgaaaaagaaggaaaaguagugcaaaaauacaacaacauaugggacaaaaccauugguaaaugcagcauuuuuccagaugaauaucgagcacccaaaaacucaccaaucgcaaugauauuuaacgaaaucaacgaacuuaguacaauacgaucauauucuaucuaucucacaggaugguucauaaaucaagaguucaagaaagcauaucuaaauaaacucuuagaccuccuaauaaaaacaaacagugaaaaacccauagaugcccgacaauucaagaaacuuagagaagaaacaauagcggaaagcauaggaaaagaaaccuuaaaagauguugaaagagaagaaaaauuagaaaaagaagaccacaaauggaaauuaaaaggacuaaaauuaaauacaaauggcaaaauccaauacaacgaccuaagcucauuagccaaauucguucauaaacuaaaacaacauuuaaaacucgacuuucuacuagaagaucaauauacaacacuugacaaaauaaacuucuuacaaucacuauucgucuacuugggaaaacaucuccgauauucaaaccgaguugacagcgcuaaccucaaagaguucuccgauucaaacaaacuauucgaaagaguacuccaagaacaaaaagacgauuuauucaaauuauuugaacaaacagauaaagacgaugaaaagauauuagcacaaacgcauucucuguccaccaaagcaaugcuauuagccauuacaagaaugacaaaucuagacaacgacgaagacaaucagaaaaacaaugacaaaggguggaacuucgaagcuaucaaaaauuucgaccaaaaauuuauagauauaacuaagaaaaacaauaacuuaaguuugaaacaagauaaaagauaccuagacgacagauucauaaaugacgccauucuauccccaggcguaaaaagaauacuuagggaagcaaccaaaguguucaacgcaauacuuaaacaauuuucagaagaauaugauguaacaaaaguaguaauagaauuagcaagagaauuaagugaagaaaaagaacuagaaaacaccaaaaacuaugaaaaacuaaucaagaaaaauagugacaaaauuuccgaacgacucgaagcacuagauaucgcugaagacaaaaucgaagauauacuaaaaagucccacaaaauccuacaaaguguuacuguggcuccaacaagaccauauagacccuuacucccaaaaagaaaucgccuucgaagacauacuaacaaaaacagagaaaacagaaauugaccauauaaucccuuauuccauuagcuuugaugacucuaguucuaacaaacucuuaguauuagcugaauccaaccaggcaaaaucuaaccaaacaccauaugaauuuauaacauccggcaaugccgguaucaaaugggaagacuacgaagccuauugcagaaaauuuaaagauggagacacaucgcuuuuagauucaacucaaagaagcaagaaauuugcaaaaaugaugaaaacugauacuuccagcaaauaugacaucggauucuuagcgagaaaccuaaacgauacucgauacgcuaccaucguauuucgagacgcccuaaaagacuacgcaaacaaccaucuuguagaagacaaacccauguucaaaguugucugcaucaacggcggagucacauccuuucuccgcaaaaacuuugacaaaucgugguacgcaaagaaagauagagacaaaaacauccaccacgccgucgacgcaucaauaaucucgauauuuucaaacgaaacaaaaacccuauuuaaccaauuaacucaauuugcagacuacaaauuauuuaaaaacaccgacggaaguuggaagaaaauagacccaaaaacaggaguaguaacagaaguaacagacgaaaauuggaaacaaauaagagucaggaaccaagugucagaaauagccaaaguaauaaauaaaugcauacaagauagcaacaucgaacgcaaagcaagguauucgcguaaaauagaaaauaaaacaaacaucagcuuauucaacgacacaguguauagugccaagaaaguaggauacgaagaucaaauuaaacguaaaaauuuaaaaacauuagacauacacgaaucugcagaagaaaauaagaacucaaaagucaagaaacaauucguauauagaaaauuaguaaaugucucacuuuuaaacaacgauaaacuagccgaccuauucgccgaaaaagaagacauucuaauguacagagccaacccauggguuauuaaucuagcagaacaaauauuuaaugaauauaccgaaaacaagaaaauuaaaucucaaaauguauuugaaaaauacaugcuugaucucacaaaagaauuuccggaaaaauuuagugaagccuuugucaaaaguaugcucagaaacaagacagccauuauauacaacgucgagaagaaaguagugcacagaauaaaacgcuuaaaaaucuuaaguagcgaacucaaagaaaauaaacuaucaaacguaauaauaagaagcaaaaaugaaucaggaaccaaacuaaguuaucaagacacaauaaacucuauagcucuaaugauaaugagaucaauagauccaacagcaaagaaacaauauauaagaguaccacuaaauacauuaaaccuacauuuaggagaccaagacuucgaccuacacaacauagacgcauacuuaaagaaaccgaaauuuguaaaauacuuaaaagcuaacgaaauaggagacgaauacaaacccuggcguguucuaacaucaggcacauuacucauacauaagaaagacaagaaauuaauguauaucagcucauuucaaaaucuaaaagacguuaucgaaauuaaaaauuuaauagaaaccgaauacaaagaaaacgacgacucugauccaaagaagaagaagaaagcaaaccgauuccugaugacacucucaacaauauuaaacgacuauauacuucuagaugcaaaagacaauuucgauauccuuggacucagcaaaaacagaauagacgaaauuuuaaacucaaaguuaggucucgacaaaaucacaaaguga

SEQ ID NO: 8713 - RNA, 3810 nt, Artificial Sequence
  Cas9 variant
augaacaacagcauaaagaguaaacccgaaguaaccauagggcuagaccuagguguagggaguguagguugggcuaucguugauaacgaaacuaauauaauccaccauuuaggauccagacuauuuucccaagccaagacggcagaagauagacgaagcuuuagaggaguaagacgauuaauaaggagaagaaaauacaaacuaaagagauuuguaaauuuaaucuggaaauacaacucauauuuugguuuuaaaaacaaagaagauauucuaaauaauuaccaagaacaacaaaaauuacacaacaccguauuaaacuuaaaaagcgaagcucuuaaugcuaaaauagacccaaaagcacuuagcuggauacugcacgauuaccuuaagaacaggggacacuucuacgaagauaacagggauuucaacguauacccuaccaaagaacuggcaaaauacuuugacaaauacggguacuacaaaggcauaauugauucgaaagaagauaacgacaacaaacuagaagaagaacucacgaaauacaaauucaguaauaaacauuggcuagaagaaguaaagaagguucuauccaaccaaacaggccucccagaaaaauucaaagaagaguacgaauccuuauuuaguuauguaagaaacuacucagaaggccccggcucgaucaacucagucucaccauauggaauauaccaucuagacgaaaaagaaggaaaaguuguacaaaaauacaauaacauaugggauaaaaccauaggcaaaugcaauaucuuucccgaugaauaccgagcaccaaaaaacucaccuauagcuaugauuuuuaacgaaauaaaugaauuaaguacuaucaggagcuauucaauuuaccuaacuggaugguucauaaaccaggaauuuaagaaggcauacuuaaacaaauuacuugaccugcugauaaaaacuaauggcgagaaaccaauugacgcaagacaauuuaaaaaguuaagagaagaaacuauagcagagucaauaggaaaagaaacauuaaaagaugucgaaaaugaagaaaaacuagaaaaagaagaccacaaguggaaauuaaaggggcuaaaauuaaacacuaacggcaaaauacaauauaacgacuuaagcucuuuagcaaaguuuguacauaaacuaaaacaacaccucaaguuagacuuccuucucgaagaccaguacgcaacacuagacaaaauaaauuuuuuacagucauuauuuguauauuuaggcaaacaccugagauacaacaacagaguagacucagccaaucuaaaagaauucuccgauucuaaucgacuauucgagcgaguccuacaagagcaaaaagauggcuuguuuaaauuauucgagcaaacugacaaagaugacgaaaaaauauuagcacaaacacauucacuaucuacaaaagcuaugcuucuagcaauaacaagaaugacaaauuuagacaaugaugaagauaaucaaaaaaauaacgacaaaggauggaacuuugaagcaaucaaaaauuucgaccaaaaauuuauagauauuacaaaaacaaauaauaaucuuagucugaaacaagacaaaagauaucuagaugauagauuuauaaacgacgcuauucuuaguccaggaguaaaacgaauuuuacgagaagcaacuaaaguauucaacgcaauauugaaacaauucagucaagaauaugacgucacaaaagucguuauagaauuagcuagagaacucucagaagagaaagagcuagaaaacaacaaaaacuacaaaaaauuaauuaaaaaaaauucagacaagauuuccgaaggauuaaaggccuuggacauagcagaggauaaaauagaagacauacuaaaauccccaacaaagucauacaaaguacuuuuauggcuacagcaagaccauauagacccauacucucaaaaagaaaucgccuucgaagauauauuaacgaaaacggaaaagacagaaauagaccacaucaucccauacuccauaaguuuugacgauucaaguucaaauaaacuccuuguccucgcagaaaguaaccaagcaaaaucaaaccaaacacccuacgaauucauaacaucaggcaacgcuggaaucaaaugggaagauuaugaggcuuacuguagaaaauuuaaagacggagauacgagccuuuuagacucaacacaaaggucuaaaaaauucgccaaaaugaugaaaacagauacauccaguaaauaugacaucggauucuuagcaaggaaucuaaacgauacccgcuacgcaaccauaguguucagggacgcccucaaagacuacgcaaacaaccaucuaguagaggacaaaccuauguucaaagucgucugcaucaacggcggaguaacauccuuuuuaagaaagaacuuugauaaaucaugguacgcaaagaaagaccgagacaaaaauauacaccacgccgucgacgcuaguauuaucucaauauuuucuaacaaaacaaaaacauuauuugaccaacuaacacaauucgcagauuacaaacuauucaaaaauacagacggaagcuggaaaaaaauagacccuaaaaccgguguaguaacggaaguaacagacgaaaacuggaaacaaauaagagugagaaaccaagucucuaaaauagcagaagaaauugacaaaugcauacaagacucaaacauugaaagaaaggcaagauacagcagaaaaauagaaaauaagacgaauauaagucucuucaaugacacaguauauucagcuaaaaagguuggcuacgacgaucaaauaaaacggaaaaauuuaaaaacucuggauauagacgagucaguagaggaaaauaagaauagcaaaguaaaaaaacaauucguguaccguaaacucguaaauguaucucuacuaaacaacgacaaacuagccgaccuauucgccgaaaaagaagauauacuuauguaccgcgcaaauccuuggguaauaaaccuggcagagcaaauauucaacgaauacacagagaacagaaaaauaaaaagccaaaacguuuucggcaaauacaugcuagacuuaacgaaagaauuccccgaaaaguuuagugaagccuuuguaaaaagcauguuacgaaacaaaacagcaaucauauauaacgucgaaaaaaaaguaguacauaggauaaaaagacugaaaauauuaucuuccgaacugaaagaaaauaaauugucaaacguaauaauaagaucaaaaaacgaaaguggaacaaaacuuucauaucaagacacuaucaauucuguagccuuaaugauaaugagaucgauagaccccacagcaaaaaaacaauacauaagggucccauuaaacacacuaaaccugcauuuaggagaccacgauuucgaucuacauaacauagaugcauaucuaaaaaaaccuaaauuuguaaaauaccuuaaggcaaaugaaauaggagaugaauacaaaccauggcguguauuaauaagcggaagccuauugauacacaaacgcgauaaaaaauuaauguauauaucauccuuccaaaauuuaaaugaucuaaucgaaauaaaaaaccuaauagaaacagaauacaaagaaaacgucgacagcgaccccaaaaaaaaaaaaaaagcaagccaaauacuucguucccuaagcacuauacuaaacgacuacauucuauuagacgcuaaagacaauuucgauauauuaggcuuaucaaaaaacagaauagaugaaauauuaaauaguaaacuagaucuagacaagaucgccaaauga

SEQ ID NO: 8714 - RNA, 3822 nt, Artificial Sequence
  Cas9 variant
augaagaaaauccuaggcuuagauuuaggaacaaauucaaucggaugggcauuaauugagguagaugaaaacaauuucccaauacgaauaauagcuaugggaagccggauaauaccccuaagcagcaacgacaaagacgaguuccaacggggauuaagcauaacuaaaaaucagucacguacaguaucaagaacacaacgaaaaggguaugaccgaaaacaauuaaagaaauccgacgacuucaaauauucacucagaagaauacucaacaaauauaauaucuucccgucagaagaacuguugaaauuaccgauguuggaucuauggaaacuacggucugacgcgguaaauccaaaugaaaacauaucagcagaacaacuaggcagaauuuuauauaugcuaaaccagaaaagaggauauaaaucggcaagaucagaagcaaaugcggacaagaaagacacagacuauguauuagcuguuaaaggaagauacgcacaacuaaaagaccgcaaccaaacaauuggccaauacuuuuacgaagaacuccauaacgcaaaaacaacaaauuccuacuucagaacaaaagaagaaguauacccaagagaggccuacaucgaggaauuugauaccaucaucaaugcccaaaaauccaaacacgacuuccuaaccgaugaagucguucaucaacugagaaaugaaauaauauacuuccaacgcaaauuaaaaucacaaaaaggccuaguuucuauaugugaauuugaaggauuugagaaaaccauauuugacaaagaaaaagauaaaaacaaaguuguuuucguaggacccaaaguggccccaaaaacaaguccacuuuuccaauuauguagaauaugggaaguaguaaauacaauaacauuaaaaauuaaaaacccagaaggcucaaaauacaaauggggugaaaagauaccaaacaucaaagaaaaggaggcuuuagcagacuauuuauucaaaaaugaaacccuaucauucaacaaacucuuggauauucucgaacugaagaaagaaaauguuuauguaaauaaacaaauaauaaaaggcauaaaaggaaacgaaacauauucagccuuacacagaauuuuaggagacaaugaauuacuuaaauuugacguaucaauaauucccucaaaccacaccagcaugcuaguagacaaaaagacaggggaaauauuagaagaacgagcgggucuagaauuagauguaucgcuagaaaaagaaccucuauaccaacuauggcauacaauauacaguaucaaagacuuagaugaauguaaaaaugcgcuaauaaaaagauucggcuuugacgaugaaauagcagaaaaauuaucucacuuagauuuuaauaaacaagcguucgggaauaaaucaaauaagucuaugagaaagauacuacccuuucuaauggagggcuauaauuauucccaaucaugcacacuugcuggauauaaccauucaaacagcuuaacaaaagaugaacgagagcagcaaguaacacucgauaaauuagaacuccuaccaaagaacagucuuaggcaaccaaucguagagaaaauacuaaaccaaaugauaaauguuguaaacgcaauauuagaagaauauggaaaaccaagugaaauaagaauagaacucgcaagagaauuaaaacaauccaaagaugaacgacaugaugcagacuuacaaaauuccaaaaacaagaaacuaaaugaagaaauuggaaaacgauuaacagaacuuggacucccaguaacaaaaagguacauacaaaaauacaaauuuauauucccuagcuuaucaaaaagucucaaagacgcucaagucaauaaccaaugcauauacugcggagaaacuuuuaauuuaacagaagcauuaucuggggaugccuaugauguagaccauaucguaccaaaaagucuacuauuugacgacucacaaaccaacaaaguacugguacacagaaaauguaacuccacaaagacuaaucaaacggccuacgacuacauagcaaguaaaggcgaagaggaagugcaaauauauagugcccgaguagacgauugguuuaaacgaggaauuauaaguuauucuaaaaugcaacgacuaaaaguaucucauaaagaguaccuagaaagaaaaagucuuaauaaagagacagaaacagauaagaaacuaugggaaaauuucauagaucgacaacuaagggacacacaauauauaucaagaaaauccaaagaaauauuacagaaaguauguaacaacgugacaacaacugaaggaggagucacugcaaaacucagggaccuaugggguugggacgacauacuaaugaaucuucagaugcccaaauauaaagaacuucggcaaacagucaucaaagaauggaccagcgaacacggaaaaagaaaacaucaaaaagaagaaaucgagaacuggaccaaaagagacgaucaccgucaucacgcaauagaugccuuaguaauugcaugcacaaaacaaggauuuauacaacgaauuaacacacucaacucaagugaaacuaaagauuuaaugcaacaagaaauaaacgaagcaaagaaacugcucggggaaaacuauaaagacaaagaauuugaaaacagcaacgaauuagucaaaaaucacaaaggaagguuauccaaauuagacgauuaccuccgccuccaaaaaccaauaaaauuuaauacuaaauacgucgaaaaagaagccgauaaaauucuuauauccuucaaagcaggaaagaaagucgcaacaauaaccaaauuuaaagcaacaggcaaaaauaaagauacuggagucaucguaccaagaggugcucuacacgaagcuggccuauauggagucagaacaaucuauucuaaaggagguauagccgaaaaacacauaauaaagaaauacaaaguaggaguaagcgcacaagaccauauuuucacuggcaaagaaagcuacagugucaagaaagacaaaaacgguaacgaaaaagucgacgacaaaauuaaagugguccucgauagcauaguagauuccaaaguaaaagaaauuguacuuaaucgacuaaacuuuggauucucagacggugaagacuauaaaaauaacguuaagaaagcucuaaacaauuuuaaaaaucuagaugaguauccuuuaugguacaacgaaaacaaaggaaucaaaauuuuaagcauaaaauugaaaacaggucucaaagacagcguuguaccacuuagauuaaaugaaaguaacgaaguaaucacucuuguuaaaacaggcaacaaucaccacaucgcuaucuacgaagacaaaaauaguaaaccaguacaacauagcuguacuuucuggcaugcaguugaaagaaagaaauacaacauacccgcuguuauaaagaaaagcuccgauguuuggaaccaauuguuagauaaagaacuaccagagucauuccucaacaacuuaccagaggacaaccuaaauuugaaguuuucuaugcaacaaaaugaaauguucguauuaggauuaucccaagaagaguucaaagaagcuauugaaaauaaugauaaaucucuacuaaguaaauaucuauaccuaguaugguccguaucagaaaacaacuauugguucagacaccauuuagaaacaaagaacucagacuugaagaaaacugaaggagccaaagaaucaaaaagacucuacaauauaagaucggugucaucacucuucuccuuaaacccagucaaaguacgauuaaaucauuuaggcgaaauaacgaaaauaggagaauacuga

SEQ ID NO: 8715 - RNA, 3825 nt, Artificial Sequence
  Cas9 variant
augaccaaacacauauuaggucucgacuuagguacuaacucuauugggugggcaauaauccaagucgauaauaacaauaauguacccauacaaauaauagccauggguucacgaauaaucccacuagauuccaaugaucgugaucaauuccaaaaaggccaagcaauaucaaagaauaaagaccgcacaacagcacgaacccaaaggaaaggauacgacagaaaacaauuaaaaaaaagugacgacuucaaauauucacuaaaaaaaauacuagaaaaauuagauauauucccaacugaagaacuaaugaaacuucccacacuagaccuauggaagcugcggucagaugccguaaguaacauugaagacaucacaccaaaacaacucggcagaauucucuacaugcuaaaccaaaagcgcgguuacaagagugcgagaucagaagcaaaugcugacaaaaaggacacagacuauguagcagaaguaaaaggcagguacacacaacuaaaagacaaaggacaaacucuaggacaguacuuuuacaaagaacuaagcgacgccaaccaaaacaacaccuacuauagaguaaaagaaaaaguauaccccagagaggcguacauagaagaauuugacgcaauaauaaacguccagaaaucaaaacacuccuuccuaacugaugaaguuauucauagucuucgaaacgaaauaauauauuaucagcgaaaauuaaaaagccaaaaaggacuaguaucaauaugcgaauucgaaggguucgaaacgacauacuuugauaaaaaaacacaacaagacaaaacuaucuuuaccgguccaaaaguagcaccaagaacaucaccauuauuucaauucugcaaaaucugggaaguagucaacaacauuuccuuaaagacaaaaaacccugaaggaucaaaguacaaauggagugaccgcauaccuacuauagaagaaaaacaaacaauagcuaacuaccuacaagaaaacgaaaauuuaaguuucauagaacuccucaaaauccuacaacugaaaaaagagcaaguauacgcaaacaaacagauacuaaaagggauacaaggaaacacuacauuuucagccauacacaagauaaucgggaauucagaacaucuaaaauucgacauagaaaccaucccgucaaaacauuucgcaguacuaguugauaaaaaaacgggggaaaucuuagacgaaagagacucccuggaauuaaacagcgcauuagaacaagaaccauucuaucaacuuuggcauacaauauacucaauaaaagauuuagacgaaugcaagaaggcacuaauaaaaagguucaauuuugaagaagaaauagcggaaaaacuaucgaaaauagacuucaauaagcaagccuuuggaaauaaaucaaauaaagccaugcgaaaaaugcuaccauaucuuaugcuaggauacaaucaaagugaagccgaaucauucgcaggauauaaccgacgacuaaccaaagaggaaaaaucaaaaaaugucucagaugaaccauuacaacuauuagccaaaaauagcuuacgccagccaguaguagaaaaaauucuaaaccaaaugauaaacgucguaaaugcaauaauagaaaaauacggaaaaccagaagaaauuagaguagaguuagcgagagagcucaaacaaucaaaagaugaaagagaagacgcagauaaacaaaacggcuuuaacaaaaaacuaaaugaauuaguagcuacuaaacuaacugaacuaggacuucccaccacuaaacauuauauccaaaaauauaaauucauauuuccagcuaaagacaaaaacuggaaagaagcacaggucgcaaaucaauguaucuacugcggagauaccuucaaccuaaccgaagcacugaguggagacaauuuugauguagaccacauaguaccaaaggcacuacucuuugaugacucucaagcaaacaaaguucuaguucauagaagcuguaauagcacaaagacaaacaacacagcauaugacuacauaacuaagaaaggcagccaagcacuaaaugauuacguagcuagagucgacgauugguucaaacggggaauuauaagcuauggaaaaaugcaacgccuaaaagucucauucgaggaauaccaggagagaaagaaaauaggaaaagaaaccgaagccgauaaaaggaucugggaaaauuuuauugaccgacaacucagagaaacagcuuauauagccaaaaaagcaaaagaaauuuuggaaaaaguaugccacaacgucacgucaacugagggaaauguaacagcaaaauuacgccaauuauggggcugggacaacguacuaaugaaccuacaauuaccuaaauauaaagaacuagaaaaaaaaacgaaacaaaccuuuacacaacugaaagaauggaccagcgaucacggaaaccgaaaacaccaaaaagaggaaaucauaaacuggacaaaaagggaugaccacagacaccacgcaauagacgcauuaguaauugcguguacccaacaaggauuuauacaaagaauaaauacucuuucaucgucagacguaaaagaugaaaugaaaaaagaacuagaagaagacaaaaccguauacaacgaacgacuuacacuacuugaaaauuaccuacuugaaaaaaaaccguucucaacagaagaaauagaaaaagaagcagacaaaauacuagucagcuuuaaagcuggaaaaaaaguagccacacuaagcaaauauaaagcaacagguauuaacgaaaucaaaggaguccuagugccaagagguccucuccaugaacaaucuguuuacgguaagauaaaagugauugaaaaagauaaacccuuaaaauaucucuuugaaaacucagacaaaauuguaaacccacuuauuaaacaccuaguaaagacaagauuacuagaaaaugaaaacaacgcacaagccgcacucguaaccuuaaagaacaaaccaauacuacuaaauaauaaacaaacagaaauacuagaaaaagcaucuugcuacaacgaggcaacaguucucaaauauaaauuacaaaguuuaaaagcgucacaaaucgaugacauaguagaugaaaaaauuaaguuucuaauaaaagagcgacucaguaaauuuggcaacaaagaaaaagaggcuuucaaggauauauuaugguucaacgaaaaaaaacaaauuccuauaacaagcauacgauuauuugccagaccggacgcaaacaaucuacaaguaauaaaaaaacaugaaaagggaaagaacaucggauucguauuauccggcaauaaccaucacauagccauauacgaagacaagaacaacaaauugauccaacacauaugugacuucuggcaugcagucgaacguaaacgaaauaacauaccaguccucauagaagacacuagcaccauauggaaucacuuaauuaacgaagacuucucugaaucauucuuaaauaaacuccccaaugauucacuaaaauuaaaauuuagcuuacaacaaaacgaaauguucauccuaggacuuccaaaagaacaaagcgaggaagcaauaaaaaguaacaauaaauccuuauuaucaaaacaucuauaccuagucuggaguauuaccgauggggacuacuucuuuagacaccacuuagaaacgaaaaacacugagcuaaaaaagauagacggcaguaaggaaucuaaaagauaucuaagacuuucaacaaaauccuuaguugaccuaaaccccauaaaaguucguuuaaaccaccuaggggaaauaacuaaaauaggagaguga

SEQ ID NO: 8716 - RNA, 3846 nt, Artificial Sequence
  Cas9 variant
auggaagacgauagucaacaugauauaagggaaauauaucuugcgauccaucauaugguuaaauaucgaggcaauuuccuaguagaaggcacacuagaaucaagcaacgcauucaaagaagacgaacuauuaaaauuacuaggaagaauuacaagauaugaaaugucagaaggcgaacaaaauagcgauaucgaacaagacgacgaaaacaaauuaguugcaccggcaaacggccaacuugcugacgccuuaugugcaacaagaggcagcagaagcaugagaguugacaaugcucuagaagcacuaucagcagugaacgauuuaucccgugaacaaagagcaauagucaaagccauuuuugcaggguuggaaggaaauaaacucgauuuagcuaaaauauucguaaguaaagaguucaguucggaaaauaagaaaauauugggaaucuauuuuaacaaaucugauuaugaagaaaaauguguacaaauuguagauagcggcuuauuggaugaugaagaaagagaguuccuagauagaaugcaaggacaauacaaugcaauugcauugaaacaauuauuaggcagaucaacuucaguuucagacagcaaaugugcaaguuaugacgcgcacagagcaaacuggaaucucauaaaauugcaacuuagaacaaaagaaaacgaaaaagauauaaacgaaaauuacggaauccuaguaggcuggaaaauagacuccggccaacgaaaaagcgugagaggugaaagugcauaugaaaacaugagaaagaaagcaaacguauucuuuaagaaaaugauagaaacgucugaucuuuccgaaacagauaaaaauagacuuauacacgauauagaagaagauaaacucuuuccaauucaaagagacagugacaacggaguaaucccacaccaguuacaccaaaacgaacuaaaacaaauuauaaagaaacaagggaaauacuauccuuuucuccuagacgcauuugaaaaagacgguaaacaaauuaauaaaauagaaggacuacuugccuuuagaguacccuacuuugucggaccuuuaguagugccggaagacuuacagaaaagcgacaacucggaaaaccacuggauggugaggaaaaagaaaggcgaaauuacucccuggaacuuugaugaaaugguggauaaagacgccucuggcagaaaauuuauagaaagauuaguugguacugacucauacuuguuaggggaaccaacccuaccuaaaaauagucuguuauaccaagaauaugaaguccuaaacgaacuaaacaauguaagacuuaguguaagaaccgguaaucauuggaacgacaaaaggaggaugagauuaggaagagaagagaaaaccuuguugugucaacgucuauuuaugaaaggacaaacuguaacaaaacgaacagcagaaaacuuguuaaggaaagaauauggaagaacauacgaauuaaguggauuaagugacgaguccaaauuuacaaguucuuuaucaacuuaugguaaaauguguagaauauuuggagaaaaauauguaaacgaacacagagaccugauggagaaaauaguagaacuucaaacgguauuugaagacaaagaaacccuacuacaccaacuacgccaauuagaaggaauuuccgaagcagauugugcgcuauuaguaaauacucauuacacgggauggggcagguuaucacgaaaacuacugacuacaaaagcuggagaguguaaaauuucagacgacuucgcaccacggaaacauucuauaaucgagauaaugagggcagaagacagaaauuuaauggaaauaauuacagauaaacaauuaggauucagcgauuggauagaacaagagaaucuaggugcagaaaacggaagcucguuaauggaaguagucgacgacuuaagagugagucccaaaguaaaaagggggaucauacaaaguauaagguuaaucgaugauauaucgaaagcaguaggaaaaagaccaagcaggaucuuuuuagaauuagcagaugauauacaaccgucgggaagaacaaucagcagaaaaucaagauuacaagauuuauauaggaaugcaaaucuuggaaaagaguuuaaaggcauagcagacgaacuaaaugcuugcagcgauaaggaccuacaagaugacagauuauuccuauauuacacacaauuaggaaaagacauguauacuggagaagaacuagacuuagacagacugaguagugcauacgacaucgaucacauaauaccgcaagcaguaacgcaaaaugacucaauagauaaccgaguuuuaguugcucgagcagaaaaugcccgaaaaacagacucauuuacauacaugccacaaauagcggacagaaugagaaauuucuggcaaauacucuuagauaacggacucauaucaagagucaaauuugaaagauuaacaaggcaaaaugaauuuucagagagagaaaaagaaagauuuguucaaagaagucuaguggaaacuagacaaaucaugaaaaauguggcaacucuaaugcgacaacgauacggaaauagugcagcaguaauaggacuaaacgcagaauuaaccaaggaaaugcacagguaccuaggauuuagccauaaaaauagagauaucaacgacuaucaucacgcacaggaugccuuguguguaggaaucgccggccaauuugcagcuaauagaggcuuuuucgcagauggagaaguaucagacggagcacaaaacucuuauaaccaauacuuacgagauuaccuucgaggguaccgugagaaauuauccgcagaagaucguaaacaaggacgggcauuugguuuuauaguaggaagcaugagaagucaggacgaacagaaaagagugaauccgagaacaggagaaguuguuuggagugaagaggacaaagauuauuuacgaaaggucaugaacuaccgcaaaaugcucguaacgcaaaaaguaggagacgacuuuggagcgcuauaugacgaaacaagguaugcugcuacagauccgaagggcauaaaggguauuccauucgauggagcgaaacaagauacuucguuguacggagguuuuaguucagcaaaaccggcguaugcgguacuuauugaaucaaaagggaaaacaagauuaguaaaugugacuaugcaagaauauagcuuauuaggcgauagaccaagcgaugacgaauuaagaaagguuuuagcaaagaagaaaucagaauacgcaaaagcaaauauauuauugagacauguaccaaaaaugcaauuaaucagauauggugggggauuaaugguaauaaaauccgccggggaacuaaauaaugcucaacaacuaugguuaccauacgaggaauauugcuauuucgacgaucuaagucagggaaaagggucccuggaaaaagaugauuugaagaaauuacuugauucaauuuugggcaguguccaaugccuauaucccuggcauagguuuacugaagaggagcuagcugauuuacauguggccuuugauaaacuaccagaagaugaaaagaaaaaugucauuacuggaauuguuucagcgcuacaugcugaugcaaaaacugcgaaucuuuccauagucggaaugacuggaucauggagacgaaugaauaacaaaucugguuauacauuuagugaugaggaugaauuuauauuccaauccccaucuggacuauuugagaaaagaguaacgguaggagaauugaaaagaaaagcaaagaaagaaguaaacucaaaauaucggacaaaugagaaaagacucccaacucuauccggagcaagucaaccguga

SEQ ID NO: 8717 - RNA, 3861 nt, Artificial Sequence
  Cas9 variant
augaccaaaaacauacuuggacucgaccuaggcacaaauucaauagguugggcacucauagaaguggaugaaaacaauacacccauaaggauaauugcuaugggcucgagaauaauaccucuuuccacaucugauaaagaggaguuccaaagaggauuaucaauaacuaaaaaccaaucacgaacaguaagccgcacacagcgcaaaggauacgacagaaaacagcuaaagaaaucagacuuaaagaaaauccuaaauaaauauaacauauuuccaucggaggaacuacuaaaacuacccauguuagacuuauggaaacucagaagugacuccgcuaacccaaaugaaaauauuuccgcagaacaacuaggacgcauccuuuauaugcugaaucagaaaagaggauacaaaagcgcuagauccgaagcuaacgcagauaagaaagacacagacuacguacaagcaguuaaaggcagauacgcucaauuaaaagaaaggaaccaaacuauaggucaauauuucuacgaagaacuauacaacgccaauacuaauaauuccuacuucagaauaaaagaagaagucuaucccagggaagcauacacggaagaguucgacacaauaauaaaugcccagaaaaacaaacaugacuuccuuacagacgaagugguacaucaacuucgaaaugaaauuaucuauuuccaacgaaaauuaaaaucccaaaaaggccuaguaucgauuugugaguucgaaggauucgaaaagacaguauuugacaaagagaaaaacaaagacaaagucguauucguuggaucaaaaguagcuccaaaaacgagcccucuauuucaauugugcagaauaugggaaguaguaaacacuauaucacuaaaaauuaaaaauccagaaggaucaaaauacaaauggggagagaaaacucccaaccuuaaagaaaaagaaauuuuggcagacuaccuauucaaaaaugacucacucucauucacuaaacugcuagaaauauuagaccuuaauaaaaaugacguauacgucaacaaacaaauauuaaaaggaauaaaaggaaaugaaacauucagcgcccuacauacaguacuaggggauaacgaacugcuaaacuucgauguuagcauaaucccaucaaaccacacuucaauguuagucgacaagaaaacgggagaaaucuuagaagaaagagcaggacucgaauuagacgcuucucuugaaaaagaaccacuguaucaacuguggcauacuauauacagccucaaaguacucgacgaauguaaaaacgcauuaauaaaaagauuuggcuucgacgaugaaaccgccgaaaaauuaagucauauagacuuuaacaaacaagcauucgguaacaaaagcaacaaauccaugagaaaaauauuaccauuccuaauggaaggguaugacuauagucaaucaugcagucucgccggauacaaccauucaaauagcuuaacaaaagacgaacgagaacaacaaaucacacuagacagguuagaauuacucaguaaaaacaguuuaagacaacccauagucgagaaaauauuaaaccaaaugauaaacguaguuaacgccauacuugaacaauacggcaaauuaagugaaauacgaguugaacuagcuagggaacuaaaacaaaguaaagacgaaagaaaugacgcagaucugcaaaacaguaaaaauaaaaagcucaacgaagaaauaggaaaaagacucgcagaauugggccugcccguuacgaaaagauacauacaaaaauacaaauucaucuucccaucacuaaguaaaaaucuuaaagaugcccacguaaacaaccaauguauauacugcggcgaaacauucaacuuaacagaagcacuauccggggacgcuuuugauguagaccacauuguaccaaaagcauuauuauuugaugacagucaaacaaauaaaguacugguucauaggaaguguaacagcacaaaaacaaaucaaacagcguaugacuacaucgguacaaaaggagaggaacaaguacgaauauauucagaacgaguugaugacugguucaaacgcggaauaauaucauacaguaaaaugcaaagacucaaaguaagucacaaagaauaccuugaaagaaagaaacuaggaaaagaaacagaaacagauaaaaaguuaugggaaaacuuuauagacaggcaacuacgagauacacaauacaucaguagaaaagccagagaaauauuacaaaaaguuugcaauaacguaacaacaacugaaggaggaaucacggcaaaacuccgcaaucuauggggaugggacgauguacuaaugaacuuacaaaugccaaaauacaaagaacuaggccaaacuguaauaaaagaauggacaucagaacauggaaaacgcaaacaucaaaaagaagaaaucgaaaacuggacaaagagagacgaucacagacaccacgcuauagacgcucuaguagucgcaugcacuaagcaagguuuuauacaaagaauaaacacauuaaauucaucggauacaaaagaucuaaugcaacgcgaaauaaaggaagcaaagaaacuuuugggagaaaauuacaaugaaaaagaguucgaaaaugacaaugaauuuguuaaaaaccacaaagaaagauuaucccaacuagacgauuaucuaagacuacaaaaaccagugaaauucgauacaaaauacguugaacaagaagcagacaaaguuuuaguauccuucaaagcaggcaagaaaguugcaacaauaacaaaauuuaaagcgaccggcaaaaacaaagacaccggaguuaucguccuaaggggagcacuacacgaacaaagcgucuacggaaaaaucaaaguaaucgaaaaagauaaaccccucaaauaucuauucgaaaacucaaagaaaauaguaaaucccaaaauaaaaguccuaguagaagaaagguuagccgaaaacgaaaauaacaguaaacuuagucucaguacacuaaagaaaaauccaauuuuccuaaacgaagagaaaacggaaaucuuagaaaaagcaaguuguuauaacgacgcgacaguauuaaaauauaaauuacagagucuuaaagccagccaggcugaugacauaguagaugacagaguaaaauuccugguaaaagaaagacucgcucaauuuggaaacaaagaaaaagaagcauuuaaagauacucuuugguuaaacgaagaaaaacaaauaccaauaauaaccguccgacucuuugcucgaccagaugccaacaacuuacaagccauaaagaaagauaaaaacggaagagauaucggauucguuuuaacaggaaacaaucaccauauagcaauauaugaagauaaagacaauaaauuagugcaacauaguuguaccuucuggcaugccgucgaaagaaagaaaaacaauguaccagcugucauuaaaaacagcucagacguuuggaaccaauuacuggauaaagaauuaccugaaucauuccucaauaaacuaccuauagacaaacuuaaauuaaaguucagccuucaacaaaacgaaauguucgucuuaggacuucuacaagaagauuuugaggcagcuauagaaaacaacgacaagacccuguuaucaaaacaccuuuaucuaguauggucaauaacagacggagacuacuuuuuccgacaccauuuagaaaccaaaaacacagaacuaaagaaaacagaaggugcgaaagaaagcaaaagauacuuuagacuaucaacaaaaggacuaauagacuuaaacccuguaaaaguaagacugaaccauuuaggagaaauaacaaaaauaggagaguacuga

SEQ ID NO: 8718 - RNA, 3864 nt, Artificial Sequence
  Cas9 variant
augaaaacaguuuuagggcuagauuuaggaaccaacucaauaggaugggcacuaauugaacuggaugaaaacaacauaccaauacgaauaguugcaauggguucaagaauaauaccacuaucaacgucagacaaagaagaguuccagcgcgggcuaagcauaaccaaaaaccaaucuaggacaguauccagaacacaacguaaaggauacgauagaaaacagcuaaagaaaucauaucucaagaaaauauuaaacaaauauaauauauucccaagugacgaauuacuaaaacuaccaauguuagaccuuuggaaauuaagaagcgacagcgcaaauccuaacgaaaauauaagcgccgaacaauuagguaggauacuuuauaugcuuaaccaaaaacgaggauacaaaucugcaagaucugaagcaaacgcagauaagaaagauacagauuacauucaagcaguaaaaggccgauaugcacaacuuaaagacagaaaucaaacaauagggcaauacuuuuacggagaauugaacgacgcaaaugaaaauaacaguuauuucagaauaaaagaagaaguauacccaagagaagcauauacagaagaguucgacaccauaauaaacgcacaaaaagauaaacacgauuuucuaacagaugaaguaauacaccaacuaagaaaugaaauuauauauuuucaacgaaaacucaaaagucaaaaaggauuaguaaguaucugugaauuugaaggauucgagaaaacagucuucgauaaagagaaaaauaaagacaaaguagucuucgucggccccaaaguagccccgaaaacaagcccacuguuucaauuauguagaauaugggaaguagugaacaccauaacacuaaaaaucaaaaauccagaaggaagcaaauauaaauggggcgagaaaauaccagaugugaaagaaaaagaaauuuuagcagauuacuuauucaaaaacgaaucacuuaguuucacuaaacuacuagaaauacuuaaacuaaauaaaaacaacguauacuucaacaaacagauauuaaaagguauaaaaggaaacgaaaccuacucaauauuacacucaauccuuggagacagcgaacuccuaaacuucgaugugagcaucauaccaagcaaucacacgucaaugcuaauugacaagaaaacaggugaaauauuagaagaacgagcaggauuagaauuagacacaagccuagaaaaagaaccuuuaaaucaacuauggcacacgauauacagcauaaaagaucuugaugaauguaaaucagcacuaauaaaacgauucggcuuugacgaugaaaccgcggacaaauuaucucguauagauuuuaauaaacaagcauucggaaacaaaagcaacaaaucaaugagaaaaauacuuccauuucuaauggaaggauacgacuauagccaaucaugcuccuuagccgguuacaaucacuccaacucauucaccaaagacgaaagggaacaacaaauaacucuagacaaacuagaacuacuccccaaaaacucacuucgacaacccauuguagagaaaauauuaaaccaaaugauaaacguagugaacgcgauauuagaaagauacgguaaaccuucugaaauaagaguagaacuugcucgagaacuuaaacaaucaaaagacgaaagaaacgacacagaucuacaaaauucuaaaaacaagaaacuaaacgaagaaauagguaaaaggcuagcagaauugggacuaccccugacgaaaagauacauacaaaaauauaaguuuaucuuuccgucucugaguaagaacuuaaaagacgcccacguuaacaaucaaugcauuuauuguggagaaacauucaauuuaacagaagcucuaucaggcgacgcauucgacguagaucacauuguaccuaaagcguuacuuuucgaugacucccaaaccaacaaagucuuaguacaccgaaaaugcaacucgacgaaaacuaaucaaacagcauaugauuacauagcuaccaaaggcgacgaacaaguucgugucuacucagaacgcguagaugauugguuuaaaagagguauaauauccuacucaaaaaugcaacgucuuaaaguaucacauaaagaauacuuagaaaggaagaaacucgguaaagaaacagaaacugauaagaaacuaugggaaaacuuuaucgacagacaacuacgagacacacaauacauaagcagaaaaagucgagagaucuuacaaaaaguguguaacaauguugcaacuacagaaggaggaguaacagccaaauuaagaaaccuaugggggugggacgauguucuaaugaaccuacaaaugccuaaauacaaagaacucggucaaacugucguuaaagaauggacuucugaacauggaaaaagaaaacaucaaaaagaagaaauagaaaacuggacaaaaagagacgaccauagacaucaugcaaucgacgcccuaguaguagcauguacaaaacaaggcuucauccaaagaauuaacacauuaaauucaucggaaacgaaagaucuaaugcaacaagaaauaaaagaagccaagaaacuauuaggagaaaauuauaaugaaaaagaguucgaaaacaacaacgaaucaguuaaaaaucacaaagagagacuaagccaacucgacgacuaccuaaggcuucaaaaacccguaaaauucgacacgaaauauguugaacaagaagcggacaaaguauugguaucauucaaaucaggaaagaaaguugcgacgauaaccaaauuuaaagcaacagggaaaaacaaagacaccggaguaauugucccacgcggagcguuacaugaacaaaauguauacgguaaaauaaaaguaauagaaaaagauaaaucuuuaaaauaccucuuugaaaauuccgagaaaauaguuaauccaaaaaucaaaaauaucgucgaaauaauccucucagaaaacgaaaacaacagcaaaauggcucuaagcacucucaagaaaaacccuauauuucuaaacgaagagaaaacagaucuucucgaaaaagccuccuguuaugaguacguuacagucaggaaauacccacuaaacacaauuaaagcaucacaagcagaugacauaguagacgaacgaguaaaauuccuaguaaaagaaagguuaacccaauucggaaacaaagaaaaagaagcauucaaagauacacuaugguucaacgaggaaaaacaaauacccauuauuacaguacgucuuuuugcacgacccgacgccaacaacuugcaagcaaucaagaaagacgaaucagguaaagaaaucgguuucgucgugaugggaaauaaccaucauaucgccaucuacgaggauaaagacggaaaauuaguccaacacagcugcacauucuggcaugcgguggaaagaaagaaauacaacauaucaacggucaucaaaaacagcagcgacgcauggaaccaauuucuagauaacgaacuaccagaacccuuucuaaauaaauuaccagccgacaaccuuaaucuaaaauuuucucuacaacaaaacgagauguuuauacuagggcucucacaggaagaguucgacaaagcucuaaaaucaaaugacaagucacugcugagcaaacaccuauaucuagucuggaguauaagugaaaacaacuacugguuucgccaccauuuagaaaccaaaaacagugaccuaaagaaaacaaaugggguaaaagaauccaagagacucuacaacauaagaaguuuaggcagccuauuuucauuaaacccaaucaaaaucagacuuaaccaucuaggcgaaauaacaaaaauaggcgaguacucauga

SEQ ID NO: 8719 - RNA, 3867 nt, Artificial Sequence
  Cas9 variant
augagauuauuugaagagggacauaccgcagaagacagacgacuaaagcguacagcacgacgaagaauuucuaggcgaagaaaccgacuucgcuaccuacaagcauuuuucgaagaagcuaugacugaccucgacgaaaacuuuuucgccagacuacaagaaaguuucuugguaccagaagauaagaaauggcacaggcauccaauauucgcaaaacuagaagacgaaguagcguaccaugaaacguauccgacaauuuaucaccucagaaagaaacuugcagauuccucugaacaagccgacuuacgucuaauuuaccuagcacuagcucacauaguaaaauaccgagggcauuuccuuauagaagguaaacuaaguaccgagaauacaucagucaaagaucaauuucaacaguucauggucauauauaaucaaacuuucguaaacggcgaaagucgauuaguaucagccccgcuaccggaaucaguacuaauagaagaagaguuaacagagaaagcuagcagaacaaagaaauccgaaaaaguacuacagcaauucccucaagaaaaagcuaauggccuauucggacaauuccucaaacuaaugguaggaaauaaagccgauuucaagaaaguauuugggcucgaagaagaagcaaaaauaacguacgcuuccgaaagcuacgaagaagacuuagaaggaauacuagcuaaagucggugaugaauacagugacguauuucuugcagcuaaaaauguauaugacgcagucgaauugagcacuauauuagcagauagcgacaagaaaucacacgcuaaacuuucaaguaguaugauaguaagauucacagaacaucaagaagaccuaaagaaauuuaaaagauuuauaagagaaaacugcccugaugaauaugacaaucuauuuaaaaaugagcaaaaagacggguacgccggcuauauagcacacgcuggaaaaguaucccaacuaaaauucuaucaauacguaaagaaaaucauccaagacauagccggugcagaauacuucuuagagaaaaucgcacaagaaaacuucuuaagaaaacagaggacauuugacaacggugucauuccacaucaaauccaucucgccgaauuacaagcaauaauccacagacaagcagcauauuauccauuuuuaaaagaaaaucaagagaaaauugaacaacucguuacuuuccgcauaccauacuauguuggaccauuaaguaaaggagacgcauccacuuucgcauggcuuaaacgucaaucagaagaaccaauccguccauggaauuuacaagaaacgguagaucucgaccaaagcgcuacagcguucauagagcgaaugacuaacuucgacaccuaccuuccuagcgaaaaaguguuaccgaaacacagccugcuauacgaaaaauuuauggucuuuaaugagcuuacaaaaauaucuuacacugacgauagaggaauaaaagcuaacuucucagguaaagaaaaagagaaaaucuucgacuauuuauuuaaaacucgccgaaaaguaaagaagaaagacauaauacaauuuuacagaaacgaauauaauacggaaaucguuacucuaucaggauuagaagaagaucaauucaaugcaucguucucaacauaccaagaccuacuaaaaugugguuuaacacgcgccgagcuggaucauccugacaacgcagaaaaacuugaagauaucauaaaaaucuuaacaauuuucgaagaccgucaaagaauaaggacacaacuaucaacuuuuaaaggccaguucagugcagaaguccuaaagaaacuagaaagaaaacacuacaccggcugggggcguuuaaguaagaaacuaauuaaugguauauaugauaaagaauccggaaaaacaauauuggacuauuuaguaaaagaugacgguguaaguaaacauuacaaccgaaacuucaugcaguugaucaacgauucacaacugucauucaaaaacgcaauccaaaaagcacagucaagcgaacaugaggaaacguuaagcgaaacaguaaaugaacuagcaggaucuccagcaaucaagaaaggaauauaucaaagccuaaaaauaguagaugagcuugucgcaaucaugggauacgcaccaaaacguauuguugucgagauggcgcgagaaaaccaaacaacaucaacuggcaaaagaagaucaauacaaaggcuaaaaauugucgaaaaagcaauggcugaaaucggauccaaucuauuaaaagagcaaccaaccacgaacgaacaacuaagagacacacgcuuauuccuauacuauaugcaaaaugguaaagauauguauacaggugaugagcucucauuacaucgauugagucauuacgauauagaucauaucauaccacagagcuuuaugaaagacgauucacuagacaacuuaguccuaguaggaucaacugaaaauagaggaaaaucugacgacguaccaucuaaagaaguagugaaagacaugaaagcauauugggaaaaacuauacgcugcaggacugauaagccaacgaaaauuccaacggcuaacuaaaggcgaacaagguggacuaacacuagaagacaaagcacauuuuauacaaagacagcuaguagaaacccgacaaauaacgaaaaauguagcagguauucuagaccaaagauauaacgcaaaaucaaaagagaagaaaguucaaauuaucacauuaaaagccagucuaacaagccaauuuagaaguauauucggacucuacaaagucagagaaguaaacgacuaccaccauggacaagacgccuaccuaaauuguguagucgcaacaacucuacucaaaguauacccaaaccuugcaccagaauuugucuacggagaauaccccaaauuccaaacauuuaaagagaauaaagcaacagccaaagcuauaauauauaccaaucuacuacgcuucuucaccgaagaugagccuagauucacgaaagacggagaaauacuaugguccaacuccuaccuaaaaaccaucaagaaagaacuaaauuaccaucaaaugaauauuguaaagaaaguagagguacaaaaagguggcuuuaguaaagagucaauaaaaccgaaaggaccgaguaauaaacucauuccagugaaaaacggucuagacccacaaaaauaugggggcuucgauucccccguaguagcuuauacaguacuuuucacacacgaaaaaggaaagaaaccacuaauaaaacaagaaauucuaggaauuaccauaauggagaaaacaagauuugagcaaaacccaauacuauuccuggaagaaaaaggauuccuacgaccacgaguuuuaaugaaacuuccuaaauacacccuauacgaauuuccagaaggacgaagaagacuccuagcaucagcaaaagaagcacaaaaaggaaaccaaaugguauuaccggagcaccuauuaacauuauuauaccaugcaaaacaaugucuauuacccaaccagagcgaaagccuagcauacguagaacaacaccaaccagaauuucaagagauauuggaaagagucguagacuucgcagaaguacacacacuagcuaaaucuaaaguacaacaaauuguaaaacuauucgaagccaaucaaacugcagacguaaaggaaauagcagcaucauucauccaacuaaugcaguucaaugcuaugggagcaccauccaccuucaaauucuuucaaaaggauauagaaagagccagauauacaucaauuaaagaaauauuugaugcaaccaucauauaucaaucaccaacgggucucuacgaaacaaggagaaaaguaguagauuga

SEQ ID NO: 8720 - RNA, 3903 nt, Artificial Sequence
  Cas9 variant
auguggggaguaucauuauucgaagcaggcaaaacagccgcugaaagaagaggcuauagaucuacucgacgacgucucaaccauaggaaauuccgucuaagguuacuugaagauauguucgaaaaagaaauccuaucaaaagacccgucguuuuucauaagacuaaaagaagcauucuuaucucccaaagacgaacaaaaacaguucaaaggaaauauacuauucaaugacaaagauuacacagaugcagacuauuacgaacaauauaaaacgauauaccauuuaagauacgaucucaucagucaacacagacaauucgauauaagagaaguguaccuagcuauacaucaccuaaucaaauacaggggucacuuuauauaugaagaucaaacguuuacaacagacgggaaucaacugcaacaucacauuaaagccauuaucacaaugauaaacucaacuuuaaacagaauaauaauaccggaaacaauagacauaaauguuuuugaaaagauauuacuagauagaaugaugaacagaucaaguaaaguuaaauucuuaauagaacuuacaggagaagacaaacaagacaaaccacuccucaaagaauuguuuaaucuaauuguuggacuaaaagcaaaaccagcaucuauauucgaacaagaaaaccucgcaacaauuguagaaacuaugaauaugucaacagagcaaguucaauuagaucuccuaacuuuagcagauguccuagcagaugaagaauacgacuugcuacuaacagcacagaaaauauauagcgcaauaauauuagacgaaagcauggauggauacgaguacuuugccgaagccaagaaagaauccuaccgaaaacaccaagaggaauuaguccuaguaaagaaaaugcuaaaaucaaacgcaauaacuaaugaugaacgagcgaaauuugaauauuucuacacagauuauauaggagcuaaaaguagcaauuaugaagaauccaaaaauauaaagaaaggauugagcgcagcauauggaaaauacuccaaagaagaacgauuauucaaacacauagaacuacuccuagcaaaagaaaauguucuuacuacaguagaacaugcauuacuugagaaaaauaucacauucgcaucacuucuuccacugcaaagaucuucacgaaacgcaguuauuccauaccaaguccacgaaaaagaacucguggcaauccuugaaaaccaagcuacauacuauccguuucuccuagaacaaaaagacaauauacacaaacuacugacauucagaauaccauacuauguaggaccauuagcugaccaaaaggacuccgaauuugcuuggaugguacgaaaacaggcugguaaaauaacccccuucaacuucgaagaaaugguugauauugacgcguccagcgaagcauuuaucaaacgaaugacaaauaaauguacguaccucauacaugaagacguaauaccaaaacacagcuuuucuuaugcaaaauucgaagucuuaaacgaauuaaauaaaauaagacuugauggaaaaccuauagacauccccuuaaagaaaagaaucuuugaaggucuauuccuagagaaaacgaaggucacucagacaucacucaaaaaguggcucgcugaacaugaacacaugacuguuucugucguacaaggcacccaaaaggaaacagaauuugcaacuucccuacaagcauuccaccguuuuguaaaaauauucgacagagaaacaguauccaaccccgcuaacgaagaaauguuugaaaagauaauauauuggucaaccguuuuugaggauaagaaaauaaugcgaagaaaacucucagaauauccacaguuaacagaacaacaacaaguacaauuagcacaaguacgauucagaggauggggaagguuaucacaacgacuaauaaacagaaucaaaacaccgguauccggcgaugaagaccacaaacucagcauuaaugaaauucuauggcaaacaaaugaaaacuucaugcaaauaauacgcaacaaagacuauuuauucaagaaaauaauugaagaacaauucgaaaacgaaacugcauuacuaaacaaacaacgaauagacgaauuagcagccucccccgccaauaagaaaggcauuuggcaagcaauuaaaauuguaaaagaacuugaaaaaguccuacaacaaccagccgaaaacauauucauagaguucgccagaagugaugaagaaagcaaacgaucaacaccacgggauaaauuuaucgaaaaagcauaugcgcaacuaaagaaagaaacagacacguuuaaucuagaacaccuaaaagaacuuaaacaaaggagcaaacaauuaaguucucaaagacuauucuuauacuucauccaaaacgggaaauguauguacuccggagaacaucuagacauagaacgauuagacagcuaugaggucgaucauauacuaccacaaucauauaucaaagacaacucaaucgaaaauuuagcccuagucaagaaaguagaaaaucaaagaaagaaagacucucuauuauuaaauucaucuauaaucaaucaaaauuacucaagaugggagcaacugaaaaacgcaggacuaaucggcgagaagaaauuucgaaauuuaacuagaacgaaaauaacggaucgagacaaagaaggauuuauagcgcgccaauuaguagaaacucgucaaaucacaaaacauguuacacaacuucuacaacaagaauauaaagacacuacaaaaguauuugcaauuaaagcaacucuaguaucaggauugagacguaaauuugaguucaucaaaaacagaaacguuaacgacuaucaucacgcacaagacgccuuuuuagucgcauuucuggguaccaauauaacaucaaauuauccaaaaauagaaauggaauaucucuucaaaggauaccaacacuacuuaaacgaaguaggcaaaucagcugcuaaaccaaaauucacauuuauagucgaaaaccuauccaaacaacaauacaacucuacaacuggggaaguaaaauggaacccggaaguagacauugcaaaacuuaaacgcauauugaauuuuaaacaauguaacauagucagaaaaguagaggaacaaucaggcgcuuuauuuaaagaaacaauauacccaguugaagaaucuagcaguaaaacaaucccucuuaagaaacaucucgauaccgcuaucuacgguggauauacagccguuaauuacgcaucauacgcauuaauacaauucaagaaaggacgcaaauuaaaaagagaaauaauaggcauuccucuagcaguccaaacuagaauagauaauucugaaaccucucuccaagccuauaucgcagaacaaauaaaauccgagguagaaauacuaaacggcagaauccuaaaauaucaacuaauaagcaauaauggaaaccgauuguacauugcagguccuagugaacgucauaacgcuagacagcuaauagucuccgaugaggcagcaaaaguaaucuggcucauaucgacuaaacaggcagacgaggcaauguuucuaaaauacuauagauuagaacauuuagaagcaguauucgaagaauuaauacgaaaacaagcagcagauuaccagaucuucgaaaaacucauaaagaaaauagaggucaauaaaguauacuucuauagcugcacauacaaugaaaaaguaaaagucauugaagaguuacuuaaaauuacacaagcuaacgcuacaaauggugaucucaaauuacucaaaaugucaaaccgagaaggucggcuaggaucaguaucaguugcacuugacuucaaaaucauaaaucaaucagucacaggacuauaucaaagcaucgaagacuacaacaauuga

SEQ ID NO: 8721 - RNA, 3930 nt, Artificial Sequence
  Cas9 variant
auggguaguguagguuucgcagguauugacaaucaauacaaccuuguaagaacaaaaggcaaaaacguaauaggaguaagauuauuugaugaggcagacagugcagcagaaagaaggggacacagaaccaauaggcggagauuacaacgacgaagguggcgucuuagacuacuagaugacauauuugccaaaccuuuacaggcgguugacccaaacuuucuugcaagauugaaauacucguacguaaauaagaaagaccagggacagcaagaucacuacuauggagguuauguauucgggucaaccgccgcugaucaagccuaucaccaagcauaucccacaauauaccauuuacgaaaaagacuaauggaggaugaucaaaagcacgaucucagagaaguauaucuagcaauccaucauauagugaaauacagaggaaacuuccucaacccgcaaucaucacuagacauagaccaacaauuugauguaacagauuuugcacaagcucucgcaagauucgcugaccaccaagcacuaaguugggcacuggaagccccaauaagauuuuuagaagcagaacuagcaacagguuugucaaacagcgcacgaguagacgcagcaauagaagcuuucucuuuugacacgaaagucgaccgggcagcaauaaaagagaugcuaaaaggauuaucaggaaaucaaauagacuucacaaaacuauucguaaacguggacucugccgauugggaucaggaagaaagaaaacaauggaaaaugaaguuaagugaagaagauuucgaugaacaagccuuaccaaucuuggaaagacucucacaagacgaaaccgaauucuuccuagcgaucaaacgagcauaugauggaaucgcguuaaugagauuuuuaggagaugaacagagucuaaguucagcaaugauaaaagcguacgaagaccacagaagggaucuaacuuuuuuaaaaacacaaguucgaacaccucaaaaccgucaagcacugucagaaggcuauacaaauuaucuaagcguagacgauaaaaaacacaaaagaggagccaaagaacuagcacaauuaauagaagccucagaugcauccgaacaagauaaagcaacaauguuagauagaauagcaaaugaucaauuugcaccaaaacaaagaaccaaagcuaacggucuaauuccauaucaauuacaucuagccgaguuaaagaaaauacucgcuaaacaaggccaauacuauccauuuuuauuggauaccuuugccaaacaaggacaaucgguaaauaaaauagaggaauuagugcaauuucggguuccauauuauguagguccgauggucccaaaaagugagacagcaggaaaugcagaaaaccauuggguagaaaaaaaugacggucaaacgaaggucaguguaacaccuuggaauuuugaccaaguguuuaauagagaccgagcugcaaaaucauuuauugauagauuaacugggaccgacacauaccuaauaggagagcccacuuuaccacgacacaguuuaacuuaugaaacuuuuacuguacuuaacgaacuuaacaacauaagaauagacggaaaaagguuaccaguugaaacaaaacaagcaauaguggaagacuuauuuaaaaaauaccgcuuaguaacuaaaaagcgucuucaggauuacuucgcaucauuugggaagagagagguagaacuaaccggacucgcagaugaaucacgauuuacuagcuccuuaaccagcuaccaugauuuacaagggcuuuuaggaaccgacuucaucacuaacccacaaaaucauagucuacuggaaaaaauugucgaaauacaaaccguauucgaagacagcgacauagcagaaagggagcuaggcaaacuaggauuagaacaaaaacuaaucccgagauuagcaaaaaagcacuauacaggaugggguaaucuaagccgaaaacuacuugauacuucauuuauucaugauccugaaagacccgaagaaccagucucgauaauggacuugcuguacacuacuaauaaaaacuucauggaaauacuacacgauagugaauaugguguagaagaauggcuaaaaucccaaaacaugaucgaugaccaaaaggauauacaaaugcgaaucgacgaacuaacaacaucaccagcaaauaaaagaggaauaaaacaagccuuuaauguccuagacgauauuacucaagcuaugggugaagaacccgcauauguauaccuugaauucgcuagagaaaagcaagcaagucgacguacgguauccagaaagaaaaggcuggaaacacuuuacaaaaacgcugcccuaaaaacugaauucaaagcaauuaaagaagcauuagcugaagaaucggacgauaggaugcaagacgacagauuauacuuauacuaugcacaacuaggaagagauauguacacgggucaaucaauaucaauugaccaauuaucaucacauuacgauauagaccauauaguuccaagggcauucauaaaagaugacagcuuggagaauaaaguauuaguuaacaggacagauaacgcuaggaaaaccgacucagcuaccuuuacagcagauguaaaagcaaaagcauucccucuuuggcagcaauugaaaaaacucggauuaaucagugcaaaaaaauuuagacuacuaacacggacaggagauuucaccgaaauggaaagagaacgauucauagcaagacaacucguagaaacucgccagaucauaaagaacguagcugcguuaauagaagggcauuucucacaaacgcaagcaguagcaauacgagcagagguaacaggagaauuacgccaacuaacucaaauaaaaaaagaucgagauauaaacgacuaccaucaugcacaggacgcacuguuaguugcaaccgcaggaacuuaucugcauagacacuuuccaaaaagggacgcaagauuuauauacaaugaauucgauuacuacacacagcacugguuaaagaaccagggugaaaauagaagacgacauccauauaguuuuguugucggcaccaugucaaaaggaaacgaagauuggacaccagacaaucuaaauuaccuuagaaaagucaugcaauacaaaacaauguuaaugacaagaaaaccuguuggaccggaaggugcauuauacaaggaaacucuuaucgcagccgaccccaaaaaaagacuaguaggagcuucaaaagaaagacaagacccaacaauuuauggaggguauacuaaagaauccagcgcauauaugucccuaguaagagcagguggcaaaaaucaauuaguuaaaauuccagucagaaucgcaaaugaaauacacagcggacaaaggaaauuagacgauuacguucaagcuaagguuaaaaaauucgaaagaauuuuauuaccuaaaauaagccucggucaauuaguugaagacgaagggcaacguuuuuacuuagcuacaaacgagaugaaacacaacgcaaaacaacuaugguuggaccaaaaagucguaacgacauauaaaagauuaacugcagaaucuccuguugaagauuuuuugacuguauuugacgcacugacaagcagugccacaauucaucauuucaaauucuaccaaagagauuuagaguuacuaagggauaacagagcaggcuuccaagaucuugcgaaagcaacacaacucaagguccucaaagacguauuauacgaacugcaugauaacgcaggauggagagacccuauaaaacaauauuucaaagaaauuggauuaaaagucaggauguggacuaaacuacagaaggaaggaggaauaaaauuaacagaccaagcagagcuuauuuaucaaaguccaaguggacuauuugaaaaacgaaggcgaguucaagauuuacuguga

SEQ ID NO: 8722 - RNA, 3939 nt, Artificial Sequence
  Cas9 variant
augcaaaacggauuucucggaauaacuguaucaucagaacaaguaggaugggccguaacaaacccuaaauaugaacuggaaagagcaucaagaaaagaccucuggggaguucgacuuuuugauaaagcugaaacagcagaagaucgaagaauguuuaggacaaacagaagguuaaaucaacgcaagaaaaaucguauucacuaccuacgggauauauuccaugaagaaguuaaccaaaaagacccuaauuucuuucaacaacuagacgaaucuaacuuuugcgaagacgacagaaccgucgaauuuaacuuugauacaaacuuauauaaaaaucaauuucccacaguauaccacuuaagaaaauauuuaauggaaacaaaagauaaaccagacauacgauuagucuaucuagccuuuuccaaauuuaugaaaaauagaggccacuuuuuauauaaagguaaccugggggaaguaauggacuucgaaaacaguaugaaaggauuuugcgaaucgcuagaaaaauuuaacaucgauuuuccuacauuaagugacgaacaagugaaagaagucagagacauucucugugaucauaaaaucgcaaagacggugaaaaagaaaaacauaauuacaauaacaaaaguaaaaagcaaaacagcuaaagcguggauaggauuauuuugugguugcucaguuccaguaaagguauuguuccaagauaucgaugaggaaauaguaacagauccggagaaaaucaguuucgaagaugcuuccuacgaugacuauaucgccaacauugaaaagggaguaggaauauauuacgaagcuauaguauccgccaaaaugcuuuuugauuggagcauaaugaaugaaauccuaggcgaccaccaacuauuaucagacgcaaugauugccgaauacaacaaacaccaugacgaccuaaaacgucuacagaaaaucauaaagggaacaggaucaagagaacuauaucaagauauauucaucaacgauguaagugguaacuacgucugcuacguaggccacgcuaagacaaugagcucagcagaucaaaaacaauucuacacauuucuaaagaauagauuaaagaauguuaauggaauuucaucggaagacgcagaguggaucgacacggaaauuaaaaaugguacauuauuacccaaacaaaccaaaagagauaauagcguaauuccccaccaacuacaacuacgagaguucgaauuaauauuagacaauaugcaagaaauguauccauuucucaaagaaaaccgagaaaaacuauuaaaaauuuuuaacuuuguaauaccauacuauguuggcccacuaaaaggaguaguuagaaaaggagaaucuacaaauuggaugguuccaaagaaagacggcgucauucauccauggaauuucgacgaaaugguagauaaagaagcaucagcggaaugcuucauauccagaaugaccgguaauugcucauaccuauuuaacgagaaagucuuaccuaaaaacucauuguuauaugaaacguucgaaguuuuaaaugaacugaauccacugaaaauuaauggugaaccaauauccgucgaauuaaaacaaagaauuuacgaacaauuauuucugacuggaaagaaagucacgaagaaaagucuaacaaaauaccuaaucaaaaauggauaugacgaagacauagaacuauccggcaucgacaacgaauuucauuccaaccuuaaaucccacauagacuucgaagacuaugauaacuuaucugacgaagaaguagaaagaauaauauuaaggauaacuguauuugaagauaaacaacuacuaaaagacuaucuaaauagagaauuugugaaacuaagcgaagaugaacgcaaacagauaugcuccuuaucauauaaaggauggggaaacuuaucagaaauguuacuaaaugguauaacagugacugauuccaauggaguagaaguaucugucauggacauguuguggaacacaaaccuaaaucuaaugcagauccucaguaagaaauacggcuauaaagcagagauagaacguuauaauaaagaacaugagaaaaacauauauaacagagaagaucuaauggauuaccuuaacaucccaccagcccaaagaagaaaaguaaaucaacuaauaacaaucguaaaaagucugaagaaacgcugcggagucccuaacaaaauauuuuucaaagugucuagagaacaccaagacgacccaaaaagaacaucauccagaaaagaacaauuaaaauacuuguacaaaagucuuaaaucagaagaugaaaaacauuuaaugaaagaacuagaugaacucaacggacacgaauuaaguaaugacaaaguguaucuauacuuccuccaaaaaggccguuguauauacucaggaaagaaacuuaauuuaaguagauuaagaaaaaguaauuaccaaaaugauauagauuauauuuacccacugucugccguaaaugacagaucaaugaauaacaaaguuuuaacaggcauacaagagaauagagcagauaaauacaccuacuuuccuguagauccugaaauacaaaagaaaaugaaaggcuuuuggauggagcuaguauuacaaggauucaugaguaaagaaaaauacuuccguuugagccgggaaaaugauuuuagcgaaaacgagcuagucucauucauagaacgugaaaucagcgacaaccaacaguccgguagaaugauagcuagcguauuacaauacuacuucccagaaucaaaaauaguuuuuguaaaagaaaaguugauaagcuccuuuaaaagggacuuucaucuaauauccuccuacggacacaaucauuuacaagccgcuaaagacgcauacauuacuauaguaguggggaacguauaucauacaaaauucaccauggaccccgcaauauauuucaaaaaccauaaacgaaaagauuacgaucucaauagauuauuucuugaaaacauuagcagagauggacaaauagcgugggaaucaggcccauauggauccauucaaacggugagaaaagaauacgcucaaaaccacauagccgucacaaaaagaguaguagaaguaaaaggaggacucuucaaacaaaugccuuugaagaaaggacauggagaauauccacuuaaaaccaaugacccuagauuuggaaacaucgcccaauauggaggcuacacaaaugugacugggagcuacuuugucuuaguagaaucaauggaaaaaggcaagaaaagaauaucacuugaauauguuccuguauaccuacacgaacguuuagaagaugacccuggacacaaacuacucaaagaauaucuagucgaccauagaaaauugaaucauccaaaaauauuacuagcaaaaguucgaaagaacucacuccuaaaaauugacggauuuuauuacagauuaaacggaaggucagguaaugcucuaauacucacuaacgcaguggaauuaauaauggaugacuggcaaacaaaaacagccaauaaaauuucugguuacaugaaaaggagagcaauagacaagaaagcuagggucuaucaaaacgaauuucacauacaagaacuggaacaacuauacgacuuuuaucuagacaaacucgaaaacggaguauacaaaaaccgaaagaacaaccaagcagaacuuauucauaaugaaaaagaacaauucauggaauuaaaaacggaggaccaguguguauuacuaacagagaucaagaaacucuucguuuguuccccaaugcaagccgaccucacacuaauuggagggagcaaacauaccggaaugauagcaaugucauccaacguaacaaaagccgacuuuuccauaaucgcagaggacccacuaggccuaagaaacaaagucauauacucucauaugggugaaaaauga

SEQ ID NO: 8723 - RNA, 3939 nt, Artificial Sequence
  Cas9 variant
augcaaaauggguuccuagggauaacaguaucaucagagcaaguaggaugggcaguuaccaauccaaaguaugaguuagagcgcgcuucgaggaaagauuuauggggagugagacuuuucgacaaagcugaaacagcugaagauagacgcauguuucguacaaauaggcgauuaaaucaaagaaaaaaaaauagaauacacuaccuaagagauaucuuucaugaagaaguuaaccaaaaagauccaaauuucuuucagcaauuggacgaaucgaauuucugugaagacgaucgaacaguagaauuuaacuucgauacaaaccucuauaaaaaccaauuuccaacugucuaucauuuaagaaaauaccuuauggaaacaaaagauaagccugacauaaggcuaguauaucuugcuuucagcaaguuuaugaaaaaucguggccauuuccuguacaaaggaaauuuaggcgaaguaauggauuucgaaaacuccaugaaaggauuuugugaaucuuuagaaaaguuuaauauagacuucccuaccuuaagugacgagcaaguaaaagaaguaagagacauauuaugugaccauaaaauagcuaagaccgugaagaagaaaaauauaauaaccaucaccaaaguaaaauccaaaacagcgaaagcguggaucggguuauuuugcggcugcagcgucccagugaaggucuuauuccaagauaucgacgaagaaaucguaacugauccagagaaaauaagcuucgaagacgcaaguuacgacgacuauauagcaaacauagaaaaaggaguaggaaucuauuacgaagcuaucgucagcgcaaaaaugcuauucgauuggucaauucugaaugaaauccuaggugaccaccaacuccuauccgacgcaaugauagcagaauacaacaaacaccacgacgauuuaaaaagauuacaaaagauaauaaaaggaaccggaucucgagaacuauaccaggacauauucauaaacgacguuucaggaaauuacgucugcuauguuggacacgcaaaaacgaugagcuccgcagaucaaaaacaauucuauacauuuuuaaaaaauagacuaaaaaauguaaacggaauuaguuccgaagacgcagaguggauagacacugagauuaaaaacggaacuuuacugccaaaacaaaccaaacgagauaauagcguaauaccccaccaacuacaacuuagagaauuugaacuaauacuagacaauaugcaagaaauguauccauuccuaaaagaaaacagagaaaaauuacucaaaauauucaacuuuguaauaccauacuaugucggaccucuaaaaggaguuguuagaaaaggcgaauccacaaacuggaugguaccaaaaaaagauggaguaauacauccauggaacuuugacgagaugguagacaaagaagcuucagccgaaugcuuuauuagcagaaugaccgguaacugcucuuacuuauuuaaugagaaaguuuuacccaaaaacucacuucuauaugagacuuuugaaguauuaaaugaacucaauccgcuuaaaauaaauggugaaagcauaucuguagaauuaaaacaacggauuuacgaacaauuauuuuuaacaggaaaaaaaguaacaaagaaaagucucacaaaauaccuaauaaaaaacggauaugacaaagauaucgaacuaaguggcaucgacaaugaauuucacucaaaccuaaaaagucauauagauuuugaagacuacgacaaccuaucagacgaagaaguugaacaaauaauauuaagaaucacgguauucgaagacaagcaacuacugaaagauuaccuaaaccgagaguucgugaaauuaucugaagacgagcgcaaacaaaucuguucucuaucuuauaaaggauggggaaaccuaucugaaauguugcucaauggcauaacaguaaccgacucaaacggagucgaaguaagcgucauggauauguuauggaauaccaauuuaaauuuaaugcaaauacuaucaaaaaaauacggcuacaaggccgaaauagaacauuauaauaaagaacacgagaaaacaauauauaauagggaagaccucauggauuacuuaaacauaccucccgcccaacgaaggaaagucaaccaacucaucacuauuguaaaaucccuaaaaaaaacauacggaguaccaaacaaaauauuuuucaaaguaagcagggagcaccaagacgauccaaagcgcacuucaagcagaaaagaacaauuaaaauauuuauauaaaagccuuaaaucagaagaugaaaaacauuuaaugaaagaacuagaugaauuaaauggacacgaacuaagcaaugacaaaguauaucuauacuuccuacaaaaaggacguugcaucuacaguggaaaaaaacugaacuuaagucgacuaagaaaaucaaacuaucaaaacgacauagauuacauauacccauuaagcgccgugaaugauagaucaaugaacaauaaaguguuaacuggaauacaagagaaccgagcagauaaauacacuuauuuuccuguugauccagaaauacaaaaaaagaugaaaggauucuggauggaauuaguucuacaaggauuuaugagcaaagaaaaauacuucagacuaucacgagaaaaugacuuuagcgaaaacgaacugguaagcuucaucgaacgagaaaucuccgacaaccaacagucugguagaaugauagcaucagucuuacaauauuacuucccagaaucuaaaauuguauuuguuaaagaaaaauuaaucucuucauuuaaaagagauuuucaucuaauuucaucauacggacauaaucaucuacaagccgccaaagacgcguauauaacaauaguaguaggcaacguguaucacgcaaaauucacuauggaucccgcaauuuacuucaaaaaucacaaaagaaaggacuaugaccuuaacagacuauuccuagagaacauaagucgagauggacaaauagcaugggaaagcggaccuuacggaucuauacaaaccguaagaaaagaauaugcacaaaaucauaucgcaguaaccaaacguguuguagaaguaaaaggaggccuuuuuaaacaaaugccauuaaaaaaaggacacggcgaauauccacucaaaacaaacgacccacgcuucgguaauauagcccaauacggaggcuacacaaacguuacaggaucauacuucguccucguggaaucaauggaaaaagguaaaaaaaggauaaguuuagaauauguacccguauacuuacaugagcgacuagaagaugacccgggacacaaauuacuaaaagaauaucuaguugaucaccgaaaauuaaaccacccuaagauccuauuggccaaaguaagaaaaaacucacuauugaaaauagacggcuucuacuacagauuaaacggaagaucuggaaacgcacuuaucuuaacaaaugcaguggaacucaucauggaugauuggcaaacaaaaacggcaaauaaaauaagcggauauaugaagagaagggcaauugacaaaaaagcacgggucuaucaaaaugaauuccauauacaagaauuagaacaacucuacgacuuuuaccuagacaaacuugaaaauggggucuauaaaaacagaaaaaacaaucaagcggaauuaauccacaaugagaaagaacaauucauggaauugaagacagaagaucaaugcguacuacugacagaaaucaaaaaacuauucguauguucaccaaugcaagccgaccuaacauuaauaggaggcagcaaacauacaggcaugauagcaaugaguucaaacguaaccaaagcagauuucgcagucauagcugaagacccacuuggcuuacgcaauaaaguaauauacagccacaugggugaaaaauga

SEQ ID NO: 8724 - RNA, 3942 nt, Artificial Sequence
  Cas9 variant
augcacuaccuagaugaaauauucgcaccccacuuacaagaagucgacgaaaacuuccuaagaagauuaaaacagucaaacauacauccugaagacccagcuaaaaaccaggcauuuauuggcaaacuacuauuuccagaccuucuaaagaaaaaugaaaggggauauccuacccuaauuaaaaugagagaugaauuacccguagaacaaagagcacacuacccuguuacaaacauuuacaaacuccgagaagccaugauaaacgaagauagacaauucgacuuaagagaaguuuaucuagcaguacaccacauuaugaaauaucguggacauuuccugaacaacgcaucgguugauaaauuuaaaguaggaaggauagacuucuauaaaaguuucaacguauuaaacgaagcauacgaagaacuacaaaacggagaaggaucauuuacuauagaaccaucgaaaguugagaaaauaggacaacuguuauuagauacgaaaaugaggaaacuaaauagacagaaagccguugcaaaacuauuagaaguaaaaguugcugacaaagaagaaacuaaacguaacaaacagauagccacagcaauguccaaauuaguacuaggauacaaagcagauuucgcaacuguagcaauggcaaauggaaacgaauggaaaaucgaucucucuucagaaacaagcgaagacgaaauagaaaaauucagagaggaauuaagugacgcgcaaaaugauauauuaacagagauaacaucacuguuuagucaaauaaugcuaaaugaaauaguuccuaauggaaugagcauaagcgaaaguaugauggauagauauuggacacacgaacgccaacuagcagaaguaaaagaauaucuagcaacccaacccgcgucugcacguaaagaauuugaucaaguauauaacaaauacauuggccaagccccaaaagaacguggcuuugaucuggaaaaaggacuaaagaaaauuuugucaaagaaagaaaauuggaaagaaauagaugaauuguuaaaagcaggcgacuuccuaccaaaacaaagaacgagugcuaacggaguaauuccgcaucaaaugcaccaacaagaauuagauagaauaauagaaaaacaagcaaaauacuacccauggcuggcgaccgaaaaucccgcaaccggggaaagagauagacaucaggcaaaauaugaacucgaucagcuaguuuccuuccgcauaccuuauuacguuggcccgcuagucacgccagaaguacaaaaagcaacaagcggcgcaaaauuugcaugggcaaaaagaaaagaagauggagaaauaaccccuuggaaucuaugggacaaaauagacagagcagaaucagcagaggcuuucaucaaaagaaugaccguaaaagauacuuaucuacuuaacgaagauguccuuccugccaacucccuauuauaccagaaauacaauguccuaaaugaauuaaacaauguacgagucaauggaagaagacuaagugucggaauuaaacaagauauauauaccgaacuuuuuaaaaagaagaaaacuguuaaagucagcgauguagcaagucuaguaauggcgaaaaccagaggcguuaacaaaccaucaguagaaggccuaagugauccaaagaaauuuaacucaaaccuagcaacguacuuagaucuaaaaucaaucguaggagauaaaguagaugacaauagauaucaaacagaccuugaaaauauuaucgaauggagaucugucuuugaagauggagaaauauuugcagauaaauuaacagagguagaaugguugaccgaucaacaaagaagugcauugguuaagaaacgcuauaaaggauggggaagacuaagcaagaaauuacuaacgggaauaguagaugaaaauggccaaagaauaauagaucuuauguggaauacugaccaaaacuucaugcagauaguuaaucaaccgguauucaaagaacaaauagaucaguuaaaucaaaaagcaauaacgaacgauggaaugacacuacgugaauggguagaauccguacucgauggcgcauacacaucuccccaaaauaagaaagccaucuggcaaguaguaagaguaguagaagauaucgucaaagcggucggaaacgcaccaaaaagcauuucaauugaauuugcucgaaaugaaggaaauaaaggagaaaucacaagaucacggagaacacaauuacaaaaacuauuugaagaccaagcacacgaacuuguaaaagauacguccuuaaccgaagaauuagaaaaagcaccugaccucagugaucgauacuaccuauacuuuacacaagguggaaaggauauguauaccggagacccaauuaauuucgacgagauaucuaccaaguaugauauugaccauauucuuccacaaucauuugugaaagacgacagccuugauaaucgaguucuggugagucgagcagaaaauaauaaaaagucugauagaguuccagcaaaacuuuacgcggcaaaaaugaaacccuauuggaaucagcuacuaaaacagggccugauaacgcaacggaaauucgaaaaccuaacuauggauguagaucaaaauauaaaauauagaucacuaggguucgugaaaagacaauugguagaaacucggcaaguuauaaaacuaaccgcuaacauuuuaggaucuauguaucaagaggcuggaacagauauaauagaaaccagagcagggcuuacaaaacaauuaagagaagaauuugacuuaccaaaaguucgggaaguuaaugauuaccaucaugcuguagacgcauauuuaacaacuuuugcaggacaauacuuaaauagaagguacccuaaacuccgaucauucuuuguuuauggagaauauaugaaauuuaagcauggaucugaucuaaagcuacgcaauuuuaauuucuuucacgaguuaauggaaggagacaaaucacaaggcaaggugguagaucaacaaacuggagaguugauaacaacaagagaugaaguagcuaaguccuucgacagacuccugaacaugaaauauauguuaguaagcaaagaaguacaugaucgaagcgaccaauuauauggagccacaauaguaacagccaaagaaucagggaaauuaaccucuccgauagaaaucaaaaagaaaagacccguggaucuauacggggcauacacaaacggaacaucugcguucaugacaauaauaaaauuuacaggaaauaaaccaaaauacaaaguaaucggaguaccaacaacgucugcaguagguuugaaacgagugggaaaaccaggcucagaaucguacaaucaagaacuacacagaauaaucaaauccaauccgaaaguaaagaaagauuuugaaaucguuguaccucacguuucauacagccaguuaauaguagaugaugacuguaaauucacauuagcgucugacaccuaccagcauccagccacacaguugguuuuaucaaaagaaucaauggaaauaauagccgacgauuuuaaauuugugaaagaaaauaccgcuacugcagacgaacagcuaguaagaguauucgacgaaauugugaaucaaaugaaucacuauuucacaauauucgaucaaagaucaaaucgacaaaaaguaacaaaagcucgcgauaaauuugucucacuaccaaccgaaagugaguaugaaggggcaaagaaaacacaagucggaaaaacagaaguaauuacaaauuuacuaaugggacuacacgcaaacucagcacaaggagaccuuaaaguuuuaggauuaagcacauuuggauucuuccaaaguucugguggucuuaaucuuagcgaggaugccaugaucguuuaccaaucaccaacuggauuauuugaaagacggauaugccuuaaagauauauga

SEQ ID NO: 8725 - RNA, 3942 nt, Artificial Sequence
  Cas9 variant
augucguuuaaagaaaacaguaaaauauauuacggauuagacauagguacagauucaguaggauggucuacaacaaacgaaaaauaugaacugcuaagauacaaaaauaaccuaauguggggaguaucuuuguuugaagcugccucacuugcagaagaaagacggggacacagaacccaacgucgacgauacgauagaaggcaacaacgaguugcccuccuuggggaacuauuugcaaaagagauucuaaaaacugauccggauuucuuuuuaagauugaaagaaucuucacuauauccugaagauagaacaaguaagaacguaaacacauacuuugaugacgcggacuuuaaggacucugauuacuucaaaauguauccaacaguacaccauuuaaucaaagaacucucugaaucaaacaaaccacacgacgugcgccuagucuauuuagcuugugcauuuauugucgcacauagaggacacuuucuuaacggugcugacgaaaauaacguccaagcaguccuagacuucgauucuucauacugugaauuuacggacugguucaaaucaaacgacauagaagauaacccauucucugaaaguguaaaaaaugaauuuucaguuauauuaagaaaaaaaauaggaauuacugcgaaagagagagagauaaaaaauuuacuuuucgguacaacaaaaaccccagacuguuauaaagacgaagaauauccaauugauauugauguuuuaauaaaauuuauaucagguggaaaaaccaaucuagcuaagcuauuuaggaauccuagcuacgacgaacuagacauacaaacagucgaaguaggaaaagcugacuuugcugacacaauugauuuacuagcaucaucaauggaggacacagauguaccacuauugagcgccguaaaagccauguaugauuggucauuauuaauagauguuuuaaaaggucaaaaaaccauaucagacgcaaaaguaugcgaauacgaacaacauaaaucagaccucaaggcacuuaaauacauaguacgcaaauaccuagaucgcgcgcaauaugacgaaauuuuuagaacugcuggagaaaaaccgaacuacguaucauauucauauaacguaacggacguuaaacugaaacaauuaccaucaaacuucaaaaaaaaaaacucugaagaguuuugcaaguauauuaaaucuaaauuagagaaaauuaaaccagaaucagacgacgaagccgucuauaacgagcucauugaaaaaugcaauucaaaaacgcuauguccaaaacaaguaacggaugaaaacagagugauccccuaucaauuauauuaucacgaacuuucuaugauccuagacaaagcuucagcauaccuagauuucuuaaacaaaacagaagacggcauaucuguuaaacaaaaaauacuuacacuaaugaaauuucgcaucccguauuucgugggacccuuaguaaaaagaaaugaaacagauaacguguggauaguaagaaaagcugaagguagaauuuaccccuggaauuuugaaaacaugguagacuucgacaaaagugaagacggauuuauuagacguaugacaugcaaauguacuuaccuagcaggagaagacguacuaccaaaauacucccuacucuacaguaaauacacuguacugaacgaaaucaauaacauaaaaguaaacggagaaaaaauaagcccugaacugaaacaagacauauucaaugaacuauucaugaaaacgucacgagucacagucaaaaaaauaacagaacuucugaaaagaaagggcgccuucagcgaagaaaaaggcgacucacuauccggaguagacaucaauaucaaaagcaguuuaaaaagcuaccuagacuucagacgacucuuagaaaauggauccuuaucagaaaacgacgucgaacgcauaauagaacgaauaaccguaacaacagacaaaccacgucucguaucuuggcuaaaggcagaguacucagaucuaccagcagaggacauuagauauauaagcagacucaguuacaaagauuauggaagacucagcgcuaaauuacuuacuggcugcuaugaacucgauacgaauacuggagaaaucgguggcaggagcauaauagacuucaugugggcggaaaacauaaaucuaaugcaaauauuaucagauaguuauggauacaaaucauuuaucgaagaggagaauaaaaaauacuacaugauaaacccuacaggaucaauagcccaaacacugcgagaaauguacguaucaccaagcguaucaagagcaauaauaagaacaauggaaauagucaaagaacucaggaaaaucaccaaaaaagacccagauaagauauuuguugagauggcaaggggaggaaaaccagaagagaaagguaaacgaacaagcucacgcagagaacaaauagaaaaauuauacgauucagccaaagcguucguaucugaugaagauaucucgcauaugagaucacaacuuggcuccuuaagugaugaacaauuaagacgagaaaaauacuaucuguauuuuauucaauucggaaaauguauguauaguggagaagcaauagacuucagccgacuaggagacaaucauugcuaugacaucgaucauauuuuuccccaaucaaaaauuaacgaugacagccuacacaacaaaguccuagucaaaucccaauuaaauggagaaaaaucagaugauuacccaauaaaagcagaaauaagaaacaaaaugcacccucuauggaagaaccuauuuuacagggacccaaaaaacccggcagauaaagugaaauaugaaagacuaacaagaagcacacccuucaccgaagacgaacuagcuggauucaucgaaagacaauuaguagaaacaagacaauccacaaaagccguagcaacucuauuaaaagagauguuccccgacaguaaaauaguguauguaaaagcaggucaaguuucagaauucagacaugauuucgauaugcuaaaaugccgugaaauaaacgaucuacaucacgcuaaagacgcauaucuaaauauuguaauaggaaauguacaugauguuaaauuuaccagcaauccaaugaauuuuguaaaaaacgcagacaaacacuauaccauaaaaguaaaagaaacucuaaaacauaaaguuagucggaauggagaaacagcauggaacccugaaacagacuuugacaccguaaaacgaaugaugagcaaaaacucaguuagauaugugagauauugcuauaaaagaaaaggcggauucuuuaaccagaacccugauagagcagguaacccugauuuggcuagauuaaaaaaagauuuagacccuguuaaauauggaggguacaacucuaaaucaauauccuguuuuucgcucaucaaauguacaggcgucggcgcaguaauuauaccaguagaacuauuaugcgaaaaaagauacuucucugaugacagcuuugcaucagaauacgcuuacagcguauuaaaaaacgcacuaccugcuaaaaacaucgcaaaaauaaguauagacgacauaucguucccacuaaaaagaagaccaauuaaaauaaacacucucuucgaauuugacggcuaccgaguuaauauacgaucaaaagacuccuaucauuauuucaccauaaguagugcaauggcagcuauauauagcaaagauacuucagacuauauaaaagccguaucuuccuauauagacaaauccgacaaaggaagcaaauuuaaacccggggaagccuucgacguacuauccaaucuaaaaguuuacgacgagauagccaaaaaaugcauaagcgaaccauuuucaaagaucagcaaacuagcagaagcggguaaaagauggaaaaaagaagaaauaucguuacagaauugccuacuuuga

SEQ ID NO: 8726 - RNA, 3945 nt, Artificial Sequence
  Cas9 variant
auguuaaaaaaagauuauucuauagguuuagacaucggaaccaacagugucggacaugcaguagucacugacgauuauaaagugccaacaaaaaagaugaaggucuuuggagacaccuccaaaaaaacuauuaaaaagaauaugcuugguguauugcucuucaaugaaggacaaacagcugcagauacuagacucaagaggggagcuagaagacgauacacacgucgaaaaaauagauuaagauauuuacaggaaaucuuugcuccugcacuagcaaaaguagaucccaauuucuuuuauagacuggaagaaucuucacuuguagccgaagacaaaaaauacgacguauacccuaucuuuggaaaacgagaagaagaacuacuauaccaugauacacacaaaacaauauaucaucucagaucagaacuagcaaauaaugaccgaccagcagaucuccgacuaguauaccuugcacuagcucauauaaucaaauaccgaggaaauuuucuauuagaaggagagauagaccuucguacaacugacaucaauaaagucuucgcagaauucucugagacgcucaaugaaaauagugaugaaaaucuuggcaaauuagacguagccgauauuuucaaggacaauaccuuuaguaagacaaaaaaaagugaagaacucuuaaaauuaagcggcgcuaaaaaaaaccaacuugcucaucaauuauuuaaaaugauggugggaaacaugggcaguuuuaaaaaaguccucgguacagaugaagaacacaaacuaucuuuuggaaaagauacauaugaagaugacuuaaaugaucugcuagcagaagcaggcgaucaauaccuugauauauucguagccgcuaaaaaagucuacgacgccgcuauucuagcgagcaucuuagaugugaaagauacacaaacaaaaacuguguucagucaagcaaugauagaaagauacgaagaacaucaaaaagauuugauagaacuaaaaagagucuuuaaaaaauacuuaccugaaaaaugccaugacuucuucucagaaccuaaaauuucugguuacgcgggauacauagauggaaagguaagugaggaagacuucuauaaauacacaaagaaaaccuuaaaaggcauaccagaaacggaggaaauauuacaaaaaauugacgcgaacaauuaucuacgcaaacaaaggacuuucgacaauggugcaauaccucaucaaguacaccugaaggaauuaguggcaauaguugaaaaccagggaaaauacuauccauuccuccgugaaaauaaagacaaauuugaaaaaauacuaaacuuuagaauaccauacuaugucggaccguuagcucggggaaacucaaaauuugccugguuaacucgagcaggcgaaggaaaaauaacgccauauaauuuugaugaaaugaucgacaaagaaacgagugccgaggacuuuauaaaaaggaugacuauaaaugaccuauacuuaccaacagaaccaguccuaccgaaacauucacuacuauacgaaagauauacuaucuucaacgaguuagccggagucagauaugugacugaaaacggggaggcaaaguauuucgacgcacaaacaaaaagaucgauauucgaacuauuuaaauuagaccgaaaaguaucugagaaaaugguaauaaagcaccuuaaaguuguuaugccagcaauaagaauacaagcacuuaaaggucuggacaacgguaaauucaaugcaucauacgguacauauaaagaccuagucgacaugggggucgcaccggaauuguuaaaugaugaaguuaauucagaaaaaugggaagauaucauaaagacuuuaacaaucuucgagggaagaaaacuaauuaaaaggcguuuagagaacuaccgagauuuuuugggcgaagauauucuucgaaaacuaagcagaaaaaaauacacaggauggggacggcuauccgcaaaacuuuuagauggaauuuacgauaaaaaaacccacaaaaccauauuagauugucuaaugacugaagauuacucacagaauuuuaugcaacucauuaacgaugauacauauagcuucaaagagacaauaaagaacgcacaaguuauugaaaaagaagaaacacuagcaaaaacgguucaggaacuccccggaagcccagcaauaaaaaaaggaauauuacaaucauuagaaaucguagacgaaauaauaaaaguuaugggauauaaaccaaaaagcaucguagucgaaauggcacgagaaacacaaaaaacacacggaacaagaaaaagagaagacagaguccaacaaauaguaaaaaacuuaaaagacgccaaugaauuacccaaaaaacuaccaaguaaugcugaauuaagugacgaaaggaaauaccuuuacugcuuacaaaauggaagggacauguauacaggagcuccacuagacuacgaccacuuacaauuuuaugacguagaccauaucaucccccaaagcuuucuaaaggacgauuccauagaaaacaaaguucuaacaauaaagaaagaaaacguaagaaaaacaaacggccuuccuuccgaagcagucauccaaaaaaugggaucuuucuggaaaaaauuacuugaugcaggcgcgaugacaaacaaaaaguacgacaauuuaagacgcaaucuacauggugguuuaaaugaaaaauuaaaagaaagguuuauagaaagacagcuaguagaaaccagacagauaacaaaauacguagcacaacuauuagaucaaagacucaacuaugacggaaacggcguagaacuugaugaaaaaauugcaaucguaacacugaaggcgcaauuggcuucacaauucaggucagaauucaaacuaagaaagguaagggcucugaacaaccuacaucacgcacacgaugcauacuuaaacgcaguaguagcaaauuuaauuauggcaaaauaucccgagcuagaaccagaguucgucuauggaaaauacagaaaaacuaaguuuaaaggacuaggcaaagcaacagcuaaaaacacauuguaugcaaauguccuauauuuccucaaagaaaaugaaguauauccguuuugggacaaagcacgagacuuaccaacaauaaaaagauauuuauacagagcacaaguaaauaaaguuagaaaagcagaacgccaaacgggaggauucagugacgaaaugcuuguuccaaagucagauagcggaaaacuucuuccgagaaaagaaggacuugauccagugaaauauggcggauacgcuaaagcagucgagucauaugcuguucugaucaccgcugaugaaguaaaaaaggguaaaacaaaaaaaguaaaaacuuuaguaaauaucccuauuauagacucaaaaaaauacgaagcagaucccacugcauaucuugccagcagaggauacacaaaugucacaaacucuuuuauuuuaccaaaauauagucuauuagaagacccagaaggcagacguagauaucuugcauccuuuaaagaauuccaaaaggcaaaugaauuaaucuuaccacaacacuuaguagaacuguuauacuggguuaacgcaaaagauggugaacagaaauuagaagaccauaaagcagaguuuaaagaacucuuugauaagaucauggaguucgcagauaaauaugugguggcaccuaaaaacagcgaaaaaauccgaagauuauaugaagaaaaccaagaugcaacaccaauggaacuaggcaaaaacuucguagaacuguuacguuauaccgcagacggggccgccuccgauuucaaauuuuucggcgaaaacauaccgagaaaaagauacaacucagcaggaucuuuguuaaacggaacuuuaauauaccaaucuaaaaccgguuuauaugaaacacggauagaucuuggcaaguuauga

SEQ ID NO: 8727 - RNA, 3948 nt, Artificial Sequence
  Cas9 variant
augggcuauucaguuggccuagauauuggaacaggaucugucggauggguuguaacuaacgaagauggaaaacucgcgagggcaaaagguaaaaaucuaauaggaguccgacucuuuaaaacugcugaacccgcagcagauagacgaacaaacaggacaacacgaagacgauuaucacgacgcaaauggcgacuaaggcuccuagacgaacuuuuugcaaacgaacuaggaaaaaucgauucaaauuucuuaacuaggcuaaaguacucuuauguacacccaaaagaugacgcaaacagagcaaacuauuauggaggauaccuguuuccaacacaagaagaaacuaaaaaguuccacgcuaaauacccaacaauauaucacuuacgucuggcauuaaugacggaaagcagacaauuugauuuaagagaaaucuauuuagcaaugcaucaaauagugaaauacagaggucacuuccuuaauucccaaaguaaaaugacaauaggaaacaccuauaacccgcaagaucuccaaaccgccauggaaaauuacgcggaagcuaagggacuaucuaucgaacucaaacaaccagaagagaugguugcuauuuuaacaggagaagccggcuucggacuaagcaagaaagcaaaagcagaaaaacuacuuaauaauuucuucuuugacaccaaagaagaaaaagccaccguacaagcaauauuagcaggaauuguagguaacacuauagauuucacuaaagucuuuaauagacaacuaaccggagacacacuaaaagcauggaaauuaaaacuagacucagagacguucgacguagacucagaaccaauacuuucagaccuagacgacgacgaaacagaacucuucuuugcaauacgccaagcauuugaugguuucacguuaaugaaucuauuaggugaucaaacaucaauauccgccgcaauggucgaacgcuauacacaacaccacgacgauuuacucacagugaaacaaguagccaagaaacaaggauuaagccauaaagaauuuuccaacaucuacucugcuuuccuaaaagaugauaccgauaaaggcaugaagaaacuccuggaagaaucuaacuugucuacagaagauguaaauggaauccaacuuagaauggacucacacgacuuuuugccacaacaaagaacaaaagcaaacagcguaauaccccaccaacuacauuuagcagaauuggaagcaauuauagaaaaccaaggucaauacuacccguucuuacucgaaacguucgaaaaagaaggaacagccgcaaauaaaaucgccgaauuauuaaaauucagaauaccauauuauguaggaccaaugguuacaaagaaagaugucgaaaaugcagggggagaugcaaccaaucacuggguaacacgaaacgaaggauacgagaaaagcgcgguuacagccuggaauuuugaucagguuuuuaauagagaucaagcugcacucgacuuuauacaaagacugacaggaacagacaccuacuuaaucggcgaaccaacacuaccucagaacucgcuaaaauaccaaauguuuacaguacuaaacgaacuaaauaaugucaaaguaaacggaaggagaauagauaaccaaacaaaacacgaccucauccaagaccuauuuaaaucaaagaaaacugucucucuuaaagccuuucaagacuacuaucaaagccaaggaaaaucagauauucaaguuguaggacuagcagacaaaacuaaauucaacagcaaucuaagcaccuacauagaucucagcaaaacuuucucggcugaagaaauggaaaacccucagaaccaagaucuauuagaacagauaguagaaauacaaacagucuucgaggacucaaaaauagccgaacgagaacuaagcaaacuagaauuaacacccgaacaaguaaccaaauuagcgaaaacacauuacacaggauggggcaaucuaagcaacaaauuacucaccacacccaucguugauguaaguggaaagaaaguuucaauucuagaccaacuagcaaaaaccaguaaaaacuucaugucaauaauaucaaacgaacaguacggagugcaagacuggauaaaagaacaaaacacaacagagacuaccgguacucuagaagacaaacuugcagacuugacgacgucaccagccaacaaacguggcauaaaacaagcauucaacguccuguucgacauacaaaaagcgaugaaaucugaaccggacagaguauaccucgaauuugcuagagaaacccaaacuucaguaagaacaaugucgagauacaauuaucucaaaggacuuuaccaaaguaaaagucucgaugcggaagccaaaaaucuuaagaaagaacuagcagaaaccgaccagaagaaauuugauaacgaccgccucuaucuauauuuccagcaacaaggaaaagauauguacacaggucaaccaauaaauauagacaaacuaagcagcgacuacgacauugaccacaucauaccacaagcauucacaaaagaugacucaauagacaacagaguccuaguaucuagacccgaaaacgcaaggaaauccgauucaggaacauacaccacggaaguccaagcagcagcauccggacuuuggaaaacucuaguacaauccggcuuuaucucacgcaaaaaguacgacagauuaacccacgcuggagauuauagugagggacagaaaaccggauucauagcaagacaauuaguagagacacgccaaauaauaaagaauguagcagcucucauugaaagcgaguucgaccagacccaagcaguagcaaucagagccgaaauaacaggcgacaugcgacgucuagucgccauuaagaaacauagagaaauaaauucauuucaccacgccuucgacgcguuauuaaucacagccgcaggacaguauaugcagaaaagguaucccgaucgugauaguaacaacguauacaaugaguucgacagauacacuaacgauuacuuaaagaaacuaagagaaucaagcagcaaagacgaaguacgaaaacuaaaaccuuucggauuuauaguagguacuauggcaaaaggaaacgaagauuggacuacagaacaaacagaauaucuaagacauauuaugaacuucaaaaacauacuaacgacuuauaaaacagggccagauagagguccucuuucaaaagaaacuaucuacgcaguagauccuaaagcaaagcugauuggaaccaauaaacacagacaagauguuagucucuauggaggauauaccuacccguauagcgcguauaugacauuaguacgagcaaacgguaaaaaucagcuaguaaaagucuccagaucagcugcauccuuaaugaagucaggacaauuaaaacucgaagauuacguacaacaacaaccugaaguaaagaaauuugagaaaauauuacuagaacaucuuccacuaggucagcuagucgacaaugauggaaaacuuauguaucucaccagcuaugaguucuaucacaaugcaaaacaauuaugguuaucuacagaaaacgcagaccuaaucaguucauuaucaauagacagcgacgaucaaaaguuaauuaaagccuucgacauauuaacagcugacucagugauagaaagauuuccauucuaugaaauugaccuaaagaaauuaauagaacuacgugauaaauucguauuaauagauaauaaacucgauguguuacguguaguuuuaaaagcacuacaacucgauagugcgcaacaaaaaccacuaaaacuaauagacaaagcagccacugauuggaaaaacuaucgacaagccggcgggaucaaacugucagauaaugcagaaauaauauaccaaucaacuacagggauauucgagaaaagaauaaaaauaucugaccugcuguga

SEQ ID NO: 8728 - RNA, 3951 nt, Artificial Sequence
  Cas9 variant
augcuacaaaaaaauuacacaaucggguuagacauaggaaccaauagcguuggcuaugcaguuauuaacgacaacuauaaagugccagcaaaaaaaaugaaaguacugggaaauacagauaaaaaaacaaucaagaaaaacuugauggggguguuacuauucgaugcaggugagaccgcugcaacuacaaggcuaaagagaggcacucgacgaagauauacacgccgaagaaaccgauugagauaccuacaagaaauuuuaggacccgagcuagcaaagguagaugcaaacuuuuuacauagauuagcggaaagcagccuaguaacagaagacaaagaauucucagcauacccaauauuuggggauagagaagaagaauuauuauaucauaaaacauacaagacaauauaucaucuaagaagcgcccuagcaaauaaagacgaaaaagcagauuuaagauuaauauaucuagcccuagcacauauaauaaaauacagaggcaauuuccucauagaaggagagauugaauuaagcgacaccgacauagauaaaguuuaugcagacuucugucgguccuuuaaugaacuauuugacaccgaaguacuacaagaaauagagguagaagccaucuucaaagauaaaacacucaguaaaacaaaaaaagccgaggaacuaguaaaaguuucaggcgucaaaaaaaaccaaguagcacaccaguucuuaaagaugauggucggaaacaccgugaauuucaaaaaagucuucaacuuaacagaagaucaaaaacuuucauuuggaacggacucauaugaagaugaauuaaacgaccuacuugcuaaaucagaugaccgauacuuagacguuuuuguagcagccaaaaaagucuaugauacagcaauucuagcuaacaucuuaaacacaaaaaauagugucgcaacaaaaacaauauuuucacaaucaaugauagaaagauucaaagaucaucaaaaagaccuaaaagaacuaaaacaacuuuucaaaacuuaucuuccagaaaaauauccugauuucuucggcaauagcaaagaggacggauacgcuggauacaucgaaggaaagacaaacgaagaaaaauuuuacacacauacaaaaaagauacugaaaaacaucccucaggcagccucaguucuagcacaaauagacguaggaaauuaccuuagaaaacaaagaacauucgacaacggaguaauaccccaucaaauccaacuaaaggaacuuuuagcaauaauagaaaaucaggguaaauacuaucccuuccucuuagaaaauaaagaaaaaauagcaaaaauacuaaccuuccgaauaccauacuacguaggaccuuuagcaagaggcaacaguagauucgcuugguugaaaagaguuggcaaggaaaaaauaacuccuuucaacuucgagaauguaguagaccuugaaagcagugcagaaagguuuaucgaaagaaugacgcucaacgaccuauaucugccugaagagaagguuuuacccaaacauaguaugcucuacgaaaaauuuuccauauuuaacgaauuagccggcauacgauauaucacagacaauggcgaaaugaaauucuuagacgcacagaccaaacaauccaucuucgaacuauucaaacaagaaaggaccgucaaggaaaaaaaaguucucgaccugcucaaaacccuuaugccgucugaaagaguagucgcaauuaaaggaauugacaauggaaaauuuaacgccucuuucgggacuuaccaugauuuauccaaaaugggauucaaaacagaaaaaauugcuucagaaaguaaccaagcaagaugggaagagauaauaaaaacauugacuauauucgaagaccgaaaacuuauaaaaucacgauugcggaaauacgacgacuucuuaaacgaaaaagaaauaggagccuuauccaaaaggaaauauacaggguggggacgccucucagcuaaauuaauugaugguauauaugauaaaaaaacacaucaaacgauucuagauuuuuuaaugaacgaagauuacaaccaaaacuuuaugcaacucauaagcaacgacaauuacucauucaaaaaaaucaucgaagauucucagguaauuaaagaagaaggcucuuugaccgaaguuauucaagaauuaccaggaagcccagcgauaaaaaaagguauucuacaaaguauagagaucguugacgaauugguaaaaguaaugggcggaaacccaaaaaaaauaguaguugaaauggcacgagaaacacaaaaaacacacggaacaaccagacgcgaagcgagaauaaaggaaauaaucaaaaaccuuaacaaacuaaaauuaaaugaacuuccaaaagauuuaccuucaaacgaagaacuaagugacgaaaaaguguacuuauauugucuacaaaaugguagagacauguacaccggagcaccacuagaccuagauaaccuaucacaguaugaagucgaucacauaauaccccaaucauuucucaaagacgacucgauagaaaacaaaguuuuaacggcaaaaauagaaaacagucgaaaaacuaacggacucccuucaguggaaauagcaaaaaaaaugggcgcguucuggagaucucuacugaaaguaggugcaauaucugaaaaaaaauaccgaaacuugaggagaagccuacacggaggaaugacagaaaaauuaaaagaaacauuuguaaaacgucaacuuguugaaacacgacagauaacuaaauacguagcacaaauacuaaacagccgauuuaacgaagaaaaaaaugaagacaaaguugcaauuguaacccuaaaagcacaauuaaccucccaauuuagaaaagacuucgagcuauauaaaguacgagaaauaaacaaucuccaucacgcacacgacgcauauuuaaacgcaguacuggcuaccuuacuuaugacaagcuucccagaacuagaaccagaauuuguauauggaaaauaccggaaaacaaaauuuaaaggauuaggaaaagcuacagcgaaaaauaacuuauacacaaacauauuacagcuccucaaggaggagucagcacaauacugggauacuaaagaaagagaucuugccacaauaaaaaaaaacguauaucaagcacaagucaauaaaguacgcaaagucgaacgacaaacagguuccuucuacgacgaaacaguagcuaaaaaaucggcaagccaaaaauuguuccccagaaaaaauggccuagaucccgucaaauacggcggauaucaacgagccaacgaaggcuacucucuacuuuucagagccgauauguuaaauaagagaggaaaaacuaaaagcguaaaaacccuugugaaaauuccaaucauagaaucagcucaguaucucgcugacccuaccgaauaucuggcaaaaagaggguauuacaacguguccgaacacagucuauuacugccaaaauucagucuacuggaaaacaacaacggucuacggcgauacuuagcaucaucaaacgaauuucaaaaagcaaaugaacuaauauuaccaaagcacuuaguucguuuauuauauuggucgcaaucaaaacaacgaaaagaagaacuuaacaaacacagggccgaauuugcagaacuauuuacuuacaucauggauuucgcagauaaauacgucguagcaccuaaaaacucagaaaaaauaaaaaacauuuacgaaaauaacaaggacagcaguguagaagugcuuggcaaaaacuucaucgaacuacuaaaauacacggcugacggcgcagccucagacuucaccuuuuuugauacaaaaauacccagaaaacgcuacaacagcgcaggugauuuguuggauggcacccuaauauaucaaagcaaaacaggacuauaugagacccgaauagaucuuggagcgauuuga

SEQ ID NO: 8729 - RNA, 3957 nt, Artificial Sequence
  Cas9 variant
augaugaucaaacugaacaacaugaaaaagauucuaggauuagaccucggaacaaauucaauaggaugggcaguaguagaaacggaagacaauaagaaauucgaauugcucgacaaaggaguacgcaucuuccaagaaggagucaaaauugaaaaaggaauagaaaguucaaaagcagccgaaagaaccgguuaccguagugcaaggcgcaucaaauuuagaagaagacucagaaaaauugaaacauugaaaguucuaauugaaaacaacaugugcccucuaucaauggaugaacuaauaguuuggaaagaaaacaaaaacaauuacccuaaaaauaaaauauucuacaacugguuaaaaacaaaagacccaaaagaaggaaccaacggcacauauauuaaccccuacuacuuuagaacagaagccaucaaacggaaacuugaaaauaccaaugacgucgggagagcccuauaccaccuggcccaaagacgaggauuuaaaucuaaccgacucgaaucuacggaugaaaaaucaagaggaauaguaaaaacggaaaucaauaaacuaucaagugaacuaaacggcagauaucuaggagaauacuuuuacgaacuguaucucaaaggagagaaaauaaggaaacgacauaucucgagggaagaacauuacuugaacgaauuuaagaaaauaugcgaaguacagaacuuuaacaaagaacucgccgaaaaacuagaacgagcaaucuucuaccaaagaccacuuaaaucacaaaagggucuagucggaaaaugcacacuacaaaauaauaagcaccgauguccaauaucgagaccagaauuugaagaguuucguauguggcaauucauaaacucaauuaaauacaaaaauucagauggaaaauucgauuuucuaaacaaggaacagagggagaauaucauaccugcguuuguaucaaacaaaaacgcaacauucgaguuuucaaaaaucgagaaaauccuaaauaagggaguucacauuuaccaguucaauuacaaaagcaaucacacgauaggaucaaaccaaacaaugauaaauuucauggauguuuucgacauugauagaaaacugacaaaugcauggcuccuauguguaaauaaaauauaugaacuuuacacggcuaaaacaaagaaagacggaucgcuaaaaagcaaaagugaaguuauaacagacguauggcacgucuuauucacauucgauaaugaggaaaauuuaaaagaguucgcacgaaauaaauuauuacuagacgaaucuagcgcccaaaaauuuaguaaaauuaauuuaaaacaggacuauucacaacuuagucuaaaagcaauaaacaaaauacugccuuaccuacaagaaggacugauauauagcuacgcugucuucauagcaaauauagaaaaugugauaggaaaaucgauauggaacauuaaagaaaaccaacaaauaauuagaacaucuaucaagaaaauuauugauaaccauaaaacagaauuagacauaaauacgauaacaaacagccuaauaaaugacuucaaagugaauuacaacaaugcccauaaagaauauaaaguagaugauauagauuuaaagaacaucagagagaaaauuauaaaauacuacgggaauaaaaccuggaacugcuuaccagaagacgaaaaacuauaugucaaagaaaaaguugaaaaauuauacgaaaaacaacucaaaucaggcaaaagaggcauuuuuauagagaaaauacgauuagaugauaggauugaaaauuuccugaaagacaacuucgauucuucagaacuaaaccuaaagaaacucuaccaccccuccgauguaucuguuuacaaaaguguaaaaauaacugacuuaggguuaagacuccuagguuccccaaugauaccaucuauuaaaaauccaauggccaugagggcaaugcaucaacugcgaaaguuaauaaaccaucuaauaauagaaggagucauugacgauucaaccauaauaaauguggagaugucaagagaacuuaacgacgcaaacaugcguaaagcuauugaacgauaucagcgccaacgagcuacagaaaaugaagaguucaaaacaaaaaucaaagaacuauauaagaaagaauguggaacugacuucgaaccaaacaaugacgauauaaugaaauaucgauuaugggaagaacaaaaucacaaaugucuauacacaggcaaaucaauuggaauuugugacuuuauaggaaguaauccugcauucgaaauagaacacacaauaccaagaucacuaucuuacgauaauucacuagaaaauaaaacacucugcgaaaaggaguucaaucaacaaguaaagaaaaacagaauacccuucgaauuaucuaacuacaaagaaauaauuaguaggaucaauaacugggaaauaaaagcagaagaacuauuuaaacaaauccaaaaaguaaaaauacaauccagaauggccgcuacaaaagaaauuaaagauaaugcaauucaaagaaaacaccuacuacaaauggaauuuaacuacuggaacggaaaauugucgagguuuaccagggaagacguaccugagggguucaaaaauucacaauuaguggauauugguaucauaacuaaauaugcgcgagcauacuugaaaacaguauuuaauaacgugaauacaguaaaagguucaacuguagcagaguucagaaauauauggggcuuacaagaauauuucgagaagaaagacagauccaaccacauacaucacugcauagaugcaauuacaaucgccugucuaacaaaagauaaauacgauuuccuagcacacuuauaccaucucgaugaacaaaacaaccgagacgccguacaccgcgcgaugauaaaaucaaaaccaugggaaaacuucguacaggaugucaaagaaauagaaaaccaaaucuuaguaucacacuauacaccugacaacuuaccaaaacaaaguaagaagauacuaagaaagagaggaaaaauacagaaaaacgaaaacggagauuuaauuuaugaaaagggcgacgcggucagaggcucauuacacaaagagagcuuuuacggagcaaucaaaagggaaaucauaaacaagaaaggugaaacagaagaaaaaguuuuauacguaaaaagaaaaccacuagaauuuucggaucucggauucaagacuaucuccgaacuggaaaauauaguugaugaugcaguacgagacaaaguacuaaacgccguaaaggacaagggcuuaaaacaagcauuaaacgaaccuaucuggaugaaugaagaaaaacaaauaccgauaaagaaaguaagguguuacacacccucagucacaaacccuauaaaccuaaagaaacacagggacaaaucaaaacaugaauauaaacaaagcuaccacguaacuaacgauggcaauuaccuaaugguaauauaugagggaaaagacucccaagaaaaagugaaacgagauuaugaaauagugucuaaccuacaagcuggagaauacuucaaacaaagcguacaugggguucuuaaagcucaggguaucaacaacuuagaaggacuaauacccaaauucaaagaaucugguaaaaauaucuuaccguuaaaauacauuuuaaagacaggaacuaugguaauuuucugggaaaacuauccagaagaaauaugggauauagacaaaaaucaauuguauaaacgcuuauuuaaaguuacccaauucgaaucugacggaagaauacaagcacgauuucaucaaaucgcaaaacccgacaacgaacuaacuaaagucagugaguuagacuucaguaacauagcugagaaaauaagauuaucgaaaggaaacuuaaauaugcuaguaaauggauacgauuucaaaaucaacguacuaggacacauagaaaaacucucauga

SEQ ID NO: 8730 - RNA, 3957 nt, Artificial Sequence
  Cas9 variant
augggcagcaauaugcucaagaaagauuauaguauaggacuagauauaggaacaaacagcguagggcaugcaguaguaacagaugauuauaaaguaccuaccaagaaaaugaaaguauucggcgacacaagcaagaaaacaauuaagaaaaauaugcuaggaguauuacuauucaacgaaggacaaacagccgcagauaccagacugaaacgaggcacuagacgaagauacacuagacguaaaaacagauuaagauauuuacaagaaauauuugcaccugaacuagcuaaagucgaucccaauuuucucuaucgacuugaagaaucaucucugguagccgaagacaagaaauaugauguauacccaauauucggaaaacgggaagaggaacuacuauaccaugauacauauaaaacuaucuaucaucugcgaagcgcacucgccaacaaugaucaacccgccgauuuaaggcuaguauaucucgccuuagcucacauaauaaaauaucgaggcaauuucuuacuagaaggagaaauugaucuacgaacaacagacauaaacaaagucuucgcggaguucagcgaaacauuaaacgaaaauagcgaugaaaacuuaggaaaacuagauguagccgacaucuuuaaaaacaacacuuucuccaaaaccaagaaaucagaagaacugcuuaaauuaucaggugccaagaaaaaucaacuagcacaccaacuuuucaaaaugaugguaggaaacaugggauccuuuaagaaaguauuagguacagaugaagaacauaaacucuccuucggaaaagacacuuaugaagacgaccuaaaugacuuacuagcagaagccggcgaccaauaccuggauauuuuuguugcagccaagaaaguguaugaugcagcgaucuuggcuucaauuuuagacguaaaagauacacaaacuaaaacugucuucucucaagcaaugauagaacgguaugaagaacaccaaaaagaucuaauagaacucaaaagaguauuuaagaaauaucuaccggaaaaaugccacgauuucuucagcgaaccaaaaaucaguggcuaugcuggauauauagacggcaaaguaucugaagaagauuucuauaaauauaccaagaaaacguugaaaggaauccccgaaacagaagaaauucuacagaaaauugaugcaaacaacuaucuaagaaaacaaagaacauucgauaauggagcaauaccacaccaaguacaucugaaagaauuaguagcuaucgucgaaaaucaagguaaauacuauccauuucucagagaaaacaaagacaaauucgagaaaauauuaaacuuuagaauaccauauuauguaggaccacuagcaagaggaaauucaaaauuugcauggcuaacgcgagcaggagaaggcaaaauaaccccauacaauuuugacgaaaugaucgacaaagaaacaucugcagaagauuuuaucaaacauaugacaauaaacgaucuuuaccuaccuacagaaccaguacucccaaaacacagucuacuauaugaacguuacacaauauuuaaugaauuagcaggagugagauacgucacagaaaauggggaagcaaaauauuucgaugcccaaacaaaaagaucaauuuuugaacuuuucaaacuagauagaaaaguaucugagaaaaugguaauaaaacaccugaaaguaguaaugccagcaauuagaauacaagcacuaaaaggacuagacaauggaaaauucaacgcgucauauggaacuuauaaggaucucgucgacaugggaguagcaccagaacuauuaaacgaugaaguaaacuccgaaaagugggaagacauuauuaagacuuuaaccauauuugaaggcagaaaacuaauaaaaagaagauuggaaaacuaucgagacuuccucggugaagauauucugcggaaacuuucuagaaagaaauauacgggcugggguagacuuuccgcaaaauugcuagauggaauuuacgacaaaaagacccauaagacuauccuagacugucuuaugaccgaagauuauucccaaaacuuuaugcaauugauaaacgacgauaauuauucauucaaagaaacaauaaagaacgcacaagugauugaaaaagaagaaacuuuagccaagacagugcaagaauuaccagguucuccagcgaucaagaaaggcauacuccaaaguuuagaaauugucgaugaaauuauaaaaguaaugggcuacaaaccaaaaucgauaguuguagaaauggcgcgagaaacucaaaagacacacggaacacggaaaagagaagaccgagugcaacaaaucguugaaaauuuaaaagaugcaaacgaacuaccugaaaaacuaccaaguaaugcagaacuaucugaugaacgaaaauacuuauacugcuugcaaaacggccgagacauguauaccggagcaccacuggacuacgaucaccuccaauucuacgauguggaccacauuauuccgcaaucauuccuuaaagaugacaguauugaaaauaaaguucugacaauaaagaaagaaaacgucagaaaaacaaauggccuaccaucagaagcaguaauccagaaaaugggcaguuuuuggaagaaauuacuagacgcaggagccaugacaaauaagaaauaugauaaucuaaggagaaacuuacauggaggacuaaaugaaaaauuaaaagaacguuuuauagagcgucaacuuguagagacgagacaaauaaccaaauacguagcccaacuacuagaccaacgguuaaauuaugacggaaaugguguagaauuagacgagaaaauagcaauagugacgcuaaaagcucaauuagcuucacaauuccgaagugaguucaaauuaagaaaaguacgugcucuaaacaauuugcaccacgcccacgaugcauaccuaaacgcaauaguugcuaacuugauaauggcuaaauauccagaauuagaaccagaguucguauauggcaaauauagaaaagccaaauuuaaaggccuggguaaagccacugccaaaaauacacuauaugcaaauguauuauauuuucugaaagaaaacgaaguauacccauucugggacaaagcaagagaccucccaacaaucaaacgauaccuauacagagcacaaguaaacaaaguaagaaaagcagagagacaaauaggaggauucuccgaugaaauguuaguaccaaaaagcgauuccggcaaacugcuaccgcgaaaagaaggauuagaucccgugaaauacgguggauaugcaaaagcuguagaaucauacgcaguacuaauaaccgcagaugaagucaagaaagguaaaacaaagaaagucaaaacauuaguaaacauccccauuauagacucgaagaaauacgaggccgacccuacugcauacuuagcuagucgaggauacacaaaugucacaaacagcuucauuuuaccuaaauauucccuccuagaagacccugaaggaagacgaagauaucuggcaaguuucaaagaauuucaaaaagcaaacgaauuaauccuaccccaacaccuaguagaauuauuauacuggguaaaugcaaaagauggagaacaaaaacuggaggaucauaaagcagaguucaaagaacuauucgauaaaauaauggaguucgcagacaaauauguuguugcacccaaaaacagcgagaaaauaagacgauuauaugaagaaaaucaagacgccaccccgauggaacuagguaaaaauuuugucgaauuacuuagauacacagccgauggagcagcaagugacuucaaauucuucggugaaaacauaccaaggaaaagauauaauagugcaggaucccucuugaacggaacacuaauuuaucaaagcaaaacuggccuuuaugaaacaagaauugaccuagguaaauuauga

SEQ ID NO: 8731 - RNA, 3960 nt, Artificial Sequence
  Cas9 variant
auguucucucaaagaaauaacccuuacugcgaacuacucuuuaaaauuauagucacaaacauagaagagaaaaaccuagaaguaauaaugggaauacgcaacucagacauauucuuuauaaguaauuuuaugugguaccaaaaacuuauuaugaugauuaaaaauauacuuggguuagaccuuggaacaaauucuauaggcugggcacuuauagaaguagacgaaaauaauauaccaauaagaauaauagcaaugggaagcagaauuauaccacuaaguacgagugacaaagaagaauuucaaagaggucuauccauaacgaaaaaccaaaaccggacuguaagcagaacccaaagaaaaggguacgauaggaaacaacugagaagaucagaucuaaagaaaauccuaaagaaauacaauaucuuuccaucagaagaacuccucaaacuacccaugcuugaccuauggaaauuaagaucugauucagcgaacccaaaugaagacaucagcgccgaacaacuaggaagaaucuuauacauguuaaaccagaaaagaggguauaaauccgcacgaagcgaagcuaacucagacaagaaagauacagacuacguacaagcagucaaaggacgcuaugcucaacuaaaagacaggcgucagacuauaggacaauacuuuuaugaagaacuaucaacagcauuuucagacaaaaacaaucaacaguacuuccgaguaaaagaagaaguauacccgagggaagcauacauagaagaguucgacacaauaaucaacgcucaaaaagauaaacacggcuuucuaacagauaaaguaauucaccaacuuagaaacgaaauaauauacuuucaaagaaaacuaaaaagccaaaaaggucucgucagcaucugcgaauuggaaggauucgagaaaacaguauacgauaaagagaaaaacaaaaacaaagucguuuuuguuggaccaaaaguagcucccaaaacuuccccacuauuccaguuaugcagaauaugggaagucguaaauacuauaucacugaaaaucaaaaacccagaaggaaguaaauacaaauggggagaaaaaguuccaaaccuaaaacaaaaagaaauauuagcugauuaccuauuuaaaaaugaaaacuuaucuuucaguacacuccuggaaauauuggaacuaaagaaagaagacgucuauguaaacaaacaaauauuaaaaggcauaaaaggcaacgaagcauacgcagcacuacacaacguacucggugaucaugaacuacucaauuuugacguaucaauaauaacaagcgaucauacagcuauccuagucgacaagaaaacaggggaaauacuagaagaaagagcggguuuagaacuagaugccagccuggaaagagaaccguuauaucaauucuggcacacaauauacucauuaaaagaucuagacgaaugcaaaaacgcacucauaaaacgauuuggccuagaugaggacauugcagaaaaacuaucccauauagacuucaacaaacaagcauucggauccaaaucgaauaaaucaaugagaaaaauauuacccuucuuaauggaaggcuauaauuauuccgagucaugcucacuugcagguuacaaucacucuaacucucugaccaaagaugaacgagaaucccagauaacgcuagaaagauuagaauuauuacccaagaauaaucuaagacaaccaauaguagagaagauacuuaaccaaaugauaaacguaguaaacacuauacuagaaaaauacgguaagccuucagaaauaagagucgaacuugcccgagaacuaaaacaauccaaagacgaaaggaaugacacagaucuacaaaacucccgaaacaagaaauuaaacgaagaaauaggaaaacgccuagcagaacuaggacuuccgguaaccaaaagauacauucaaaaauauaaauuuauuuuuccaucauuaaguaagaaucuaaaagacgcccaugugaauaaccaauguauauauugcggcgaaacuuucaaccuaacagaagcacucaauggugacgcauacgacgucgaccacauaguaccuaaagcguuacucuucgacgauucacaaaccaacaaaguucuaguccaucgaaaaugcaauagcacaaaaacaaaucaaacagccuacgacuauauaacagccaaaggagaagaagaagucagaauauacagcgaacgaguugacgauugguuuaagaaaggaauaauaucuuacucaaaaaugcaacgacuaaaaguaagccauaaagaauauuuggaaagaaagaaauuaggaaaagagacagaaacugacaagaaacugugggaaaauuuuauagacagacagcuaagggauacacaauacauaucaaggaaaagcagagaaauccuacaaaaaguuuguaacaauguaacaacuacagaaggaggaguaacugcuaaacuaaggaaucuguggggaugggacgacauucuaaugaaccuacagaugccgaaauauaaagaacuaggucaaacaauuacgaaagaauggaccagcgaacauggaaagagaaagcaccaaaaagaagaaauagaaaacuggacaaaaagagacgaucauagacaccaugcaauagaugcccuaguaguggcauguacaaaacaaggauuuauacagagaauuaacacuuuaaacucuucggaaacaaaagaccuuaugauaaaggagguagaagaagcgaaaauagaguuuaaugagaagaccacguuauuagaaaaauaucuuaaaacacaaaaaccauuuacgacgagagagguaaugaaagaagcugauaaaauauuaauaaguuuuaaagcggggaagaaagucgcaacaauaacaaaauuuaaagcaacagggaaaaacaaagaaacaggaguaauagucccaagaggagcccuccacgaacaaucuguguacggaaaaauaaaaguaauugaaaaagacaaaccguuaaaauacuuauucgaaaauccugacaaaauaguuaauagucguauucgcgauuuaguagaaacuagacuuucagaaaaugaaaauaacucuaagaaagcacuaaguacuguaaagaaaaaccccauuuucuuuaacgaagagaaaaacgaaauucuggaaaaagcaaguugcuauaacgaugcgacuguccugaaauauaaauuacaaaaucugaaagcgaaccaagucgacgacauaguagacgaaagaguaaaauuucucgucaaagagcgauugacucaguuuggaucgaaagaaaaagaagcauucaaagauauucuuugguucaaccaagaaaaacaaaucccaauuauaacaguaagacuauucgcuagaccagaugcaaauaauuuacaaaucauuaagaaagacaaaaacggaaaagauauaggauucguuuuaacugggaacaaucaccauauugccauauacgaagacaaagauucuaaauuaguccaacauucuugcgcauucuggcaugccguugaaagaaagaaauauaacauaccugcggucaucaaaaacucggcagauguauggucucuacuccuagauaaagaacucccugugcuauuccuagauaaauuaccagcugacgaauuaaaccugaaauucucaaugcaacaaaacgaaauguucauacucgguuuaagucaagaagguuucgaugaagccauuaaaaauaacgacaaaucccuacuaucaaaacauuuauaucuaguauggucuauauccaauaaugacuacuauuucagacaccaccuagaaaccaaaaacacagaacucaaaaauauccccacagcaaaagacagcaaacgauacuuuagguucaaaagugucggagcccuaguuggaauaaauccgaucaaaguaagauuaaaccacuugggggaaauaacgaaaauuggagaauga

SEQ ID NO: 8732 - RNA, 3960 nt, Artificial Sequence
  Cas9 variant
augggauacaacauuggccuagauauuggaacuggaucuguaggcugggcagcacugacagaugaaggaaaacuagcgcgggcaaaaggaaagaacuuaauaggagugagauuauuugacuccgcgcaaucugcagcacaacgucguaguuauagaacaacaagacgacgacuuucccgacgaaaguggagacuuagauuacuagaaaauauauucagugacgaaaugggaaugauagaugaaaacuucuuugccagauuaaaauacagcuacguucacccaaaagaugaagugaacaaugcacauuacuacggcggauaucuguuuccgacacaacaagaaacccacgacuuucacgaaaaauuucaaacuaucuaccaccuaagauuaaaacuuaugaucgaagauugcaaauuugaccuacgcgaaaucuauuuagcaaugcaucauauuguaaaguacagaggacauuucuuaaacucacaaagcaaaaugacaaucggugacaguuacaauccccgagacuuccaacaagccauacaaaacuaugcugaagcuaagggccuuaucuggagccucaaugaugcacaagaaaugacagacguacucguaggacaagcaggauuuggccuaaguaaaaaggcuaaagcugaaagacuauuaagugccuuuucauuugacacuaaagaagauaagaaagcuauacaagcaauucuagcuggcauaguaggaaauaccacagauuucaccaaaaucuuuaaucgagaaaggucgggcgacgaauuaaagaaauggaaacuuaaacuagauagugaagcguuugaugaacaaucacaagcuauugucgacgaauuagacgaugaugaaauggaauuauuuaaugcaauccgucaagcauuugauggauucacacucauggaucuauuaggcgaucaaacaucaauaucugcagcaaugguaaaaagauaccagcaacaucacgaugaccuaaaaaugguuaaagaaauagcgaagaaacagggucuaucacaccaagauuuuucaaaaaucuacacagcauuucuaaaggaugauacagacaaaggcaugaaagcacuauuagauaaagcagauuuagcagacgauguguuaguagaaauacaacaaaggauugagucucacgauuuucuaccaaaacagcgcacaaaagcaaacucugucauaccuuaucaacuucaucuugcggaacuagagaaaauaauagaaaaucaaggaaaauacuauccauuuuugcucgacaccuuuacaaacaaagcaggagaaacuauaaauaaacuuguagaauuaguaaaauuuagaguaccauacuauguaggucccaugguaacagcugcagauguagaaaaggcaggcggcgacgccacuaaccacugggugaaaagaaacgaaggauaugagaaaaguccggucacacccuggaacuuugaccaaguauuuaaucgagaucaagcagcacaagacuucauugaccgacuuaccggaacagauacauacuuaaucggagaaccuacacuacuaaagaacucauuaaaauaucaacuuuuuaccguacuuaaugaauuaaacaaugucaaaauuaauggacauaaaauagaugagaaaacaaagcauguacucauacaagaucucuucaaauccaagaaaaccguuuccgaaaaagccauaaaagacuacuaccugucacaaggaaugggagaaauucaaauaguuggauuagccgauaaaacaaaauuuaacucaaaucuauccucguacauagaccuaaguaaaacguuugacgccgaauuuauggaaaaucccgccaaucaagaacuacuagaaaacauaauacaaauacaaacaguauucgaagacguaaaaauagcagaacgagaauuacaaaaguuagccuuacccgacgaacaaguacaacagcucgcuaagacucauuauacaggaugggguaacuuaucagacaaacuccuaaguacuccuauaauucaagaagguucacaaaagguuuccauucuaaauaaguuacagacaacauccaagaauuuuaugucaauuauaacggauaacaaguucggaguacaacaauggauccaagaacaaaacacagcugaaacugcugacucaauucaagacagaauugacgaacuaacaaccgcuccugccaauaaacgcggaauaaaacaggccuuuaaugugcuuuucgacauucaaaaagcuaugggagaagaaccaaacagaguauacuuggaauuugcgaaagaaacucaaaauagcguucgaacaaauucuagauacaacagacucaaggaccuuuauaagucuaaaacacuaucagaugacgucaaagcgcucaaggaagaacuugaaucacaaaagucuucucuacaaucagaacguauuggcgaccgauuauauuuauacuuuuuacaacaagguaaagacauguauacgggacagccaauaaauaucgauaaauuguccacagauuaugacaucgaucacauaauaccacaagcauacacaaaggacgacucaauagacaacaggguccuaguaucaagacccgaaaaugccagaaaaagugacucagcaacuuacacuacggaaguacaacaaagcgcaggcggccuuuggaaaagccuaaagaacgcaggauuuauaagccaaaagaaauaugauagauuaacuaaagguggagacuacucuaaaggacagaaaacgggauuuauagcacgacagcuaguagaaacaagacaaauuaucaaaaauguagcaucauuaauagaauccgaauuuucacaaaccaaagcuguagccauaagaucugaaaucacagcagauaugaggagacugguagcaaucaagaaacacagagaaauaaauucuuuucaccaugccuuugaugcacuauuaauaacugcagcaggacaauacaugcaagcucgauaccccgauagagauggagcaaacguauacaaugaauuugauuauuacacaaauaccuaucucaaagaauuaagacaaucuucaucuucaucccaaguaagacgacuuaaaccuuucgguuucguagugggcacaauggcaaaagguaaugaaaacuggagcgaagaugauacccaauaccuuagacacguaaugaauuucaaaaacauccuaacaacaagacggaaugacaaagacaauggggcucuaaauaaagaaaccauuuacgccguagacccaaaagcaaaacugauaggaacgaauaagaaaagacaagacgucucacuguacggagguuauauauacccauauagugcguauaugacccuaguacgagcaaacgguaaaaacuuacucguuaaaguuacuaucucagcagcagagaaaauuaaaucaggccaaaucgaacuauccgaauauguccaacagagaccagagguuaagaaauucgagaaaauccuaauaaacaaacuggcuauaggacaacuuguaaacaaugacggcaaccucauauacuuaacuagcuacgaguucuaucacaacgccaaacaacuauggcuuccaaccgaagaagcugaccuaauaucucaguuaaauaaagauucauccgacgaagauuuaaucaaaggcuucgacauacugacauccccagcaauacuaaaaagauucccauuuuacgaauuagacuuaaagaaauuaguuaauaucagagacaaauuuauagccguagaaaacaaauuugauauauuaaugguaauucuaaaagcgcuacagcuggacgcagcccaacaaaaacccguaaaaaugauugacaagaaaucagcggacuggaaagacuacagacagaggggaggaauaaaacuaucagacacaucagaaauaauauaccaaucuaccacaggaauauucgagaaaagagucaagaucucaaaccuauuauga

SEQ ID NO: 8733 - RNA, 3963 nt, Artificial Sequence
  Cas9 variant
augaccgagcaacaaagaccauacaauauaggacuagauauaggaacaagcucaauaggaugggcgguuacagaccaaaaugacaaacuacuccacauucgcggccacaaugguauaggugugaggcuauuuaaagaaggagagagugcagcagaaagacgaggauuccgaacaacaaggcgaagacuaagucgaaggagauggagacuacgauuccuggacagaauauucgaugcagaacuagcaaagguagauccgaauuuccuagcacgacucaaacaaucgaauaucagcccucucgacccaaacaaacagauguucggaaauauccucuuugacgacgcccaauucgacgaccaaaaauuucaucaacaauacccuacgaucuaucauuuaagaucagcucuagcacaaccagacgcaccucaagccgacguacgccuaauauauuuagcgcuacaccacaugauaaaauucagaggacauuuuuuaaacggcgccgccguugaaaaauuucaugguggacaacuccacuuagaggcugaauuucaagaacuaaaccaaauauucucaaaucaacaaagagaccauguacaauuacaaacaagcucuuuggacgaaguagcuacaauuuuaaaagacaaccaaagaacaccaucagaccgccaaagagaacuaucugcacgauuauuuguucccgucgauaagaccauugauaaagaaaacaaaaaacuugcaacggaacugcucaaagcaguguuaggucuaaaagcuaaauucgauguaauacuuggaguggaagcaacggacccacaagcauucaaacuccaauucaguucagacgacuuugacgauaaaauagccgaauuggcaagcgaacuuacagacgaagcaaaugaaauauuaacuguucuccaacggcuauacuuuucauuaaaucuagccgacauacuuacgaaucgacaaacaaaacaagucgccgacucaauaagcacagcuaugaucaauagauacgaugaccacaaacaccaccucaaaaugcuaaaagaacuugaaacacaaguaacucaagaacaaagagacggacuaaaaaaagcuuacgaugaguacauugacggagauaaaccaacaauugacacauucuacaccaacgucaaaaaaaacuuagacgauuccgaacuggcuaaucaaaucaaaucccuuauagauuuacaagcauuuaugccgaaacaaagaucaaaagagaaugguucaauaccacaccaacuacaccaaagggaauuagaccaacuaauagaagugcaaggaaaauacuaucccuggcuuuuagcugccaaagacaaacuagacgcacuaauagccuucagagugccuuacuauguaggcccaaugaucgacccaaaugaaucagacgacccacagaacacaaaauuugcuuggaugguaagaaaagaggcaggcgaaaucacacccuggaauuuugaagaaaaagucgacaaaacaggaucagcaacaaacuucauaaaacgaaugacgacaacagauacauauuuacuaggcgaaccagugcuaccaaaaaacucacuacucuaccagcaguuuacagugcuaaacgaacuuaauaaauuaaaggucgacggaaaagcacuuacaguugaucaaaaaaaauaucuuuacgaacacguaugcaaaaagcaacgccgcguaacucucaaaaaauuaucugacugucuaauggcaagaggggacuucccuaugggggccauauuuacaggaacaacagaccaaaaaaauaugaauaacacccuaaaaacuuaucaagacuuccaagaaauauucggagaugagauugacaaucccgauagacaaguggacuucgaaaaaaugauagaaugguccacgaucuuugaagacagagaaaucuuuaaacucaaauuggcagaacuuaauuggcuaacauccgaacaacuagaacgaguaucuaagaaaagauaucaagguugggggagauuaucacaaaaacuacuaacucauauaguaaaugagaacggugaaagaauuauagaucaauuauggaacacaaaccaaaacuuuauggagauuaugggucaagacgggguaaaacaggcaauucaagaacacaauggagcgaacguagcacaaacaggcaucaacgaaacaauugaugaacucuauacgucuccacaaaacaaaaaagcaaucaggcaaauacuucuagucguagaugacauaaaaaaagcaguaggauaugcaccagccaauauaaugauggaauuugcucgagaagaucgagaugaccacagacugauagcaucgcgagcacgacaguuggaaaagaccuaccaggaaauaucgaaaaauugguuugacaacgaaucagugacccaagaauuaaaagaucaaauuaaaaauaaaacuaaauucacugauagauuauaccuuuacuuuauucaaggaggaauugaccuuuauacaggacacccucuaaacaucgaccaauuaagcucauaugacauagaccacauauuaccgcaaucauuccuacuugacaacagccuuaauaaucguguauugacuagccaaagugaaaacagaguacauaaagaagauagacuaccgggugaaaccguagcuaauaaaaugagaccaacauggaaaaugaugagagaacaaggacuaaugacacaaagaaaauacaauaaucucacauuaaagccagaccaaauauccaaauuuaauaaucgcggccaauucauaaacagacaacuaguagaaacaagacaaguaauaaaacuagcugcagacauaaugaaucaaaaauaucaagcagaccaaacaaaaguagucacaguuaaagccaaucuuacacaccauaugcgggaaaaauuuaauuucuauaaaucacguaauguuaacgauuaucaucacgcguuugacgcauaccuaacaguuuucguaggaaauuggcuauuaaaagaauacccaaaguuacagcccuauuucgucuacggcgauuuugcaaaaaccggaaccaauaacuuaaaaucuuucaacuuucuauaccguuucgaaagagaccauaaacuaaaugauaaaggggcaaucgacacagacaaagaccaacaacuuggauauaugaaacgcauuuacagauucaaaaaaauguuagucacaaaacaauuagaaacuaaugagggugccuuauauaaacagacuauauacaaggcaccagccaacgaaaaaaauacaaaaaaaaaccguucgcuaauaaauacaaaaaaaaauagaccaucagacauauacgguggauacucacaauccguaacggcauacaugucgcucgucuuuuuuaaaaauacauuuaaacuaauaaaaaugccacucguugcggccaacgcaauaaaaaacucccuaucgaguuaucaugacacuauacuaaaaauacuaggaucaaaugaguuuaaaguuuuaauaccaaaaguaaaaaugaaccaauuaauuaaggagggugauagccuauauacagucguuggcguguacaaacacaacgcacaacaacuaauccuaucagacaacaguaugggaauaauaacuaagccaauccgagaaauaugugacagugaccuugacagcguguuuaaugaacucguugacaacauagauaaguacuuaaauuuauacaaaauagaagauaaacucaccaucaaagaaaaauuuuaugcccuaaaaaacaaagagucgaaauucaaauguaucagugacauacuagucgggacacauuguaaugcagggagaucgaacuuaaaaauaauaggacuauccaguuauugggggauguuuaguggaaacaaugacggacucaaaauaaacgaaaauucacaauuaaucuaucaaucuccaacaggccuauuugaacauagaguaaaaguaucagacuuauga

SEQ ID NO: 8734 - RNA, 3972 nt, Artificial Sequence
  Cas9 variant
augaaagauuucuauauaggacuagauaugggaaccgacucagugggaugggcaguagcagaugaagacuacaaccuaugcaaauucaaaggcaaagcaauguggggaguaagacucuuugacgaaagugccacagcagccgaaaggagagguuucagaacugcccgacgucgagcacaaagaaaaagacaaagaauacuaugguuacaaauguuauucaacgaagaaauaagcaagaaagauauagcauucuuucaacgauuaaaugaaucaaaacuauauuuagaagacaaaaguacuaauguaccauaugcaguauucgcugacgaaucauucaccgauguugacuaccauaaauuguacccaacuaucuaccaucuaaggaaagaacucguacaaucggacgagccucaugauguaagacugguauaucuagcacuacaucaccucaucaaaaaccgaggacacuuuuuauuugaaaacgucggcucggacuuugaaaaagaaaguucuuucgagguauuauucaaaaauuuacaaaauuacauacuaggagaauaugaacuagcucuagagugcauuagcccacuccagauagcagacauacucaaagauaaaucaaaacgaaaaacuacgaaaucaagcgaaaucugcaaacuacucggaauaagcaagaaaggccaaccgagacuaaacgcaaucguauugcuaauguguggacaauccgucaaacuagcugaccuauacggugacgaaaauuacaacaaagaagaaaaaucaucaauaucauuugaaaaagguuaugaagauaaugaggaaacauauagagaauuauuacuagagcgauuugaauuaauagagaaaauaaaagcauuauaugacugggcaauauuagcagauauucucaaaggagaaacuuauauuucauucgcgaaaguaaaaacguaugacgaacacaggcaugauuuacaacaguuaaaagcauucguuaaagaaagaugcagaagcgacuauaaugaaauuuuucgagaaaccucagauaaacuaaauaauuauacggcauauugugguaaauuuaaagaaaauggaagaaacggcguaauacuacauagcgcuaaccaaaccgacuucugcaaauaucuaaaaaguaaauucgacaaacuagauaaaucuggauacgaagacauguuugaaaagaucgaaaacggaaguuuuaugccaaaaauagucguaaaagacaacgguguaaucccaaugcaagugaaugaaagcgaaguacgagccauauuaaagaacgcauccgguuaccuugacuuuuuaaacaaccaggacaaagacggaauaacaguagccgacaaaauacugcaaauuuuugaauuuagaauaccauacuacguaggaccacuaaauguacacucagacaacucaugguuaguucguaaagacgggaaaauuuacccauggaacuucaauaaaaucgucgacgucgacaaaagugccgaagaauuuauaaacaaauuaacagccaaauguacguaucuacccgaccgagauguaauucccaaaaauucaauauuauacagccgauauaugguacuaaaugaauugaacaauuuaaaacucgacggcaagaaaccugaugucagcuuuaaacaagcagucuuuaaugacuuauucaugcaccgacgaaaaguuacacaaaaagcauuaagagaauacauaaaagcacaaacaggaacggaaccugaaauaacuggaauagauggagacuuuaaagcuaacaugagacccgcaauugaacucgcaggguacaaccuauccgaacccgacaaagaagaaauaauaaaagccauaacuauuuuuggagacgacaagaaacuauuaaaaagaagaauaaaagauaaauacagcgaaaugcuaucagaagacgaaauuaagaaaauaugcaaauuaaaauacaaagauuggggaagacuuucccgcgaauuucucaccgaaaucuuugacguagauacagcuacaggugaauguaaagacaacauaauaaauacauuauggaacacaaaugacaaucucauggaauuacuaggugccaaauacaacuucacacaaagcauagaacaagcuauaagcaaaucuacacacaaagcaucuauagagaaaauggucgaagauauguacguaucucccaaaguaaaacgaacaguauuucaauccuuaaaaauaaugaaagaaauaguuaaaaucaaaggccaugcuccaaagaaaguuuucguagaaaugacaagacaugaugguacaaaaggagacaacggacguaccaaaucucgaaagaaacaauuagaagaacuauauaagaaauguaaagaagauuccacagaacuaugggaugaacuugagaaaacugacgacgacgaguuccgacaagacaaacuuuuccuauacuauacacagaugggucgauguauguauuccggagaaagaauagaacuaagagaucuauucaacaaaaaccuguacgacauagaucacauauuuccacgaucaaaaguaaaagaugauagcauagacaauagggucuuagucaagaaacaaauaaacagucauaaagauaacgauuauccacucgacuccacaguacgagagaaaaugagaggucacuggcaauacuuauugagacacggauuuaucucgaaaaagaaauaugauagauuaacacgcguaacaccucuaacugaugacgagcuugcugacuucauugccaggcagcuaguagaaacaucucaaucaacaaaagccgucgccacgcuauuaaaaaccuuauauccaaccacagaaauaguauacguaaaagcagaauuagucucucgauucagaacugaauacaaauuuauuaaauguagagaaguaaacgaccuucaccaugccaaagacgcguauuuaaauaucguaguaggaaacguauacaacguaagauacacccauaguaaagcaauauucauaaaaggacuccaaaccaagaaauacucccuaaauagaauguucgcauucgauacgccuggagcguggaacaucgaaaaugaaaagucacucucaauagucaagaaaacaguuaugaaaaacaauauccuauauacacgcuacucauauaugaagaaagguggcuuguucaagauccaaccacucaagaaaggaaacggacaggcaccacuaaagaaagaucuaccccuaagcgacauuggcaaauacggagguuaugacaaaccaacagcuagcuacuuuuccuacaucaaauaugaaggcaagaaaggcaaagaaugccgacaacucgucgccaucgauaauuaccucaagaaauacuacgaagaaaauccaaucgaauaccuaacaaaucgauuaggacucaaaaauccagcuguucuaaucccaguaauaaaauauaacucaugcauagaaauugacggauuucgaaugaacauaucaagcaaaagcaaugaaggaaagacuaucguuuauaaacccgcugugcaauuaguucuaggagcugaaaaagaagccuacguuaagaaaauaaguaaaguccucuccaagccagaagaacagaaaauaacaagcuaugacggaguaucagcagaagaaaauauugaacuauucgacgcacuuaccgcuaaaaugacgaauacuaucuuuaaaauaaaacuagaggacauugggaauaagauaaaaucuggucgcgacaaauucguaacucuagacgucaagaaacaaugcuacguaauaaaugaaauacuaaagauaaugcauuguaacguaguuacaggagauuuaagucuaauuggagcagccaagaaagcaggaauuguaucaacaaauagugcucuaucagagaucaagaaaguuagcucaauuauguuaauaaaccagucugucacaggccuauucgaaacaaagauagauuugcuaaauaucuga

SEQ ID NO: 8735 - RNA, 3975 nt, Artificial Sequence
  Cas9 variant
augagagcaaaaggaaaaacucuaauuggcacuucguuauuuagagaaggaaacacggcagcagaaagacgaggauacagaacaacucaacguagguuaaaaagaaggaaacgaagacuaaaacuacuagaagcauucuuugacccauauaucuuugaagucgacgaaaacuuucuagcucgucuacacgaagcugauaucucgccuaaagacgaaaauaaaagguuuugggggagcuuacuauuuccuaaugagaaggacgcaaacuucuauagaaaauaccccacaauuuaucaccugagaaaagcauuaauggaagaagauagaaaauucgauguucgagccaucuuucucgcuauucaccauauuaugaaauaccgagggaacuucuuaaguccucuaagcguugacagcuuuaaacaagaaggacuagaacuaaaagaacaacuagacagacaacuuaaaagaguugcagaacuauacaacgaacuaaauacagauguaaaaauuaacgucucagacguggaaacaauacaagacauaauaauagacaaaaauaaaaguagaagagacaaagccggagcauugaagaaauuauuagcaguaucauccgauaggaaagaaauuaauaaacucaaugccaguuuagcaaaagaacuaagcaacgcuauacuaggcaugaaagcacaauuugcuaauuugcuccuagcagacgaucuagaaaucgacaaaaacaagaaaaauuucagcuuauuggauacaaaugcugaagaaaaugugaguggucuauuagaauuagucaacgaaaaacaagcugaacuauucgacgcaauaaaaaccauccacgaucaaauaauacuaaaugagauaguuccagacgguaaaucaauaucacaaaguauggucgauaaauaugaagcucauagggaacaacuacaaguuuuaaaagcacucuaugagaaaauggaugcaaaacaaauaaaagcuaucaagaaagccuacagucucuacauugacggaaaagaccccaaagcaaagaaaguugauaaaagagcacaccaaaauagagcagacuuuuauaaagaagugaagaaaguucuaguagaacucgaugauucuagagccgaaaaacuauuaggacuaauagaaaugggucaauuucuacccaaacaacgaacggcgaugaauggcguaaucccaaaucaacuacaucaaguagaauuggauaaaauuauagaaaugcaaucaaaauauuacccguggcuagcagagaaaaauccaguuaaaagccaucagaaaagagcccccuacaaacuagaugaacuucuaacauucagaguacccuacuaugucggaccaaugguaacaucuaagaaacaacaacaaaccagcaauaguaacuucgcauggaugguacgaaaacaagaaggcgaaauaacaccauggaauuuugaagaaaaaguagauacaauugcuucagccaacgacuucauaaaaaggaugacugcuaaagauacauaucuaguuggcgaagacguucuccccgccaacuccuuacuguaccaacgauauaaaguauuaaacgaacucaacaacauaaaaguuaauggaagaagauuaccaguagagcuaaaaagagaagcauacguagcauuauucgaaaauggagauucuaaaaccgucucagcgaaauguuucaaaaacuggcucaauguaaaacuuaaaaaccuaaauucacuaaaacuggaagguuuaagcacaggcacgaaauuugacaauaacuuaagcacuuaucaugaccucaagaaaauauucggcaaagccguagacgacgccgggagacaaaaagacuuugaacaaauaaucgaauggcucacuauauucgaagacaagaaaauacuaagaauaaaauuaaaagaaauagaaugguuaacagaagaaaacauuacacaacuaacgagguuaaauuauaacgguuggggaagacuuaguaggagacugcucacgggcaucugugauucaaacggucaacgaauaauggacuggcuuugggacacaacaaacaauuuuaugcaaauacaaagccaaccagacuuccaaaaagcgauaguagaauacaauagugauaaauuagaacaaggggacauagagcaaauccuuggcgaggcuuauacaucaccacaaaauaagaaagcaauuagaaaaguaauaaaaguuguacaagacguggaaaaagcaaugggcgcaaaaccuacuucuauuucaaucgaauuuaccaggucagauggaagaagcgaauuaacuaacaguagaaugacacaauugcagaaaacucucauguccuuauccgaagaaaugacagaccaagcauuacuagcagaguucaaagacuuccaagcaucuaaaaagaaacuuacaaauaaauacuaucuuuauuucacacaacuaggucgagauauguacaccggcgaaccacuaaacauagaucaauuaucacuauacucagauggggaucauauauuaccaagaucauuuauaaaagacgacucacuugauaacagggucuuaacaaaaagagcaguuaacaacgaaaaaucugacacugucccaguuugugaauauggcgcaaaaaugaaagauuucuggaaugauuuguacgacaacggccuaauaaguaaacaaaaacucgcuaacuugcuaaccgacccagacgaaauaggaccauacaaagcaaacgguuuuauacgccgucaauuaguggaaacaagucaaguaauaaaacugagugcagaaauauuacaaacacucuaucaagauaccaaaaucauugaaguacgccaaaaauacacucacgaacuaagggaacauuuuaacuuuguaaagauucgacaacucaaugacuaucaccacgcguuugacgcauaccuaacagccuucucuggccguuaucucuaccaaagauauccaaaauuaagaggguacuucguauauggagacuacaacaaauucgacgcgaagaaagaccgcaacuaccucaaaucuuauaauuuccuauaugaccuugaagaaggcaaaacugaucaaauuguagacaacguugaacacaaaguauucaugaacagacaagacgcaauaaaccaacuuaagaaagccuacgaauacaaauauauguuaguuagccaagaaacuuacaccaauaguggcgcaauguucaaagaaaccauauacccagucaaucccaaacaaaaacucauccaaaagaaaaaugacaaacccgucgacauauacgguggcuacaguaauaauuacgaugcguaccuuuccauuguaagacuagaggacaagaaaggaauaaaauuccggguaguugguauacccaugagaaauaaagcagaauuagauaaucuagcgaaagaagaccauaacggauacaugcaaagauuaaaugaaauagucgacgaacaaauaaacucuagcgggaaaaagaaaacauuccggauuauacuucccaaaguccacuuuaaacaauuaguagaagacgacucaggaaaauuuauguuaggaagugcagcauauccauacaaugccaaacaacucguucuaagugugaaaucuauagaaagucuagcgaacaaagaugccucugacagagaauuaguagcaguauacgaagaaauacuaaacguagugaacgauaaauucacccuuuaugaugccagacaauucaggaauaaauuaacaagcucuaaagauaaauucguagaacuaaauacagcagauaaaguaacagaauugcucgacauauuagacggauuacacgcaaauccgguuguuaagaaacucaaaauaaucaguggaaguccuuucggauuucugcaaagaccaucgggaauaguauuaacugaaaaugcaaaauugaucuaucaaucuccuacagggauauuugaaagaguaguauauuuacgugauuuguga

SEQ ID NO: 8736 - RNA, 3984 nt, Artificial Sequence
  Cas9 variant
auggaaggucaaaugaaaaauaacggcaacaaucuucaacaagguaacuacuaccuaggauuagauguagguacuucaucagugggcugggcuguaacugauacugacuauaacguauuaaaauuuagaggaaaauccauguggggugcaagauuauucgacgaagcaaguacagcugaagaaagaagaacacaccggggcaacagacguagacuugcacgacgaaaauaccgacuauuauuacuugaacaauuguuugaaaaagaaauaagaaaaauagaugacaacuuuuucguccguuuacaugaauccaacuuaugggcagaugauaaaucaaaacccuccaaauuucuucuauuuaacgauacaaacuuuacggauaaagacuaccuuaagaaauauccaacaauuuaccaucuacgaucagacuuaauacacaauucaacugaacaugacaucagguuaguauuucuagcguuacaccauuuaaucaaauacagaggccauuucaucuaugacaacuccgcaaauggagaugucaaaacauuagacgaagcagucagcgauuuugaagaauacuuaaacgaaaacgauauagaauuuaauauagaaaacaagaaagaauuuauuaauguacugucagacaaacaucuaaccaagaaagaaaagaaaauaagucuuaagaaacuauauggggacauaacugacagcgaaaacauaaacauaucuguacuaauagaaaugcuauccggauccagcauaucccuaucaaauuuguucaaagacauugaauuugauggaaaacaaaaccuuucucuagauagcgauaucgaagaaacacuuaacgacguuguagauauccucggagacaacauagaucucuugauacaugcuaaagaagucuacgauauugcugucuuaaccucaaguuuaggcaaacacaaauauuuaugcgaugccaaaguagaacuauucgagaaaaauaagaaagaucuuaugauauuaaagaaauauaucaagaaaaaucaccccgaagacuacaagaaaauauucucauccccaacugaaaagaaaaacuacgcagccuacagccaaacaaacagcaaaaauguuugcucccaagaagaguucugucucuucauaaaaccauacauccgcgacauggucaaaucagagaacgaagacgaaguuagaauugcaaaagaaguagaagauaaaucauuucucacaaaacuuaaagggacuaauaacaguguaguacccuaccaaauacacgaaagagaauuaaaccaaauacucaaaaauauaguugcuuaucuccccuuuaugaaugaugaacaggaagacaucagcgugguagacaaaauaaaauuaauauuuaaauuuaaaauaccauauuacgugggcccccuaaacacuaaauccacacguucaugggucuacagaucagaugagaaaauauaucccuggaauuucagcaacgugauugaucucgacaaaacugcacacgaguucaugaauagauuaauaggccguugcaccuauaccaaugauccuguuuuaccaauggacagcuuacuauacuccaaauacaaugucuuaaaugaaauuaacccaaucaaaguaaacggaaaagcaauacccguugaaguaaaacaagcaauauauacagaccuguucgaaaacagcaaaaagaaaguuacgagaaaaucaaucuacauauaccuacuuaaaaauggguacauagaaaaagaagacaucguaagcggaaucgauauugaaaucaaauccaaacuaaaaagucaccacgauuuuacacaaauaguucaagaaaacaaaugcacuccagaagaaauagaaagaauuauuaaaggaauccuaguuuauucagaugacaaauccaugcucaggcgauggcuuaaaaauaauauaaaagggcuaucagaaaaugacguaaaauacuuagcaaaacuaaauuauaaagaauggggacgucuaaguaaaacuuuacuuaccgauauuuacacaaucaauccugaagauggcgaagcauguuccauccuugauaucauguggaauacaaaugcaacacuaauggaaauuuuaagcaacgaaaaauaucaauucaaacaaaacauagaaaacuacaaagcagaaaacuaugaugaaaaacaaaauuugcacgaagaacucgaugacauguacauaagcccagcugcuagacgcuccauuuggcaagcauuacgaaucguagacgaaaucguagacauaaagaaaagugccccuaagaaaauauuuauagaaauggcacgcgaaaagaaaucagcuaugaaaaagaaacgaacagaaucgcgaaaagauacauuacuugaauuauacaaaucauguaaaagccaagcagaugguuucuaugaugaagaacuguuugaaaaacuauccaacgaaucaaacucaagacuaagacgcgaucagcuuuacuuauauuacacccaaaugggaagaucuauguacacaggaaaaagaauagacuucgacaaacuaauuaacgacaaaaacacauaugauauagaccacauauaucccagaucuaaaaucaaagacgacuccauaacuaacagaguacucguagaaaaagacauaaacggcgagaaaacugacauuuauccaauaagcgaagauaucaggcagaaaaugcaaccauuuuggaaaauuuuaaaagaaaaaggacugaucaaugaagaaaaauacaaacgccuuacaagaaacuacgaauuaacagacgaagaacucaguaguuucguagcuagacagcuaguggaaacacaacaaagcacgaaagcucuugcuacacuucuuaagaaagaauacccauccgcuaaaauaguauacaguaaagccggcaacguaagugaauuucggaauagaaaagacaaagaauuacccaaauucagagaaauaaaugaccuccaccacgccaaagacgcauaccuaaauauagucguaggcaauguauaugauaccaaauuuaccgaaaaauucuuuaauaacauaaggaacgaaaauuacucacuaaaaagagucuucgacuuuucaguacccggggccugggacgcaaaagguaguacauuuaacacaauaaagaaauacauggcgaaaaauaacccaaucauugcauucgcgccauaugaaguuaaaggagaacucuucgaucaacaaauaguaccaaaaggaaaaggacaauuuccaauaaaacaaggaaaagacaucgaaaaauacgguggauauaauaaacucucaagcgcauucuuguuugcuguagaauacaaaggaaagaaagcacgugaaagaucacuggaaaccguauacaucaaagauguagaacucuaucugcaagauccuauaaaauacugugaaaguguauuaggacucaaggaaccucaaauaauaaaacccaaaaucuuaaugggguccuuauucucaauaaauaacaagaaauuaguaguaacagguaggagugguaaacaauacguaugccaucacauauaucaauuauccauuaacgaugaagauucucaauaccuuaagaacauagccaaauaccugcaggaagaaccugaugguaacauagaacgucaaaacauucuaaacauuacuucggugaauaauaucaaacuguucgacguacuauguacuaaauucaauaguaauaccuaugaaauuauuuuaaauucacucaaaaacgacgucaaugaagguagagaaaaauuuucugaacucgacauuuuagaacaaugcaauauacuucuccaacuacuaaaagccuucaaauguaaccgagaaaguucaaaccuagaaaaacucaauaacaagaaacaagcaggcgucauaguaauaccacacuuauucacaaaaugcucuguuuuuaaagucauacaccaaucgauuaccggacuauuugaaaaggaaauggaccucuuaaaauga

SEQ ID NO: 8737 - RNA, 3984 nt, Artificial Sequence
  Cas9 variant
augaaaaauuacucaauaggacucgacauaggcacgggaucagucggaugggucuguaucgaugaaaauuaccaaauacuaagauacaacaaucgagcugccuuuggaguacacgaauuugaaacugcacacguggcagaagaaagaaggauaaaaagaggagccaggcgcagauauaacagacgaaaaaaaagaauucaacuacuacaaucacucuuuguaccacacaugcaacagaaagccuucuucgcacccacaauaacagaacacuacuggaaaaaugacaaucaauuugaaaacagaacccuuuccgaagugcuaaugagccuaggaaugaaccccaauaccuauccaacuauauuucaccuaagacacgagcuuauugaauccucaguaaaaaaagaugcaagauuaauauaccucgcccugcacaaccuugucaaauuuagaggacacuucuuacaagaagguucaacauggaaugcaaacauguccgacgccaauuuauccgaacaauucgaacagcuccuccauauauauacagagauggaagaauuaccacaaguaucacuaacagcccaacaaucaacugauguugaacacauacuacuaaauaaccauauaagcaaggcugagagagcaagacaacucacagcacuuuuugaaagaaccuaugaaccauuuuucaaacuuauagucgggcuggauaucgcagcugcacagcuauuuaaacagagugagcaacaacuucuauacaaagaaucaaaaaccaaaguuaauuuaacagcggaaacacuuccugaaguacuacaaacaauguuagaaccagaaguugcauucauugaggcaguacaaccauucuaccaacaaacaguucucuucgaucucuuaaaaggacaaaguuauguagcugcagcaaagguggaagccuuuaaccaauacgaaagagauuuagcgcuccuuaaaagcguuauaaaugagguugguucagaaaaacaauaucgagcauuuuuuauaacaucaaaacaaaaaaaacgccaauuugaacaaaaacccaacauggaacuccuaugucaccuugauagauuuaacagagagaaaaaauaugaagaaaccuuuuacaaagaaguaucaaaacuauuaacagcacucauaaaggaagcaacaggagaagugaaagaacacaucgagcaaauaauucaagccauggaaagucaaucuuucuuaguaaaacagaagggcauucaaaacgcaucaauccccuaccaaaacucacuuuacgaagcagagaugauacucagaaaucaacaagccuacuacccguggauaacagaugaauucauugaaaaagugaaacaacucauugcuuuuaggauuccauacuacauaggaccucuuguccagggcgacgaacaaccauuuggcuggcuacaacgacaagcggauggcaacaucacacccuggaacuucgacgaaaaagucaacaaagcagcaagcgcagaauccuuuaucacacgaaugacgaaaaacuguacuuaucuaaaagaagaaaaaguucuaccuaagcaaucauuaauguacgagaaauucacacuuuuaaacgaacuaaacucaguccaaauuagaagcucauuagaacaaccacauaaaaaacaccgccuaugcgaggauaugaaacaauggauuauagaacauguauucaaaaaaaccaaaaccguaacacacaaaacauuaauacaagcauuaaaaaaauccccauacaaagacgaauuauacgaugagaguacagguaacuggaaagacguauacggaacacaaaaagaggaccguuucgcaucuagucuuagcaccuauauuucuuuaaaagaaauuguaggagacauaguugauaacgcguuuauggaagaaauuauauacuggcuaacaguauuuacugacagagacauuaucacucuuaagaugaacgauaaauauccauuuauaacugaacaacaaauacaacgauuacuaaguuuaaauauaucuggcuggggucaacuaagucaaagacuccuacaaucaaucccaguugaugauaugaaccgcuccgugaucgaauauauggaaaagcacgcaguuaacuuuauggaauuauuaucaccaagacaaucagacuuagcauacaaaaucgaacaagucaauaaacaacacuccaaaaaaauccacaaaauacgauaugaagauauagaacagcuaacagggucuccagcacuaaaacggggaauauggcggagcguaaaaauaaucgaagaacuaacagcaauuuuuggcgaaccuaaaaauauaaugauugaaguugcgagagaagaucaggccucgcaucgaaccaaaucaagaaaagaacaaugggagaguauaggaaaaucccuagccaaagaagagaaagaacucaaagcauucuucaaggaaauggcccaguacccaaaacaacaauucgacagaacccguuucuggcuguauguaacacaacaaggaaaaugcuuauacaccggaaaaacacuacgacuagaagacuuaaguucauacgaaauugaucacauacuaccaagaaacuuugugaaagacgauuccauagacaaucuagcucuuguuuacccaauggcuaaucaagaaaaaaacaaagcuggaaacaacaaaaugccacuagaaauaauagacgccaaacaacaaccagccaugauggcacauuggaaacgacucaaccaacuaaaauuaauauccgacucaaaauugcacaaacugaugaaaccuagcuuuaacgauguggacaaagaaaacuuuaucgccagacaacuaguagagacaagacaaauuauuaaacauguucgagauuuguuacaagaaagauucgaacacacagauauacacguaguaaaagcaaaaauggugagucaauuucgcaaauuuucacgaauuccaaaaauacgcgauuauaauaauaaacaccaugcgauggacgcacuuuucacaacuguccucauacaauucauauuacaaaaauauggcaaaaauuuuuuacaguucgaucuacaacacaaagauauuucaaaaaaauggucaaaaauugcacaaucuacuaaacauuuuuuccucuuucaacaauuugccgaacagcaaauaaaguccccaguuacgaaggaauuagugaguggcguacaauacuuugaacacaucuucuacgaacaaucauggcaaacaacaaaaaugacacaaacgaucgauucaaacuucuacaaagagacaauauucucaccuaaauuaaaaacagcaaaauacacuucugcgaaagcagagaaauucguccaugaugcaaucguaaaauacgcgguuugcggaauacaauauacuuccuuaaaaaaaaauaaagaacaacaucauguacuccucacagacauuaacguaaucgaacauuaucaacuaaaagaggcaagccuaaacgaauuagcauuacacuuagcaaaaagagaaucuaaagacgaugucauagacgcacaaauguuaguaguuauccccaaauauaaaaaaauaauguuaaacggaucaccauacuauuguaucucaucagacgaaagacauauugcaacccaauuuguucuucgaaaagaccuacuagaagcaguacuucacgucaacgacgaaacaucaguagacgaacuacgcacgcucuuccggagcauagucgaagaaaugaugacacaauacaaaguauauaauaaagacacuauaagaaacaaaauagaugcuuuuaucgaaacagaacuaaucgauguagagacuuuucaagucgguuuuacggaaauuaaaaaaaugguagcugcaaaugcucaaagauccgauaaauuuggugggagauuacgacaaguuaugaagguagaagauauauauauaauugacgaaaguaucacagggcuuagguaccgaaaaccucggaaacuaguaaaauga

SEQ ID NO: 8738 - RNA, 3984 nt, Artificial Sequence
  Cas9 variant
augaagaaaaacuacaccauuggauuagacauagguaccgcgaguguagguugggcaguauuaacagaagauuaugaauuaauaaaacgaaaaaugaaaauaucagguaauacgcaaaagaaagcaguaaagaaaaauuucuggggaguaagacuauucgaacaaggagaaacagcagaaggaagaagauuaaaaagaacaacccgacgcagaauagccagaagaagacaaaggauucaauaucuuagaacaauauuugaugaagguaugaaucaaguugacgcaaacuucuuugcaagacuagaugaaaguuuuucaauuauagacgaaaaagaaaacgaaagacacccuauuuuuggaaacguagcugaagaagcagcauaccaugagcaauucccgaccauuuaucaccuuagagaacaucuagcaaauaguuccgaacaagccgaucuaagacuuguauaucuugcacuagcacauauaauaaaauuccgcggccauuuccuaauagaaggggaacuaaauacugaaaacucaagugugaguggaacauucgaacaauucauuaaaguauauaaugaaaccuuuaaugucgaaaaagcacuagaucuaacaguagaccuugacgguauugcagaacagaaaauuucgagaaugaaaagagcagaacuaauacuuagccucuuccccgaagagaaaagcacaggugacuuugcccaauucauuaaaaugauaguagguaaccaagggaacgucaagaaaacauuuucucugaaugaagacgcaaaaauucaauuuagcaaagaagaauacgaagaaaaucuugaaacacuauuagcagaaauaggggaggacuucagaucaguauucgaugcggcaaagaguguauaugaugcuauuucauuagcuaauauacuuaaagucacagacgcaacaaccagggcuaaacuauccaguucaaugguaguaagguucaccgaccacaaagaagaucuuaaaacacuaaaaagauuugucagagaaaaccuaccugacgaauacgacgaccuauucaaaaauaagaaaguagcgggcuacgcagguuacaucgauggcaacgaaacacaagaggcuuucuacaaauaucucaagaaaacacuagcgaaagcaacaggcgccgaaggauuuuuagcaaaaauggaacaagaagacuuccuucgaaaacaaagaacuuuugacaacgggguaauaccauaucaauuacaucuugaagaacuuaaagcuaucauuaaaaaucagaaaaguuacuauagcuuccuagacgaagagaaaauaucacaauuaaugaccuuucgaaucccauauuacguuggaccuuuagcaaaagaaaaaggccaauuugcaugguuaacucgaaaagaaaugggaaaaauaaccccauggaaucugaaugaaaaagucgauauagaaaaaucagcaacagacuucguagaaagaaugacaaauaaugauagcuacuuacccauggaaaaagucuuaccaaaacauucauuacuauacgaaacauucacagucuacaaugaacuaacaaaaguaagauauaucgacgacaauggacgcgcccaaaacuucagcagcaaagagaaaagacaaauaauaaaugaauuauucaaacaacaaagaaaagucaagaaagaaaugcuagaagcguuccucaaaaacgaauacgggauagagaaccccaaaguagaaggaauugaaaaauccuucaaugccugucuuggaacauaccaugaucuuauaaaacuagguaucagaccagaauuauuugagcaaccagagcaugaacaacaauucgagcaaauaguaaaaauacugacagucuuugaagacaggaaaaugcgaaggaaacaacuagaaaaauuuucaaacauauuaacagaagaagaacaaaaacaauuagaaagaaaacauuauaaaggauggggcagacugucagcaaaauuaauucacggaauuguagaccaaaagacccagaaaacaaucuuagacuacuuaaucgaugacgacgaucugcccaaaaacagaaaccgaaacuuuaugcaacuaauaaaugaugagaaccuauccuucaaagaagaaauugagaaaauagcauucgacaacgauaagaguaccgaagaaauuguacaagaacuugcuggcucaccagcaauaaagaaagguauacuccaaucauuaaaaaucguagaagaaaucauagacauaaugggagaacugccgaccaacauagugguggaaauggcaagagaaaaccaaacgacagcacaaggaaauagggcuucaaaagcacgaaugaaguacuuggaagaaagcauuaagaaauuaggaaguucaauccuagaagacgaaccaaucagcaaagaugcuaaccuucucaggaaugacagacuauuccuauacuacuuacaaaauggacgcgacauguacaccggaaacgaacucgauauaaacaaucuaucuucauacgacauagaccacaucguaccacagaguuuugucaaagaugauagcauagauaauagaguauuaacgacauccaguaugaacagaggaaaauccaacacaguaccagccgaaucaguaguuaagaaaaugagaccaacaugggaaagauuauuagcaagcggacucaucagcaagaagaaauuuagcuauuuaacaaaagcaacgaauggcggcuuaacagaagaagacaaagcacauuuuauacaaagacaacuugucgaaacuagacaaauuaccaaaaauguagcucaaauccuccaucagaaauacaauaacgaacaacuuucagaaaaaccuguaagggugaucaccuugaaaucagcauuagcaucacaguuuagaaaagauuuuucacucuauaaaaucagagaacuaaaugauuaccaucaugcgcaagacgcauaccuaaauggagucauagcucaagcauuacuaaaaguauacccaaaacuagaaccugaguucguguauggagaauaucaaaaagucuccaucagagcccuaaacaaggcaacugccaagaaagaauuuuauucaaacauaaugaauuucuucacaagugaugaaaugguagcgaacgaagagacaggagaaguucuguggaauagacaacgcgacauuaaaacuaucaagaaaguaaugaacuaucaccaaaugaacauagucaagaaaguagaaauccaaacaggagcauucacaaaggaauccauacuuccuaaagguccuaguaagaaacuaauagccaggaaaaauaacugggcuccugugaauuacggcgguguggacucaccgacgguagcguauagcguaauaauaacacaugaaaaaggaaaagcagcaaaaguuguucagcagcuaguaggaauaaaaauacuagaaagacaagcauuugaacaagacgaaguagcauuccuagaagaaaaaggauucauacacccuaaaguacaacugaaacugccaaaauauucucuauaucaauuugccgacggacguagacgucuacuugcaagcgcagaagaaucccaaaaggggaaucaaaugguucuaccaguacaucuuauagaacuacuguaccaugcaaaacacguuagcgauuccucaggaaaaagucuagaauaccuaaacgaacaucgucaugaguucgcagaacuccuggaagcuauccuacaauuuacagaacaauauauagacgccgguaaaaaucaaaagaaaguaagagauuuauaugagaaaaaucaagacgcagacaugcgugaacucgcaucaucauuuauccaguuacuucaacuaaauaaacagggcgccccugcugacuucaaauucuuuggagaaacaauaccacgacgacgcuauaaaaauacugccgaaaucguugaugcaacauuuauaaaucaaucaaucacaggauuauacgaaacacagaaaagauuaguguga

SEQ ID NO: 8739 - RNA, 3984 nt, Artificial Sequence
  Cas9 variant
augacagaacaacagcaaccauauaauauaggacucgacaucggaacgagcucaauaggaugggcuguaaccgaucagaacgacaaacuacuacacauacgaggccacaacggcauagguguucgacuauucaaagaaggagaaagcgcugcagaacgcaggggauuccguaccacaagaaggagauuaucaagaagaagauggagauuacguuucuuagacagaaucuucgacgcagaacuagcuaaagucgauccaaauuuccuagcacggcugaaacaauccaacauaucacccuuagacccaaauaaacaaauguucggaaacauacuauucgaugacccacaauuugaugaucaaaaauuucaccagcaauacccaacaauuuaucacuuacgaucagcauuggcucaaccagacgcaccacaagcggacguaagacuaaucuauuuagcacuacaccacaugaucaaauuccgaggacacuuccucaacggagccgcggucgaaaaauuucauggaggacaacuucaucuagaaucagaguuccaagaauuaaaccaaauauucaguaaccagcaacgugaccauguucaacuucaaacaucuucucucgaugaaguagcuacgauuuuaaaagauaaccaaagaacaccaagcgaccgccaaagggaacucucagcacgacuuuuugucccuguugauaaaacgauugauaaagaaaacaagaaacuugccaccgaauuauugaaagcaguccugggucuaaaagcaaaauuugacgugaucuuaggaguagaagcuacugacccccaggccuuuaaauugcaguucaguagcgaugacuuugaugacaagauagcugaauuagcaucggaauuaacagaugaagcuaaugaaauccuaacaguacuccagcgauuauacuucaguuuaaaccuagccgauauacuaacaaaccgccaaaccaagcaaguugccgauucgauaucuacugcaaugauaaauagauaugaugaucacaagcaccaucuaaagaugcugaaagaacuagaagcacaaguuacccaagaacaaagagacggacuuaaaaaggcuuacaaugaauauauagauggagacaaaccuacgauagacaccuucuauaccaauguaaagaaaaaccucgacgacucugaacucgcaaaccaaauuaaaucauuaauagaccuacaagcauucaugccuaaacaaagaaguaaagaaaauggaucaauaccacaucaacuccaucaacgagaacuagaucaguuaauagaaguacaaggcaaauauuauccgugguuacuagcggcaaaagacaaacuagaugcauuaaucgcguuccggguaccauauuaugucggccccaugauugauccaaaucaaucagaugauccccaaaacacuaaauucgcauggauggucagaaaagaagcuggcgaaauaacaccauggaacuucgaagaaaaaguagacaaaacaucuucagccaccaacuuuauuaaacgaaugacaaccacagacaccuaccuacuaggugaaccugucuuaccgaaaaacagucuccucuaccaacaauucacaguuuuaaaugaacuaaauaaacucaaaguaaacggaaaagcauuaacaguugaucagaagaaauacuuguacgaccacguaugcaagaaacaaagaaggguuacucuaaagaaacuaucagauugucuaguggcgcgaggugacuucccuaugggagcuauauucacaggaacaacagaucagaaaaacaugaacaauacucuaaaaacguaucaagauuuccaagaaauauuuggagacgaaauagauaauccagaucgucaaguugauuuugagaaaaugauugaauggucaacaaucuuugaagacagagaaauauucaaauuaaaacuugccgaauuaaauugguuaacaagugaacaauuagaacgaguaucaaagaaaagauaccaaggauggggaagacuuucacaaaaacuacuaacucacauugucaaugaaaacggagaaagaauaauagaccaacuguggaacaccaaccaaaacuucauggaaauaaugggccaagauucaguaaaacaagcuauccaagaacauaauggagccaaugucgcacaaaccgguauaaacgaaaccauagacgaacucuacacaagcccacaaaacaagaaagcuauuaggcaaauacuauuaguuguagaugacauuaagaaagcaguaggauacgcaccagcaaauauaaugauggaguucgcacgugaagaccgagacgaccaccgacuuauagcaagucgcgcuagacaacuugagaaaacauaccaagaaauaagcaaaaauugguucgacaaugaaucaguaacucaagaacuaaaagaucaaauuaaaaauaaaacuaaauucacugaucgucuauacuuauacuucauucaaggaggaauagauuuauauacuggacauccacucaacauagaucaauuaucaucauacgauauagaccauauacuaccacagucauucuuauuagacaacagcuuaaauaauagaguccuuacaagucaagcagaaaaccgaguucacaaagaagacagauuacccggagaaacaguagcaaauaaaaugagacccacuuggaaaaugaugcgugaacaaggacuuaugacccaaagaaaauacaauaacuuaacgcugaaacccgaucaaauaucaaaauucaacaaccgaggacaauucauaaacagacaauugguggaaacaagacaaguuauuaaauuagcagcagacaucaugucacaaaaauaccaagcagaccaaacaaaagucguuacaguaaaagccaacuugacacaucauaugagagaaaaauuuaauuuuuacaaaucuagaaauguuaacgacuaccaucaugcauucgacgcauaccuuacccuuuuuguuggcaacuggcuauuaaaggaguacccaaaacuacaaccguacuuuguuuauggcgacuucgcaaaaacaggcacgaacaacuugaaaucauuuaauuucuuauaucgauuugagagagaucacaaacucaaugauaaaggagcuauagauacugacaaagaccaacaacuaggauacaugaaacgcauauaucgauuuaagaaaauguuaguaacaaaacaauuagaaacaaacgaaggugcccuauauggacaaacucuauaccccgcucccaaaaaugacaagaaaacaagaaaucuuaucaauucuaagaaaaaccggccaucagacauauacggaggcuacucaaacgaaaacgguucauucuuaacucuaguaaaacucaagaaaggaaguaaauacgacuauagauuaguagcuguucccguaaguaaaauaucagaaauuaaagaaucagaacuugccacaaucgaaaaagcuauagcgccccaauuuuugaaauccucaggaaaauauagagacuuccaaguaguucuaagcaaaauacuaauaaaucaaaaagucauugaugaugguaugauauuuacaauaggaucgaaaucuuauaaacacaaugcaaaacaaguaguccuaucugauaacaguauacaaaucguaaguacacucuccagaauaucagacaaagaaaaacucauaaccguuuucgacgaaauagucgacauaacaucaaaauaucuaccuugguacaaaguaaacgacguagagaaaacgaaaaugcuauucaggcaaaugcaagacauugaugaaaugaagaaaauaaucgacaauuccuuaauaggauuacauugcaaugccagcauaacugauuuaggaaaaguuggacuaucaaaauauugggguagguucguccuaacagcgggcauaucccuaacaguagaugcgcaauuaauauaccaaaguccgaccggccuauucgaacauagaguaaaagucagugauuuauga

SEQ ID NO: 8740 - RNA, 3990 nt, Artificial Sequence
  Cas9 variant
augaauaaacaacccuauaacauaggacuagacauagguaccagcagcguaggauggucagcaacagaacuagauaaucgccuucuccauauaaaaggccacaacggcauuggcguacgacuuuucaaagaaggggaaucagccgcagaucgucgaggauuccgaacgacaaggaggagauuagcaagaaggaaauggagacuuagacuccuaaaugaaauauucgcaaccgaaauugccaaaguagaccccuccuucuucgcacgauuaaaacaaagcaacguaagcccgaaagaccccaacaaaaccauguucggaaacauccucuucgaugaugaaaaccucgacgaucaaaaauuccaccacgauuacaaaacaauuuaccaucuacgacaggcaauaauaaaucacccugaacaaaaauucgacauuagauuaauauacuuagcaaugcaucacauaauaaaauauaggggccacuuccucaaccaagccaacguacaagacuuuaaaggcggaaaaauagaccuugaaaaaucauuuaaagcauuaaacgacauauucgaaaaccagggaagagaccuccgucuggucacugacgaagcaaaccaguauguuaaaguucucucagacaacgcaaaaacucgaagugacagaaaaaaggaacuuucaaaguugcuauacguaccaauagacaaagauacggacaaaaauucaaaaaaagucacaggagagauauuaaaagcaauauugggaaauaaagccaaauuugaugucaucuuuggaaucgaaguagaaaauccgaaagaaugggugcuuaccuucaacucagacgauuucgaugacaaaauagaagguuuaucuucucaaaugacagaugaagacagcgaaauacuacucaucuuaaaagaauuauauuuugcacucaacuuaucagacauauuaaauaauucuguuaccgacaaaaaugcaaaaacacuaagcgaagcaaugauaaauagauacgacgaccacaagaaccaacuagccauguuaaaaaaagucauagauucaucagacaaaaaacacgcuaaagaauuaaaagaggcguacucggcuuacauagauggcgaaaacaacaaaaaaauaaguuucgaagacuuaaaaaagcgaauacaaaagaaccucguugacucugaacuaagucaaaaaauaaaugaucuucuagaucacgauuacuuucuccccaaacaaagaucaaaggaaaauggagccauaccucaccagcuccaacaacaagaauuagaucaaaucaucgagucucaaaaacaauacuaccccuuccucgcugagcuaaacccaaacgaaaaaagaucccgucaagcaaaauacaaauuagacgaacucguugcuuuccgcguaagcuauuacguaggaccaauggucgaaguuacagacagcaaucaggagaauaaugguaaauucgcauggaugaucagaaaagaacaaggagaaaucacgccguggaacuucgacgaaaaaguagacagaacagaaacagcaacuaaauucauaacgcgcaugacaacaaccgauaccuaccuaauuggagaaccuguauuaccuaaaaauucuuuacuauaucaaaaauucgucguauuaaacgaguuaaauaauuuaaagauaaaucaagaaacaauaacucccggacaaaaacaauaccucuaugaacacguaaugaaaaagaacaaaagaguuacacuaaaaaaaaucgcagacgcccuaguuauaaaaggcgauuauccauaugcccccgaaguuaaagguacuacagaucaaaaaaaccuuaauaauggguuaacaacauacauugacuuagccaaaauuuucggaaaugagcuagacgauguagauagagaagcagauuucgaaaaaauaauagaguggaguaccauauucgaagaucaacauaucuucguccucaaacuccaagaacuaaaaugguuaaccgaaaagcaacguaaccaagucguaaaacuccgauaucagggauggggcaaacucucaaaggaauuacuugccgguuuaguagaugauaauggucaaagaauaaucgaccuacucuggagcgacaaccaaaauuucaugcaaaucgucaaucaaaaaagcuucaaggagaguauagccgaccacaacggugcacauuuagaagaaaaaaauuuaaaagacgucauaaacgaccuauauaccucaccacaaaauaaaaaagcaaucagacaaguaauauuagucgucgaugauauaauaaaugcaguaggcuaugaaccagcaaacauaaugauggaauuugcacgcgaagauucaaacgaccacagauuaacaaacagcaggucaagacaacucgaaaacguauauaaagauauaacaaauuccugguucgacaacgauucaguaaaagaugaacuagaagacaaaauaaaaaauaaagacaaauuuacagacagauuauaccucuauuucacacaagguggaaaggaccuauacacuggcgagccacuaaauauagacgaucuauccucauaugauauagaccauauacuaccgcaaucauuuauacuagacaacucucuagacaauagaguacucaccucacaaagaaauaauagaguuucaaaagaagaccaacuuccuggcgaacuauucggaacgaaaaugcaugccuucuggaagagauuaaaagcugcucaccuuaucucgaacaaaaaauauuacaauuuaacacuaacgccaaacucaauaucaaaauuuaacaaucaaggaagauucauuaacagacaacucguugagacaagacaaguaaucaaacuggcugcagaaauccuucacaacagauauucagaagagaaaggcacuaacauagucacuauaaaagcaaaccucacacaucacaugagagaaaaauuuaauuuuuacaaaaaucgcaacgugaacgacuaucaccaugcuuuugacgcauacuuaacagccuuuguaggaaacuggcuauuacaacaauauccgaaauuaaaaccuuauuuuguauacggugacuucgcuaaaaccgaaaucaacaaccuaaaauccuuuaacauguuauauaaauucgaacaggcgcaccaacuuaacgaaaaagaugggaaaaucgcaaaagauaccgacgcgcuacuugguuacaugaagaauguauaccauuuuaaaaagauguuaguaacaaaagaauuagagacuaaccauggagcucuauuuaaccaaacccuguacccaucaccagcccacgauauaaaaaaaagacaguuaaucaaaccuaaagacaauagaccaacagauauauacggaggauacacucacgaagagcgaaaauauauguccuuaguaaaaguaauagguaaaaaagacaaugaauauagaauggcaaauguaccauuacugaaaauaaacaaaaacaaugacaucaaagaaauauuaaagucucaauuuaguaauaaaaaauucgaaaucguccuucccaaaguauuaaaaaaucaacuuuucuccgaaaauggcgcauuauucguaauaggaucaaaaggcuacaaauacaacgcgaaccaauuaguacugucagacuuagauaugaagcuacuaaaugaccuaucaaauaacaaaagcauugacgaagucaccauaaaccaacucuuuaaaaauauaguugauaguacaaauaaauauaugccacuauaugaaaucaaaaaccuaaaugaagucguagaaaaauuuaauaaucuugaauuuaaugacaaaaaaaaaacuauaacagacuuucuauuggccacacaugcaaauccuacuaugucaaaccuaaaaaacauaggacuacccuauuucggcagauucauaagaaacacggguauuaaacucucagaaaacgcaaacgucauauaucaaucacccacaggccuauucucacgaaaaauuaaaauaucggacuuuuga

SEQ ID NO: 8741 - RNA, 3993 nt, Artificial Sequence
  Cas9 variant
augaaaaaugacuacacaauaggauuggauaucggaacaaacuccguaggcuacucaguuguaacagacgauuauaaggucauaucaaaaaaaaugaauguuuucggcaauacagaaaagaaauccauaaagaaaaacuucuggggcguaagauuauucgaaucaggacagacagcacaagaagcuagaaugaaacgaacaucacgacgacgaauagcuagaagaaaaaaccguauaugcuaucuacaagaaauauuucaaccagaaaugaaucaccuagacaacaacuucuucuaccgacuaaacgaguccuuccuagucgcagacgacgcuaaauacgauaaacauccaauuuuuggaacacuugaugaagagauucauuuucaugaacaauuucccacaaucuaccauuuaagaaaauaccuagccgacggcgaugaaaaagcggaccuaaggcuuguauaucuugcaauagcgcacauaauuaaauuuagaggaaacuuccuaauugaaggugaacuaaauacagaaaacaauagugugauugaauuaucgaaaguauucguucaacuauacaaccaaacacucagcgaauuagaaggauuccaauucauagacgaaaguauugacuucagcgaaguacuaacacaacaauugagcaagucagaaagagcugauaacguguuaaaguuguuuccagacgaaaaaggaacaggaauauucgcucaauuuauuaaacuuauaguaggaaaucaaggaaauuuuaaaaagguguuccaacuagaagaggaucagaaacuacagcuauccacugacgacuacgaagaaaauauugaaaauuuauuagcgauaauuggagacgaauacggagacaucuucguagcugcucaaaaucucuaccaagcaauauugcuugcagguauauuaacuucaacagaaaaaacaagagcaaaacuaagugcaucaaugauacaaagguaugaagaacaugcaaaagaccuaaaacuuuugaaacgauuuguaaaggaacauauucccgacaaauacgcggaaauuuuuaacgaugcaaccaaaaauggguaugcaggauacauagacgggaaaacaaaagaagaagaguuuuauaaauaucuaaagacaacuuuaguucaaaaauccggauaccaauauuuuaucgaaaaaauagaacaagaaaauuuucucagaaagcagcgaaucuacgacaauggagucauaccacaccaaguccaugcugaagaauuaagagcuauauuaagaaagcaagaaaaauauuauagcuuuuugaaagaaaaucaugaaaagaucgaacaaauuuuuaaaguacguaucccauacuacgugggacccuuagcgaaacacaacgaacaaucaagauucgcguggaauaucaggaaaucugacgaaccuauaaggcccuggaacaugaaugacguaguggaugaaaaugcauccgccguggcauucauagagcgcaugacaauaaaagauauauaccuaaaugaaaacguacuaccuagacacucacuaauuuacgaaaaauucacaguauucaaugaacuaacuaaaguccuauacgcggacgaucgaggcguauuccaacgcuuuucagcugaagaaaaagaagacauuuucgagaaauuauucaaaagcgaacgaaaaguuacgaaaaaaaaauuagagaauuaucucagaauagaacuuucaauaucuucaccaucuguaaaaggaaucgaagaacaguucaacgcaaacuuuggaacuuaucuugaccuaaaaaaauuugaugagcugcaccccuaccuggaugaugaaaaauaucaagauaccuuagaagagguaauaaaaguuuuaacagucuucgaagaucgaucaaugauacaaaaucaacuagaacaacuaccgcuaaaucucucuacaaaaacaauaaaagcauuaucaagaagaaaauacaccggguggggaagguuaucagcacguuuaauagacggaauacacgauaaaaacucgggcaaaacuaucuuagacuaccuaauagaagaugaauccgauaguuauaucguaaaucgaaauuuuaugcagcuaaucaacgacgaucacuuaucuuuuaagaaaauaauagaagauucgcaaccauauaaagaacagcaaucggcugaagaaauuguuagugaacuauccggcucaccugccauaaaaaaagguauccuucaaucccuaaaaauaguagaugaacuuguagccaucauggguuauaaacccaaaaauauaguagucgaaauggcaagagaaaaccaaacaaccggacgaggcaaacaaaacucaaaaccgagguuaaaaggaauugaaaauggacuaaaagaauucagugacucaguauuaaaagguagcuccauugacaauaaacaacuccaaaaugauagacuguauuuauacuaucuacaaaauggaaaagauauguacacgggacaugaauuagacaucgaucaucuaagcaccuacgacauagaucauauaauuccacaaucauuucuaacggacaacagcauagacaaccgaguccuuacaacauccaaaucgaauagagggaaaagcgauaacguaccaucagaagaaguaguaagaaaaauggauagauucuggagaaaacuucuaaacgccaaacuaauaagcgaaagaaaauacacaaaucucacuaaaaaagaacuaacagaauccgauaaagccggauuucuaaaaagacaacugguagaaacaagacaaauuacaaaacacguagcaacaauauuagauagcaaauucaacgaagauucaaacaauagagacguacaaauaauaacccuaaaaucugcauuaguuuccgaauuucggaaaacauuuaauuuauacaaaguacgggaaauaaacgaucuacaccaugcccacgaugcauaccucaacgcaguaguggcacuuucuuuauuacggguauauccucagcuuaaaccagaauuuguauauggggaauauggaaagaacaguauacaugaucaaaauaaagcaacgauaaaaaaacaguucuauucaaacauaacaagguacuuugcaagcaaagacuacaucauaaacgaugacggagaaauauuguggaacaaacaagaaaccauagcacagguuauaaaaacuuuaggaaugcaccaaguuaaugugguuaaaaaaguagaaauacaaaagggcggcuuuaguaaagaaucaauacaaccaaaaggagaaucacaaaaacuaauacgaaggaaacaacaauggaauacaaaaaaauauggaggauuugacucgccaguaguagcguacgcaauuuuauugucguuugacaaaggcaagcgaaaagcuagaucauucaaaauagugggcauaacuauacaagauagagagucauucgaaggaaacccgauacuauaccuaucaaaaaaagacuaucacaauccaaaaguagaggcaauacuaccuaaauacucacuauucgaauucgaaaacggaaggagaagaaugguagcgagcgccucagaaacacaaaaaggaaaccaauuaauuauaccaggacaucuuauggaauuauuauaucacucaaaaaaaaucauaaauggaaaaaacucagacuccguauccuacauccaaaacaauaaagaaaaauuucgagagauuuuugaauacaucguagacuucaguuccaaauauauaucggcagacgccaaucucaacaaaauagaaaaaauauucgagaacaacuuccacaaagcuucugaacaagaaauagcaaaaucauucauaaaucuacuaacauucacagcaaugggagcaccagcagacuucgaauucuucggagaaaaaaucccucguaaaagauacgucagcauuucugaaauaauagacgcuguauuuauccaccaaagcauaacaggauuauaugaaacccgaguccguuuaacagaagucuga

SEQ ID NO: 8742 - RNA, 3993 nt, Artificial Sequence
  Cas9 variant
auggaaaaggaauacacaauagguuuagauaucggcaccaacaguguugggugggcaguacuaaccgacgauuaucgauuaguagcucgaaaaauguccauacaaggcgacucuaauagaaaaaaaaucaaaaaaaauuuuuggggagccagacuguuugaagaaggaaagaccgcacaauuucgcagaaucaaaagaacaaaucgcaggagaauagcacgcaggagacaaagaguacuugcccuacaagauauauucgcagaagaaauucacaaaaaagacccaaauuuuuuugcuagauuagaagaaggggaucgcguagaagcugauaaaagauucgcaaaauuuccuguauucgcuacacuguccgaagaaaaaaauuaucaucgacaauacccaaccauauaccaucuccggcaugaccuagccaacucgaaagagcaagcagauauaagauuggucuaccuugccauagcacauugccucaaauacagagggcacuuuuuauuugagggagaacuugauacagaaaauacaucuguuacagaaaauuaucaacaauuccuacaggcauaccagcaauucuucccugagccaauaggagaccuagaugaugccguuccaauuuugaccgaaagacucaguaaagcaaaacgagucgaaaaaguccuugcuuacuaucccucagaaaaaucaacaggaaauuucgcacaauuucuaaaguuaaugguaggcaaccaagcaaacuucaaaaaaacauuugaccuagaagaagaaaugaaacuaaacuuuaccagagacuguuaugaagaagauuugaaugaauuacuagaaaaaacaagcgaugauuacgccgaacuauuucuuaaggcuaaggggguauacgaugcuauuuuacuaucucagauucuaucaaaaagugaugacgaaacaaaagcuaaauuaagcgcuaacaugaaauugcgcuuugaagaacaccaaagagaucuuaagcagcucaaagaauuaguaagaagagaccuaccgaaaaaauacgaugacuucuucaaaaaccggucaaaaaauggcuacgcaggcuacgucaaaggaaaagcaacacaagaagacuucuauaaauuccuaagaacugaguuagcaggacuagaagaaucacaaagcaucauggaaaaaauugauuuagagaucuaccuacuaaaacaacgaacauuugcuaauggagucauuccucaccaaauacacuugguagaaaugcgcgaaauaauggacagacaaaaacguuuuuauccauuccuaaaaggagcacaaggaaaaauugaaaaacuacucacauuuagaauacccuacuacgucggaccucucgcacaagaaggccaaaguccauuugcauggauaaagcgaaagagccccucccaaauuacucccuggaauuucgcagaaguagucgacaaagagaauucagccaucgaauucauagaacgaaugacaaaccaagauaccuaucuuccaaaagaaaaaguauuacccaaacaauccuuaauauaucaacgauucaugauuuuuaacgaauuaacuaaagucuccuacacugaugaacgaggaaaaucacacuauuucaguagugaacaaaaaaggaaaauauuuaaugaacuauuuaaacaacauccacgagugacagaaaaacaauuaagaaaauuccuagaauuaaacgaacaaauagacaguacagaaauaaaaggaauagaaacaucguucaacgcaucauacagcacuuaccacgacuuauugaaacugagugaccaaauggacacuuuauuagaugacccagauaugaccacaauguucgaagaaauuauaaaaauauuaacaauauucgaagaccgcgaaaugauacgcgagcaacugaaaccauacgaaaccguccuaggauuacccgccauuaaaaaauuagcaaaaaaacauuacacaggauggggaagacucucagaaaaaaugauacaaggaaugagagaaaaacaaucacguaaaaccauucuagauuauuuaaucgacgaugacgauuucccuugcaaucgcaauagaaauuucaugcaauuaauuaaugacgaucaucuuucuuucaaggaaacaauagcaaacgaacuaauaaugucagacuccaacguauuacuagaccaaguaaaagcaauaccagguucgccggcaguaaaaaaaggaauauggcagucaauaaaaauaguagaggaaauaauaggcaucauaggcaaagcacccaaaaauauaguaaucgagauggccagagagaaccagagaaccagccgaucacgacccagauuaaaagcauuagaagaagcuuuaaaaaauauagauucaccccuauuaaaagauuacccaacagacaaucaagcuuuacaaaaagauagguuauaccucuacuaccuacaaaacgguaaagauauguacacaggagaaccucuagaaauacauagacuuucagaauacgacaucgaucacaucauaccacgauccuuuauaguagacaacagccuagauaauaagguacuaguaagcuccaaaguaaacaggggcaagcucgacaaugcacccgauccauugguaguuaaacgaaugagaagccacugggaaaaauuacaucaagcaaaacuaauaagcgacaaaaaauuagcgaaucuaacaaagcaaaaccuaaccgaagcggacaaagcuagauucauccaacgacaacuuguagagacccgacaaauaaccaagcaugucgcaaacuugcuccaucaacacuucaaccugccagaagagguuuccgcaacagaaaaaacaucaauuauuacacuaaagucgacuuuaacgagucaauuccgacaaauguucgauauauacaaaguucgggaaauuaaucaccaccaccacgcacaugacgcuuacuuaaacggcguugucgccaugacgcuacucaaaaaauaccccaaacuagcaccagaauucguuuacggcucauacauaaaaggugauauaaaucagauaaacaaagcgacagccaaaaaagaauuuuacucaaacauaaugaaauucuucgaaagugaagaaauuauaugugacgaacaaggagagguaauauggaacaaaaaacgcgacuuaaguaccaucaaaaagacaauaggagcacaccaagucaacauaguaaaaaaaguagaaaagcagaaagguggauucuauaaggaaacuauaaacaguaaggcaaacccagaaaagcuaauaccccgcaaagccagccuagauccucuaaaauaugguggauacggaagcccacuaguagcuuauaccguaauauuuauauucgagaaaggcaaacaaaaaaaaguaacaaaaggaauagagggaauaacaguaauggaacaacuuagauuugagcaggaccccagagaauuuuuaaaaacaaaaggguaugaaggagucaaacaauggcucauccuacccaaauauauuuuauuugaagcacaaggcggguacagaaggaugauagcaucacaccaagaaacucagaaagcuaacagucuaauccuaccagaaaaccuaguaacauuauuauaccaugcccgacauuacgaugaaauuaaccauaaaguaagcuuugacuaugucaacgcacacaaagagggauucaaugacauauucgacuucauaagugacuuuggaguaagauauauccuagcaccgcaacacuuggaaaaaauaaagguugcauaugaaaaaaauaaagaaguugaccuaaaagagaugaucgaugcaauuuuaagccuacuaaaauuuacacuauucggagcuucgguagaauuuaaguuuuuugauauaaaaauacugaaaagguauaaaucauuaacagauauaugggaagcaacaauaaucuaccaaucaguaacaggacuauacgaaagaagaguagaaguaagaaaguugugggauggagaaagacuauga

SEQ ID NO: 8743 - RNA, 3996 nt, Artificial Sequence
  Cas9 variant
augaacaaacagccauacaacaucggccuagauauaggaaccucaagcgucggcuggucagcaacagaacuagacaaucgacuauuacacauaaaaggccauaauggcauugguguaaggcuauucaaagaaggagaguccgccgcagaccgcagggguuuccgaacaacacgaagacgacuagcuaggagaaaguggcgauuacgauuauugaacgaaauauucgcaacagaaauagcuaaaguugauccaucauuuuuugcaagacucaaacaaucuaacgugucaccgaaagacccuaauaaaacuauguucgaaaacauuuuguuugaugaugaaaaccuugacgaucaaaaauuccaccacgacuauaaaaccauauaccaccuaagacaagcuauaauaaaccaccccgaacaaaaauucgauauacgguuaauuuacuuagccaugcaccauauaauaaaauaucggggacacuuucuaaaucaagcaaauguacaagacuucaaaggaggaaaaauagauuuagaaaaaaguuuuaaagcgcuuaacgacauauuugaaaaccaaggucgagauuuaaggcuaguaacagacaaagccaaccaauauguaaaaguccuauccgacaacgcuaagacaagaucagacaggaaaaaagagcuaucuaaacuguuauacgucccaauagacaaagauacagacaaaaacaguaaaaagguuaccggugaaauauuaaaagcgauauuaggaaacaaagcaaaauuugacgugauauucggaauagaaguggaaaauccaaaggaaugggucuuaacuuucaauucagaugauuucgaugacaaaauugaaggacuuagcagucaaaugacugaugaagacagugaaauacuuuuaauucuaaaagaauuauauuuugcucuaaauuuaucagacaucuuaaacaacagcguuacugauaaaaaugcuaaaacacuaagugaagcaaugaucaaucgauaugaugaccacaaaaaccaauuagcaaugcuaaaaaaagugaucgacucaucggacaaaaaacacgcaaaagaacuaaaagaggcuuacucugccuacaucgacggagaaaacaacaaaaaaauuuccuuugaagaccuuaaaaagcgaauacaaaaaaacuuaguagauucagaacuuucccaaaaaaucaaugacuuacuagaucacgacuacuuccucccgaaacaacgauccaaagaaaacggagcgauaccccaccaacuacaacaacaagaauuagaccagauaauagaaucccaaaagcaauacuacccauuuuuagcagaauuaaacccuaacgaaaaaagaucaagacaagcaaaauacaaacuggaugaacuaguagcauuccgaguaccuuacuauguggggccaaugguagaaguuacagacaguaaucaagaaaacaaugguaaauuugcauggaugauaaggaaagaacaaggagagauuaccccauggaacuuugacgaaaaaguugaccgaaccgaaacugcaacaaaauucauaacacgcaugacuacaacugauacauaucucauaggagagccuguacuaccaaaaaacagucuauuauaccaaaaauucguaguauuaaacgaacuaaauaaucuaaaaauaaaccaagaaauaauaacaccaggucaaaaacaauaccuuuacgaacauguaaugaaaaaaaacaaaagaguaacuuugaaaaaaauagcagacgcauuaguaauuaagggagacuacccauaugcaccagagguaaaaggaacuacagaccagaaaaacuuaaacaacggccugaccaccuacauugaucuagcaaaaauauuuggaaacgaacucgacgacguagaucgcgaggcagauuuugaaaaaaucauagaauggucuacuauauucgaagaccaacacauauucgcucuaaagcuacaggaacucaaguggcuaaccgaaaaacaacguaaccaaguaguuaaauuaagauaucagggaugggguaaacuaucaaaagagcuccuagcaggucuaguugaugacaacggccaacggaucauagaucucuuauggucagacaaccaaaacuuuaugcagaucgucaaucaaaaaucauucaaggaaagcauagccgaucacaacggcgcacauuuagaagaaaaaaacuuaaaagauguaauaaacgaccuauacacgaguccucaaaacaaaaaggcaauacgacaggucauacucguuguagaugauauaauaaaugcaguaggauacgaacccgccaauauaaugauggaauuugcuagagaagauuccaaugaccaccgauuaaccaauucaagaucaagacaacuagaaaauguuuauaaagacaucacaaauagcugguuugauaacgacucaguaaaagaugaauuagaagacaaaauuaaaaauaaagacaaauuuaccgaccgccuuuacuuauacuucacacaaggagguaaagaucuauauacuggagaaccacucaacaucgacgaucuuucgaguuacgauaucgaccauauacuaccacagucauucaucuuagauaacucccuugacaaccgaguauuaacaagccaaaggaacaauagaguuuccaaagaagaucaacuaccaggcgaacucuucgguacaaaaaugcaugcauuuuggaaacgcuuaaaagcagcccaucucauuaguaauaagaaauauuauaauuuaacauuaacaccaaauuccauaaguaaauuuaacaaccagggaagauucaucaacagacaacuaguggaaacacgccaaguaauaaaauuagccgcagaaauauuacacaaccgauacucggaagaaaaaggaacuaacauagucaccauaaaagccaaccuaacucaccacaugagagagaaauucaacuuuuauaaaaacagaaauguaaacgauuaccaccacgcauuugacgcuuaccuaaccgccuucgucgggaacuggcuuuugcagcaauacccaaaacucaaaccauacuucguuuacggugacuucgccaaaacagaaauuaauaacuuaaaaucauucaauaugcuauauaaauucgaacaagcucaccaacucaaugaaaaagauggaaaaauagcaaaagaugcugaugcccuguuaggauacaugaaaaacgucuaucauuucaagaaaaugcucguaacuaaaaaacuagaaacaaaccauggagcgcuuuuuaaacaaacgcuauauccaucaccugcacacgacauaaaaaaaagacaauuaauaaagcccaaagauaauagacccacagauauauacggagguuauacacaugaagaaaggaaauacaugucauuggucaaaguuauaggaaaaaaagauaacgaguaccguauggcaaauguaccgcugcuaaaaauaaacaaaaauaaugauauaaaagaaauccugaaaucccaauucagcaauaaaaaauuugaaauaguauuaccaaaaguacuaaaaaaucaauuauucucagaaaacggagccuuauucguaaucgguucaaaagguuacaaauacaaugcaaaucaguuaguacuaucagacuuagacaugaaacuacuaaaugaucuaucaaauaacaaaaguaucgaugaaguuacaaucaaucaauuauuuaaaaauauaguagauaguacuaauaaauauaugccgcuauaugaaaucaaaaaccucaaugaaguaguagaaaaauucaacaaccuagaauucaacgacaaaaaaaaaacgauaacugacuuccuauuagccacacacgcuaauccuacaaugucaaaucucaagaauauuggccuuccgucuuauuucgggagguucacaucuggcaacgccggaaucaaauuaagugaaaacgcuaauguaaucuaucaauccccaacagguuuauucuccagaaagguaaaaaucagugauuuuuga

SEQ ID NO: 8744 - RNA, 3999 nt, Artificial Sequence
  Cas9 variant
augaaaaacagagaaaauauaaaauauuacauaggaguagauauagguaccaacucagugggaugggcaguaaucgacgagaaugguaaccuacuaaaaaaaggaaaacaucacuuguggggaagccgauuguuugaucaagcucaaacagcccaaaacagaaggaauuauagaucaucaagacgacgauacaauaaacgacgucaacgaauuggccuacuaagauuaauaaugucugauaugguucuggaaguagauccaagcuuuuucauaagauuagagaaaaccaccuuccuagacaaggaggacaaaaaagcgauacugaaagauaauuacaaaaugaauuacaaccucuuuugcgaugaagauuauaacgacaagaaauauuuuaaagauuacccaacuauauaucaccuuagaaaaaaauuaugcgaaucagacgaaaaagcagauccaagauuaauuuacuuagcucuccaucacauaguaaaauaccguggaaacuuccuauacgaaggacaagaacuacaccuagaaccgucaaauaaagaagaagauuuaaagauuuuauucgacauacuuggaaaaaauaaugacacugucuacgauauuucugaagaacaaauacaauucauccuuaagaccguagucgagaauauaucaaaaacggcaaaagucgacgaauguaugucacaacuaaaacucaauucugaagacaaaaaaauuguaaaagaauucaugcggggcuuaguaggaaacaaauucaacguaucaaaacuauacaugcacgaggacuuacaauucgacgacgaagauuuaaaauuacaauuuucagacaaaucauaugaagaaaaaauaacugaguacgagaacguacucgaggaaaaaauggaauucaucgacuuaaugcaaagauucuacaguuggauagaauuaagcaaaauaguaggaagcgauucccaacacgcauccauaucaggcgcaaugguaaacauuuacgaaagucaucgugaagaccuaagaacgcugaaagaaguaaugcuaaaaaucggcaaaaaagaguacgacgaaauguucaaaccgacuuccaaaaacguaguaaacuacuauaauuacguaaacccaguagcaugcucaggugauaaaaccgauggauuuuauaaguauguuaagaaagcgaucgagaaaucugacgauuccagaaaagacgaaauacuacaaaaaauagcaaacgagacguacaugcuaaaacaaacaaguaaaaacaaugcguacauaccauaccaaaugcaaaaggaugaacuaauuaaaauacuagaccaucaagaaaaauacuauccaguauuaaaagaaaacagagauaaaauaauuaguauacuagaauuccggauccccuacuauuacggaccgcuagacgguaacaaacaauucggaugguuaauaaaaaaaaaagguaaagaaaaugaacgaauuuugccauggaaucaucaagaaauaguugauguacaggaaacagcagcacaauucauaaaaaaacuaacaaauuacugcacauauuuaccaauagaaaaaguaaugccacaaaagagucuaacuuguagcauguacgaaguacuaucagaaguuaacaaaauacgaauagaugguaaacuauuaccaauugacacaaaaaaucgacuaauugaagaucuauuuuuuaagcguaaaacagucaaggagaaagaccuaauaaacugguuaaaacagaaccagcuaacggucggagaaauaacuggauaucaaaaagaaaaagccuucagcaguagccucgcaccauggauagauuucaaagagauauucgacgaaauaaacgauaguaauuaugacuuaauagaaaaaauaauagaagacaugacaauauuuaaugaaggcucuauuuuaaaagaacguuuaaaaaaagcauacaaccuagaccaaaauaaaguuaaaaaaauaaugaaacuaaaauacucaggauggaguagacuaagcaagaaacucauuaaugggaucagagcagacaacaaauucgggucuuccguaucaauucuugacguaaugaaagaaagccacauggcgcuaauggaaaucauuaacgaccaagaucuggguuucaaacaaauuauagaaaaagaaaauuucaaaaaugaaacaggaucguuugaauaugaagauauagaaaacuuagcaggaagccccgcucugaaaagagguaucuggcaaacacuacaagucauagaagaaauaaaaaacuauaugggacacgaaccaaaaaauauuuauauugaauuugcaagggaagaacaagaaaagguaagaacaacaacaagagucaaaaaauugaaguccaucuauaacgauauaaagaaccaauuagacguacacgguaaagaagucuauucaaacuuaaauaaacaagacgaaaaauccagcauagaaaaacggcuauaccuauauuacacucaacucggaaaaugcauguauaguggcgaaagucucgacauagacaaacuaucaaacuaugaaauugaccacauauuccccagaacacucacaagugacgacucauuagacaaccuagugcucguaaaaaaaaaagaaaaccaacguaaacuagacgaucuuguucuaccuuuagaaauaagaaacaaaauggaaguuuucuggaaaaaauuguaugacaacggacuaauaacacagacuaaguauuacagauuaaugagggaugaauucagaagagaccaaauagauaaguuuauaaacagacaauugguagagacaagacaaauaauaaagcacguagcgaacauaauugaaaaccacuaugaggauacuaaaguauuuacuguaagagccaauuuaucacaugaauuucgagaaaaauaugggauuuacaaaaaucguaauguuaaugacuuccaucaugcacacgacgccuacauagcuuguauaauaggacgauauauccaaauacgauuuccaggacuagaagcgaaguauguauauggccaauauaugcaaaacguaaagaaaacaaaaaacaauauagauaaagaaaaccacggauucauaaucaauuccaugaaauacgaaugcauugaugaagauacaggcgaagucauuuggaacccagaaaggauacuugauuauauaaagugcuucaacuaucgagacguuuauauaaccaagaaacucgacacaaauaauagggaacuauucaacguaaccauucugccaaacgacaaaaauagugaaaaaggcaaaacaaaggcuacaauaccagugaauaaguuaaggucuaauguacgaaaauauggaggauucagcgguuuacaaagcgauaucguagcaauagaaggaaaaaaagguaaaaaaauagaccgaagacuaaucaacuugcccauacuacuaagauacguaaguauugaagaccaaugcaaauauauaauggaaaauaauaaauacagugauguaaagauaauaaagaaaauaaaaaaaaaccaacucauugaaauagauggaauaugcuacuaccucaaaagugcagaugaacuagauacagcuuaucaauuaauacuauccagagacgauaacgaaaugauuuaccgaauagauagagcaauacaaaacaaugauuuuaguuauuucgauaauaaaaaagaaaacauagacgaauuauaucgccuaauaugccacaaaaugaucgaaaauuauccaaaguacaaaaaaaaagucuacgaauuuauaaaagaacgggaagaagaauucuuugaauuagauaacagccagaaaugcauuguaauauucgaaaugauuagagucaugaaaaggggcgaacaauacauuaacauaccauucgaaccauacaaucuaaaaaaugauagaaaagggagauuaaacugucaaagcauauugcuagacaacacauacuuuuacgauguaaguauaacuggaauauacucaaaaaaguacaaauuauga

SEQ ID NO: 8745 - RNA, 3999 nt, Artificial Sequence
  Cas9 variant
augcaaaagaacuacacgaucggacuagauauuggaacaaacucaguugguugggccguuaugaaagacgauuacacauuaauaagaaagcgcaugaaaguauuaggaaacacagacauuaaaaagauaaagaaaaauuucugggguguaaggcuauucgacgaaggagaaacagcuaaagaaaccaggcuuaaaaggggaacaagacgaagauaccaacgacgaagaaacagauuaauauacuuacaagauauauuucaacaacccaugcuagcaauagacgaaaauuucuuucaucgauuagacgacucguucuuuguaccagaugauaaauccuacgauagacauccaauauucgguagccuagaagaagaaguagcguaccauaacacguauccaacgaucuaucaucuaagaaaacacuuagcagacaauccugaaaaagcggaccuacgauuaguauauacggcccuagcacacauaguaaaauaccguggacacuuccuaauagagggagaacuaaauaccgagaacacaagcauauccgaaacauuugaacaauuucuagauacauauagcgacauauuuaaagaacaacuuguaggggacauaucaaaaguagaagaaauacuaucaaguaaacaaagucgaucaagaaagcaugaacaaauaauggcuuuauucccaaaugaaaauaaacucggaaauuucggaagauucaugaugcuuauaguaggaaauaccucuaauuuuaaaccuguauucgauuuagaugacgaguauaagcuaaaacuaagugacgagacauaugaagaagaccucgauacuuuauuaggaaugacagaugauguauuccuggacguuuucauggcugcuaaaaauguauacgacgcaguagaaaugucagcaauuauauccaccgacacagguaauaguaaagcuguauuaaguaaucaaaugauaaauuucuacgacgaacauaaaguagacuuagcucaguuaaaacaauucuuuaagacacaucugccagacaaauacuacgaauguuucucugauccaaguaaaaacgguuacgccggguacaucgacggaaaaacaaaccaagaagauuuuuacaaauacaucgaaaaaguuaugaagacuaucaaaucagacaagaaagauuacuuuuuagauaaaaucgacagagaaguauuccuccggaaacaacguagcuucuacaauucaguaauaccccaccaaauccacuuacaggagaugcaagcuaucuuagaccgucagagccaauacuauccauuccuagcugaaaauagagacaaaauagaaagccugguaacauuucguauaccauauuacguaggaccuuuaacugucucagaucaaucagaauuugcguggauggaacgccaaucagacgaacccauaagaccguggaacuucgaugaaauaguaaacaaagaaaggucagcugaaaaauucauagaaagaaugacaaauauggauacuuaucuccuugaagagaaaguguuaccuaaaagaaguuuacucuaccaaaccuucgaagucuacaacgaacuaacaaaaguaagauacacaaaugaacaagguaaaacagaaaaauuaaaccgucaacaaaaagcagaaauuauugaaaccuuguuuaaacagaaaaacagaguacgggaaaaagauaucgcuaacuaccuggaacaauauggauaugucgacggaaccgauauuaaagguguugaagacaaauuuaacgcaucacuaucuaccuauaaugaucuagcuaaaauagacggagcaaaagcauaucuggaugacccagaauaugcagaugucugggaagacauaaucaaaauacuaacuaucuuugaagacaaagcuaugcgcaagaaacaacugcaaacauacucagacacacuaucaccagagauacuuaagaaacuugaaagaaaacauuacacaggcuggggaagauuuucaaagaaacuaauaaacggacucagagaugaaggauccaacaaaacuauacuugauuauuuaaaaagugaugaaggaucuaguggcccuacaaacaggaacuucaugcaacucauacgugauaauacccucuccuuuaaaaagaaaauagaagacgcacaaacuauagaggacacgacccacauauacgauacuguagcagaauuaccaggaucucccgcaauaaagaaaggcauaagacaagcacuuaaaauaguagaagagauaauagauauuauuggauacgaaccagaaaauauaguaguagaaauggcuagagaaagucaaacuacaaagaaaggaaaagaucuuucgaaagagagauuagaaaaauuaacugaggccauaaaagaauuugacggaccaucagacgugaaagucaaagaucuuaaaaaugagaaucuccgcaacgaccgauuguaccuauauuaccuacagaauggaagagacauguacacaaacgaaccccuagacauaaauaaucuaagcaaauacgacauagaccacaucauaccacaaucuuucacuacagauaacaguauagacaacaaaguuuuaguaagcagaacgaaaaaucaaggaaacaaauccgaugaugugccgucaauaaacauaguacauaaaaugaaaccauucuggagacaacuacacaaagcgggucuuauaucagauagaaaauucaaaaacuugaccaaagccgaacacggcggcuuaaccgaagccgaccgggcgcauuuccuaaauaggcaauuaguagaaaccagacaaauaacuaaacacguugcuaacuuacuagauucacaauacaacacggcagaagaacaaagaauaaacaucguauuacuaaaaagcuccaugacuagcagauucagaaaagaauuuaaauuauacaaagucagagaaaucaacgauuaccaucacggacacgacgcauaccuaaacgccguuguagcgacuacaauaaugaaaguauauccaaauuuaaaaccgcaauuuguauauggacaauauaagaaaacgucaauguucaaagaagaaaaagcaacagccagaaaacauuuuuauucaaacauuacaaaauucuuuaagaaagaaaaaguuguaaacgaagaaaccggcgaaaucuuaugggauaccgaaaggcauuuaucgacaauaaaaagaguccucucuuggaaacaaaugaauauagugaagaaaguagagaaacagaaaggucaacuuuggaaagaaacaaucuaccccaaaggagacagcaguaaacuaaucccuguuaaagaaggaauggacccacaaaaauaugguggccucucccaaguaagcgaagccuucgcuguugucauaacccacgaaaaagguaaaaagaaacaacuuaaaucugauuuaauaagcauaccaauuguggaucaaaaagcauaugagcaacacccaaccgccuaccucgaagaagcaggauacaauaacccuacuguauuacacgaacucuucaaauaucaacuauuugaacuagaagauggaagccgucgaaugaucgcguccgcuaaagaguuccaaaaaggaaaucaaaugguacucccacuagaacugguagaauuacuuuaccaugcuaaccgauaugauaaaguaaaauucccagauucuauagaauacguucaugauaacuuagccaaauucgaugaccuccuagaauacguaauagacuuuagcaacaaauauauaaaugcagauaaaaacguccagaaaauccagaaaauauauaaggaacacggaacagaagaugucgaacuaaccguagaaaguuucguaaaccuaaugacuuucacagcuaugggagcuccagcaacguuuaaauucuauggcgagucaauaacaagaucaagauauaccagcaucacagaguucagagguucaaccuuaauauuucaauccauaaccggccuauacgaaacaagauauaaacuagaagacaacuga

SEQ ID NO: 8746 - RNA, 3999 nt, Artificial Sequence
  Cas9 variant
augaugaaagaauauucaauaggucuagacauagguucaucaucagucggauucguugcaguagaugaccaauaccgaguaguacgagcuaaagguaaaaauguaaucggaacaagacuauuugaugaaggaaaaacagcagcagaccguagaggauugagaaccacgcgaagacgacuuagucgaagaaaauggcgauugagauuauuacgaggaaucuucgaaccacacauaaacgaaauagaugaaaguuucuuuaugcggcuuaaagaaucgaacauaagccccaaagauucaaacaagcacuuuccuggugauauacuauucaaugauagaucagaccgcgaguucuaugaaaauuacccaacuauauaccaucugcggcaagcauuaaaaacagaaaaacgccaauucgacauacgagaaaucuauuuagccaugcaccacauuguuaaauaccgaggccacuuucuagaaggaggaacaguaacagacuuugaaguaggagaauuagaucuagcugggaaauucucaagacuaaacgaacuuuucgaaucgauaaaucuagaaguaccguucguauuacgccuagacaaucuagaagauguaaaagcaguucucauugauucacaaagaucagcacaggacagacaacgaacacuuaccccugauauuuacguuccaaguaccgacaaaaucacagagaaaagauucaaagguauugcaacagaauuauuaaaggcaauaguuggaaacaaggcaaaauuugauguacuagcuggcuuagaacuggauaaagaagaagcaaaacucugggcacuuacuuucgauuccgaaaccuuugacgaagauaucgaacaacuggaaggagacaugacagaagcaacacaggaucugauugaaauacuuaaaagucugagaagucuaauucgauuagcagucaauaugcccgaaggaguaucacuuagcgaaaugaugauucaaagauacgaagaucaugcggaccauuuaaaauuauuaagagacauaauucauaacacagaugcagaaaaggccgccggcuuacaagcagcauaugacggauauauagauggagucaaagguaaaaagacaccaguagaugauuuuuauaaagcaaucaagaaaaaucuagacgacucagaagcagcccaccaaaucuuagcuuuaauagauaaaaacgaguucaugccuaaacaaaggaguaagucaaauggauggauuccacaccaaauacaacagaaagaacuagacagaauaauagaaaaucaaaaacaauauuauccuugguuggccgacguuaacccaaaugaaucucgacgaaagguagccccauauaaaauugaugaauuaguuacguucagagugccauacuacguaggaccauuggucacaucagaagaacaaaagaaauacggaaguaaauucgcuuggaugguccgcaaagaagaaaaaggagaaauaacaccauggaacuuugaccaaaaaguagauagggccgccucagcgacagaauuuauuaacagaaugacaaccauggacacuuaucuuuuaaacgaagacguacuaccagcacauucauuaauauaucaaaaauacgaaguccuuaaugaacuaaacaaagucaaaauaaauggcgacgcgauaacccccgaacuuaaacagaaaauauaucaugauuuauucgaaaaacaaacaacaguauccaucaaaaauuuacaaacauauuuaguaagugaaucagaagcgucagaaguuccugaaauuaaaggacuugcagaugaaaagaaauuccuuucaggauuaacuacauaucaugaccucaugaaaauauucgacaggaacguaguaaacgauccugaaagagccgaagacuucgagaaaauuauaagauggagcacggucuuugaagauaaacacauauauagagaaaaacucgacagcuuaucauggcuaacaacagaucaaaaagaccgguuagcuguaaaacgauauagaggauggggacgacuaucugaaaaacuauuaauaggacuaagagacgaaggacacagauccauaauggacuaucuaugggaaacaacaagcaauuucaugcaaauacaagcacaaaacgacuuuagcgagaaaaucgcagcagaaaacaaagaauuuuuggacaauacacaaucuguucagggaauuauuaacgaacuauauaccaguccacaaaacaagaaagcaauaagacaaacacuacuggugguagaagauaucaaaaaggcguuccacggagaagccccuaagagaauauuuguugaguucgcaagagaaaaugaaaguacuccccaaaggaguauacaaagacaaagacaagucgagaaugccuacgaaaaagugacucaaaacuuauuaguagacgacaagauuagagcagaacuaaaggauucaauuaacgaaaagagauuauuucaugaccgucuguuccuguacuucaugcaaggagguauugacauguacagcggcaaaaagaucaacauugauaaccuuucagcguaugacauagaccacauacuaccccaaucuuucaccguagacaauucucuugauaacagagucuuaacaaaccaaaaagauaauagagaaaaaggaaacagcuuaccuucagaacucuaucguggcaguaugaaagaaacuugggaaaugaugcggaaccaaggauugcuuagcaaaggaaaauuccauagauuaaugaugacuccaaacucgaugacugcuuaugaucaacaagguuucauaaauagacaguuaguagaaacaagacaaguuauaaaacuggcaguagaaauauuagccagcgaauuugaucaagcugaugaaaaaguugaaauuguuagcguaaaagcugguuugacacaucagaugcggcaagauuucucauuaaucaagaauagagaugucaacgacuaucaucaugcauuugacgcauaccuuacggcguuuguaggaacuuaccuuuuaaaaagauauccaaaacugcgaccauacuucgucuacggcgaauuuaagaaauucucacaaaaacaagcaaaucuaacaaauuuuaacuuuuuaugggcacuuaaacacaaagaccaaguagcuguggaagauacaggcgaaaagauauggaauaaaccacaagaucuagcauacauuagacaccuuuuugcauuuaagaaaaucuugauuuccagagaaguaagcgaaagacauggugcauuauuugaucaaacguuauauaaagcgucagacgacaaagcaaguggucaagguucaaagaaacuaauuccagcaaaagauaacagaccgacugaacuauauggagguuacaguggacaaacaagugcuuucauggcuauaguaaaaguaaccaaaggaaagaaaacuaaauaccuugucguugguguaccaacagcugccauaucucaauuacaaggaauggacguaaaaaguagucaauacacagagaaaauauacaacauauuaucuccaaaacugcucucuaaaaaugacgauuuugaagucaucgucccaaaaguaagauauaggcaauuaauacuugauaauaaucagcuauuuacacucgguagcgacacuuauaaauacaacgcccgccaauuaguccuaucgaaugagguucuagcuguaauuaacagagauaaaucauuuaucgacaagaaacugucagaagaagcagaaaaucaagcguuaaacgaugcauucgaugaaauugucguggcaauggauaaacacuucgaccuguacgacaaaaacgguuucagggagaaaguuaaagcaggcaaacaaagauucgaagaacuaccaguuucccuauucucagaagauaaagagaaugaaggaauaacaaaacgcacaguauuaaaaaggauucugcaaggucuccacgcaaacgcaacaacaagcgacuuaaaaguacuagauggaaaauucuauaacuga

SEQ ID NO: 8747 - RNA, 4002 nt, Artificial Sequence
  Cas9 variant
augaaaaacuacacaauaggauuagacaucgggguagcaucaguuggauggguauguauagacgaaaacuauaaaauauuaaauuauaauaaccgacacgcauuuggggugcacgaguucgaaagcgcagaauccgcagcugguagaagacuaaaaagagggaugcgaagaagauacaauaggcgaaagaaacgucugcaacuacuacagagcuuauucgacaguuacauaacagauucuggauucuuuucuaaaacggauucacaacacuuuuggaaaaauaauaacgaauuugaaaauagaucauuaacagaagugcuaucuucauuaagaauaucuuccaggaaauacccuaccauauaucaccuccggagcgaccuuauagagucaaauaagaaaauggaucucagauuagucuaucuugcacuacauaaccuaguaaaauacagaggucauuucuuacaagaagguaauuggucagaagcugcaagugcugaagguauggacgaccaacuacuugagcuaguaacucgauacgccgaacuagaaaaccuuucuccccucgauuuaagugaaagccaauggaaagcugcggaaacuuuauuauuaaauagaaaccuuacaaaaaccgaccaauccaaagaauuaacggccauguucggaaaagaauaugaaccauucuguaaauuaguggcaggacuuggggucagcuuacaucaacuauuuccuagcucugaacaagcacuagcauacaaagaaacuaaaacgaaaguacaacuuucuaaugaaaacguugaagaaguaauggaauugcuacuagaagaagaauccgcacuucuagaggcaguccaaccauucuaucaacaagugguuuuauacgaauuacuaaaaggugaaacauacgucgcaaaagccaaaguauccgcauucaaacaauaucaaaaagauauggcaucacuuaaaaaucuacuagauaaaacauucggagaaaaagucuauaggucauauuucauuagcgauaaaaauagccaacgagaauaucagaaaucccacaaagucgaaguacucuguaaauuagaucaguucaauaaagaagcuaaauucgccgaaacauuuuauaaagaccuaaagaaauuauuagaggauaaaucuaaaaccucaauagguaccacagagaaagaugagaugcuacgaauuauaaaagcuauagacagcaaccaguuccuacaaaaacaaaaaggaauacaaaacgccgcuauaccucaucaaaacagucuauacgaagccgagaaaauccucagaaaccaacaagcucacuauccauuuauaacaacagaauggauagaaaaaguaaaacaaauauuggcauuuagaauacccuacuacaucgggccucuagucaaagacaccacacaaucgccuuucagcuggguagaaagaaagggagaugcacccauaacgccauggaauuuugacgaacaaauagacaaagcagcuucagcagaagcauucaucuccagaaugaggaaaacuuguacauaccuaaaaggccaagaaguucuuccuaaaagcucccuaacauaugaacgauuugaaguacuuaaugaacuaaacgguauucaacuaagaacaaccggagcugagagcgauuuccggcaccgauuaucauaugaaaugaaaugcuggauuaucgauaacguguuuaaacaauacaaaacgguaucaaccaaacggcuacuccaagagcucaagaaaucaccuuacgcugacgaauuauacgaugaacacacaggagaaauaaaagaaguuuucggaacccaaaaagaaaacgcauuugccacgucacugagcggauauauuucaaugaaaucaaucuuaggugcagucguagacgacaauccugcaaugacugaagaauuaauauauuggauagccguuuucgaggaucgcgaaauuuugcacuuaaagauacaagaaaaauacccuagcauaacugacguucaaagacaaaaacuugcucuaguaaaauuaccaggauggggccguuucagccgacuacuaaucgauggacuaccccuagacgaacaaggccaaaguguuuuagaucacauggagcaauacagcucuguuuuuauggaaguucucaaaaacaaaggauucgguuuagaaaagaaaauacagaaaaugaaccaacaucaaguagaugguacaaagaaaauacgcuacgaagacauagaagaauuagcagguagccccgcauuaaaaaggggcauauggagaucagucaaaaucguagaagaauuagucaguauauucggggaaccagcaaacauaguucucgaaguagcaagagaagauggcgaaaagaaaagaacaaaaagucgaaaagaccaaugggaggaauuaacaaaaacaacauugaaaaaugaucccgaccuaaaauccuucauaggagaaauaaaaagccaaggagaccaaagauucaaugagcaacgauuuuggcuauacguaacacaacaagggaaaugccuauacacagguaaggcacuagacauccaaaaucuaucaauguaugaaguagaucauaucuuaccacaaaauuucguaaaagacgacucccuggauaauuuagcauuaguaaugccagaagccaaucaaaggaaaaaccaaguaggucaaaacaaaaugccccuagaaaucauugaagcaaaccaacaauaugcuaugagaacucucugggaaagauuacaugaauuaaaauuaauaagcucggguaaacuagguagauugaagaaaccaucuuuugacgaagucgauaaagauaaauuuauagcaagacagcuaguagagacaagacaaaucauaaaacacgucagagaucuucuugaugagagauuuucaaaaucagauauacaccuaguaaaagcagguauagugagcaaguuuagaagauucucagaaauaccuaaaauaagagacuacaacaacaaacaucaugcuauggacgcgcuauuugcagcagcauugauucaaucuauacuuggcaaauauggaaagaacuuuuuagcauucgacuuaucgaagaaagacaggcaaaaacaauggagaucaguuaaaggaagcaauaaagaguucuuuuuauuuaaaaauuuugguaaccugagauuacaaucaccagucacaggcgaagaaguaagcggagucgaauauaugaaacacguauacuuugaacuaccauggcaaacuaccaaaaugacgcaaacgggcgauggcauguuuuacaaagaaaguauauuuucuccgaaaguuaaacaagcaaaauacguuucucccaaaacugaaaaauucguccaugaugaaguuaaaaaccauucuauaugccuaguagaguuuaccuuuaugaagaaagaaaaagaaguacaagaaacaaaauuuauagaucuaaaaguaauagagcaucaccaauuuuuaaaagaaccggaaagccagcuagccaaauuucuagcagagaaagaaacaaauaguccaauuauacacgcacgaaucaucagaacuaucccuaaguaccaaaagaucuggauagagcauuucccuuacuacuuuauaucaacacgagaacuacacaacgcucggcaauuugaaaucagcuacgaauuaauggaaaaaguaaaacaacuaucagaaagaucgucugucgaggaacuaaaaauaguguuuggcuuauuaaucgaucaaaugaacgauaacuauccuauuuacacuaaaucaucaauucaagauaggguacaaaaauuugucgauacacaauuauaugacuucaagagcuucgaaauaggauuugaagaacuuaagaaagccgucgccgcuaaugcgcaacguagcgacacauucggaucuagaauaucaaagaaaccaaaaccagaagaaguagcaauaggguacgaaaguauaacggguuuaaaauauagaaaaccucgaaguguuguagguaccaaacguuga

SEQ ID NO: 8748 - RNA, 4002 nt, Artificial Sequence
  Cas9 variant
augucacaaaauauaguagacuacugcaucggacuagaucuaggaacagguucaguuggaugggcaguaguagacaugaaccauagacuaaugaaaagaaacggaaaacacuuauggggaagcagacuguucagcaaugcugaaacagcagcaaacagacgugcaagucguucaauaagaagacguuauaacaaaagaagagaaaggauuagacuacuaagagcaauacugcaagauaugguacucgaaaaugauccaacauucuuuauucgacuagaacacaccagcuuucuugaugaagaagacaaagccaacuaucuuggagcugacuacaaagauaauuacaaccuauucauagacgaagauuuuaacgauuacacauacuaucacaaauauccaacaaucuaucauuuaagaaaagcacugugcgaaucaacagaaaaagcagauccuagauuaauauaucuagcccuacaccacaucguaaaauauagaggaaauuuccuauacgaaggucaaaaauucaacauggaugcuucaaacauagaagaccgauuauccgaugucuuuacacaauuugcagacuucaauaacauaccuuacgaagaugaugagaagaaaaaucuagaaauauuagaaauucugaagaaaccccucucaaagaaagccaaaguagacgaagugauggcccuaaucgcaccagaaaaagauuucaaaucagcauacaaagaacugguuacaggaauagccggcaauaaaaugaaugucacuaaaaugauacuaugcgaaccaauaaaacaaggagacucugaaauaaaacuaaaauucagugacucaaauuacgacgaucaauucucagaagucgaaaacgaucuaggagaauacguagaauuuaucgacucacuccacaauauuuacaguuggguugaauuacaaacuauaaugggcgcuacacauacauauaaugccucgauaagugaagcaaugguaagucgauacaacaaacaccaugaagaccuacaauuacucaagaaauguauuaaagacaauguacccaagaaauauuucgacauguuccggaacgauuccgaaaaacuaaaaggcuacuauaacuauauaaaucaucccucuaaagcaccuguagacgaguucuauaaauacgucaagaaauguauagaaaaaguagacacaccugaagcaaaacaaauacuccaugacaucgaacuagaaaauuuucuccuaaaacaaaacucaagaacaaacggaucagugccauaccaaaugcaacuagacgaaaugauaaaaauaauagacaaucaagcaaaauacuacccgguguuaaaagaaaaacgagaacaacuacuaucaauucuaaccuuuaaaauaccguacuacuuugggccauuaaaugaaacaagugaacacgcguggauaaaaagacuagaaggaaaagaaaaccaaaggauacugccauggaacuaccaagacaucguugauguugaugcaacugcagaaggcuucauuaaaagaaugaggucguauuguacauacuucccugaugaagaaguccuccccaaaaacagucugaucgucucaaaauacgaaguauauaacgaacuuaauaaaauacgaguugaugauaaacuucuagaagucgauaucaaaaacgauauauacaaugaacucuucaugaacaacaaaacagucacagagaagaaacugaaaaacuggcuaguaaacaaccaaugcugcaacaaaaacgcggaaauaaaaggcuuccaaaaagaaaaccaauucuccaccucacugaccccuuggauugauuucacaaacauauuuggcgaaauuaaucaaucaaacuuugauuuaauagaagacauaaucuacgaucuaacaguuuucgaagauaagaaaauaaugaaacgacgauuaaagaaaaaguacgcacuaccagacgauaaaauaaaacaaauacuaaaauugaaauacaaagacuggagccguuuaagcaagaaacuccuugacggaauaguugcugauaauaaauucgguucuucaguaaccguucuagaugugcuagaaaugaguagauuaaacuuaauggaaauaauaaaugaucgcgaucucggcuacgcacaaaugauugaagcagcagcaucaugcccggaagauggaaaauucacauacaaagaaguccaacgauuagcaggcuccccugcucuuaaaagaggaauauggcaaucacuccaaaucgucgaagaaauaaccaaaguaaugaaauguagaccuaaauacaucuacauagaguucgaacgaucagaagaaacaaaagaacguacagaaagcaaaaucaagaaauuagaaaacguuuacaaagaucuggaugaacaaacaaaaguagaauacaaaacaguuuuagaagaacuuaaaggauucgacaacacuaagaaaauaagcucggauucauuauuccuauacuuuacacaacuuggcaaaugcauguacucaggaaagaaauuagacaucgacucacuagacaaauaucaaauugaccacauaguaccacaaucacugguuaaagaugacucauucgauaauagaguacucguaguuccaucagagaaucaaagaaaacuagacgaucuaguagucccaucugauauaaggguaaaaaugaauagcuuuuggaaauuauuauucgaucacgaacuaauaagcccuaagaaauuuuauucacugauaaaaacugaauacacugaaagagacgaagaaagauucauaaaccgacaacuugucgaaacuagacaaauaaccaaaaacgucacucaaauaauagaagaucauuacuccacuacaaaaguagccgcgauucgcgcaaaccuaucucacgaguucagggucaaaaaccauauauacaaaaaucgagauaucaacgacuaucaccacgcccacgacgcuuacauuguagccuuaauugguggcuuuaugagggaccgauacccgaacaugcaugacagcaaagccgucuacagugaauauaugaaaauguuucgaaagaauaaaaacgacaagaaaagauggaaagacggauucguuaucaacaguaugaacuacccguacgaagucgacggagaguuaauauggaauccagauauuauaaaugaaauaagaaaauguuucuauuauaaagacugcuacugcacaacaaaacucgaucaaaaaucaggacaaauguucaauuuaacaguccucccaaacgacgcacauagucccaaaggaacaacugaagcaguaaucccaguaaauaagaacagaaaagauguaaacaaauacggugguuuuucaggauuacaauaugucauuguugcaauagaaggcaagaagaaacgaggcaagaaaacaaaacucgucaagaaaauuaguggaguaccauuacauuuaaaagcagccucacucgaugagaaaauaaaauauauugaagaaaaagaaaacuuaacugacgugaaaauuauuaaggacucaauaccaguaaaucaaaugauugaaauggauggaggagaguaucuacugacauccccaauagaguucguaaauggaagacagcuaguacuaaacgagaaacaaugcgcucucauugcagauauauacaaugccaucuacaaacaagauugcgauaaucucgacgacguuuugaugauccaauuauacaucgagcuaauaaauaagaugaaagcacuauauccagcuuaucaauccauagcagaaaaauuugaauccaugacagaagacuaugucgcaguauccaaagaagaaaaagcagacaucauuaaacaaauguuaaucauaaugcaccgagguccuagaaauggcaaaauacaauacgcagauuucaacguaggagauagaauaggcaggaaaaauaaaaugucucucgaccuagaaagaguaacguucguaagucaauccccgacaggaauauacaccaagaaauauaaauuauga

SEQ ID NO: 8749 - RNA, 4002 nt, Artificial Sequence
  Cas9 variant
augggaaaagaauauuauuuaggauuagacauagguaccgacaguguagggugggcuguaugugacacaaacuauaaaauaccaaaauucaaagggaacgcaauguggggaauaagacuauuugaaaaaucaaacagcgcagaagaacgaagaggcuuuaggucuaguagacgcagaacucaaaggaaacgcgaaagauuaaaacucuuagaaaugcuauuugaugaagaaauauccaaaauugaccccgcauucuucauaaaacuacgagaaucaaacuuguacuuagaagacaaguccacgaaaauaccauacuguguuuucagcgaugaaaacuauacagacaaggacuuucacagagacuauccaaccaucuaccaccuaagaaacgaguuaauaaaaucuaacaaaccgcaugauguacgacuuguauauuuggcccuacaucauauaauaaaaaacagaggacacuuccuuuucgauuacagcuacaaaaaugauaaauccggggauuucaugcccauauacaacgacuuaaaaaauuacuuuuacgacaauuaugaaauagaacuagauuguucggaugucgacgaauucgccaacacccuaaaagacaaaucuaaaggcaagacaaaaaaaaacgcagaaauagcagaacuauuuggcguauccaaaaaguaugacaaaguacuauacagcgcauuaucauuguuaaguggaucgaguguaaaacuauucgacauauucgaugacgaagcauugaaagauguagaaaaaaaaucugucaguuucucuucagguuuugaugacaacgcuaacgacuuccaaaguuaucugggagaaagauuugaacuguuagaaaaacugaaagcaguguaugacugggcaguucuggccgacauacuggauggcaaagaguauauaagcgaagcaaaaguugcuauauacgagaaacacaaaagagaccugaagacucuaaaaaaauauauaaaaauauacaugccagaaaaaaaggcagaaauauucaacauaucgucaaaagacaauaacuauguugcuuauagcaaacauauaaaaacaucuaacgguaccggcgugcucauaucuacuugcacacaagaggaauucugugccuaccuaaagaaaacauuaggaauaugcaaagacgcauccuaugaagaaauguucaaagaaauagaaaacucaacauucaugccgaaacaaguaacuaaagauaacgggguaguaccaaugcaaguuaaugaaaaagagcucgucgcuauacuagacaaugccaaagaauauuugccauucuuauuaaauaaagacaaugauggaaaaacaguauaugacaaaauuaaagcacucuucgaauacagaauaccguacuacaucggaccauuaaauacacacucuacaaaaucuugguuaguacgaaguaacgagaaaauuuaccccuggaauaucgaagauguaguagacuuugacaaaucagccgaaaaauuuauagaaaauuuaacaaguaaauguacuuacuuaccacaauaugacguaauuccaaaacauucucugcuauacaacaaauucugcguccuaaacgaauuaaauaaucuaaaaauugacggagaaaaaauaucaguacaacucaaacaagauauuuacaacgaucuauucaaaaaauacuacaaaguaacaaacaaaaaacuuugugacuaccuaaaaagcagaaauauagccuucgacgaaauaucgggaauugauaaugauuuuaaauccucacucaaaucauauaaagaccuuguugcauauaacuugacugaugaacaaaaagaagaaaucguaaaggcaauuacaauuuuuggagaugauaaaaaauuacuaaaaaaaagacuuaaaaacgaauucggagggugcuugucggacgacgaaauaaaaaaaauauguaagcuaaaauauacuggcuggucuaaacuauccagagaguuucuuacagaugucacugcagucuacaaagagaccggugaauuaauuaacauuauaugcgcccuuugggagacaaacuacaaucuaacaucauuacuauacagugacgaguucugcugcgacgacaaagaaaacaaaacauuuaacgacaaaaucaaugaacuaaacucuuucgguaaugacaaaacacucaaucaaauagucgaagaacuauauguaucuccacucguuaaaagaccuauauaucaaagucuacuuaucaccaaagaacuugaaaaaauaaugaaaugccccccuaaaaaaauauuuguagaagucgcaagaggugcagaagaaaaaaaacgaacuguaaguaggcgcaauaaacuacuggaccuauauaaaucaugcaagaacgauuauccacucuuauucgacgaacuacaaaauaauacuacagacgaugaacuaaaauccgauaaacuauacuuauauuuuacucaauucggaaaaugcauguauacaggagagaauauagaguuaggcgacuuauucaacaagaaucuauaugacauagaccacaucuauccucaaucaaaaauuaaagaugauuccuuagacaaucgcguacugguaaaaaaaaccacaaacgcgaagaaagacaaugaauauccacuaaguucacaaauuagagaaaaaaugacaccccauuggaaagcacuacuagacaaaggacuaauaaacaaaaaaaaauacgaaagauuaguacguaacuacccacucagugaugaagaauuaucacaauuuauaagccgacaauuaguagaaacacggcaaucaacaaaggcaguggcuaauauauuagaacaauuguauccaaggccagauacugaaauaguuuacgugaaggcagcacuagcaucagaauuccgccaccaauacgauauguuaaaauguagagaaguaaacgaccuacaccaugcaaaagacgcuuaucucaacaucgucgugggaaacgcuuacaacggcaaauucacacauaauaaagcgaacuuuauaaagggucuucaaaacaacgacaaagccuauaccguaaaauuagacucaaugcuaaaacauaauaucgacggcgcauggauagcagauaacaaugaauccuuaaauauaguaaaaucaacgaugaauaaaaauaauauccgauauacacgauaugccuuugagaaaaaaggaggauuauucaaagucacaaucuuaaaaaaaggaaacggucaagcauccauaaaaaaaaacgauaaaagaaauagcaucgaaaaauaugguggauauaaccaaguaucauccaccuacuucuccuguguagaacacggaaaagacaacaauagaaugauaucaauguucucaguaaaccucuacgacaaaaauaaauaugaagagaaucccauagcuuaccuaauagaaaauuacgguuuaauaaauccaauaaucaaaguaaaaaaaguaaaaauucagucgugcauaaguuuugacaacaugcuaugucauuuaggcggaaaagacuccggugguagccaaauuuccuacagaccaggaguccaacucguacuaggcuacgauaaugaacgauacauucgaaacguaauaaggugugcgggaggagauuuacaccuucaaacaucaaaaaaugaaaaagauauagugacagccgaaaaaaauaucgaacuauucaacuuacuuaucgaaaaaaugaaaaacaacauuuacggcguccuuuauagcaauuuaggcgauaaauuauacugcagcaaagaaaaauucgagaaacuagacauagucgaacaauguaacguaaucaaaaacguccuuacaauuuuaaaaaauaaugcaucaaaaggugaucugaaaucaauagguauaaaagcuaauggugccauccguuuaaauaacaacaucagcgaaauaaagaaagucaaaaguaucaaacuaauaaaucaaucggucacuggucuauuugaacaagaaauagaacuauuaaaccuauga

SEQ ID NO: 8750 - RNA, 4002 nt, Artificial Sequence
  Cas9 variant
augucacagaauauaguagacuauuguauaggccuugauuuagguacugguucagugggaugggcaguaguagauaugaaccaucgauuaaugaaaagaaacggaaaacacuugugggguucgcgacucuucucaaaugcggaaacagcagcaacaagacgaucgucccgaagcauacggcgacgauacaacaaacgaagagaaagaauaagacuacucagggcaauauuacaggacaugguccucgaaaaagaccccacauucuucauacggcuagaacauacaucuuuccuggacgaagaagauaaagccaaauaccuaggcacagacuauaaagacaacuacaaccuuuuuauagacgaagacuucaaugacuauacauacuaccacaaauacccaacgaucuaucauuuaagaaaagcccuaugugaaucaacagaaaaagcagacccaagguuaauauaccuagcucuccaccauauaguuaaauaccgaggaaauuucuuauaugaaggccaaaaauucaauauggacgcuaguaacauagaagacaaacuaagugacguguucacacaguuugcagacuucaacaacauaccauaugaagacgacgaaaagaaaaaccuugagauuuuagaaauacuaaagaaaccacuaaguaagaaagcuaaaguugacgaaguaauggcauuaauuucaccagaaaaagaauuuaaaucagcauacaaagaauuaguuacaggcauagcaggcaauaaaaugaacgucacuaaaaugauacugugcgaaagcaucaaacaaggcgacagugagauaaaacugaaauuuucagauucgaacuaugaugaccaauuuagcgaaguagaaaacgaucuuggagaauacguagaauuuauagacagcuuacauaacauauacucaugggucgaguuacaaacaauaaugggagcaacacauacagacaaugccucgauauccgaagcaaugguuagcagguauaacaaacaccaugaagaucuacaacuacuuaaaaaguguauuaaagacaacguaccaaagaaauauuuugacauguuucgaaaugauucagaaaaaguaaaaggauacuauaauuacauaaauagaccaaauaaagcaccuguagaugaguuuuauaaauucgucaagaaaugcaucgaaaaaguugacacccccgaagcaaaacaaauauuacaugacauagaauuagaaaauuucuuacucaaacaaaacucaagaacaaauggaucaguaccauaccaaaugcaacucgacgagaugauuaaaauaaucgacaaccaagcaaaauacuaucccguacuaaaagaaaaacgagaacaauuauuaagcauacuaacauuccgaauaccguauuacuucggaccgcugaacgaaaccagugaacacgcauggauaaaacgacuagaagguaaagaaaaccaaagaauccuaccauggaauuaccaagauacaguagauguugaugcgacagcggaagguuuuauaaaacggaugcgaucuuacugcacguacuuuccagaugaagagguucuaccgaaaaauaguuuaaucguaaguaaauaugaaguuuacaacgaacuaaauaaaauacgaguagaugauaaacuucuggaaguagacguuaaaaacgauauuuauaacgaacuauuuaugaaaaauaagacaguaacagagaagaaacuuaaaaauugguuagugaacaaccaauguugcagaaaagaugcagaaauaaaaggauuccaaaaagaaaaccaauucucaacaagccuuacacccuggauugacuuuacuaacauauucggcaaaauugaucaaaguaauuuugacuuaaucgagaaaauaaucuacgauuuaacaguauuugaagacaagaaaauaaugaaacgaagacucaaaaagaaauaugccuuaccugacgauaaaauaaaacaaauacuaaaauuaaaauauaaagauuggucaagauuaucuaagaaacuacuugauggaauaguagcagauaauagauucgggagcagcguaacuguacuugaugugcuugaaaugagcaggcuuaaccuaauggaaaucaucaacgacaaagaauuagguuaugcacaaaugauagaagaagccucaucauguccaaaagauggaaaauucacuuacgaagaagucgccaaacuagcaggaaguccagcacuaaaacgaggcauauggcaauccuuacagaucgucgaagaaauuacuaaagucaugaaauguagaccaaaauacauauacauagaguuugaacgaucggaagaggcaaaagaacgaaccgaaucuaaaaucaagaaacuugaaaacgucuacaaagauuuggacgaacaaacaaagaaagaguacaaaucuguauuagaagaacucaaagguuuugacaauacaaagaaaauaucuagcgacagccuguuccuuuauuucacccaguuagguaaauguauguacagugguaagaaauuagacauagacagucuagacaaauaccaaaucgaccauauaguaccacagagucuaguaaaagaugacucauuugacaacagaguucuaguacuaccuucagaaaaccaacgaaaacuagaugaccugguagucccauucgacauuagagacaaaauguaucgauuuuggaaacuccucuucgaccacgagcuaauaaguccuaagaaauuuuacucacuaauaaaaacagaauacacagaacgcgacgaagaacgauuuaucaaccggcaauuagucgaaacuaggcaaaucaccaaaaacguaacacaaaucauagaagaucacuacuccacaacgaaaguggccgcaauaagagcaaaccuaagccacgaguuccgcguuaaaaaccauauauacaaaaacagggauauaaacgacuaccaucaugcacacgacgcauauauagucgcccugauaggagguuuuaugagagauagauauccaaacaugcacgacaguaaagcuguauauucagaauauaugaaaauguuccgcaaaaauaaaaacgaucaaaagaaauggaaagaugguuuuguaauaaauagcaugaauuauccuuacgaaguagauggaaaacuaauauggaauccagaccuaauaaacgaaaucaagaaaugcuuuuacuacaaagacuguuacuguacaacaaaacuugaccagaaaucuggacaaauguuuaacuuaacaguguuaccaaaugaugcacacagugcaaaagguacuaccgaagcaguaauuccgguaaacaaaaauagaaaagaugucaacaaauauggaggguuuucuggauuacaauauguaauagcagcaaucgaaggaacuaaaaagaaagggaaaaagcuaguaaaagucagaaaacuaucaggaauacccuuauauuuaaaacaagcagauauaaaagaacaaauugaauauguagaaaaagaagaaaaacucagcgaugucaaaauaauuaaaaacaauauuccucuaaaccaacuaauagaaaucgacggaagacaauauuuacuaacaucaccaacagaaugcguaaacgcaaugcaauugguccuuaacgaagaacaauguaaacuaauagcagauauauauaaugcaauauacaaacaagauuucgacggucuggauaacaugcugaugauacaacuauacuuacaacucauagauaaacugaaaacauuauacccaauuuacaugggaauaguggaaaaauucgaaaaacucaccgaagacuucguaucuauaucaaaagaagagaaagcuaacguaauaaaacaaauguuaauaauaaugcauaaaggaccacaaaacggaaauauaauauaugaugauuucaauguugggaaaagaauagggagacuuaaugggagaaccuucuaccuggacaauauugaguucaucucacaaagcccuacagggauauacacaaagaaauauaaauuauga

SEQ ID NO: 8751 - RNA, 4002 nt, Artificial Sequence
  Cas9 variant
auguauacauacuauuuuaaagaaucagaaaugguguacgacgucggauuggacaucggaacaggaagcguagguuggguagccuuagacgaaaacggcaaauuagcacgggcuaaaggaaaaaauuuaguaggaguuagacuguuugauacagcacaaaccgccgcagacagaagaggauucaggacaacgagacgacgauugucaaggagaaaauggagacuacgccuucuagacgaacuauuuucagcagaaauaaacgaaaucgacucaucauucuuucagagacucaaguauuccuacguacacccgaaagaugaagaaaacaaagcccauuacuauggcggauaccuauuuccuacagaggaagagacaaaaaaguuucaccgaaguuauccaacaauauaucacuuaagacaggaacuaauggcucaaccaaacaaaagauucgacauccgugaaauauacuuagcuauucaucaccucguaaaauaucgaggacauuuccuauccucccaagaaaaaauaacaauuggcaguacauauaaucccgaagaucuagccaaugcaauagaaguguaugccgacgaaaaaggauuaaguugggagcuaaauaacccagagcaauuaacagaaauaaucucaggcgaagcagguuauggauugaauaaauccaugaaagccgacgaagcgcucaaauuauuugaguuugacaacaaucaagauaaagucgcgauaaaaacguuauuagcaggacucacugguaaccagauagacuuugcgaaacuauuuggaaaagauauaucagauaaagaugaagcaaaacuuuggaaauuaaaauuggaugacgaagcacuagaagagaaaucucaaacaauucuaagucaacuaacggaugaggaaauagaacuauuucaugcaguuguacaagccuaugauggcuuuguacuaaucggacuauuaaauggagccgacucaguauccgcugccaugguucaacucuacgaccaacacagagaagauagaaaacuccuaaaaucacuggcucaaaaagcaggcuuaaaacacaaacgcuucucagagauauaugaacaacuugcgcuagcaaccgacgaagcaacaauuaaaaacgguaucucaacagcucgagaauuaguagaagaaucaaaucucucaaaagagguuaaagaagauacauuaagacgucuugaugaaaaugaauucuuaccaaaacaaagaacaaaagcgaacucuguuauuccgcaccaauuacaccuagcagaacuacagaaaauucuacaaaaccaaggccaauauuauccguuucuccuagauacguuugaaaaagaagacgggcaggacaacaaaauagaagaacugcuucgauuuagaauaccuuacuacgucggaccauuagucacuaaaaaagacguagaacaugcaggcggagaugccgacaaccacuggguagaacguaacgaagguuucgaaaaaucacggguaaccccauggaauuucgauaaaguauucaauagagauaaagccgcaagggacuuuaucgaacgauuaacaggaaaugacacauaucucauaggugaaaaaacguuaccacaaaacucauuacgcuaucaacuauuuacaguuuuaaaugaacugaauaauguacgaguaaacgguaaaaaauuugauuccaaaacuaaagcagaucucaucaacgaccuauuuaaagcacgaaaaacggucaguuuaucagcacugaaagacuaucuaaaagcacaggguaagggugauguuacaaucaccggacuagcagacgaaucaaaauucaacucaagcuugagcucauacaaugacuuaaaaaagacauucgaugcggaauaucuugaaaaugaagauaaucaagaaaccuuagaaaaaauaauugaaauacaaaccguauuugaagacaguaaaauugccucccgugaacuaagcaaacuaccccuagacgaugaccaagucaaaaaguuaucacaaacccauuauacaggauggggucgacuuucugaaaaguuacuagacagcaagauaauagacgaaagaggacaaaagguaucuauacuagacaaacucaaguccacaagucaaaacuuuaugucuauaaucaauaacgacaaauauggcguccaagcauggauaacggaacaaaacacaggaagcucaaaguuaacauuugacgagaaaguaaacgaacucacgacaucaccugccaacaaacgaggaaucaagcaaagcuucgcaguacuuaacgacauaaaaaaagcgaugaaagaagagcccagaagaguauaccuagaauucgcaagagaagaucaaacaucaguaaggucagucccaagauacaaccaacuuaaagaaaaguaccaaaguaagagccucucagaagaagcuaaaguacuaaaaaaaacauuggacggaaacaaaaauaaaaugucagacgauagauauuuccucuacuuccagcaacaaggaaaagauauguauacaggccgaccgauuaacuuugagagacucagucaagauuaugauauagaccacauaaucccucaagcuuuuacaaaagacgacucauuagauaacagaguucuuguuagccgaccagaaaaugcaagaaaauccgauucguuugcguacacagacgaaguacaaaaacaagauggaucauuguggacuagccuacugaaaaguggcuuuauaaaccggaagaaauaugaaagacuaaccaaagcuggaaaguaucuagaugggcaaaagacaggauucauagcgagacaauuaguagagacucggcaaauaauuaaaaacguagccucacucauagaaggagaauacgaaaauagcaaagcugucgcgauaagaucagaaauaacagccgacaugagauuacuaguaggaauuaaaaaacaccgcgaaauaaauucauuccaccacgcuuucgaugcauuacuuauaacugcagcuggacaauauaugcaaaaccgguacccagaucgugacagcacaaacgucuauaacgaauuugauagauacacaaaugauuacuuaaaaaaucuaagacaauuaaguuccagagaugaaguaagacgacucaaaaguuucggguuuguaguaggaaccaugcguaaaggaaacgaagauuggucugaagaaaacacgucauacuuacgaaaaguaaugauguucaaaaauauacuaacaacaaaaaaaacugaaaaagacagaggaccacuuaacaaagagacuauauucaguccgaaaucagggaaaaaguuaauaccauuaaauagcaaacgaucugacaccgcuuuauauggaggguacucuaacgucuacucagcauacaugacauuaguccgagcaaaugguaaaaaccuacuaauaaaaauaccaauaucuauagccaaucaaauagaaguagguaacuuaaaaauaaacgauuauaucguuaauaacccagccauaaaaaaauuugaaaaaauacuuauaucaaaacuaccacuuggacaauuggucaacgaagacggaaaucugauauaccuugcgaguaaugaauaccgccauaaugcaaagcaauuauggcuaagcacuacagaugcagacaagauagcaucaauuucagaaaauucaucagacgaggaauuauuagaagcauaugacauccuaacuagugaaaauguaaaaaaccgauucccguucuuuaaaaaagauauugacaaauuaucacaaguccgagaugaauucuuagauagcgacaaaagaauugcaguuauucagaccauacucagaggacuccaaauagaugcagcauaucaagcucccguuaaaauaauaagcaagaagguaucagacuggcacaaacuacaacaaucagguggaauaaaauuaagcgacaauagcgaaaugaucuaccaaagcgcuacaggcauauucgaaacacgaguaaaaaucagcgaccuauuauga

SEQ ID NO: 8752 - RNA, 4005 nt, Artificial Sequence
  Cas9 variant
augaaaaaucccuacacaaucggcuuagauauaggaacaaacucaguugggugggcaguccucacaaaccaauaugauuuaguuaaaaggaagaugaaaguugcagguaauagugauaaaaagcagauaaaaaaaaacuucuggggaguacgacuguuugacgacggccaaacugcaguagauagaaggaugaauaggacagccaggcgacgaauagagcggcgacgaaacagaaucagcuaccuacaagagauauuugcaguggagauggcuaacauugacgcgaacuucuuuugucgcuuaaaugacaguuucuauguugacucagaaaaaaggaauucucgucacccauuuuucgcuaccauugaagaagagguugcuuaccauaagaacuaucgcacaauuuaccaccuaagggaagaacuugucaacucaucugaaaaagcggauuugcgacuaguauaucuagcauuggcacauauuaucaaauaccguggaaacuuucuuauugaaggcgcacucgauaccaaaaauacaucaguagacggcguauacgaacaauucauacaaacauauaaucaaguauucaugagcaauauagaagaaggcacacuugcaaaaguugaggagaacauugaaguagcaaauaucuuagcaggaaaauucacacgaagagaaaaauuugaaagaauacuacaacuauacccaggagaaaaaucaaccggaauguuugcccaauuuauaucauuaauaguaggcucaaaaggaaauuuccaaaagguguuugaucugaucgaaaaaacagacauagaaugcgcaaaagauagcuaugaagaagaccucgaagcacucuuggccauaauuggggaugaguaugcugaacuauuuguagcagcaaaaaacacuuauaaugcuguaguccugucaaguauaauaacuguaacugccacugaaacaaacgcgaaacucagugccucuaugauagaaagguucgaugcccaugaaaaagaccucggcgaguuaaaagcauucaucaaauugcaucuuccgaaacaauaccaagaaauauuuaacaaugcagcaauagacggauaugcaggcuacauagacggaaaaaccaaacaagucgacuuuuauaaauaccuaaaaacuauauuggaaaacauagaaggagcugacuacuuuaucgccaaaauagaagaagaaaacuuccuccguaagcaacgaacauucgacaacggcgcaaucccucaccagcuacauuuagaagaacuagaagcaauaauacaucaacaagcaaaauacuaucccuuccuuagagaagacuaugaaaagauaaaaucauuagucacauuuaggauaccauacuucguaggaccacuagcaaaaggucaaucggaauucgcuuggcugacuagaaaagcagauggagaaauaaggccuuggaacauugaggaaaagguugauuucggaaaaagcgcgguagacuuuauagaaaaaaugacaaacaaagauacauaucucccuaaagaaaauguacuccccaaacacagccuaugcuaccagaaauauaugguuuauaacgaacuaacuaagguaagguauaucgaugaucaggggaaaacuaauuacuuuaguggccaagaaaaacaacaaauauuuaaugaucucuucaaacaaaaacgcaaaguaaaaaagaaagaucuugaacuauuccuaagaaauauaaaccauauugaaucaccuaccauagaaggcuuagaagacucauuuaaugcaagcuaugcuacauaucacgaucuacuaaaaguagguaugaaacaggaaauauuagacaacccacuaaacacagaaauguuggaagacauaguaaaaauacuuacaguauuugaagauaaacccaugauaaaagagcaacuacaacaauuuucugacgugcuagauggugggguacuaaaaaaacuggaaagaagacauuacacaggguggggaagauuaucagcuaaauuacuaguagguauacgagaaaaacaaucgcacuuaacuauacuagacuauuuaaugaaugacgauggccuaaaccgaaacuugaugcaacuaauaaacgacuccaacuuaucuuucaaaucaauuauagaaaaagaacaaguaagcacaacggauaaagauuuacaaucaauugucgccgauuuagcaggaucaccggcuauaaaaaaagguauacuacaaaguuugaaaauagucgaugaacuaguaucaauaaugggauauccaccacaaacaauaguuguagaaauggcaagagaaaaccaaacaacagguaaaggaaaaaacaacagcaaaccccgauauaaaucauuagaaaaagcuauaaaagaauucggcucuaaaaucuugaaggaacacccaaccgauaaucaagaauuaaaaaauaacagauuauaccuuuauuaucuucaaaaugguaaggauauguauacaggucaagaacuugauauccauaaucucaguaauuacgacauugaccauauagucccacagagcuuuauaacagauaauucaaucgacaacuuaguccuaacauccucagcaggaaacagagaaaaaggaggcgauguaccgccacucgaaaucguaagaaagcggaaaguuuucugggaaaaacuauaucaaggaaauuuaaugaguaagcgaaaauucgacuaucuaaccaaagcagaaagaggaggucuaacggacgccgauaaagccagauuuauacacagacaacucguagaaacgagacaaauaacaaagaaugucgcaaauauauugcaucagagauuuaacaacgagacggacaaccauggaaacacaauggaacaaguuagaaucguaacacuaaaaucugcccucgucucccaauuucgaaaacaauuccaauuauauaaaguuagagaaguaaaugacuaucaucacgcacacgacgcauaccuuaacgguguaguggcaaacacacuguuaaaaguauacccccaacuggaaccagaguucguauauggagaauaucaucaauucgauugguucaaagcaaacaaagcaacugcuaaaaaacaguucuacacaaacaucauguuguuuuucggacaaaaagaaagaaucauagaugaaaauggcgaaauuuuaugggauaaaaaauaucuugaaacaauaaaaaaaguuuuagacuauagacaaaugaauauuguaaaaaaaacagaaauacaaaaaggagaauucagcaaagcuacuaucaaacccaaaggaaacagcucaaaacuaauaccaagaaaagaaaacugggaccccaugaaauacggaggcuuagacucccccaacauggcauaugcaguaaucauagagcacgcaaaaggaaaaaaaaaacuaauauucgaaaaaaaaauuaucagaauaacgauaauggaaaggaaaauguucgaaaaagaugaagaagcauuucuggaagaaaagggauaccgacauccaaaaguacuaaccaaacuaccaaaauauacucuauaugagugugaaaaagggcgaagaagaaugcuagcgagugcuaacgaagcacaaaaaggaaaucaacuaguauuaucaaaucacuuaguaagccuccuauaccaugcaaaaaauugcgaagcaagugacggaaaauccuuaaaauauauagaagcccauagagaaacauucucagaacuccuagcacaaguuucugaauuugccacuagauauacauuagcagaugcgaaccuaaguaaaaucaacaacuuauuugaacaaaauaaagaaggagauauacaagcaauagcccagagcuuuguagacuuaauggcauucaacgcaaugggagcaccggcgagcuuuaaauuuuucgaagcaacaaucgauaggaaacgguauacaaaccucaaagaacuauuaucuucgacuauaauauaccaaucgaucacaggacuguaugaauccagaaaaagacuagacgauuga

SEQ ID NO: 8753 - RNA, 4005 nt, Artificial Sequence
  Cas9 variant
augaaaaaaccguacacgauaggacucgauauaggaacuaauucggugggaugggcagcccuaacagaccaauacgaucuaguaaaaagaaaaaugaaaguugccggaaacucggaaaagaaacaaauaaaaaaaaaccuauggggcguuagacucguugacgaaggaaaaacagccgcccacagacgagucaauagaacaacaaggcgaagaauagaaagaagaagaaaucgaauaucauauuuacaggaaauauucacugcagaaauguucgaaguagacgcgaauuuuuuuuaucgauuagaagacucauuuuacauugaaagcgagaaaaggcaaucccgucacccguuuuuugcaacgauagaagaagaaguagcuuaccaugaaaauuaccguacuauuuaccaccugagggaaaaacuuguaaacagcucugauaaagccgaccuacgacuaguauacuuagcccuggcacacauaauaaaauaucgaggaaauuuccuaaucgaaggcaaacucgauacuaaaaauacaucaguugacgaaguauucaaacaauuuauuaaaacauauaaccaagucuucgcuucagacauugaagaaggaucccuaacaagaauagaagaaaauaacgaaguggcaaagauauuuucagaaaaauuaacgaaaagagaaaaacuagacaaaauauuaaaucuauacccaaacgaaaaaucaacugacuuguucgcgcaauucauuucauuaaucaucggaucaaaaggaaacuucaaaaaauuuuucaacuuaacagaaaaaacagauaucgaaugugccaaagacagcuacgaagaagaucuagaaguucuauuagcaagaguaggggaugaauacgcagaaauuuuugucgccgccaaaaacgcuuacaacgcaguaguacuaaguagcauaauaacaguaaguaauacugaaacaaaagcaaaauuaucagcuucuaugaucgaacgauucgauaaacacgauaaagacuuaaagcgaaugaaagccuucuucaaagucagauuacccgaaaacuuuaaugaaguauuuaacgacguagagaaagacgguuaugcaggauacaucgaaggaaaaaccaagcaagaggcauucuacaaauacaugaaaaaaaugcuagaacacguugaaggcgccgacuacuucauaaaucaaaucgaagaagaaaacuucuuacgaaagcagagaacuuuugacaacggagcaauaccacaucaauuacauuuagaagaacuugaagccauucuacaccaacaagcuaaauauuacccauuuuuaaaaguugacuacgaaaaaauaaaaagccuaguuacauuuagaauaccauauuuuguaggaccgcuugcaaacggucaaagugaauuuucuuggcuaacaagaaaagcugacggggaaaucagaccguggaacaucgaagaaaaaguggauuucggaaaauccgccauagauuuuaucgaaaaaaugacaaauaaggauacuuaucuacccaaagaaaacguccuacccaaacauucaaugugcuaccaaaaauauaugguuuacaaugaauuaacaaaaauacgauacacagacgaccaaggaaaaacccacuacuucagcggucaagaaaaacaacaaauuuucaaugaucuauucaaacaaaaaagaaaaguuaaaaaaaaggaccucgagcuauuucuauacaauaugaaccacgucgaaagcccaacaguagagggcguagaagacgcauucaauucaagcuucacuacuuaccacgaccugcagaaagucggaguaccucaagaaaucuuagacgauccacuaaacacugaaaugcuagaagagauuaucaaaauccucacuguauucgaggauaagagaaugauaaacgaaagacuccaagaauucagcaauguucuugacgaagcaguucuaaaaaaacucgaacgacgacacuacacaggauggggacgacuaagugcaaaacuccuaauaggaauaagggauaaagaaucacaccuaacuauucuugauuacuuaaugaacgacgauaaacauaacagaaaucuaaugcaauuaauaaaugacucaaauuuaucauucaagucgauuauagaaaaggaacaaguaucuacagcagacaaagauauacaaucaauaguugcagacuuggcaggauccccugcgauaaaaaaaggaauccuucaaucccuaaaaauaguagaugaacucguagguauuaugggguacccaccacaaacaauuguuguggaaauggcacgagaaaaucaaacaacaggaaaagggaaaaacaauucaaaaccuagauuuacaagccuagaaaaagcaaucaaggaacuaggcagccaaauucuaaaagaacacccaaccgauaaccaaggcuugaaaaacgaucggcucuaccuauauuaccuucaaaacggaaaagacauguauacuggucaagaacuugauauucacaaucuaucgaauuacgacauagaucaugugguaccccaaucauuuauuacagacaacagcauagacaaucgcguucucgcaagcuccgcugcaaauagagaaaagggagacaauguaccuuccuuagaaguuguccgaaaaagaaaaguauauugggaaaaauuguaccaagccaagcuaaugucaaaaaggaaauucgacuaucuaacgaaagcagaacggggaggccuuacugaagcagacaaagcuagguuuauacaccgacaacuugucgaaaccagacaaauaacaaaaaacguugcuaacauccuacaucaaagguucaacuguaaaaaggaugagucaggaaauguaauagaacaaguacggauaguaacauuaaaagcagcgcuaguuagccaauucagaaaacaauuccagcuauacaaaguaagagaagucaacgauuaccaccaugcacaugacgcuuaucugaacuguguaguugcaaacacacugcucaaaguuuacccacaacuugaaccagaauucguauacggagauuaccaccaauucgacugguuuaaagcuaacaaagcaacagcuaaaaaacaauuuuacaccaacauaaugcuauucuucgcaaaaaaggauaggauaaucgaugagaauggugaaauccugugggacaaaaaauaucuggacacaauaaaaaaaguuuugaacuauaggcaaaugaacauuguaaagaaaacagaaauucaaaaaggugaguucucaaaugccacugcaaacccaaaagguaauaguagcaaacuaauaccacguaaagcagacugggauccaauaaaauacggcggcuuugacggaucuaauauggcauacgcaauaguaauagaacacgaaaaacgaaaaaaaaaaacagucauaaagaaagaacucauucaaauaaacauaauggaacgaacagcauuugaaaaagaucagaaagaauuuuuagaaggaaagggcuaucgcaaucccaaagucauaacaaagauaccaaaauacaccuuauacgaaugcgaaaacggacgaagacggaugcuagguagcgcuaaugaagcacaaaaaggaaaucagaugguucuaccaaaucaucugaugacccuacuguaucacgcaaaaaauugugaagccucggacggaaaaaguuuagcguauauagagucgcaucgugaaauguucgcagaacuacucgacagcaucagugaauucgcaucacguuauacucuagcagaugcuaacuuagagaaaauaaauacuauauuugaacaaaacaaauccggggacguaaaaguaaucgcccaaucauuugugaaccuuuuagaauuuaacgcaaugggugccccagcaucauuuaaauauuucgaaacaaauauagaaagaaaaagauacaauaacuuaaaagaauuguuaaaugcuaccaucaucuaccaauccauaaccgggcuauacgaagcaaggaaacgucucgaugacuga

SEQ ID NO: 8754 - RNA, 4005 nt, Artificial Sequence
  Cas9 variant
augaaaaauccauacacaauaggacuugauauaggaacaaauagcguagguugggcaguacucacagaucaguacgaccuaguaaaacgaaaaaugaaagucgcugggaacuccgacaaaaaacagaucaaaaaaaacuucugggggguacgauuauucgaugauggccaaacagccgucgaucgacgcaugaaucgcacagcacgacgaagaauugaaagacgaaggaacagaauaucauacuugcaagagauauuugccguagaaauggcaaacauagacgcaaauuucuuuugccgacuaaaugauuccuucuauguagauagugaaaaaagaaauagucgacauccauucuuugccaccauagaagaagaaguugccuaccacaaaaacuauaggacuauauaccauuuaagggaagaauuagugaauaguagcgagaaagcagaucuuagguuaguauaccuagcacuugcacacaucaucaaauacagaggaaauuucuuaauagaaggcgcacuggacaccaaaaauaccucugucgacgaagucuauaaacaguuuauucaaaccuacaaucaaguauuuaugucuaacauagaagaaggagccuuagcaaaaguagaagaaaauacagaaguagcaucaauauuagcagggaaauucacaagacgagaaaaauucgaacguauacuaagguuguacccgggagaaaaaagcacaggcauguucgcacaauuuaucagccugaucguagguaacaaaggcaauuuccagaaaguauuuaacuuaguagaaaaaacagacauugaaugcgccaaagauuccuacgaggaggaucuagaagcgcuacuagcaauaaucggggacgaauacgcagaacuauucguagccgcgaaaaacacuuacaacgcuguaguacuaucgaguaucauaacagugacagcaacugaaacaaacgccaaauuaucagccaguaugauugaacgauuugacgcgcacgaaaaagaauuaggcgaguuaaaagcauucauaaaacuacaucuucccaaacaauaccaagaaauuuucaauaacgcggaaauugauggcuacgcuggauacauagacggaaaaacaaaacagguagacuucuacaaguauuuaaaaaccacuuuagaaaacguggaaggcgcagauuacuuuauuacaaaaauagaagaagaaaauuuccuacgaaaacaaagaacguuugauaacggaguaauaccgcaccaauuacauuuggaagaacuagaagcaaucuugcaucaacaagccaaguacuaucccuucuugcgcgaaggauacgacaaaaucaaaucucuaguuacuuuuagaauaccuuacuucgucggaccccuagcuaauggccaaucagaauuugcaugguuaacaagaaaagacgacggagagauaagaccauggaauauugaagaaaaaguagacuuuggaaaaucagcaguugacuucauagaaaaaaugaccaacaaagacacauaccuaccaaaagaaaacguauuaccgaaacauucauuaugcuaccaaaaguauaugguuuauaacgaacuuacaaagauucgguacauagacgaccagggaaaaacaaauuacuuuucugguagagaaaaacaacaaaucuuuaacgaccuauucaaacaaaaacgaaaagugaaaaaaaaagauuuagaacuauuccuaagaaauauaaaccauauugaaagcccaaccauagaaggauuagaggacucuuuuaacgcaagcuaugcuaccuaucacgauuuauuaaaaguaggccuuaagcaagaaauacuggacaauccacugaacacagaaauuuuagaagauauugucaaaauacuaacaguauucgaagacaaacguaugauaaaagaacaacuugaacaauuuagcgauguacucgaugggguagucuuaaaaaaacuagagagaagacacuacacagguugggguagacucucagcuaagcugcuagugggaauucgagacaaacaaucccauuuaacaauucuugauuauuuaaugaaugacgaugggcuuaacagaaaccuaaugcagcuaauaaacgauaguaauuuaucauuuaaaucaauaaucgaaaaagaacaaguaucuacaaccgauaaggauuuacaaucaaucguggccgauuuagccggaucaccagcaauaaaaaaagggauccuucaaagccuaaaaauaguagacgaacuuguaaguauaaugggauacccaccucaaacaauaguuguugagauggcacgagagaaucaaacuacaggaaaaggaaagaacaauucaaaaccuagauacaaaucucuagaaaaagccauaaaggacuuuggaucgcaaauacuaaaagaacauccaacagauaaucaagaauuaaaaaacaauagauuauacuuauacuaucuccaaaacggcaaagauauuuacacaggacaagaacuagauauacauaauuuaagcaacuacgauauagaucauauaguuccccaaaguuucauaacagauaauucaauagacaaccuaguacuuacuaguagugcaggaaauagagaaaaaggcggagauguaccuccacuggaaauuguaaggaaaagaaaaguuuuuugggagaaacuauaucaaggaaaccuuaugagcaaaaggaaauuugacuauuuaacaaaagcagagagaggagggcucacagaagcagacaaagcgagauuuauacaucgucaacuaguggaaacuagacaaauaacaaaaaacguagcgaacaucuugcaccaaagauuuaauaaagaaaccgauaaucauggcaauacaauggaacaaguacggauagucacauuaaaaucagcucuuguaucgcaauuccgcaaacaauuucaauuauacaaaguuagggaggucaacgauuaccaccacgcgcaugacgcuuaccucaacggaguaguagcuaacacuuuauuaaagguauacccgcaacuagaacccgaauucgucuauggagaauaucaucaauucgauugguucaaagcaaauaaagcaaccgccaaaaaacaauuuuacacaaauauaaugcuguucuucgcacaaaaagaaagaaucauugacgaaaacggagaaauacuaugggauaaaaaauaucuagaaacuaucaaaaaagugcuggacuacaggcaaaucaacauuguuaagaaaaccgaaauacaaaaaggggaauuuucuaaagcaacaauaaaaccaaaaggaaacaguucaaagcuuaucccgagaaaagaaaauugggauccaguuaaguauggaggacuagauagucccaauauggcauaugcgguaaucaucgaacacgcaaaaggcaaaaaaaagauaguuaucgaaaaaaaguugauacaaaucaacauaauggaacgaaaaauguucgaaaaagacgaagaagccuuccuugaagaaaaaggauaucaucaacccaaaguacucacaaaacucccaaaguauacauuauaugaaugugaaaaaggcagaagacgaaugcuauccagugcuaacgaggcacaaaaaggaaaucaacucguacuaucaaaucauuuaguaucuuuacuguaccaugcaaaaaacugugaagcuucagaugguaaaucccuaaaauacauugaagcacacagagaaacguucagugaguuacuagcacaaguaucagaauuugccacuaaguacaccuuagcagaugcuaauuugucaaaaauaaauaacuuauuugaacaaaauaaagaaggagauauaaaagcuaucgcacaaucauucguagacuuaauggccuucaaugcaaugggugccccagccucauucaaguucuuugaggcaacaaucgacagaaagagauauacaaauuuaaaagaauuacuauccucaacaauaauauaucaaagcauaacgggccuauacgaaucacgaaaacgccuagaugauuga

SEQ ID NO: 8755 - RNA, 4005 nt, Artificial Sequence
  Cas9 variant
augggacgaaaaccauauauacuaucccuggacauaggaacaggauccgugggauacgcaugcauggauaaagguuucaacgucuuaaaauaccacgacaaagaugcauuaggaguguaccuuuucgauggagcacuaacggcacaagaacgcaggcaauuuagaaccagccgaaggcgcaaaaaccgaagaauaaaacgacucggacuacuacaagaacuacuagcgccgcuaguccaaaacccaaacuuuuaucaauuucaaagacaauucgcauggaaaaaugauaacauggacuucaaaaauaaaucacuaucagaaguacuaucauuccucggauacgaaagcaagaaauauccuaccauuuaccaccuacaggaagcgcuacuacugaaagacgaaaaauuugacccagaacuaauauauauggcacuauaccaccuaguaaaauacagaggccauuuucuuuucgaucaccuaaaaauugaaaacuuaacaaacaaugacaacaugcacgauuuuguugaauuaauagaaacauacgaaaaccuuaauaacauaaaacuaaaucuugauuaugagaaaacaaaagucaucuaugaaauacuuaaagacaacgaaaugaccaaaaacgaccgagcaaaaagagucaaaaacaugcagaagaaacucgaacaauucucaauaaugcuccuuggacuaaaauucaaugaaggaaaacuguuuaaccaugcagacaacgcagaagaacugaaaggcgcaaaucaaucgcauacuuucgcagacaauuacgaagaaaaccuaaccccauuccuaacaguagaacaaucagaguuuaucgaaagagccaauaaaauauauuuaagccuuacuuuacaagacaucuuaaaagguaagaaaaguauggcaaugaguaaaguagcugcauaugauaaauuccgaaacgaauuaaaacaaguuaaagacauaguuuauaaggcugacuccacacggacccaauucaaaaagauauuuguuucgucaaagaaaucacuuaaacaauaugaugcaacacccaacgaccaaacguucucaucccucugcuuauucgaucaauaccuaauuagaccgaagaaacaauacuccuugcuaauaaaagaacuuaagaaaauaauaccucaggauucagaauuauauuucgaagcagagaacgauacccuacuaaaaguucuuaacacaacggacaacgcguccauucccaugcaaauaaaccuauacgaagcugaaacuauacucaggaaucaacaaaaauaucacgccgaaauaacagaugaaaugauagaaaaaguacuuuccuuaauacaauuucgcauaccguacuacguaggcccgcuagugaacgaccacaccgcuagcaaauuugguuggauggagagaaaauccaacgaaucuauuaaaccuuggaacuucgaugaagucguggacagaucaaaaagcgccacacaauucauacgacgaaugaccaacaaaugcagcuauuuaauuaaugaagacguuuuacccaaaaacucauugcuuuaucaagagauggaggugcugaaugaacuaaaugcaacgcaaauacguuuacagacggaucccaaaaaccgaaaauacagaaugaugccacaaauaaaacuauuugccguagaacauauauuuaagaaauacaaaacaguuagucauucaaaauucuuagagauuaugcucaauucaaaucaucgagaaaacuuuaugaaccauggagagaaauuaucaaucuuuggaacacaagacgacaaaaaguucgcaucgaaauuaagcaguuaccaagacaugacgaaaauauucggagacaucgaaggaaaaagagcucaaauugaggaaauaauccaauggaucacaauauuugaagauaagaaaauacuuguacaaaaacuaaaagaauguuauccagaacuaacaucaaaacaaauaaaccaauuaaagaaauugaauuacuccggcuggggaagacucagugaaaaacuacucacacaugcauaccaagggcacucaauuauagaacuacuacgucacagcgacgaaaauuucauggaaaucuuaacuaaugacgucuauggauuccaaaacuucauaaaagaagaaaaucaaguccaauccaacaaaauacaacaucaggauauagcaaaucuuacaacaaguccagcuuuaaagaaaggcauauggucaacuauaaaauuaguacgagaacuaacuucgauauuuggcgagcccgagaaaaucaucauggaguucgcaacagaagaucaacaaaaaggaaaagaacaaaaaucacgaaaacaacuaugggacgauaauauuaagaaaaauaaacucaaaucuguugaugaauauaaauacauuaucgacguugcuaacaaacuuaacaaugaacaacuucaacaagaaaaauuaugguuauaucuaagucaaaacggaaaauguauguacucuggacaguccauugaucuagacgccuugcuaucccccaacgcuaccaaacacuacgaaguagaucauauauucccaagaucauucauaaaagaugacaguauagauaacaaaguccucgucauuaagaaaaugaaucaaacgaaaggagaucaaguaccauuacaguuuauacaacaaccuuacgaaagaauugcauacuggaaaucgcuaaauaaagcaggacucauaucagauagcaaauuacauaaauuaaugaaaccugaguucacagcaauggacaaagaaggcuucauacagagacaauuaguagaaacaagacaaauauccguacauguaagagauuuucuaaaagaagaauacccaaauaccaaaguaauucccaugaaagccaaaaugguaucagaguucaggaagaaauucgacaucccaaaaaucaggcaaaugaaugacgcacaucaugccauagaugcguaccucaacggcgucgucuaccacggagcccagcuggcauacccuaauguagaccuauuugauuucaacuucaaaugggaaaaaguaagagaaaaauggaaagcauuaggcgaguucaauacaaaacaaaaaucaagagaauuauucuucuucaagaaacuggagaaaauggaaguaucgcaaggagaaagguugauuagcaaaauaaaacucgauaugaaucauuucaaaauuaauuacucaaggaaacuagcaaauauaccccaacaauuuuacaaucagaccgcaguaucgccuaaaacagcagaacuuaaauacgaaagcaacaaaagcaaugaagucgucuacaaaggauuaacacccuaccaaacauacgucgucgcaauaaaaucggucaacaagaaagguaaagagaaaauggaauaccaaaugauagaccauuacguauucgacuuuuacaaauuucaaaauggcaacgaaaaagaacucgccuuauaucuagcgcaaagagaaaacaaagacgaaguacuagaugcucaaauaguguacucacuaaauaaaggagacuuauuauacauaaauaaucacccauguuacuuuguaagccguaaagaagugauaaacgcaaaacaauuugaacuaaccguagaacaacaguuaucacuguacaaugugaugaacaauaaagaaacaaauguagaaaaauuacuaauugaauacgauuucauagcagaaaaaguaaucaaugaauaccaccacuaucucaacagcaaauuaaaagaaaaacgaguuagaacauuuuucucagaaucaaaucaaacccacgaagauuuuauuaaagcacuugacgaacuguuuaaagucguaacugcaucugccacaagaucagacaaaauuggaucaagaaagaacaguaugacacaccgagcuuuccuuggaaaaggaaaagacgucaaaauagcauacacaagcauuucaggacuuaagacaacgaagccaaagagcuuauucaaacuagcugaaucaaggaacgaacuauga

SEQ ID NO: 8756 - RNA, 4005 nt, Artificial Sequence
  Cas9 variant
augaagaauccuuauaccauaggucuagauauuggaacuaacaguguagguugggcugucuuaacagaccaauaugaucuggucaagagaaaaaugaagguagcgggcaacucagauaagaaacaaauuaagaaaaacuuuuggggcguccgacucuuugaugagggagaaaccgcagcagaucggagaaugaaucguacagcaagaaggcgaauagaacgcagaagaaauagaauuucauaucuacaagaaauauucgcacuagaaauggcaaacauugaugcaaacuuuuucugcagacuaaaugacucauucuacguagauuccgaaaaacgaaauucuagacauccguucuuugcaacaauagaagaggaagucgcauaucacaaaaauuaucguacaauauaccaucuaagagaagaauuagucaacuccucagaaaaagcugaucuacgacuuguauaccuagcucuugcacacaucauuaaauacagaggaaacuuuuuaauagaaggugcccuagauaccaaaaauacaagcguagacgggguauauaaacaauuuauacaaacauauaaucaaguauuuauaucaaauaucgaggaagguacacuagccaaaauggaggaaaauacaacagucgcagauauauuagcgggaaaauuuacaaggaaagaaaaauuagaaaggauauuacaguuauacccaggagaaaaaucaacggggauguuugcacaauuuauuucucuuauagugggaucaaaaggaaauuuucagaaaguuuucgauuugguugagaaaacagacauagaaugugcaaaagacucauaugaagaggauuuggaagcucucuuggcaauuaucggcgacgaauaugcugagcuauuugucgcugccaaaaacacauauaaugcaguagugcuuaguucuaucauuacagucaccgacaccgaaacaaacgcaaaacuaucugcaagcaugauagaacgauucgacgcacaugaaaaagaccucagggaauuaaaagcauucauaaaacuccaucucccuaaacaauacgaagaaauuuuuagcaaugucgcaauagauggauacgcaggauauauagauggaaaaacaaaacaaguugauuucuacaaauaccuaaaaacauuauuagaaaauauagaaggcgcagacuacuuuauagcaaaaauagaagaggaaaacuuuuuacgaaaacaaagaacauucgauaacggagcaauaccucaccagcuacacuuagaagaacucgaagcaauacuacaccaacaagcaaaauacuauccguucuuuaaagaagcauaugacaaaauuaaaaguuuaguaacauuuagaauaccuuacuuuguagguccucuggcaaauggacaaagcgauuucgcuuggcuaacacggaaagcagauggcgaaauacguccguggaauauagaagaaaaaguugauuucggcaaaucagcaguagacuuuauagagaaaaugacgaauaaagauaccuaucuaccgaaagaaaauguccucccaaaacauagcuuauauuaucaaaaauacaugguguauaaugaauuaacaaaaguaagauauauagacgaccaaggaaaaacuaauuauuuuagcggacaagaaaaacagcaaauauucaacgacuauuuuaagaagaaaagaaaaguuucgaagaaagaccuagaacaauuucuacguaauaugucacacaucgaaucaccaacuaucgaagggcuagaagacagcuuuaacucuucuuacgcaacauaucaugauuuauuaaaaguuggaauuaaacaagaaguacuagaaaacccguuaaacacagaaaugcuagaagacauaguaaaaauacucacaguauucgaagauaaaagaaugauaaaagaacaacuacaacaauucucagauguauuagauggcgcagucuuaaagaaauuggaaagaagacauuauacagguuggggccgacuuagugcaaaauuacuuguuggaauuagagacaaacaaagucaccuuacuauacuagacuaccuaaugaacgacgacggauuaaauaggaaucucaugcaauugauaaacgauucuaaccuuaguuuuaaaaguaucauugaaaaagagcagguuucaacaacagacaaagauuugcaauccauagucgcagaccuugccggcaguccagccaucaagaaagguauuuuacaaagccuaaaaauuguagacgagcuaguuucaauaaugggcuacccuccucaaacaauuguagucgaaauggcccgagaaaaucaaacaacaguaaaagguaaaaauaauagcagaccaagauauaaaucacuagaaaaagcaauaaaagaguucggaucacaaauacucaaagaacauccgacggacaaccaagaacuaagaaacaauagauuauacuuauacuauuuacaaaauggaaaggacauguauacaggacaagaauuagacauccauaaucucucuaauuaugacauugaccacaucgucccccaauccuucauaacagauaacuccaucgauaaccuuguacuaacaucaucagccggaaacagagaaaaaggcgacgacguaccaccacuugaaauuguaagaaagcggaaaguauucugggagaaacuauuucaaggaaaccuaaugaguaaaagaaaauuugauuacuugaccaaagcagaaagaggaggucuaacagaagcagacaaagcaacuuucauccacagacaacucguggaaaccagacagauaacuaaaaacguugccaacauacuacaccaaagauucaacaacgaaacagacaaccacgguaauaauauggaacagguucgaaucguuaugcugaaguccgcccuaguaagccaguucagaaaacaauuucaacuguacaagguaagagaaguaaacgacuaucaucaugcacaugaugccuaucuaaauggagucguggcuaacacauuacucaaaguauauccucaacuugaaccagaauuugucuacggagaauaccaccaauuugacugguucaaagcuaacaaagccacggcgaagaaacaauuuuacaccaauauaaugcuauucuuugcacaaaaagaaagaauaauugaugaaaauggcgagauccugugggauaagaaauaccucgaaaccauaaagaaaguacucgauuacagacaaaugaauauagugaagaaaacagaaauacaaaaaggagaguucagcaaagcaacuauaaaacccaaagguaauuccaguaaauugauuccacgcaaagaaaauugggaccccaugaaauauggggguuuggacucgccaaacauggcauaugcggucaucaucgaacaugcuaaaggcaaaaagaaaguuguauuugaaaagaaaauaauccgaauaacgauaauggaaaggaaagcauucgaaaaagaugaaaaauccuucuuagaaaaacaaggauacagacaaccaaaaguucugaccaaauuacccaaauacacacuauacgaaugugaaaauggaagaagaagaauguuagcaucugcgaacgaagcacaaaaagguaaccaacagguacuaaaaggucagcucauaacauuauuacaucacgccaaaaacugcgaagcaagugauggaaaaucacuagacuauauagagucaaacagagaaauguucggugaacuacuagcccacguaucugaguucgcaaaaagguauacauuagcugaugccaacuuaucaaaaaucaaucaauuauuugaacaaaauaaagauaacgacaucaagguaauagcacaaucauucguaaaucuaauggcauucaaugcgaugggagcuccagcuucguucaaauuuuucgaggccacaauagaacgaaagagauacacaaaucuaaaagaacuacuaucugcuacuauuauuuaucaaucaauaacugguuuauaugaagcuagaaaaagacuagacggauga

SEQ ID NO: 8757 - RNA, 4005 nt, Artificial Sequence
  Cas9 variant
augaaaaacccuuacaccauuggccuggauaucggaacaaauaguguuggcugggccguucuuacaaaucaauaugaucucgugaaacgaaaaaugaaaguagcaggaaacagcgauaagaaacaaauuaagaaaaacuuuuggggaguccguuuauucgacgauggacaaacagcuguagaucgcagaaugaacagaaccgcacgucgacgaaucgaacguagacgcaaucgaauuaguuaucuacaagaaaucuuugcagucgaaauggcuaacaucgacgcaaacuuuuucugcagacuaaaugacucuuucuauguagacagcgagaaaagaaacagcagacacccuuucuuugcaaccaucgaagaagaagucgccuaccaugauaauuacaggacaauauaucauuuacgugaagaacuggucaacucuagcgaaaaagcggaccuucgacucguuuacuuagcauuagcccacauuaucaaauauagaggaaacuuucuaauagaaggcgcauuagauacuaaaaauacaucaguggaugaaguguacaaacaauucauccaaacauauaaccaaguguucaugagcaacauagaagaaggagcauuagccaaaguugaagaaaaccuagaagucgcuucuauacuagccggcaaauucaccagacgagaaaaauucgaacgcauucuuagacuuuaccccggagaaaaaucaacaggaauguucgcacaauucaucagcuuaauaguuggaaauaaaggcaacuuccaaaaagucuuuaaucuaguagagaaaacagauaucgaaugugcaaaagauucauacgaagaagaucuggaagcgcuccucgccauaauaggagacgaauaugcggaauuauuuguggcagcuaaaaacacauauaaugcuguaguacucucaucuauaauaaccgugacagcaacugaaacuaacgccaaacucagugcauccaugaucgaaagauuugacgcacacgaaaaagaucuaggcgagcugaaagcauuuauaaaauuacauuugccuaaacaauaccaagaaaucuucaacaaugcugcuauugauggauacgccggguacauugauggaaaaaccaaacagguagauuucuacaaauaucuaaaaacaacccuagaaaauguagagggagcagauuacuucaucacaaaaauagaagaagaaaacuuuuuaagaaaacaaagaacuuuugacaauggcguuaucccccaucaacuucaucucgaagaguuagaagcuauacuacaucaacaagcaaaauauuacccuuucuuaagagaagacuaugaaaagauaaaauccuuaguaacauucagaaucccauauuucguuggcccacucgcaaaaggucaaucagaguucgcauggcucacaagaaaagcagacggagaaauaagaccguggaauauagaagaaaaaguagacuucggaaaaucagcaguugacuuuaucgagaaaaugacaaauaaagauacauauuuaccaaaagaaaauguucuaccaaaacacucauuauguuaccagaaauauauggucuacaacgaauuaacaaaaguuagauacauagacgaccaagggaaaacaaauuacuucagcggacaagaaaagcaacaaauuuuuaaugauuuguucaaacagaagagaaaaguuaaaaagaaagaccucgaacuauuccugaggaacauaaaucauaucgaaucaccaacgauagaaggcuuagaagacagcuuuaacgcaagcuaugcgaccuaucacgaucuccuuaaaguagguaugaaacaagaaagccuggacaguccucuaaacgcagaaaugcucgaggacauaguaaaaauuuuaacaguauuugaggauaaaaggaugauaaaagaacaauugcaacaauuuagugacguuuuggacggaguaguccucaagaaacuagaaagacgacauuacacuggauggggaagacuaagugcaaaauuacuuguaggaauaagagauaaacaaucgcaucucacaauuuuagauuaccucaugaaugaugacggccuaaacagaaacuuaaugcagcuuauaaacgauaguaaucucucguucaaauccauaauugaaaaagagcaaguuagcacuaccgacaaagacuuacaguccauuguagcagacuuggcaggaaguccggcaaucaagaaaggaauacuacaaucauugaaaauaguugaugaauugguuucgauaaugggauacccaccacaaaccaucguagucgaaauggcaagagaaaaccaaacaacuguuaaagggaaaaacaacagccggccaagauauaagagcuuagaaaaagcaauaaaagaguucggaagccaaauuuuaaaagaacauccaacagauaaccaagaacugaaaaacaaucgccuauaccuauacuaccuucagaacggaaaagauauauauaccggacaggaauuagauauacacaauuuauccaacuacgacauugaccauauuguaccacaaucauuuauaacagauaauucaauagacaaucuaguacuaacaucaucagcggggaacagagaaaaaggaggggauguaccaccccucgaaauuguuaggaaaagaaaaguauucugggaaaaacuguaucaaggaaacuuaaugucaaaacguaaauuugauuaccucacaaaagccgaacguggaggauugacagaugccgauaaagcaagauucauccauagacaguuaguagaaacaagacaaauuacuaaaaauguugcuaacauucugcaucaacgguuuaauaaugaaacagauaauuaugguaauacaauggaacaggucaggauuguaacacugaaaagcgcccuagucagucaauucagaaaacaauuccaauuauacaaaguuagagaaguaaaugauuaccaucacgcacaugacgcauacuuaaacggaguaguagcaaacacacuacuaaaaguauacccccaacuagaaccggaguucguauauggagaauaccaucaguucgauugguucaaagccaacaaagcaacagccaagaaacaauuuuauacgaacauaaugcuauuuuucgcacaaaaagaaagaauuaucgacgaaaacggugaaauacuaugggacaaaaaguacuuagaaacaauuaagaaaguauuggauuauaggcaaaugaacauaguaaagaaaaccgaaauccaaaaaggagaguucagcaaagcaacaauaaaaccaaaagguaacucaucgaaauuaauuccgcgcaaagaaaauugggacccgaugaaauacggcggacuagauagcccaaauauggcuuaugcaguuaucauagaacacgcaaaagggaaaaagaaaauaguaauugaaaagaaauuaauacaaauaaacauaauggaaagaaaaauguucgaaaaagacgaagaagcauuccuugaagaaaaaggauacagacacccaaaaguauuaacaaaauugccaaaauauacuuuauaugaaugcgaaaaaggaagaagaagaauguuagccagugcaaacgaagcgcaaaaaggcaaucaacucguauuaucuaaccacuuggugucuuuacuauaccacgccaaaaauugugaagcaagugacggcaaaagucuaaaauauauagaagcucacagagaagccuucucagaacuucuagcgcaaguaucagaauuugccacaagauauacucuagcagaugcuaacuuaucaaaaauuaacaaccuauucgaacaaaauaaagaaggggacauuaaagcaauagcacagucauucguagaccucaugguauucaaugcaaugggagcuccggcuuccuuuaaauuuuucgaagcaacaaucgauaggaaaagauacacaaaccuuaaagaacuuuuaucauccacuauuauauaucagucaauaacaggacuauacgaaucacgaaaaagauuagacgauuga

SEQ ID NO: 8758 - RNA, 4005 nt, Artificial Sequence
  Cas9 variant
augaaaaacccauauacaauaggacuugauauuggaacaaauucaguuggaugggcaguacuuacagaucaauacgaccugguuaaaagaaaaaugaaaguagcaggaaacagugacaagaaacaaauaaagaaaaacuucuggggaguacgacuauucgacgaaggagaaacugcagcagaccgaagaaugaaccgaacagcaagacgaagaauagaaagacgacgaaaccgaauaucauaucuacaagaaauauuugcacucgaaauggcgaacauagacgcuaacuucuuuugcagauugaacgauucauuuuacguggacucagagaaaaggaacagcagacauccuuucuuugccacaauugaagaagaaguagccuaccauaaaaauuaucguaccauauaccaccuacgcgaagaguuaguaaauucaagcgaaaaagcagaucuccggcucguauaccuugcauuagcacacauaauaaaauacagaggaaauuuucuaauagaaggagcucucgacaccaaaaauacaaguguugacgggguauauaaacaauuuauacagaccuacaaucaaguuuucauaagcaauauagaagaagguacauuagcuaaaauggaagaaaacacuacugucgcuaacauccuagcagguaaauucacaagaaaagaaaaacuagaaagaauuuuacagcuauacccuggagaaaaaucgaccggaauguuugcacaauuuauaucacugaucgugggaucuaaagguaacuuccaaaaaguauucgaucuuguagagaaaacugauaucgaaugugccaaagauagcuaugaagaagacuuggaagcucuacuagcuaucauaggagacgaauaugcggaacuguucguagcagccaaaaauacuuauaacgcaguagugcuaaguucaauaauaaccguuacagacacggaaacaaaugcaaaacucucugcgaguaugauagaaagguuugaugcccacgaaaaagaucuaucagaacuaaaagcguuuauuaaacuacaccuaccuaaacaauacgaggaaauauucagcaacgucgcaauagauggauaugcaggauacauagacggaaaaacuaaacaagucgauuucuacaaauaucuuaaaacacuccuagaaaauauagaaggagcagacuauuuuauagccaaaauugaagaagaaaauuuucuaagaaaacaaagaacauucgacaacggcgcaauaccccaccaacuacaccuagaagaacuagaagccauacuacaucaacaagcgaaauacuaucccuuucuaaaagaagcguaugauaaaauaaaaucucuaguuacauuccgaauaccauauuuuguaggaccacuagcuaacggccaaagcgauuuugccuggcuuacaaggaaagcagauggcgaaauacgaccauggaacauagaagaaaaaguagauuucggcaaaucagcaguagauuuuauagagaaaaugaccaacaaagauacauacuugccuaaagaaaauguacuuccuaaacauagccucuacuaccaaaaauacaugguauauaaugaauuaaccaaaguaagauacauugacgaucaaggaaaaacaaacuauuucagcggacaagaaaaacaacaaauuuucaaugacuauuucaaacagaaacgcaaagugagcaagaaagacuuagaacaauuucuaagaaacaugagucauauugaaucaccgaccauugaagguuuagaagacagcuucaauucauccuacgcaacguaucaugauuuacuaaaaguugggauaaaacaggaaguacuggaaaacccccugaacauggaaauguuagaggacauaguuaaaauauuaacaguauucgaagauaaacgaaugaucaaagaacaacuucaacaauuuaguggaguucucgacggcgcaguccugaagaaacuagaaagaaggcacuacacgggguggggccgucucucagccaaacuccuaguuggaauaagagacaaacaaagccauuuaacaauucuagacuauuuaaugaaugacgacggacucaacagaaacuuaaugcaauuaauaaacgacagcaaccuaaguuucaaaagcauaauagaaaaagaacaggugucgacuacagauaaagacuuacaaagcauaguagcugaucuggccggcuccccagccaucaagaaagggauacuucaaagccuaaaaauaguugaugaauuaguaucuaucaugggcuauccaccccaaacaauaguuguagagauggcccgagagaaccaaacuacuguaaaaggcaaaaauaacucucgcccaagauacaaaucauuagaaaaagcgauaaaagaauuuggaucccaaauacuuaaagaacacccuaccgacaaucaagaacuaaggaacaauagauuauaccuauauuaucugcaaaauggaaaagauauguacacaggacaagaacuagauauacacaacuuaucgaauuaugauauagaccauauagugccucagagcuucauaacagacaacagcauagauaacuugguacugacaucgucagcaggaaauagggaaaaaggggaugaugugccgccuuuagaaauaguaagaaaacgcaaagucuucugggaaaaacuauuccaaggcaaucucaugaguaaaagaaaauucgacuaucuaacaaaagcugagagagguggcuuaacagaagcugauaaagcaaccuucauccacaggcaacucguugaaacuagacaaauuaccaaaaacguggcaaacauauuacaucaaagauucaacaaugaaaccgacaaccauggcaacaacauggaacaaguuagaauaguaauguugaaaucagcccuaguaagccaauucagaaaacaauuccaacuuuauaaaguaagagaagugaacgacuaccaccacgcacacgaugcguaucuuaacggcguagucgcaaacacucuauuaaaaguauauccacaacuugagccagaauuugucuacggugaguaccaucaauuugauugguucaaagcaaacaaagcaacagcgaaaaagcaauucuauacaaacauaaugcuauuuuucgcucaaaaagagaggauaauugacgaaaauggggaaaucuugugggauaagaaauaccuagaaacuaucaagaaaguucuagauuaucgacaaaugaauauagucaagaaaacagaaauucaaaaaggugaguucucaaaagcaacaaucaaaccaaaaggaaacucaucaaaacuaauaccaaggaaagaaaauugggaccccaugaaauauggcggacuagacaguccuaauauggcauaugcgguaaucauugaacaugcaaaaggcaagaagaaaauaguauuugagaagaaaauaauacgaauuacaauaauggaacgcaaggcuuucgagaaagacgaaaaaucauuccucgaaaagcaaggcuauagacaaccaaaggucuuaacgaaacuaccuaaauacacuuuauaugaaugugagaacggucguagaagaaugcuagcaagugcaaaugaagcacagaaaggaaaccaacagguauuaaaaggucagcuaauuacucuauuacaucacgcuaaaaacugcgaagcaucagauggaaaaucacuggacuauauagaaaguaacagagaaauguucggugagcuacuugcccacguaagcgaguucgcaaaacgauacacucucgcugacgcaaauuuaaguaaaaucaaucaacuauucgaacaaaacaaagauaacgacauaaaaguaaucgcccaaaguuuuguuaaucucauggcguucaacgcaaugggagccccagcuaguuuuaaauucuuugaagcgacgauagaaagaaaaagauauacaaaucugaaggaacuacuaagagcaacuauaauuuaucaaucuauaaccggauuauaugaagcaagaaaaagacucgacgguuga

SEQ ID NO: 8759 - RNA, 4005 nt, Artificial Sequence
  Cas9 variant
augaaaaauccauauacaauaggcuuagauaucggcacaaacucaguaggcugggcagugcuaacagaucaauacgaucuaguaaaacgcaaaaugaaaguugcaggaaacagugauaaaaaacaaauaaaaaaaaauuuuuggggggucagauuauuugacgaaggcgaaaccgccgcagaucgcaggaugaauagaaccgcacgaagaagaauagaaagaagaaggaacagaaucaguuaucuacaagaaauuuuugcacuugaaauggcaaauauugaugcaaacuuuuucugcagauuaaacgacucauuuuauguagacuccgaaaaaagaaacaguagacacccauucuuugcuaccauagaagaagaaguagcauaccauaaaaauuauagaacgauauaucauuuaagagaggaauuagucaacaguucugaaaaagcggaccuacgacuggucuauuuagcgcuagcgcauaucaucaaguaccgaggcaacuuucuaaucgaaggagcacuagacaccaagaauacaucuguagauggaguauauaaacaauuuauacaaacguauaaccaaguauucauuagcaauauagaagaaggcacuuuagcuaaaauggaagaaaauacaacagucgcagauaucuuagcugguaaauucacacguaaagaaaagcuagaaagaauacuucagcuuuacccuggagagaagaguacaggaauguuugcccaauuuauuagccucauagugggaucaaagggaaacuuccagaaaguauucgaccuaguggaaaagacagacauagaaugcgcuaaagacaguuaugaagaagaucuagaagcauuacuagcaauaauaggggaugaauacgcagaacucuucguagcagccaaaaauaccuacaacgcaguuguacucucaaguauuauaacaguaaccgacacagaaacaaaugcaaaauuaucggcuagcaugauagaaagauucgacgcgcacgaaaaagauuuaagugagcuaaaagcguuuauaaaacuccauuuaccuaagcaauacgaagaaauauuuaguaacguagcaaucgacggauaugccggauacauagauggaaaaacaaaacaaguugacuucuauaaauaucuaaagacacuacucgaaaacauugaaggggcagacuauuuuauagccaaaauugaagaagaaaauuuuuuaagaaaacaacgaacuuuugauaauggagcaauuccacaucaacuacaucuugaagaauuagaagcgauacuucaccaacaggccaaauauuacccuuuccuuaaagaagcauacgauaaaaucaaaucucuagucacauucaggauaccauacuucguaggaccauuagcaaacgggcaaucagauuucgcauggcuuacuagaaaggcugacggugaaauaagacccuggaacaucgaagaaaaaguagacuuuggaaaaagugcaguagacuuuauugaaaaaaugacaaauaaggacaccuauuuaccaaaagaaaaugucuuacccaaacauuccuuauacuaucaaaaauauaugguuuacaaugagcucaccaaaguaagauauauugacgaccaaggcaaaacaaauuauuuuagcggacaagaaaaacaacaaauauucaacgacuacuucaaacaaaaacguaaaguaucaaaaaaagaccuagaacaauuucuuagaaacaugagccacauagaaucaccaacaauagaaggguuggaagacucuuuuaauucauccuaugcaacauaccacgacuuacuaaaaguaggaauaaagcaggaaguuuuagagaauccauuaaacacugaaauguuagaagauauugucaagauauuaaccguauuugaagacaaaagaaugauuaaggaacaacuacaacaauucucagacgucuuggacggcgcagucuuaaaaaaguuggaaaggcgacauuacacaggauggggucggcuguccgcaaaacugcuuguagguauacgcgauaagcaaucgcacuuaacaauuuuagacuaucucaugaaugacgacggucucaauagaaauuuaaugcaacuaauuaacgacucuaauuuauccuuuaaaucaauaaucgaaaaagaacaaguuagcaccacagacaaagaucuucaaucaauuguagcggacuuagcaggcagcccagccauaaaaaaggguauacuacaaucacuaaaaauaguagacgaacuaguaaguauaaugggcuacccaccacagacaauaguaguagagauggccagagaaaaccaaaccacuguaaaagggaaaaacaauucacgaccaagauauaaaucauuagaaaaagcuauuaaagaauuuggcagccaaauuuuaaaagagcaccccacagauaaccaggaacucagaaauaacagauuauacuuauauuaccuccaaaacggcaaagauauguauaccggucaagagcuggacauacauaaucucucgaauuaugacauugaucauaucguuccccagucauucaucacagauaacucaauugacaaccuaguacuaacauccucagcagggaacagggaaaaaggagaugauguaccaccacucgaaaucgugcgaaaacguaaaguuuucugggaaaaauuauuccaaggaaaucuaauguccaaacgaaaauuugacuaucucaccaaagccgaaagagggggguuaacggaagcugauaaagcaacuuuuauacacagacagcuaguggaaacacgacagauuaccaaaaacguagcgaacauacuucaccaaagauuuaacaaugaaacggacaaccaugguaacaauauggaacaaguaagaauaguuauguugaaauccgcauugguaucacaauuccgcaagcaauuccaacucuacaaaguuagagaaguaaacgauuaccaucaugcucaugaugcauauuuaaauggcguaguugcuaacacacuauugaaaguauacccccaauuagaaccugaauucguauauggcgaauaccaccaauuugauugguuuaaagccaauaaagcaaccgcuaaaaaacaauuuuacacaaauauaaugcuauuuuuugcacaaaaagaaagaauaauagaugagaacggagaaauuuuaugggacaagaaauaccuggaaacuauuaaaaagguacuagauuacagacagaugaacaucgucaaaaaaacagaaauacaaaaaggagaauuuucuaaagcgacuauaaaaccaaaaggaaacucgagcaaacucaucccccgaaaagagaauugggauccgaugaaguauggcggcuuggauaguccaaauauggcauaugccguaauuaucgaacacgccaaaggaaaaaagaaagugguauuugagaaaaaaauaaucagaauuacaauaauggaacgaaaagccuuugaaaaagacgaaaaaagcuuuuuagaaaagcaaggcuaucgccaaccaaaaguccuaacaaaacuacccaaauacacacuauacgaaugugaaaacgggagaagacguauguuggccuccgcaaacgaagcacaaaaaggaaaccagcaaguacuaaaaggccagcuaauaacacuacuacaucacgcgaaaaacugugaagcauccgacgguaaaucacuagacuauaucgaaucaaaucgcgaaauguucggagaauuacuagcacacguaucugaauucgcuaaaagauauacucuagcagacgcuaaccuaaguaagauaaaccaauuauucgaacaaaauaaagauaaugacauaaaagucauagcucaaucauuuguaaaucucauggcuuucaacgccaugggugcaccagcaagcuucaaauucuuugaagcaacaaucgaaagaaaacgauacacaaaucucaaagaacuguuauccgcaacaauaaucuaucaauccauuacaggacuuuacgaagcucguaaaagauuagaugguuga

SEQ ID NO: 8760 - RNA, 4005 nt, Artificial Sequence
  Cas9 variant
augaaaaauccuuauacaauaggauuagauauaggcacgaacucaguaggcugggcuguacuaacgaaucaauacgauuuaguaaaacgaaagaugaaaguggccggaaacagugacaagaaacaaauaaagaaaaauuuuuggggcguacgacuguuugacgacggacaaacagcagucgauagacguaugaaccggacugcgagacgcagaauagaaaggagaagaaacagaauuaguuaccuacaggaaauauuugcaguagaaauggcaaacauagacgcaaacuucuuuuguagauuaaaugauaguuuuuauguggacagugagaaaagaaauagccggcaucccuuuuucgcaacaauugaagaagaaguagccuaucacgacaacuauagaacaauauaucauuuaagggaagaauuaguuaacuccucagaaaaagcggauuugagacucguuuauuuagcuuuagcccauauaaucaaauacagagguaacuuucugauugagggagcuuuagauaccaaaaauacauccguagacgaaguauacaaacaauucauacaaacauauaaucaaguauuuaugaguaacauagaagaaggcgcgcuagccaaaguugaagaaaauuuagaaguagcaaguaucuuagcgggaaaauucacgcguagagaaaaauuugagagaauuuuaagacuuuacccaggugaaaaaucaacagguauguucgcacaauuuauuaguuuaauagucgggaacaaaggaaauuuucagaaaguuuuuaaccuaguagagaaaacagacaucgaaugcgcuaaagacucguaugaagaagauuuagaagcauuacuagcaauaauaggcgaugaauacgcagaacuauuuguagcugcgaaaaauacuuauaacgcaguuguacucucaucaauaaucacuguaacggcaacugaaacaaacgcaaaacucagcgcaagcaugauagaaagguuugaugcucaugaaaaagaccucggagaauuaaaagcauuuauuaagcuacaccuaccuaaacaauaccaagaaauauuuaacaaugccgcaaucgacggauacgcuggcuacauagauggaaaaacuaaacaggucgauuuuuauaaauaucuaaaaaccacauuagaaaacguagagggcgcagauuauuucaucacgaaaauagaagaagaaaacuuuuuacgcaagcaaaggacuuuugauaauggagucauuccacaucagcuacaccuagaagaacuggaagcuauacuacaccaacaggcgaaauauuacccauuuuugcgagaggacuacgagaaaaucaaaucucuuguaaccuuucgaauaccuuacuucguaggaccacucgcaaaaggacaaucagaauuugcauggcuuacaagaaaagcagacggggaaaucagaccauggaauauagaagaaaaaguggauuuuggcaaaucagcaguagacuuuauagagaaaaugacaaacaaagacaccuaucucccuaaggaaaauguauuacccaaacauucacuauguuaucaaaaauacauggucuacaaugaacuaacaaagguaagauacauugaugaucaaggcaaaacaaauuauuuuagcggacaagagaaacaacagaucuuuaaugaucuuuucaaacagaaaagaaaaguaaagaagaaagaucucgaguuauucuuacgaaacaucaaccauauagaaucaccaacaauagagggacuagaagacucauuuaacgcuucauacgcuacauaucaugaccuacucaaagugggcaugaaacaagaaaguuuagacaguccacuuaacgcagagauguuagaagauauuguuaaaauccugacaguauuugaagauaaaagaaugauaaaagaacaacuucaacaguucucagauguauuagacgguguaguccucaagaaacucgaaagaagacacuauacggguuggggcagacuaucagcaaaacugcucguaggaauacgcgacaaacaaucacacuuaacuauacuagacuaccuaaugaaugacgacggacuuaauagaaaccuaaugcaacugauaaacgacucaaaucuuucauucaaaaguaucauagaaaaagaacaaguaaguacaacagacaaagauuuacaaucaauaguugcagauuuagcuggaucucccgcaauaaagaaaggcauccugcaaagccucaaaaucguagacgaauuaguaaguauaauggguuacccuccccaaaccauagucguugaaauggcacgcgaaaaucaaaccacuguaaaaggcaaaaauaacucacguccgagauacaaaucacuagaaaaagcuauaaaagaguucggaucacaaauauuaaaagaacauccaacugacaaucaagaacugaaaaacaacagguuauauuuauauuaccuacagaacggaaaagauauauauaccgggcaagaauuagauauacacaacuuaucaaauuaugacaucgaucauauaguaccccagagcuuuauuacagauaauagcauagauaaccuuguccucacaaguagugcagguaaccgagaaaaaggaggagaugucccacccuuagaaauuguaagaaaacgaaaaguguucugggaaaaauuauaucaaggcaauuugaugagcaaaagaaaauuugauuaccuaacuaaagccgaaagaggaggucuaaccgaugcagacaaagcucguuucauccaccgucaauuaguagaaacacgucaaauaacuaaaaauguuacaaauauccuacaccaaagauuuaauaaugaaacagauaauuauggaaacaccauggaacagguaagaaucgugaccuuaaaaucagcccuagucagccaauucagaaaacaauuccaacuauacaaaguuagagaaguaaacgacuaucaccacgcacaugacgcauaccuaaauggcguuguagcaaacacguuauuaaaaguauacccacaacucgaacccgaguucgucuacggugaauaccaucaauucgauugguuuaaagcaaacaaagcuacagcaaagaaacaauucuacacaaacauuaugcuguucuuugcccaaaaagaaagaauuauagacgaaaauggcgaaauauuaugggauaagaaauacuuagaaacuauaaagaaaguauuagauuaccgacaaaugaacauuguaaagaaaacagaaauacaaaaaggagaauuuucaaaagcaaccauuaaaccuaaaggcaauaguagcaaacuaauaccacgaaaagaaaauugggaccccaugaaauauggaggguuagacucacccaauauggccuacgcagugauuauugaacaugcgaaaggcaaaaagaaaauagucauagaaaagaaacuaauacaaauaaauauaauggaacgaaaaauguuugaaaaagaugaagaagccuuccuagaagaaaaaggauacagacauccaaaaguacuuaccaaacucccuaaauacacucucuaugaaugcgagaaagggagaagaagaaugcucgcuucagcuaaugaagcucaaaaaggaaaucagcuaguucuaucuaaucaccugguaagucuauuauaucacgcuaaaaauugugaagcaagugauggaaaaucguuaaaauacauagaagcacacagagaggcauucagugaacuacuagcccaaguuagcgaguucgcaacuagauauacccucgcagaugcgaaucuuucaaaaauuaacaacuuauuugaacaaaacaaagaaggagauauaaaagcuauagcucaauccuuuguagaucucaugguauucaaugcaaugggugcaccagcaaguuucaaauuuuucgaagcaacaauagaucgcaaacguuauacuaaucuaaaagaacuacuauccaguacaauaauauaccaaucaauaacggggcuauacgaaucuagaaaacgccuagacgacuga

SEQ ID NO: 8761 - RNA, 4005 nt, Artificial Sequence
  Cas9 variant
augaagaaagaguacaccauuggucuagauauaggaacuaauucgguaggaugggcuguucuaacagaaaauuacgaccuagucaaaaagaaaaugaaaguauauggaaacacggaaaccaaauaucuaaagaaaaaucuauggggaguaagacucuuugaugaaggagaaacagcugcagauagaagacuaaaacgaacaaccagaagacgauacucucgcagaaggaauagaauauguagguuacaagaucuauuuacagaggaaaugaaccaagucgaugcaaauuucuuccacagguuacaagagagcuuccugguccccgacgaaaaagaauuugaaagacacgcuauauucggaaagauggaagaagaaguaucuuauuauagagaguucccgacuauauaucaccuacgaaaacaucuagccgacaccagugaacaagccgacuuaagacuuguauaccuagcucuagcacacauuguaaaauacagaggacacuuucuaauagaaggagaacuaaauacugaaaacucaaguguaucggaaacuuuucgaacauuuauccaaguguauaaucaaaucuucagagaaaaugaagugccacuagcuguaccagauaauauagaagaauuauuuucagaaaaaguaucacgagcuagaaaaguugaagcaauucucagcguauacagcgaagaaaaaucaacagguacucuugcacaauucuuaaaguuaaugguaggaaaucaagggcgauuuaagaaaacauuugacuuagaagaagacggcauaauacaaauacccaaagaagaauacgaagaggaacuagaaaccuuauuagcaaucauaggagaugaauacgcagagauuuucucggcaacaaaaucagucuaugaugcaguagcacuaagugguauucucaguguaaccgacggagacacuaaagcuaaacuauccgccucgaugguugaacgauaugaagcacaucaaaaagauuuaguacaauucaaacaauucauacgcaaggaacuuccagaaauguacgcaccaauauucagagauaauagcgucucuggauaugcagguuacgucgaaaauucaaaaguaguaacacaagcagaauuuuauaaauacaucaagaaagcaauagaaaaaguccccggagcugaguacuucuuagagaaaauagaacaagaaacauuccucgacaaacaaaggacauucaauaacggcguaaucccacaucaaauacacuuagaagaacuagaagcaauaauucaaaaacaagcaacauacuaccccuuuuuggcagauaacaaagaagaaaugaaacagcuugucacuuucaggauucccuauuaugucggcccacuagcagauggcaacaguccauuugcaugguuagaaagaauaagcuccgaacccaucagaccagguaacuuagcagaaguugucgacauaaagaaaucggccacaaaauuuauugaaaggaugacaaacuuugacaccuacuuaccaacagagaaaguacuaccuaaacacagcaugaucuacgaaaaauacaugguauacaacgaacuuacaaagguaaguuacgucgacgaaagagggaugaaucaacguuucucgggagaagagaagaaacaaauuguagaagaacucuucaaacaauccagaaaaguaacaaagaaauuacuagaaaaauuccucucaaacgaauuuggacugguagacguggcaauaaaagggauagaaacaucuuuuaaugccgguuacggcacauaucacgacuuucuaaaaauagggauaacaagagaacaacuugauaaagaagaaaauucagaaacauuagaggaaauaguaaaaauccucacggucuucgaagaccgaaaaaugauacgagaacaauuaaagaaauauacauaccuauucgaugaagaaguccugaagaaacuagaaagacgucauuauacggguuggggacgacugagcgcaaaacuacucauaggaauuaaagagaaaagaacgcacaaaaccauacuagacuaucuaauagaagacgacggaggaaaacaaccuauaaacagaaacuuaaugcaacuuauaaaugauucagaucuuucguucaaaagcgaaauagccgaagcacaaagcgauaugaacacagaagauuuacacgaaguagugcaaaauuuagcaggaagcccagcaauaaagaaaggcauacuacaaucauugaaaauaguggaugagcuaguugauauaaugggaucccuccccaaaaauaucguaguagaaauggcccgagaaaaucaaacgacaucgcgaggccgcacaaacuccaauccacgcaugaaagcguuagaagaagcuaugagaaacuuaaggucuaaucuacuaaaagaauaccccacugauaaucaggcuuuacaaaacgaccgauuauauuuauauuaucuacaaaauggcaaagacauguacaccggccucgauuuaucacuacauaaccucucaucauaugauauagaucacauagucccacaaaguuucacuaccgacaacucacuagacaaucgagucuuaguauccuccaaagaaaaccgagguaaaaaggaugacguacccaguaaagaagugguacagaaaaacaucacucuuugggaaacucuuaaaaacaguaaccuaauaucucaaaagaaauacgauaaucucacuaaaggacugcgaggcggccuuacugaagacgaccgugcacauuuuaucaaacgacaacucguagaaacucgacagauaacuaaacacguagcacggauacuagaccaacgauucaacucacagaaagaugaagaagguaaaaccauaagagcaguaagaguggucacacucaaauccagucugacuagccaauuuagaaaacaguucgccauacauaaaguaagagaaaucaacgauuaucaccacggacacgacgcauaucucaacggugucgucgccaauaguuuacuucggguauacccucaacuacagccagaauuuguuuauggugacuacccuaaauucaacgcauacaaagcaaauaaggcaacagccaagaaacaacucuauacaaacauuaugaaauucuuugcugaagacgcaguaaucauagaugagaacggagaaauuuuaugggacaagaaaaauauagccacaguaaagaaagugauguccuacccccaaaugaauauaguaaagaaaccagaaauacagacaggcucauucaguaaagaaacaauaaaacccaaaggagauagugacaaacuaaucucacgcaaaacgaauuggagccccaaacucuacggaggcuucgacucaccacagguugcauauagcguaauaauaaccuaugagaaagggaaaaagaaaguaagagcaaaagccauaguaggaauaaccauaauggagcaaucccuuuucaagaaagauccgguuucauuauuagaagaaaaaggauaugcuaaucccgagguuuuaauucacuugccaaaauacacccuuuaugaauuggaaaauggacguagacgacuccuggcuagcgcaaacgaagcacaaaaagggaaucagcuaguacucccagcaaguuuaguaacucuauuauaucaugccaaacaaguugacgaagauucaggaaaaagcgaagaauacgugagagaacauagagcagaauuugcagaaauccucaacuacguacaagccuuuucagaaacuaaaauucuagcaaauaaaaaccuacaaacaauuuuaaaauuauaugaagaaaauaaagaagcagauauaaaagaaauagcugaaucuuucguaaaccucaugaaauuuucagcauacggagcucccauggauuucaaauucuuuggcaaaacaauaccaagaaguagauacacaagcgucggagaguuauuaucugccacuauaauuaaccaaucgauaacgggacucuaugaaacuagaagaaaauuaguagauuga

SEQ ID NO: 8762 - RNA, 4005 nt, Artificial Sequence
  Cas9 variant
augcgaaaaccuuacacgauaggauuagacauuggaacaaacuccgugggaugggcuguucuaacagaccaauauaaucuaguaaaaagaaaaaugaaaguagcgggaucagcagagaagaaacaaaucaagaaaaauuuuuggggaguacgacuauucgaugaaggagaaguggcagcaggccgucgaaugaaucgaacaacaaggagaaggauagaaagaagaagaaacaggauagcuuacuuacaagaaauauuugcggcagaaauggccgaaguagacgccaauuucuucuaccggcuagaagauuccuucuacauagaauccgagaaaagacacagccgucacccauucuucgcuaccauagaagaggaaguagcuuaccaugaagaauauaaaaccauuuaucacuugagagaaaaauuaguaaauucuagugauaaagcugaccuaagacugguuuacuuggcacuagcacauauuauaaaauacagaggaaauuuccuuauagaaggaaugcuugacaccaaaaacacauccguggaugaaguuuucaaacaauucauccaaacauauaaccagauuuuugcaagugauauagaagaaggcucauuaacgaggcuugaagaaaacaaagaaguagccgaaauacuaucagaaaaacuuacacggagggaaaaauuagauaaaaucuugaaauuauauacgggugaaaaaucaaccgggauguucgcuagauucauaaaccucauaauaggaaguaaaggcgauuuuaagaaaguguuugaucucgacgaaaaagcagaaauagaaugugcaaaagauacauaugaagaagaucuagaagcauuauuagcuaaaaucggagacgaauacgccgaaauuuuuguagcugcaaaaaguacauauaaugcggucguacuaucaaacauuaucacaguaaccgacacugaaacaaaagcaaaacuaagugcuaguaugauagaacgcuucgauaaacaugcaaaagaucuaaaaagauugaaagcauuuuucaaaaugcaauuacccgaaaaauuuaaugaaguuuuuaaugacauagaaaaagauggguacgccggauauaucgacgggaaaacaacucaagaaaaauucuauaaauauaugaagaaaaugcuugccaauauagauggagcagauuauuuuaucgaccaaaucgaagaagaaaauuuucuacgaaaacagcgaacauuugacaauggcacaauuccacaccaauuacauuuagaagaacuagaagcaauuuuacaucaacaagcgaaauacuaccccuuuuuaagaaaagauuacgagaaaauucgaucauuaguaacguuuaggauuccguacuucaucgguccauuagcaaacggccaaucagacuucgcaugguuaacaagaaaagcagacggagaaauaagaccauggaauauugaagaaaaaguagauuucggaaaaucugcaauagacuucaucgagaaaaugacuaacaaagacacauaccugccaaaagaaaacguacugccaaaacauucacuaugcuaucaaaaauacaugguuuacaacgagcuaacaaaaauaagauacaucgaugaucaggguaaaacacaucacuucaguggucaagaaaaacaacaaauauuuaacggucuguuuaaacaacaaagaaaagucaagaagaaagacuuagaaagauuuuuguacaccauaaaucauauugaaagucccacaaucgaaggaguagaggacgcauucaacucaucguuugcaacauaucacgaccuacaaaaaggaggcguuacacaggaaauacuagacaacccacugaaugcagauauguuggaggaaauaguuaaaauccuaacaguauuugaagauaaaagaaugauaaaagaacaacuacaaaguuuuucugacguauuagacggcacaauacucaagaaacuagaaagaagacacuauacaggguggggaagguugagcgcaaaauuauuaaccgguauucgagacaaacacucacaccucacaauacuagacuaucuaaugaacgacgacggauuaaacagaaaccuaaugcaauuaauuaacgacagcaaccucagcuuuaaaucaauaauugaaaaagaacaaguaucuaccgcugacaaagguauacaaucaauaguagcugaauuagcaggaagccccgccaucaagaaaggaauauuacagaguuugaaaauagucgacgagcuaguagggaucaugggauacccuccacaaacaauuguaguagaaauggcaagagagaaccaaaccacggggaaaggcaaaaauaacagcaaaccaagauuuauuagccuagaaaaagccauuaaagaauuuggaagccaaauacuaaaagaacauccaacagacaaccaaugucucaaaaaugauagacuauaucuauacuauuuacaaaacgguaaagauauguauacagguaaagaguuggauauacauaauuuauccaacuacgauauugaucacaucauaccacaaaguuuuauaacagauaacucgauagacaauagaguauuaguauccaguacagcaaacagagaaaaaggagauaacguuccccuacucgagguaguuaggaaaagaaaagcauuuugggagaaacuauaccaagcgaaacucaugucuaaaagaaaauucgauuaccuuacaaaagcugaaaggggaggcuugacagaagcagacaaagcaaauuucauucaacgucaauuaguagaaacgagacagaucaccaaaaauguugcaaauauucuguaucaaagauuuaacugcaaacaagacgaaaauggaaacgaaguugaacaaguucgaauuguaacccugaaaucaacccuaguaucucaauuucgcaaacaauuccaacuauauaaaguaagagaaguuaaugacuaucaccacgcccaugaugcauacuugaacggcguuguagcuaacacacuccuaaaaguuuacccacaguuagaaccagaauuuguguacggagacuaucaccaauucgauugguucaaagcuaacaaagcaacugcuaagaaacaauucuacacuaacauaaugagauuuuucgcaaaagaaaaucaaaucauugauaaaaacggcgaaauacuaugggacaaccguuauuuagacacaaucaagaaaguacucagcuacagacaaaugaacauugucaagaaaaccgaaauccaaaaaggcgaguucagcaacgccacagugaauccaaaaggaaacucgagcaaacucauaucaaggaaagccgacuggaacccaauuaaauauggaggauuugacggcagcaauauggccuacucuauaguaauagaauacgagaaaaggaaaaagaaaacagucauuaagaaagaacuaauacaaauaaacauaauggaaagaguagcauuugaaaaagaucaaaaagcauuucuagaagaaaaagguuacuacucacccaaaguacuaacaaaaauaccaaaauauacccuuuacgaaugugaaaacggccgacgaagaaugcuuggauccgccaacgaagcgcaaaaagguaaucaaaugguacugcccaaucaucucaugaccuuacucuaccacgcuaaaaacugugaagcaaaugacggagaaucccuagcauacauagaaaugcacagagagauguuugcagaauuacucgccuacauuuccgaauuugcuaaaagauacacguuggcaaacgacagauuagagaaaauuaauauguucuuugaacaaaacaagaaaggugacauaaaaguaauugccaaauccuuugacaaauugaaaguauuuaacgcguucggugcgccaagagauuucgaguucuuugagacgacaauaaaaagaaaacgauauuacaauauaaaagagcuacuuaacgccacgauaauauaucaaucaauaacugguuuauaugaggccagaaaaagauuagaggauuga

SEQ ID NO: 8763 - RNA, 4008 nt, Artificial Sequence
  Cas9 variant
augaaaaacuacacgauaggacuggauauaggaacaaauucugucggaugggccgucaucaaagaugaucuaacgcuaguaagaaagaaaauaaaaauaucaggaaauacagacaagaaagaaguaaagaaaaaucuuuggggaucauucuuguucgaacaaggagauacggcacaagauacuagagucaaaagaauagccaggagacgauaugaacgacgaagguuucgcauaagagaacugcagaaaauuuuugacaaaaguaugggagaaguagauagcaacuucuuccacagacuggaugaaucauuucuagucgaagaagacaaagaauacucaaaauauccaauauucuccaacgaaaaagaagauaaaaauuacuacgacaaauauccgacuaucuaccaucuaagaaaagaccuagcagacucaaaccaaaaagcagaucuacgccuaaucuauuuagcuuuagcccauaugaucaaauacagaggacacuuucuaauagaaggagacuugaaaauggauggaaucucaaucuccgaaucguuccaagaauuuauagauucauacaaugaaguaugcgcacuggaagacgaaaaucuagaaauaauauacaacgaugaauuacuaacucaaauagaaaauauauuuaaacaagauauaagucgauccaagaaacuagaccaagcgaucgcauuauuucaaggagugaaaaggcaaagucuauuuggaauauuccucacucuuauugucggaaacaaagccaacuuccagaaaauauuuaaucuugaagacgacauaaaacuagauuuaaaagaggaagacuacgaugagaaucuugaagaauuauuaaguaauaucgacgaagguuacagagacguauuucuacaagcuaaaaacguuuacaacgcaauagaacucucaaaaauucugaaaacagacgggaaagaaacuaaagccccauuaagcgcacaaauggucgaacuauauaaucaacaucgagaagaccuuaagaaauacaaagacuacauuaaagcauaccuaccugagaaauauggagaaacuuucaaagaugcaacgaaaaacgguuaugccggcuauauugaugggaaaacaucacaagaggauuuuuauaaauucguaaaagcccaacuaaaaggugaagaaaauggagaauacuuuuuagaagcaaucgaaaaugaaaauuucuuaagaaaacaaagaaguuucuacaacggaguaaucccuuaucaaauacaccuccaagaacuuacggcaguacucgaucaacaagaaaaacauuauuccuuccuaaaggaaaaccgagacaagauaauaucacucuuaacguuuagaauacccuauuacguggguccacucgcuaagggagaaaguagauucgcuuggcuagaacgaucaaacagugaagaaaagaucaagccuuggaauuuugauaaaaucguugauaucgauaaaagcgccgaacuauucaucgaaaaccuuacuagccgugauaccuacuugccagaugaaccaguucuaccaaaacguagccuuauauaccaaaaguuuacaauauuuaaugaacuaacaaaaauaucauacauagacgaaagaggcauacuucaaaacuucaguucaagagagaaaauagccauuuucaaugaucucuucaaaaauaaaucaaaaguaaccaaaaaucaacugguuaaauacauagaaaacaaggaacaaauaauagcuccagaaauuaaaggaauugaagacagcuuuaauucaaacuacagcacauacauagaccuaucaaaaauccccgauaugaagaaacugcucgaaaaagacgaagaugaaauuuuagaagagauaauuaaaaucuuaacaaucuucgaagauagaaaaaugagaaaacgacaacuuaugaaauuuaaagauaaacuuagugaaaaagcaauaaaucaacuaucgaagaagcacuacacaggauggggacaauuaucugaaaaauuaauaaaugguauuagagacgaacaaucaaauaaaaccauauuggauuaccuaaucgaagauaacggaugcccaaagaauaugaacaggaacuucaugcaacuaauuaaugacgacaccuuaucauuuaaggaaaagauccgaaaagcucaagacauaaaccagguaaacgacauaaaagaaaucguaaaggaucuacccggaucacccgcuauaaagaaaggcaucuaccaaaguauucgcauaguagacgaaauaauuagaaaaaugaaagauagaccuaaaaauaucguaauagaaauggcaagagaaaaccaaaccacacaagaaggcaaaaacaaaucaaaagcacgacuaaagaaaauacaagaagggcuagaaaauuuagauucuguccauguggaaaaacaagcacuagacgaagagaugcuaaaaucaccaaaauauuaucuauacuguuuacagaauggcaaagauauauauacaggcaaagaccuugacauaggccaauugcaaaccuaugacauugaucauauaauucccagaucauucauaacagauaacagcuucgacaaccuaguacuaacauccaguaccguaaauagagguaaacuagauaacguuccaaguccugauauaguacgucagcaaaaaggauucuggaaacagcuacuaagagcuggguuaaugagucagagaaaauuuaacaaucuuaccaaaggcaaacuuacagauagggacagacaacaauuuauuaauagacaacuuguagagacaagacaaauaacaaaacauguagcaaacuuauuaucgcaccaucuaaacgaaaagaaagaagucggggaaauaaauauuguacuacuaaaaagcgcuuuaacuucacaguuuagaaagaaauuugacuucuacaaaguccgcgaagucaacgacuaucaucaugcacacgacgccuaccuaaacggagucauagcacucaaauuacucgaguuguacccauauauggcuaaagacuuaauauaugguaaauacagcuaucauagaaaaauugaaggagauaaagccacgcaagcuaaauacaagaugucuaacaucauagaacguuucagucaagaccuucucgcaaacccagacggugaaauugcgugggaaaaagauaaagaucugaauaccauaagaaaagugcuuucaucaaaacaaauaaauauaauaaagaaagcagaagagggcaaaggacgacuuuucaaagagacaauaaacucccgaccaucaaagaaaacagagaaaagaauacccauuaaaaauaaucuugauccgaauauauauggagguuauauagaagagaaaauggccuacuacauagcgaucaacuacuuagaaaacgguaaaacaaagaaagccaucguaggaauaagcaucaaagauaagaaagacuuugaaggacaaacaacugaauauuuaggaaaaaucggauuuaauaaagcauccauaauuaauagcuucaaaaacuacacccucuuugaacuagaaaacggaucaagaaggaugaucguuggagccucaaaagaaaacgacucuaaaggagaauuacaaaaagguaaucaaauguacuuaccacaaaaccuccuugaguucgucuaucaccuaaaacacuauaaugaagacgaaaccagucauaaauucaucguagaacauaaagcauauuuugacgaauuauuaaacuacauaguggaguucgcuaauaaauaucuagaacuagaaaauucaaucgaaaagauaaaagaccuguaccacggaaaaggaccagaugucgaagaaaaagagcuaguagaaucauucauuaauuuauuagcgaucacuaaaugcgggccagcagccgacauaacauuucuaggcgagaaaauuagcagaaaaagauacaggucuacgaauugucuauggggaucagaaguuauauuucaaucaccgacaggacuauaugaaacacgacucagacuggaauga

SEQ ID NO: 8764 - RNA, 4011 nt, Artificial Sequence
  Cas9 variant
auggaugacaacuaccaauuaaugcacgcuaaaggaaaauauggguacggaacaagaauauauucggaaggacaaacugcagcugauagacgggguuuuagaaccacaagacgaagguuaaauaggagaaaauggcguuuacgucuauuacaagacuuuuucgagcccuauauacuaccacaagaugaagcauucuuuauuagacaaaaacaaucaaauuuaguaccacaagauacaaagaaacaauacccggaaaguguacuauuugacgacacaagugacaaagacuuuuauacagaauauccgacaauauaucacuuacgacaagcacuuaugaccgagaauagacaauuugauauaagagagguauaccuagcaauacaccacauaguaaaauaucggggacacuuucuuaauaacgcuccgguuaaaacguuuaaaucugguaaccuagauuuagcuauaaaauucaaugaacucaacgaagaguucaaaucaguuuacccagaucuggaauuacaauucaacuuagaucaaauagacgaaaucaaaaagauauuacuugacaguaccaagaguagauuugauagacaaggugaagcagucaaacuaauauacacgguaagcgaagugaaaaccauugaaaaacuccaaaacaaaauagugaagcaauuccucagcgguauacuaggauuaaauacaagauuugaugugcuaacaaacacagaaagcgaugauucaauguggaaauucagucucgauucugaaucaagcgaugaugcucuagacgaaauuauagcccaacucgacgauccagcaauucacguaguugaauuaguaaaugaaauacauucaucaauaacacuagcugggaucguuccagaaggacaagguuuaagugaaaguaugguggaaaaauacgaagcacacaaagcccacuuacaacuauuaaaagcaguugaaaagcuaguagacaagaaagccgcagauaaauuggaaguagccuacgaccaauauauuaaugggaaagauaguaaacaauuuauuaaagaagacuuuuacaaagcuguacaaucugaaauaaaagguguagccggagacgaagucgcugaaauaaaucaacuaauugaacuagaucaauucaugccaaaacaacgaacaaaagaaaauggggccauaccacaucaauuacaccaacacgaacuugacguuauaaucgaaaaccaaucgaaauacuacgacuggcucggggaaaaaguuggaaacgaauauaaguuagacaaauuggugagcuuuagaguaccauacuacguagggccauuaguagacacugcaucgaaagaaaagaaagaugaaacaagauuugcauggaugguacggaaaaacccagaaagcacagaagcaauaacgccauggaacuuugaagacauaguagacaaaaacgcaucugcggaaaauuucauuaaaagaaugacaacaaaagacaaauacuuacuuaaugaggauguucuacccaaauguaguuuguuaacccaagacuuugaaguauauaacgaacuaaacaacauacgaguuaacggagagaaauucacagcugaacagaaacaauuaauucaugaugaacucuuuacuaagcacgcuucaguuaguaucaaacaacuuaaagacuuucuggucucagaacuaauguacguaagagacaaucuuaaaguagaaggacucgcagacgaaaagaaacuaaugagcucauuguccacgcaauucgauuaccagaaaaucauaccagaccaaauaaacgacguaaaauauagagaagacaucgaacaaauaauagaauggagcacgauauucgaagaugcugcaauauuuaaaaccaaauugaaagaaauagauuggcuaaccgacgaacaacgcaacaaacuagcaaauaaaagauacagaggauggggcucauuaucaaaaagacuauuagcgugccucgucgacgagaacgggcaaagaauuauagauauucuaagagacagcagugauaauuucaugaugauagugaacagaccagaguucaaacaagcaaucuucgacgaaaacgcgaaccuaacggaaacaaacuccaagaaagacauguucgaaaugauagacaauuuuuacacgaguccacaaaauaagaaagcaauaagacaaguguuacuuguuguucaagacauucaaaacgcgaugggcggcguagcuccgcagaaaaucuuuauugaguucgcuagagaagaugaaguaaauggaagaagaacaaauagucgcuauucacaaauacgugaaauguacuccaaagucacagaugauguuauaaacaaaacaguuagaggagaauuagaagcaaacaaaggcucacuaaauaaagaaaaacuauucuuauacuucuuacaaggaggaauagauuuguacucaggaaaaacaauaaacauagacaacauaucgucauaugauguagaucacguauuaccucaauccuuuauaaaagacgauagcauaaacaauaaaguucuaguuaaugccaaagguaauagaguuaaaaaugacaaugugcccauggaacuuuuuggagcaaaaauguacccaacauggaaaaggaugguagauacagggauuaugucaaaagccaaauuuaaaaaucuaacacuaaacccggauaacguagauaaauuuaaagcagaaggauuuauaaaccgucagcuaguggaaaccagacaaauaauaaaauuaguagcucaaauauugaacgauaaacuuggcgacgacacuaaaauaguaagcguuaaagcuaacuuaacacacgacaugagagucuuuuucgauuucccaaagaaucggaacguaaacaauuaccaucacgcauuugaugcuuaccucagugcauuuguagguacauaucucuacaaacguuacccaaaacuacaaccauacuucguauauggcgaauuuaagaaaauggacaaacugaaaaauaugacaucauucgauuuucuaagagaucucaaacacaccgacaaaguagucgauaaagacacaggcgagauuauagcagauaaacuagcuguaauaacaaauaugaacaaaauauaugacuucaagaaaguacugguaacacaugaaguccaugagaacucuggggcaauguaugaccaaacccuauacccagcaaaauuagacaaaucucuaggaagaaaaggcgccaaacaacuaauaccaaagaaagaugauaugccaaccgcacuauaugguggauacacaggaagcaaagacgcguucaugucaaucguaaggcucaagaagaaagaugaaguauauuacaaaguaauuggaauaccaguccgcaucgcagacucaguccaacauggaaaagaagucgauguagaagcacuuacacaauucaucgagaccaaauuuaccaaagaaaaccuuaacaagaaaacaggugaaauuacacggaaaguggaaugguucgaacucguuuuaccuaaaguucuauuuggacaagcaguuuucgacggaggacaaccauucaugcuaggaagcucaacauacccacacaaccuacgagaauugguccuuacaaaagacagcgugaagaaaauagcaggcaaagagucuaauaaaucauacuuagaugcuuacgacgaaauuauggaagcaaugaauaaauacuucccauuauacgacaccaauaaauucagagagaaagugauagaaggaaggucgaaauuuauugaucucccugacaaagacgaguaugagaauaauaagcuaguccaaguagguaaaaguacgauaauagacagaauguuuauaggacuacacgcaaaugccgcacgaaccgaccuaaagaacauaggaauaacuaccccauuugguuuuaugcaacaggcuuccgguauaaaacuaaccaaagacacgguaguuuuauuucaaagcagcacgggccuguucgaacgcaaagucgcauuaaaagacuuauga

SEQ ID NO: 8765 - RNA, 4011 nt, Artificial Sequence
  Cas9 variant
augacuaaagauuauacaauuggacuggauaucggaaccaauuccgugggaugggcuguacugacugaugacuaucaauuaaugaaacgaaaaaugucuguucauggaaacaccgagaagaagaaaauuaagaaaaauuuuuggggagcccgacuuuuugaugaaggccaaacagccgaauuucgucgaacuaaacgaacaaaccgucgcagacuagcaagaagaaaauaucgccucucaaaacuacaagacuuauuugccgaagaacuauguaaacaagaugacugcuucuuuguacgauuagaagaaucauuccucgugccagaagaaaagcaauacaagccagcaucaaucuucccaacccuagaagaggagaaagaauacuaccaaaaauacccaacuauauaucauuuaagacaaaaacucguugacagcacagaaaaagaagaccuacguuuaguauaucucgcccucgcccaccuccuuaaauaccggggucacuuccuauucgaaggauaucucgacacugaaaauacaucgauagaagaauccuuccgcguuuuucuugaacaauacgguaaacaaagugaucaaccucuaaucguucaccaaccaguacucacuauauuaacugacaaauuaagcaaaaccaagaaaguggaagaaauucuaaaauauuauccuacagagaaaauuaacagcuucuuugcccaaugccucaaacuaauaguaggaaaucaagcaaauuuuaaaagaauauucgacuuagaagcagaaguaaagcuacaguuuuccaaagaaacauaugaagaagaccucgaaucacuguuagagaaaauaggagacgaauaucuagacauauuucuacaagcuaagaaaguacaugaugccauacuucuaucugaaauaaucagcucuaccgugaaacacacacaagccaaauuauccucugggaugguugaaagauaugaacgccauaaagccgauuuagcaaaauucaaacaauuuguaaaagaaaaugucccccaaaaagcgaccguguucuuuaaagacacaaccaaaaacgguuacgcaggcuauauaaaagguaaaacuacacaagaagaauuuuauaaauucgucaagaaagaauugucaggaguaguaggcucagaaccauuuuuagagaaaauagaucaagaaacauuccuacucaaacaacgaaccuacaccaaugguguuauaccccaccagguacaucuaaucgaauuaaaagcaauaauagaccaacaaaaacaacauuaccccuuucuagaagaagcaggccccaaaauuaucgcacuauucaaauucagaauaccauacuacguaggcccccuagccaaagaacaagaagcauccucauucgcauggaucgaaagaaaaacagcagagaaaauacauccuuggaacuuuagcgaagucguagacaucgaaaaauccgcuaugcgcuucauacaaaggaugacaaaacaagauacuuaccuacccacagaaaaaguacuaccgaaaaauagccuccuuuaucaaaaauauaugauauucaaugaauuaacaaaagugucauauaaagaugaacgaggcguaaaacaauacuuuucgggcgacgaaaaacagcaaauauuuaaacaauuauuccaaaaagaacgaggcaaaauuacagucaagaaacugcaaaauuuucuuuacacacauuaucacauagaaaaugcacauauauucggcauugaaaaagcguuuaaugcaucauacucaaccuaccacgacuucaugaaacucgcuaaaaccaaccaaaaaucuaugcaagaauggcuugaacagccagaaauggaaccaauuuucgaagacaucguuaaaauacugacuauauuugaagauagacaaaugaucaaacaccaacugaguaaauaccaagaagucuucggagaaaaacuacuuaaagaguucgccaggaaacacuacacaggcugggguagauuuucugcuaaauuaauccauggaaucagagaucgcaaaacuaauaaaacaauucucgacuaucugaucaaugaugaugacguaccagcaaauaggaauaggaauuuaaugcaacucauaaaugacgaacaccucucauucaaagaagaaauagcaaaagcuacgguuuucucaaaacacaaaucccuaguagacguaauacaagaccuaccagguuccccagccaucaagaaaggcauauggcaaucacuuaaaaucguagaagaauuaauagcgauaauugguuacaaaccaaagaacaucguaauugaaauggcccgagaaaaucagaaaacacaucguacaaaaccuagguuaaaagcacucgaaaauggacuaaaacaaauaggaucaacacuauuaaaagaacaacccacagauaacaaagcccuacaaaaagaaagacucuaccucuacuacuuacaaaauggaagagacauauacacaggagaaccccuagacauagaaaaucuucaucaauaugaaguagaucacauaauaccgaggaguuuuauaguugacaacagcaucgauaacaaagucuuaguagcaucaaaacaaaaccaaaagaaacgcgacgacguaccuaacaaacaaauuguaaaugaacaacgcauuuucuggaaccaauuaaaagaagccaaacucaucucuccuaagaaauacgcauacuuaacaaaaaucgaacuaacaccagaagauaaagcacgauucauacaaagacaauuaguugaaacacgucaaauaacuaaacauguagcuaacauauuacaucaaucuuuucaucaagaagaagaaggaaccgauugcgacggcguccaaauaauaacacugaaagccacacuaacaucucaauuuaggcaaacauucggacucuacaaaguaagagaaauuaauccccaccaucacgcgcaugaugccuaccucaacggcuucauugcaaauguauuacuaaaaagauauccuaaguuagcaccagaauuuguuuacgguaaguauguaaaauauucauuagcccgugagaauaaagcuaccgccaagaaagaauuuuauucaaacauacuaaaauuccuagaaucugaugagcccuucugcgacgaaaauggggaaaucuauugggagaaaagcuaucaucuaccacgcaucaagaaaguuuuauccucccaccaaguaaacguaguuaagaaaguugagcaacaaaaagguggcuuuuacaaagaaacaguaaacucaaaagaaaagcccgauaaauuaauagaaaggaaaaauaauugggacguaacaaaauacggaggauuuggcucgccagucauagccuacgcuauagccuucgucuaugccaaaggaaaaacccagaagaaaacucgagcgauagaagguauaaccauuauggaacaagcagcauucgaaaaagacccaacgacauucuuaaaagacaaaggauucccucaagugaccgaauuuauaaagcucccaaaauacacucuuuuugaauuugacaauggacggagaagauucuuagcuucucacaaagaaucacaaaaaggcaaccccuucauacuaucagaucagcuaguaacucuuuuauaucacgcacaacacuaugauaaaauaacguaccaagaaucguucgauuacguuaacacgcaccuguccgacuuuagugcuauucucacagaaguccucgcauuugccgagaaguacacauuagccgacaaaaauauugaaaggauucaagaacuuuacgaagaaaacaaguacggagaaauuucaaugauugcacaaucguucuugcaacuccuacaguuuaaugccauaggagcuccagcagauuucaaauucuuuggaguaacaauaccaagaaaaagauacacgagcuuaacugaaauaugggacgcuacuauaauauaucaaagcgucacgggacuauaugaaacaagaauaagaaugggagauuuaugggcaggagaacaauga

SEQ ID NO: 8766 - RNA, 4011 nt, Artificial Sequence
  Cas9 variant
augacaaaagacuacacgaucggacuagauaucggaacaaauucgguaggcugggcaguacuuacggacgacuaccaauugaugaaacgaaaaaugaguguccacggcaacaccgaaaaaaaaaaaauaaaaaaaaauuucuggggagccagacuguucgaugaagggcaaaccgcggaauuccgucgaacaaaaaggacaaacagaagaaggcuagcacgcaggaaauauagauuguccaaacuucaagaucuuuucgcagaagaacuaugcaaacaagaugauuguuuuuucgucagacuagaagaaucauuucucguaccagaagagaaacaguauaagccagcuucaauauuuccaacauuggaagaagaaaaagaauacuaccaaaaauauccuacuauuuaccacuugcgccaaaaacuaguugauucuacagaaaaagaagaucuucgucuaguuuaccucgcacuagcccaucuauuaaaauaucgaggucauuucuuauucgaaggagaucuagacacagaaaacacuaguauagaggaaucauuucgaguauuccuagagcaauacucaaaacaaucagaccagcccuuaauuguccaccaaccaguauuaacuauauuaacagacaaacucagcaaaacaaaaaaagucgaagaaauacuaaaauauuauccaacagaaaaaauaaacuccuuuuuugcacaaugccuaaaacuuauagucggaaaccaggcaaacuuuaaacgaauauuugaccuagaagcugaaguuaagcuacaguucucaaaagaaacauaugaagaagaucuagaaucacuucuagaaaaaauaggagacgaauacuuggacauuuuccugcaggcuaaaaaaguacaugacgcaauauuacuaucagaaauaauaucgaguacaguaaaacacaccaaagcaaaacuaucuuccggaaugguagagcgauacgaaagacacaaagcagauuuagcaaaauucaaacaauuuguaaaagaaaauguaccacaaaaagcaacaguauuuuuuaaagacacaaccaaaaacgguuacgcaggauauauaaaagggaaaacgacacaagaagaauuuuacaaauucguuaaaaaggaacuaucaggcguggugggaucagaacccuuucuugaaaaaauugaucaagaaacauuucuccugaagcaacgcacauauaccaacggcguuauuccccaucaaguacaccuaauagaacucaaagcuauaauagaucaacaaaaacaacauuauccguuucuggaagaagccggcccuaaaauaauagcccucuucaaauuuagaauuccauacuacguggguccucuagccaaagaacaagaagccuccaguuuugcauggauagaacgaaaaacagcagaaaagauuaaucccuggaauuucucagaagucguggauauugaaaagucagcgaugcguuuuauacaacgcaugacaaaacaagacacauaccuacccacagaaaaaguauuaccaaaaaacucccuguuauaucaaaaauauaugauauuuaacgaauugacaaagguaucuuacaaagacgaacgaggagucaaacaauacuuuuccggagacgaaaaacaacaaauauucaaacaauuauuccagaaagaaagaggaaaaauuacggucaaaaaauuacaaaauuuccucuauacccacuaccacauugaaaaugcacaaauauucggcauagaaaaagccuuuaacgcuagcuauuccaccuaucaugacuucaugaaacucgccaaaaccaaccagaaagcaaugcaagaaugguuagaacaaccggaaauggaaccaauuuucgaggacaucguaaaaauauuaacaauuuuugaagaccgucaaaugauuaaacaucagcucucuaaauaccaagaagucuucggagaaaagcuuuuaaaagaauucgcaagaaaacauuacacaggauggggaagauucucugcgaaacugauacacggaauccgugacagaaaaacgaauaaaacaauacuagacuaccuaauaaacgacgacgacguaccugcaaacagaaauagaaaccuuaugcaacuaauaaacgaugaacacuuaagcuuuaaagaagaaauagcaaaagcaacaguauuuaguaaacauaaaucacuagucgauguuauccaagacuuaccaggcucccccgcaauaaaaaaaggaauauggcaaucacucaagauaguagaagaacuuaucgcgauuauaggauauaaaccuaaaaacauaguaaucgaaauggccagagaaaaucaaaaaacccaccgaacaucuccucgccucaaagcauuagaaaacggucuaaaacaaauuggaaguacauuacuaaaagaacaaccaacggacaacaaagcacuacagaaagagcgauuguaucuauacuacuuacaaaauggcagggauauguauacaggcgaaccacucgaaauagaaaacuuacaucaauaugaaguagaccauauaaucccacgauccuucaucguagacaacuccauagauaacaaaguccuaguggcaagcaaacaaaaccaaaaaaaacgugaugauguaccaaaaaaacaaauaguuaacgaacagcgcaucuucuggaaucaacuaaaagaagcaaaauuaauuucuccaaaaaaauacgcguaucucacuaaaauugaguuaacuccagaggacaaagcucgauucauacaacgacaacucguggaaacccgacaaauaacaaaacaugucgccaacauauuacaucaaucauucaaucaagaagaagaaggaacagauugcgaugggguacaaauaaucacauuaaaggcuacacuaacaucccaguucagacaaacauucggauuauacaaaguuagagagaucaauccgcaccaccaugcacaugacgccuaccucaauggauuuauugcuaacguucuauuaaaaagauacccuaaauuagcuccagaauuuguauacggaaaauacguaaaauacucacucgccagagaaaauaaagccacugccaaaaaagaauucuacucaaauauccuuaaauucuuagaaagugacgagccuuuuugugacgaaaacggagaaauauauugggaaaaaagccaccaccuaccaagaaucaaaaaaguuuuaagcagccaucagguaaacgucguaaaaaaaguagaacaacaaaagggagguuuuuacaaagaaaccgucaauucaaaagaaaaaccagacaaacuaauagagcgcaaaaauaacugggacguaacaaaauauggagguuucggcagucccguuauagcauaugcuauagcuuuuguuuaugcaaaaggaaaaacacaaaaaaaaacacgagcaauagagggaauaacuauaauggaacaagccgcauuugaaaaagauccgacaaccuuccucaaagaaaaagguuucccacaagucacugaauuuaucaaauuaccuaaauauacgcuauuugaguucgauaacgggcgcagacgauucuuagccucgcauaaagaaagccaaaaaggaaauccauuuauacuauccgaucaacuaguaacacuacucuaccaugcacaacauuacgacaaaauaacauaccaagaaucguucgacuacgucaacacucacuugagcgauuucucugcaauacucaccgaaguccuggcauucgcugaaaaauacacacuggcagacaaaaauaucgaaagaauacaagaauuauacgaagaaaacaaauacggugaaaccuccaugauugcccaauccuucuugcaauuauuacaauucaaugcaaucggcgccccagcagacuucaaauucuuuggagucacaauucccagaaaacgcuacacaucauuaacagaaauaugggacgccacaauuauuuaccaaaguguaacaggacuuuacgaaacacgaauaaggaugggagacuugugggcaggagaacaauga

SEQ ID NO: 8767 - RNA, 4014 nt, Artificial Sequence
  Cas9 variant
augaaaaauaugaaaaagcccuacacaauaggacucgacauaggcacaaacucuguaggcugggcaguacuaacugaucaauacgauuugguaaaaaggaaaaugaaaaucgccggugauagugaaaagaaacaaauaaagaaaaacuuuuggggcguaagacuauuugaugaaggacaaacagcggcagauagaagaauggccagaacagcaaggcgaagaauagaaagacgaaggaacagaauuucuuaucuacaagguauauuugccgaagaaaugagcaaaaccgaugcaaacuucuuuugcagacuuagcgacuccuuuuacguagauaaugaaaaacgaaauucacgacacccauucuucgcuacuauugaagaagaaguugaauaccauaaaaacuauccaacgauauaccaucuacgagaagaauuaguaaacaguucugaaaaagcagacuugcgcuuaguauauuuagcauuagcccauaucaucaaauaccgaggaaauuuccucauagaaggagcuuuagacacacagaacaccaguguagacggaauuuauaaacaguuuauccaaaccuacaaccaaguauuugcuaguggaaucgaggauggaucacuaaagaaauuagaagacaacaaagacguggccaaaauuuuaguagagaaaguaacaagaaaagaaaaacuugagagaaucuuaaaauuauauccuggagaaaagagugcaggaauguucgcacaauucauuagucuuauagucggcagcaaaggaaacuuccagaaaccauuugaccucauugagaaaagcgacaucgaaugcgcaaaagacucauacgaagaggacuuagagaguuuacuugcucugauaggagacgaauacgcagaacuauuuguugcagccaaaaaugccuacucagccguaguacuuaguaguauaaucacaguagcugagaccgaaaccaacgcaaaauuaagcgcgucaaugauagaaagauuugacacccaugaagaagauuuaggagaauuaaaagccuuuauaaaauuacauuuaccuaaacacuaugaagaaaucuucucaaauaccgaaaaacacgguuaugcaggcuacaucgacggaaaaacuaaacaagcagacuuuuauaaauacaugaaaaugaccuuagaaaacauagaaggggcagauuauuuuaucgcuaaaauagagaaagaaaauuuccuucgcaagcaacgaacauuugacaacggagccauaccccaccaacuccauuuagaagaacuagaagcaauauuacaucaacaagcuaaauauuacccguuccugaaagaaaacuaugauaaaauaaagagucuaguaacauuccguauuccauacuucguaggaccucuagcaaacggucaaucagaguucgcuuggcuaacaagaaaagcagauggugaaauccggccauggaacaucgaagaaaagguugacuucggaaaaucagcaguagauuucauagaaaagaugacaaauaaagauacauaucugccaaaagaaaacguacuaccuaaacauucacuaugcuaccaaaaguacuuaguguauaacgaacuaacaaaaguacguuacaucaacgaccaaggaaaaaccucauauuucucaggccaggaaaaagaacaaauauuuaacgauuuauucaaacaaaaacguaaaguaaagaagaaagaucuggaacuauuucuaagaaauaugagccauguagaaucacccacaauagaagggcuugaagauaguuucaauuccucauacaguacauaucaugaucuucuaaaaguuggaauaaaacaagaaauacuagacaauccaguaaauacagagaugcuugaaaacaucgucaaaauacuuacuguauuugaagauaaaagaaugaucaaagaacaauuacaacaauucagcgauguacuugacggaguuguauuaaagaaacuugaaagaagacacuauacugguuggggccgucucagugcaaaacuauuaaugggaaucagggauaaacaaucacaucuaacaauucuagauuaucucaugaacgaugauggucugaaccgaaaccuaaugcaauuaauuaacgacucuaacuuaucauucaaauccauaauugaaaaagaacaaguuacaacagcagauaaagauauacagucaauaguagcagaccuggcaggaucaccagcaaucaagaaaggaauacuacaauccuugaaaauaguagacgagcuaguaaguguaaugggauacccgccucaaacaauaguaguagaaauggcaagggaaaaccaaacgacaggaaaagguaaaaacaacagccgaccgagauacaaaucauuggaaaaagcaauuaaagaauuuggaucacaaauacuaaaagaacauccaacagacaaccaagaauuaagaaauaaucgauuauaucuauauuaucuacaaaacggaaaagacauguacacaggacaggaucuagauauacacaaccuaucaaauuacgauauugaucacauaguaccacaaaguuuuauaacagacaacagcaucgacaauuuaguacugacaaguagugccgggaaucgugaaaaaggagaugaugucccaccuuuagaaauaguucgaaaaagaaaagucuucugggaaaaauuauaucaaggaaacuuaaugaguaaaagaaaauucgacuaccuaacaaaagccgagaggggaggacuaaccgaagcagacaaggccagauuuauacauaggcaacuuguggaaacaaggcaaauaaccaaaaacgucgcaaacauccuucaucaaagguuuaacuacgaaaaagacgaccauggaaauacaaugaaacaagucagaauugucacauuaaaaucagcauuaguaucacaauuccgaaaacaauuucaguuauauaaagucagagacguaaaugauuaucaucaugcucaugacgccuacuuaaauggcgugguagcaaacacacuguuaaaaguauacccacaacuagaaccagaauuugucuauggagacuaucaccaauuugauugguucaaggcaaacaaagcaacagcgaaaaagcaguucuauacuaauaucaugcuauucuuugcacagaaggacagaaucauagaugaaaacggugaaauucucugggacaagaaauacuuagauacgguaaagaaaguaauguccuaccgacagaugaauauagucaagaaaacugaaauccaaaaaggcgaguuuucaaaagcgacaaucaaacccaaaggcaacucaagcaaauuaauaucucguaaaaccaacugggacccuaugaaauacggaggauuggauucaccgaacauggcauacgccguaguuauagaguaugcaaaagguaaaaacaagcuaguauuugaaaagaaaauaauuagggugacaauaauggaacgaaaagcauuugaaaaagaugaaaaagcauuuuuagaggaacaaggcuauagacaaccuaaaguucuugcuaaacucccaaaauauacacuauaugaaugcgaggaaggaagaaggcgaauguuagcaucagcaaacgaagcacaaaagggaaaccaacaaguuuuacccaaccaccuaguaacucuauuacaccacguagcuaauugugaagugucagacggaaaaagucuagauuauauugaauccaaccgagaaauguuugcugaguuacuugcucaugucucagaguucgcuaaacguuauacucuagcagaagccaauuuaaacaaaaucaaucaacuguucgaacaaaauaaagaaggcgacauaaaggcaauagcccaguccuuuguggaucuaauggcauuuaaugcaaugggugcacccgcaucguuuaaauucuuugaaacaacgauagaaagaaaaagauacaacaaucuaaaagaauuauuaaauucaacaauaauuuaucaaaguauaacaggauuauacgaaagcagaaaaagacuagacgacuga

SEQ ID NO: 8768 - RNA, 4014 nt, Artificial Sequence
  Cas9 variant
augaaaaaauucgaaaacuacuaccuaggacuagacaucggaacaucauccauuggaugggcagucacaaacucccaguaugacauuuuaaaauucaacggaaaauacaugugggguaccaggcuauuucccgaagcaaauaccgcacaggaaagacgcauccacagaucaaguagaagaagacuuaaaagaagaaaagaacgaauacagauacuccaaauguuauuugacaaagaaauagcgaaaauagauucaggauucuuccaaagacucaaagauuccaaauauuauaaagaagacaaaacagaaaaacaaaccaacuccauauuccaugauaaagauuauucagacaaagaauaucaccaagacuucccaacaauuuaccauuuacgaaaguuccuacucgaaggaaauaaacccaaagacaucagguuuguauaucuagcuuuacaucauauacuaacacaucguggacacuucuuauuccccgauauggaaguaaguaacguuaccgaguucagcaacauauucagugaauugaagcaauaccuauaugacgagauggaccucgauuucgaauggaaaaacggcaaacuaaacgaaguagagaacauacucaaagaucgaaaccucgcgaaaagcgaaaaagaaaaaaaauuauguggcauaauagaauuagaaggaaagauugauaaucaaagaaaagcuaugauagguaugaugugcggauguaagaaaaaguucagugauuuauuucaaaacgaaaacuauagagaauuagaaaucucaaguuucucuuucgcagacuccucauacgaagaaaaaagagaugaacucgaaggaauacucgcagaaaauaucuuguguuuagauuaccuaaaaaccauauacgauuggggaaaauuauccgacauucuacagggugaagaaucaauaucagucgcaaaaguaaaaagcuacgaggaacaccaacucgaccuaaaauaccuaaaaaacauacucaaacuauauucacacaaagaaaaagaaaacguuuuuagaaaaaaagagggaaaguacccaaaauacauuagugggaaauuaucccaagaggaauucaacaaaaguaucaaaaaaauauuagaggaaauaaaaagcguaaaacaagaagaccguaaaguuuucgacacacuacuaaaaagagcauccaacaaccuacuuugcccuaaacaagucauaaaagaaaaugguguaauaccauaccaaauacacaaauuugaacuagaaaaaauccuaagaaauauggcagacuucuucccaaugcuaaaagaaaaaaaagacggaaaaacacucuccgaaaaaauuaucucagucuuuacauucagaauucccuacuacguugguccccuuaaucaaaauucugacagagcauggcuaguaaaaaacaaagacgagaaaauauaucccuggaacuuugaagaaauaguuaaucuagaagaaagcgccgaaaaauucauacaaaacuuaacaaacaaaugcacuuauuuaguacucgaagacguacucccaaaauccucaaucuuauauucaaaguucauggugcuaaaugaacuaaauaaucucaaaauagauggugaagccauaucuguugaccuaaaacagaaaauauaccuaaaucuuuuccaaaaauacaaaaaaguaacauuaaaaaaauuaaagggauauuuaaaauccgaaaacauucuaauagauacaucaacacaaauaacaggaauagauggagacuucaaaagcucccuaggaagcuaccuagauuuuuacaacauacuaggggacaaaguuaaaacagacuucggaaaaaaguugauagaaaauugcauucuauggauaacgcuauauacuggagaaaaaaaacuacugaaaaauaagaucauagcaaacuacaaaggagaacuuagcgaagaagagauaaagaagauaguaaacuuaaaguacaaagacuggggaagacuuaguuacgccuuccuagaagaaauucaauccgccucccuagaaacuggagaauuaaggaacauaauacaaaugaugugggaaaccaacaacaaccugauggaacucuuaaguucgaacuaccaauuuuuauccgaaaucgaaaaaagaaacuccgucguagcaauaggaaaagaauuuaauuacgaaacaauacucggagauagcuacgccucucccaguguaaaacgaaugauauggcaaucucuaucgguaguagaugaaauuaaaaaaauaaugaaaaaagccccaaaaaaaauuuucauugaaauggcaaggcaagaagacaugaaaaaagaaagaaaggaaagccguaaaagcacauuucuaacgcuauacaaauccauaaaagaagaaggucgcgauuggauuaaagaaauagaaaauugguccgauagcgaguucagaucaaaaaaacucuaccuauauuacacccaaaugggcaaauguauguauaccggagaaaaaauuucacuagaccaacucuucaacaaaaacauauacgauaucgaccauauauauccgagaucaaagacuaaagacgacucgauugagaauauuguccuagucaaaagaaauauaaaugcaaaaaaaacagaugaguauccacuugaaagaaacauacaacaaaaacagcacgacuuuuggaaaaugcuucauaguaaaaaauugauaggcgacaaaaaauacgaaagauuaacgagaaccacugaguuuacagaugaggaacucucugauuucaucgcacgacaguuaguugaaacaagacaaucaacuaaaauaguggcagauauccuaaaaaaucuauucccugaaacaaagauaguauauguuaaagcgaaccuaacaagugauuuuagaaaaaacuucaaaauacuaaaaucacgagacauaaacgacuaccaccaugcacacgaugcauaccucaauauugucacaggaaauguauauaauauaaaauuuacagacaacccuagaaacuucaucaaagacaaaaaauuggaaggcaaaaaauauaaucugaaaguagaaaaaauuuucgaauaccggaaagagaacgaauccuuuuggaaucccaaaacgaugguuacgaaaauugaaaacuacauauucaagaaacgaccacaauucacacgauauagcuuugaacagcacggagguuucuuugaucaaaauauagucgacaaggaaagcuguaaaaaaggaaccggcuacauaccuauuaaaaguucuaaugcaauacuauauaacacuucuaaauauggaggauacgguucgguaacggguacguauuucuuucuaguagaacauacaaugaaagggaaacguauacggacuauagaaaugaugccgcuguaucuaucaaagaaaauucacuccaaagaagaacucgaaaaauacugcaaagagaaacuugagcugcagaagcccaguguuaggcuagcacgcauuaaauacaacucacuacuaaaaauaaacggguucccauaucacauaacaggaaaaacuaacgacucauauuggaucaugagugcaauacagcuccuacuaaguaaaaauuacuacgaauauuuaagaaaacuauacaucuucuguaaggaagagagauuggaagaagaaauaguaggagaaaaaaauaucaaauuauauacauguauccuagaaaaacucgaaaaaagcauauauucucacaaacugcucaacaucaacuauaacggaaaaagcaagaaccuaaaagacauacuagaaagugaaaaagaaaauuucuugcuacuuucugagaaaaagcaagcccagauacuaaucgaaauauuuaccuuauuagaaaguaacaacuuuggcgcuaaccuagaaagcuuuggaugcggaaaaaaaugcggcauaacaaaaauaaacaaaaacauugauaaguuagaagaaguacuccuaaucaaccaaucaccgacuggacucuuugaaaauagcauagaccucaaaaagguauga

SEQ ID NO: 8769 - RNA, 4014 nt, Artificial Sequence
  Cas9 variant
augaagaaagacuaugugauaggacuagauauaggaacuaauaguguaggaugggcgguuaugacagaagacuaccaacuugucaaaaagaaaaugcccauauauggaaacacagagaaaaaaaaaauaaaaaaaaacuucuggggaguaagacucuucgaagaaggacacaccgcagaagacagaagacucaagcgaacagcaaggagaagaauauccagaagaagaaaccgauugcgauacuuacaagcguuuuuugaagaagcaaugacagaccuagaugaaaauuucuucgcgagauugcaagaaucauucuuaguuccagaggacaaaaaauggcacagacacccuauauucgccaaauuggaggacgaaguagcauaucacgagacauaccccacaauauaccaucugcguaagaaauuagccgacagcuccgaacaggccgauuuaaggcucauauauuuggccuuagcccauauaguuaaauacagaggacacuuuuuaauagaagggaaacuuucaacagaaaacauaagcguaaaggaacaauuccaacaauucaugauaauauauaaccaaacauucguuaauggcgaaagucgccuaguauccgcaccacuuccagaaaguguacuaauagaagaagaacugacagaaaaagcaucucgaacaaaaaaauccgaaaaaguccuacaacaauuuccacaagagaaagcuaacggccuuuucggucaauuucugaagcuuaugguaggaaacaaagccgacuuuaaaaagguauuuggacuagaagaagaagcuaaaaucacauacgcguccgagucauacgaagaggaucuugaaggcauucuggcaaaaguaggugaugaauauagcgacguauuucuugcagcaaaaaacguauaugacgccguggaacuaucaacaauccuagcagacucugauaaaaaaucacaugcaaaguuaucaucaagcaugauaguccguuuuacagaacaucaggaagaucucaaaaaauuuaaacgauuuauaagagaaaauuguccagaugaauaugauaauuuauuuaaaaaugaacaaaaagacgguuacgcaggauacauagcgcacgcuggaaaaguuucacaacuaaaauucuaucaauacguaaaaaaaauaauacaagauauugcaggagcagaauauuucuuagaaaaaauagcgcaagaaaacuuccuaagaaaacaacgcacguucgacaacggagucauaccucaucaaauccacuuagcggaacuacaagcaauaauacauaggcaagcagcauacuaccccuuccuaaaagaaaaccaagaaaaaauugaacaacuaguaacauuuagaauaccauauuauguugguccauuguccaagggagacgcaagcacguuugcaugguuaaaaaggcaaucugaagaaccaauuagaccuuggaaccugcaagaaacaguggaucuugaucaaucugcaacagcuuuuauagaaagaaugacaaacuucgauacauacuuacccuccgagaaaguacucccaaaacauagccuacuauaugaaaaauucaugguauuuaaugaauugacaaaaauaucuuauacugacgacagagggauaaaagcuaacuuuucuggaaaggagaaggaaaaaauauuugauuacuuauuuaaaacucgaagaaaaguaaaaaaaaaagacauaauccaauuuuauagaaaugaauauaauacugaaauugucacacuaucaggccucgaagaagaucaauucaaugcaucuuuuuccaccuaucaggacuuauuaaaauguggcuuaacaagggcagaguuagaucacccugacaacgcagaaaaacuagaggauaucauaaaaauacuaaccauauuugaagaucgucagcgcauaagaacacaacucucaacauucaaaggucaauucagcgcagagguccuaaaaaaauuagagagaaaacauuauaccggauggggaagacuuagcaaaaaauuaauaaacggaauauaugacaaagaaucuggcaaaacuauauuaggauaccuaauaaaagaugauggaguaucuaaacacuauaacagaaacuuuaugcaauuaauaaacgacucacagcuuuccuuuaaaaacgcgauacaaaaagcccaaucgucugaacaugaagagacucuaucagaaacaguuaacgaacuugcaggguccccggcaauuaaaaaaggcaucuaccaaucuuugaaaauuguagacgaacucguugcaauaaugggauaugcacccaaacgaauugucguugaaauggcuagggaaaaucaaaccacguccacagguaaaagaagaagcauacaacgauuaaaaauaguugagaaagccauggccgaaauuggaucaaaucuacuuaaggagcaaccaacaacaaacgagcaacuccgugauacucgauuauuccuguauuauaugcaaaacgggaaggacauguauaccggcgaugaauuaucauuacauaggcuaucgcacuaugauauagaucacauaauaccccaaagcuuuaugaaagaugauagcuuagauaaccuuguccucguaggaucaacagaaaaucgaggcaaaucagaugauguaccaaguaaagaagucguaaaagacaugaaagcauauugggaaaaacucuaugccgcugggcucaucucucaaagaaaguuccaaagacucacaaaaggcgaacaagguggccuaacucuugaagauaaagcacacuucauacaaaggcaauuagucgaaacaagacaaauaaccaaaaacguagccgguauacucgaccaaagauacaaugcgaacucaaaagaaaaaaaaguacaaauuauaacgcuaaaagcgucauuaacaucccaauucagauccauauucggauuauauaaagugcgugaaguuaacgacuaccaccauggccaagaugcauaccucaauugcgucgucgcuaccacauuacuaaaaguauaucccaaccucgcgcccgaauucguauauggagaauaccccaaauuccagacguucaaagaaaauaaagcgacugcaaaagcaauuauauacacaaaucuacuccguuucuucacugaggaugaaccgagauucacaaaagauggcgaaauacuauggucaaacagcuaccucaaaacuauaaaaaaagagcuaaacuaccaucaaaugaacauagugaaaaagguugaaguacaaaaaggaggauucucuaaagaaucaaucaagccuaaaggaccaucaaacaaauuaauuccaguuaaaaacggucucgacccacagaaauauggaggcuuugauagcccaauagucgcauauacaguacuauuuacacaugagaagggaaagaagccauuaauaaaacaagaaauauuagggauaacaaucauggagaagacgcgcuuugaacaaaauccaauacuauuucuagaagaaaaggguuuucuccgaccuaggguacuaaugaaacuaccuaaauacacuuuauacgaauucccugaaggucgaagaagacucuuggcaagcgcaaaagaagcccaaaaaggaaaccaaauggucuuaccugagcaccuacuaaccuuacuauaucaugcaaaacaaugcuuauugccuaaucaaagcgaaucauuaacuuaugucgaacaacaucagccagaguuucaagaaauauuagaacgaguaguggacuucgcagaaguacauaccuuagccaaaaguaaaguucaacaaauuguuaaacuuuucgaagcaaaucaaacagcagacgucaaagaaauugccgcaucauuuauacaauugaugcaauuuaaugccaugggagcaccaucaacguucaaguuuuuccaaaaagacauugaacgagcacgauauacaagcauuaaagaaauauuugacgcaacaauuauauaucaaagcacaacaggacucuacgaaacgcgucgcaaaguaguagacuga

SEQ ID NO: 8770 - RNA, 4014 nt, Artificial Sequence
  Cas9 variant
augaaaaaagauuacguaauaggacucgacaucggaacaaauagcguagguugggccguaaugacugaagacuaucaacucguaaaaaaaaaaaugccuaucuacggaaacacagaaaaaaaaaaaauaaaaaaaaauuuuuggggcguacgacucuuugaagaaggacauacagcugaagacagaagacuaaaaaggacagcacgacgacgaaucagccguaggcguaacagacuaagguaucuacaagcauucuucgaagaagcaaugacugaucuagacgaaaauuuuuuugcuagauugcaagaaaguuuccucguuccugaagacaaaaaauggcacagacauccaaucuucgcaaaauuagaagacgaagucgcauaccaugaaaccuauccaacuauauaccaucuacgaaaaaaauuggcagacucaucagagcaagcugaucuacgacuaauauauuuagccuuagcccacauuguaaaauauagagggcacuuucuaauagaaggaaaacugucaacugaaaacacaagugugaaagaccaguuccaacaauuuaugguaauuuauaaccaaacauucgugaacggagaaucaagauuagucucugcaccacuaccugaaucuguacucauagaagaagaacuaaccgagaaagcaagcagaacaaaaaagagugaaaaaguacuccaacaauuuccccaagaaaaagcaaacggucuuuuuggacaauucuuaaaauuaaugguaggaaacaaagccgauuucaaaaagguauuuggucucgaagaagaggcuaaaauaacuuacgcaagcgagucauaugaagaagaccuggaaggaaucuuagcaaaaguaggagacgaauacagcgacgucuuccuagcggcaaaaaacguauaugaugcaguagaauugucaacaauacuugcugacagcgacaaaaaaagccaugccaaacuaagcuccucaaugaucguaagguucacagaacaucaggaagacuuaaaaaaauuuaaacgguucaucagggaaaacugcccagacgaauaugacaaucuauucaaaaaugaacaaaaggauggauacgcaggauauauugcgcacgcgggcaaaguaagucaauugaaauucuaucaauacguaaaaaagauaauacaagauauagcgggugcagaauacuuccuagaaaagauugcacaagagaacuucuuaagaaaacagagaacuuuugauaacgguguuauuccacaucagauacaccuagcggagcuccaagcaaucauacacaggcaggccgcuuacuaccccuuucucaaagaaaaccaagagaaaauagaacaauuagucacauucagaauaccguauuacguaggaccauuauccaaaggagacgccaguacuuuugcuuggcuaaagagacagucugaagaaccaauuagaccauggaacuuacaagagaccgucgaccuagaccaaucggcaacagccuuuauagaaagaaugacaaacuucgauacauaccuaccaucagaaaaaguguuaccuaaacacagccugcuauacgaaaaauucaugguauucaacgaauuaaccaagauauccuauacugacgaucgaggaaucaaggcaaacuucucgggaaaagaaaaagaaaaaauauucgacuauuuauucaaaacuagaagaaaaguuaaaaaaaaagauaucauucaauucuaucgaaaugaauacaacaccgaaaucguaacgcuuucuggcuuggaagaagaucaauuuaaugcgucauuuucgacauaccaagaucuauuaaaauguggguuaacaagagcggaacuugaccaucccgauaacgcagaaaaacuagaagacauaaucaaaauuuuaacaauuuuugaagaccgucaaagaauacgcacgcagcucuccacuuucaagggacaauuuucggcagaaguauuaaagaaacucgaacgaaaacacuacacggguuggggacgacuaagcaaaaaauuaauaaacggaauuuaugauaaggaaucugggaaaacaauccuagacuaccucauaaaagaugacggcguuagcaaacauuacaaucgaaacuucaugcaacuaauuaaugacucucagcucucuuucaaaaaugcuauacaaaaagcacaaucaugugaacacgaagaaacccuaucagaaacgguaaaugaacucgcaggaagucccgccauaaaaaagggaauauaccaaucacuaaagaucguugaugaacuaguagccauaaugggguacgcccccaaacggauuguaguagaaauggcaagagaaaaucaaacgacaucaaccggaaaacgaagaucaauccagagauuaaaaaucguagaaaaagcaauggcugaaauuggcucaaaccuacuaaaagaacaaccaacaacuaacgaacaacuaagagauacacgcuuauucuuauauuauaugcaaaacggcaaagacauguauacaggagaugaacuuucauuacacagacuuucgcacuaugacauugaccauauaauaccacaauccuucaugaaagaugauucacuagacaauuuaguacucgucgggucuacugaaaaccggggaaaaagugacgacgucccuucaaaaaaaguaguaaaggacaugaaagcauacugggaaaaauuauaugcagcgggacuuauuucccaacguaaauuucaacgucucacaaaaggagaacaaggcggacuaacacucgaagacaaagcacacuuuauacaaagacagcuaguagaaacccgacaaaucacaaaaaacguagccgguauacuagaccaaagauacaacgcaaaaucaaaagaaaaaaaaguccaaauaauuacacuaaaagcaucauuaacgagucaauuccgaucgaucuucggauuguauaaagucagagaaguuaaugacuaucaccauggacaagacgcuuaucuaaacugcguagucgcgaccacucuucucaaaguauaucccaaccuggcuccagaauucguauacggcgaguauccgaaauuccaagcauuuaaagagaacaaagcaacagcaaaaacaauuauuuauacaaaccuaaugagauucuucacagaggaugaaccaagauuuacuaaagauucagaaauuuuauggucuaauucguaucucaaaaccaucaagaaagaacuuaauuaccaccaaaugaacaucgucaaaaaaguagaaguacaaaaaggcggauucucaaaagaaucuauaaaacccaaaggucccagcaauaaacuuauccccguuaaaaauggauuggacccucaaaaguauggaggauuugauuccccuguaguagccuacacaguucucuuuacacaugaaaaagguaaaaaaccacuaauuaaacaagaaauccuaggaaucaccaucauggaaaaaacccgauuugaacagaauccaaucuuauucuuagaagagaaagguuuccuacggccacgcguacuaaugaagcuccccaaauacacauuauacgaauucccagaaggucgacgaagauuacuggccagugcuaaagaggcacagaaaggaaaccaaaugguucuaccagaacacuuacuaacccucuuauaucacgccaaacaaugccuauuaccaaaucaaucggaaaguuuggcauauguagaacaacaucaaccagaauuucaagagauauuagaaaggguuguagacuuugcagaaguacacacauuagcaaaaucgaaaguucaacaaauaguaaagcucuuugaagcaaaccaaacagcugacguaaaagaaauagcggcaucuuucauacaauuaaugcaauucaaugcgaugggagccccauccaccuucaaauuuuuucaaaaggauauagaaagagcucgauacacaucaauaaaagaaauauuugacgcaacaauuauauaccaaucaacaacgggccuuuacgaaacuagaagaaaaguggucgacuga

SEQ ID NO: 8771 - RNA, 4014 nt, Artificial Sequence
  Cas9 variant
augaagaaagauuaugucauaggauuagacaucggcaccaauucagugggcugggcaguaaugacagaagauuaucaauuagucaagaaaaaaaugccuauuuacggaaacacagaaaagaaaaaaauuaaaaaaaacuucuggggcguuagacuguuugaagaaggacauacugcagaggaccgaagauuaaaacgaaccgcuagaagaagaaucaguagacguagaaacagauuacguuaccuacaggcuuuuuuugaagaagcaaugacggcacucgacgaaaacuucuucgccagguuacaagaaucauuucuaguaccagaagauaaaaaguggcaucgacaccccaucuuugcaaaacuagaagaugaaguggcauaucaugagacauacccgacaauauaucauuuaaggaaaaaacuagcagauucaucagaacaagcagaucuacgacuaaucuaccuagcacuggcccauauaguaaaauauagagggcauuuccucauagagggcaaauuaucaacagaaaauaucaguguuaaagagcaauuccaacaauuuaugauaauauacaaccaaacauuuguaaacggggaaaguagacuuguaucugcaccacuaccugaauccguacuaauagaagaagaacuuacugaaaaagcaucacgaacgaaaaaaagcgaaaagguuuuacaacaguucccacaagaaaaagcaaacggacucuucgggcaauuucuaaaacuaauggucggcaauaaagcagacuucaaaaaaguauucggucuagaagaagaagcaaaaauaaccuacgcaagcgaauccuaugaagaagauuuagaaggaauacuagcaaaggugggcgaugaauacucagauguauuucucgcagcaaaaaacgucuacgacgcagucgaacuaucaaccauccuagcugacuccgacaaaaaaucucacgcuaaauuaagcucuucaaugauagucagauuuacagaacaucaggaagaucuaaaaaacuuuaaaagguuuauuagggaaaauugucccgaugaauacgauaauuuguucaaaaacgagcaaaaagauggauacgcuggauauauuacacaugcuggaaaaguaucacaacuuaaauucuaccaguacguaaaaaaaaucauacaagacauagcaggagcagaauacuuuuuagagaaaaucgcucaagaaaacuuccuuagaaaacaacguacauucgauaacgguguuauaccccaccaaauacaccucgcagaacuacaggcaauaauccaccgacaagcagcguacuauccauuucuuaaagaaaaucaagaaaagauugaacaauuaguaacauucagaauuccauacuaugucggaccuuuauccaaaggagaugccaacacuuuugccuggcuuaaaagacaaucagaagagcccaucaggcccuggaacuuacaagaaaccguagauuuagaccaaagugcuacagcauuuauugaaagaaugacaaacuuugacacuuaccuaccuucagaaaaaguacuaccuaaacacucacuacuguacgaaaaauucaugguauucaacgaacucacuaagauauccuauacagaugacagaggcaucaaagcaaacuucucgggaaaagaaaaagagaaaauauucgauuaccuauucaaaacucguaggaaaguaaaaaagaaagacauuauacaauuuuacagaaacgaauacaauacagaaauaguaacauuaucagguuuggaagaagaucaauucaacgcaucauucaguaccuaccaagacuuacuaaaaugcgggcuaacaagagcagaacuagaccauccagacaacgcagaaaaacuagaagacauaauaaaaauauugaccauauuugaagaccgacaaaggauccguacacaacuaucaacauuuaagggacaauuuagcgcagaaguucuuaaaaaguuagaacgcaaacacuauacaggguggggacgccuaucgaaaaaacugauuaacgguauauacgacaaagaaucaggcaaaacaaucuuagacuaccuaauuaaagaugauggcgugucuaaacacuacaauagaaacuuuaugcaauuaauuaacgacagccagcugucauuuaaaaaugcaauacaaaaagcacaaaguucagagcacgaagaaacguuaagugaaacagucaacgaacuagcaggaagccccgcaauuaagaaaggcauauaucaaucauugaaaaucguggacgaauuggucgcaauaauggguuaugcaccuaaaagaauaguaguagaaauggcaagagaaaaucaaacaacaucaacaggaaaacgaagaaguauucaaagauuaaagauaguggaaaaggcaauggcugaaauagguucgaacuuacucaaagaacaaccaaccacaaacgaacaauuaagagacacaagacuauuucuauauuacaugcagaauggaaaagacauguacacuggagacgaacuaucgcuacacaggcuaucucauuacgauauagaucacauaauaccccagucauuuaugaaagaugacagcuuagauaaccuaguauuaguuggaaguaccgaaaauagaggaaaaucagacgacguuccgucgaaagaaguuguaaaagacaugaaagcauauugggaaaaacuuuaugcagccggccucauaucacagcggaaauuucaaagacuaacaaaaggugaacaaggaggauugacccuagaagacaaagcccacuucauccagagacaacucguagaaacacgacaaauaacaaaaaacguagcaggaauccuagaccaacgauauaacgcaaaaaguaaagagaaaaaaguccaaauaauaacgcucaaagcaagucucacgagccaauucagaucaauauucggacuauauaaaguucgagaaguaaacgacuaucaucacggacaagacgccuaucuuaacugcguuguagcaacaacacuacucaaaguguacccuaauuuagcucccgaauucguauauggggaauacccgaaguuccaaaccuuuaaggaaaauaaagcaacagccaaagcgauaauuuacaccaauuuacugagguuuuucacagaagaugaaccaagauucacgaaagauggcgaaauuuuauggucaaauucauaccucaaaacaauuaaaaaagaauuaaauuaucaucaaaugaauaucguuaaaaaaguagaaguucaaaaaggaggauucagcaaagaaucaauuaaaccaaaaggacccucaaauaaauuaauaccuguuaaaaauggauuagacccucaaaaauauggaggauuugacucaccuauaguagcguacacuguacuguucacacaugaaaaggguaaaaaacccuuaauaaaacaggaaauacuaggcaucaccauaauggaaaaaacuagguuugaacaaaaucccaucuuauuuuuagaagaaaaaggauucuuaaggccgaggguguuaaugaaacuaccaaaauacacucucuaccaauucccagaaggcagaagacgauuacucgcaagcgcaaaggaagcacaaaaagguaaccaaaugguucuucccgaacaucuacuaacacuucuguaccaugccaaacaaugccuacuacccaaucagucagaaaguuuagcauacguagaacaacaucaaccugaauuucaggagauacuggaaaggguugucgauuuugcagaaguccacacacucgccaaaucaaaaguacaacaaauagugaaguuauucgaagcaaaucagaccgcagacguaaaagaaaucgcagccaguuuuauucaauuaaugcaauucaaugccaugggugccccaucaaccuuuaaauucuuucaaaaggauaucgaaagagcgcgauacacaagcauaaaagaaauauucgaugcaacaaucauauaccaaagcacuaccggacuauacgagacccgccgaaagguaguagacuga

SEQ ID NO: 8772 - RNA, 4014 nt, Artificial Sequence
  Cas9 variant
augaagaaagacuacgugauaggucuagacauuggaacaaauaguguuggaugggcuguaaugacagaagauuaccaguuagucaaaaagaaaaugccaauauacggaaauacggaaaagaagaaaaucaagaaaaauuucuggggaguacgauuauucgaagaaggacauacggcagaagacagacgacuaaaacgaacagcuagaagaaggaucucacgacgaagaaaccgacuucgcuauuugcaagcauucuuugaagaagcgaugacggaccuagacgaaaacuuuuucgcacgacuccaagaaucuuuucuaguaccagaagauaagaaauggcaccgacacccgaucuucgcaaaauuagaagacgaaguagcauaucaugaaacauacccaacuauauaucacuuaaggaagaaacuagcagauagcucugaacaagcggauuuacgacuaauauaucuagcguuagcucacauuguaaaauauagaggacauuuucucauagaaggcaaacuaucgacggaaaacauaucaguaaaagaacaauuucaacaauuuaugauaauauacaaucaaacauuuguaaauggagagucaagauuaguaucagcaccguuacccgaauccguucuuauagaggaagaacuaacagagaaagcaagucgaaccaagaaaucagaaaaaguauuacagcaauuuccccaagaaaaagcaaacggacuuuucggacaauuccugaaauuaaugguaggcaacaaagcugauuucaagaaaguguuuggauuagaagaagaagcuaaaauaaccuaugcauccgaaucuuacgaagaagauuuagaagguauacuugcaaaaguaggggaugaauauagcgauguauuucuagcagcuaaaaauguauaugacgcaguagaauuaucgacuauacuagcugauucugacaagaaaucccaugcaaaauuaucaaguagcaugauagucagauucacagagcaccaagaagaccuaaagaaauucaaacgguucauaagagagaacugucccgaugaauaugauaaucuauuuaaaaaugaacaaaaagauggauacgcaggguacauugcacaugcuggaaaaguaagucaacuaaaauuuuaccaauaugucaagaaaauaauucaagacauagcuggagcugaauauuuccuagagaaaauagcucaagaaaauuuccuuagaaagcaaagaaccuucgauaaugguguaaucccucaccaaauacauuuagcagaacuccaagcaaucauucacagacaagcagcauacuacccguucuuaaaagaaaaucaagagaaaauagaacaguuaguaacguucagaaucccauauuacguagguccccuaucaaaaggagaugcaucaacauuugcuuggcuaaaaagacagagcgaggaaccuauuagaccauggaaucuucaagaaacaguagaucuagaccaaucggcaaccgcuuucauagagcgcaugaccaacuucgauacauaucuacccagugaaaaaguuuuaccaaaacauagucuguuguaugaaaaauucaugguauuuaacgaauuaaccaaaauuaguuacacggaugaccgggguaucaaagcaaacuucucagguaaagaaaaagagaaaauauuugauuaucuauuuaaaacucgcagaaaaguuaaaaagaaagacaucauacaauucuacaggaaugaauauaauacagaaaucguaacccucagcggacucgaagaagaccaauuuaacgccagcuuuaguaccuaucaagauuuauuaaaaugcggccuaacaagagcagaacuagaccacccagacaacgcagaaaaacuagaagacauaauuaaaauacugaccauauuugaagacagacaacguauacgaacacaguugaguacguucaaaggacaauucucagccgaaguucucaagaaauuagaaaggaaacacuacaccggauggggucgauuaucaaagaaauuaauaaacggcauauaugacaaagaaagcggaaaaacuaucuugggcuaucugauaaaagaugacggcgugucuaaacacuauaaucgaaacuucaugcaacuuauuaaugacucucaacugucauucaaaaaugcuauacaaaaagcccaaagcucagaacacgaagaaacucuaagcgaaacagugaacgaacuagcaggaucaccagcaaucaagaaaggcauauaucaaucacuuaaaauagucgaugaacugguugcaauaaugggauaugcgcccaaaagaaucgucguagaaauggccagagaaaaucaaacaacgagcaccgguaaacgacgcuccauucagagauuaaaaauaguggaaaaagcuauggcagagauagguuccaaccuauuaaaagaacaaccaacaacaaaugaacaacuacgagauacacgacuauuccuauacuacaugcagaacgguaaagacauguacacaggagaugaguuaucccuccacagacuuagccauuacgacauugaucauauaauaccacaaucguucaugaaagaugacucccuagauaaccugguccuaguuggaucaacugaaaauaggggaaaaucugaugacguaccaucaaaagaaguaguaaaagacaugaaagcauauugggaaaaacucuaugcagccgguuuaauaucucaaagaaaauuucaaagacuuacaaaaggcgaacagggaggcuuaacuuuagaagacaaagcacacuucauacaaagacaauuaguagaaaccagacaaaucaccaaaaacguagccggaauauuagaccaaagauauaacgcaaauagcaaagagaagaaaguucaaauuauaaccuuaaaagcaucccuaacaucacaauuccgaucgauuuucggucucuauaaaguacgugagguaaaugacuaucaucacggacaagacgccuauuuaaauugugucguugcuacgacauuacuaaaaguauaccccaaucuugcuccagaguucguauauggugaauauccaaaauuucaaacuuuuaaagaaaacaaagcaacagcaaaagcaauuauauacacaaaccugcuaagauucuuuacggaagacgaaccaagguucaccaaagacggagaaauucucuggagcaauucauacuuaaaaacaaucaagaaagaauuaaacuaccaccagaugaauauagucaagaaaguagaaguccaaaaaggagguuuuucaaaagaauccauaaaaccaaaagggccaucaaauaaacuaauaccaguuaaaaacggauuagauccccagaaauauggcggauuugacucaccaauaguggcauacacuguuuuauuuacacaugaaaaaggcaagaaaccacuaauaaaacaagaaaucuuaggaauaaccauaauggagaaaaccagauuugaacaaaauccaauacuuuuccucgaagaaaaagguuuucuuagaccaagaguacugaugaaacuacccaaauauacgcucuacgaauuuccagaaggaaggagaagacuauuagcgucagccaaagaagcacaaaaaggaaaucaaaugguauugccagaacaucucuuaacacuuuuauaccacgcaaaacagugcuuacuacccaaccaaucggaaagucuugcguacguugaacaacaucagccugaauuucaagaaauauuagaacgaguugucgauuuugcugaaguacauacacuugcuaaaucaaaaguacaacagauaguaaagcuguucgaagcaaaccaaacagccgacguuaaagaaaucgccgcaucguucauacaauuaaugcaauucaaugcaaugggagccccaaguacguuuaaauucuuccaaaaagauauugaaagagcgcgauauacaagcauaaaagaaauuuucgaugcaacaauaauuuaccaaucaacaacuggucuauacgaaacccguagaaagguaguggauuga

SEQ ID NO: 8773 - RNA, 4017 nt, Artificial Sequence
  Cas9 variant
augcaagauuacuaccuugguuuggauauaggaacaaauucaguugguugggcagugacggaugaaaacuacaacuuauuaagaaaaaaaggcaaagacuuauggggaguacgacuauuuaaagaagcccaaccggcuacagagcggcgaggucauagaagcuccagacggagaaccauacggaaaaguuugcgaaagcaacuguuaagagaauuguucgaagaggaaauaaaugcaauagacaaagacuucuuccuucguuuagaugaaucuaaauacugguuagaagacaaaaaaauagaaggaaaauauagcuuauucaacgacgaaaauuuuacagacaaagacuauuacgaaaaauucccaacaauauuccaccuaagaaaggcccuaauagagucugacgauaaggaggacaucagacuauauuucuuagcaaucaaccaaaugaugaagcgacgcggccauuuccugauagacgguaaauuaaguaacguagaagacauaaccccauucaaagaaugcauccaaaauuuaauuaacgaagaacuggauaccgaaaucgaaaccgaauucuacgacaaagccaucaagaucguaagugauuacucauuaaaaaaaacagaaaaaaaaaauuuaaucaaagaccucguaaaggaaaccgacucaauugaagacuccaaaaaaaucauuaacauauucaaccuucucauaagcggaaaauccaaaguaaacggaauuuucgaugaugaagaaauccuagaaaaaauuaaagaagauaacaaagaagauuuuuaccucacaucagagaaauaugaagaaaaccuggaguauuuuagccagcuuuuagacuauagauuugaauuaauaucauccuuaaaaaguaucuacgacuacauaauccugcaagagguacugaaagguaaaaaauaccuaaguuaugcacaaguagaacgauacaaaaaccauaaagaggacuugcgaaaguuaaaacaacucauaaaaaaauacgacaaaaauggaaagaucuacuaccaaauauucagggacgaaaauuuuaaaaagggauacguagcuuaucuaggguauuauaaaaaaaacaaaaaaaacguaccgguaaaaaaaugcgauuaugacacauuuucaaaaaacauaaaaucaacacuagacaaaauuugcgauaaggaagacccacuguauauagaacucauugauaaaauagaaaaaggaggauuccuacugaaacaaauaguaaguacaaauucaguaauuccacaccaaguacacgaacuagaacuagauaaaauccuugaaaacuuagaaaaaaauuauccaucguucaaagaaauaucugacggaguaucaaaaauugauaaaauuaaaaugauuuucaauuuccggauaccguacuauguagguccuuuaaacgacuaucauaaagacaaaguuaacucaaauacauggauaguaaagaaugaaggauuugaaaaugaaaacauuagacccuggaacuucaguaaaauagucgaugaacacgcaugugaagaagaauuuaucaaaagaaugauaaacgaguguuccuacauuccaggugaaaaaguacuccccaaaagcucgcuuuuauauagcgaauauaugguacuaaaugagcuaaacaacuuaagaguaaacggugacaaacucaacccgaaaaucaaaaaggaaauaguggaaaacauauauaaaaaagaaagaaaaguuacacuaaaaaaaauaagaaacuuccucauaauaaauaacuauguagacucgaaggucgaauuuagcggccuaagcgacggaauuaaagcgaauaugucuucauacaucgacuuugcagaaauccuagacgacaauuuugacaauaacaugguagaagaucuaauagaacaaaucacaauacacguuggaaacguaaaacuacuaacagaaaaaaucucgaacaaauaucccaaccuagaaaaaaaacaaauaaacaaaauaguaaaccuuaaguucaaagauugggcacgauuuaguaggaaacuacuaguaggaauagaaggcacggaaaaagagacgggugaaauaaacacaauaauaggauucuuaagagagacaaacgaaaauuuuauggaacuaaugaguaaccgauacacauuuagcgaagaaauaagugaaauaaaaaaaaaauauauaccaaauaaguuauccaaacaaaucgucgacgaccuauauguaaguccagcuguaaagaaaaugauuuggcaaguacucaacauaaacgacgaacuuauaaaaguacuuggaaaacaaccaaaaaaaauauuuauagagauggcacguggcaaagaagaaaaaccagaagugaaagacaguagaaaaaauaaacuaauugaacuauacaaaaaucuaggaaaagaaggcaaagaauggcucaacagaauagaagacaaaacagaagcagauuuuagaaauagagcacuuuaccuauacuacacccaaaugggaagaugcauguacacuggggaaauuauugauauagaacgauuauaugauaaagaauuauaugaucuagaucacauaauaccacgaaaaaugaaaaaagacgacagcauacacaaaaaucucguacugguuaccagaaauagcaaccaauaugaaaaaaaggauaauuaccccguaccagaggucauuaaaucacgugaaaacguucgacaccuaugguaugcgcuaaaaaaaaaaggauuaaucaccgaagaaaaauauaacagacuaacacgaauuaacccacucagugauaaagaauuaucagaauucauagagagacaacuaguagaaaccagacaaaccaccaaagucgucaaggacuuauucgaaaacuacuacaccgacucaaaaauaguaacagucaaagcaggacuuguaagugaauugagaagagauuucgaaguauuaaaaugucgagagauaaaugacuuaaaucacgcacaugacgcauuccugaacauaauuguaggcgaugugugguccaaaaaauucacauccaacccuuacaacuucgugaagaaaaacagagaaaaauauacauuaaauaacauauucacuaagaaccagaaagaucuaagaggaaaugaaaucuggaacugcgccgaagguaaaaaaagaauaauuaagacacuaaacaaaccuucaguauuauuuucaguugaaaacuuugagcaaacaggacagcuuuucgaucaaaauaucauaggaaaacaagacuauaaagagaaaacaaguuacgucccaauaaaaggagacgaaagauugcaagacauaagcaaauacggaggauauagaggaauaucaggggcuuacuuuuucauaguagaacauacagaaaaaaacaaaagaguaaaaaccauagagagcuugccaauauacaugaaaagcuacguagaagaaaauggccuccuugauuucuguaccaaugaaaugaaauuaguggauccuaaaaucauaguaaaaaaauuaaacuacaaaucggaaauaauagucgacggauucaaauaucucauaucaggcaaaaccgaaaaccggcuaagcuuagaaaccaacgaauauuuguauuggaaccauacucaaacaacagacauaaaaaaaauacuaaauaucaaugagaaaaucgaacucgaaaaauacaacggcgauauagaaucagaaagagaaaauauaauuaaauacauucaaaucauucuagaaaaauucaaacucaaaccauuuaucaaaagaagaaaucuaccuaacauagaaauaaauuucgccgacuaugaaacagagaaauuacuacaacuccucguuaaucuaauaccacucaccaccaaauaugugagcccaguagaccuaacaguuauuucaggcucgaaauacgcagguaaaguacucauaccaaagaaaauaucaaaccucaaugaggugaucuuuauaucaaaaaguaucacaggcaucuaugaaucaaggagaagaaucauuuga

SEQ ID NO: 8774 - RNA, 4017 nt, Artificial Sequence
  Cas9 variant
augaaacaagaauauuuucuuggacuagauauggggacugguucacuaggaugggcaguuacagauagcacguaccagguuaugagaaaacacggaaaagcacuauggggaacaagacuuuuugagucagcuucaacggcggaagaacgacgaauguucaggaccgcaagaaggagacuagauagaagaaacuggagaauacaagucuuacaagaaauuuucucagaagaaaucuccaaaguugauccaggauuuuuccuaagaaugaaagaaagcaaguauuauccggaagauaaaagagaugcagaaggcaacuguccagaauuaccauacgcacuauucgucgaugauaauuauacagacaagaacuaucauaaggauuauccaaccauauaccaccuccgaaagaugcugauggaaacaacagaaauaccggauauaagauuaguauaccuggugcugcaccacaugaugaaacacagaggccacuuucuccuaagcggagauaucucgcaaaucaaagaguucaaaagcacauuugaacaauugauccaaaacauacaagaugaagaauuggaauggcauauaucucuagaugacgccgcgauucaauuuguugaacacgucuuaaaagauagaaaccuaacaagaaguacaaagaaauccagacuaauaaaacaacuaaacgcaaaaagcgcaugcgaaaaagcuauacuaaaucuguuaagcggaggaaccguuaaacucucagacauauucaauaauaaagaauuagaugaaucagaaaggccaaaaguauccuuugccgacucaggguaugaugacuacauaggaauaguagaagcagaacuggcagaacaauacuauauaauagcaagugcgaaagcaguauacgacuggucagucuuaguagaaauauuaggcaacagcguaaguauuucagaagcgaaaauaaagguauaccagaaacaucaagccgaucucaaaacacuaaagaaaaucguucgacaauauaugacaaaagaagauuauaaacgagucuucguagacaccgaagaaaaauuaaauaauuauucggcauauauaggaaugaccaagaaaaaugguaagaaaguggaucucaaaucuaaacaauguacacaagcagauuucuaugauuuccuaaagaaaaaugucaucaaaguaaucgaucauaaagaaauuacucaagaaauagagucagagaucgaaaaagagaacuuccucccaaaacaagucacaaaagacaacggagucauuccauaccaaguacacgacuaugaacuaaagaaaauauuggacaacuuaggcacgagaaugccguucauuaaagagaaugcagagaaaauccagcaacuauuugaguucagaauaccuuauuauguagguccauugaaccggguagaugacgggaaagacggcaaauuuacauggucaguacggaaaagcgaugcaagaaucuauccauggaacuucacagaaguaauagaugucgaggcuuccgcagaaaaauucauuagaagaaugacaaauaaaugcacauaucuaguaggcgaagacgugcuaccuaaagauucauuaguauauagcaaauuuaugguauuaaacgaauuaaacaaccugagacucaauggagagaaaauaucaguagaauuaaaacaaagaauauaugaagaauuauuuugcaaauaucgcaaaguuacuagaaagaaacuugaacgauacuuaguuaucgaaggaauagcuaagaaaggaguugaaauaacuggaauagacggagacuucaaagcaucauuaacggcauaucaugacuuuaaagaacgccuaacggauguacaauuaucucaaagagcuaaagaggcaauaguacuaaauguaguuuuauuuggagaugacaagaaacuguuaaaacaaagauuaagcaaaauguauccaaaccuuacaacaggacaacuaaaaggaauaugcucacuaucauaccaaggaugggguagacuaucaaaaacuuuucuagaagaaauuacaguaccagcucccggaacaggugaaguauggaacauaaugacggcacuauggcaaacuaaugacaacuuaaugcaauugcucagucggaacuacggauuuacuaacgaaguggaagaauuuaacacacuaaagaaagaaacagacuugucauauaaaaccguagacgaacuauauguuucuccagcaguaaaaagacaaauauggcaaacauuaaaaguaguuaaagaaauacaaaaaguaaugggaaacgcaccuaaaagaguauuuguagaaauggcgagggaaaaacaagagggaaagaggucggauucaaggaagaaacagcuaguagaacucuacagagcaugcaaaaacgaagaaagagauuggauaacagaauuaaaugcucaaucugaccaacaacuccgaucagauaaacuuuuucuuuauuacauacaaaaaggcagauguauguauucaggugaaacuauacaacuugaugaacugugggauaacacaaaauacgauauugaccacauauauccacagucaaaaaccauggacgacucacuaaacaauagaguauuaguuaagaaaaacuauaaugcaauaaaaucagacacuuacccacucagcuuagauauacaaaagaaaaugaugaguuucuggaaaaugcuucaacagcaaggauucauaacgaaagagaaauauguacgucuaguaagaucggacgaauuauccgcagacgaacuagcgggauuuaucgaacgacagaucguagaaaccagacaaucaacaaaagcagucgcaacuauacucaaagaagcauuaccagauacagagauaguauacguaaaggcagggaacguuucaaacuuuagacaaacuuaugaauuacuaaaaguacgugaaaugaaugacuuacaucacgccaaggacgcauaccuaaauauugucguagguaacgcauacuucguaaaguucacgaaaaacgcagcaugguucauaaggaacaaccccggaagaaguuacaaucuuaaaagaauguucgaauuugacaucgaacgcucaggagaaauagcuuggaaagcuggcaacaaagggucaaucguaacugugaaaaagguaaugcagaaaaauaauauccuaguaacacgcaaagcguaugaagugaaaggaggauuauuugaucaacaaauaaugaaaaaggggaaaggucagguaccuauaaaaggaaacgacgaaaggcuugcagacauagaaaaauacggaggcuauaauaaagcagcaggaacuuauuucauguuagucaaaaguuuagacaagaaaggaaaagaaauuaggaccauagaguuugucccccuauaccugaaaaaccaaauagaaauaaaucacgaaucggcgauacaguaccuagcacaagaaagagggcuaaauagcccagaaauacuacuaucuaaaaucaagauagauacucuauucaaaguagacggauucaaaauguggcugucuggaaggacaggaaaucaacugaucuucaaaggagcaaaccaacuaauuuugagucaccaagaagcagcaauacuuaagggcgugguuaaauaugugaacaggaaaaacgaaaacaaagaugcaaaacucucugaaagggauggcaugacagaagagaaauuacuacaauuauacgauacguuccuggacaaacucucaaauacgguauacagcauacguuuaagcgcccaaaucaaaacauuaaccgagaagcgugcaaaauucaucggucuaucgaacgaagaucaaugcauaguucugaacgaaauuuuacauauguuccagugccaauccggaagugcaaauuuaaaacuaaucggaggaccaggaucugccggaauccuaguaaugaacaauaacauaacggcauguaaacaaauaagcguaauuaaccaaagcccaacaggaauauacgaaaaggaaauagaucuaauaaaguuauga

SEQ ID NO: 8775 - RNA, 4017 nt, Artificial Sequence
  Cas9 variant
augacuaaaccauacucaauaggccuagauaucggcacaaacucagucggcugggcaguuguuacugacggauauaaaguaccagccaaaaaaaugaagguacuuggcaacacggacaaaucacacauaaagaagaauuuacuaggagcucuacucuuugacucaggcaacacggcaaaggaucgaagacuaaaaaggacagcacgcagaagguauaccagaagaagaaacagaaucuuguacuuacaagaaauauuugccgaggaaauggcaaaggccgacgaaagcuucuuccagagacucaaugaaucauuccuaaccaacgaugauaaagaauuugacucucacccaauuuuuggcaacaaagccgaagaggaagcucaucaucacaaauuccccacaauauuucaucuaagaaaacacuuagccgacagcacagaaaaaagugaucuucgacuaauauaccuggcucuggcccauaugauuaaauuuagaggccacuuucucauagaaggacaacuaaaagcagagaauaccaauguacaaacauuauucgacgacuuuguagaaguuuacgacaaaacgguagaagaaagucaucuaucggaaauaucaguaucaagcauacuaacggaaaaaaucucaaaaucgcgaaggcuagaaaaucugauaaaguacuacccaacagaaaaaaaaaacacguuauuuggaaaccuaauagcucuaucacuaggacuacaaccaaauuucaaaacaaacuucaaacuauccgaagaugcgaaacuacaauuuucaaaggauacauaugaagaagaucuaggagaacuguuaggcaaaauuggagacaauuacgccgaccuauucauaucagcuaaaaauuuauaugacgcuauacuacuauccgguauacucacaauugacgacaacacaacuaaagcaccacugagcgccucuaugauaaaaagauacgaggaacaccaagaagaucuugcacagcucaaaaaauucauacgacaaaaccuacccgaucaauacucagaaguauuuucagauaaaacgaaagacgguuacgcuggauacauugacggaaaaacgaaccaagaagcauuuuauaaauauauaaaaaacaugcucucuaaaaccgaaggagcggauuacuuuuuagauaaaauagauagagaagauuuucucagaaaacaacgaacauuugacaaugguagugucccacaccaaauacaucuacaagaaaugcacgccauucugcgucgccaaggcgaauacuacccauuuuuaaaagaaaaucaagacaaaaucgagaagauccuuacauuccgcauuccauacuauguuggaccgcuugcacgaaaagguucaagguuugcaugggcugaauacaaagcugauaaaaaaguaacuccauggaacuuugacgacauacucgauaaagagaaaucagcagaggaauuuauaacuagaaugacacugaacgaccuauaccuaccagaagaaaaagucuuacccaaacacagucuuguauaugaaacuuuuaacguauauaacgagcuaacaaaaguaaaauacguaaacgagcaaggcaaagcaaucuucuuugaugcuaauaugaaacaagagauauuugaucacguuuucaaagaaaaccgaaaaguuaccaaggauaaacugcucaacuaccuaaacaaagaauuugaagaauucagaauaguaaaccuaacuggucuugacaaagaaaacaaagcauucaacaguuccuugggaacauaccacgaucuucgcaaaauauuagauaaaaguuuuuuggaugauaaaguaaaugaaaaaauaaucgaagauauaauacaaacccucaccuuauucgaagauagagagaugauccgacaacgucuccagaaauauagcgauauauuuacaacacaacaauugaagaaacuagaacgcagacacuacacaggauggggacgccucuccgccaagcugauaaacggcauaagggauaaacagucaaauaaaacgauacuuggguaccuaaucgacgacggauacaguaauaggaacuuuaugcaauugauaaacgacgauucuuuacccuucaaagaagaaaucgcacgcgcucaagucauaggagaaacagacgauuuaaaccaacuugucucggauauagcuggaucuccagcuauaaagaaaggaauacuacaaagccuuaaaauaguagacgaacuaguaaaaguaaugggucacaaccccgccaacauuguaaucgaaauggcaagagaaaaucaaacaaccgcaaaaggaagacguuccagucaacaacgauauaaacgucucgaagaagcaauaaaaaaccucgaucaugaccugaaccauaaaauauuaaaagaacacccaacagauaaucaagcacuacaaaaugacagacuauuucucuacuacuuacaaaauggcagagacauguacacugaagauccauuagacauaaaccgucucucagauuacgauaucgaccauauuaucccacaaucauucauuaaagacgauuccauagacaacaaaguauuaguauccagcgccaagaacagaggaaaaucagacaauguccccagugaagacgucgucaauagaaugagaccuuucuggaauaaacuacuaagcugcggucuaauaucgcaaagaaaauauucaaauuugacaaaaaaggaacuuaaaccagaugacaaagcagguuuuauaaaaaggcaacugguagaaacacgacaaauaacuaaacaugucgcacaaauacuagaugcaagauuuaauacaaaacgagaugaaaauaaaaaagucauacgcgaugucaagauaauaacgcuaaaaucaaaucucgucucgcaauuuagaaaagacuucaaauucuauaagguccgugaaauaaacgauuaccaucacgcacacgaugccuaucuaaaugccgugauagguaaagcauuacucgacguauacccacagcuagaacccgaauuuguauauggagaauacccccauuuccacggauauaaagaaaauaaagcaaccgcaaaaaaauuuuuuuauagcaacauaaugaauuucuuuaaaaaggaugauauucggacagaugaaaacggcgaaaucgucuggaaaaaagacgaacauauaagcaacauaaaaagaguacuaucauauccacaaguaaauauagucaagaaagucgaaauacaaaccguaggccaaaaugguggacucuuugaugauaaccccaaaagucccuuagaagucaccccaucaaaauuggucccguuaaaaaaagaauuaaaucccaaaaaauauggaggauaucaaaaaccaacuaccgcuuacccagucuuacucauaaccgauaccaaacaacucauucccaucucaguuaugaauaagaaacaauuugaacaaaacccagugaaauuuuugagagauagaggauaccaacaaguaggaaaaaacgacuuuaucaaacuaccaaaauauacacuaguggauaucggcgacggaauaaaaagauuaugggcaagcucaaaagaaauacauaaaggcaaucaacuagucguaucaaaaaaaagccaaauacuccuauaucacgcacaccauuuagacuccgaccuauccaacgauuaccuacaaaaucauaaccaacaauuugauguacuauucaacgaaauaauuuccuucucaaaaaaaugcaaauuagguaaagaacauauacaaaaaauagaaaauguauauagcaacaaaaaaaauucagcaucaauugaagaacucgcagaauccuucaucaaacuguuaggcuucacacaauuaggugcuacaagucccuucaauuuuuuagggguaaaacuuaaucaaaaacaauacaagggaaaaaaagacuacauacuaccuugcacagaagggacccuaaucagacagagcaucacaggccuuuaugaaacgaggguugaucuaucgaaaaucggagaagacuga

SEQ ID NO: 8776 - RNA, 4017 nt, Artificial Sequence
  Cas9 variant
augcgcgauuacuacauuggauuagacuuagguacaggaucacuagggugggccguaacagauagagaauaugaaauuaugagagcacauggaaaagcacuauggggagucagacuuuucgauucggcuaacaccgcagaagaaaggcgagguuucagaacugcccggagacgccuagauagacgaaacuggagaaucgaacuacuacaagaauuguuuggugaagauauagguaaggucgauagcgguuucuuucugagaaugaaggaaaguaaauacaugccggaagacaaaagggacguaaacggaaauuguccaaaauugccauaugcccuuuuuguagaggauggcuauacagacaaagacuaccacaggcaauucccaaccauauaucauuuaagaaaaugguugauggaaaccgaagaaacaccagacauaagacuaguguaccuagcacuacaucauaugaugaaacaccgagggcauuucuuauuuucaggaaacauagagaaaauaaaagaauuccaagaaacauuccggcaauauauagggaaaauuagagaagaagaacuagauuuucauuuaugcauagagggagaagaacugagggaaacggaaaauauauuaaaagacaaaaacuugacuagaagugcaaaaaaaacuagacuaauaaaauuauuaggugcucacacugcaugugaaaaagcugcauuaaaucucguagcuggcggaacugugaaauugagugauauauuuggcaauagugagcucgacgccugcgaaaaaccaaaacuaaguuucgccgaugcaggauaugaugacuacgcuggaaugaucgaagacgaacuaggagagcaacauguuauuauagaaacagcaaaagcaguauaugacuggagcguuuuggcggacauuuuaggagacuaccguuguauaagugaagcaaaagcagcaguauacgaaaaacaucaaaaagauuuaagacauuugaaagaacuaguaaaggaaaacuuaggaagagauguguacaaagagguauucguaaaaacaaacgagaaacuucccaacuacuccgcauauauagguaugacgaagaaaaauggcgucaaauccgagauggaagguaaacgaugugauagaaaagcauuuuaugacuauuuaaaaaaaacaguaguuaaugcaauaccagacgaaagcaaaaccgaauaucucagaaaagaaauggaaacagagacuuuucuaccgcgacaagucacuaaagauaaugguguuauaccacaucaaguacaucuacaggaauuagaugcuauuuuggaaaauuuaaguggcagaauaccagcacucaaagaaaacgggucaaaaauaagagacaucuucacuuuuagaauaccauauuauguaggaccacuaaauggcauugugaaaggaggagaaaggacaaauuggguuagaagaaaaaaagcaggaagaauuugcccauggaauuucgacgaaaugguagacacuggggcaucagcagaagaauucauaaggagaaugacgaguaaauguacguauuuaauacaugaagacgucuuaccaaaaaauuccauguuauauagcaaauuuaugguacucaaugaacuaaauaacguacgacugaacggagaaccuauaucgguagaacuaaaacaaaaaacauacgaagaucucuuucagagacacagaaaagucacaagaaggcgacucaccgauuauauuagaagagaagguauagcaggacgagaugcggauauuacagguauugacggugauuuuaaaggaucacuuacagcauaccacgauuuuaaagaaaaacuaacuggaugcgaauugagucaagcagauaaggaaaauauaauccucaacauaacacuauucggggaagauaaagcacuuuuaaaaaaaagauuaggagcguuauacccggcauugacagaaccacaaaaaaaagcuauaugcgcauuaucauauaaagggugggggcgacuuucacaacggcuauuagaagggauaacagcaccagcaccagagaccggagagauauggacuguaauaagagcuaugugggaaaccaaugacaaucuuaugcaaguacucagugaaaaauacuguuuugcugcagcaauagacgaagaaaacgccggugaagaacugaaagaaauuacguauaaaacuguagaacaaaugaacgugagcccagcaguaaggagacaaauauggcaaucucuacaagugauaaaagaaauauguaagguuaugggaggccccccaaagagagucuuuguagaaauggcccgagaaaaaauggaaucuaaaagaacagaaagucggaaaaaaagguuaauagaucuuuauaaaaaauguagagaagaagaacgggauuggauagaagaacucgguaacacagaagaaacacgacuaagguccgacaaacucuacuuguauuauacucaaaaagguagaugcauguauucaggugaagugauagaacuugaggaauuaugggauaaccgaaaauaugauauugaccauaucuacccacaaagcaaaguaauggaugacagcuuagacaauagaguuuugguaaaaaaggaguauaaugcugauaaaacagaugaauacccaauaagagcagauaucagaggaaaaaugagagcauucuggagaauauuaagagaagaaggguuuauaucuaaagaaaaauauaauagauugacaagaggcacagguuuugagcccucggaauuagccggauuuauagcaagacaacucgucgagacuagacaaggaacaaaagcaguagcuucaguacuaaaacagguauucccugaaacagacauaguauacgcaaaggcucgaguagcaucacaauucagacaagaauuugauuuaauuaaagugcgggaaaugaaugaucugcaccacgccaaagaugcguacguaaauaucgucgugggaaaugucuacuauacuaaauucacaucaaaugcagcaugguaugugaaggaacaucccgguaggucguacaauuuaaaaaaaauguucacuucagagagagacguagcaagaaauggagagacagcauggcgagcagguaacaguggcacuauagcaaccgucaaacgcgucauggguaaaaacaauauacuugugacaagacguucguacgaaguuaaaggagggcuauucgaucaacaacuaaugaagaaaggcaaaggacaaguacccauaaaagguagagaugaaagacuugcagacauagacaaauauggaggcuauaacaaagcggcaggcacauauuuuaugcuagcagaaagugaagacaaaaaaggagcaaaaauacgaucagucgaauacguaccauuguaucuuugcaauugcauugaaaaagacgaagaagcggcuaaaaaauaccugcaaaaagagagaggucuaaaaaauccccgaguucugauagccaaaauaaaaauugacacauuauuuaaagucgauggauucuauaugugguuaagugggaggacgggaaaccaauuaauauuuaagggggcaaaucaauuaauacucucagaaccagauaugagaauuuugaaaaaaguauuaaaauaugucaaccggaaaaaagaaaauaaaaacgcaguauuaggcgaacacgaucaguuacccgagacagaccuaauccgacuuuacgauguguucuuagacaaaauagaaaacacaguuuaccacguaagauugagugcucagcagggaaccuuaacgaaaaacaaagacacauuuugugaauugucaaaugaggauaaauguauaguacucagugaaauccuacacauguuccaaugccaaaguggaagcgcaaaucuuaaacuuauaaagggaccuggaagugcaggaauuuuaguauuaaauaauauuauaucaaaguguaaccaggugucaauaauacaccaaaguccaacuggaauauaugaacaagaaauagaucuaaaaaagauauga

SEQ ID NO: 8777 - RNA, 4020 nt, Artificial Sequence
  Cas9 variant
augaacaaagcauauacauuaggguuagacauagggacaaacagcguaggaugggccgucgucacagaugauuaccgauuaauggcaaaaaagaugccuguacacagcaaaauggaaaaaaagaaaauaaaaaaaaacuucuggggagccagacuuuucgaugaaggacaaacagcagaagaaagaagaaacaaacgcgcuacacgacgcagacuacgacgacguaaauaccguauccuggaauuacaaaaaauuuucuccgaagaaauauuaaaaaaagacucucauuucuuugcacguuuagacgaauccuuccuaaucccagaagacaaacaauacgcaagguucccgauauucccaacucuccuugaagaaaaagcauacuaucaaaauuacccuacuauauaucauuuaagacaaaaauuagcugacucuacugaaaaggcugauauuagacuagucuaucuagcucuagcgcacaugaucaaauauagaggucacuuucuauuugaaggugagcuagacacugagaacaccagugucgaagaaacauuuaaagaauuuauagacauauacaacgaacaauucgaggaagguaucauauucuacaaagauauaccucuaauacuaaccgacaaacuauccaaaucaaagaagguagaaaaaaucuuacaauauuaccccaaggaaaaaacaacagggugucucgcucaauucuuaaaacuaaucguaggaaaucaggguaacuucaagcaagcauuucacuuagaugaggaagucaaaauacaaauaucaaaagagacuuaugaggaagaccuugaaaaauuacuaagaaaauccaacgaagaaaugauagacguauuucuacaaguaaaaaaaguguacgaugcuauacuacucucugacauacuaaguacuaaaaugaaagauaccaaagcuaagcugucugcaggcaugauagaacguuaccaaaaccacaaaaaagaucuugaggaacugaaacaauucguuagagcacaccuccacgagaaagucacaguauucuucaaagacagcuccaaagauggauaugcaggauacauagaugggaaaaccacacaggcagauuucuauaaauuccuaaaaaaagaacuaacaggaguaccagguucagaacccaugcuagcaaaaauugaccaagaaaauuuucuauuaaaacaaagaacaccaacuaacggaguaauaccacaucaaguucaucucacugaauucaaagcaauaauagaccaacaaaaacaauauuauccauucuuagaaaaaucgaaagaaaagaugauucaguugcuaaccuuuagaauuccguacuacguaggaccgcuagcucaggacaaagaaacuucauccuucgcauggcuugaaagaaaaacgacggaaaaaauuaaacccuggaaugcaaaagauguaauagacuacggcgcauccgcaaccaaauuuauacaaagaaugaucaauuacgauacauaccuaccgacagaaaaaguccuaccaaaauauucaaugcuauaucaaaaauauaccauauucaacgaacuaacaaaaguggcauacaaggaugauagggguauuaaacaucaauuuucuucagaagaaaaauuaagaauuuuccaagaauuguucaaaaaacagaggaggguaacaaaaaaaaaguuacagcacuuccuaagugcaaacuauaauauagaagacgcggaaauacuaggcgucgauaaaguguuuaauucaagcuacgcgacauaucacgacuucuuagaauuagcuaaaccauauaccgaaaaaauaauagaauuguuagaacagccugaaauggaagaaauguucgaagacaucgucaagaucauaacuauauucgaagacagagaaaugguccguacccaacucaaaaaauaccaaagaauccuaggugaagaaaucuuuaaaaaacuagucaaaaaaaaauacacaggguggggaagacucaguaaacgccugaucaauggaauaagagaccaaaaaacaaauaaaaccauacuggacuauuuaaucaacgaugaugauuuccccuauaauagaaauaggaauuuuaugcaacucauuaaugaugaucaccuauccuuuaaagaagaaauagcaaaagaguugacacucucagauaaacagucauuauuagaaguagucgaagcgaucccuggaucacccgcaauaaaaaaaggaauuuggcaaacucuaaagauaguagaagaacuaauagcaaucauaggcuauaaaccaaaaaauauagucaucgaaauggcaagagagaaucaaacaacuacagggggcaaaaacagaaguaagccucgccugaaaucacuugaagaagcauugaaaaauuuugacucacaacuauuaaaagaacgcccaguagacaaccaaucacuccagaaagauagauuauacuuauauuacuuacaaaacggcaaagacauguacacaggagaaucucuagauauugauaggcugucugaauaugauauugaccauauaauuccacggucauuuauuguagaccacucacuggauaacaaaguacuuguauccucuaaagaaaacagacuaaaaaaagaugacguaccagacucuaaagucguaaaacgcaugaaggcauauugggaaaaauuauuacgggcaaaccuaauuucugaacgaaaguucucauauuuaaccaaguuggaauuaacagacgacgacaaagcuagauucauacaacgacaacuagucgaaacacgccaaauaacaaaacauguagccgcaauucuucaccaauacuucaaccaaacacaagaacuugagaaagaaaaagacauacgaauaaucacccuuaaauccucuuuaguuucucaauuccgacaaguauucggcauccauaaaguccgagaaauaaaucaccaucaccaugcucaugacgcauaucuaaaugcaguaguagcccuugcccuauuaaaaaaauacccuaggcuagcaccagaauucguauacggaucauucgcaaaauuccauuuaguuaaagagaauaaagccacagcaaaaaaggaauucuacuccaacauacuaaaauuuuucgaaaaagaggaacaauuuugugacgaaaacggagaaaucuucugggauaaaagaaaacacauacaacaaauuaaaaaaguaauuucaucucaucaaguaaacauaguaaaaaaaguugaagugcaaacaggcucuuuuuacaaagaaacagucaacaccaaagaaaagccagauaaacucaucaaaagaaaaaauaacugggauguaacaaaauauggaggauucggaaguccaguagucgcauaugccguugucuucacauacgaaaaaggaaagaaccacaaaaaagccaaggccauugaaggaauaacaaucauggaacaagcacuauuugaaaaagauccgaucucauuucuuaucgaaaaagguuacagcaacgugaaccaauucauaaaacuaccaaaauacacauuauuugaauuagcaaauggacaacgacgaaugcuagcaucgcaccaggaacuccaaaaagcaaacucauucauacucccugaaaaacuagugacauuauuauaucaugcaaaucacuaugaugaaauagccuauaaagacuccuacgacuacguuaaugaacacuuuaguaacuuccaagauauucucgacaaaguaauaauauucgcagaaaaauacacaagcgcaccucaaaaauugaaccaaauaauugcaacuuacgaaaaaaaucaagaagcagauagaaaaauaauggcacacagcuucguaaaucuaaugcaauucaacgcacuaggagcacccgcagacuucaaauucuuugauacaaccauuacuagaaaaagauauacaucccucacagaaauauggcaaucaacaaucauauaccaaagcguaacggguuuauaugaaacacgaaggagaauggcagaucuaugggauggaguccaauga

SEQ ID NO: 8778 - RNA, 4020 nt, Artificial Sequence
  Cas9 variant
auggaacgcuaccacauaggacuagacauuggcacaucaaguauagggugggcuguaauaggagacgacuucaaaauaaaaaaaaaaaaaggaaaaaaccuaauuggaacucggcucuucaacgaaggagcaacagccgcagaacgucgaggguuucgaacacaaagacgacgcuuaaaccguagaaaauggagacucaaacuacuagaggaaaucuucgauccauauauggcggaaguagacgaauacuucuucgcccgccuuaaaagcucaaaccuuucuccaaaagauucuaacaaaaaauacuuaggaagcuuacucuucccagacaaaucagacuccaauuuuuaugacaaauauccaacaauauaccauuuacgacgcgaccucauggagaaagaugaaaaauucgaucuccgagaaauauaccucgcaauacaucacaucgucaaauauagagggaauuuccuagaaaaagucccggcaaagaauuacaaaaauucaggagcaagcauuggauuuuuauuagaagaaguuaacucccucuacaaagauauuauaggcgacgaaucaauagcuauacuaaauuccgagaaauuugaagacguagaaaaaauuauucuagacgaagaaacgagaaaucucgacaaacaaaaaucaguagggaaacuacucgucgaagacaaaaaaaaaaaaaacauagucacagcauuuucaaaagccauauuuggauauaaguucaacauugaagacuuacuauuaauagagaaugacgaaaaaaauaaacuuacguucaaugaugagaacauagaugacauauuuaacgaacuaucacacagucuagaugauaaacagauggaccuacuaacaaaaacgagagagauuuacuuuaaauuuaaacucaacaugauaguucccacaggguacacauuaucagaaaguaugaucgaaaaauaugaaaugcauaaagcacacuuaaaaauguacaaagaauuuauaaacacucucaacacaaaagacagaaaaauauuaaaaaaugcauacagcgauuacauuaacacagaaaaagcaaaggcagccaacgcccaagaaaacuucuacaaaacuguaaaaaagaucauaaaagacaacaauagcgacaccgccaaaaaaauaaucguacuaauugaugagggcaacuucaugccaaaacaacggaccggagaaaauggcguuauaccacaucaacuucaccagaucgaacucgaccggaucauagaaaaccaagccaaauacuacccaugguuagcagaagcaaacccggucgaaaaaaacagaaaauucgcgaaauauaaacucgacgaguuaguaacauuuaggguaccauacuauguagguccccuaaucgacaaaacugaauccaauaaaaacgaaaaagaaaccaaauucgcauggaugguacggaaagcaaaaggaacaauuaccccauggaacuucgaaaaucuaguggauaggacggaaucagcuaacagauucauaaaaaggaugacaucuaaagacaccuacaucaucggcgaagacguacuaccagcgucaucacuacuauacgaaaaauucaaaguacucaacgaacuaaauaauauuaaaguuaacgaaaaaaaauuagacaucgaacaaaaacaagacauauaucuaaaccuauuuacaacagcaaaaaacgugacuaaaaaaucacuggcgacguauuuaaauugcucagcagacagcauauccggauuauccgauggagaaaaauucaauucaucuuuaaguagcuacauagaccugaaagcuauacuaggaaacauaguggacgauuguaauaaaaacgaagacuuagaaaaaauaaucgaguauaguacgguauucgaagauggaaauauauacaaagaaaagcuuucugaaauauccugguuaacagacgaacaaauugaaaaacuuucaaauauccauuucaaaggcugggggagguuaucuaagaaacuauuaacgcaaaucaccaaugaaaacggcgagcgaauaauugaugcccuauggaacacuucgaacaacuucaugcaaauaauuaacgacgagucgauacaagcuaaacucgccgaaaucaacggaaaauacgcgggaaaaagugaccucgaagauauauuaagugaagcguauacauccccccaaaauaaaaaagcaauaagacaaguaaugaaaguaguagaagauauugaaaaggcaaugcaaugugaaccaacaucaauuucaauugaauucaccagaaaaaaacaaaaaaguagacuuacgaacacacgauauaaaaaaauuucugaugucuacgaaaaaaucgcagacgaagucauaucagaauacgaacugcgcaaacuccagagcgaacuagacaguaacgcuaacaacaugcgagacagauacuacuuauauuuuaugcaacuuggcagagauauguacaccggagagaaaaucaacauagacgaguuacaccaaagauacgauauagaucauauucuaccacaaucauuuauaaaagaugauaguauaaacaauagaguacuaacgagaaaagacgucaauaacaaagaaaaaagugauaaaacagccgcugaucuuuacgccguagaaauguccgacuuuuggagaaaauugcgaaaacaaggccuaauaacugaacaaaaauauaaaaaccuccuaacaaaauccgacaguauagauaaauacgcaaagaagggcuuuaucaaaaggcaguuaguagagaccucacaagugguaaaacuaguugcuaauaucuuacaagacaaauauuccgacaccaagauaaucgaaguuagagcaaaacucaacucgaacuuacgcgaagaauacaaacuuauuaaaaaccgagcaguaaaugacuaccaccacgccauagacgguuacuuaaccacguuuauaggacaauaccuauacaaaacuuaccccaaauuaagaaguuacuucguuuauaacgacuucaagaaauuggacaguaacuacuuaaagcacaugaaaaaauucaacuucuuauggcaacuacaagacgauaaaacgaucgauauauacgacaauguaaauaauaaauucguacugaauguaccugaaaugaaaaaauauauacaaaaaauauauaacuacaaguauauguuaguuagcaaagaggugacuacuaaaaauggagcguuuuaugaccaaaccaaauauaacgcuaaaacgguuaaucucauacccaucaaaaagaauaaaccaacaaacauauauggcggauacaaaggaaaaguaucaucauacaugaugcuaguaaaaauacguaaaaaaaaagaaguaauauacaaauucgugggcguuccacgacucuggacagaugaauuagauagacuaaaagauacgacagaacgcaagauauuacucaaugaaauagccaaaaauucguuaucaaaaacagaacaagauuucgaggucauacucgauaaaguauauuacggccaauuaauaauagacggaaaucaaaaauauacacuagguucaagugaguauaaauauaacgcaaugcaacuacaccucuccaaacacgcacucgaaguucuagccaaagaaaacguaaaagacgcagaaauaacagauaaagacuuagucucuguauaugaggaaauacuaucaguaguaaacaaauacuucgaacuauacgacaucaacaaauuuagacaaaaacuaaacgaaggcuuagaaauauuuagaaaauuaccaguauacaacguauacgagucaaacaaaaucaaacagguugggaaauucgaaguacucaauagaauacuuaugggacuacacgcaaaugccaugaucacagacuuaaaaguacuuggaauaaaaacgaaacuaggacaaaugcaaguaaauggcgggauaaaacuuucacccgacgcaaaacugaucuaccaaagccccacaggaauuuuuuccagagccguacgagucaaagaucucggauga

SEQ ID NO: 8779 - RNA, 4020 nt, Artificial Sequence
  Cas9 variant
augucacucaacacaaauaagaaauacaauauuggacuagacauugguacuacaucugucggcugggcugucacagaugcagacggccaaaaauuacucaaagccaaaaauaaaaaccuaugggguguaucucuauuugaagcagguaaaaccgcagcagaacgccgcggauaccgaucaacacgaagaagacucaaccaccgcaaauuccguuuacgcuuauuggaagauauguucgagaaagagauacugagcaaagacccaucauucuucauccgacucaaagaagcauuccuaucaccaaaagacgaacaaaaacaauuuaaagguaacauauuauucaacgacaaagauuauacagaugcagauuauuacgaacaauacaaaacaauauaccaccuuagauaugaucuaauaucucaacaucgacaauucgauauacgagagguauaucuugcaauucaccaucucaucaaauaccgaggacauuucauauaugaagaccaaacuuucaccacggacggcaaucaacuucagcaccauauaaaagcaauaauuaccaugauaaacagcaucuuaaaucgaauuauaauaccagaaacaauugauauaaacgucuuugagaaaacacuguuagaccgaacaaugaauagaucaagcaaaguuaaguucuuaaucgaacugacaggcgaagacaaacaagacaaaccacuauuaaaagaauuauuuaaucuaauagugggacuaaaagcaaaaccggcaaguauuuucgaacaggaaaacuuggcaacaauugucgaaacaaugaauauguccacagaacaaguacaacuagauuuacuaacccuagcugauguacucgcugacgaagaauacgacuuauugcuuacugcacagaaaauauacucagcaauaauauuagaugaaucaauggauggauaugaauauuucgccgaagcaaagaaagagucauauagaaaacaucaagaggaacuuguucuaguaaagaaaauguuaaaaaguaacgcgaucacaaacgaugaacgugcgaaauuugaauacuucuauacagauuauauaggugcaaaaaguucuaacuacgaagaaagcaaaaucauuaagaaaggacuuuccgcggcauacggaaaauacucuaaagaagaaagacuuuucaaacacauugaauuacuauuagcuaaagaaaacguacucacuacuguagaacaugaccugcuugaaaagaacauuacauucgcaagucuucuuccccuucaacgaucuaguagaaaugcagucaucccauaucaaguccaugagaaagaacucguagcgauuuuagaaaaucaagcaacauacuacccauuccuacuagaacaaaaagacaauauccauaaacuacucacauucagaaucccauacuacguugguccauuggcagaccaaaaagacucagaauuugcauggaugguacgaaagcaagcaggaaaaauuaccccguuuaacuucgaagaaauggucgacauugaugcaucaucagaggcauucaucaaaagaaugacaaacaagugcacuuacuuaauacacgaagauguaauccccaaacacuccuucagcuacgcaaaauuugaaguacuaaaugaauuaaacaaaauaagacuggacggaaaacccauugacauaccucugaagaaaagaauauucgaaggcuuauuucuagagaaaacaaaaguuacucauaccucucuuaagaaauggcuagcggaauaugaacacaugaccguauccguaguccaagguacccaaaaagaaacagaauuugcaacaucucuccaagcauuccaucguuucguaaaaauuuuugaucgagaaaccgucagcaacccggcaaacgaagaaauguuugagaaaauaauuuauuggucuacaguauucgaagacaagaaaauuaugcgucgaaaacuauccgaauacccccaacuaacagaacaacaacaaguucaacuggcacaagucagauuccgagguuggggacgacuaagccaaagauuaaucaauaggauuaaaacaccaguuucaggagaugaagaccacaaauuaucaauaaaugaaaucuuauggcaaacaaaugaaaacuuuaugcaaauaauucgaaauaaagauuaccucuucaagaaaauuauugaggaacaauucgaaaacgaaacagcccuuuuaaacaaacaaaggauugaugaauuagcaacaucaccagcaaauaagaaaggaauuuggcaagcaaucaaaauagucaaagaacuagaaaaagucuuacaacaaccugccgaaaauauauucauagaguucgccagaagcgacgaagaaucuaaaagaucaaccccaagagacaaauucauagaaaaagcauaugcacaacuaaagaaagaaacggauacauucaaucuagaacaucuaaaagaauuaaaacaaagauccaaacaacuuuccucgcaaagacucuuccuauauuuuauccaaaaugguaaauguauguacaguggagaacaccuagauauagaaagauuggauagcuaugaaguagaccauauuuugccacaaaguuauaucaaagauaauuccauagaaaaccucgcuuuaguaaagaaaguugaaaaccaaagaaagaaagacucgcugcuacuaaauagcagcaucauaaaccaaaacuauagucgaugggaacagcugaaaaacgcaggucuaauaggugaaaagaaauuuagaaaucuaacaagaacaaaaauaacagauagagacaaagagggauucauugcuagacaacucguugaaacaagacaaauuacuaaacauguaacccaauuacuacaacaagaauacaaagauacaaccaaaguauucgcgauaaaagcaacuuuaguaagcgaccuacgaagaaaauuugaguucauuaaaaaucgaaacguaaaugacuaucaccacgcgcaagacgccuuucuuguagcauuccuaggaacaaauauaacaaguaauuaucccaaaauagaaauggaauaccuuuuuaaagguuaucaacauuaccugaaugaaguaggaaaaucagcagcaaaaccuaaauuuacauucauaguagaaaaccuaucaaaacaacaauacaauaguacaaccggagaaguuaaauggaauccagaaguagauauagcaaaauuaaaacgaauacucaacuucaaacaauguaauauugucagaaagguagaagaacagucaggagcgcuauucaaagaaacaauauacccuguagaagaaucgucaucaaaaacaauaccacuaaagaaacaucuagauacagcuauauacggcggcuacacagccguaaauuaugcaucauacgcacuuauacaauuuaaaaagggcagaaaacuuaaacgcgaaauuaucggaauaccucuagcuguccaaacgcguauagauaauagcgaaacaucccuccaaaccuauauagcagaacaaauaaaaagcgaaguggaaaucuuaaacggaagaauacuuaaauaccaacuaauaucuaauaacggaaacagacucuauauagccggcccccgugaacgacacaacgcccgucaacuaauaguuucugaugaagcagccaaaguaauauggcucaucucaaccaaacaagcaguugaagcaaccuuccuuaaacacuacacucuagaacaccucgaagccguuuucgaagaacuaauacguaaacaggcagcugauuaccaaauuuuugaaaacuugaucaagaaaauagaagucaauaaagcauauuucuacucaugcacauauaacgaaaaaguaaaaguaaucgaagaauuauuaaaaauaacgcaagcaaaugccacgaacggcgaccuuaaacuucucaaaaugacuaacagagaaggacgauuaggaaguguaagcguagcacuagauuucaaaaucauaaaccaaagcgucacaggguuauaccaaagcaucgaagauuacaauaacuga

SEQ ID NO: 8780 - RNA, 4020 nt, Artificial Sequence
  Cas9 variant
augucacucaauacaaacaagaaauauaacaucggacucgacauaggaacaacaucaguaggaugggcaguaacugaugcagacggucaaaaacuccuaaaagccaaaaauaaaaaccuauggggcguuagucuuuucgaagcaggaaaaacagcugcagaacgacguggauacagaucaaccagacguagacuuaaccacagaaaauuccgauuacgauuacucgaagacauguucgaaaaagaaauccuauccaaagauccaucauuuuucauaagauugaaagaagcauuccuaucacccaaagaugagcaaaaacaguucaaaggaaauauacuauucaaugacaaagacuacaccgaugcggacuauuacgagcaauauaaaacaaucuaccauuuacgauacgaccuaauuucgcaacacagacaauucgauauccgagaaguauacuuagcaauacaccaccuaauuaaauacagaggacacuucauauaugaagaucaaacuuucaccacggacgggaaccaacuacaacaccacaucaaagcaauaaucacaaugauaaauucaauacugaaccgaauaauuauuccggaaacaaucgacauuaauguuuuugagaaaacauuauuagaccgaacuaugaaccguucuucaaaagugaaguucuugaucgaacuuacaggagaagauaagcaagacaaaccacuuuuaaaagaauuauucaaucugaucguaggacuuaaagccaaaccagcaagcauuuuugaacaagaaaauuuagcuacuaucguggaaacaaugaauaugagcacagaacaaguccaacucgaccuuuugacucucgcugauguacuagcugacgaagaauacgaccuccuacuaacagcacagaaaauauacagcgcaauaauauuagacgaaucgauggacggauacgaauauuucgcggaagcaaagaaagaaucguauagaaaacaucaagaagaauuaguacucguaaagaaaauguugaaaagcaaugcaauuacaaaugacgaaagggcaaaauucgaauauuucuauacagacuacauaggugcgaaaucuucaaacuaugaagaaucaaaaauaaucaagaaaggccuauccgccgcauauggaaaauauucaaaagaagaacgacuauuuaaacacauugaacuacuacuagcuaaagaaaauguuuuaacaacuguagagcaugaucuucuugagaaaaauaucaccuuugcuucacucuugccuuuacaacgcuccuccagaaacgcuguuauaccauaccaaguacaugaaaaagaacucguagcuauacuagaaaaccaagcgacuuauuauccauuucuauuggaacaaaaagacaacauucacaaacuacuaacauuccgaaucccauauuacguaggcccacuagcagaccaaaaagacagugaauuugcuuggaugguuagaaaacaggcaggcaaaauaaccccauucaacuuugaagaaaugguagacauagaugccagcucagaggcauucaucaaaagaaugacuaacaaauguacauaucucauacacgaagacgugauaccuaaacacuccuucuccuaugcuaaauuugaaguacucaaugaauuaaacaaaauacgacuagacggcaaaccaauagauauaccacuuaagaaacgcauuuuugaaggauuauucuuagagaaaaccaaagucacacauacaucacuuaagaaaugguuagcagaacaugaacacaugacagucagugugguacaaggcacacaaaaagaaacagaguucgcgacuuccuuacaagcauuccacagauucguuaaaauauucgaucgcgaaaccgugaguaauccagcaaaugaagaaauguuugagaaaaucauauacuggucuacaguauucgaagauaagaaaaucaugagacgaaaauuaucagaauacccacaacuaacagaacaacagcaagugcaacuagcacaaguacgauuucgcggcugggguagacuuucacagcguuuaauaaaccguaucaaaacucccguaucuggagacgaagaucauaaauuaaguauaaacgaaauacucuggcaaacaaacgaaaauuucaugcaaauaauccguaacaaagacuaccuauucaagaaaauuauagaagaacaauuugaaaaugaaacagcacucuuaaacaaacaaagaauugacgaacuugcaacaagccccgcaaacaagaaagggaucuggcaggcaauaaaaauaguaaaagaauuagagaaaguacuacagcaaccagcagaaaauaucuucaucgaauuugccagauccgacgaagaaucaaaaagaucaaccccucgugauaaauucauagaaaaggcuuacgcucaauuaaagaaagaaacagauaccuuuaaucucgaacauuuaaaagaauugaaacagcgaagcaaacaacuuucaucacaacgucucuuucuauauuuuauacaaaacgguaaauguauguacuccggcgaacaccucgauauagaacgacucgacucauacgaaguagaccauauucuaccacaaucuuacauaaaagacaauucaauagaaaaccuagcucuagucaagaaagucgaaaaccaaagaaagaaagacagccuacuacuaaacagcagcauuauaaaucaaaacuacagcagaugggaacaauugaaaaaugcaggucuaaucggugagaagaaauuccgaaaccucacgcgaaccaaaauaaccgaccgagacaaagaggguuucauagcucgacaacucguggaaacacgucaaaucacuaaacauguaacacagcuuuuacaacaagaguauaaagacacgacaaaaguuuucgccauaaaagcaacucuaguaucagaccuacguagaaaauucgaauuuaucaaaaaccgcaacgucaaugacuaccaccacgcccaagacgccuuucuuguagcuuuucuaggcacgaauauaacaaguaacuauccaaaaauagagauggaauacuuauucaaagguuaccaacauuauuugaacgaaguagguaaauccgcagcaaaaccaaaauuuacuuucauaguagagaaccuaucaaaacaacaauacaauucaacaacaggugaaguaaaauggaauccugaaguugacauagcuaaauuaaaaaggauacucaacuucaaacaaugcaauaucguaagaaaaguagaagaacaaucuggagcacucuuuaaagaaaccaucuauucaguagaggaaucaucuucaaaaacaauacccuuaaagaaacauuuggauacagcaauauacgguggauacacggcagucaacuacgcauccuacgcacucauucaauuuaagaaagggcgaaaacucaaaagagaaauaauaggcauaccuuuagcaguacagacaagaauugauaacagugaaaccagucuccagacguauauagcagaacaaauaaaaucugaaguugaaauucuaaauggaagaauccuaaaauaccaauuaauaagcaacaauggaaauagauuauacauagcuggcccgagagaaagacauaacgcacgacaacuaauagugucagaugaagcagcaaaagucauaugguuaauaagcacaaaacaagcaguagaagcaaccuucuuaaaacacuacacucuagaacaccuugaagcaguauuugaagaauuaauccgaaaacaagcagcagacuaccagauauuugaaaacuuaaucaagaaaauagaaguuaauaaggcuuacuuuuacucauguacuuauaaugaaaaagucaaagucaucgaagaacuucuuaaaauuacccaagcaaacgccacaaacggugaucuaaaauuauuaaaaaugacaaaucgugaaggucgccucggaucaguaucgguagcauuagacuucaaaauuauaaaucaauccguaacuggauuauaccaaucaauagaagacuauaauaacuga

SEQ ID NO: 8781 - RNA, 4020 nt, Artificial Sequence
  Cas9 variant
augaaaaaagaauauaccaucggauuagacauaggaacaaauagcguaggcuggucaguacuuacugacgauuacagacucguauccaaaaaaaugaaaguagcaggaaacaccgaaaaaagcucgacgaaaaaaaacuucuggggaguaagauuauucgaugaaggccaaacagcugaagcacgaagaucuaaaagaacugccagacgccguuuagccagaagacgucaacguauccucgaacuacaaaagauauuugcuccagaaaucuuaaaaauugacgagcauuucuucgcacgacugaacgagucauuucuuguucuagacgaaaaaaaacaaucgagacauccgguguuugcaaccauuaaacaagaaaaaucguaccaucaaacauaccccacaauauaucaucuuaggcaagcccuagcagacagcucagaaaaagcagauauucgacugguauacuuagcaauggcccaccuauuaaaauauaggggacacuuuuugaucgaaggagaauuaaacacagaaaauucuuccguaacugaaacauuccgacaauucuuaagcacauauaaccaacaguucuccgaagccgacgacaaacaaacagagaaauuagacgaagcaguagauuguaguuuuguuuuuaccgaaaaaaugucaaaaacgaaaaaagcagaaacccuacuaaaauacuuuccgcacgagaaauccaauggauaucuaagucaauuuauaaagcuaaugguaggaaaucaaggcaacuuuaaaaauguguucggucucgaggaagcaaaacuccaauuuaguaaagagaccuaugaagaagaucuugaggaauuacuagaaaaaauaggagacgacuauauagaucuuuuuguucaagccaaaaauguguaugacgcuguacuauuaucggaaauacuaucugauaguacuaaaaacacacgcgccaagcuaucagccggaaugauaagaagauaugacgcccauaaagaagaccuaguauuacucaaaagauuuguaaaagaaaaucuaccaaaaaaauacagagccuucuuuggugacaacucugucaacggauacgcgggcuacaucgaagggcaugcuacacaagaggauuucuauaaauucgucaaaaaagaauuaacagggaucagagguagugaaguauuccuaacuaaaauagaacaagaaaauuucuugaggaaacaacgaacauuugacaaugguguaaucccucaucaaauucaccuaacagaacuacgagcaauuauagccaaucaaaaaaaacacuacccauucuugaaagaagaacaagaaaaacucgaaucccugcucacauuuaaaaucccuuacuaugugggcccucuugcaaaaaaacaagaaaauaguccauuugcaugguuaauuagaaaaucagaagagaaaaucaaaccauggaaccucccugaaauaguggauauggaaggcagcgccguucgauucauagaaagaaugaucaauaccgacauguacaugccucauaauaaagucuugccaaaaaacucucuccuguaccaaaaauucagcauauauaacgaauuaaccaaaguaagauaccaagaugaacgcggccaaaugaacuacuucucuuccauugaaaaaaaagaaauauuucaugaacuauuugaaaaaaacagaaaaguaacuaaaaaagacuugcaagaauuccuauaccuaaaguaugacauaaaacacgccgaauuauccggaaucgaaaaagccuuuaacgcaucauacacgacauaucacgauuuccuaacgaugagugaaaauaagagagaaaugaaacaaugguuagaagacccagaacuagccuccauguuugaagaaaucaucaaaacacuuacaguauucgaagaucgagaaaugauuaaaaccagacuaagucaucacgaagcaacacuaggaaaacacauaauaaaaaaauugacgaaaaaacauuauaccggaugggggcgguuguccaaagaauuaauucaaggaauaagagacaaacaaaguaacaaaaccauucucgacuauuuaauuaaugacgaugauuucccacaccauagaaauaggaauuucaugcaacuaauaaaugacgauagcuuaagcuuuaaaaaagaaaucaaaaaagcacaaaugauaacggauacagaaaauuuggaagaaauagugaaagaacucacugguucccccgcaauuaaaaaagguauauuacaauccuuaaaaaucgucgaugaaauagucggaauaaugggauaugaaccagccaauaucguagucgaaauggcaagagaaaaucaaacgacaggaagagggcuuaaaagcuccaggccaagacuuaaagcccuagaagaaucccuaaaagauuuuggaagucaacuauuaaaagaauaucccacagauaacucaagccuucaaaaagaucgacuauacuuauauuaccuccaaaacggacgagauauguauacaggcgccccacucgacauacacagacuaagugauuacgauaucgaccauauuauaccucgcucauucacuacagauaacucaauugacaauaaaguguuagucucuucaaaagagaaccgacugaaaaaagacgaugucccaucagaaaaaguaguaaaaaaaaugcguucguucugguacgaucuuuauucauccaaacuaauaucgaaacgcaaauuggacaauuuaaccaaaauaaaacuaacggaagaagacaaagcugguuuuaucaaacgccaacuuguagaaacucggcaaauaacuaaacacguagcaggcauuuuacaccaccguuucaauaaagcagaagacacaaacgaaccaauaagaaaagucagaauaaucacacuaaaaucagcacuaguaagucaauucagaaacagauucggaaucuacaaggugagagaaauaaaugaauaucaucaugcacaugacgcauaccugaaugguguaguagcacuagcacuucucaaaaaguauccucaauuagcgccagaguucguauauggcgaauauuuaaaauuuaaugcccacaaagcaaacaaagcaacgguaaagaaagaauuuuauagcaauauuaugaaauucuucgaaagugacacucccguaugcgacgaaaacggggaaauuuucugggauaaaucaaaauccauagcccaaguaaaaaagguaauuaaccaccaccauaugaauauuguuaaaaaaacagaaauacaaaagggagguuucuccaaagaaacaguugaaccaaaaaaagacucaucuaaauuacucccuagaaaaaacaauugggaucccgcaaaauauggaggccugggcucaccaaacguugcauacacaguagcauucacguaugaaaaaggcaaagcuagaaaaaggacaaacgcucuagaaggaauaacaauaauggaaagagaagccuuugaacagucaccuguauuauucuuaaaaaacaaagguuaugaacaagcagaaaucgaaaugaagcuaccaaaauacgcacuuuucgagcuagaaaacggcagaaaacguaugguagccagcaacaaagaagcacaaaaagcaaauagcuuccuucucccagaacaccuaguaacguugcuuuaucacgcaaaacaauaugaugaaauaucacauaaagaaaguuucgacuauguaaacgaacaucauaaggaguuuucugaaguuuucgcacgaguucucgaauucgccggaaaguacacauuagcagaaaaaaacaucgagaaacuagaaaagauauauaaagaaaaccagaccgacgaccuugcaaaacuagccuccucauuuguaaauuuaaugcaauuuaacgcaaugggugcaccugcagacuuuaaauucuuugacgugacaauaccaagaaaaagguacacaucauuaaccgaaauauggcaaagcacaauaauacaccaaucaaucacuggccuuuacgaaacacguauaagaaugggaaaguga

SEQ ID NO: 8782 - RNA, 4023 nt, Artificial Sequence
  Cas9 variant
augaaaaaagaauauacaauuggacuagauauaggcacuaacucaguaggauggagcguccuaaccgacgacuaucgauuaguaucaaaaaaaaugaaaguagccggcaauacggaaaaaucuagcacgaaaaagaauuucugggguguaagacuauucgacgaaggacagacagcggaagcaagaagaaguaaacgaacggcgagacgaagacucgcacgacgacgacaacgaauacucgaacuacaaaaaauauuugcaccugaaaucuuaaaaauagacgaacacuuuuuugcucgucugaacgaauccuuucuaguucucgacgaaaaaaaacaaucaagacauccgguauuugcaaccauaaaacaagagaaaucauaucaccaaacuuacccaaccaucuaccaccuacgucaagcacucgcagacuccagugagaaagccgauauacgauuaguauaccucgcaauggcucaucuacucaaauacagaggacacuuuuuaauagaaggcgaguuaaauacggaaaacucauccguaacggaaaccuuuagacaauuucuaagcacauauaaccaacaguucucagaagcagacgacaaacaaacugagaaacuagacgaagccgucgauuguaguuucgucuucacugaaaaaaugucaaagacgaaaaaagccgaaacccuacucaaauacuucccacacgaaaaaucaaacggauaccucucccaauucauaaaacucaugguaggaaaccaaggaaacuuuaaaaauguauucggucuggaagaagaggcuaaacuucaguucaguaaagagacauaugaagaagaucucgaagaauuacuagaaaaaauuggagacgacuauauagaucuauucguacaggccaagaauguuuacgacgcaguccuacuaagugaaaucuuaagcgacucaacaaaaaacacaagagcaaaacuaucugcaggaaugauucgacgauacgaugcacauaaagaagaccuaguccuuuuaaaacgcuucguaaaggaaaaccucccuaagaaauaccgggcuuuuuuuggagacaauuccguaaacggauacgcuggcuauauugaaggucaugcaacucaagaagauuucuacaaauucguaaaaaaggaauuaacuggaauucgcggcucagaaguauuccuuacaaagauagaacaagaaaacuuucucagaaaacagcguacuuuugauaacggagucauaccucaucaaauacacuuaacagaacuuagggccauuauugcaaaccaaaaaaagcauuaucccuuccuaaaagaagaacaagagaaacuagaaucguuacugacauucaaaauccccuauuauguaggaccauuagcuaaaaaacaagaaaauaguccuuucgcauggcuuauaagaaaaagugaagaaaaaauuaaacccuggaaucuuccagaaauaguagacauggaaggcagcgcaguaagauucauagaaagaaugauuaauacagacauguauaugccacacaacaaaguuuuaccuaaaaauuccuuauuauaucaaaaauuuuccauauacaaugaacuaacaaaaguccgauaccaagaugaaagaggacaaaugaauuauuuuucgucaauagaaaaaaaagaaauuuuccaugaacucuuugaaaaaaaccgaaaagucacaaaaaaagauuuacaagaauuucucuacuuaaaguaugauauaaaacacgcagaguugucggggauugaaaaagccuucaacgcaucuuacacaacauaucaugauuuucuuacaaugucugaaaacaaaagagaaaugaaacaaugguuagaagacccugaacuagcaucgauguucgaagaaaucauaaaaacacuaaccguauuugaagaccgagaaaugauaaagacaagacuaagucaccaugaagccacauuagguaaacauauaaucaagaagcuaacaaaaaaacauuacaccggguggggucgacuauccaaagaacuaauacaaggcauacgagauaaacaaagcaauaaaaccauauuagacuacuuaauaaacgacgaugauuucccgcaucauagaaaccgcaauuuuaugcaacuuauaaacgaugauaguuuaagcuuuaagaaagagaucaaaaaagcacagaugauaaccgauacagagaauuuagaagaaaucguuaaagaauuaacaggaucgccagcaauaaaaaaaggaauccugcaaucacucaaaauagucgacgaaauuguaggcauaaugggcuacgaacccgcaaauauaguaguugaaauggcuagggagaaucaaaccacaggacgcggacuuaagucaagcagaccacguuuaaaagcgcuagaagaaucucuuaaagacuuugguagucaacuauuaaaagaauaucccacggacaauucgucacuacaaaaggacagauuauaccuauacuacuuacagaacggacgagacauguauacaggagcaccacuagauauccacagauuaucggacuaugauauugaccauauaaucccacguucauuuacuacagauaacucaauagacaacaaagucuuagugagcucaaaggaaaauagacuaaaaaaagacgacgucccaagcgaaaaaguaguuaaaaaaaugagaucauuuugguacgaccucuacaguucgaaauuaauaucaaaaagaaaauuagauaacuuaaccaaaauaaaacuaacagaagaagauaaggcgggcuucauuaaaagacaacucguagaaacucgacagauuaccaaacauguagcuggaauacuacaccaccgauuuaauaaagcagaagacaccaaugaaccaauaagaaaagucaggauaauuacauuaaaaucugcccuagucucccaauuccgaaacagauuuggaauuuacaaaguaagagaaauuaacgaauaccaccaugcgcaugacgcauaucuaaacggagucguagcacuugcacuacuaaaaaaauauccucaguuagccccagaauuuguuuacggcgaauaccuaaaguuuaaugcacauaaagccaauaaagcaacaguuaaaaaagaguuuuacucuaacauuaugaaauuuuuugaaagugauacaccaguaugcgacgaaaauggagaaaucuucugggacaaaaguaaauccauagcucaaguaaaaaaagugauaaaccaccaucacaugaacauaguaaagaaaacagaaauacaaaaaggugguuuuagcaaagagacuguggaaccaaaaaaagacucauccaaacuccuuccaaggaagaacaacugggauccggcuaaauauggaggauuaggcuccccaaaugucgcauauaccguugcguuuacuuaugaaaaaggcaaagcacgcaaacggaccaacgcccuagaaggaaucacuauaauggaaagagaagcauucgaacaaucaccagugcuauuccuuaaaaacaaggguuaugagcaagcugaaauagaaaugaaauuacccaaguacgcucuauuugaauuagaaaacggaagaaaacguauggucgccaguaacaaagaagcucaaaaagcaaauaguuuucucuuacccgagcaccuaguaacacuauuauaccaugcaaaacaauaugaugaaauuucacauaaagaaucguucgacuauguaaaugaacaucauaaagaauucucagaaguauucgcaagaguauuagaguucgcagggaaauauacgcucgccgaaaaaaauauugaaaaauuagagaaaaucuacaaagaaaaccaaacagaugaucuggcaaagcucgcaucauccuucguaaacuuaaugcaguucaaugcuaugggagcaccagccgauuuuaaauuuuuugauguuaccauaccccgcaaacgauacacaucauuaaccgaaauauggcaaucaacaauaauacaccaaucgauuaccggacuauaugaaacuagaaucaggaugggaaaauga

SEQ ID NO: 8783 - RNA, 4023 nt, Artificial Sequence
  Cas9 variant
augaaaacagauuacuucaugggauuagauaugggaacaggaucacugggaugggcaguuacagauagcucauaucaccuuugcagagcucaugguaaagaccuguggggaguaagauuauuugaaacugcacaaacagcagaagaacgaagaguauuccgcuguaauaggagacgacucgacagaagaaaaaggcgaauacaacuauuacaagauauuuuugcgccagagauauauaaaauagauccaggauuuuuucuaagacuuaaagaaaguagauaucugccagaggauaaaaaaaaccucgaagggaaaacacccgaacuaccauaugcacuguuuguagacaaaaaauacaccgauaaagacuuccauaaagaauaccccacuauauaccaucuacgccuuagguuaaugcaagaccgaacuccagcggacgugcgcuuagucuauuuagcgcuccaucaucuuauaaaacauagaggacauuuuuuauuugcaggaauagaagcugauaaggugacagacuucagugccgcauucucagaauuucucaggauaguacaggaacaagaauuagauauaagcuucacuccagacgaagaauccucacaaauaaucaaagaaacacuacagaauacaaauuucacuagaucgaaaaagucuacugaacuuaucaaaggacucaaagcgucuacggguugugaaaaggcacugcuaaaauuaaucagcgguugcaaaguuaaacuaucagcuguauucgacgauccuggcugugacgccuaugaaaaaccacagguauguuucgcagaauccagcuacgaggauuaugccgccauuuuagaagacgaacuggaagauagauucauaguaauugcugcggcaaaagcacuuuaugauuggucgguucuagucaacauucuaggagaagcaaguacaguaagugaagcuaaagugggaauuuaugaaaaacauagaagagaccuaaaguauuuaaaacaucuugucaaaacgaaccuaacaagggaagacuaccaagauuuguucguuaaagcaggcgcuaaaaaaaacaauuauugugcuuauauaggaaugacaaaaaaaaacaacaaaaaaguuguucuagaggaaaaaagaugcaccaaggaagauuuuuacgcauaccuaaaaaaagaaauauacucaaagguucaagaaaauccugaggcagaauaucuauuagaagaauuggaaaaagggacauuucuaccucgucaaguuagcaaagacaaugggguaauaccauaucaauuacaauuucuagaacuucagaaaauauuaaaaaacgcaguagaauacuuaccauuucuaaaagaagaaucugaaaaaauacaacaaauaaugacauuuagaauaccuuauuaugucggaccacucaacggaaaaaaagaaggucaaaauacauucgcaugggcuguaagaaaaaauaaugagccaguauacccauggaacuucgaggaaguuauagauacagaagcuagcgcagaacaauuuaucaggagaaugacaaauaaauguacguaccucccaggugaagacguauuaccgaaagagagccuauuauauucaaaguuuaugguccuaaacgaacuuaacaaucuacgaauaaauggaacaaaaaucaguguagaauuaaaacaagaacuauaugaaaaacuauuucaaagauauagaaaaguaagugccaaaaaacuacgagauuaucugguacgaaauggcauaacagaaaaagacgcagaaauaucagguauagauggagacuuuaaaggaacacuaagagcauaccacgacuuuaaagaaaaguuaaccggggucgaacucacugaagcggaaaaagaaacgauuauauuaaauauaacacuguucggugaagauaaaguauuacucaaaaaaagaaugcaaagacuguuaccaaauuuaacagaaggccaaaaaaaagccauaguaacccuaaauuauuccggauggggaagguuaucacgagaauuuuuagaagaaguccaagcaccaaauccggaaaguggcgaaauucuuagcauuauaagagcauugugggaaacaaacgcgaaucugaugcaacucuugaguaaccaauacggauaucaagaaauacuggaacaaaugagagcagacuggaccggccauaaauuagacuaccaaacaguggaagaacuauauguuaguccagcaguaaagaggcaaauauggcaaaccuuacaagugguaaaagagcuaaaaaaaguuaugggaggcgaacccaagagggucuuccuggaaguagcgagagaaaaaauggaaucaggacguaccgucucgcggaaaaaacaucuaaaagaucucuaccuuaguuguaagagugaggaaagaaacuggcuugcggaacucgauagacaugaagaacauuccuacagaagugacagacucuuuuuauacuacacccaaaaaggaagauguauguauugugguaaaccaaucgaucuaggucaccuaugggacguaaacauguaugauauagaucauauauacccacaaucaaaaguaauggacgauagcauuagaaaucgcguuuuaacaugucguaccugcaaugcagaaaaaacagaccauuauccacuuaaagcagaaauaagacagaaaaugcgaccuuucugggauucucugaaagcagggaauuuuauugaagaggaaaaauggaaacgacucauacgaucagaagaguuuacaucaacugaacuagccggauuuauagaaagacaauugguagaaacgaggcagaguacaaaagcuguagcagauauauuaaagcaagcaaugccagaaacagaaauaguauaugucaaagcgaaaaacguaucggcuuuucgucaagauuuuaacuucguuaaaaaucgagaugucaaugauuuucaucaugcaaaagaugcguaucuuaauauaguuguuggaaacacguacuucguaaaauuuacaaaaaaugcuaguugguuuauugaaagaaauccaggacgaucauacaauuuaaaaaggauguuuacuucggauuaugauguaaugagcaacggugaaauagcauggaaagcaggaaacuccggaaccauuacuacaguaagaaaaaugaugaaaaaaaauaguguauuauuuaccagaagaaguuuugaaguaaguggaggauuauucgaucaacaacuaaugaagaaaggcaaaggacagguuuacguaaaaaguggagacgaaagacuacguucaaucgagaaauauggaggauauaacaaagcgacaggugccuauuuuaugcuaguagaaucggaaggaaaaaaggguguaaaaaaaaggacuaucgaauuuguaccacuuuauagaaaagcagaguuagaagcaagugaagaaaaaaugcuagaguaucuaagaacagaaauagggcucaaagaaccacauguauuguugcauaaaauaaaaacagauacauuauuccaagcugauggauuuaaaaugcaccugucaggacgaacuggcaaacaacucguauuuaagggggcuaaucaguuuuuaguagccgaggauuaugagagauuauuaaaaaaaguaggaaaaguuacagaacaauugaaaacaaauaaaaacuacaaaauaaaugacuacgaugggaucacagaagaaggcuuaaaagcuuuauauucggaauuuuugucaaaacuucaaaaagcaccauaugguaaucgacugggaacacaagcagaaacauuggaaaauggcaaagagaaguucgauaaacuaaguuuagaaaauaagugucaaguguuaagugaaauccuacaucuauuucaauguaauaguagcgcugcagauuugaguaaacuaggaggacccggucauggagguauauugguacuuaguaaugaaauaacuaaauguaacaaaaucucuaucauacaccagaguccggccggaauauacgaacaggaaauugaccuaaaaacacuguga

SEQ ID NO: 8784 - RNA, 4023 nt, Artificial Sequence
  Cas9 variant
auggaacaagaauacuaccuuggauuagacaugggaacaggguccgucggaugggcaguuacagacagcgaguaccacguacuccgcaagcacggaaaagcacucugggguguaagguuguuugaaagugcuagcaccgcagaggaaagaagaauguuucgaacgaguagaagacgacuagaucguagaaauuggaggaucgaaauacuucaagagauauucgcugaagaaauuucaaaaaaagauccuggauuuuuucuaagaaugaaagaaucaaaguacuaucccgaagacaaacgagacauaaacggaaacugcccagaacuuccauaugcauuauuuguagaugaugacuuuacagauaaagacuaccauaaaaaauuuccaacaauuuaucaccuuagaaaaaugcuaaugaauacugaggaaacacccgauaucagauuaguauauuuagcaauccaucauaugaugaaacacagaggacauuuuuuacucagcggcgacauuaaugagauuaaagaauucggcacgacguuuaguaaacuacuagaaaauauaaaaaacgaagaauuagacuggaaucuagagcugggaaaagaagaauaugccguagucgaaucaauacuaaaagauaacauguuaaaucguaguaccaaaaagaccagacucauaaaagcgcuaaaagcaaaaaguauuugugagaaggccguccuaaaccuucucgcagguggcacaguaaaacucagugacauauuuggacuagaagaauuaaacgaaacagaacgaccaaaaauaucguuugcagauaacggauacgaugauuacauuggagaaguugaaaacgaacuaggcgaacaauuuuauauaauagaaacggcuaaagcagucuacgacugggcaguauugguagaaauacugggaaaauauacaagcauauccgaggcaaaaguugcaacuuaugaaaaacauaaaucagaccuccaauuccuuaaaaaaaucguaagaaaauauuuaacaaaagaagaauacaaagacauauuuguaagcacaucugauaaacuaaaaaacuauucagccuacaucggcaugacaaaaauaaacggaaaaaaaguagaucugcaaaguaaaagguguaguaaagaggaauuuuaugauuucauaaaaaaaaacguacuaaaaaagcuagaagggcagccagaauaugaauaccuuaaggaggaacucgaaagggaaacauuuuugccaaaacaagucaacagggacaauggcgucauaccauaucaaauucaccucuaugaacucaaaaaaauacuaggaaaccucagagacaaaauagauuuaauaaaagagaaugaagauaaacuaguucaauuauuugaauuuagaauaccuuacuauguagguccucuaaacaaaauugacgauggaaaagagggaaaauuuacuugggcaguuagaaaaucaaacgagaaaauauacccuuggaacuucgaaaauguagucgauauagaagcuagugcagaaaaauuuauaagacgaaugacuaauaaaugcaccuauuuaaugggugaagauguucuacccaaagacucguuacuauacucaaaauacaugguccuuaacgaauuaaauaacguaaaacuagacggagaaaaacuaagcgucgaguuaaaacaaagauuguauacggacguauucuguaaauacagaaaaguaacugucaaaaaaauuaaaaacuaccugaaaugcgaaggcauaauaucuggaaaugucgaaauuaccgguauugauggagauuuuaaggccucgcuuacugcauaucacgauuuuaaagaaauauuaacagguacagagcuugcaaaaaaagauaaagaaaauauuaucaccaacaucguuuuauucggggaugauaaaaaauuacuaaaaaaaagacucaaccgccuuuauccacaaauaacaccuaaucaacuaaaaaaaauuugugcacuuaguuauacaggauggggaagauucucaaaaaaauuucuggaagaaauaacagcgccagauccagaaacuggagaaguauggaacauaaucacagcacuaugggaaucuaauaacaaucuaaugcaauuauuaucaaaugaauacagguucauggaggaaguugaaacuuacaauaugggaaaacaaaccaaaacacucucguaugaaacaguagaaaacauguaugucagcccaucgguuaagagacaaaucuggcagaccuuaaaaauaguaaaagaacuagaaaaaguuaugaaagaaagcccaaagagaguuuucauagagauggcaagagagaaacaagaauccaagagaacagaaaguaggaaaaaacaauuaaucgaccuauacaaagcauguaaaaaugaagaaaaagauugggugaaagaacuuggagaccaagaagaacaaaaacuucgaucagauaaguuauauuuauacuacacacaaaaggguagauguauguauagcggcgaagucauagaacuuaaagacuuaugggauaacacaaaauacgauauugaccauauauacccgcaaaguaaaacaauggaugacuccuuaaauaaccgaguacugguaaaaaagaaauauaaugcaacaaaaucagacaaauacccguuaaacgaaaacauacgacaugaacguaagggcuucuggaagagucuccuagauggugguuucauaucuaaagagaaauaugaaaggcuaauucgaaauacagaauuaucaccagaggaacuugcgggauuuauagagaggcaaauaguggaaacacgucagaguacaaaagccguagccgaaauucugaaacaaguauucccagaaagcgaaaucguauauguaaaagcuggaacaguaagcagauucagaaaagauuucgaacuauuaaaaguuagagaaguuaacgacuugcaccaugcaaaagaugccuaccuaaauaucguagugggcaauaguuauuacguuaaauuuacaaaaaaugcaagcugguucauaaaagagaauccaggccgaacuuauaaucuaaaaaagauguuuaccucaggauggaacaucgaaagaaauggugaaguagcuugggaaguaggaaaaaaaggaacaauagugacaguaaaacaaauaaugaacaaaaacaacauacuaguuacaagacaaguacacgaagcaaagggcggcuuauuugaccaacaaauaaugaaaaaaggaaaagggcaaauagcaauaaaagaaacagaugaaaggcuagcuuccaucgagaaauaugguggauacaacaaagcagcuggagcuuacuuuauguuagucgaauccaaagauaaaaaagguaaaacaauaaggacaaucgaauuuaucccuuuauaucuaaagaauaaaaucgaaagcgacgaaagcauagcacuaaacuuccuggaaaaaggaaggggauuaaaagaaccaaaaauauuacucaaaaagauaaaaaucgauaccuuguucgauguagauggguuuaaaaugugguuaucggguagaacaggagacagacuuuuauuuaaaugcgcaaaccaacuaauccuagaugaaaaaaucaucguaacaaugaaaaagauaguaaaguucauacaacgcagacaagaaaacagagaauuaaaacucagugacaaggacggaauugacaacgaaguucuaauggaaauauauaacacauuuguagacaaauuagaaaacaccguguaucggaucagauuaucagagcaggcaaaaacuuuaauagacaaacaaaaagaauuugaaagacucaguuuagaagauaaaucgucaacacuauuugagauacuacacaucuuccagugucagagcucagcagcuaaccuuaaaaugauaggcggaccaggaaaagcuggaauacuaguaaugaauaauaacauuagcaaauguaauaaaauaagcauaauaaaccaaagcccaacagguauuuuugaaaacgaaaucgacuuacuaaaaauauga

SEQ ID NO: 8785 - RNA, 4023 nt, Artificial Sequence
  Cas9 variant
augggagaagaauauuuucuugguuuagauaugggaacagguagucucggaugggcuguaacagaugacaaauaucaaauauuaagaagacacggaaaugcguuaugggguguacgacucuuugaaaccgcuaacacggcugaagaaagaagaauguucagaacaaacagaagacgauuagauaggcaaggauggagaauuaaaauuuuacaagaacuauuugcugaagaaauaugucgcgucgauccuggcuuuuauuuaagaaugaaagagucaaaauacuauccagaagauaaacgagaugcaaauggugaaugcccugcacuaccguacgcucuauucgcagaugcacaauacacagauaaagauuaucacagagaauuuccgacuauauaccacuuaagaaaaaugcuuauggaaacagaaaccacgccagacauaagguuaguauaucuagcauuccaccacaugaugaaacauagaggacacuuucuauuauccggagauauuagccaagucacagaguucaggaacaccuucuuacaaaugaucgcaaauauaaaaagcgaagaauuagauuuuucgcuagaaauugaagaaacgcaaaugggacaaauugaagccguauuaaaagaucacaaauuaacucggucagagaagaaaagaagacuaacacaaauacuuaaaccagcuacggcaugugagaaagcaauauucacccuccuuucggguggaacagucaaacucagcgacauuuuuggaaaagccgaacuagaugaaggagaacgaccaaaaauaucauucgcagacaacggauaugaugauuauucugcaagugucgaagcggaucuaggagaacaauacuacaucaucgaaagcgcaaaagcaguauacgacuggagcguguuaucugacauccugggagauucggucucaauaucagaugccaaagucaaacucuaugagaaacacaagaaagaucuugcuuaccuaaagaaagugguaagagaaaaucucccgcgagagguauauaaccaaguauuuguaaacacagaugaaaaauuauguaacuacugcgcuuauauagguauggccaagaaaaacggaagaaaaguagcauuagaaggaaaaagaugcacuagagaagaauuugagucauuucuacgcaagaaaauuguaaacaaaauagaagacaaagaaauacaagaauacuuaucugaggaaauagaaaaaggaacauuuuuaccuaggcaaguuaccaaagauaauggcguaauaccauaucaaauacaucucuacgaauugagaaaaauaaucgacaauuugucacccagaaugccuuucauuagggacaacggagauaaaauaauacagcuauucaccuuuaggaucccauacuaugucgggccacuuggaaaaggugaaggcagugaaaaauucucaugggcaguaagacgaacagacgaggcaauauauccguggaauuucaaagacguaauagaugucgaagcaucggcagaaaaauuuauuugcaggaugaccaauaaauguacauauuuauauggagaagauguccucccaaaagauucgccgcuguauuccaaauucaugguauuaaaugaguuaaauaauuuaaaauuagauggccaaagcguaagcguagagcucaaacaaagaauuuaccaagaauuauucugccauacaagaaaaguuacucagaagaaauuaguaagcuacuuaguucgggaaggaauaacaggcaaaaauguggaaauaucagguauagacggagauuucaaagcaucccucacugcuuaucaugacuuuaaagaaaaauugacuggaguagaacuaagccaacaagaacaagaagaaauaguucgaaauauaguacuuuuuggcgaggacaagaaacuacugaaacaacgauuggaaggacgauuuccgcagcuuacacaaaaacaaaucaguguaaucgcaacauuaucauauaaaggguggggaagacucaguagagaguucuuagaaaauaucacaguaccagcaccugguaccggcgagguauggaacaucauaacugcccucugggaaacgaaugauaaccuaaugcaauuauuauauggcgaauauggcuuucaaacagaaaucgaauguuuuaacgccaaagagaaaaagaaaagucuaaguuaugagacaauagaggaaaguuaugugucuccaucaguuaaacgacaaauuuggcaaacguugcaaguaguaaaagaacuaaagaaaguaaugagaggggauccaaaaagaguuuuuauagaaauggcaagagaaaaccaagaaagcaaacgaaccgaaagcaggaagaaaacuuuauuagaucucuacaaaaauugcaagaaagaagaaccagaauggauagccgaacuaacagagcaccucgaaaaauuagaugauagucaacuucgaaaagacaaacuauuccucuauuauacacaaaaaggaagaugcauguacucaggugagagaauagaauuagaagaucuaugggauaauacacgcuacgacauugaucacauauauccacaaaguaaaacaauggaugauucagucgauaauagagugcuuguuaagaaagaauauaaugccaagaaaaccgacguauacccaauagcugccgacauaagaggcaaaaugucacccuuuuggaagaaacugcucgauaauaaauuaauaagcaaaaagaaauacgauagauuagugagaaccgaagaacuaacaccagaagaauuagcagguuuuauugauaggcaauuaguugaaaccagacaaaguacaaaaguaguugcagaaauacuaaaagaagcauuccccgacacagaaauaguauauguaaaagcagguaauguaaguaauuuccgacauauguuugauauugugaaaguaagagaguuaaacgauuuacaucaugcaaaggacgcauaucucaacaucgucguaggaaaugcguacuaugucaaauucaacaaaaacgccgcaugguucauaaaagagaauccuggaaggucauauaaucuaaaacgcauguuugauuaugacauccggcgcaauaaugaaguagcuuggcuugcuggaagcacuggaacuauaucacaggucaaaaauaugguuaguaaaaaucauauccugguaacucgcaaaucauaugaaguaacagguggucuauuugaccaacaacugaugaagaaagguaaaggccaagucccagucaaaacaucagaugaaagacuaggaaacauagaaaaauauggaggauauaauaaagcaaguggagcauauuucauguuaguaaaaaguaaaaauaagaaaggcgaagaacaaagaacaauagaauaugucccuauauacuuaaaacacuauauugaagaaucaaaagaaaacgcucucgacuaucucaaaaaugaaagaaaacuaaaugaaccagaaauauuacuagacaaaaucaagaaagacacguuauucagaguaaaugguuuuuauaugugcuuaucaaaacgaacagggaaacaacucgcauuuaaaggagcuaacgagcuacuguuaccagaaccugaaacucuauuacuaaagaaaauaacaaaauauauacagcgacgaaaagagaacaaagaccuaaaacuuacgaaacaagauaauauuacagaaaaagaacucuuggaauuguacgauguuuuuacugaaaaauuaaaccauaguguauaugccgugugucuaggaacacagggaaaaacucuaguacagaagaaaccagcauuuguagcauugccgguagaagaaaaauguauaguccuaucagaaauuuuacauuuguuucaaugucaaucgggaucagcaaaccuaaaauuaauaggaggcccagcuagugcaggaauuuuauaccuuaauaguaacauaucugacgcuggugaaaucuuaauaauaaaucaauccccaagugguauauuugaaaaacguauagaucuacuccgauuauga

SEQ ID NO: 8786 - RNA, 4023 nt, Artificial Sequence
  Cas9 variant
augaaaaaagaauauacaauaggauuagauaucggaacuaacucggucggaugguccguuuuaacugacgacuaucgacugguaagcaaaaaaaugaaaguggcagggaacacagaaaaaucaucuacaaaaaaaaacuuuuggggagucagauuauuugaugaaggacaaaccgcugaagcaaggagaucaaaacgcaccgcgagacgcagacucgcucgcagaagacaacggauacuagaauuacaaaaaauauuugcuccagaaauucuaaaaauagaugaacacuucuuugcccgccucaaugaaagcuuuuuagugccagaugaaaaaaaacaaucaagacauccagucuucgcaacaauaaaacaagaaaaaucauaucaccaaacauaucccacaauuuaccacuuacgacaagcacuagcagacagcucugaaaaagcagacauuagacuuguauaucucgcaauggcgcaucuucuaaaauacagaggucauuuucucaucgaaggagaacuaaacacagaaaauucaucaguaacagaaacauucagacaguuccugucaacauauaaucaacaauuuagcgaagcaggcgacaaacaaaccgaaaaacuagaugaggccguugauugcucauuuguauucacagaaaaaaugucaaaaacaaaaaaggcagaaacccuacuaaaauauuucccucaugaaaaaagcaacggguaucuaucacaauucauuaaacuaaugguuggaaaucaaggaaacuucaaaaauguguucggucuugaagaagaggcaaaauuacaauucagcaaagaaaccuacgaagaagaucucgaagaacuguuagagaaaauaggugaugacuacaucgaccuauuuguacaagcaaaaaacguauacgaugccgucuuauuguccgaaauacugagcgauucaacaaaaaauacacgagcaaaacuuucagcuggaaugauaagaagauaugacgcacauaaagaagaucucguucuauuaaaaagauucguaaaagaaaaccuuccaaaaaaauacagggcauuuuucggcgacaauagcgucaacggcuaugcgggcuacauagagggacacgccacacaagaagccuucuauaaauuuguuaaaaaagaacuaacaggaauuagaggcucugaaguauuucucaccaaaauugaacaagaaaauuuucugagaaaacaacgcaccuuugauaauggaguuauaccccaccaaauccaccuauccgaacucagagcaauaauagcaaaucaaaaaaaacacuacccuuucuuaaaagaagaacaggaaaaguuagagucauuacuaacauuuaaaauccccuauuacguaggaccacucgcaaaaaaacaagaaaauucacccuuugcuugguuaauacguaaaucagaagaaaaaauuaaacccuggaaucucccagagauaguagauauggaagguucagcggucagauucauagaaagaaugauuaacacagauauguauaugccacauaacaaaguacugccaaaaaacagucuccucuaccagaaauucuccauauauaacgaguugacaaaaguuagauaccaagacgaacgggggcaaaugaacuacuucaguucaauagagaaaaaagaaauauuccaugaauuauucgagaaaaaucgaaaagucacaaaaaaagaucuacaggaauuccuguauuuaaaauaugacauaaagcacgcagaauuaucgggaauagaaaaagcauucaaugccagcuacacuacauaucacgacuuccucacaaugagcgaaaauaaacgagaaaugaaacaaugguuagaagacccagaacuagcuucuauguuugaagaaauuauuaaaacuuuaaccguuuuugaagacagagaaaugauaaaaacccgcuuaucacaccaugaggcaacauuagguaaacacauaauaaaaaaauuaacaaaaaaacauuauacagguuggggacgacuaaguaaagaauuaauacaagguaucagagauaaacaaaguaacaaaacaauccuagauuaucuaaucaaugacgacgauuucccacaccaccgaaaccguaacuuuaugcaguugauaaaugacgacagucuaucauucaaaaaagaaauaaaaaaagcccaaaugauaaccgacacagaaaaucuagaggaaauuguaaaagaacuaacaggaucacccgcuauuaaaaaaggcauuuugcaaucacuaaaaauuguagaugaaauaguaggcauaaugggguacgaacccgcuaacauugugguugaaauggcuagagaaaaucaaacaacuggaagaggcuuaaaaagcagucguccaagauuaaaagcacuagaagaaagcuuaaaagacuuugguucucaacuucuuaaagaauacccaacggauaacagcagcuuacaaaaagaccgccuauaucucuauuaccuacaaaauggaagagauauguacacuggugcaccauuagacauucaccgauuaucagauuaugacaucgaucauauaauaccacgcucuuuuacgacagauaauucuauagacaauaagguccuaguauccucuaaagaaaacaggcuaaaaaaagacgacgucccguccgaaaaaguuguuaaaaaaaugcggaguuuuugguaugaccuauauucaucaaaacuaaucucaaaaagaaagcuagacaaucuaacaaaaauuaagcuaaccgaagaagauaaagcagguuucauaaaaagacaauuaguagaaacuagacaaauaacaaaacacgucgcaggaauucuucaucauagauuuaauaaagcggaagacacuaaugacccuauacgcaaaguacguauuaucacgcuaaagucggcacucgucucucaauuucgaaauagauuuggaauauacaaaguucgcgaaauaaacgaguaccaccacgcacaugaugcguaucugaacggcgugguugcauuagcacuacucaaaaaauauccccaauuggcuccagaauuuguuuauggagaguaucuaaaguuuaaugcccauaaagccaauaaagcuacaguaaaaaaagaauuuuauuccaauauaaugaaauucuuugagucagacacaccaguaugugacgaaaauggagaaaucuuuugggacaaauccaaaaguauugcucaaguuaaaaaagucauaaaccaucaucacaugaacauuguaaaaaaaacggagauccaaaaagggggguucagcaaagaaaccgucgaaccaaaaaaagacuccaguaaauuacuaccccgaaaaaauaacugggacccagcuaaauacgguggauuaggaucuccaaauguagcauauacuguugcuuuuacauacgaaaaggguaaagccagaaagagaacaaaugcauuagagggaauaaccauaauggaaagggaagcuuuugaacaaucaccaguacucuucuugaaaaacaaaggcuacgaacaagcggaaauagaaaugaaauuaccaaaauaugcgcuuuuugaacuagaaaauggcagaaaacgaaugguagccucaaacaaagaagcccaaaaagcaaacagcuuccuauuaccggaacaccuuguaacgcucuuauaucaugcuaaacaauaugacgagauaucacacaaagaaucauuugauuaugucaaugaacaccauaaagaauucucagaagucuuugcuagagucuuggaauucgcaggaaaauacacauuggcugaaaaaaauauagaaaaacucgaaaaaaucuauaaggaaaaucaaacagaugaccuagcaaaacuagcaucuucauuugucaaccugaugcaguuuaacgccaugggcgcuccugcugauuucaaauucuuugauguuacuaucccgaggaaacgcuacaccucacucaccgagauauggcaaucaacuauaauccaccaaucaaucacaggacucuacgaaacaagaauacguauggguaaauga

SEQ ID NO: 8787 - RNA, 4023 nt, Artificial Sequence
  Cas9 variant
auggagcaagaguacuaccucggcuuagacaugggaacaggaucaguagguugggcaguaaccgauagugaauaccacguacuacguaaacacggaaaagcauuauggggcguaagacuuuucgaaagugccaguacagcggaagaaaggaggauguuccgcacaagucgaaggcggcuagauagacgcaacuggagaaucgaaauucuucaagaaauauucgcagaagaaauuucaaaaaaagacccaggcuucuuuuugagaaugaaagaaucuaaguauuauccugaagacaaaagagacaucaauggaaacuguccagagcuaccuuaugcacuauucguugaugacgauuuuacagauaaagauuaucauaagaaauuucccaccauauaccauuugcguaaaaugcuaaugaauacagaagagacaccagauauaagauuaguauaccuagcgauacaucacaugaugaagcacagaggccauuuuuuauugaguggagauauuaacgaaauaaaagaauucggaacgaccuucucaaaguuacuugaaaacauaaaaaacgaggaacuagacuggaacuuagaacuugggaaagaagaauacgccguuguagaaagcauccuaaaagacaacaugcugaacagaucaacaaaaaagacacgacuaauuaaggcuuuaaaagcaaaaaguauuugugaaaaagcaguacuuaaccuacuggccggagguacaguaaagcuaucagauauauucggacucgaagaauuaaaugaaacagaacgaccgaaaauaagcuuugcagauaacggauacgacgacuauauaggagagguugaaaaugaacuaggggaacaauucuacauaauugaaacagcaaaagcaguauacgacugggcaguucuaguagaaauauuaggaaaauauacaucaauaagcgaagccaaaguagcaacauacgaaaagcauaaaucagacuuacaauucuugaaaaaaauagugagaaaauauuuaacgaaagaagaauacaaagauauauucgucucaaccagcgauaaguuaaaaaauuacucagccuauauuggaaugacuaagauuaauggcaaaaaagucgaccuacaaagcaaaagguguagcaaggaagaauuuuaugauuucauaaaaaaaaauguucuaaaaaaauuagagggacaaccagaauaugaauaucuaaaagaagaacuggaacgugaaacuuuucuaccaaaacaaguaaauagagacaacgggguaauuccuuaucaaauccaucuguacgaauugaaaaaaauucuggggaaccuacgugauaagaucgaccuuauaaaagagaacgaggacaaacugguacagcucuuugaauuucgcauaccauacuacguuggaccauuaaacaaaaucgaugacggcaaagaaggaaaauucacaugggcaguccgcaaauccaacgaaaaaauuuaccccuggaauuucgaaaaugucguagacaucgaagcaagcgccgaaaaauucauaagacgaaugacaaauaagugcaccuaccuaaugggcgaagacguacuaccaaaagacucacuauuauacucaaaauauauggugcugaacgaacuuaauaacguaaaacuagacggcgaaaaauuaucaguagaguuaaaacaaaggcuauacacagaugucuuuugcaaauaucguaaggucacuguaaaaaaaaucaaaaauuaccucaaaugcgaagggauuauaucgggcaacguugaaauaacaggcaucgacggagacuuuaaagcuagucuuacugcauaucacgauuuuaaagaaauacuaaccggaacagaauuggcgaaaaaagacaaggaaaauauaauaaccaacauaguccucuuuggugaugacaaaaaguuauuaaaaaaaagacucaacagacuauacccacaaauaacgcccaaccagcucaaaaagauaugcgcccuaagcuauacaggauggggaagauuuucaaaaaaauuucucgaagaaauaacggcacccgauccagaaacaggagaagucuggaauauaauaacugcgcuaugggaaucaaacaauaacuuaaugcagcugcugaguaaugaauaucgauucauggaagaaguagaaacuuauaauaugggaaaacaaacaaaaacacuaucguaugaaacgguagaaaacauguacguuagucccucaguaaaaagacaaauauggcaaacauuaaaaauugugaaagagcucgagaaaguaaugaaagaaucaccaaaaagaguuuucauagaaauggcacgugaaaagcaagagucuaagagaacugaaucaagaaaaaaacaacuaauagaccuauauaaagccugcaaaaaugaagagaaagauuggguaaaagaacuaggcgaccaagaagaacaaaaauuaagaucagauaaauuauaucuauauuauacacaaaaggguagguguauguacagcggagaaguuauagaacuuaaagaccuuugggacaauacaaaauaugauaucgaccauauauacccgcaaaguaaaacaauggaugacucacuaaacaaucggguacucguuaaaaaaaaauauaacgcaauaaaaucagacaaauauccauuaaacgaaaauauaaggcaugaaaggaaaggauucuggaaaucacuacuggauggcggguucauuucaaaagaaaaguaugaaagacugauaagaaacacagaacugagucccgaagagcuagccggguuuaucgaaagacaaauugucgaaacccggcaaaguacgaaagcuguagcugaaauuuuaaaacaaguauuccccgaaagugaaaucguauauguuaaagcaggaacgguaucaagauuucgaaaagacuuugaacuacuaaaaguacgagaagucaacgauuugcaccaugccaaggaugcauacuugaacauuguaguaggaaauaguuauuauguaaaauuuacaaaaaaugcaagcugguucaucaaagaaaacccugggagaacauacaaucuaaaaaaaauguucacaaguggauggaauauagaaagaaacggugaaguagccugggaaguaggcaagaaagguacaauaguaacaguuaaacaaauaaugaauaaaaauaacaucuuagugacacgucagguacacgaagcuaaaggaggucuauucgaccaacaaaucaugaaaaaaggaaaaggacaaauugcuaucaaagaaacagaugaaaggcuagcaucaauagaaaaauauggcggauacaauaaagcggcaggugcauauuuuaugcuaguagaaagcaaagauaaaaaaggcaaaacaauaagaacaauagaguucauuccucuauaccuaaagaauaaaaucgaaucggaugaaaguauagcccucaacuuucuugaaaagggaagaggauuaaaggaaccuaaaauauuauuaaaaaaaauaaaaauugacacacucuuugacguagauggauucaaaauguggcuuucaggaagaacaggagacagauuacucuuuaaaugcgccaaccaauuaauauuagaugaaaaaauaauuguuacaaugaaaaaaauagucaaguuuauacagaggagacaagaaaacagagaguugaagcuaagcgacaaggaugguaucgacaacgaaguacugauggaaaucuauaacacauucgucgacaaacuagaaaacaccguauauagaauacgauuaagcgaacaagccaaaacacuuauugauagacaaaaagaauuugaaaggcugucauuagaggacaagucaaguacacuauuugaaauacuacauauauuccaaugccaaaguucggcugcaaaccuaaaaaugaucggcggaccuggcaaagcaggaaucuuagucaugaacaacaacauuucaaagugcaauaaaauuucgauaauaaaccaaucuccaaccggaauauucgaaaaugaaauagaccuucuaaaaauauga

SEQ ID NO: 8788 - RNA, 4026 nt, Artificial Sequence
  Cas9 variant
augagauuccaaaacaagaaaacaggugacuacuucguaggccuugauauugguacaaauucaguuggaugggccguuaccaaugaaaaauaugaaauacuaagagcuaaaaaccacagaauguggggcucaagacuuuuugaagaagggaaaacagcagaagaacggcgcguucauagggccggaagaagaagauuaaaucgcagaaaugacagacuaaugauucuagaagacuuauuugccgaagaaauaucuaaaguagacaaagcauucuaccaaagauuacaugaaucacaauauagacaagaacacaaaacagugucagguccauauuuucuauucaacgacaaagaguucacagacgaagacuaccauauagauuauccaacaauuuaccauuuaagaguggcgcuaaugaaagccccugcaaaagacguuagauuguuauuccucgcuauccaucacauaauaaaauacagaggaaauuuccuacaugaaggugaaacauucaaaacuacugguggauuaacagauauacuacaaaggguacucgcuuguaacgaauuuaguggucuaaaacaacauauagaugacacugcacuggucaaauuacuaacaaauaaaggcauuaccagaagugauaucgcaaaacaaauaucagaacuagcaacagauaaacucuauagaaaacaagcaaaagcguucgcaucuuuaguccuaggauugaaagcaaaucuagaugacuuauucaacgaaccggaauauaaagaacucgacucugaaauacgaacuguagaauuuaguggaaaagaauacugggaagaaagagacaaauacgaaccauacuugggugaaucacucuuugcacuagacgguugcaaaacacuguacgacacauuauuauuaaguaacaucaaacccgauggaaaauaccuaagcgaagcgaaagucgaaacuuucgaaaaacaucaugaacaucuagaaucacugaaagacuuacucaaaagcaauaaggcauuauauaaccggguacuuagggacgaugaaaagaaccuaaacaauuauauaaccuauaucggaaaauccgaauuuaauaaacgauguucaagagacgaguucuacaaauuuuugaaacaaaccauuaaagauauaucagacaacgaaaauaaagcggaaaucguccaacuaauggaacuggauuccuuccuaccguuacuacguguucgcgaaaacggaguaauaccuuaccaaauacacgaagaagaauuagaacagauccugaacguuucgucggaaaaauacccguuccucaauaaagcugaugguagugguuuuacaauugcacagaaaauccugaaacuacucacauuuagaauaccguacuucgugggaccauuaaauccagcucauaaagauagagacaacgguuuugcguggguuguacgcaaagcuccugguaaaguauacccauggaacuuugaagacaaaguagauauaagcgcuagcgcaacagcguucauagaaaauuuaacaaacaaauguacauaucucauuggcgaagacguacuacccaaauacucacuggcguauucuaaauucagucuacuuaaugaauuaaauaaccuacgauacgaugggaaaccauuauccuaugaaacuaaacaaaguuucaucaaagacuguuucgagaaagaacauaggaaaaugaccgagaaaaggaucagagaguuccuaaaacaucuaggaggaacagaugguaagggagcgcugaccggacuagacguugauauaaaaucagaucuaaaaucauaucgagauaugguucguauacuaggugauggauucgaugaaacaauggcagaaagaauaaucagauacguaacauuauucggggaagcuaagaaaguauuacuaaguacuuuagaaauagaauuuggagacgauuuaucagacacccaaaagaaacaaauacuaaaacuacaauacagggacugggggcgguuaagugcaacucuauuaaaaggaauuaaaggcguagcaggcgacaacccagaaugcucaauucucgaaugcauggagcaacaaccgcucaaccuaauggaaguacuaucaagucacaacacuuacuuagcagcaauugaagaauuuaauaaagaaagaacagaaccuaccgacauaguagacuacaaacuuguugaugauuuauauauaucaccagcuguaaaaagauccguauggcaaacucugagaauauuagaugaaaucacaaaacuucgaggaaguguaccaaagaaagucuuuguagaagucgcacguacaaacagagcagaaaagaagaaaacugauucaagaaaagaaagauuacuccaauuauauaaaacaaucaaagaugaaggaagaaacuggaccgaggagauaaaacaaagagacgcaggagauuucaauagcaagaaacuuuuccuauacuacacucaacaaggaagguguauguacagcggcgagaaaauaacaagcauuggcgacuuauucacaaguaaauaugauauagaccauaucuauccaagauccgucacaaaagacaauucgugggauaaccuagucuuaguaaaagcagaauuaaauagagaaaagaaagacauauacccuauugaaaaagauacacaggauaggugcauuucccuguggaaacaacuacuagaacaaggauugauauccgaacgaaaauaugaaaggcucguacgaacuaccccucuaacagcugacgaacuagccgacuucguaaacagacaacugguagaaacaaaucaauccguaaaagccgucacuaauuuauuaaaacgacuauaccccgauacuacuauuugcuaugugaaagcggaaaauguaucagacuuccgacaagagagagaguuugucaaauuacgaaguuuaaaugcacaucaucaugccaaagacgccuaucugaacauuguagugggaaacguguaucacgagaaauuuacuaauaauccuagaaauuuuauuaaaaaugcaagaagcgacaagaaaagacccuacucacuaaaucauauguucgacuaccuccuacaaguagguaacaaagaaauauggaacccgaaaacggacaauaaucuaguaaagaaaaugaugagaaacaaugacguacaaguaacuagaauguuaguagaacagacgggagcucuauaugaugcaacgauauauaaagcaagugugacaaaaucugaaucauacguaccccugaaauccucagaugccauauugagcgacgucaagaaauaugggggauucacaucaauaaaaauagcauacuauucaaucuucagauucuauaagaaaaauagcgaagaguucgaaacacacauaauaucaaucccgguguuaaaagccgggacccucaauucaaaagaagacuacguugcuuauggcgaagaaauaaugaauaaacaaaaauucgauagaguggaauuaguauacaagaaacuauguaugaacucacucguaagaauaaauggaguaauguacuacuuaggcgguaaaacaaauaacucauuauacauagacagcgcaauauccuuaguacuacccgacaacauagcuaagaaaauaaaagcaguugaaaaauauauagcuagaguagcggaaaacggaaacuacaaaccacaaccugaccaagugucaccagaauuuaauaugaucauauauaaagcauuaacugagaaaaugaaacaaccagcuuucguaggcuugaaaacaaacagagaaaaugaacuagaaaaagaaaccacuaucacagccuucauagcaaugacguuaauagaacaauguaaaaugcuaauggaaaucuuaaauuuacuaacacaacagaaaacaacauacgccuugaaaccaauaggugugagugcgucacgaaguacacucggaaugaacauuacagggcuauccgaauuuacaauuauaacacaaucuguuacaggauuacaggaaaaagaaauuaggauaauauga

SEQ ID NO: 8789 - RNA, 4026 nt, Artificial Sequence
  Cas9 variant
auguggggauccagacuauuugaagaagcaagcacggcucaagaccgccgagaacacagaaguaaucgacgacgcuuagaaagaagaaaauacagguuagauuuacuggaagaacuauuuguagaagaaauaaacaaaauagauccagaauuuuuuauaaggcuaagagaaucaaaauuucauuucgaagaccgcagccuaaagaauaccuuuauauuguuuaacgacaaaauggaagguggcuacaacgacaaaguuuucuuuagcaaguacccaaccauuuaccaccuaagaagugcauuaauaaacgggaacaaagaagaugugagagcaguauucuuagcaauccauaauauccugaaaaaucgcggacauuuccucuuagcuggaaaugacauuaauaucagucuauccuuaaacgacacucuuacagaccucuucgaauauuuaaaaauucacuuaggaauagagguagaauucgagaauaaacuaaaagacaucgagaaaaucgcauuagacaaaaacuuaagcaaaucggacaaacaaaaaaaaauuguacaacucuuagaaacagauuacaaaaaacaacuugccgauguauuuaaacuuucccuaggacuuaccgcaaauauggaaaacauauucggcaaggaaaacgaacagggucuugaauucaucaaugcugaaaauaaaauaaagaaaauacaguucgacagcucuuacgaagaaaacauagcagaauucgaucaauucuacggagaauauuuugaaauaaucgacauaugcaaaaaaauuuacgaugcuauaucauuaagccaaauacuaguagacggcaaaggguugagcgaaucaaaaguucuuucauaugagaaacacaaagaagauuuaaaacuacuaaaaaaaguacuaaaaaacauugacaaagccuaugacaacaaaggagaagacagacuaguguacaaaguauuaaaagaagauaaagauaaaggaacuaacuaugucaauuauucuaagcuuucaaacaauggcacagcgacuacaaaagaagaauucuauaaguuccuaucaaaaaaucucgacuuaaaaaaauucggaaaacuaaacaaagaagacauagaaacacucgauuauauaaacucagaaauucuccuagguagguuuuugccccuccaaaaagagaaaaucaacgguguaauaccauaccaauuacagaugaaagaauuaacucaaaucuuaaacaacgcaaguaaauaccucccauuucuaaacaaaauugaggacggcaugaccgugaaagacaaaauaauaaguuugauaaaauuuagaauaccauauuaugucggaccguuaaacgaauacaauagaauagagaacggaaacggauucgcauggaucgaaaaaaagaaaaaugaaaaaauauuuccguggaacuuuaaugauguaguugacauagaaaaauccgcagaaaaguucauaaauaaccucaccaauaaauguacauacauaaaagaagaaacgguacuaccuaaaaauagcaucauuuauucaaaauuuaugguccucaacgaguuaaacaacuuacaauacggcaauaaaaaauuagauauagaauuaaaaaugaaaauguacacagaccuauuccucgaaaagaaagacaaucgaaaaguaacugaaaaaagaauacuagaguacuuccgcaucaauggaaucaaugacggaaaagaaaaacucacugguuuaaauaaugaaauccacgcagacaugaaaucauaucgagacaugugugaaauaaugggcgaaaauuuuaacaucaauguagcagaaaacauaauaaacuggauaacaguuuuucauggugaaaaaaaaauacuaauaaacaaaauaaaaaacguguaugguaagauguucaacgacgaacaaauaucaaaacuaucaaagcuaaacuauagcgauugggggcgacucaguaaaaaacuucuuacagauaucaaaugcuauauagacgcagacggcauaaauuuuccugucucaauacucgaagcuauggagguaucaaauaaaaaccucauggaacuacuaucaaacaaauacgaauuuauaaguugcauagacgacauaaacaacaaauacuucggagaccgugauaucagugcgucagaacuaaucgacgaacucuacgucagcccagcaguuaaaagagggauauggcaaucagugagaauccuagaagaaauuguaucuaucauaggacacaacccaaaaaagaucuucauagaaaugacaagacacaacgaagaaaaaguucaaaaaagcagccggagacauaauuuggaagaacuauacaaagcaauaagaaaagaccccgaauauguagaacucaucaaagaauuugacucaacuacagacacagacagcuucaaaauaaaaaaacuauacuuauacuuuaugcaacuaggaaaaugugcauauucgaaagaaaaaauugacuucgacaaauuauucacagacagcuaugauauagaccauauauacccaagaaguaaaaccaaagacgauagcauacacaacaaucuuguauuggucaaagcaaaauacaauagggaaaaaacagacguuuacccaauagauauaaacauacaaaaaaauaugaauucauucuggaacuucuuauauaccaaaaaauucauaacagaagaaaaauauaaaaggcuaaucagaacauccgaucucacugacgaagaguuagccaaauucauaucacgacaacugguagaaacaucucaaucaaccaaagcaacagcagaagugcuaaaacaaauauauggcgauuccgacauaugcuaugugaaagcagaaaaugugucagacuuuagguacggaucaucaagacaaaaagacaaaaacgacauacaaaaauuauucgugaaaugucgagaagucaaccacuuccaucaugcaaaagaugcauacuuaaacauaguuguaggaaacguauacgacguaaaauuuacaaaaaaccccguaaauuucauuaagaaaaauaaaaugggaaauaaaucaaauuacaguuuaaaccacauguuuugcuuugaugucgaacgaaacggcuacaaagcaugggacucaucugaaacgaucaagacaguaggcaggaugaugaaaaguaacgauguaagaauuacaaaacacguccacccaacgcgaggagaacuauaugacgcuacaauauacaaagcaaaaauugcaaaaaccggauccuauaugccacuaaaaucaaguaaaaauacuccacuaucugacguaaccaaauacggggguuauacaaaaauaaaaauagcguacuacucgguuuacaaauauaaauuuagcgacaaaaauuuaauaaaaacagaaauaagauuaauuccaauaccgaucuacuuaagcaagaaugaugacgauauaaaagaauacgucaaaaauuaucuaaacgacagaguaaacucaaaauuaaucgauuucacaaaaauuuacgacaaacuauacgucaacucccuaauaaaaauaaacggauaucuauauuaucugggcggcaaaacuaacgacaggguguggauagacaacgccguaagcauaguucuagaugauaaaauagaauaucuuauaaaaagaauaagcaacgacauaaaguauggcuaugaaaucaacgucucagacgaugaauuaauggauauuuacgaaucacuugcagaaaaggccaauaaaaaaauauucuauaauagacuuuccgacuucgaaaaaauauucuccaauauggacgucaaaaaaaaauuuguaaaacucgaaaaaaacgauaaaugucgaguauuauuacaacuacuaaauguucucacagacagucaaacgacauacaaauuagaaaugguaggauuaaaacauagcagaaguaacaucggaaugaagauuucaaaccuagaagaauuuaaagucaucaacaguagcauaaccgguuuauauucaaacgaaauugacaucuuaaacauuuga

SEQ ID NO: 8790 - RNA, 4026 nt, Artificial Sequence
  Cas9 variant
auggaaaaagacuacuaucuaggacuagacauggguuccgguucugcuggaugggcaguaacugacgaucaauaccacguccuaagagcacacggaaaagcaauguggggaacuagacuuuuugaaucagcaaacaccgccgaagaaagaagaauaaaucgcaccgcaaggcguagacugaaaaggaggaaccaaaggauagaaugguuacaagaaauauucgccgaagaaaucaauacgaaagauaguggauucuuucggagaaugaaagaaaguagguauugggcggaagacaaaagagaugaaaauggaucauguccugaaaugccauacucacuauuuauugacgaagauuucacagacaaagaauaucaugaaaaauuucccacaauauaucaucuuagaaaauaucuuaugaccacugaagaaacaccugguauucgcuuaguuuacuuagcauuucaccauaugaugaaacacaggggacacuuucuacuuaacggaaacauugaagaaauucgcaaauuucguaaaacuuucgaucaauuuuuagaaguaguacgaaaugaagagaugggauucgccggcgaaaucgaagaagagacauauaagaaaauagaaaugacauugaaagaugugaauuugacaagaucugccaagaaaacaacuuuaauaaaaucguuaaaaguaacuaggguugaggaaaaagaauuguuggcauuaauaucagguuguacagucaaacugaguaacauauucaacgauaaaucacuagacgaaacagaaagacccaaaaucucguucgcggaugcaggauucgaugauuaugaagcggaaauucaaagcaacuuaaacgagaaauauuacauuauugaaagcgcgaaagccguauaugauugggcggcguuagcagauauucuuggagaauacagcugcauaucagaagccaaagucgcccuauacgaaaaacaccauaaagacuuaaaaagacugaaagaucuaguacgaaacaauauaucuucagaaguauauaaagagauauuugucgauguuucagguaaauauaaaaacuacugcgcauauaucgguacaacaaacauaaacgguaagaagaaagauuuugaaggcaagaaaugcacaaaagaagauuuuuaugcauaccuaaagaaaucaguaaucgaauguauaaacgauagugagaaaacagauuggcuuaaacuggagcuagaaaaaggaaacuucuuacccaaacaauuaacgggagaaaacucagugauaccguaucaaguacacuuauacgaacuuaaugcuauaauuaccaaucuacaagaaaggaucccacuuuuaaaaagagauggugagaaaauuagacaaauauucacauuuagaguuccauacuacguaggcccccuaaacggaaucagcauagacggcaagaaaacaaauugggucaaaagaaaagaaggcgugauauaucccuggaauuucagugauauuguugacgaagaaagcagugcagaaucguucauccggcggaugacaaacaaauguacauauuuaauacacgaagauguacuaccaaaauacuccuuguuauacagcagauuugaaguccuaaacgaauuaaacaacguaagacuaaacggagaacuucuaucaguugaauugaaacagaaaauauaugaagacguauuccaacgauaccgaaaaguuacacagaaaagacuaaaaagguauuugcuaacagagggaauaauagaugaaaauacaguaauaacaggacuagauggagauuucaaaggaucauuaaccgccuaucaugacuucaaagagaaacuuacuggauuaaauuuaaccgaaagagaaaaagaagaaauaauauuaaacauaacauuguucggagacgcgcguagccuacuuagaaaacgaauuggaaaaauuugcucccaacuaucggauaaacaaaaagaaaaucugucaaaacuauccuaucaaggcuggggcagauugaguaagaaauuccuuaaugggauagcaaucucaguucaaggagaagaagaauggacaauaauaaaagcacuaugggaaacccaagauaauuuaucacaacuaaugggcgcgaaauauacauuuagaaacgcaguagagaaagagaauggagaacuagaaaauagagaaauaucauacgaaacagucaaagaccuuucaauauccccaucagucaaaaggcaaguauggcaaucccuauuaauuguuaaagaaauuuguaaaauacagaagaaacccccaagaaaaguauuuguagaaguagccaaagagaaaacaaacagcggaagaacugaaucacgcaagaaacgacuacaagauuucuacaaauauuguaguaaauaugagaaagaacuauaugacgaaucaauucaaaauaaacuagaaaaaugcucagaaagcgaccuacgaucggacaaacuuuuccuguacuacaugcaaaugggacgaugcauguacaccggccagccaauugacuucgacgaauuguggaacaaccagaaauaugauauagaccauauauacccccaaagcaaaacaauggaugacucaaucgauaaccgggugcuaguuaaaagaauaucaaaccaagagaaaacagauguuuaccccaucagagcagacauuagagaaaaacgaagaggcuucuggaaggaacuaaagaauguaggguuaauaucggaagagaaauauaaacgacugacucgagcaacagaguucgaaccggcagaauuagcagguuucauaaguagacaauugguagaaaacagacaaaccacaaaaguaguagcaagcauacuuaaacaggcgaugcccgauaccgaaauagucuauguuaaagccagaaccgucagcgaauuucgacauaaauuuaacuucaucaaaguuagagaaaugaacgacuuucaccacgcuaaagacgcauaucuaaacguagugguaggaaacacauauuuaguuaaauucacaaaaagcccaguuaacuucauugaaaaucacagcaauagaucauauaauuuaaagaaaauguucacagacggaagaguagagaggaauggcgaaauagcuuggauuucaggggaaaaugguacuaucggaacaguaaggaacaucaugaagaaaaacaauauccuaguaacaaggagagcucacgaagccacgggaggauucuuugaucaacaacuaaugaagaaagguaaaggacaagucccuguaaagggcucugacgagcggcuauuagacauugaaaaauauggugguuauaauaaagaaacaggagcauacuucguccuuguagaaagugaugaaaagaagggcaaaaagaaacgaaccauugaguaugugccaauacgauugaagaaacaauuagaaaacaauagaaaagcacuagaaaacuaccuaugcgaacaaagaggauuaacuaaccccguaguccuaauagauaaaauaaaaauggauucauuauucagaguagacggauucuuuauguggcuaagugggagaacuggaaaccaauugcuauuuaaaugcgcaaaccagcuaguacuuagcacagaagaugaagcaacacucaagaaaauugucaaauuugucaauagaagaaaagaaaacaaagaaauuaaaauauaugaaucagacaaauuaaacgaagaaaugcucaaccgauuauauaauacuuuccucuauaaacugcaaaacaguauauauggaaauagauuaggagaacaagccaaaaccuugaguagcaagaaagaaaacuucgacaaacuucaaauagaagaaaagugccuaguucucuaugagaucuuacauauguuccaaugccaaagugcuacauccgacuuacaacuaauugaaggcccuggaaaagcugggacauuaagauuaaauucaaacauaacaaaauacaaaaacauaaauaucauuaaccaaucacccacugguauauaugaacaaguaauagacuuacagaaaauuuga

SEQ ID NO: 8791 - RNA, 4026 nt, Artificial Sequence
  Cas9 variant
augggaaaaggguauuacguaggauuagauaugggcacaggaaguguuggaugggccguaacagaugaaagcuaccaaauccuaagaagacauggaaaagcaauguggggagugagauuauuugaaagcgccaaaacugcagaagaaagaagaauguuucgaacaggaagacgccgauuagauagaagagguuggcgaauagaaauacuccaagaaauauucgcugaagaaaucucaagaguggaucccggauucuuccuaagaaugaaagaaucuaaauacuaccccgaagauaaaagagacauucagggcaauuguccagaacugccuuacacuuuauuuguagacaaaacauuuacagacaaagauuuucauaagaaauauccaacaauuuaucaucuucgaaaaauguuaauggaaacugaggacacacccgauaugcgacugguauaucuagcuuugcaucauaugaugaaacauagaggacacuucuuacuuagcggagacauuucacaaguaacagaauuuaaaaacacauuuaaucaauuuauugagaacauuagaaaugaagaaauggacuuugaaauagaacuagacgaaagcgccguacaaaugauagaagaaacacuaaaagauaaaaaucuaacacgcagugcuaagaaaaguaaacuuguaaaaggccucaacgcgaaaaacguaagagacaaagcauuucucacacuacuuaguggaggaacaguuaaacuaagcgacuuauuugguauggaagaacuaaaugaaggugaaagacccaaaauuucauucgcagauaacgguuacgaagaauaugcagcagugguagaaauggaauugggggagcuauacuacauuguagaaagcgcuaaagccgucuacgacugggcaauacuaagcgauauuuugggcggaagcacaucaguaucggacgcaaaaguaagagcauacgagaaacauaaagcagacuugaaauaccuaaaagcaguaguaaaagaauauuuucccaaagaaguauacaaugcaguauuuguugaaagcagcgauaaacuaaauaacuacccggcauacauagggaugacaaagaaaaacggaaagaaagucucgcuagaagggaaaaggugcagcagagaggaauuuauggacuuccuaaagaaaaacauugucguuaaauuaccagacgaagaagcaaaaauguaucuacaaagugaauuagaaaaagacucauuucucccgaaacaaguaaacaaagauaauggagucauccccuaucaggugcacaaauaugaacuaaagaaaauacuagacaaucuaggugauaaaauaccauucuuaaaagaaaaugcagagaaaauagaaaaacuauucucauuucguauaccauacuacguaggaccccuaagaacgggaaacggggaaaacucaaaauuugcaugggccgaacgcaaaucuacagagaaaauauacccauggaacuuugaaaaugugauagauguagaacaaucugcggagaauuucaucaggaggaugacgaauaaauguaccuaucucaucggagaagauguacuuccgaaagauucauuauuguauucgaaauucaugguauuaaaugaacugaauaaccucagacuagauggccagaaaauaaguguugaacuuaaacagaaaaucuauagagacguauucugcagaagcaggaaaguuacccaaaagaaacuaaaaucauaucugauacgcgaaggcauagccggcaaaaauguagaacuaacaggaauagacggagauuucaaaggaucacucacagcguaccacgacuuuaaagaaaaacuaauugacguagaauuaacucaaaaagaaaaagaagagauaauucuaaauauuguccuauuuggugacgauaagaagcuguuaaaacaaagguugaagaagaaauucccacaacuaaccgaaaaacaaaucaauacaguaacugcacucaguuacaaaggauggggacgacuaagcaagaaauuauuggaagaaguaacaguacccgccccagaaacaggagaaguauggaacauaauaacagcauuaugggagacaaaugauaacuuuaugcaacuacuaaguaaggaguaucaauuuagcgaccgaauugaagaguucaacgaagagaaagcagaccccgaaguaagcuaccaaacuauugaagaccuauauguaucaccagcagucaaaagacaaauauggcaaacacuacaaaucauacaggaaauugaaaagguaaugggugaaaaaccaaaaagaguauucguggaaauggcgagagaaaaacaggaaaauaaaagaacugaaucaaggaagaaaacauugucagacuuauauacaaaauguaagaaagaagaaccagaauggauagaagcacuaugcacaagucuugaaaaacacgaagaacaccaacuuagaucagauaaguuauaccucuauuauacgcaaaaaggaagauguauguauaguggagagccaaucgaccuugaagaccugugggauaauacaaaauaugauauagaucauaucuacccccaauccaaaacaauggacgacucccuaaagaauagaguauuagucaagaaagaauacaacgcuaagaaaucagauacauauccaaucgcagcagauauccaaaagaaaaugaugcccuucuggaaaucacugcuaacagguggcuuuauaccaaaagaaaaauacgacagguuagugaggaauaauccauuagaugcaaaugaacuagcgggguuuauugaaagacaaauaguagaaacacggcagucgaccaaagcuguagccgagauauuaaagaaaauccuacccgauaccgaaaucguauacgugaaagcaaaaacuguauccaaauuuagacaagacuuugauuucauaaaaguaagagauaugaacgaccuacaucacgcuaaggaugccuauuugaauauaguugugggaaacguguacuucguaaaguuuacuaaaaaugcagcaugguuuguuaaagagaauccagguagaaccuauaauuuagaaaagauguucauaugggauguagcgcgagauggugaaauagcauggaaggcagggaaaagcggaaguauaguucaaguacgcgcuaugauggagaaaaaucacaucuuaguaacuaggagaaguuaugaaguaaaagggggacuauuugaucaacaaauacuuaagaaaggaaaaggacaaguaccaguaaaagaaucagacgaacgacuaagagacauuggaaaauacggcgguuacaauaaagcggcugguguuuacuucaugcuuguuaguucaaaagauaagaaagggaaagaacaaaggacaauagaguucguucccauauacuuaaaggauagaguggaaaaagauauggaaagugcacgaaauuacuuaauggaagagaggggauuaagggaacccaaaauacugauaaagaaaauaaaaauugacacacuauuuaaaguggacggauucuauaugugguuaagugguagaacgucaaaucaacucauauucaaaggagcaaaccaacuaauacugaguaaagaggacaugaaaacucucaagaaaguuguuaaauacauucaacgacaaaaagaggacaaaaauguaaaaauaaguaugcgagaugggauaacagaagaagaauuacuaaaacuuuacgaaacuuuucuggauaaaauacgacacucaaucuauggcgcacgacuaucaagucaagaaaagacccuaguuaacggaaaggaaaaauucaucgaccuaucaguagaagcgaaaugucaagucuuguaugaaauccuucaucuuuuucaaugucaaucgggggcugcaaauuuaaaaaugaucggcgggccagcuagcgcugggauacuggucaugaauaacaacaucaguaaauguaaaaacauuucuauuguaaaccaaagccccacugguauauaugaaaaggaaauugaucuucuaagaguauga

SEQ ID NO: 8792 - RNA, 4026 nt, Artificial Sequence
  Cas9 variant
augacucaaaaaguaaucccuuauaacauaggauuagauauuggcacaaacuccgucggaugggcaguuacagauaacgaaaacaaauuacuacauauaaaaggacacaacgguaucggagucagacuuuuuaaagaaggacaauccgcugccgaacgcugcggauuuagaacaacuagacggcgauuaucaagacgaaaauggagguuaagacuacuaaacgaaauauuugcagauaaaauagcaaaaguugacccaagcuuuuucgccagauuaaaacaauccaacgugucccccaaggauccaaacaaaaccauguucggaaacauucuauuugauaacggaaaccuuaacgauaaaagcuuucaugacgaauauaagacaaucuaucauuuacgacaaaguauaaucgaucauccugaaaaaaaguuugacauacgccuaauauaucuggcaaugcaccacauaaucaaauaccgaggacauuuccuaaaccaagcaaacguacaagauuuuaaagguggcaaaauugaucucgaagaauccuuuaaagaccuaaauuccauauucgaaaaucaagggagggacuuaaggcuugucacagaggacgcgaacaaauacguaaaagaacuaucagauaauucaaaaacaagaaacgauagacaaaaagaauuaucuaaaguuuuauauauuccgauagacaaaaacagugacaaaaacaauaaaaaaguaacaaccgaaauaauaaaagcgauucuagggaugaaagcaaaauucgacguaaucuucggaauagaugccgaaaacgcaaaagaauggucacugacuuuuaauucagacgacuuugacgauaaaauagaaggucuauccgcccaaaugacugacgaagcaggcgaaauucuuuuaauacuaaaagaauuauauuuugcccuaaauuuaucugacauccuaaauaacucugucacugauaaaaacgcgaaaacccuaucugaagcuaugauaaaccgcuacgacgaccacaaagaacaacuaaccaugcuaaaacaaguaauugauaacucagacaaaaaacacgccaaagcauuaaaagcagccuauucagcauauaucgacggagaaaacaacaaaaagauauccuuugaagacuuacgaaaacguauccagaaaaacuuagacaacucagaaacauccaaaaaaauaaaugauuuguuagaacaugacuauuucuuacccaaacaacgcuccaaggaaaacggcgcuaucccacaccaacuacaacaacaagaacuggacaaaauuaucgaaucccaaaaacauuauuacccauuucuagcagaauuaaacccaaaugaaaaaagaucccgacaagcaaaauacaaauuagaugaauugguagcauucagaguaccauacuacgucggcccaaugguuaaagcaacagaaaacaaccagucgaacaauggaaaauuugcguggaugauuaaaaacgacaacaucuccgacaaauugaaaaaagaggaaaucaccccauggaauuuugacaaaaaagucgauagaaccgaaaccgcaacgaaauuuauaacccguaugaccacaacagauacauaucuaaucggcgaacccguauuacccaagaacagcuuauuguaucaaaaguuuguuguccuaaacgaauuaaacaacuuaaagaucaacaaacagccuauaacccccgaacagaaacaauacguauaugaacaugucaugaaacaaaccaaaagagucucccuaaaaaaaauagcagacgcacuagucauaaagggcgacuacccuuaugcaccagaaauaaccgguaccacugaucaaaaaaauaugaauaacggacuaucgacuuacauagacuuagccaaaauauuuggagacgagcucgacgauauagaucguaaagaagacuuugaaaaaauaaucgaguggucaacaauauuugaagaccaacacaucuucgcacuaaaacuaaaggaaauuaaauggcuuacagaagaucaacggaaacaaguagugaaacuaagauaucaaggauggggaaaauuaagcaaaaaacuacuagcugaccucguugaugacaauggccaaagaauuauagaucuacucugggauuccaaacaagauuucaugcagauuguaaaccaaaauagcuucaaacaggcgauagcugaacauaauggcgcccaucuagaggaaaaagaccuuaaagauauaauaaacaauuuauacacaagcccacaaaacaaaaaagccauuaggcaagucaucuuaguuguagaugacauuauccgagcagugggauacgaacccguaaacauaaugauggaauucgcacgagaagacucuaaagaccaucgacuaacuaauucacgaucuaggcaacucgaaaaaguauacaaagauauuacaaauuccugguuugacgacgauaacguaaaagacgaauuaaaagacaaaauaaaagacaaagcgaaauuuacagacagacuuuacuuauacuuuacacaaggcggaaaagauuuguacaccggugaaccccucgacauagauaaccuaucgaauuaccaaauagaccauaucuuaccacaaucuuucauucuagauaauuccuuagauaaccgcguccucaccuccaaaauaaacaaccaaauuaaaaaagauaacuuacccggcgaguucuuuggaucgaaaaugcacaauuuuuggaaacaucuaaaagagcuacaccuaauaucaaacaaaaaauauuauaaccuuacccuaacucccaauucaauaucaaaauucaacaaccaagguagauuuauaaacagacaacuaguugaaacacggcaaguuauuaaacuagcagcugagauccuacauaauagauauucagaagaaaacggaaccaacauaguaaccguaaaagcaaaucuaacacaccacaugcgcgaaaaauuuaacuucuauaaaaacagaaauguaaaugauuaucaccaugcauucgacgcauaucuagcagcauucgucggaaacuggcucuuacaacaauacccuaaacuaaaaccuuacuucguuuauggagacuucgccaaaacagaaauagacaacuuaaaaucauucaacuuaauauauaaauuugaacaagcccaucaacuaaacgaagaagacgguaagauagccaaggacaccgaugcacuauuaggauacaugaaaaacguauaucacuucaaaaaaaugcuaguaacaaaagaacuugaaacgaaucacgggaaccucuuuaaacaaacacuauacccaucacauggaaagaugaaaaaccuaauaaauccuaaagaaaacagaucuucagacaucuauggcggauauucaucggagaccggagccuacgugucacuaauaaaaguauucaaaaaaaacaaaauagaaaauaaaauaauaaaaaucccccuacuauauaucgauaaacuaaaccgucaagcaaacgccaaacaauucauaagaaauuuuauuauaaaagaugauucaaauaaguuugauauccucagcgaaaaaauauuuuuaaaucaacuaguaaucgauggagaugaacucuucacaaucuccggcaguggugacagacaaaacgcacaacaauuaauccuaucagacaaaucgcuuaaaauucucucaaaaaacaucaacguuaucuccaaaaacgauuuaaucauaauuuuuaacgaaauaauagaugauauaugcaaauacaugaaaauguacgaaguggaaaauagcgaugaaacaaaagcaaaauucgaagaaauaaaugacaaagacagaauguuaaaaauaauaaacgacuuauuacuagguuuacaugcaaaugcaagucguucgaaccuaucaucaauuggacuaucaccaucauuugguagauucuuuucaggaaacgcagggauaaaacucagcgaaaacgcaaaauuuauauaucaaucuccaacaggacuauuuucacguaaagucaaaauuucagaccuauga

SEQ ID NO: 8793 - RNA, 4032 nt, Artificial Sequence
  Cas9 variant
augacguacuaccucggacuagauaugggaacaucauccguggguugggcgguuacugaugaaaacuauaauuuaauacaucgccaccguaaagaccuaugggguaucagagaauuugaagaagcgaaaacagcagucgaaagaaggacucagagaaucucaagacgaagaagacaaagagaaguggcacguaucggacugcuuaaagauuauuuccacgaugaaauucaaaaaguagauccaaauuuuuaccaaagauuagacaauucuaaauacuuuccugaagacaaagaggaaguaguaaaagggaaaaacggaauauuugcagacgaaaauuauacagaccgggacuauuucgcugaauaucccacuauauuccacuugagaagagaacuccucaauagcaaggaaccccaugaugugagauuacuguaucuggcuuuauuaaacauguauaaacaccgaggccacuuucugaacacaacacugggaacagauggagaaaacagaaaauuaucagaugucuaucgcgauuuugucguaaaaacagaagaaguucuaggcuuaaccuucccacaagaaacagauaacggaaagaugcaagaaauuauguguucccgcgaguuuaguagaaaaaggaaagcagagcuuuuaugugcuuuacuagagaucgauaagaaacaaaaacaacaaguugcauuaauagaaugugugcucggacuagauaaauccguaaaacaaauguacggaaccgcugucccagaugauuucgacaaaaguguaaaaguaaacuucagcgauucaaguuuugaagaaaaaguaagcgaaguagaagaauuauuagaugaagaaaaauaugaacuuauauuaugcaugaaagaacuauacgacacggcaguacucaaucaaauuaugggcgacugcaacuauuuaucagaggcuagaguacaagaauacgaaaaacauaaagaagacuuaaaacuauugaaaaggacaguaaagaaauacggaacagcugaagaauaucaauucuuauuuagaagcucggagaaagcaaguuauaacgcauauguacauucuguaaacaguggcgagaaaauaagaaggaauauggacggacgaagccgagacgaccuauauacagugcuaaagaaaaugcuuaaaaacuauccgcaagaagacgcagauugcaaauauauccuagaggaaauagaaaaagaacaauuuuuaccaaaacaauuaguuagcgacaauggugucauaccaaaccaaauacauuauaaagaaaugaagaaaauucuggagaacgcagaacaauauuugcauuuucuacgcgaaaaagaugaauccggguauacuguagcagagagaauacuaaaacuuuucgccuuccaaauaccauacuauauaggaccuaccucagaaaaaucaggcaaaaacggaggaaacggauggguaguaagaaaagagcaaggucaaguauuacccuggaauauagaagagaaaauagacaugaaagcgaccucagaaacguucauaaguagaaugguuagaaggugcacauauuuaagcgacgaaauggugcuaccaaaagcuagcuuagaauacgaaaguuuuugcguccuaaaugaacuaaauaaccucagaauacgaggaguaaaauugccaauaacgguaaaacaagacauauauaaagaccuauuugaaagagguaaaagaguuacuagaaaacagauuguaaauuaucuuaaaggaguaggaauauuacaagaaggugaagaagaugaacuaacaggaaugauggauacuuucaacaguucgcuagcaucguauggcaaauuuaaaucgauccuaggugagaaaauucaagaagacucauguaaacggaugguagaacaaauaauauuuuggugcacuauauacggagacgcaaagaaauuccugaaagaacaauuagaagaaaaauauggagaugugcuaaccagggaacaaaucaaaagaauauuaggauucaaauuaaaagauuggggcaaucuauccaagaaguucuuagaacuaaacggcugcgaucgaaacacuggugaagucaugucacugaucagaaugcuuugggaaucagacgacaaccuuauggaacuuuuaaaagauaguucuuacaccuaccgggcagaauuagaagaacaacaggagaaauuaacgaaaacauuaacagagauaugcccagaagauuuagaaggauauuauuucuccgcccccgucaaaagaaugauuuggcagacgcuacuaauucuaaaagaaguagaaaaaguaaugggagaaccaccaaaaaggguauuuguagagaugacaagagaacacgaugaacgcagagagaugaaagauaguaggggaaagaaauuucaagagcuauacaaaaacauuaaagaugaagaacauaacuggaaagcugaaauagaagaugcggaaaaagaugggcggauaagaaguaagaaaauguacuuguauuuaacccaaagaggacgcugcauguauaccggaaauccaaucgauuuagaagaguuauucaccacaaaauacgacaucgaucacauauacccacgacauuucguuaaagaugacaaucucgauaacaacuugguauuaguagaaaaagagaaaaacgcacacaaaucagaccaauaucccuuaggagaugauaucuauacugggagacucaguugguggaaagaacuacacagagaaaaacuaauaaaugaugaaaaauauaagagacuaacggggagagcaccuuuuucagaugagcaaaaagcaggauuuauagcacgucaauuagucgaaacaucacaaggaacaaaaggaguagcaaguauauuaaaggaaguuuuaccagagacaacaacaauaguguacgcaaaagcaagaaacgucucagauuuccggaauacuaacgaacuacuaaaggcacggucaguaaacgauuuucaccacgcgcaggacgcauauuugaauauaguaguaggaaauguauauuacguuaaauuuacgaauaacccgcuuaacuucgucaggucaggcgaagguuauaauuuagacgggguauuccgaaagaacguaaucagaggacaagaaaaugcauggauuguaaaaccagaaaaaggagagaaaaugacacuugaaaccguaaaaagagugauggcgaaaaacacaccauuacucaccagacuaucuuucgaaggaagaggagguuuggcuaaucagacauuauacagugcaaaagaggcugcaggcgaaggcuacguaccacuaaagaguuccgauucaagacuacaggaugugaccaaauauggaggcuucacgucaguaacaacggcuuauuucauauuaguagaacaugauaugaaaaagaaacgagucaggaccauagaauccguuccaauccuguggaaagaaagaaucgaaaaagaaaguggacaauuagaaauauacuguagagaagcauugggucuaguuaauccggacaucagaguucguaaaauauuaauacaaagucuaguaaagaaagacggauucuauaugcaucuaucaggaaaaacaggaaaccgauuuauaaugagaaacgcaguggaacuauguuugaaacaagaguggauaaauuacucuaagaaacuggaaaaagaaggaugcgaugaaagcauuacaaaagagaaaaaugaagaauuauacgaaauauuaaaagaaaaacacauaaauggcaucuauaggaaacggccaaacccaaugggugaaaaacuccacauacgacaggaaacauucaggauguuaaccuuagaggaacagaagaaagugcuacuaucgcuauuaaauuuaacaaaaauagguccgguugaagcaaauuuagaauuaauaggagaaucagcacauacagggaaaauguuaaucaguaaaaauauaaccgaagucaaagaguucuaucucauacaucaaagcguaacggggauauacgaaaaacaaguaaacuugcuaaccguguga

SEQ ID NO: 8794 - RNA, 4032 nt, Artificial Sequence
  Cas9 variant
auggccacuaagaaagaguacaauaucggucucgauauugggacaacaucagugggauggaguguaguagaaacagauaaccaaaaaguaaugcgaaaaggaaacaaagcauuauggggcguaagauuauucgaagaagcaacaacagcagaaagucgcagaaugcaaaggucaacaagaagaagauaugauaggcguagagaacgaauaaaauuacuucaagaggaauuuuccgaagagauaaauaaaguugacaaaaacuuuuuccaaaaacuuaaagaauccaaauauguagaaaacgacaaaauaaacaagaaaauaguacugacaaaagaagaaaaacaagaacuaaaagacuaucaaaacaaauauaaaaccauauaucaccuacgugaugaacuaauuaauaacccagagaagaaagauauacgauuaguauaucuugcgauacaccacauaauaaaauaccgaggaaauuuucuauaccaaaacgcaaauuuuaauauugauaaccuugacauaaaagacaaacugaaugaauuauucuccauauugaguaacaacauacaagaauuagaaauaccagaggacuacauaaacauaauagacuuugaugaauuagaagcagaccuacuaaaagauaccaaaaacgacgugaaagcacuacucauugacaaccuuaccgaacuaacaaauaaaucaucagcaaccgaguuuggcaaauuaaugguaggcaacaaagguaacaucaauaaacuauuaauguuagaaacugacaacaaaauugaaauaaguuuuuccggcacagacuacgaugauaaauaugaagaauaccaagaggcacuaggagaaaacauagaaauccuugacauuuuaaaacaaauuuacgacuguauauuucucaagaaaauauucaaaggaaauaaaaacacaucaauaucaucguuaaugguuaaaucuuuugaacaacauaagaaagaccuaaacuuccuuaaagaauuauucaaagacaacagagaacuauacaaugaaauuuuccgaaccaagaaagaccuaugcuuauaugagaaauacauuacaaacaaaaucgacugcgacgaauuucgaaaagaaauuaauaaacuacuagaaucccuauucucugaugaaaauauaaaacaaaauuugcucgacgaauacaaucuugagguaaaagagagaauagaaaauggaacuuuucucccaaggauaacaacaaccgacaauggaaaauaccccuaucaacuaaauaaaagugagcuuauaaaaauaauagaaaaucagggaaaauacuacccauuucuccuuaacaaacuaaacgacaauaaaacuuauaaaauaguuaaacuucuagaauuuaggauaccauacuacguaggcccccugguuucagagaaaagaucugaaaacucauggcuagaaaggaaaaucaauaauguaaaaaucaccccuuacaacuucgaugacguuguagauaaagagaaaaccgcugaaaaauucauuaaacguaugauaagucacugcaccuacuugcuugacgaauaugcacucgcaaacaacagcauacucuacucagaauuuaaaguaaugaacgaauuaaaacaaauaaggguaaacgauagaaaauuagaauuaaaauuccaacaacaaauacucgaggacuucuuuaagaaaacaucaggaacaauaacagaaaggaaauuuaaaaauuaucugauaucaacaggggaauacagcauggaaggcggaaauuuccgaaucaccggcuauagugcagacggaaaauucgcaaacaauaugcagucauauguagacuucuucggagagaacggaaucuuugcagacacagacuauaaucucgaaaacgcagaagaaaucauagaauggaucacaauauucgaagauaaagauauacuugaaaagaaaguaagagauaacuauagcaaacuaaaugaaaaccagauuaagaaaguacuagcaaagaaauauucaggauggggaagccuaaguaagaaacuucucaaaacaaaauacuacaaagacaaagcaacggagcuguauaaaucaauccucgaccucauguacgagaccgacaaaaauuucaugcaaauaauaaaugaugauaaauacaauuuccaagagaugaucaagaaauucaacaacaaagaagagaacaagaaacuaaacuacucaaucguagaagaacuagcaacaaguccugcaacuaaaagaggcauauaccaagcacucaaagugguugaggaacuuguagauuauauaggauacgaacccaaaaauaucucaaucgaaauggcaagaucagaagaagaaaaaguaaggaaagauaguagaaaagauuacauuaauaauuuauauaaaggaugcaaagauuccauagaaaauuacaagaaauuaaaacaugaacuagauucacacgaaauaacaucccaaagacuguuccuauauuuuauccaagaaggaaagugucuauacacuggcacgccacuaaacaucgaagacauagaaaaucaauccuuauaugaaauagaccacaucauaccaagaagucuaauaaaagacgacuccauagacaauaaagcauuaguacuaaaagaauguaaccaagacaagaaggcuucguacgucuuaccuucgaaguucagaaacucaaagcagaaaaccugguggaaacauuuaaaagauaauggucuaauguccgccaagaaauuucacaaccuaauacgagaaaaauacaacgaagaagacauaaauggauucauaaauagacagcuaguagaaacaagacaaauaacaaaacauguggcuaacauacuaaacaauuuguacaaggauacaaaugucauuuauuuaaaagcagaccuuucccacaacuauagggagaaauaugacuuauucaaauucagagacauaaaugacuaucaccaugcacacgacgcauaucuagcagcaguucuaggggaauacaaagagagauucaugaaacgaaaaauaaacuuugacauggucaaagaacugaacucaaaaauagucgaaauggacgaaggcaaaagaagaaaucuacgauucggauacgucauaaacagucucgaugaaaaccuaaaugacauaguuuuaaaaauaagcgaaaaucuagucgauaaugaaacaggugaaguauuauuugacgcucaugaauuuaauaaaagaguagaagacacuuuauauagaaacgacauacuaaucuccagaaaaacagagauaagaacuggccaauucuacaaagaaacuauauacaagaaagguaaaggcacuaucccaaucaaauucgguaugccgaccgacauuuacggcggcuacucuaauacaaacgcuaggaaacuaaugcuuauagaauacaaugaaucuaaaaugaaaauaaucggguuacccauggccuuagcaguacgaaauaacgacgccgaaauaaaugauuacauuaaaacacaaauaaaucucaagaaaaacaguacauuuaaaaucaagaaaugcuccaucccauuugaaaccgaaauaauauacaacaaucaaaacguauucauaaagggauauaguauaggucauaagaacugugaaaucagcaacgcaauacaacucaaaauagccaaagacaaaaugaaacacuggaaauacgcacuacaauacuuacuaaaugauaagaaacaauacauagauuuugccgaaaaauaugucaaugaaauauacgauuuccuaauaaacuuagaucuguuucccuuguucaacaaagagcuagacaaaaucaaaaacaaaguaaacuuugaagaccuugccuuagaucaacaaaagaaaaucacuaaagaacucuucaaaaugcuacauugcaacaguguaaacgccaaccuaagcgaauuuggacuuggugaccgcaugggacgacucucgggauacaacauaacagauggaauaauaauaucaaaauccguaacaggaauaagagaauccagauacgaguucuga

SEQ ID NO: 8795 - RNA, 4035 nt, Artificial Sequence
  Cas9 variant
augagccaaaacaauaacaaaauauacaauauagguuuggacaucggagacgcaucaguaggaugggcaguagucgacgaacauuauaacuuacuaaaacgacauggaaaacacauguggggcucccgacucuucacucaagcaaacacagccguagaaagacgcucaagcagaucuacacgcagaagauacaacaagagaagagaacgaauuagacuacucagagaaaucauggaagacauggucuuagaugucgacccaacauuuuucauacguuuagcgaauguaucguucuuagaccaagaagauaaaaaagacuacuuaaaagaaaacuaccacagcaacuauaaucuauucauagauaaagacuucaacgauaagaccuauuacgauaaauacccaaccauauaucaccuccgaaaacauuuaugcgaauccaaggaaaaggaagauccacgucuuauauauuuagcgcugcaucauaucguaaaauacagaggaaacuuucuauaugaaggucaaaaauucucaauggacguuucgaacauagaagauaaaaugauagauguucuaagacaauucaacgaaauuaaccuauuugaauacguagaagacagaaaaaaaaucgacgaaguucuaaauguauugaaagaaccacuaucuaagaaacacaaagcugaaaaagccuucgcuuuauuugauacaacgaaagauaacaaggcagccuauaaagaacuaugcgcagcauuagccggcaacaaauuuaauguaacaaaaaugcuaaaagaagccgaacugcaugacgaagacgaaaaagacauauccuucaaguucuccgacgcaacauucgacgaugcuuucguagaaaaacaaccacuguuaggagauugcguugaguucaucgaccuacuucacgacaucuacucuuggguagaauugcaaaacauacuagguucagcacauacaagugaaccuaguauaucagcugcaaugauacaaagauacgaagaucacaaaaacgaccuaaaacuacucaaggauguaauacgaaaauaucuacccaaaaaauacuucgagguguuuagagaugaaaaauccaaaaaaaauaauuauuguaacuacaucaaccacccuucaaaaacuccagucgacgaauuuuauaaauauauuaagaaacuaaucgaaaaaauagacgacccugaugucaaaacaauauuaaacaagaucgaacucgaaucuuuuaugcuaaaacaaaacagcagaacgaauggagcaguaccauaccaaaugcaguuagacgaacuaaauaaaauacuagagaaucaaaguguuuacuauagcgaucuaaaagauaaugaggacaaaauuagguccauccuaaccuuccguauaccauacuauuucgggccauuaaacauaacaaaagauagacaauucgacuggauaauaaagaaagaaggaaaagaaaacgaacgaauccucccauggaacgccaacgagauaguagauguagacaaaacagcagaugaauucauaaaacgaaugagaaauuuuugcaccuauuucccugacgaaccaguaauggccaaaaacucacuuacagucucaaaauaugaaguauuaaaugaaauaaacaaauuaagaaucaacgaccaucuuauaaaaagggacaugaaagacaaaauguuacauaccuuguuuauggaccauaaaucaaucucagccaacgcgaugaaaaaaugguuaguaaaaaaucaauauuuuagcaacacggacgacauaaagauagaaggcuuccagaaagaaaaugcauguucaacuucauuaacgccauggauagauuucacaaaaauauucgggaaaauaaaugaaagcaauuaugauuuuauagaaaaaaucauauacgauguaacaguguucgaagauaaaaagauacucagaagaagacuaaagaaggaauacgacuuagacgaagaaaaaauaaaaaaaaucuuaaaacuaaaguauucaggguggaguagacuaucuaaaaaauuacuaucuggaaucaagacuaaauacaaagacagcacuagaacaccggaaacuguccuggagguaauggaacgaacgaacaugaauuuaaugcaaguuauaaaugacgagaaacuaggauucaaaaaaaccauagaugacgcaaacuccacuagugucucagguaaauuuucuuaugcagaaguucaagaauuagcaggguccccagccaucaaaagaggaauauggcaagcuuuauuaauaguagacgaaauuaaaaagauaaugaagcaugagccugcacacguguacauugaauucgcaagaaacgaagacgaaaaagaaagaaaggauucauucgucaaccaaaugcuaaaauuauacaaagauuacgauuucgaagacgaaacagaaaaagaggccaacaagcaccuaaaaggagaagaugccaaaagcaaaauaagaagugaacgacuaaaacuauacuacacgcaaaugggaaaaugcauguauacaggaaaauccuuagacauugauagauuagacacauaccagguagaccauaucguuccacaaucacuauuaaaagaugacucaaucgauaacaaagugcugguccuuucuuccgagaaccaaagaaaauuagaugaucuaguaauaccaaguagcauaaggaacaaaauguacggauuuugggaaaaacuauuuaauaacaaaauaauauccccuaaaaaauuuuauucacuaauaaaaacugaauucaacgagaaggaucaagagcgcuucaucaacagacaaauagucgaaacgagacaaaucacaaaacacguagcacaaauaauagacaaccacuacgaaaacacaaaaguaguuacaguccgagcagaccuaucgcaccaguucagagaaagauaucacaucuauaaaaauagagacaucaacgacuuucaucacgcucacgacgcauacaucgcaacaauucuaggaacuuauauaggacacagauucgaauccuuggaugcaaaauauaucuacggugaauauaaaagaauauucagaaaucagaagaauaaaggaaaagaaaugaaaaaaaauaaugaugguuucauauuaaacucgaugagaaacaucuacgcagacaaagacacuggugaaauuguaugggauccaaacuauauagaccgcauaaaaaaaugcuucuacuacaaagauuguuuugucacuaaaaagcuagaagaaaacaauggaacguucuuuaaugucacaguacuaccaaaugacacuaacagcgacaaagacaauacccuagcuacuguccccguaaacaaguaccgaaguaacguaaacaaauauggaggauuuagcggagugaacucauucauaguagcaauaaagggaaaaaaaaaaaaagggaaaaaaguaauagaaguaaauaaguugaccggaauaccauuaauguacaaaaacgccgacgaagaaaucaaaauaaacuaucugaaacaggcagaagaccuagaagaagugcaaauaggaaaagaaauauugaaaaaccaacuaauagaaaaagacggaggauuauacuacauaguggcgccuaccgaaauaauaaaugcaaaacaacucauacuaaacgaaucacaaacuaaacuagucugcgaaaucuacaaagcaaugaaauacaaaaauuaugauaaccuagacagugaaaaaauaauagaucuauacagacugcuaauaaacaaaauggaacuauacuacccagaauacagaaaacaauuagucaaaaaauucgaagacagauaugagcagcuaaaaguaauuucaauagaagaaaaauguaacauaauuaaacaaauacuagcgacguugcauugcaauuccucaauagguaaaaucauguacucagacuucaagauauccaccacuauaggucgauuaaacgguagaacaaucagcuuagacgauaucagcuucaucgcagaaucaccuacugguauguacaguaaaaaauauaaacuguga

SEQ ID NO: 8796 - RNA, 4035 nt, Artificial Sequence
  Cas9 variant
augaagaaaaccaacccauauauauuaucacuugauaucggaacugcaucaauaggguaugcauguauggacuuagacuucaauauccuuaaauaccacgacaaagacgcaauaggaguauuaaccuucgaaggagcagauaccgccgcagaaagacgagguuuucguacaagccggagaagaaagaacagaagaauaaaacgacucggacuucuacaagaagucuuagcaccccuagucaaaaauccaaauuacuaccaacuacuaaaccuacacaaauggaaaaacagcaacgaagauuucaaacacagaucacuaucggaaguacuaaaaauucuagguaaaaacccaaaaacauacccuacaauauaccaucuacaacaagauauccaaaaccaucccgagaagaaauuugaaccagagcuuauauucuuagccuuguaccaccuaguaaaauauaggggacauuuccuauucaacaaucuuagcuuugacaaagggaagacaguagacaaugaagcccaacucucugaauuacucgaacaguaucaaucuauaaaucccuacgaagauaguauaaguaauaaagauauaaaugugauaguugacaccuugaaggacgaccaacuaacaagaaacgauaaaucuaaagaauugaaacgaaacgucuccaaaacacacgcagaacuauucaaaaugcuagucggacuaaaauucaaacaaagcauucucuucgaaaacauggaaaacgccgaagauauuaaagaaucggcaacagguagcgacgccaucucauuaucugaugauuauuacgaaaaccuauccgaauuucuuacagacgaacaacuuaacuucauugaaucugccaacacauucuuuaugggaauaaugcuagaucgaauccuaaaaggcgccacauccaucuccgccgcuaaaguccgagacuauaaaauauucaaaaaucaacuuaaaauaauaaaagacauaguauaucaaaacaaauacgacaaauaucaugaguucuuuguaacaucaaaagaagacaugcgagcauaccaggaaaauccagaugcaaagacauucggaaaacuaagcaaauucgaccaauaucuuauucacccgaaagaucaauacgcaaaacuaaugaaagaucugaaaggcaucguacccaagaaauacaccgaaguauuaaaccugauagaugaacaaaaauuccugguaguacaaaacacuacagacaacgcaucuauaccauaccaaaauaacguguuugaagccgaaaacaucuuacgcaaucaacaaaaauauuauccggaaauaacagaagaaaugauuggaaaaguaauaaaccuaaucucauucagaaucccauacuaugugggaccuuuaacuaacaaaaacggccaaagcgacuucgcguggaugauaagaaaaucugacgaacaaaccuuaccauggaauuucgacaaagucaucgauaaauccaaaucggcagaaaaauuuauacgccgaaugacgucgaaaugcacauaccucuuagaagaagacgucuugccuaaacacagccuacuguaccaagaaauggaaguacucaacgaacucaauaacguccaacuacgcggggaaaaugaaccuaaacaccgaauccaucgacuagaccccaaaguuaaacaauuuaucuaccacaaucuuuuucaaaagaagaaaaacguuacacacaaagaccucaucacucuauuacaaaauucagaacacagaaacacccuaaauaaaacaucuggacaaaaacuuaaagucuuuggaacgcaaaacgacucaaaauucgcuucaaaacucagcacauauaaugauaugaaagcuaucuucgguucaguagaaaauaaacgacaaaugauagaagaacuuguccucuggauaacaauauucgaagacaaagcaauauuaaaacagaaaauaggagaaaaauaccccaacaucacagaaaaacaacuaaaccaaauaguaaaacuaaauuacucaggauggggccgacugagcgaaaaacuacuaacuaaagaagucaauggaagaucauuaauagauuuaauguauucaacagaaaauaauuuuauggaaauaauaacagauaaaacacuaggauuugauuguuuuaucaaaaacucaaacaaaguuaaaaacgccaaaauauccuacaaagauguugcugaauuaagaacaucaccggcguuaaagaaagguauauggaacgcuauaaaaauggucagagaaauuucggaucucuucggggcgccagagaaaauaauaauagaauuugcuacagaagaccaaguaaaaggcaaaagacaaaaauccagaucagaauuaugggacgacuuaguuaagaaaaacaacuugaaaagaaauaagaaauuuaaaggucuguuugaagaacuaaaagccuacccagaccuugacuucucgaauccaaaauuauggcuauacauacaucaaaauggaaaaugcauguacacgaagaaacccauagaucuagaaagauuaaugucggacacaaauaaccaacuauacgagauugaccacauacuaccaagaacauuuguaaaagacgacagcauaaacaauaaagugcuaguaauacaaucagcaaaccagaagaaaagcggagacaaaaugccucuagaaauauuugauaaucauguacuuguaccguucuggaaaauguuauaugaaaacgaccucauaucaucuucuaaacuaucaaaauuaaugaagaaagaauuuaacgacuuagacaaagaagguuucauacaaagacaauuaguagaaacaagacaaauaauuagccacguaucagauuuucuaacagaagaguaccccagcacaacaguaguaccaaugaaagccaauguggucucugaguuacggcgaaaauuugacaucccaaaaauaagacaacuuaaugacuggcaccaugcaguagacgcauaccuuaacggauucguauaucaagcagcccgcguauucuacccgaaagucaacuuauucgaauuuaacuucaaaugggaaaaaguucgugaaaaauggagacaacuaggugaauuuacggaaaacaauaagaaaagggaguucuuccuauucaaaagaauggaaaacuacguaaacgaacacggagaaggaaugaucaguaaacucauuuucgauuuagacaacuucaaauuuaauuauuccagaaaaguagaaaguaccgaaagugccuuuuacaaacaaagcgcauuuucuccuaaaaacaccacagcccaauaugauuccgacaaaaauaaaaccgcaauauauaaagaaaugaaaaauaaaagagguauugugguaucauauacauauguaaagaaagaucaggaauugaucggguaugggguuuucaacgaaacuguauucgaauauguaaacaacgcugacguagacaugaacacaagggcacuuaaaauaguacgaaaagccuucccuaaauuagacauaaagaaagcacaauaccuauucucuauaaauaaaggcgaugcauugcuaguuaauggacacccauuccuauucguaagcgcgaaagaaagaauuaauggaaaacaacucgaauuugauauuaacaugcagagaagacugaagaaagcacuuagaccuuacaacaaaaugacagaacaagaaaaaguugguguauacaaccaauucgcagaaaaaguuguucaagaauacgaaaacagcuuaggggcuaaaacacggaacgaaaaauuagaauuaauaagaaaucaauucaacgaaucugauaaaagcaacgaagcauuaauacaaugcauccuagaaguacucaaaaugacaaaagugucggcggagcggucaguaaaacuaaaaauucgauggggaucacaaacaccgaauacacuaauagacauaaacaacaaagcgaaaauaauguauaauuccaucacagguuugaaacaaacgagacuaaaaucaauauacaaauuagcagaaaguaaaaaugaacucuga

SEQ ID NO: 8797 - RNA, 4035 nt, Artificial Sequence
  Cas9 variant
augaacaaaaacuacuacaucggucuagauauggggaccaacucaguuggaugggcaguaaccgaccaagaguacaauuuaauuaaacuaaaaggcacucacgcuuggggagcaagaauauuccaagaggcaaaagauaaaaaagguacucgcgcaauuagaucuagccgaagaagaauggacagacgaaaauaccgaauacaccuucugaaucaguuauucgcacaagaaauccaagccauugacuccaccuucuuuauccgacuagcauauucagcauacugggaaguagacaagaaagacaaaggaauugggagaaacauauuauuuaaaacaaaacaagaagaaucacaguucuacaaaaaauacccaacaauauggcaucugcgaaaaucccucuuagaaaaccaacccgaugcuuucuccgauuuacguuauguguaucuagcguuucaucacauuaugaaauauagagggaauuuucuccaugaaggagaaauuaaaacaaacgaacuacaaguccaacaaaucgaacaacuuaaucaauuccucauuaauaaauacaaagaaauauacgauaacgacgucgaagaaagaacuuucauugcuaaccaucaaaucgacgcacuaaaagagauauuauugaauaaaaacacuaauaaaaccaccaaagaaaaagaaaucaaaaagcuuuuugauuacgcagacugcgaaucacuugaaccauauauaaguuguuucucuaaauuagcaguaggcgggaaauuugaucucucaaaacucggauaugaagguaacauccaauucagugaccccucuuuugaagaaaaagcaucaaucuuacaagacgauuucagacucauagccauagcaaaagagauguaugacuuugugauuuugaaugaucuauugaaggaccaaccaaauuuaaguacagcaaugguucauguauaugaaacacauagacaggaccuaaaaaagcuaaaagacauuauaauagauauagacgcuaauaaagguuuacaaaauaaugauagaugguauuucaaacuauucaaagauaaaaacgcgccaaaaaacuacuccgcauucauccauaaaaauuccaaucaaaaacgaccaagcauagacgaguucaaugacgagauaaaaaaaauacuuaucgaacaccgcaacgacguaucccuggaaaaacaagacgaccucaaaaugcuauucgaaaaaguggaaaauaagacacuauuaaaaacgauagccauacaauccacgucuguaauuccacaccaacuucaccuagacgaacuagaaaaaaucauagauaacgcaucaacaaaauaccccuuucuaucgaacaucagagauaagcucguauugcucuuuaccuuccgaguucccuauuauuacggaccuuugaaugacaaaucccccuacuccaacguagagagaaaacaauucgcaacuguaacaccuuggaacuuugacgaaauauuugaugagaacaaaacccgagaaaaauucaugaagaaacucacaaauaacuguacuuacuugagcggugaaacaguaaugccaaaaaaggcacucgcauacgaagauuauuuaauauacgaccgauugaacguuuuacuuguaaauggcgaauacuuaagccuacaagaaaaagaaaaaaucuaccacuaccuaauaucacggccaaaaacaacuuuagaucaauuaaaaaaagaauuagccaaauggcacaaucaaaguccgauugacauaaucuuuucaaauauucaugaagaaaucccauuugaggccucaagccacgcacaccucaugaaaaguuucgacuuagaaaaacaaaaagaagaauuagaacgauacaucacuuuagccacuauauacgccgacgacaaaaaaucacuaaaagaauuacuaaaaaaugaaucucuacuagaugaaaaucagaaaaaugucauucucacacuaccaacgaaaaaaugggcaccuuuguccuauaaacuucuacaaaauauaguuuauacugacgacuacggcguaguacauucuauacuagacauaaugaaagaaacgaaccaaaauuuccaaauggugcuacauaacgaacaauaccauuucaaagaacuaaucgaacaagagaaccaaaaauuuacccaagaaaaaacaaucgaagaucuuauagaagaaaaauuggaaucaauuccaagucuaacacagagaucaauacgucaaacacuacuaauuauugaugacaucauuaaggcaucacaccaaaaagugccagaaaaaauuuucauagaaguaacacgcaauaacgacgacaaacgaaaaggacaagauggcaaccaacuugcacgagacaaagaacucaaccgcuuccuaacuaaucuacuaaaggacgaaaaagcuaaccaauucugcgacguaucgcaacuucuaaaagacuuagaagaagucgauaaagucaagcugaaagggaaacacaucuaccuauauuuuaagcaacucggaauagaucuauacacaggaaaaaaaauaguuuuaaaccaauuacuaacuuccacaaaauacgacaccgaccauauaaucccgcaauccuugauaaaagacgacucacuagacaaccuaguccuaguugaacgcgaagucaaucuaaaaguuaaaggcaaucacuaucccguaccaucacgaauacaagacgaacaaaaaaaacuauggcacuuucucuuacaaaaaaaggcaauaagcgaaaaaaaauacgguaaccugaccagaaccuccaaaauaaaacucgaagaaguagaagauuucguagcaagacaaaucaauguaaucaauuauuccaaugugauaauacgggacauucucaaacucaaauacccacacacagacauaauuuuuucaaaaucacaauacccuuccuucauucgaaaacaucugaaaauagucaagaacagagacguaaacgacgcacaccacgcaguagaugcauaccuaaaugucgucucaggcaauuuacuaucaaccacauucucaaaagccuauaucaggaaaaaauauauccaaauacaggacggcgaaaaagagacauucaacauggaaaccauacuagaaaauuacuuuaaaaauaaugaaaaucaauuaaaaauaaaaacaaacugccucaggagagaugcacuaauaacauucaaaguggacuacuucagcggcgaauuuuacggccaaacgcgacuaccaaaaggaaaugaaaaccuuauacccauaacacuaaacgaagacaacccuauguccgacaccaguaaauacggaggcuauacgaaccuugcgcaagcauaccuauucgccguaagcuaucaagaggacggugagaugaaaaaagcaauccugagaguaccauaucuauacgacacuuuauauaagaacgauagugauaaguuacuaucgaaaguucuagacaacccaaaagcaacaaacauacaaauacugcguaaaauccaucuaaaccaaaaaauaagauuuaacgacgguauauauuugcuauauacaaacgaaaaagauagaaacaaauauaaaauggcauaucaaaacuacauagacaaugauuaccuauacuauuuacauugggccaacaaacacuuagaggaacuauuagacaaucaagaaaaacaaacuuucauuuacaacucaaaaaacgaccaauucgagguaucgaaagccaaaaauaaagaaauauuccaauauuuacuacaaaaaaccaaagccaaagucuaugacacuugcaacuacauagugaaagcgagagagaccaauaucgaaaucuucgaacaacuaacucuaaaagaacaaauaacuaugauuaaccaauggaucaagaugaugagucgagacugcgaaaaaguaaaauucgaugcucguuucacaaauuucucaaacugucuucucagacucucaaacaauauuaacccgaaagauucaauuacaaucauauaugaaagccccaccggauuauucaaacaugaagugaaaauauga

SEQ ID NO: 8798 - RNA, 4035 nt, Artificial Sequence
  Cas9 variant
augaagaaaaccaauccauauauacugaguuuagacauagggacagcaaguauaggauacgccuguauggaccuugacuuuaauauauuaaaauaucaugauaaagacgcuauaggaguacuaacauuugaaggggccgacacagcagcugaaagaagagguuuccgcacaaguagaagacgcaaaaaucgacgcauaaaaagacuuggauuacuacaagaaguacuagcaccacucgugaaaaauccaaacuauuaccaauuacuuaaccuacauaaauggaaaaauaguaaugaagacuucaaacauagguccuuaucagaaguacuaaaaacccuaggcaaaaauccaaaaacauacccaacaaucuaccaucuacaacaagauauacaaaaucaccccgagaagaaauucgaacccgaacucaucuuccuagcacucuaccaucuaguaaaauacagaggacacuuccuauucaauaaccucucauucgauaaaggaaaaaccguagacaacgaagcacagcucucagaacuacuagaacaauaccaaaguauuaacccauacgaaggaucaauauucaauaaagauauaaaaguaauugucgacacacucaaagaugaccaacuuacgagaaacgacaaaucaaaagaacugaaacguaacguauccaaaacucacgcagaacuauuuaaaaugcucgucggacugaaauucaaacaauccauacucuuugaaaacauggaaaacguagaagacauaaaagaauccgcaacaggaagugacgccauaagucugagugaugacuacuacgaaaaccuaagcgaauuucuuaccgacgaacaacuaaauuucauagaaucugccaauacauucuuuauggguauaaugcuagacagaauauuaaaaggagcaacauccauaagcgcugcaaaaguacgagauuacaaaauauuuaaaaaucaauuaaaacuaauaaaagacaucguauaccaaaacaaauaugauaaauaccacgaauuuuucgucacuucaaaagaagacaugcgugcuuaucaagaaaauccugaugcaaaaacauucggaaaauuaucuaaauuugaccaauaccuaauccauccaaaagaccaauaugcaaaacugaugaaagauuugaaagguaucguuccuaagaaauacacugaagugcuaaaccuaauagaugaacaaaaauuccuagucguacaaaacacaacagacaaugcauccaucccauaucaaaacaacguauuugaagcggaaaauauuuuaagaaaccaacaaaaauacuacccagaaauuaccgaagaaaugauaggcaaaguaauaaaucugaucagcuucaggauuccauacuaugugggaccacuaacaaauaaaaacggacaaucggacuuugccuggaugauaaggaaauccgacgaacaagcacucccauggaacuuugacaaaguaaucgauaaaaguaaaagcgcggaaaaauucaucagaagaaugacuuccaaauguacauaucuacucgaagaagaugucuuaccgaaacauuccuuacuauaucaagaaauggaaguacuaaaugaacuuaacaacguacaacucagaggagaaaaugaaccuaaacaucguauucaccguuuagacccaaaaguaaaacaguuuaucuaccauaacuuauuccagaaaaagaaaaaugucacucauaaagaucuaauaacacuucuccaaaauucugaacauaggaacacccucaacaaaacaucuggucaaaaauugaaaguuuucggcacgcaaaaugauucuaaauucgccucaaaauuaaguacauacaacgacaugaaagcaauauucggaaguguagaaaacaaacgacaaaugaucgaagaauuaguuuuauggguaacuauauuugaagauaaagcaauccuaaaacaaaagauuggagaaaaauacccaaacaucacagaaaaacaacuaaaucaaauaguaaaacuaaauuacagcgguuggggcagauuaagugaaaaacuucuaacaaaagaaguaaacggccgaucacuaauagauuuaauguauucaaccgaaaacaauuucauggaaauuaucacggacaaaacucuaggauucgauugcuuuaucaaaaauucuaauaaagucaaaaacgcuaaaaucagcuauaaagacgucgcagaauuacgaacaagcccggcccucaagaaaggaauuuggaaugcaaucaaaaugguaagagaaauaagcaacuuauuuggagcacccgagaaaauaauaaucgaguucgcaacagaggaccaaguaaaaggaaaacgacaaaaaucacgaucagaacuuugggaugauuuagucaagaaaaacaauuuaaaaagaaauaaagaauuuaaaggacuauucgaagaaaucaaggcuuacccagaccuagauuucucaaacccuaaacuauggcucuacauacaucagaaugguaaauguauguacacuaagaaaccuauagaucuugaaagacuccuaucagauacaaacaaccaauuauaugagauugaccauauacuuccccgaacguuuguaaaagaugacucgauaaauaacaaaguucuaguuauacaaagcgcuaaccaaaagaagucuggcgauaaaaugccucucgaaauuuucgacaaucacguccuaguaccauucuggaaaaugcuauacgaaaacgauuuaauaagcaguuccaaacuauccaaacuaaugaagaaagaguucaacgaucuugauaaagaagguuuuauccagagacaacuuguagaaacacgacaaauaauaagucacguaagugacuuucuaacugaagaauauccuuccacaacugucgugcccaugaaagcuaacguagucagcgaacuacgaaggaaauucgauaucccaaaaauaagacaacuaaacgauuggcaucacgcuguagaugcauauuugaacggcuuuguauaucaagcugccagaguauuuuauccaaaaguuaacuuauuugaauuuaauuucaaaugggaaaaaguacgcgaaaaauggcgacaauuaggugaauuuacugaaaauaauaagaaacgcgaguucuuuuuauucaaaagaauggaaaacuacgugaaugaacacggugaaggcaugauaagcaaacugauauucgaccuagauaacuuuaaguucaacuacagcagaaaaguugaaucaacagaauccgcauucuacaagcaaucagcauucuccccaaagaauacaacagcccaguacgacagcgacaagaauaagaccgcuauuuacaaagaaaugaaaaacaagcgagggaucgucgucagcuauacauacgucaagaaagaccaagagcucauaggauauggaguauuuaacgagacaguauuugaauacguaaacaaugccgauguagacaugaacacgagggcgcuaaaaauaguccgaaaagcauucccgaaauuagacaucaaaaagguucaauaucucuuuuccaucaacaaaggugauacccuccucguaaacggucaccccuuccucuucguaucugcauaugaaagaauaaacggaaaacaacuugaauuugacauagcaaugcaacgaaaaauaaaacaagcacuaaguccauacaauaauaugaccgagcaagaaaaaguagaguucuacaaccaauuugccgaaaaagucauagaagaguuuagaaauaguauaggacuucaaagcagagauagaaaaguaaauuuaaucaaaaaucuauucaauaauacagagaaaagcaaugauucgaugacgcaaagcauauuagaaguccuaaaaaugaccaaaguaucagcagaaagaagcaaagaacucaagauuagguggaacggccaaacaccaaacaccuucaucgacaccaaaaauaacgcagaaauacaauacaaaagcaucacuggacuaaaaacaacaaaaccaaagucaauuuucaaacuggcagaaucuaagaaugaacuuuga

SEQ ID NO: 8799 - RNA, 4038 nt, Artificial Sequence
  Cas9 variant
augaaaaaaccauauuccauagggcuagacauaggaacaaacucaguagguugggcagucguaacagacgauuauaaaguucccgcaaaaaaaaugaaaguguuagguaacacagauaaaucacauaucaaaaagaaccuccuaggagcccuacuauuugacagcggaaacaccgcagaagacagacgcuuaaaacgaaccgcgagaagaagauauacuagaagaagaaacagaauccucuaccuccaagaaauauuuuccgaagagaugggcaaaguggacgacuccuucuuccaccgauuagaggauuccuucuuaguuaccgaggacaaaagaggagaaagacaucccauauucggaaaucuagaagaagaagucaaauaucaugaaaauuuuccaacaauuuaccaccuuagacaauauuuagcagacaacccagaaaaaacagaucuacgccuaguauaccuagcucucgcccacauaauaaaguucggcggccacuuucuuauugagggaaaguucgauacaagaaauaacgacgugcagagguuauuccaagaauuuuuagcagucuacgacaauacuuucgaaaacucaucccuacaagaacaaaacguacaggucgaggaaauuuuaacagauaaaaucucaaaaucggcaaaaaaagacagaguguuaaaacuauucccgaacgagaagucaaauggaagauucgcugaauuuuugaaacuaaucguaggcaaccaagcagacuuuaaaaaacauuuugaacuugaggaaaaagcaccacugcaauuuucaaaagauauuuacgaagaagaacuagaaguccuucuagcacaaaucggugauaacuacgcagaacucuucuuaucagccaagaaguuauacgacucaauuuugcuaaguggaauacucacuguaacugauguauccacaaaggcuccacuaucagcuuccaugauacaaagauacaacgaacaccaaauggaccuagcacaacugaaacaauucauuagacaaaaacuaagcgauaaauauaacgaaguauuuucggacguaucaaaagacggcuacgccggauauauagaugggaaaacaaaucaagaagcguuuuauaaauacuugaaaggcuuauuaaauaaaauugaaggaucaggcuacuucuuagacaaaaucgagagggaggauuuccuaagaaaacagagaacuuucgacaacggaucaauaccacaucaaauacaucuacaagaaaugagagcaauuauacgccgucaggcagaauucuacccuuuccuagccgacaaccaagacagaauagaaaaaauacuuacauucagaaucccguacuauguagggccauuagcaagagguaaaagcgauuucgcguggcuaucgcgaaaaagcgcagacaaaauaacaccauggaauuuugaugaaaucgucgauaaagaaucaucaguggaggcauuuauaaaccggaugacaaacuacgaccuauaucucccaaaccaaaaaguacuccccaaacauucauuauuauaugaaaaauucacaguuuauaacgaacucaccaaaguaaaauauaaaaccgaacaaggaaagacagcauucuuugaugccaauaugaagcaagagauuuuugauggcgucuuuaaaguauaccgaaaaguaacgaaagauaaacuaauggacuucuuagagaaagaauuugaugaauucagaauaguggaccucacuggacuagacaaggagaacaaggcguuuaacgcaaguuacgguacguaccaugauuuaagaaaaaucuuagauaaggauuuccucgauaacagcaaaaacgaaaaaauacuagaagacauaguauuaacacuuacacuguucgaagauagagaaaugauaagaaaaagauuaaaaaauuauuccgacuuauuaacaaaagaacaguuaaaaaaacuugaaagacgacacuauaccggaugggguagacucagugccgaguuaauacacggaauucgaaacaaagagagucggaaaacuauuuuagacuauuuaaucgacgaugguaacagcaaucgaaauuucaugcaacuuauaaacgaugacgcauugucauucaaagaagaaauagcaaaggcucaaguaaucggcgaaacagauaaccuaaaccaaguugucucggacauagcagggucaccagcaauaaagaaaggcauacuacaaucucucaaaauaguagacgaacuuguuaaaauaaugggacaucaacccgaaaacauaguagucgagauggcgagggaaaaucaauucacaaaccaaggacgcagaaacucucaacaaagacuaaaaggucucacagauaguauaaaagaauuuggcucacaaauacuaaaagaacaccccguagaaaacagccaacugcaaaaugauagacuauuccucuacuauuuacaaaauggucgggauauguacacuggugaagaauuggauauugauuauuuaucucaauacgacaucgaccacaucauaccacaagccuuuauaaaagacaauucaauagauaaucgaguauuaaccucaucaaaagaaaacagaggcaaaucagacgauguuccaucaaaaaauguagucagaaaaaugaaaucauauuggucuaagcuccuaucagcuaaauugauaacacaaaggaaauucgauaacuuaacaaaagcagaaagaggaggccugaccgacgacgauaaagcagguuuuauaaaaagacaacuaguugaaacaaggcaaauuacaaagcauguagcacgaauauuagacgaaagauuucauacagaaacagacgaaaauaauaaaaaaaucagacaaguaaaaauaguaacuuuaaagagcaacuuggugaguaacuucagaaaagaauucgaacuguauaaagugagagaaauaaacgauuaccaucacgcccaugacgcauaccuaaaugcuguaaucggaaaggcauuacuaggaguauauccacagcuugaaccagaguuuguuuacggcgacuacccacacuuucauggacacaaagagaacaaagcaacagcgaaaaaauucuucuacucaaauauuaugaacuuuuucaaaaaagaugauguaagaacagauaaaaacggagaaauaauauggaaaaaagacgagcacauaucaaauauaaaaaaaguacugaguuauccacaaguaaauauaguaaaaaaaguagaagaacaaacaggaggauucucaaaagaaucaauacuacccaaagguaacagugacaaacuuauaccacgaaaaacaaaaaaauucuauugggacacuaaaaaauauggcggcuucgauucaccaauaguagcauacuccaucuuggugauagccgauaucgaaaaagguaaaucaaaaaaauuaaaaacaguaaaagcauuaguaggagucacaauaauggaaaaaaugaccuuugagcgagacccaguagcauuucucgaacgaaaagguuacagaaauguacaagaagaaaacaucauuaaacuccccaaauacucccuauucaaauuagaaaauggaagaaaaagacuacuggcaagugcacgcgaguuacaaaaagguaaugaaauuguccugccaaaccaccuaggaacacuacuuuaucaugcuaaaaauauacacaaaguagacgagcccaaacacuuagauuacguagacaaacacaaagacgaguucaaagaacuccuagauguaguuucaaauuucagcaaaaaguacacacuugccgagggaaaccuagaaaaaauaaaagaacuuuaugcacaaaacaauggcgaagauuuaaaagaacuagccucuucauucaucaaccuucugaccuuuaccgccauuggugcaccugccaccuuuaaauuuuucgauaaaaauaucgacagaaaaagguauaccucuacaacggaaauacuaaacgcaacacucauacaucagucaauaacuggcuuguaugaaacuagaauagacuugagcaaacuagguggagacuga

SEQ ID NO: 8800 - RNA, 4038 nt, Artificial Sequence
  Cas9 variant
auggaaaacuacaauauuggguuagauauuggaacaaccucaguaggcugggccgucguaaacgaugccacgaauaaagucaugagaaaaggaggcaaagcacuauggggaguacgccuguucgauccagccguaacagcagaagacagacgagccaaacguggcacgagaaggagauacgauaggagaagggaaagaauuaaacuucuacaagaugaguucaaagacgaaauaaacaaaguugauucuaacuucuuucuuaaauuagaagaaucaaaauauacuucaaaagacaucaaaaauaaaaccguuuuaauauccauggaagaagaaaaagccauaaagaaauacaaucaagaauauccaaccauuuaucauuuaagacaaaaauuaaugaacagcaacgaacaaauggacauaagacugguguacuuagcuauucaucauauaauaaaauaccgaggcaacuuuauauacgaagggaacuccuuuucagugaacaaucuaaauauagauaauaaacucaaagaaauuuucuuaucauuaucugaagauguagaugaauuggacauaagcgaagaaugcauaaauaacauaaauuauaaacagcuagcaaacaucuuuaacgaacaaucuaaaaaugaucucaaaguuaaacuuacuucagaacucaccaguuauagucuaaacaaaaacuucauauccgaauuuugcaaacuaauaaucggaaacaaauucagcgccaagaaauuauucaaccuagaaacagacaacgauguaagccucagcuucgacggcaccgacuucgaagauaaagcaggagacuuagagagcuuacugaacgacuauuuagaaguguuggaacaacucaaagaacuauaugacauggucuuccuuaagaaaauauucggugguaguaaagaaacuacgauaucgggacuaauggucgaacgauauaaccaacauaagaaagaccucaaacuacugaaagacacauuuuccuccgauagaaaaauauacaacaaaauauuuagauccaagaaagacauaaaagacgauaaagauaugugcuuguaugaccuauacauccacaauaaacuagaaacaacugacuuccuaaaagaaaucaagaaauacgugaacacagauaauuucauuauaacugacgaagacuuucuaaaaaggcuagaaaauaaugaaguacuaccaagaauaacaaguaaagagaacggcaaauacccauaccaauuaaauaaagacgaacuugugucaauaauagaacaucaaggaaaacacuacccauucuuguuaaauaagacagacgacggaaucuacaaauuaguacgacuauuagaauuucgaaucccuuauuucguuggaccccuaguaucaaaagacaugagugaaaacgcauggaugcuccguaaugaaggaaugcaaggaguccacauaaccccguauaacuucaagaaaguaauaaaccuagauaaaacagcagaaaucuuuauaaagcgcaugauaucacauugcacguaucuccuggaugaagaagcccuaccuaauaacagcaucuuauacagcgaauuuaaaguacuaaacgaacuaaaacaaauaaaagucaacggagaacaucuaacaaaagaugaacaacacaaaauuauugaggaacuuuuuaugaaaacaucaggaacuauaaccgaaaauaaauuuagagaguuccuacuuaacacauuggacuauaauuucuaugaaaacgaacuaaaaauuaccggcuacucggcugauugcaaauucgcaaacaacaugcaaucauacauagacuucuuuggcgaaaauggaaucuucgaaggcaccagcuacaauacuaacgaugcugaaaagauaauugaauggaucacuauuuucgaugacaaagacauccucaaaagaaaaguagaaaaugaauacccagaauuaaaaucuaaucaaguuaaaaacauauuaaacaagaaauacuccggauggggacgacuaagcagaaaacuauuacuagaucuacguguacucgacaaagaaacugauauacccaaaaguaucauggacuuaauguacgaaacagaugaaaacuuuaugcaaaucauaaauaacgacaaauauaauuuccaaaaacuaaucgcuaaagaaaauaaaaucgaaaacaccagcaaugaccucucauacgauguaguagagaaucucgcgacaagcccagcgaccaaaagaggaauauaccaagcucuaaaaguagucaaagaaauaaccaccuauaugggguaugaacccaaaaauauaaugguugaaauggccagaggagaugaaaagaaaauacgaaaagaugaccgcaagaaauaccuacaaaaacuguaugacaauauaaaagacgaagucgacucaaacuacaaaaacuuaaagaaagaacucgcaaaagaagagaaaauugacaccgacaaacuauauuuauacuaucuacaagaagggaaaugcuuauauuguggaaaaccaaucaaugucgacgaucuaaauacuaaaaacagucuauaugaaauagaccacauauuaccaaggacacuuauuaaagacaacagcugggacaaccgcguucuagucugcagaggauguaaucaaaagaaagcagccucauuagugcucccaaaagaguuccgcaacgacuauacuaaaucaaucuggaucaggcuuaaaaauaacaaacuuaugucuaacaagaaauucuacaauuuaacaagaaaaucauauucugaagaagauauuaaaggauucauaaauagacaacucgucgaaacuagacaaauaacuaaacacguagcaaauauacuaaauuguuuuuacccaaaaacaaaaauaguuuauuuaaaagcuaauaucucacacucauaccgagauaaauacgacuuauucaaauuucgcgacauaaaugacuaccaucacgcacaugaugcauaccuugcugcuacauuaggaagcuaucaagaaaaauaccuccauuacgaucuugacuacaacaaaauaaaugaguucaaugaaaaacuaaucaaaaaugaagacuauaagagacugcauuauggaauuguaguaaauagccucgacgaagaguuccaauccgccuuugcagaaauagcaccaagacugauaaacgaagaaacaggcgaacuccuauuuaaugccaagaaauucaacgauuuaguugaagacacacucuauaggaaugacauacuaauuaguagaaaaacagaaaucagaacaggcaaauuguacaaggaaaccaucuauaaaagagguaagggaaauauaaaaauaaaagaaaauaugccaaccgaaacguauggcggguacucaaacauggaaacaaguuaucugacacuuguaaaauacggcaacaagacaaaauuaaucggaauccccaugagcaucgcaaacaauaaggauguaaaaguaaaacuugauuuuaucaaagaacauuuagaucucaaaagucuagauaacauaguaauccuaaaagacaacauaccuuaugacguaaguauaaauuacaaaaaccaggacguauauguaaaggguuauaguaccgcaaacaaaaauugcgaacuaucgaacgcccaccaacuuaaaaucaagaaagacaugaugaagaaaugcaaauacguccugaacaaaguauacaaaaacaaauaugaugacaucaccaacauggacauagaaaacgcaauaacuuuuauaaacuaccuauucgaaauaaaaaucgaguucccauuguucuccaaagaaauaaccaaaauacaggauaacauaaauuuaacugaauguuccuucgaacaauuagcaaacauaauaaaacaacuucuaauaaucuaccacugcaauucuaaaaacggaaaccuaaaagaauuuggacuuucagaucgaaucggacgacucuccggugcaaaugucacaggaggagauuucaucuuuacaagugucacaggccuaaaagaaaagacagcauccuacgacggagaauga

SEQ ID NO: 8801 - RNA, 4038 nt, Artificial Sequence
  Cas9 variant
augguugaaaaauauggaauagguuuagacaucgguacuuccacauuaggcuggaccucaguugacgaaaacggcaaaauacaaagacugaaaggucaaacagcacuagggacaagguuauucaacgaaggucaaacagcugaagaacgucgagguuuuagaacaacacgccgccguauucaaagaaggagauggagacuacgauuauuacgagaaaucuuugaugaacccaucggaucaguagacgcgggauuuuucgcuagacagaaaaugucaucacuaaguccacaagaugaucgcuucgaagacacauaccggcuguuuaacaaccaaacugauaaagccuuucacgaugaauauccaacuacguaucaucuaagacaagcguuaaugaacagugaccgacaauucgacauaagagagauauacuuagcuauacaucacauuguaaaauauagaggaaauuuucuucgguccggcaaaccagcggauuucaaaacagguaaacuagaucuaaaagaaaaauuugaagaaauuaacgcagauuggcaaacauuaauaucggaggaugccccgcaacuaccagucgaugaccuaacaacaauuaaagcagugcuaguggauggaucuagaucucguagugauagacaaaggggucugguaaaacuauggauggccaaugaaacuguagagaaaaacuggaaaccuguuaugacugaauuagcuaaagcaauauuaggacucaaaacuaaauuauacuuguugacagggcuagauuuaccuaaagaagaccaaaaagcauggacauucucacuagacacucuagaagaccaucaaggagacaucgacagcuucuuugaugaucaugcccaacaacuaaucgaucguuuagcagaacuucgggcuaugauacaacugacagaaauaauaccgagcggacugaauuucucgcaaucaaugguucaaagauacgaagcacauagaagccacuuagaaauguacaaacaauacgcuuuagaccaaacugauccuaaaaggacaaaagccuugcgggcugcauauaacgcauauaucgaucagcaugaaauugcagacgauuucuauacugccguuaaaagagucaccaaagaugaucaaucagaaacagcagaagaaauaaacagacuaauaggccuagaacaauuuaugcccaaacagaggacaaaggaaaacggaguaaucccuuaucagguacaccaacaagaacuugaccaaauaauagcacaucagaaaaaguacuauccauuucuaggaacggaaaauccaguaauagaucaccgagaaucgcaaccuuauaugcuagacgaauuaguauccuuccggguuccauauuauguaggaccaaugguagcugcaaaucccgaauuaaaaacaacagaaaacccuuucgccuggaugauaagaaaagcucaaggcgaaauaacaccauggaacuuugacgaaaaaguagaucguaaaggcagugcaacugcuuucauagaaagaaugaaaacuacagauacauaucuauuaggugaagacguacuaccacaacaaucacuauuguaccaaagguucaugguccucaaugaacuuaauaacauacgaauagaugacgagcuacuaacaacaaaccaaaaacaauggguauucgacagagucuuuaaaggaaaagguacaauuagugcaaaacaccuacaagacgcauuaaaacaucacggcgaaacagauggcuuaccaaaaauauccggauuagcagauccaaccaaauuuaacagcgcacuaaccuccuaccgugauuuccaaaaaugguuaccaaacgacauagaucggaaagacagaacugcagauauagaaacuauaauaaauugguccacaguguucgaagauacacacauuuucguugaaaaacuuaaagagaucgaauggcuaacagcugaccaaaggagaagaauagcaucaaacagauaucgggguugggguagacuaucaaaacacuuauuaacugaaauaaaagaugaacaaggauuauccauaauggaccaauuauggagaacacaacacaauuucaugcaaaucguacaugagccggauuaugcuaaacaaaucgaggcagcaaacacugucggaauggcaaaacaagauaucggaaccguaauaaacgauuuauacacaaguccgcaaaauaagaaagccauuagacaaguacucgccguagugaaagacauacaaaaugcacaccacggagucgcaccgucauggauauuuauggaagccgcucgaggugcagaucaaaacccacaaagaaguaggcaaagacaacgucaguuacaagauuuauaugcuaaaacagcagcagaucuaguagauacagaaguacaacaagaguuaacagacaaaauuaaggauaaagcaaacuuuacugaucgucuaaugcuauauuucuuacaaaacggacaagacauguacucaaaagagaaacuuaacaucgacaggcuaagugaguacgacauagaccacauauuaccacaagccuugauaaaagaugacucauuagacaaccgaguuuugguccaucaaucaaucaaccgaaauaaaucagacacauuugccucagaaaaauacggagcaaaaaugcaaggugccuggcaccaauggcgagcggcaggacucaucagugccagaaaauuacgaaaucuagaaaugagaccagaugaaaucagcaaauacgcaaccggcuucauacgacgacagcuugucgaaacaagacaaguaaucaaacuuguaacugaaauccuaucucaucaauauaacccugaggaaacaaagcuaguuucagucaaagcaggccuaucccaugaacuuagaagagaggcaggacuaccaaaacucagagacuuaaacgauuaccaucaugcaaucgaugcguaccuagcagcaagaauaggaaccuaucuauugaaacguuauccgcggcuugagagauuuuucgucuacggucaauuccaaacaucaagauuagaucuaaggagauucaacuuuauucaugaccuaguuaaaucaaaacaaggagugauaguagauucagacacuggugaaauauuaugggauagacaaaaagauaucgacuacauuaaacauuuaaugggacuuaaacaucuauuaguaacacaugaagucuacgacucagcagcagaaauguaugcccaaacgauauucaaagccagugacaaugauagcaaaguccuuauaccaacuaaaaaugauagaccgacugcaaucuacggugguuauacuaagcggagaaauggauauuuagcaauccuuaaaauuaccgaaaagaaagcugaaacguacagagucguagguguuccaacauuauacaugagucaauuagcaaccgcacgaucccacucgguagaagcagaaaaggcacuacuaaagagcuuaauggcuccagagaucuuaagugaaagcaaagucgucucauucgaagugguaguaucacacguccauuuaaaccaauuaguaagagauacaguauuugggccugcgcacuacuuugguuugggacccuuuagguauguaagaaauuuccaucagcuagucuugccauuuaaagaucaagagauauuaguuaaaaggacaccuacagaugaggaacucaauacuguuuuugaagauauuuguuggcaaguggaaaacuauuuugcaguauuugacauaaauggauuucgaaacgcuuuaaagaaaaguauagauaaauuugaacaauuaccaauugaaaacguguuuaaagauaagaaauuagugacccaaggaaagaaagaagucuuagcauuuguuaugcagggucuccaugcgaacgcuucauacaggaauuuaaaagucucauugggaauaaaaacaccauuaggucaacuacaacuaacaaaauucauguuaucaagagaugcagaauuaauugaugaaagcccaacuggacuguuucgaagaauaagaaggcuaaaagauuuauga

SEQ ID NO: 8802 - RNA, 4038 nt, Artificial Sequence
  Cas9 variant
auggguaacaaacuuaggaacguagaugacuacuacuuaggacuagacauagguacggaaagcguagguugggcaguaacugacaaauacuacguaauaccuaaauuuaaagguaacgccauguggggcguacauuuguuugacgaaggagaaaccucaguuaaaagacguggauuucgaucggcuagaaggagaacacaacgaaaaagagaaagacuagcauuguuagaagcguuauucgacgaagaaauauguaagaaagacuguacuuucuuccgacgauuacaugaauccgaccuuuggccugaagauaaaucaggagacgauaaauaugcaguauucgcagacgaaaacuacacagauaaagauuuucacaaagaauacccuacaaucuaucauuuaagauaugaacuaauuaaaaacaaagaaccccaugacgucaaauuggucuuucuggcacuacaucacauaauuaaaaauaggggacauuuccuauucgacagcuuaucaagcgcggaagauuuuaacucugcauacgagacuauguguagcuaccuaucagauaaugaaauacaacuuaauuguagugacauagaacaauucaaagccauacuaaaagauaggagacaagguaagaucgagaaaacuaaaaauuuagccucacuuuucggaauaacaaagaaaagcgaccccguaucuuacgcaguaauggcuguccuaucagguucgacaguaaaaaugugugaucuauuuggagaugacgaauuaaaaacagucgagaaaaacaauauaucauucgcuagcgguuacgaagaaaaugaagaaauauaugcgucaguacucggagaucgauuugaacuugucaaaauacuuaaagcaguauaugacugggcaguauuagcagauauauuagauggaaagaaauacauuucugaagcuaagguagcgguuuaugaaaagcacaaaaaugaccuuaaaaccuugaagaaauacguaaaaacauaucuaccagaaaaauacaaugaaauauuuaaaauuucugacggaaagaaagacaacuacgucgcauacaguggacacauaaaagaauccggaaaaaccggagaacucaagaaaacaugcaauucggaaaauuuuugcgcauaucuaaagaaaacuuugggcaaaaaugccgaucucucauacaaagaaauguucgaugaaaucgaaaacaaaacauuuaugccaaaacaagucacaaaaagcaacggaguaguaccgaugcaaguuaacgaagaggaacuuaaagcuauacuugacaacgccaaagacuacuuaucauuccuaaacagcugcgacgaaaauggaguaucaguuuaugauaaaauuaucaaaaucuucgaauaucggauaccauauuauguaggacccuuaaauacacacacagagaacaguuggcugaagagaaaagaugguguaaaaauauacccauggaacuucgacgacgucgucgauauugacuccucagcugaaaaauuuauaaauaacuuaacguccaaaugcacauaucuucccgaaugugacguaauucccaaauguagccuccuuuauaguaaauuuacaguacuuaacgaaauaaacaaucuaaaacuaaauggcgaagacauuccaguggaauugaaacagggaauauacaaagaccucuuuaugacaagaagaaagguaacaguaaaacaaauaaaagauuaccuuaaagccagaggauguuaugauaacaacgacguauuaucaggaaucgauacaacaguuaaaagcucacuaaaaucuuauuucgauuucaaaggauuugaaagccuuaccuucgaugauaaagaaucaauaauagcaaguucagucauauucggggacgauaagaaauuguuaaagaaacggcugaagaaacuauuuccagaaaaacuaacagaugaagauaucaagaaaauaugcaaacuuaaauauacaggcugguccagguuaagcaaagaauuucugugcgauguggaauuuacguacaagaaaacaggcgaaguaaugaauguaauaacagcacuaugggaaaccaauuauaacuuaaugcaaauacuuuauagcgaagauuucugcugugauggugacgaaaagaaaaaccuuaacgauaaacuagacgagcucagcuauacaggagaccagcacagccuaagaaaagccguggaugcccucuacguaagcccgaaagucaaacgaccaauacucagagcacuacuaauagcaaaagaaaucgaaaagauacaggaaagaccaccgaagaaaauauucguagaagucgcaagagguauagacaacagagaagaaagacacagagacagcaggaaaaacagacuuauggaauuauauaaaaauugcaaaaaggaagcagaaaaauucugcccuuacuucgacgcacucaguaagaaacuuucagacgaagaugaaagcaaauuaagacgagauaaacuauauuucuauuauauccaguuaggcaaaugcauguacacaggagaggaaauaucguuaggagaacuaaugaacggaaauggacguuuugacauagaucauauauacccaagaucgaaaauaaaagaugauucccuaacgaauaaaguccuaguaaauaaaacaguaaacaacaauaaaacaaaugucuacccgauugaugcagccauacagucuaaaaugaguccauacuggcagaugcuuaggucaucaggauuaaucagugaagaaacauauaaaagacuaacuagaaaaacaccauuaacagacgacgaauuaucagcauucgucagccgucaacuaacugagacacaacaaucuacaaaagcaguugcccacaucuuagagcaacucuauccuaaaccuaagacagaaaucguuuacguaaaagcagcucuaguacacgcauuuagacaaucuaacgacaugcuaaaaugcagagaaguaaacgaucuccaccacgcaaaagaugcuuauuugaacauagucguugguaaugccuacaauguuaaagucacacacaauaaaguaaacuucauaaaaggcuugcaaaacaacgacaaaggauacacaguuaacccagaaaaauuuuucagccaugacauuccaggcgccuggagcguaaaagauuccaugaacacgguaaggagguuuaugaacaaaaacaauauaagguacacuagauuuccuagaaagaaacaagguggauuauuuaaaauaaacccguuaaagaaaggaaacggccaagugcccuuaaaagcaucgggcgccagauccuguaucgaaaaauauggcggauaugacaaggcaaccucagcuuauuucucauacgucgaauauacagauaagaaaggcaaagcuguaagacaaauguucccagucaauuuauaugaaguaaaagaauacgaagcagacaugcaaggauuuguaacaagucgaaucgccgaagcaucuaacguuaaaauccuaauaccauguguuaaauaugacgcguguauaucauucgauggaugccgaauguuuauaacgaagaaaacagggaaucgaauaggauacaaaccuggaaugcagcuaguucuuggauacaaauaugaaaaauacauccgcaauauugaaaacuacuuaacuaaacacaaagauagagagauaaucccaagagauaauauauccgcggaagaaaacauagaauuauacgacaucuuaaccggaaaaaugcuaaauacaguacuuucaguaaaauucaguggaauaggaaagaaacuagagaaaagacgagaaaaauucguauuaugcucaccugaagaacaaugcuguguccuaaaugaaauacuuaaaaucuuacacgcuaauguacuaaguggcgaucucucauugauuggagaaaguccaaacacaggcacgaugaagacaaacgcaaaauucagcgaaauaaaggacguacacucaauaaaauuaauuaaucaaucagucacagggcucuuugaacaagaaauagaucuccuuaaauga

SEQ ID NO: 8803 - RNA, 4038 nt, Artificial Sequence
  Cas9 variant
augggaaaacccuauaguaucggacuagauauuggaaccaauucaguagggugggcaguuguuacagaugauuacaaagucccugcuaaaaaaaugaaagucuuaggcaacacagacaagcaauccaucaagaaaaaccuucuuggcgcauuacuauucgauagcggagaaaccgcagaagcaacccgacucaagcgaacugcaaggcguagauauacgcgccggaaaaacagauuaagauaucuacaagaaauauuuacaggagaaaugaauaagguugaugagaauuuuuuccaaagacuagaugacucauuccuuguagaugaagacaaaagaggagaacaccacccuauauuuggaaacauagcagccgaaguaaaguaccaugacgauuuccccacaauauaucacuuaagaaggcaucuagccgacacaucaaaaaaagccgaucuuagacuaguauaccuagcauuagcgcacaugauaaaauuuagaggucacuuccucuacgaaggagaccuaaaagccgaaaauacagacguccaggcuuuauuuaaagauuucguagaagaguacgauaaaacgauagaagaaucucaucuauccgaaauaacgguagacgcacuaagcaucuuaaccgaaaaagugaguaagagcagcagacucgaaaaccugaucgcgcauuaccccacugaaaaaaaaaauacucuauucggaaacuuaauagcacuauccuuagaccuccaucccaauuucaaaacaaacuuucaacuaucagaagacgcaaaacuacaguuuucaaaagacaccuacgaagaagaucucgaaggauuccuaggagaaguuggagaugaauaugcagaucuauuugcuagugcuaaaaaccuauaugacgcaauucuauuaaguggaauauuaacaguagacgauaacucaacaaaagcgccucuaagcgcuucgaugguaaaacgcuacgaagaacaccaaaaagauuuaaaaaaauugaaagauuuuaucaaaguaaacgccccagaucaauauaaugcgauauucaaagauaagaacaaaaagggauaugcauccuacauagaaaguggagucaaacaagaugaauucuauaaguauuuaaagggaauucuccucaaaauuaacgggucgggcgacuucuuagauaaaaucgauagagaagacuuccuuagaaaacaacgcaccuuugauaauggcagcauaccacaccaaauucauuuacaggaaaugcaugcgauauugagaagacaaggagaacauuaucccuuucuaaaggaaaaucaagauaaaauagaaaaaauacucacauuccgaauucccuacuacgucggaccacucgcaagaaaaggaagcagauucgcaugggccgaauauaaagcagaugaaaaaauaacaccauggaacuucgaugacauacuagauaaagaaaaaagugcagaaaaguuuaucacccgcaugacuuuaaaugauuuauacuuacccgaagaaaaaguacuacccaaacauaguccacucuacgaagcauuuacagucuacaacgaacucaccaaaguaaaguauguuaacgaacaaggugaagccaaauucuucgacacgaacaugaaacaagaaauauuugaucauguauucaaagaaaacaggaaaguuacgaaagauaaauuacucaauuaucucaacaaagaauuugaagaauucagaaucguuaaucucacaggccucgacaaagaaaauaaagcuuuuaauuccucauuagguacauaucacgaucuccgaaaaauauuggacaaaucauuccuggaugacaaagccaaugaaaaaacaaucgaagacaucauacaaacucugacauuauuugaagacagagaaaugauacggcaaagauuacagaaauauucugauauauucacaaaagcccaauuaaaaaaauuagaaagacgacacuauacugguuggggaagacuaagcuacaaacuaaucaacgguaucagaaacaaagaaaauaaaaaaacaauucuagacuaccugauagacgaugguuacgcaaaccguaacuuuaugcaguuaauaaacgacgaugcucucucauuuaaagaagagauugcacgugcacaaauuaucgaugauguagacgacauugcaaaugucguacacgaucuucccgguuccccagccauaaaaaaaggaauacuucaaagcguaaaaauagucgaugagcuugucaaagugaugggacacaacccagcaaacaucauaauagaaauggcccgugaaaaucagacaaccgauaaaggacgacgaaacucacaacaacgacuaaaacuacugcaggacucauuaaagaacuuagacaauccaguaaacauaaagaacgucgaaaaucaacaacuccaaaaugauagacuauuccuuuauuauauacaaaacggaaaagauauguacacuggagagacacucgauauuaauaaccuaucucaauacgacauagaucauauaauaccgcaagcauucauaaaagacaauucccucgacaauagaguauuaacaagaucagacaaaaaucgugguaaaagugacgacguacccucuauagaaguuguucaugaaaugaaaagcuucuggucuaaacuucucucaguaaaauuaaucacucaacgaaaauucgauaacuuaaccaaagcagagagaggcggacuaacagaggaagacaaagcagguuucauaaaacgacaacugguagaaacacgacagauuacgaaacauguugcucaaauacuagaugaaagauucaacacagaauucgauggaaauaagagaagaauuagaaaugucaaaauaaucacucucaaauccaaccuaguaucaaacuucagaaaagaauuugaauuauauaaaguuagggaaauaaaugacuaccaucaugcucacgacgccuacuuaaacgcaguagucggaaaugcacuccuauuaaaauacccacaacuagaaccugaauucgucuacggagaguaccccaaauauaauagcuacaggagccgcaaauccgccacagaaaaauuccucuuuuauagcaacauacugcgauucuuuaagaaagaggauauacaaacgaaugaagacggcgaaauugccuggaauaaagagaagcacaucaaaaucuuacgaaaaguuuuaucauacccacaaguaaauauaguuaaaaaaacugaagaacaaacaggaggauucaguaaggaaaguauacuaccaaaaggggaauccgacaaauuaauacccagaaaaacgaaaaacucauacugggaccccaaaaaauauggaggcuucgacucuccgguaguugcauacucaauacugguuuucgccgaugucgaaaaaggaaaaagcaaaaaauugagaaaaguccaagacaugguagggaucacaauaauggaaaaaaaaagauucgagaaaaauccuguagacuuccuagaacagagaggcuacaggaacguacgacuagaaaaaauaauaaaauuaccaaaauacagccuuuucgaacucgaaaacaaacgccgaagguuacuagcaagugccaaagaacuucaaaaagguaacgaauuaguaauaccacagagauuuacaaccuugcucuaccacucauacagaauugaaaaagauuaugaacccgaacaucgagaauacguagaaaaacauaaggaugaauuuaaagaacuccuugaauacaucaguguguuuucaagaaaauacguacuagcagauaacaaucuuacaaaaaucgaaaugcuauuuaguaaaaauaaagaugccgaagugucaucacucgcaaaaucuuuuauaaguuuauuaacuuuuacugccuucggagcgccagcagcuuucaauuucuucggugaaaacauugaucgaaaaagauacaccagugucaccgagugucuaaaugcuacucugauccaccaaagcauaacgggacuuuaugaaacacgaaucgauuuauccaaacuaggggaagauuga

SEQ ID NO: 8804 - RNA, 4038 nt, Artificial Sequence
  Cas9 variant
auggaucaaaaauauuccauagggcuagacauuggcacaaauuccgucgggugggcuguaguaacugacgauuacaaaguaccugccaagaaaaugaaaguauuaggaaacacagacaaacaaucuauuaagaaaaaucucuuaggggcacuauuauucgauagcggggaaaccgcugaagcuacaagauuaaaaagaacagcacgccgaagauacacacgaaggagaaacaggcuuagauauuuacaagaaauauucgcagaagaaaugaauaaaguagacgaaaacuucuuccaacggcucgaugacucauucuuaguagacgaagauaaaaggggcgaacgacacccaauauuuggcaauauagccgcagagguuaaauaucacgacgacuuccccacaaucuaucaccugagaaaacauuuagcagacauuucucaaaaagccgaucuaagauuagucuaucuagcccucgcacauaugauuaaauuuagaggacacuuucuaauugaagggcaacuaaaagcagaaaacacaaauguacaagcacuauuuaaagacuuuguagaagucuacgacaaaacaguagaagaaagccaucuaucugaaaugacaguggacgcacuauccauccuaacugaaaaaguaagcaaaucacgaagguuagaaaaccucauagcccacuacccagcggagaagaaaaacacacuauuugggaacuuaauagcuuuaucacugggucuacagccaaacuuuaaaacaaacuuucaguuaucugaagacgcgaaauuacaauucucuaaagacacuuaugaagaagauuuagaaggccuacucggagaaauaggugacgaauacgcggaccuauucgccucagccaaaaaucuauacgacgcaauucuauuaagcggaauauuaacuguagacgauaauuccacgaaagcacccuuaagcgcaucaauggucaaaagguacgaagaacaccaaaaagaccuaaagaaauuaaaagauuuuauaaaaguuaaugcuccugaccaauacaaugcgauauucaaagacaaaaauaagaaaggguaugccggguauauagaaaacggaguaaaacaggaugaauuuuacaaauacuuaaaaggaauacuuuuacagauaaacggguccggagacuuccuugauaaaauugacagagaagauuucuuaagaaaacagagaacuuucgacaauggaucaauaccucaucaaauacacuuacaagaaaugcaugcuauacuccgaaggcaagaagaacacuacccauuuuuaaaagaaaaucaagacaaaauagagaaaauuuuaacguuccgaauaccauacuauguuggaccauuagcacgcaaaggaucgagauuugcaugggcagaauacaaagcugacgagaaaauuacccccuggaacuuugacgacauacuugauaaagaaaaauccgcagaaaaauucaucacacgaaugacucuaaaugaccuauacuuaccggaagaaaaaguauuacccaaacacagccuacucuaugaaacauucacaguauacaaugaacucacaaaaguaaaauauguaaaugaacaaggagaggcaaaauuuuucgacgccaacaugaaacaagaaauauuugaccacguuuuuaaagaaaauagaaaaguaacaaaagacaaacuacucaacuaucuaaauaaagaguucgaagaauuuagaauaguuaaccuuaccggucuugauaaagaaaacaaagcauucaauuccaguuuaggaacauaucaugaccugagaaaaauacuggauaagagcuucuuagaugacaaagcaaaugagaaaacuauagaagauauaauacaaacacuaacacuuuucgaggacagagaaaugauaagacaaagacuacaaaaauauucagacaucuuuaccaaagcacaauugaagaaacuagaacgaagacauuauacaggaugggggagguuaucguacaaacugaucaauggaauacgaaauaaagaaaacaagaaaacaauacuagauuacuuaauagacgacggauaugcaaaccgaaauuucaugcaauuaauaaacgacgaugcauuaucauuuaaagaagaaaucgccagagcgcaaauaauaggcgacguugacgacauagcgaauguaguacacgaucuuccuggauccccagccauuaagaaaggcauacuacaaucagucaaaauaguugaugaacuggucaaaguaaugggccacaacccagcgaauauuauaaucgaaauggcccgugagaaccaaaugacagacaaaggaagaagaaacucacaacaacgacuaaaauuguuacaagacucacuaaagaacuuagacaacccaguaaacauuaaaaacguagaaaaucagcaacuccagaaugacagguuauuuuuauauuacauucaaaacggcaaagacauguauacuggugaaacacuugacaucaauaaucuaucgcaauaugauauagaccacaucauaccacaagcauucauaaaagauaauucucuugauaacagaguuuuaacgagguccgacaaaaaccgaggaaaaucagacgacguaccaucuauagaagugguacacgaaaugaaaucuuuuuggucaaaacuccugaguguaaaacucauuacccagcguaaauuugauaaccugaccaaagcagaaagaggcggucuaacagaagaggacaaagcaggauucauaaaaagacaguuagucgaaacacgucagauuacaaaacacgucgcacaaauccuagaugaacguuucaauacugaguucgauggaaauaaacgcagaauuagaaacguaaaaauaauuacccuaaaaagcaaucucguaucaaacuuuagaaaagaauuugagcuauacaaaguccgggaaauuaacgauuaucaucacgcccacgacgcuuacuuaaacgcaguagucggaaacgccuuacuauuaaaauacccucaacuagagccagaauuuguuuacggugaauacccaaaguacaacucauauaggucaagaaaaucugcuacagagaaauuuuuauucuauucuaacauauuacgcuuuuucaagaaagaagacauacaaacaaacgaagauggggaaauugcauggaauaaagaaaaacacaucaaaauucuuagaaaaguacuaaguuauccccaaguaaauauuguuaagaaaacugaagaacaaacaggugguuuuagcaaagaaucaaucuuaccaaaaggagaaagcgauaaacucauaccccgcaaaaccaaaaacuccuacuggaacccgaagaaauacggcggcuuugacucacccgucguagcauacuccauacucguguuugccgaugucgaaaaaggaaaaaguaagaaacuacgaaaaguucaagauaugguagguauaaccauaauggagaagaaaagauucgaaaaacacccaguagauuucuuagaacaaagaggcuaucgaaacguaagacucgaaaagauaauuaaauuaccaaaguauucccuuuucgaacucgaaaauaaaagacguagacuccuugcauccgcaagagaacuucaaaagggaaacgaguuaguaauaccccaacgguucacgacuuuauuauaucauucauaucaaauugagaaaaacuaugaaccagaacauagagaauacguagaaaaacauaaagaugaguucaaggaacuacuggaauauauuucaguauuuucuaggaaauacguauuggccgacaacaaccugacuaagauugaaaugcuauucaguaaaaacaaagacgccgaagugagcagucuagcaaaaaguuucauuucucuauuaacauucacagcauuuggcgcuccagcagccuucaacuucuucggugaaaacauagauagaaaacguuacacuucugucacagaauguuuaaacgcaaccuugauccaccaaagcauaacaggauuauacgaaacuaggauagaucuuaguaaauuaggagaagauuga

SEQ ID NO: 8805 - RNA, 4038 nt, Artificial Sequence
  Cas9 variant
augaaaaaagaauacucaauugggcuagacauugguacaaacagcguagguugggcuguaauaacagacgacuauaagguaccagcaaaaaaaaugaaaguauuaggcaacacugauaaacaaaguauaaaaaagaaucuacuaggggcucuacuauuugauagcggcgaaacagcggaagcaacacgcuuaaaacgaacugcacguagaagauauacccgaagaaaaaacagacuaagauaucuucaagaaauuuuuacugaagaaaugaacaaaguagacgaaaacuuuuuucaacguuuagacgacaguuucuuaguagaagaggacaagcaaggaagcaaauaccccauuuucggcacucuuaaggaagaaaaagaauaucacaagaaauuuaaaacaaucuaccaucucagggaagaacuagcuaauucuaaagaaaaagcagaucuaagacuaguuuaccuagcacuugcacacaugauaaaguuuaggggacacuuuuuauacgaaggagaccuaaaagcagaaaauacagacguacaagcucucuucaaagauuucguugaagaauaugacaaaacuauagaagaaagccaccucuccgaaauaaccguugacgcacuaucaauauuaacagaaaaaguaucaaaaucaucaagacuagaaaaccucauagcacauuacccuaccgaaaaaaaaaacacauuauuuggcaauuuaaucgcacuaucacuaggauuacaaccaaauuucaaaaccaacuuccaacugagcgaggaugcaaaguugcaauucagcaaagacacauacgaagaagaucuagaagaacuacuaggagaaaucggagaugaauacgcugaucuauuugcaucagccaaaaaucuuuacgaugcaauacuucuauccgguauacuagccguagaugacaauacaacuaaagcaccacugucggcaucuaugguaaaacgauaugaagagcaucagaaagaccucaagaaacuaaaagauuuuaucaaaguaaacgccccugaccaguacaaugcaauauuuaaagauaaaaacaaaaaaggguacgcaggguacauagaaagcggcguagaacaagaugaauucuacaaauacuuaaaaggaauacuucucaaaauaaacggcaguggugauuuuuuagacaaaauugauugugaagacuuccuacgaaaacaaagaacauuugacaacggaucuauaccgcaccaaauacaccuucaggaaaugcaugcaauauuacgcagacaaggagaacacuacccuuuccuaaaagaaaaucaagacaaaaucgaaaaaauuuugacauucaggauaccuuacuauguaggcccacuagcccggaaagguaguagguucgcgugggccgaauauaaagcugacgaaaaaauaacccccuggaauuucgacgacauacuugacaaagaaaaaagcgcggaaaaauucauaacaagaaugacacuaaacgaccuauauuugccggaagaaaaaguucuaccaaaacauaguccucucuaugaaaccuuuacagucuacaacgaacuaacaaaagucaaguacguaaacgaacaaggcgaagcaaaauuuuuugauacaaacaugaaacaggaaauauuugaucauguauucaaagaaaaucgaaaagucacaaaggacaaacuacugaauuauuuaaacaaagaauucgaagaauuucguauagucaaucuaacagguuuagauaaggaaaacaaagcuuucaauucaucauuaggcacuuaccacgaccuacgcaaaauacucgacaagucauuccuagacgacaaagcuaacgaaaaaacaauagaagauauaauccaaacacucaccuuauuugaagaucgagaaaugauuagacagagacugcaaaaauauuccgacauuuucaccaaagcacaauuaaaaaaacuggagagacggcauuacacaggaugggguagauuauccuauaaauugauaaauggaauuaggaacaaagaaaauaaaaaaacaauucucgauuaccuaauugacgauggauacgcaaauagaaauuucaugcagcuaauaaaugacgacgcacuauccuucaaagaagaaauagcacgagcucaaauuauaggcgacguagaugacauugccaaugucguucacgaucuaccuggcucacccgccaucaaaaaaggcauacuucagagcgucaaaauaguagaugaacugguaaaagugaugggacauaauccagcaaacaucauuauagagauggcaagagaaaaccaaacaacagauaaagggagaagaaacucccaacaacggcucaaacuauugcaagacucauuaaaaaaucucgauaaccccguaaauauaaaaaaugucgaaaaccaacaacuccaaaaugacagauuauuccucuauuacauccaaaacggaaaagacauguauacuggugagacuuuagacauuaauaacuuaucacaauacgauaucgaccauauaauaccacaagcauuuauaaaagauaauagccuagacaaccggguccuaaccagauccgacaaaaacagaggaaaaagugaugacguaccaucgauagaagucguucaugagaugaagaguuuuuggucaaaacuacuuaguguaaaauuaaucacacaaagaaaauuugauaauuuaacgaaggcggaaagaggaggauugacggaagaagacaaagcgggcuuuauuaaacgacaacucguggaaacucgacaaauuacaaaacacgucgcacaaauacuagacgaaagauucaauacagaauucgacggggcucaacgacgaauuagaaaugugaaaauuauaacguuaaaaucuaauuuaguaagcaauuucagaaaagaauucgaacuauacaaaguacgagaaauaaaugacuaucaucaugcccaugacgcauaucuaaaugccguuguggguaaugcacuauuacuaaaauauccacagcuagaacccgaauucguauacggagaauacccuaaauauaacagcuaucgauccagaaaaagcgccaccgaaaaauucuuauuuuauucaaauauuuuacgauucuuuaaaaaagaagacauucaaacuaacgaagauggagaaauagcauggaauaaagaaaaacacauaaaaauacucaggaaaguauuaucauacccucaagucaauauaguaaaaaaaacagaagagcaaaccgggggauuuucuaaagaaucaauucuaccgaaaggugaaucagauaaguuaaucccaagaaaaacgaaaaauucauauuggaacccuaaaaaauacgguggauuugacaguccaguagucgcauacucaauccuugucuucgccgacguagaaaaagguaaauccaagaaacuacgaaaaguacaagauaugguaggaauaacuauaauggaaaagaaaagauuugaaaaaaauccaguugacuuucuagaacaacgcgguuacagaaacguaagacuugagaaaauuaucaaacuacccaaauauucuuuauuugaacuugaaaauaaaagaagaagacuucucgcaagcgcacgagaacuccaaaaaggcaaugaacuaguuauaccacaacgauuuacaacauugcuuuaucauucauaucaaaucgaaaaaaacuaugaaccagaacaucgagaguacgucgaaaaacauaaagacgaauucaaagaacuauuagaauauaucaguguauuuucgcgaaaauacguacucgcagauaauaaucucacgaaaaucgaaaugcuauuuucaaagaauaaagaugcagagguguccagccuagcaaaaucauucauuucccuacuuacuuucacagcauuuggugccccagcagcauucaauuuuuuuggggaaaacauagauagaaaacgcuauacaucagucacagaaugcuuaaaugcaacguuaauacaucaaagcauaacaggccucuacgagacaaggaucgaucuauccaaacuaggagaagacuga

SEQ ID NO: 8806 - RNA, 4041 nt, Artificial Sequence
  Cas9 variant
augaaucaaaccaaaaacuaugauauaggcuuagacauuggaguaggcucaguaggguggacaauuacugacucucaaagccaaaaaguucucaaaguaaaaggaaaacaaggaauuggcguacauuuauuuaacgaaggucaaacagccgaagaaagacgccaauuccguacuaacagacgccgauuaaaacgucgcaaauggagacuccgucuccucagagaauuguucgacgagccaauaucauccauagacccugaguucuuugcaagacucaaauacuucaaugaaucaagcaaagacccaaaaaacaaagguuaccaaccacaauugcacgaugaccuaaaagacguugacuucuaucgucaauacccaacgauauaucaccuaagacacgcguuaaugacucaaaaagaaaaauuugacauacgagauaucuaucuugcaauacaucauaucgucaaauaucguggacauuuucugaugaauggacauucaucaaguuucagugucgcucagacagauuggaaagcagaucugacaaaacucuuugaacucauacaagaaacaagaaccaaccucgauuucaguuucgaccuuacagaaaucgacacaaucaaaucacuucuauucgacaaaaaccuaagucgaaacgacaggcaaaaggaaauuguaggucuaaucaacaauaauagccaacuugauaagaaagauaaggcauugacgaagcaacuugucgaaagugucgucaaagguauaguugguaugaaaacacggaccgauauauuauuaggauacgaaguggacaauaaagaacaaagcaaagccuggaauuuuagcauagacgaguuagacgaccaaauggcaacaauugauccagcacucucacaaaauucucaagcucacgacauaauuacacuaauacaaaaacucuauaugacaguacagcuggcccaaauagugccugaaggacaaucaguaucagaaaugaugauaaauagauauaaccuauaugccgaacaacuccaacaauuaaaagauuacaaaaaaauaaaucuagaaacaggccuacuucucagggaagccuaugacgaacugaugaccaaagcgcuaacggcugcaccuggaaaaaccauacacgacacuuucuauaauaagguaaaaaaaauacuaaaagaccaagacaauaaacaagcacugucaauuaaacaagcaauugaagacuccaauuaucucauacccuuacggauuaaaucuaacggagucauacccuaucaacuucaucaaagagaacuagacgcuauaauagaaaaucaaaaagaauucuacccauuucuagccacaccaaacccaguagaugggcaucaagaagcauuaccauauaaacuagacgaauuaauaggcuuuaaaguaccauacuaugucgguccaauggucgacccagaaguagauuccgaccaaaauuucgcauggaugguccgaaaagaaaaaggugaaauaaccccauggaauuuucauaauaaagucgacauuacacaaagcgcagauaacuuuauaaaaagaaugaaaacgacggacacuuaccuaauaggcaaagacguacuaccacaaaauucgcuacucuaucaacgcuauacaguguuaaacgaacuaaaugguauaaaaguagcaaacaaaaaacuaacaauagaacaaaaacaacgcuuauaugaccaacuauucaaaaaaaaaaaaacaguaaaaaaacaagacauucuaaacaaccuaguugcagcuggcgaaauucacgaagaugacaauuuaaccggucuaucaaauggcacaacauucaacaauaaccuuggcucauauauagauuauuguaaaauaaucggccaagacaaauuagaagacgcaucaaaacaagcugauauagaacguauaaucgagugguccacaacauuugaagacgcuaauauuuuuuuaacaaaauuagccgaaauaaacugguuaacagaagaucaacgacaaaaacucucccaaauucgcuacagaggauggggucaauuuaguaaaacgcuauuaaccgauauaaaggacaauaaagacaauucaauuauugauaacuuaauguccacaaaaaaaguuuucaugcagauaauaaacgauacaacaauuaaacaaaaaauagaugauuacaaucaauaccaccuaaaucaugcagauuuaaaagacacaaucgcuaauuuauucacuucaccucaaaacaaaagggcaauaaaccaaacccuacuaguaauugaagacauuauaaacgcaguugggcacaaaccaaauagaauauucauagagucugcaaaagacaauagaaaugccaaaaaccaauuaacccaaaguagacucaaacgaauaguuaaacaguucgaagauaacaaacaacacguagaucaaucugucuaugaggaguuaaaacaacuggacgacgguucccacgccucaauagacgauagacuucucuuauacuuccuacaaaauggaaaagacauguacacuggacaaccuauagacauaucccaacucagcaccagccaauaccacauagaccauauacucccacaagccaaaguaauggauaacgcauuagauaacagagugcucguaucaucaaaagcaaacacagaaaaaucagaccgcuucuuaucagaaauaccucaauuucagcaacggagucuaugggcggaacucgaaagaauggguuuucuaacaaaggcuaaaaaagaacgucuccuaaugacuagcgaugaauuuaagcagaauuccgucagauucauagcacgccaacucgucgaaacaagacaaaucauaaaacuagucaaccaacuaauaauacaagaacaucccgaagucaaacucguuaacauuaaagcagaccuaacaaaugcuuuuagaaaaaaauucaauuucguaaaaaaccgcaacgcuaacgacuaccaccaugcauucgacgcauaccucacaagccucauugguagccauuuacuuaaaucacacccaaaaugggagccacucuuugucuacucagacuacgauaaaauaaaauucgacaacgcuccacaaggagucaacaucaugaaagaauucgaacaaagcaaacucgcagacgaaaauggcgaaauaaucuggaauaaagacgaaaugauggccuauuuagaacgacuauacaauucaagacaaauacugaucacgaagaaaguauacgcacgacacgguaaccuauuuaaacaaacaaucuucaaagcaggagaaagcgacaaccuaauucccguaaaaaauaacagaagcgacauagcaauauauggagguuauaaaucaaaacaagucucauacuaugcucuaauaagcuuacacaacaaaaaaagacaaaaacgacuaguagcuguuuaccuaauagauauccaaaaacuccaaaaucuaaacgaaucagacuauuucaaaacauuacacacaaucauuaaagaaagacacaacauaaagccagaauuugacauacuagccgauaaaaucuaccaaaaucaauuaauaauagacaacaaaaacggcuccaaucgaccuuucagaauagaaggagacuuuaaaaacgauagacaacuguaucuuccuuuacaguaccagagaugguuagcuagcaaagaaccaacagaugaaaaacuuaaccgaauauucgaccauauaugcgaacagcuagccgauuacuuuccucuguuugcaggcaacgcuugcgacaaauuacuugauaacagagauaaauucuaucaguuaaguaucaaaucagaauucaacgacaaagguaaacuaauugcagaaggaaaauuauccguaauugauaaacuauugguagcuaugcacgcagauagcaggaacuccaaucucgcaguaauagggcugucaagcagcugggguagguuuaagcuacauggcggcaacgaagcuauaggaacaucuguacaacuuauccaucaaucacccacuggauuauuuaaacguauacaaagauuuaauuga

SEQ ID NO: 8807 - RNA, 4041 nt, Artificial Sequence
  Cas9 variant
auguuaucagcaggagugauguuaggcgauguuucagcauuaaaauccaguagaaauucacuauuucagaaaaguaagaaauuaauugaaaauucaagcucagacuuaacaaaagucgauuauaguaaaaugagagaaauucuguuaagcauaagaaauauagcuauccgauuuuucaacaaugaagacuuuaaagaaagugacuacuacaaagaauuucccacaauuuggcauuuacguaaaaaucuuauggaauccgacaaaaaggcagauauaagauuaguuuaccuggcucuacacaauauaguuaaauaucgcgguaacuucuuacaagaaaauaauaaagacuuaagggcugccaacgcuaaugcuggagcagcagcgaucgacuuaagcaaugcacuugaagaauacuuuucacugcacgaagacgaaagugcauugacaugcgucccaaauguagccgauuuacaaaugacgcuggaacaaccuggacuacgcaauggugaacgucuagaucggauaguagcagccuuaaauaugccugaccgagcacgugcaaaacuuuuugcaaaggcuuguauuggacaaaaaguggaauuuagcaaacuugcauuaggaauggaaaaacaagaagguacaaaugcauacaucugggacgaugauaaauacgacgaacucguugcucuaugcccugaagacuucuucccaguauuggaaaccuugaaaaacgcuuacucagcauauguauuaucagacuuauuagcaggcaaauuaucaauaucagcuucucuaaucgacuccuaugagcaacaucagaacgaccuaaaaauaguaaaagaauuaguaagagaauauuuagggcaaaaagaauauggccgacuauuucgagguccuaaauucgccaauggagauuauaacuucaauaaaguagcaaaaccaucauacacgucauacauuuuaggugaaucauuaugcaacaaacaaggaacaacacgagaggagcuagucaaggaacuaaaacgagucuuugaugacuguucggcgauacaagcagauaaaagauaucagaaaauaaaacagagacuugaagacgaucccaaauucuuaauaaaacagaaaacccgagcaaacggcgcuauaccauaucaauugcauuuagaagagaugcaucaaauaauagaaaaacaaggaaaauauuacccauuucuagucgaacaacaggaccuaauagaaaaacuuguaucaucaagaauaccauauuacgucgguccacuaaacgguggacacgaccccaaccauccauauccaacgaaucccauagauccaaagcgaaaguuugcauggucaguaagaaaaccaggaauggaacaugaaaaagcauacccuuggaauguagaugaaguaauagauucagaagaaacagcggaaagguuuauacguaggaugacagggaccuguacauaccuauauggagaaccaguaguucccagaugcucccuacuauaugaagaauuuugcguuuuaaaugaacuaaauggugcccgcuggggagaagguaauggggacacccauagauuugauaguuccgacagaacagaaauacucgaacaacuauucaagaaaagaaaaagaguaacacacaaagcaauagcaacauggcuagaaauaaaucacggaguaacuaaugugaaaauaucaggaacucaagcagaaaacgcauuugaaaguaagcucucaagcuauaaugauuuuugcaaccuauuaggaguugauggauuagaagaugucugcccgcuaacaaaagaugacauugaacaaauuauauuaugggugacagucuucgaagauaagaaauuacuccuccaaaaacuucaacgagcuuucggcgauaaauugucugaaaaacaaaucgcaaguauuaugcgaaaaccauaugccggauggggcagauuauccaguaaacuacuuacuggaaucaaaagagaaacaccuuucggaagaauaaguauauuagacguaaugagagauggagacccgagaccgggacaccauuuagacgcaaugaauuucauggaaauucucagagaaaaagauuuuggauuccaagacagaauagaugagauaaauaaagaaagaacaaaagagucuggcuuacuauuaaguguagaagaccugccaggaaguccugcacuacgaagaucagucaaucaggcaaugcauauauuaaaagaaauaguaucaauugcuggaaaagaacccagcagaauagucauugaagucacacgagaucccgacgaagagaaaagaggccaucgcacagauacaagguacaaacaacucagugaagcccuugcugcgauuaaaacagauauuguacaguuugauucaucacuacuagcagaacuuaaagaaagaaaagacaguuuggauucugaacgcuuaaugcuauacuuccaacaaugugggaaaagccuguacucagggaaaccccuagacauuaaucgucucagcgaauaccaaguagaccacauaauaccacaauguuacauaaaggacgacaguuuagauaacaaagcucuugucuuugcauccgagaaccaaauuaaacuagacucauuacuucuagacaaaucaauaauaaggucucaaaaaggcagauggcaagaacuacacagagcuggucuaauauccaacaagaaauuucgaaacuuaacaugcacggaaauaagcgaucgaaugaugaaaggcuucauaaaucgccaauuagucgaaacaucacaaauuguaaaauuuguaagacaaaugugcgaacaacgauaugaaucgucagaaguuauuagccuaagagccagucuaagucauaaccuaagagauagauguggcuuuauaaaaugcagagaauuaaaugacuaccaucacgcacaugaugcuuaucuagcaugucaaauagcuagauucaucggaaucagauacccucgauggcaagacggaaucagcagagaguuuauaaacaaauauauaaaacaacuuguuaaaaagggaaaaucaucuggaaaauucuuugcaggcaaaucaggauuuauuauagauucguuuaugcaugauggauucgacagagaaaccggagaaauauuuagagacggaugggaugcuacauuugaaaucacaagaaugagaagaguacuuggauacaaagauugcuuuauaacaagaaugccagaggaacagacaggcgcauauugggaagagacuauauauucaccccuagacgccaaaaaugggaaaaaccuacaaauuccucuaaagcagucaggcaaagaaggcuaccucgauccaaagaaauacgguggaacaaauacggcauuuaaugcauauuucuucgccuuuguugcaaaagaugcucguggaagggacaaauacuucuuugaaggagucccaguauaucucgcaaaacaacuaaacgaacaaccucaaauuuuaguagauuuugcaaauuccauugcagcaaccaagaaaugcucgaccgcaaaaauacuuagaagcaaaguaccgcuaagacaaaaauuuuuacuugacgguacauccuuuuaucuuggaggcagaaccggaaauaaaaacguaauacuaucaggggucgaauuugcauguggaauugauauggccaaaaugauugacacagcgauuaaacacccugaagaauuaucucaaaaggaacuuauaucuauaauacaaaugcuagccgacacgauagaaagaaacagugaccgacaagcaaguuuaaucaacuuccgaagauucgaugacaaacuuaggaauauagacgcuauugcagcaucuagaauaauuaaaaauuuauuaaacucuaugaacggaguaaagcaaucuugugauuuaagcgauuuaggcggaucaaaacaaagcggauucaugcaaucaaauauagcuacacuuuuugaacgaauaacaugguguuacaguaguauaaccggaauguucgaacagcgaguuucauucgaagaucuuaaaaauggaauuuga

SEQ ID NO: 8808 - RNA, 4041 nt, Artificial Sequence
  Cas9 variant
augaagaaaagaaauagagaagaauauuauguuggcuuagauauuggaaccucaaguguaggaugggcaguugcuacacccgacuauagaauaccuaaauucagaggacacaaaaugugggguaguaggcuauuugcagagggaaaaagagcagcagaaaggagacaguucagaacaaauagaagaagauuagcaagacggcgagauagacuccagauucuagaagaauuguucgcagaagaaauggccaaaguugauaauacauucuuuaugcgcuuaaaagaaucaaaauucuuuuuagaagauaaaaccgucaaagaaaaacacaucuuauuuucaaccgauaaauuugacgcagacagauuuuacaaagauaacccaacaauauaucacguaagaaaaagacugauggaagaagaaccgcaagacauccgagaauuauuuuuagcaguacaucacauacucaaauacagaggucacuuccuauuugccgguucauuggagcaaaauggcgauuccauagaggaacucguaagaacacuauuuggaaaacaaggauuagcaauauuagaugauacaauugauucaaacgaaaugguaaauauucuaaagaauaacgagaaaacuaaaucugacagaaagaaagccgugcaagaauuauggaacccucuaaaagacaaaguaaagaaagcgcaagcugcagagauggcugguguaguacuuggacuaaauagcgacauaucaaaauuauuugacaauucggauuacaaagacuugaaaauaaauuuuaguuccggcgacuacgacgaaaaacgugaugauuaugcaaauucaauaggcgaugauauagucuuacuagacacuaugaaagcucuauaugauacacuaauacucagccaaauucuacaaggaaaacaaaguauaagcgaagccaaaguagaagacuacaacacucauaaagaacaacugagggcuuuaaaagcgauauuaaagccgcacaaaagauuauauaaugaaauguuuagagaaaacaauaaaaaggauuuaagcaacuacguagcuuacauaaguucuuacagugaaggaaagagaguaaaucgagagggguuuuauaaauacguacaagcgguucuaaagcaagucgaugauagcgacucaaagcaagcuauucuagaagcaauuagauuagaaacauucuuaccacuccuaagaguuaaagacaaugcaguaauaccgcaccaaauacaucaagcagaacucgaggcaauccuagaaacagcccguaaaaaguacaaauuccuuaacgaugucucagaaggcguuucaguuaaagauaaaauaauacaacuauucaccuuuagaauaccuuacuauguagguccauuaaacccacacuccggagaaacagucgccgacagaaaacaaggaacaggauggguuguuagaaaacaaagaggcaaagucuaccccuggaauuuugcggacaugguagauguaaaagcaagcgcagaggcauucaucacaaaucuuaccaacaaguguacauaucuaauaggcgaagacguauugccaaaaagaagucuccucuacucagaauuuaugcuacucaaugaacuaaauaugauuaaauaugauggacaugaauuaccagucgaaauaaagagauuauauauagagcaaguauuuaaacaggaacacaagaaacaaacaaaagggagaguacuagacuuuuuaaaaagaaaugguuuaauuaccggaucagccacagcagugauaacgggaauggaugauaguauuaaaggagaucugcaauccuacagagacaugguaagaauuuuuggcacaggguucgaucauucaauggcugaaagaauuauacgauggguuacacuauucggcgaagcaaaagauauucuagaaaauaagauuagagaagucuauggaaauucaauaucagauagucaaaugagagcaaucaagaaacugaaauacgccgauugggguagauugucccaagcauucuuuaucaaaauuaucggaugugauaaaucaggaguggaacgaaacaucaucacauguuuacgagaaucuagccaaaauuuaauggaaauacuaucugaucaagguacuuauauuaaacaaauaaaggcuuggaaccaucaacauacaaccaauaugauggauacguuggauuaucagcuaguagaugacuuguacguggcuccauccguuaaaagaucaauauggcaaaguuuaugcauaguagaagaauuagucaagauaaugggccaagccccgaagaaaauauuuguugaaguaacuagaacuaaucaagcugagaaaacuaagaaagacagccguaagaaaagauugguugaacuauacacagcaaucggaaaagaaggugcagcauggaagaaagaaauugaaaaacaccaagcgggugauuucagaagaaagaaacuauauuuauauuauacacaaaugggaagauguauguauucucacgaaccuauagcaauggaugcacuauucacgagugaauaugacauagaucauauauauccacagagcuuaacaaaagaugacaguugggauaaucugguauuagucaaaucccaacuaaauaaagaaaaaucggaucaauauccacucagaccggcgauacgagagaaaaauaaagcauacuggcaauaucuauguagagcugguuuuauuagugaaaagaaauacgaaagacuaaugagaacuacagaacuaacggcugaagaacuaucggguuucauugcgagacaauuaguagaaacaucgcaagcuacuaaagcgguaauaggauuacuagaacgaauauauaaacauacugacauauguuuugucaaagcagaaacaguaucacaauuucgacaccaacauaauuucauaaaaauuagagaacucaacaauuaccaucaugcaaaagaugcauaccuaaacauagucguaggcaauguauaucaugaaaaauuuaccaaaaauccuagagaguucauagcacgauccacagaaagaagaccuuacaacuuaaauagaauguaugauuuugaccuacuaaaacaaggacgagucauuuggcaagucccaaagagcuuagaaacaguacaagccaugaugaaaucaaacgauguuaggauuacgaagaaacucuuaguccaaaaaggggaacucuaugaugcaaccauaacgaaagcacauaaaacgaaagaaggcauguacuuuccauuaaaaggagcugaugcacgcuuacgcgauguucauagauaugguggauaugagaaaauuaaaaucgcguauuacucagucuuuucguguugugagaaggcuucagauacaauccauacucucauaauaccaauuccaguuuacgcagccggauugcuacaaacugaggcagaccucacugcauaugcuuggcagacaaaacagaaaaccaaaccuauaaaagauauauauucaaugaucacgcccauuuacaagaaacucugcauaaacacaguaguaaaaauagacggauucaaauacuuucucggaggacgaacagaagacuacauaugucucuauccagcuauuccuguuguauuagaugaacaagcagcugcuuauuuaaaagcaguaucaaaaguaggcagagcagaugauguagagaauaccgcccaagcaauagaucuuauaacugcagaagcgaaugaagcauuuuaugacguauugcuuaagaaaauggaagcaaaaauauuuguaaaagcauaccaagaaaggguugaaaaauuagcuagcgaaacagcacgagaacgauuuagaaaauuaaguauaggagcgcaauguuccuguuuauuagaaauccuaaaucuccuagcaaauaauaaaacaacgagcaauuugaagaaauggcuaggaguaacgaugucucgacgaaaacaaccuauggaucuaaccaaacuagaggaauguauaguauacgaaacguccauaaccggacuguaugagaaagcaguaucacuucuauga

SEQ ID NO: 8809 - RNA, 4041 nt, Artificial Sequence
  Cas9 variant
augguagaacacuaugcaauaggauuugacauaggaacggguaguacagguuucgccggaguagauccuaauggaaaauuaguacguaugagggguaaaaacgucuacggaguguacagauuuaaaggaggagaagcggcagcugauagaagaggauuccguacgacacgcagacgaauaaaacgacgaaaauggcgucuaagauuccuaaaaucuuucuuugaacccuauaucgcuccaauagaucccgaguucuuucuaagacaaaaauacucagcagacucaccacuugacccaaaaggaauacgagcagacaaaggccuauuaucagacaugucagaccaggaguuucacgcaaaauauccaacaauauaccauuuaagauaucaacugaugcacgagaaaagacaguuugacgucagagaaauuuaccuagcaaugcaucacauaauaaaauacagaggccacuuuuuaauagaagauggugcagacaacuuugaugccaaacaaauagauuucuuugaccaauuucaacgaauggccgcaguuacagccggauuaccugaauuggaaacguuagucguuccagacgaaacacaauccgacgcauuuaaaagaguuuuauucgaugaaucccaaaccaaaucugauagacaaaaaguauuagccucacaauuauuagauauccaagacaaucaauccaaagcaauuaaagauuuuauagcagcguuaacuaaagccguaguagguaugaaagcaaaucuggcaacauuaacguccaccgcuauagaaagcacagauaaaaaugauuggacuaaaccccuagggcaacucgaugacuuuuuacuaaaacaugaagaagaucuagacgaagauggauacgcauugauagaugccgcuaaucaaauguacuccgcugcaguucucgcggcuuuaguuccugaaggaaugggauucuccgaagcuaugauggcuagauacgcacaacauaagaaacaguuagcuuuauacaaacagguuauagcuagucuaccagauaaaacucaacgacaugaauuaaaagacgcuuacgcagauuacauugaacaugcagcacaaaaucccagagaugccuucuacaaaagaguuacaaaaguccucgaaggaguagauuccgcagacgcgcguacuguaaugacugcaaucagucaugacgaguuucuccuaaaacaaagaacuuuaucuaacggaaaaauaccuuaucaaaugcaacaacacgaguucgacgcaauaauugaaaaucaaaaagcguacuauccauggcuugcaaccccaaacccgguagaagcugaugccaaaagauuacccuauuauuuagacgaacugauuggcuucagagucccauauuauguugguccaaugguuacagaaaaacaaucccaguucgccuggaugauucgaaaagcggacggagaauuaacuccauggaauuucuuugacgucguugauagagagaaaacugcuaaccgauuuauucagcgcaugcaaacuaccgauaaauacauacuaggugaagacguacuuccgaaacacagcauuuuauaucaacaauuugaagugcuaaacgaauugaauaauauucggguugagaaacauccccuaacaacugaacaaaaacaauuuauauaucaacgacuuuuuguagaccagcagagaaaaacaauaaccaagaaaaauuuacaagauacccucguggcuaugggagaauuugacaaagcuccagauauaggaggcuuagcaaaagaagauguaaugaugucaagucuagcuacauucgcagacuacucaaagauauuacccgaagccauuucagauccaacuagacaaaacgacauagaagauaucauagcauggaguacaauuuucgaggacacacaaauuuucuucgauaaacuuaaaacagucgacugguuaacaacucaacaaagaaaacgcuuagccaguauuagauacacgggcugggggaaauuaucuaaacgccuucuacaacaaauaccuacaucgaaacacacuaacguaauggcagcucucugggcaacuagcgacaauuuuaugcaaauacuccaagaugaacaauuccaagaaggacucuaugaugcaaauagauuacccgaagaaacacuaaccccggaugaacagguagagaaaaucuuagacgaggcuuaucuaagcccagcagauaagaaaggcgcuagaaaaguaauaaaaguuaugaaugacauaguacgagcuaaucauggaguacuaccagaacaagucuuucucgaaucugcagaugacccucagaaaaacaaacgcagaucuguuagucgaucaaaacaauuagaagaaaaauauagacaagcugcacagagcuuuauugacgaagcaguaaaagaagaacuaaacgcacaaauaguaaauucagcugaauuuaacgauagauuaguauuauacuuuacccaaaaugguagggauauguacaccgguaaaagguuagauauagaaaacuuaggaagcuaucaaaucgaucauauuuuaccacaaagucucgucaaagaugacagcuuagacaauagagcacuuacugccagagacauaaacgcagaaaugaguaaccaauuuguuagcgaaagauuuggauuaggaccaagagcuuuuuggcaacaacucaaaaauaacggucucauaagcggcagaaaauuucgaaacuuagugaugcaaagagaugaaauagacaaauaugcacccggcuucauaaacagacagcuagucgaaacuaggcaaauuauaaaaacaguagaacaaauaauacaccgacuauggccagacauacaaauaguuacaauaaaagcaaacuuaacgcaucaaguucgaagcgaauuagguuuccccaaagucagagaauuaaaugacuaucaccaugcuuuugacgccuuguuagcggcacgaauagggcaauaccucuuagaacacuacgcaggauugaaaccguucuuuacauauggagaauuuaaaagaggcgauacaaagaaauacgguacaaccaacuuccuaagacguuuaacaaaagauaauaaagacaagaaaggcgaauuauuaccagaagucuccgauuggauugacucaauugacucuauauauaauuauaagaaaauccccguugucugggaaaauacaacaaacaugucagcacuauuugaucaaacuauauacccaagaccagaccgagacaccacaaaaaggaaauugauucccacaaaacuggacaaaccuaccgauauauauggcgguuacagcucugcaaaaacugccuacauggcuguuaugcguguacaaacaaagaaagguacagaauacccaguauucaauaucccuguaaguauagcaucacaauuaaacagaaucaccgaccaaacaaugcucaaacaacaaguaaaacaauucaucauaaaugcagaacaaucugcuucgaaaaagaaacucuacgaaucaggagacguuauccucucccgcguagcccuaggccaacgguuuacagacaaaaauuacggugaaguauuucuaauaucuaacauggaaguucaaaauccacaauccuuaugguuagguagagcaagccaacaaagauugacaagagaaccagagggaaaugaaaaaccagagaccucauuagcugauauuuaccaacaaauauuaaaacaaguagaucgauacuuccuugcguucaacauucgacaacaaaggcaaaaacugcuuggcaccuuagaccaauucacuagcuuaccugucggacgcguuaaugaacaaacucgcaccgaccaaaaucaaagaucaauuauagcucgugugaugauugugcuaggaaaaggaaguagagaagaaaaauuuccagaguuugggcuaucagcacuggggcgccuagugagaacugggggaauaacacuaagugaagaugcacaaauaauauaccagucuccaacagguuuauuugaacgaagaguagcgcucaaagacuuauga

SEQ ID NO: 8810 - RNA, 4041 nt, Artificial Sequence
  Cas9 variant
auggcuaaaauacuaggucuagacuuaggcacaaauagcauagguugggcgguaguagauauugaaaacaauaaugaauuuacauuaaucgaaaaggggguaagaauauuucaagaaggugugaagauagaaaaaggaauagaagguagcaaagcagcagaacgaacgacuuacagaucagcucgcagaaucaaauacaggcgaaaacucagaaaaauacaacucuuaggcguacuaagcgaaaacgguuauuguccuuuucucagcaaagacgaacuggacagcuggagauacaaaaagguauaucccacaaauaaaucauuuuugaacuggcagaaaacgaacgaaauacaacuugaaaaccccuacuuuuacagagcacuguugguugaaaagaaacucaauuuaaauauagaagaagacagauucaaaauaggcagagcauucuaccaucuagcucaaagacggggauuccuaucaaaucguauggaaggaaccaaagaaaaugacgguacagugauuaaaucaaucacagagauaucaaccgccaaaggggacaaaaccuuaggccaauacuuuuaugaaagauacaagaaaggagagaaaauaagggacacauacacucaucgcgaagaacauuacuuggaagaauuuguaagaauaugcgaauuucaacaauuagacaacaaauuugcagaaaaaguaagaaaagcaauuuucuaucaaaggccccucaaaucacaaaaaggacucauaggaaaauguguauuugaaccaaagaaaucacgcuguuccguuucaagaccugaguucgaagaauauaggaugcuauguuucuuaaacaacauuaaaauaaaaaccccaucagaugaaaauuugcgcuuccugacagacaaugaaaaagaaaaacuaaaaccgcaauuuuuccgaaaaagcaaagaccacuucgacuuugaagaccucguuaaacaacuagcgcccaaaaaccaauucaaguuuuauaaauccagagacauauuaccugguaauuggcucuuuaauuauucaaugaacacaacaguaucaggaugcccaauuucugcaagguuaaaagaucuauuuggcgaaaacuuuauggacauaaaauuugacuauauacgagaaaaagauggaaagaaaucaguaauagacauacacgacaucuggcacguguuguucacguacgacucagaagaaaaauuaaaagaguucgccagaaaccgguuaaauuuagacgauauuaagauaaaagaauuucaacguauacaauuaaagaaagaauacgcugcacuaucacuaaaagccauaaggaaaauacuaccuuuccuaagagaagggcuaauauacucacacgccguauuuauagcaaacauggaaacggccauaccgagcgaaauauggaacaauuauacuaaucggaauauaaucaaaaaugaaauauacaauaucauuagcaaccaaacugaagauaaacaaguaguagauauagugaacgguauuauaaagagcagucguaucgaaaacucaguguggaguaaugaagcaguagaguucuuuaagaaagaccuaaacagcaaaauuaaaaauuauuacggaaucaaaacguauaacgauuuucccgaagaaaagaaaauacgcauagaaacauacgcauucaaccucuuuaaacaacaaaugaugaaaaauuucggacgcggagaauuugcugcaguacaacguauagacgaacgacuaaaacuauuuuuaacagacaacuuuaauaucgauccaauauuacuaaagaaaauauaccauccuucagcaauagaaguauaucaaccaccaguacgcaaaaacgacggaaaacuauaccuagguucgccaauggucaguaguauacgcaacccgauggccaugcgcgcacuccaucaacuucgaaaauuaauuaaugaacuuauaaggaaagaacuaauagacucuaacacaaaaguaaacauagaaauggcaagagaacucaugaaugccaaugaacgaaaagccuaccaaaacuggcaaaaugauagagagaaaauccgaaaagaauacgcacucaaaauaaaacaacaucucgauguagacaaagaaccuagugacgucgauauccugaaauaccaauuaugggaagaacaaaaccacaaaugcauauauacaggaaaagaaauaaauauaagugacuuucuuggcuccaauccaaaauucgacauagaacacacgauaccacggagcauaucuuucgauaacucacaauccaacaaaacacuaugugaaaauuauuuuaauagauccguuaagaaaaacagaauaccagcagcccuaccaaaucacggagaaauaauagaacgucucgaaaacuggaaauuaaaauaugaggaacucgaaaaacaaauacaauaugcaguacgacaagcuaaaggugcaggagauaaagauucaaaagaucgagcaauacaaaaacgacacaaacuaaaauuugaauacgacuauuggaaaaacaaauaugacagauuuguuauggaagaugucccagaaggauucaaaaauucacaauuaguagacacagggauaauaacaaaauauaguagaauguaccuaaacacauuauucgauaaaguauauacuguaaaaggaaacacuguugccgauuuuagaaaacuguggggcauacaagaugaauacgaaaagaaagcaagaguaaaucacagccaccauugcguagacgcaauaacaauagccugcauaacaaaauccaacuacgagaaucuagcuaaauuuuaccacgacugggaagaacuccauguuaaaggcauagaccaauuaccaccaaugaacaaaccguggaaaaccuuuacagaagacauaaaagccauccaauaugaaauucuggugagccauuacacgccagauaacuuaccaaaacaaagcaagaaaauucuacgcaagaaaggaagaauacagaaaaacgaaaauggaaaucccauuuauuuaaaaggugacacaguuagagguagccuacaucaacaaaccuucuacggagcaauugagaaaacugagguuaauaagaaaggugaacccgaaaaagucauaaaauauguaguaagaaaaagccuagacguauuagaugacagcagugugaaaaacaucguagacgacaucguaaaagaaauaguacaaaacgcacggauaaaagaaaaagauuuuauuaaagaauuagaaauucaaaagcggaaguuagccaaagcugaagaaaacaaagucguacaaauucaagcugaaauagacaaacuaaauaaacaaguagcagacuuauacacuaugccgaacaaaaauggcaacccuauacccauaaagaaagugagaauauuucaaacaucaguuacaaacccaauacaccuaaaacaacaaagagauaaaucucagaaaaccucaaaaccacauaaagaguucuacuaugcagccaaugauaguaauuauaugauggcaauauacgaaggaaaagacgaaaaaggcaaaguaaagcgagacuucaaauuacuaaauaacuuagaggcaggagaauuuuucaaauacucuguccacaaagaccugaaagagaaaaaccuagaaaauauuagaaacgugauaccagauaaaguaucagcagguaaaauugaaauaccacuaaaagcuaucauuaaaaccggaacgaugguaauauuaugggaaaauucuccagacgaaguaugggacuuaacuauaucugaaguggauaagcgauuauacaaaguagugggaaugagugugaaucgaaucaaaucagauguuaaaacuuucgaguucgggaacauuguccuaagacacaauaaagaagccucuccagcaacuuuacuuaaaauacaagauggugaauuuaaauccgacgaaaauuacauagcccaaagaaagcuaagccauaaccaauucaacgcucuaguagaagguguagauuuuucacuuaguguguuaggcgaaauaaaacgucugaaguga

SEQ ID NO: 8811 - RNA, 4044 nt, Artificial Sequence
  Cas9 variant
augggagaagauggaaaaccaguacgagucaaaggcaaaacagcaauaggagcaagauuauuucaagaaggucauguagccgcagaccgacgcauguuuagaaccacaagacguaggcucaaucggcguaaauggagacuaaaauuauuagacgaaauauucgauccuuauauaaccccaguugacuccacauucuuugcacgauuaaaacaaagcaaccucagcccuaaagacagccgaaaagaauuuaagggaaguauguuauucccugaucuuacagacaagcaauaucaugaggauuacccuacaauuuaccaccuacgacgugcacucaugaccgaagauaaaaaguucgauaucaggauggucuacuuagcuauccaucacauaguuaaauauagaggaaacuuuuuaaacucagcaacuguagacacguuuaaagcgucuaaaguagauuucaagaaaucauuuaaccaacucaaugaacuauauagcgccauaaaucccgaagacgcuuuccaagucgacaugaauaaaucagaugaaaccggaagacuauuuuuagacuccucuauaagaaaauucgauaaacaaaaacaaaucucaaaacucauaccagucguuguagaagacaaagaagccaagaaacuaaauggcaaaaucgcacucgaaauaacuaaagcaauucuggguuauaaaucgaaacuaaauguaguuacucaaacagaaccugaagauccaaagaaaugggcaguuaaauucgaugaugaagacauagauaguaaacucaacgauauccuaccagaaauggacgagaaucaacaauccauagucgaaauaauucaagacuuauauucccagguaacacuaaaccaaauaguuccaaacggaaugucgcuuucagauagcaugaucaagaaauauaacgaucaccacgaacauuuaaaacuauauaagaaacuuaucgauaauauaagugacacuaagaaaagaucggcacucaaaacggcauaugacaaauacguaggugacgacggaaaaacaaucgaacaagaugaauuuuauagcaauguuaagaaaaacuuagacgacagcgaccuuucaaaacaaaucgccgacuuaauugaagcagaaaaauucaugccaaaacaaagaaccagucaaaauggcguaaucccacaccaacuacaucaacgugaacucgaugaaauaauugaacaccaaucuaaauacuaccccugguuugcugaagcuaauccaaauaaacacgaccuccauuuggcaaaauacaaaauagaagaauugguagcauuuagaaucccauauuauguagguccaaugauaacccccgaagaucaagagaaaaguucacaaacuauauuugcguggaugaaaagaaaagaacccggacaaaucacacccuggaauuuugacgaaaaaguugauagaauggaaagcgcaaacagguucauaaaaagaaugacaacaaaagauaccuaccucaucggcgaagaugugcuaccagaccaaucccugcuauacgaaaaauuuaaaguacuuaaugaacucaacauggucagagugaacgaccauccacuaaaaguaucagaaaaacaagcaauauaccgugaccuauucgaaaaccaaaaacgaaucagcgugaaaaacuuacaaaacuacguaaaaucuaagucuggauuaccaaccggcccaaaaauaucuggacuuucagauccugaccacuucaacucaucgcuuggaacguacaaugacuucaagaaaauguucggagauaaaguagacgacccagauuugcaagaugauuucgagaaaaugauagaauggucaacuauauuugaagacaagaaaauauugagagcaaaacucgacgaaguagcauggcuaucagacacccagaaaaacgaauuuaaagaaauaagauaucaaggauggggccgacucaguaagaaauuguuaacagguaucguugacggcaauggccaaaggauaaucgaugaauuauggaauacaaauaaaaacuuuaugcaaauacaauccgaugacuccuuugccaaacguauacaugaagccaacgcuaaucaaaugaaagcuacagaugucgaagauguauuggcagaugcauauacaaguccccaaaacaagaaagccauuagacaaguagugaaaguagucgaugacauacaaaaagccauggguggaguagcuccaaaauuuauaagcaucgaguucacacgcagcgaagacagaaauccgagacgaacaauauccagacaaagacaguuagaaaauacacuaaaagauaccgcucaggcucucgucaaaucaauaaacccagauauuuuaucagaacuugauaacgccucaaaaagcaagaaagggcuaacagacagacucuaccuauacuucacccaguuaggaaaagacauguauacuggaaaaccaauaaauauagaugaaauaucaaauuacgauauagaccacauauucccucaagcauuuauaaaagacgacuccuuaaacaauagaguacugguauccaaagcgggaaauaaugguaaauccgcaaacgucccuuuaaaacuauuuggagcaaaaaugggcggauacuggaaacaauuagcagacgcaggccuaaucggucaacgcaaacuuaaaaauuuacagacaaauccugacaccauuucuaaauucgccaugcauggguuuauaagacgucaauuaguagaaacuucucagguaaucaagcuaguggcuaacauccuaggagauaaauaccgaaacgacgacacaaaaauuauagaaaucaccgcacgaaugaaccaucaaaugagagaugaauuuggauucaucaaaaaccgugaaauaaacgacuaucaccaugcauucgaugcauacuuaacugcauuccuaggccacuaccucuaucaucgauacauaaaauugcggccauacuucguauauggagauuucaagaaauucagggaagacaaaguuacuaugagaaacuuuaacuuucuacacgauuuaacugaugacaaacaagaacguauagcugacacagaaacuggugaaguaauaugggacaggaaacguagcauacaacaauuacgagauguguaccauuauaaauucaugcuaauaagccaagaaguauucucuuuaaacaaagaaauguucaaacaaaaacuuuucccagcgacucuugcaaagaaaagcaaacuaauucaaauaaagaaagauaaaccaguagauauauacggaggcuauagcaacaacacagacgccuaucuaacagucguaaaacuuaaaggaucaaaagaggauaaauacaaaauaguaggaguaccaaugcgagccuuagacaaucuuaaacacgcagaaaaagaaagcccgcaaagcuacacggcagaguuaagaaaagcccuugaaccgcaauuuacaaaaauaaagaaaaacagaaaaacaggcgaaguauccaaagucguaaccaacuuugauaucguuuuaggacgccuauucuaccgacaaaugguuauagacggcucugaaaaaucucuuauagcuucaucuguauaccaauacaacgcaaaacaacuuguuuuaagcgaccaagccaucagaaccaucuccgaucaagaaggcauugaugaauuugaauuaucuucacaauacgauaaaguauacgacgaaauaguccagaaagucgaaaaauuacucccaauauuucaacacagacacuuucaagaaagguuaaacaauggaaaaagccuauucguaaaccuuccaguacacgacguuuacgaaggcaacaaacuugaacaaguaggaaagaaacauaucauaaacucaauacucggugguauccaugccaacgcagacagaccagacauagaucuauucgguaucaaaaaucuaggacaauuuuccaguacaagcggcauuaauuuaucaucagacgcuauaauauguuaucaauccccaacaggucuauuugaacgccguguaguucucaaagaucuuuga

SEQ ID NO: 8812 - RNA, 4044 nt, Artificial Sequence
  Cas9 variant
augacuaagagggaagaaccuuacaacguugguuuagacauaggaagcaguucgguaggcugggcaguaguugauaauaacuaucacuuauuaaauaucaaaaaaaauaaccuguggggcgcucgccuuuuuaaagaggcagaaacagcucaagucacuagaggccacaggagcaugagacgccgauaccguagaagaagaaauagacuaaacuggcuagacgaacucuucgcagaugaauuagccaaaaucgauccaucauuucuauuacgcaugaaaaauucuuggguaagcaagaaagaaaguacaagaaaaagggauccauauaaucuuuucaucgaugaaaaauacaacgacgucgauuauuuuaaccaguacccaacaauuuuccacuuacgaaaagaacuaaucaccgaagauaaaaaaguagauauuagauuaauauaccuagcaauccacaacauaaucaaauacagaggcaauuucacacuagaaaaccaaaauuuugauauaucgcaacucaguucgaacuucagccaacagauaucagacuuuuucgccuuguuuuccgacuucggugugauaaugccagaagauuucgaccccgacaaaaucucagacauacuucuaaauccaaaucucaguccaagugguaaagucucugaagcgauagcaacaauuucaccaaaaacaaauguaaaagcaaaaauuaaaauaauucugcuacuacuaguaggcaacaauggagaucugaaaaaauuauuugauuuggaaacaaccgaaaaaauagcaguaaaacucagcucccgacacauugacucagaacuuccaauaauacuaucagaacuaaacgaacaacaagaaaacaucauaaccaucgcaaacuccauauuuggcucaauuauccuaaaagauuuccuaggagacgaaacaucuauuagcgccgcaaaaguuauaaguuucgaggaccacaaacaagacuuacagaaacucaaaacaauguggcgcgaaaccucgaacaaggaagcgguuaaagcaggcaaaaaagccuacgaagacuauauuggacaugaagauucagaaacuuucuacaaaaaaauaaaaaaauuuuuagaaaaagcccaacccguagacuuagcaaauaaagcucucgcugagauagaacuagaaaauuaucuuccaaaacaaagaaauagaaacaacacuguuauuccauaccaacuaaaugaaaaugaacuaaucgccauacuagaccaccaagaaaaauauuacccauuccuaaaagaaaaccgagacaaaauacucucucuacuaaccuucagaaucccguauuacgucggaccccuucaagacuccaacaauaaccgguucucauggaugacacgaaaggcuuccggagcaauaagaccguggaacuuuuccgaaaaaguaaacguugaacaaucauccaaugacuucaucaaacgaaugagaucaaccgacacauacuuaauaggagaacccguacuaccaaaaaaaucacuaauauaccaauguuacgaaguauuauccgaauuaaauaauacaagaguuaaagauggaagcagcaauccaaaacgucuugaugucacaauaaaacaaagaauuuauaacgagauuuucaaaaaccaaaaaagcgucucaguaaaaguccuacaaaacuggcucaucaaagaaucuuacuuuaaaucaccagagauaagcggucucgcagacaaaaaaaaauaccuuucaaguuugaguacauacauugacuuuaaaaaaauauucgggcaaagauucguagaugauccagugaauuccccucaacucgaggaauuggcggaaugguuaacauuauuugaagauaaaaaaauucuccucauaaaacuccaaaacuccaaauauucguaugaucaagcaacaauaaauaaauuaucgacaaugcgauaccaagguacaggaaaauuaucaaaaaaacugcuaguagaccucaaaaccacaaaaaaaucaaucgguaaauccggagcagaaucauuauccauccuagaucuaauguggaguacaaaagacaacuucaugcaaaucauucaugacgcagacuacacauuugaacaacaaaucaaagaauuuaacuaugacacugaagacgaauuaaccccacuagaaaaaguagcgaaucuacauggaagucccgcacuaaaacgaggacucaaucaauccaucaaagucguggccgauauaguaaaauuuaugggacacgaccccgaaaaaauauucaucgaauuuacccgauccgacgacuucagcaaacucacaauaucccgauacagaagaauuaaaaaacaauaucuggaaaucgccaaagcaauaaaaaaaauucccgcagaguuuaaagauauuaaggaauaucaaacacaauuggaggaaaacaaaggcaaacuggcaucugaaagauuaauguuauauuucuuacaaugcggacacucauuauacagcaacaaaccaaucgacuuaaauaugaucaauuccagcaaauaucauguagaccauauauuaccccaaucauacauaaaggaugacaguuuagaaaauaaagcucuuguauuggcaucugaaaacgaaaauaaaauagauaacaugcuaaucucucaugacauaaucgcaaccaaccuaccaagauggcaggcccuaaaagaucaaaaucuaauggguuccaaaaaauucgccgauuuaaccagaaccacugucaccgaaaaccaaaaaaaaggauuuauacaaagacaauuaguucaaacaucccaaauagucaaaaauauaacacuaauauuaaaugaccuuuacaaaaacacuuccugcauagagacacgggcaacacuaucaucugaauucagaaaagcguucucgaacuuugacgaaacaacauaucauuaccaauucccagaguuuguuaaaaaucgagacguaaacgauuuccaucaugcacaagacgcuuuccucgcuuguguaauaggcgaauaccaacugaaaaaauaccccaaagacaaucuacggcucguauaugaucaauacucuaaauuccuagauucuuuaaagaaagacacuagaaaaaaaaacggcagaaugccuagauacacacaaaacgguuucaucauaggcucaauguuuaacggaaaaacauauguagacgacaauggcgaaauaaucugggaccaaaagauaaaagaaaguauccgaaaaacauucaacuaccaccaauuuaaugucguaaggcaaaccauagaacaacacggaaaacuuuuuaaugacaccauccaaccacauucagaccguuauaaacuaauuccucugaaaaccaaccgcgacccagcaauauacgguggauacaauaaugauaacaacgcauacucaguaguacuugauguugacggaaaaaaaaaaaucaacgggauacccauaaggauugcaaaccaauuaaaauccgacgaacucgaccucucuucaugguuagaaaauaauauaaagcauaaaaaacccaugacaauucucauagauaaaguaccaaaauaccaaagaauuauaaaugaggaaacaggagauuuacuuauaacauccgcaaaugaaguaaucaauaauguacagcucuuucuaccauccauguacaccgcucuaauuagccuacucgauucuaccaaaacagaaauguauagcaaauuauuaucaaacuacgaagccaacauccuaauagacauauaugacuauuuauuaacuaaauuaaaaaauaauuauccccuauauaggaaagaaugggcaaaauuagcugaacacagagacgauuucauugaaagcgaucugguuacucaagcauccacgcuccagcaauugauaaaauuuaugcacgccgaccccuccaacgucaaccucaaauucggaaauuuuaaaggcaacagauucgguagaaaaaacggcaacaucaaacuaaguaaaaccgacuucauauaugaaucaccuacaggccuguucaaaucgauuaaacacaucgacuga

SEQ ID NO: 8813 - RNA, 4044 nt, Artificial Sequence
  Cas9 variant
augaaaucagaaaaaaaauauuauauaggacuagacguugggacuaauucaguaggaugggcuguaaccgaugaauucuauaauauuuuaagagcaaaagguaaagauuuauggggcguaagauuguuugagaaagccaaaacugcagcagacacucgaacauuucgaucaggacguagacgaaaugacagaaaagggaugagauuacaaauccuacgagaaauauuugaagacgaaauaaagaaaguugauaaagauuucuaugacagauuagacgaaucuaaauucugggcugaagacaaaaagguaucugguaaauauucauuauucaacgauaaaaacuucuccgacaaacaauacuuugaaaaauuccccacaauauuucaccuuagaaaauaucuaauggaggaacacggcaaaguagauaucagauauuauuuccuagccauaaaucagaugaugaaaagacgaggacacuuccuuauagauggacaaauuagucauguaacagacgauaaacccuuaaaagaacaacuaaucuuacugaucaaugaccuacucaaaauugaauuagaggaagaauuaauggacucaauauuugagauacuagcagauguuaacgaaaagaggacagauaaaaagaauaauuugaaagaacugaucaaaggucaagauuuuaauaaacaagagggcaauauacucaauuccaucuucgaauccauaguaacuggcaaagcgaaaauuaaaaacaucauaucagaugaagacauccuagaaaaaauaaaagaagacaacaaagaagacuucguucuaacaggagacucauacgaagaaaacuuacaauauuucgaagaaguuuuacaagaaaacauaacucuuuuuaacacacuaaaaaguacauacgacuucguaauuuugcaaaguauacuaaaggguaaaucuacacuaucagaugcucaagucgaaagauacgacgaacauaagaaagaccuugaaauacuaaaaaaaguaaucaaaaaauacgaugaggauggaaaguuauuuaaacaaguauucaaagaagacaauggaaacgguuaugucucuuauauaggauauuacuuaaacaaaaacaaaaagauaacagcuaaaaaaaagauaucaaacauugaauucacuaaguacguaaaaggaauacucgaaaaacaaugcgacugugaagacgaagcaguaaaauaccuacucggcaaaauagaacaagaaaacuuuuuacuaaagcaaauaagcucaaucaauuccguuauaccccaucaaauacacuuauucgaacucgauaaaaucuuagaaaauuuggcaaaaaacuauccaucguucaauaauaaaaaagaagaauucacaaaaauagaaaagaucagaaaaacauuuacuuuccgaaucccuuacuacgucgguccccugaaugauuaucauaaaaacaacggaggaaaugcauggauauucagaaauaaaggugaaaaaauccgaccauggaauuuugaaaaaauuguugaccuacauaagucagaggaagaauuuauuaaaagaaugcucaaccaauguacauauuuaccugaagaaacgguauuaccgaaauccagcauucuauauucagaguacaugguacugaaugaacuaaacaacuugcgcauaaagggaaagccacucgacacagacguaaagcuuaaacucauagaagaacuauuuaagaaaaaaacaaaaguaacucugaaaucaauaagagauuauaugauacgaaauaacuucgccgacaaagaagacuucgacaauuccgaaaaaaaccuagaaauaguuagcaauaugaaaucauauaucgauuucaauaacauacucggagacaaauuugaacuggaaaugguugaagaucugauagaaaaaauaacaauacacaccggaaauaaaacccugcucaaaaaguauauagaggaaaccuaccccgaucuuucuucaagccagauacaaaaaaucaucaaucucaaauacaaagauuggggaagguuaucucgaaaauuauuagaugggauaaagggcagaaauaaaacugaugaugucaacaccguaauuaacuucaugcguaacuccagcgauaaucucaugcagauaauagaaggaaaaaauuacaguuucaacgaauacauagacaacuugagaaagaaauauauaccacaagaaauaucauaugaaguugucgagaaccucuaugugucgccauccguaaaaaaaaugauuuggcaaguaauaagaguuacagaggaaauaaccaaaguaauggguuacgacccagacaaaauauucaucgaaauggcaaaaucagaagaagaaaaaaagacgacgauaucacgcaaaaauaaauuauuagaccucuauaaagcaauaaaaaaagacgaacgagauagccaauaugaaaaacugcuaaccggacucaauaaauuagaugagagcgaacucagaucaaagaaacuauaucuuuacuauacgcaaaugggaagagacauguauacaggcgaaaagauugaccuugacaagcuauucgacaguacacauuacgacaaagaccacauaaucccucaaucaaugaagaaagacgauucaaucauaaacaaccuaguacucgucaacaaaaaugccaaccaaacaacaaaaggcaauaucuacccaguaccuagcuccauacgaaacaacccagauauauacaacuauuggaaauaucuaauggaaaaagaauucaucagcaaggaaaaauauaaucgauuaauuaggaacacaccauugacgaacgaagaacucggcgucuuuauaaauagacaacuuguggaaacacgccagagcacaaaagcaauaaaagaguuauucgaaaaauucuaccagaaaagcaaaauaaucccaguaaaagcaucauuagcuagcgacuuaagaaaagauaugaauacacuaaaaucacgcgaagucaaugacuuacaccacgcacacgacgcauuucuaaacauaguggcaggugauguauggaaccgagaauuuacuagcaauccuauaaauuacguuaacgaaaaccgugaaggagacaagguaaaauauagccuaucuaaauauuucacgcgcccaagaaagagcaaagguaaaguaauauggacaccagaaaagggaagaaaacuuauuguugacacccucaauaaacccucaguccuaauaucaaacgaaucccauguaaaaaaaggagaauuauucaacgcuacaauauccggcaaaaaagacuacaaaaaggggaaaauauacuuaccucuuaaaaaagaugaucggcuaaaagacgucuccaaauacgguggauacaaagccauaaauggggcauucuuuuuccuaguagaacacaccaaaagcaaaaaaaggauuaggaguauugagcuauucccacuacaucuuuuaagcaaguucuaugaagacaaaaacacuguuuuagauuaugccauaaacgucuuacagcuacaagauccaaaaauaauaauagacaaaauaaacuauaggacagaaauaauaauagauaacuuuuccuaucuuaucucuaccaaaaguaacgacggaaguauaacugucaagccaaaugaacagauguacuggcgaguugacgaaauaagcaacuuaaaaaaaaucgaaaacaaauacaaaaaagaugcaauacucacagaggaagacaggaaaauaauggaaucauacauagauaaaaucuaccaacaauuuaaagcuggaaaauauaaaaaucgucgaacuacugacacaauaauagagaaauacgaaauaauagaccuagacacacuagacaauaagcaauuguaucagcuacuuguagcuuuuauaucacuauccuacaaaacaucuaacaacgccguagauuucacaguaauaggucuagggacagaauguggaaaaccaaggaucacaaaucucccugauaauacauacuuaguauauaaaucaauaacaggaauauacgagaaaagaauaagaaucaaauga

SEQ ID NO: 8814 - RNA, 4047 nt, Artificial Sequence
  Cas9 variant
augaagaaacccuacacaauugcacuagacauaggaacaaauucaguuggauggguaguaguaacagaugauuaccgaguuccaacaaagaaaaugaaaguucuugguaauacagaaagaaaaaccaucaaaaagaauuuaauaggcgcgcuacucuuugauuccggagacacagccgaaggaacucgacuuaaacgcacagcacgacguagauauacaagacgaaagaaccgauuaagauaucucaaagaaauuuucacagaagaaauggcuaaaguagaugauggauuuuuccaaaggcuagaggauagcuucuacguauuagaagauaaagaagguaacaaacauccaauuuucgcaaaccuggcugaugagguugcauaucacaagaaauacccaacaauuuaucaucuacguaaagaguuagucgacaacccucaaaaagcugacuuaagauuaauauaucuugcagucgcacauauaauaaaauuccgaggucauuuucucauagaaggcacacuaucaucgaaaaauaauaaccuacaaaagagcuuugaccauuuaguagacaccuacaaccuauuauucgaagaacaacgacuucuaacagaagguauaaacgcuaaagaacuccuuagcgcagcacuaaguaaaucaaaaaggcuagaaaaucucaucucuuuaauccccggacaaaagaaaaccggaaucuuuggaaauaucauagcacucucccuuggcuuaacacccaauuucaaagccaacuucggauuaucaaaagacgugaaacuccaacuugcaaaagacacauacgcagaugauuuagacucacuacuagcacagauaggggaccaauacgcugauuuauuucucgcagcuaaaaacuuauccgaugcaauauuacugucagauauacuuacagaaucggaugaaauuacaagagcgccauuauccgcaagcaugguaaaacgauacagggagcaucacaaagaucuagucacauuaaaaacuuuaauuaaagaucaauuacccgaaaaauaucaggaaauauuucuagauaaaacuaaaaauggauaugcagguuacauugaaggccaaguaucacaagaagaguucuauaaauauuuaaaaccuauauuagcuagauuagauggaucugaaccuuuauuauugaaaauagacagagaagauuuccuacgaaaacaacgaacauucgacaacggaucaauuccucaucaaauacaucuagaggaacuacaugcuauauuacgcagacaagaaguauucuacccuuuccuaaaagauaaucgaaagaaaauagaaaguuugcuaacuuuccgcauucccuacuacguaggaccauuagcacgaggccacagcagauucgcauggguuaaaagaaaauuugacggcgccauaagaccauggaauuucgaggaaauaguagacgaagaagccagcgcccaaaucuucauagagaaaaugacuaaaaacgaucuauaucuacccaaugaaaaaguccuuccuaaacacagucuucuguaugaaacuuuuacugucuacaaugaacucacaaaaguaaaauaugcaaccgaaggaaugacacgaccacaauuuuuaucagcagaccaaaagcaagccauugucgaucuucuguuuaaaacaaauagaaaaguaacaguaaaacaauuaaaagaaaacuacuucaagaaaauugaauguugggauagcguugaaauuacaggcguagaagauagcuuuaacgcauccuuaggcaccuaccacgaucuacuaaaaauaauucaagauaaagacuuucuagauaaccccgauaaccagaaaaucauugaagacauaauacuuacguugacuuuauucgaagacaagaaaaugauaaguaaaagacuagaccaauacgcacacuuauuugacaaagugguucuuaauaaguuggaacgacaucauuauacagguuggggcagauuaucagguaaacuuaucaaugguauacgagacaaacaaucaggcaaaacgauauuagacuuuuuaaaagcagauggcuuugcaaacaggaacuucaugcaauuaauccacgauucagaguuaaguuucaucgacgaaauagcaaaagcacaaguaaucgguaaaacugaauacagcaaagaccuugugggaaauuuagcggguucaccagcaauaaagaaagggauaucgcaaacuauuaaaauaguagaugagcuagugaaaauaaugggauacuuaccacaacaaauagugauagaaauggcacgagaaaaccaaacaacagcacaaggaauuaaaaaugcgaggcaacgaaugagaaaauuagaagaaacagccaagaaacuaggcucuaacauauuaaaagaacauccaguagacaacucucaauuacaaaaugacaaaagauaucuuuacuauuuacaaaacggaaaagacauguacaccggcgacgaucuggauauagacuaccuaagcuccuacgacauagaucacaucauaccccaaucauucauuaaaaacaacagcauagauaacaagguguuaacgucucaaggagcuaacagaggaaaauuggauaacguacccucugaagccauuguuagaaaaaugaaaggauacuggcaaagccuacuacgagccggagcaauaucaaaacaaaaauuugacaaucuuacaaaagccgaaagaggcggauuaacucagguagacaaagccggauuuauacaaagacagcuaguagaaacuagacaaauuacaaaacauguugcucaaaucuuagacucacguuuuaacacagaauuugacgaccacaacaagagaaucagaaaagugcacauaaucacauuaaaaucaaaauuaguauccgacuuuagaaaagaauuuggacuuuauaaaauaagagauauuaaccacuaucaccaugcccacgacgccuaucucaaugcagucguagcuaaagccauauuaggaaaauacccccaacucgcuccugaauuuguauauggcgauuaucccaaauacaacucauucaaagaaagacaaaaagcaacccagaaaaugcuauuuuacuccaacauucuaaaguucuuuaaagaccaagaaagccuucauguuaacagcgauggugaggaaauauggaacgcaaacaaacaucuaccaauuauuaaaaauguacuuagcaucccccaaguuaacaucguaaagaaaacagaaguucaaacuggaggguuuuauaaagaaucaauauuaucuaaaggaaauagugauaaauuaauaccacgcaaaaacaacugggacacaagaaaauauggaggcuuugacucaccaacaguagcauauagcguccuuguaauagcaaaaauggagaaagggaaggccaagguacuaaaaccuguaaaagaaaugguuggaaucacaaucauggaaagaacagccuuugaggaaaacccaguuguuuuccucgaagcaagagguuauagagaaauacaagaacaucuaauaauaaaauuacccaaauauaguuuauuugaauuggaaaauggaagaaggagauuacuagccuccgcaagcgaauuacaaaaagguaacgaacuauuccuaccaguagacuauaugacuuucuuauacuuagcggcucauuaccaugagcuaacaggcucaucugaagacguauuacgcaagaaauacuuuguagaccgucacuuacacuauuuugaugacauaauccaaaugauaaacgacuucgcugaacggcauaucuuagcaaguucaaaucucgagaaaaucaaccacacuuaccauaauaacucggaccuaccaguaaacgaacgagccgaaaacauaauaaauguauucacauucguagcacucggcgcacccgcagcauucaaauucuuugaugcaaccauugacagaaaaagauacacaagcaccaaagaaguauuaaacgcuacccuaauccaccaguccguuacaggacuauacgaaacacgaaucgaucucucucaauuaggugaaaacuga

SEQ ID NO: 8815 - RNA, 4047 nt, Artificial Sequence
  Cas9 variant
augaaaucagaaaaaaaguacuauauaggucucgacguaggaacgaacucaguaggcugggcuguaaccgacgaguucuacaauauauuaagagcaaaaggcaaagaucuuugggggguacgccucuuugagaaagcaaaaacagcagcugacacacgcacauuuagaagcggaagacgaagaaacgaucgcaaaggagugagacuacaaauacuacgugaaauauucgaagacgagauuaaaaaagucgacaaagacuuuuacgaccgacuagacgaaaguaaauucugggccgaggacaaaaaagugucagguaaguacagccucuucaacgacaaaaacuuuuccgacaaacaauauuucgaaaaauucccaacuauauuucaucuccgaaaauaccuaauggaggaacauggaaaaguagauauaagauacuauuuccuagcaauaaaccaaaugaugaaacgaagaggacacuuucuaauagacggacaaauuucccacgugacagacgacaaaccccucaaacaacaacuuauacuccuuauuaaugaccuacuaaaaauagaacuugaagaagaguuuauggacucuauauucgaaauacuagcggauguuaaugaaaagaaaacugaaaaaaaaaacauccuaaaagaauuaauaaacgcacaagacuucaacaagcaagaaggaaagauacuauauuccauauucgaauccauaguuacagguaaagcaaaaaucaagaacauaauaucagacgaagauauucucgaaaaaauaaaagaggacaacaaagaagacuucguucucaccggcgacucauaugaagaaaaccuacaauauuucgaagaagucuuacaagaaaauauaacauuauuuaacacgcuaaaaagcgccuacgacuuugugauacuacaaaguauacuaaaaggcaaaucaacucuuuccgaugcacaagucgaaagauacgaugaacacaaaaaagaccucgaaauuuuaaaaaaaguuauuaaaaaauaugaugaagacggaaaguuauucaaacaagucuucaaagaagacaauggcaacggguauguaucguauauaggauauuaccuaaauaaaaacaaaaaaauuacagcuaaaaaaaaaauuucgaauaucgaauuuacuaaauauguaaaaggaaucuuagaaaaacaaugcgacugcgaagacgaagacgucaaauaccugcuaggaaaaaucgagcaagaaaacuuccuauuaaaacaaauaucgucaauuaauucggucauaccacaucaaauucaccucuucgaauuagauaagauuuuagaaaauuuagccaaauauuauccaucauucaauaauaaaaaagaggaauuuacaaaaauagagaagauucgaaaaaccuuuacauucagaauaccauauuacgucggaccccuaaacgacuaucauaaaaacaauggcggcaaugcuuggauauucagaaacaaaggugaaaaaauucggcccuggaacuucgaaaaaaucguagacuuacauaaaucagaagaagaauuuauuaaacguauguuaaaccaaugcaccuaccucccggaagagaccguacuaccaaaaaguuccauacucuacuccgaauacaugguauuaaaugaacuaaacaauuuacgaauaaacggaaaaccaauagacacagacguuaaauuaaaguuaauugaagaacuauuuaagaaaaaaacaaaagucacacuaaaauccauacgagacuacaugaucagaaauaacuuugccgauaaggaagauuucgauaauucggaaaaaaaccuugaaauuguaucuaacaugaaaaguuauauugacuucaacaacauacucggagauaaauuugaauuagaaaugguagaggaccugauagaaaagauaacaauacacacagggaauaagaagcuauuaaaaaaauacauagaggaaaccuacccagaccucaguuccucccagauacaaaaaauaauuaaccuaaaauauaaagauuggggacgacuaucacgaaagcuacucgauggaauaacaggaacuaacauugagacuggagaaauagacaccguuauaaauuuuuuaagaaauagcuccgacaaccuaaugcagaucauagguagucagaacuacucauucaauaacgacauagauaaauuaagaaaaaaauacaucccacaggaaauaaguuacgaaguaguagaaaaccuauauguaagucccagcguaaaaaaaaugauauggcaaguaauaagaauaaccgaggaaauaaccaaagucaugggcuacgauccagacaaaauuuuuauagaaauggcaaaaagcgaggagggaaaaaaaaccacaaucucaagaaaaaacaagcuccuggcauuauauaaggcuaucaaaaaagaugaacgcgacagccaauacgaaaaauuauugacaggccuaaacaaauuagacgacagugauuuaagaucaaggaaauuguacuuauacuacacacaaauggguagagacauguacacaggagaaaaaauugaucuagauaaacuauucgacagcacccauuacgauaaagaccauaucaucccucaaagcaugaaaaaagacgacagcauaauaaacaaucuaguacuaguuaacaaaaacgcgaaucaaaccacgaaaggaaacauuuauccaguuccaucauccauacguaauaacccgaaaauauauaacuacuggaaauaccugauggaaaaagaauucaucucaaaagaaaaauacaacagauuaauacgaaauaccccacuaaccaacgaagaacucggaggauucauaaaccgucaacuaguagaaaccagacaaucaacuaaggcaauaaaagaauuauucgaaaaauucuauaaaaaaagcaaaauaauaccaguaaaagcuauauuagcgagugaccuaagaaaggacaugaacacucucaaaucgagagaagucaacgauuuacaccacgcacaugacgcuuuccuaaauaucguugcaggcgaugucuggaaucgcgaauucacuaguaacccgauaaacuacguaaaggaaaacagggaaggcgacaaaguaaaauacagucuaucaaaauauuucacacguccacgcaaaucaaaaggcaaaguuauauggacaccagaaaaaggccguaaauuaauaguugacacauuaaacaaaccuaguguacucauaaguaaugaaucacaugugaaaaaaggagaauuauucaacgcuaccauagccggcaaaaaagauuacaagaagggaaaaauauaccuaccacuaaaaaaagacgacagacuacaagacgucagcaaauacggcggcuauaaagcaauaaauggagcauucuucuuccuaguagaacacacuaaaucaaagaaacgaauaagaaguauagaacucuuuccacuccaucuccuuaguaaauucuaugaagacaaaaacacaguauuagauuaugcaaucaacguccuucaauuacaagacccuaaaauaaucauagauaaaauaaauuauagaacagaaauaauaauagauaauuucucguauuuaauaagcacuaaaucaaacgacggaucaauaacuguaaaacccaaugaacaaauguacuggagaguagacgagauauccaaucuuaaaaaaauagaaaauaaauacaagaaagaugcuauacuaacggaagaagaucggaaaauaauggagucuuacauagauaaaauuuaucaacaauucaaggcaggcaaauauaaaaacagacgaacaacagauaccauaauagaaaaauacgaaauaaucgacuuagacacgcucgacaacaaacaauuauaucaauuacucguugcuuucaucucacucucauauaaaacaaguaacaacgcaguggauuuuacuguaaucggccucggaacagagugugguaaaccaagaauaacaaaccuaccagacaauacguaccuugucuacaaaucgaucacaggaauauaugaaaaacggaucagaauaaaauga

SEQ ID NO: 8816 - RNA, 4047 nt, Artificial Sequence
  Cas9 variant
augaaaucugaaaaaaaauauuacauaggcuuagaugugggaacuaacucugugggaugggcagucaccgacgaauucuauaauauauugagagcaaaaggaaaagacuuauggggagucagauuauucgaaaaagcggacacugcagcaaauacacgaauauucagaucagggagaagacgaaaugaucgaaaaggaaugagacuccaaauuuuaagagaaauauucgaagacgaaaucaaaaaaguagacaaagauuucuaugaucgacuugacgaaaguaaauucugggcagaagacaaaaagguuaguggcaaauauucacuguuuaacgacaaaaacuuuucagauaaacaauacuuugagaaguucccaaccauauuccaccuacgcaaauauuuaauggaagaacacgguaaaguagauauacgauauuacuuuuuagcuaucaaucaaaugaugaaaagaaggggccacuuccuaaucgacggacaaauaucacacgucacagaugauaaaccacuaaaagaacaacuaauauuacuuauuaacgaccuacuaaaaauagaauuagaagaggaauuaauggacucaaucuuugaaauucuagcagacguaaacgaaaaaagaacugauaaaaaaaacaaccuaaaagagcucaucaaaggccaagacuuuaacaaacaagaaggaaacauauuaaauuccauauucgaaagcauaguaaccggaaaagccaaaaucaaaaauauaaucucagaugaagauauacuugaaaaaauaaaagaagauaauaaagaggacuucguacuuacaggagacagcuacgaggaaaauuuacaauacuucgaggagguucuccaagaaaauauaacguuauuuaacacuuuaaaaucuacauaugauuuucuaauacugcaaucaauacuaaaaggaaaauccacauuaagugacgcacaaguugagcgauaugacgaacacaagaaagaccucgagauccugaagaagguuauuaagaaauaugaugaagacggcaaacuauuuaaacagguauucaaagaagauaauggcaacggauacguaucuuacaucggauauuaccuuaacaaaaacaaaaagauaacagcaaaaaaaaaaauaucuaauauagaauucaccaaauacguuaaaggaauacuagaaaaacaaugcgacugcgaagaugaagacguaaaauaucuacuaggcaaaauugaacaagaaaauuuucugcucaaacaaaucucaucaauaaacucuguaauuccacaccaaauacacuuauucgaacucgacaaaauucuagaaaacuuagcuaagaacuacccaaguuuuaauaacaaaaaagaagaauucaccaaaauagaaaaaauacgaaaaacauuuaccuucagaauuccuuacuacguaggcccccuaaacgacuaucauaaaaacaacgggggcaacgccuggauauucagaaacaagggcgaaaaaaucaggccauggaacuucgaaaaaauagucgaucugcacaagucagaagaagaauucaucaaaagaaugcucaaccaauguacauauuuaccagaagaaacaguauuacccaaaucaucaauauuauacucggaauauauggucuuaaacgaauuaaacaaucuaaggauaaacggaaaaccauuagacacugacguaaaacucaaacucauugaggaacuauuuaaaaagaaaacuaaaguaacacuaaaaucuauaagagacuauaugguaagaaacaacuuugcugacaaagaagacuucgacaauucagaaaaaaauuuagagauagcauccaacaugaaaucauacaucgacuucaauaacauacuagaagacaaauucgauguagaaaugguugaagaccucauugagaaaaucaccauacacacaggaaauaagaaacuucuaaaaaaauacaucgaagagacauacccggauuuaucaaguucccaaauucaaaaaauaauaaaccuaaaauacaaagauuggggcagacugagccgcaaacuauuggacgguauaaaggguacuaaaaaagaaacugaaaagacagauacaguaaucaauuucuuaagaaauucaucugauaauuuaaugcaaauaauugguucacaaaacuauagcuucaaugaguauauagauaaacugcgcaaaaaauauauaccacaagagauaaguuaugaaguagucgagaaccuauaugucagcccgagcguaaaaaagaugauuuggcaaguuauacgagugacagaagaaauaacaaaaguaaugggauacgauccagacaaaauuuucauagagauggccaaaucggaagaggaaaaaaaaaccacaauaucgaggaagaacaaacugcuagaccuauauaaagcaauaaagaaggacgaaagggacagccaauacgaaaaacugcuaacagggcucaacaaacuagaugacucagaucuccgauccaggaagcuauaccuauacuacacacaaaugggcagagacauguacacaggcgagaaaauagaccucgauaaguuauucgauagcacacacuacgacaaggaucacaucauuccccaaucaaugaagaaagacgacucaauaauaaauaacuuaguacuagucaacaaaaaugcaaaccaaacaaccaaaggaaauauauauccagugccauccucgaucagaaacaacccaaaaaucuauaauuacuggaaguaccucauggaaaaggaauuuaucucaaaggagaaauacaacagacucauaagaaacacaccccuaacuaacgaggaacuaggaggauucauaaaccgccaacuuguagaaacacgacaaagcacaaaagccauaaaagaacuauuugaaaaauucuaucaaaaaaguaagauuauaccaguaaaggccucccucgcuucagaccucagaaaagacaugaacacacucaaaagcagggaaguaaaugacuugcaccaugcacacgacgcauuuuugaacauaguagcuggagauguauggaauagagaauuuacgucaaauccaauaaauuacguaaaagaaaaccgagaaggugauaaaguaaaauacucgcuuucuaaagacuucacacgaccacguaaaagcaaaggaaagguaaucuggacacccgaaaaagggagaaaacuaaucguagauaccuuaaacaagccaucaguacucauaucaaaugaaagucauguaaagaaaggggaauuguucaacgcaacaauagcagguaaaaaagacuauaaaaaaggcaaaauauaucuacccuuaaaaaaagacgacagauuacaagauguuucuaaauacggagguuauaaagcuauaaauggggccuuuuucuuccuaguugaacauacaaaaucaaaaaaaagaauuagaucaauagaguuauucccucuacaccucuuaucaaaauucuaugaagauaaaaauacaguacucgacuaugcaauaaauguacuucaacuucaagaucccaaaaucauaauugacaaaaucaacuauagaacagaaauuauaaucgacaacuuuagcuaccuaaucucaacuaaaagcaaugacggcaguauaacuguuaaaccaaacgaacaaauguacuggcgaguagacgagauuagcaacuugaagaaaauagaaaacaaauauaagaaagacgccauacugacagaagaagacaggaaaauuauggagucuuacauagacaaaauauaccaacaauuuaaagcaggaaaauacaaaaaccgaagaacaaccgacacaauuauagagaaauacgaaauaauugacuuagauacccuagacaacaaacaauuauaucaacuccucguugcauucaucucauuaucauacaaaaccagcaauaacgcaguagauuuuaccgucauaggauuagggaccgaguguggcaagccaagaaucacaaaucuaccagacaacacuuauuuaguauauaaauccaucaccggaaucuacgaaaaaagaauaagaauaaaauga

SEQ ID NO: 8817 - RNA, 4047 nt, Artificial Sequence
  Cas9 variant
auggaaaagaauuauuaucucggacuagaccuuggaucgaauagcguagggugggccgcgacagacgaagauuauaacuuccuccgauuaaaagguaagacagcauggggugccagaauuuucagcgaagcuaaagacugcaaagaacgaagaacuuacagaucuaacaaacgacgccuagccaggcgcaaguacagacuaguauuacuaaaacaguuauuugcagaagaaaugacuaaaguagauaagacuuucuuuuugagauuagccaauucaacauauugggaagaagauaaaacgaaagacuccgaugggaaugaaauaggaaaaaaucuaaucuucaaaacacaugaagaagaaaaacaauacuauacuaaauauccaacaauauggcaucuucgaaaagcucuaauagaaaacgacgaagaagcacugucaaaucucagauacguauaucuagcgauacaucacauugucaaauauagaggaaauuucuuaacagagggcgaaaugggcaacgauauacccccaauaacgaccauagaagaaauaaaccaaacacuaucucuccuggaaguagauagcagcgaagaugcaacugacaaaacuacuuacauaaaacccgaauccuacaacgaauuauuuacaauccucgaaaacaacaaccuaaacaaaguaaaaaaacagcaagaaauagauaaauuauuuauaagcuccaaagaaagaucagaaaacauaaaaaauuacaucaauuuauucaaaacaauaauagucggaggcucauucuccuugaaaaaaaucaacgaagacacagaagacauuucaguggauuuuacaaaagacuuugaaaacucagaagccgacauauccaaagcacuaggagauucguucaaccuaguguuaauagccaaaaaauauuaugauuauauuauacuaaaagaacuauuaggaaaaaauaaagaaauauccgaagcaaugguacaaauauacgaggaacacaaagacgacuuaaaauccuuaaaaaccauacuuaaagaccuugacaauaaacucggaaaugauggcaaagaucgaauuuacuacuccguguucaagcaagaaccgacagaaaaauuuaaagaaacaaacuauuuaagcuuuguacaaggcgggaaacuagaggaacuaaacaaguacauaaaaaaaauacuugaaaacaaugagaaagacauugaugacaaggagacauacaacgcauuauaugaaaaagccuguaaaggcgacuuauucaaaaaacaagccaacgcauguacaagucugaucccacaucaauuucaucuccgcgaacuaaaaaagauccucgaaaaugccggaaggaaauacuccuuucuaaaugauaucagcgauaaaauaauaaaaauauucaaauuuagaguuccuuacuacuauggcccacuaaacaacgagucuaaugcacacucauggguggucaaaaaagagggucaagaaaaagcaaaaauaacaccauggaacauaaacgaaaucaucgacacccccaaaacucgcgauaacuucuuuaaaaaacuaacaaauucauguacauaccuaguaggggaaacuguauuaccaaaaacaucccuauacuacgaaaaauaucuaguauuagaucgacucaacaaaaugcagguaaauggagacuaccuaagcgcaagcgaaaaaaacgacgucuuaaaauuuauccuuucucgaaagacuacaaccauagaacaaaucagaaccuauuuaucaaaaaauaaaucuacuaaagcuaacgacauuucuaucuccaauauaaaggccaccgaccccuuuaacgcuguaagccacgcauucuacggaaaacacccagaccucaacauaaacuuaugcgaggaacuaaucaaauucgcuaccaucuacgcugaugauaaaaaagaacuuaaaaaauuugucuccucgaauuucaaccuuacagacgaauucaucaaagaauaccuaaacacucccacuaauaaauggggacgauuaagcagaaaauuucucuguggcggcgaucaacucgaaauguauuacguagacgacaacggaauacuacauaguauccucaauauacuagaagaaacaaacgaaaauuuacaagaaauacuuaacaacgaaaaauacggcuuuaaucaaaagauagcagacuuuaauaacacacuaaccgcugacaaaacaacagaagaacaaauagaagacauucuagacuccacaccugcacuaaugaggcgaucaauaauacagacuuuagcaguaguagaugauguaauaaaagcagccggaaaagcaccgcaaaaaauaaugauggaaguuacccguacugauggcaaaaaagaagaaacaaaaucgcgauacguacaacugaaaaaacaaaucacaaacgacaagguucucacgucagacgaaaaaaaggaacucuuaacaaaccucgaaaacaaaaaaauccaacuaaagggcaaacacaucuaccucuacuuuaugcaaaugggaauagauuucuacacuggaaaaauaauggauauaaacgacguuauuaacggaaaauacgauauagaucacaucauuccccagucaaugaucaaagaugacaguuuagauaauaugguguuaguaucaaaagacuauaaccagaagguaaaaaaagauauauacccuauuugugaugaaauuagaaacaacauguuagauaaauggaagggcuauuacgcaagaaaaaucauuuccgaagaaaaauauaauagauuaaaaagaacaaaagaauuaaacgcugaugaaauaaacgccuucauuaauaggcaaaucaacguaguaaauuacucuaacauucaaaucaaacgcaucuuugaaauaaaauacccugaaacuaaaauaauauucucaaaagcuagcuuuccuagccuacuacgaaaagaguaugaaauugcaaaaaugcgagaccuuaacgaugcacaucacgcgguagacgcauaccucaacauagucugcggaaauaucuuaacaacacuuuacacagauauauuuuacauguucaaagaaaaaaaagaagaccacaaaaacaucucauucaacauggaaaaacgucucauaaauuacauugacaaaaacaaucuuaaagacaaaauaaaaacuucaugucuaaggcacgaugcauuaauaaccuacaaaccagauuacgauucugguaaauucuacaaagaaaccauauucaaaaaauccggagauaaagaaacaggcuuaauaccacugcauacaaaaggcccaaugagcgauacgaaaaaauauggaggcuacucucaauuaucacaaucauauaucauugcaguagaauauaaauuaaaaaacaaaacaguaaaaaaacuaugucgaguccccacgcuauaucucaaacaauauaagaacgauuuaaauaccaucgcaaaaaucaugauagacgacgaaaaagcaacugacauaaaaguccucaggaaaauauaccucaaucaaaaaaucagauacaacgggugcuauuaccuaauauauacgagcaaagaaaaacaaaacaaguacaaaauggccuaucaaaauuaucucgacaacgauuaucugaucuacuuaaauaagugucuaaaaaaaauagacgaacuugaugacggagaacucacaucccaagaauuuauuguuaacaaagacggagacaaauucuuaauagacaagaaccauaauuuagaaauauucaaaucaauaaaagaacaguacaauaaaacaauuuacgauuauacuccuuauaucguccaaucaagggaaaugaaagaagaagacuucaacaaccuuucacuaaaaaaacaaaucgauacacuauuaaacaugaucaaaauccuaaguagaagcaaugaacaagcuaaauuugaaacugcauucuuugaaaacuucacaaaaguuuuccucaaaacaaugacuauaacuaacgagaaaguuuacauagugaacgaaucaccaucaggauuauuuaaaggcaaggaagaauugauauga

SEQ ID NO: 8818 - RNA, 4047 nt, Artificial Sequence
  Cas9 variant
augaaaaaguucgaagacuauuaccuaggacuagacuuaggaaccucauccauaggcugggcaguuacgaacgaaaaauacgacauauuaagauucaauaaaaaauuuauguggggaacccauuuauucgacaugggaaauacagcaucugaacggagaauauucagaacaagcagacgucgacucaagaggaaaaaaaacagaauagaacuauuacagacucuauucucagcugagaugucaaaaaaagacuucgguuucuuccaaagguuaaaagaaucacaauacuucaucgaagauaaaaccuuuaaaaacaaaaauacgcuauucauggacgaaaacuacacagaccaagacuaucacauggaauauccaacaauauaucaccuccgaaaagcacuaaucgauaacgaagaaucagccuucgagaucagaaaauuauaucuggcaauaucacacauacuaucucaucguggacauuucuuauuugaaggagaauuaagcgauaauuuagauuuugacgacauuuuuaaugaauucguaaaauaucuaaaugaagaacucaacauagauuuuaaaauaaaaucagacguaagucuacaagccauuaaagaaauucuaacagauaaaauguuaaauagaacaaaaaaaaaagaaaagcuaagugaauuacuagaggaggaaaagaauaaaaucuaucaagagauauggaaacuacuggucggcaaugaggcaaagaugaguacaauauucgaugacaaagaauacgaagaagccaaaauagccuucaguaagggaaauuacgacgaaaaagaggaagaauaugaaagcauacuaggagaaaaaauucuuuucguacaaaaagcaaaagcaauauacgacuggauguuauuacaaaacauacucaaagaagacaaauaccuaucauauucaaaagucaaacuuuacaacgaacacaaaaaagaucuaaagauauuaaaagacguacugaaaaaccuugauaaaaaaauauacaaagagauauucucugaaaacggucuauacgaagaguaucuacgcauagaaaaaaaaaaaauaggaucuaaagaagaaaaaacaaaagauauccuuuacaacagacucaaaaaaauuuucgaaaacagagauaacauggcuauagaggacauucuuaacaaaaucgaacuagauaguuucuuacccaaacaaaaaauaaaagacaacggcguuauuccacgacaaguacaucaaaaagaacuagagaucauauuaaaaaacgcugaaaaauauuucaaauggcucauagaaaaagacgaaaccgggcuaucagucuccgaaaaaauuaugaaaauauucaaguucaaaauuccuuacuacguagggccauuaaacucaaaaucacccuucgcauggaucgaacgaaaggaauacggaaaaauucuacccuggaacuuugaaaacauggucgacaugagcaaaacugccgagaaauucauaaaaagaaugacuaauaaaugcacuuaccuaccagaaaaagacgucauacccaaaaacucacuucuguacacaaaauacaugguccugaaugaauuaaacaaucuaaagauacguggagaaaaaauaaaaguagaguuaaaacaaaaaaucuauacagaacuauuccaaaaaaauaaaaaaauagguaugaaaacacuaauagaauuucuaaaaucgcaaaauauuguagugacaaaaguggaaaucaccggaaucgacggaaccuucaacacuucccuaggauccuauauagacaugaaaaaaauauucggagaagaaaaaauagucaaagacuccuacaaaaaaaugauagaagauaucauauuauggauaacucuauacggggaagaaaaaaaacucauaaaaucaaagauagaagaaaaauaccccgaaaaaguaacaccggaagaaaugaaauuaauacuaaaacuaaaauacagagauuggaguagauuaagcaaagaguucuuaacugaaauugaaacaauggacgaagagacaggcgaacucauaucaaucaucgaaaugcuauggagaaaaaacgaaaacaucauggaguuacuuucauauaaauacgauuuuucaaacaggauaaaagaauacaacggaaucaacgaaaaggaaaaaaacauaacauaugaagaccuagucaaagaccuccaaaucucaccauccgucaaaaaaaugaucuggagagcuuuagugauaguaaaagaaaucaaaaaaguuacgaauaaguccccaaaaaaagucuucauugaaauggcacgggacacucaaacugagaaaaaaagaaccgaaaaacgcaaagacaaacuuuuagaguuauauaaaaacauaaaaaacgacgauagcaucaaagagcuagagaagaauuuaaaagacaagacaaacgacgaucucaaaucuaaaaaauuguauuuauacuaucuccaacuaggucgauguauguacuccggagaaguaauuagacuagaagacuugaugaacgacaaucuauaugacauagaucauauauauccacaaucaaaaauaaaagacgacucauucgacaauacaguacucgucaaaaaacaaauaaacgccgacaaaaccaacgaauacccaauagauaaaaguauacagaacaagugcaaagcauucuggacgucccuaaaagaacgaggcuuaaugagcaacacuaaauacgaacgauuaacaagaacugagggcuucucagaugacgaauuagcgggauuuauaagucgacagauaguugaaacgcgacaagcaacuaaaguccuagcagacuuacuaaaagucaucuucggcuccgauacuagaauaguguacguaaaagcaggacugacaucagacuucagacaaaaauucgguauauacaaauucagagaacuaaacgacuaccaucaugcacaugacggauaccucaauauaguuacaggaaacauauacaacacucuauuuacagacaacccguauaauuucauaaaagacagaaagaaagauaacagaacuuacaaucucaacaaaguauucgaacgagagaaugacguauggaauccggacguaaugcucagcaaaaucgagagguauauauauaaaauuagaccacuuuuuaccagagcaagcuacgaacaaaaaggcggauuuagugaucaaaacauauccuccgaaaaggacaaacuacgaccauuaaaaucaagugguguacuaucaaauauaaaauauggaggauaugacaaaauaaaaaacaguuauuucuuuauagucgaguauacagaaaaaaaaaaaagaguuagaucuaucgaaacacugcccauauacaucaagaaaucaauuaguacgaaagaagacuuagaaaaauauuguaaagaagaacucaaacuucaagaaccuaaaguccucguaucaaagcuaaauuacaaauccuuaauuuacucuaauggccacgaauauuauauaaacaguaaaacggccgacuccaucacuauacaaaacggaauacaaauuauucugacaaaagaaaacuacgaaaccuaccgaaaaauauacaagaaucuagaauaucucaaacucauauauaaagacgaaaaaauuagagaagaaaaaauacuugagaaaauucccaaaauacugaaaaacaacaaaaaugauagagaucuaagugaagacgaaauaagcgaaaaauucuggaaacucuacaaagaaauauuugaaaaaauaaaaauagguauauucucuaaauuuaaaagcacacuaccuauauauauagaagauugcaaaaaacuaaaagauuucaccacacucaauaauuacgcaaagagccgguucauacaagaaauuuuaaaaugccugaauucccaacaaggagaauuugacacaaaauauacacacaauuauucaaaaaaauacaacacaaaacuauccaaaucgaaaauacuggaaaaugauuucuauauuauaaaccaaagcccgacaggguuauucgaaaaaaaaguauuucuagacaaauga

SEQ ID NO: 8819 - RNA, 4047 nt, Artificial Sequence
  Cas9 variant
augggagaagauggaaaaccauuaagaguaaaaggaaaaaccgcaauaggagcucgucuauuucaggaagguaaucccgcugcagauaggagaauguuuagaacaacucgaagaagauuaaaucgaagaaaauggagacuaaaacuacucgaugaaauauuugauccauauauaacuccgguagacucaacauuuuucgcccgucuaaaacaaucaaacuuaucaccaaaagacucucgaaaagaauuuaaaggaucuauguuauuuccagaucuuacagauaaacaguaucauuuagacuacccuaccaucuaccaccuccgacacgcauuaaugacacaggacaaacaauucgacauaagaaugguuuaucuagcaauccaccacauugucaaauacagagggaacuuucucaauucgacaccugucgacaguuuuaaagcaucaaaagucaacuucgacgaccaauucaagaaacucaaugaauuguacacagcaauaaaccccgaagaauccuuucaaauuaacuuagcaaacucagaaaagaucggacaacaauuucuagacccaucuauaagaaaauuugauaaaaaaaaacagauaccuaagauaguaccaguaacaauggaugacaaagcgguggauaaauuaaacggaaaaauagccagcgaaauaaucaaugcaauauuaggauacaaaucaaaacuugauguagcaguacaaugugauccugaagauucaaauccuugggcaguaaaauuugaugaugaagacauugaugcaaaacuucaaaaaaucuuaccggaaauggaugaaaaccaacaaucaauaaucggcaucauucaagauuuauacucccaaguaacacuuaaccaaauaguaccaaauggcaugaguuuaagugaauccaugauuaaaaaauacaaugaucaccacgaucauuuaaaauuauacaaaaaauuaauaggccaaaucagcgacagcaaaaaaaaaaccgcauuaaaaaaagcauacgaucaauacguaggaaaugauggaaaaguuaucgaacaagaugauuuuuacucaucaguaaagaaaaauuuagacgacuccgaacuuuccaaacaaauaauggaccuuauugacgcagauaaguucaugccaaaacaacgaacgucucaaaacggugucaucccgcaucaacuacaucagcgagaacucgacgaaaucauagaacaccagagcaaauacuacccaugguuagccgaauccaacccaaacaagcaugaccugcaucuagccaaauauaagauugaagaacucguugcauuccgaaucccauacuacguaggaccaaugauaaccccagaagaucaaaaaaaaagcggagcagcaguauucucauggaugaagcgaaaagaaccaggacaaauuacaccauggaauuuugaugaaaaaguagaucguauggaaucugccaacaaauuuauaaaaagaaugacaacaaaagacacuuaccuaaucggagaagacguacuaccugaugaaucacuauuauaugaaaaauucaaaguacuaaacgaauuaaacaugguuagagucaauggggauagucuaaaaguggccgacaaacaagcaauuuaucaagauuuguucgaaaauuauaagcacauuuccguaaaaaaauuacaaaauuauauaaaaggaaaaacuggucuaccaaauaaccccgagauuucgggacucucugacccagaccaauucaacaauucauuaggaacauauaaugacuuuaaaaaacucuucggcgauaaaguugaugaucccgaccuacaaaaugacuucgaaaagauuguagaauggucaaccguauuugaagauaagaagauacuaagagcaaaauuaaaugagauaacaugguuaacagauaaacaaaaagacgaccuugaaucaucgcgauaccaggguugggggagacuaucaaaaaaacuacucacaggaaucguaaacgaccaaggggaaagaauaauagacgaacuauggaacacaaauaagaauuucaugcaaauacaaucagaugacgauuucgccaaaagaauccaugaagcaaaugccgaucaaaugaaaucaacaaauauggaagacguucuugcagaugccuauacauccccccaaaauaaaaaagcaauccgacaaguagucaaagucguagacgacauucagaaagcuaugggcgggguagcuccaaaauuuauauccauugaauucacuagauccgaagacaggaacccuagacgcacgauaagcagacagagacaacuagaaaacacauuaaaagauaccgcaaaaucauuaguaaaaucuaugaauccaaauauccucucagaacuagacaacgccaguagaagcaaaaaaggacucacagauagauuauacuuauauuucacacaguuaggaaaagauauguauaccggagaaccuauaaacauagaugaaauaaguaacuacgacaucgaccacauauugccacaagcauuuauaaaggacgacaguuuaaguaauaggguuuuaguuucuaaagcagugaauaacggaaaaagcgcuaauguaccacuaaagcuuuucggagcaaaaaugggacacuucuggaaacaacuagcagaagcaggccuaauaaauaagcacaaacuuaaaaaccuccaaacuaaucccgauacaauuuccaaauucgcaaugcacggcuucauacgaaggcaacuaguagaaaccagucaaguaauaaaacucguagcuaacauacucggugauaaauaucgaaacgacgauaccaaaauaauagaaaucacagcacgaaugaaucaccaaaugagggaugaauuugguuuuauuaagaaccgugaaauaaaugauuaucaccacgcauuugacgcauaucugaccgccuucuuaggaagauacuuauaccacagauauaucaaacuccgaccauacuucgucuacggugauuucaaaaaauuccgagaagauaaaguaacaaugagaaacuuuaacuuccuccacgacuuaacagacgacacccaagcuagaauagccgauacagaaaccggcgaagucauuugggauagagagacaucuaucaaacaacuacgugacguguaccauuacaaauuuaugcuaaucagccaagaaguuuauacccucagaggagcgauguucaaucagacaauauauccagccucucaggcugguagaaaaaaacucauacccaugaaggcagauaaacccguagacguauacggcggauauagugguucaacagacgccuauauggcaauaguuagaauccaugauaaaaaaggagauaaauacaaggucgugggaguaccgaugcgcgcuuuaaaucgucuuaacacggcuaaaaauguuagugacgcaaaauaugaucaagaacucaaagaaguccuaacaccccaauucacuaaauccaaaaaaaacagaaaaaccggagaaauaacccaaacaguggaagauuucgagguaguacuaggaaaaguaauguaucgacaacuagucauagacggcgauaaaaaauuuauguuagguucaucaaccuaucaauauaaugcaaaacaacugguacuuucagaugaaaguauaaaaacauuagcgagugagggaaaacuaaacgaagcacaagaauccgccgcuuacgacaaaguauacgaugaaauccuugacaaaguaaacaaauacuucgcuuuauacgacaccaacaaauuucgacaaaaacuaucacuuggaaaggacaaauucguaggauuacccaaucacaacguuuuugaugggagcaaaaaaauaagcuccggaaaacgggaaauccuuaaugaaauuuuaaacggucuucacgcaaacgcgacacuaggaacauuaucagauauagguuucucaacuccauuuggcaaaaugcaacaaccaagaggcaucggccuaagcucuaacaccuccauagaauaugaaaguuucacugguuuauuuaagagaaccaucuuuuuaaaagaucuuuga

SEQ ID NO: 8820 - RNA, 4047 nt, Artificial Sequence
  Cas9 variant
augaagaaaccauauacuauagcacuagacauagggacaaacucaguaggcuggguuguugucacggacgauuacagaguaccaacaaagaaaaugaaaguacuaggaaauaccgaaagaaaaacaauuaagaaaaauuuaauaggagcacuacuguuugacucuggugauacagcagaaggaacaagacucaaaagaacagcaagaccaagguauaccaggagaaagaaccgacucagauuccuaaaagaaaucuuuaccgaagaaauggcaaaaguggacgauggauucuuucaaagauuagaagauuccuuuuacguacucgaagacaaagaaggaaauaaacauccuaucuucgccaaccucgccgacgaaguagcauaucauaagaaauauccaacaauauaucaucucagaaaagaacuuguagauaacccacaaaaagccgaccuccgacuuauauaccuagcagucgcacacauaaucaaauuucgaggacacuuucucauagaaggcaccuuauccaguaaaaacaacaaucuccaaaaaucauucgaucaucuaguagauacauacaacuuacucuucgaggaacaaagguuauuaacugagggaauuaacgcaaaagagcuucuaagugcagcauuaagcaaaaguaaaagauuagaaaaucugaucucucuaauuccaggccaaaagaaaaccgguauuuuuggcaacauaaucgcccuaagccuaggacucacaccaaauuuuaaagcaaauuucggauuaucaaaagauguaaaacuucaacuagccaaagacacauaugccgacgaucucgauuccuuauuagcgcagaucggugaccaauacgcagacuuguuucuagcagccaaaaaccuaagcgacgcaauacucuuaucugacauacuaacggaauccgacgaaauaacuagagccccgcucucagcuucuaugguaaaaagauaccgagaacaccacaaagacuuaguuacacucaaaacauuaaucaaagaucaacuaccugaaaaauaucaagaaaucuuucuagauaaaaccaaaaacggauacgcgggcuauaucgaaggacaagucucccaagaagaguucuauaaauaucuuaaaccuauccuugcaagauuagacggcagugaacccuuacuacuaaaaaucgauagagaagauuucuugcgaaaacaacgaacauuugacaacggaucaauaccacaucaaauucaucucgaagaauuacaugcaauacuacgaagacaagaaguauucuauccauuuuuaaaagauaaccgaaagaaaauagaaucacucuuaacuuucaggauacccuauuauguaggaccccucgcaagaggacauucaagauuugcuugggucaaaaggaaauuugacggagcuauucgcccauggaacuuugaagaaauuguugacgaagaagcuagugcccaaauuuucauagagaaaaugacgaaaaacgauuuauaccuaccaaaugaaaaaguacuaccuaaacauucacuuuuauaugaaacauuuacaguuuacaacgaacugacaaaagucaaauacgcaacagaagguaugacaagaccacaauuucuauccgcagaccaaaaacaggcuauaguagauuuacuuuuuaaaaccaaccgcaaaguaacaguaaagcaacuaaaggaaaauuauuuuaagaaaauagaaugcugggacuccgucgaaauaaccggaguugaagacucuuuuaacgccuccuugggaaccuaccacgauuuacuaaaaauaauacaagauaaagauuuucucgauaacccagauaaccagaaaauuauugaagauauaauuuugacacuaacgcuuuuugaagauaagaaaaugauaucaaaaagacuagaucaauacgcccacuuguuugacaaagugguacuaaauaaacuugaaagacaccauuauacuggcugggguagacuaucagggaaauuaauuaacgggauaagagacaaacaaucuggcaaaacaauucuugacuuuuuaaaagcugauggauuugcgaauaggaauuucaugcaacuaauccacgauagugaacucucguuuauugaugaaauagcaaaagcacaaguaaucggaaaaacugaauacucaaaggauuuaguaggaaaucuagcaggaagcccugcaauaaagaaaggaauuucacaaacgauaaaaauaguugacgaacucguaaaaaucaugggcuaccuuccacagcaaauaguaaucgaaauggcaagagaaaaucaaaccacagcccaaggaauuaaaaacgcaagacaaaggaugcgaaaacuagaagaaacagccaagaaauuagggucaaauauauuaaaagaacacccaguagauaacucucagcuucaaaaugacaaaagauaccucuacuaccuacaaaaugguaaagacauguacacaggagaugaucuugacaucgacuaucuaucaaguuaugauauagaccacauaauaccacaaaguuuuauuaaaaauaauagcaucgauaacaaaguacuaacgagccaaggcgcaaacagaggaaaauuagacaaugugccgucugaagcaauaguuagaaagaugaaaggauauuggcaaucccuacuuagagcgggcgcaauaucgaaacagaaauuugauaauuuaaccaaagccgaacgaggagggcuaacucaaguggauaaagccggguuuauucaacuucagcuaguggaaacacgacaaauaacaaaacacguagcacaaauauuagauagucgauuuaacaccgaauuugacgaucauaauaagcgaauuagaaagguucacaucauaacguuaaaaagcaaacuuguuucagacuuccgaaaagaguucggacuauacaaaauacgagacauaaaccacuaccaccacgcucacgaugcauaccuuaaugcuguaguagccaaagcaaucuuaggaaaauacccucaauuggcaccugaauuuguuuacggagacuauccuaaauauaacucauucaaagaaagacaaaaagcaacacagaaaacacuauuuuacucaaacauucuaaaauucuuuaaagaucaagaaucacuacacguuaauagugacggggaagaaauauggaacgccaauaaacaucuaccuauaauuaaaaacguacuaagcauuccacaaguaaacaucguuaaaaagacagaaguacaaacaggagguuuuuacaaggaaucuauacuaaguaaaggaaacucagacaaguuaaucccacgcaaaaacaauugggauacuagaaaauaugggggauuugauucaccuacaguagcauauucaguacucguaauagcaaaaauggaaaaaggaaaagcaaaaguccugaagccuguuaaagaaaugguaggcauaacaauaauggaacggauagcauuugaagaaaauccaguuguauuccuagaagcgaaaggauacagagaaauccaagaacaccuaaucauaaaacuaccaaaauauucauuauucgaauuagaaaacggaagaagaagguuacuugcaucugcaagugaacugcaaaaagguaacgaacucuuucuaccagucgacuacaugacuuuccuauacuuagcagcgcacuaucaugaauuaacagggagcagcgaagacguccuuagaaagaaauauuucguugaaagacaucuacacuauuuugaugacauuauacaaaugaucaacgauuucgcugaaagacauauucucgccuccaguaaccuagagaaaauaaaucacaccuaucacaacaauucugacuugccgguaaacgaacgugcagaaaauaucauaaacguuuucaccuuugucgcucucggcgcaccagcagcuuuuaaauucuuugaugccacuauagaucgaaaaagauauacaucaacgaaagaaguauuaaacgcaaccuugauucaucaaucaguaacuggauuauaugaaaccagaauagaucucucacaacuuggagaaaauuga

SEQ ID NO: 8821 - RNA, 4050 nt, Artificial Sequence
  Cas9 variant
augaaacaaaaauuuuacguuggguuggauaugggaacagcaaguguagguugggcuguaacggaugacaaauauaacauaauaaaacggcacggaaaagcauuauggggagucagguuguuuaaaacagcaaacacagcagaagaaaggagaauauuccgagcugcaagaagacggacacaaagaagaaaacaaagaauggagcuacuucaagaaaucuucggagacgaaaucucaaaaacugauaucggauucuaccaaagaaugaaagaaucaaaauacugguuugaagauaaaagagauauaaaugguaaacaaccagaacuuccuuaugcacuguucguagacgacggguucacugauaaagacuaccacgaacaauucccaacaauuuuucacuuaaggaauguauuaguuaacgaauggacacaaaaauaugauauacgacuugucuaccuagcgauacaucacauaauaaaacacagaggucauuuccuguucgaaggcaagaaaaugucugaagucacugacuuuggaagcgccuucgaggcauuuuguaaaguagccucagacaacgauauagaaauuaccguagaugaagaaaaacucaaagacauagaagaccucuugaaaagucggcagaaaaguaaaacagccaagaaacaagaauugggaaaaauaauagcgggggcagauaaacaaaagaaagcgcucgcagcauuaguuacaggaugcauggucaaauuaucagaaauuuucgccgacaaaagccuagaugauggagaacgaaauaaaauuaguuuugcagauaguaauuaugaugaauacaucgcgaauguagaagaaacauuagcagaacgcuuucuauuaauagcagcuggaaaagcccuauaugacugggcugugcuuucagauauauuagaaggaucaacauauauuagcgaagccaaaguaaaaauauacaagaaacacggugaugaccugagaaaauuaaaaggacuacuaaaaacacgaccagaugaauacaaacucauauuuggacuacccgaaaaacaggcuaacuauagugcauauauaggaauggucaagaaaaacgguaagaaagucccuauagauaagaaaugcacuaaagcagacuucuauucauuucuuaagaaaacguuaaacaaaaucaacuuugaagaugaaaaagaaagagaaaucgcugaaucuaucauaaacgagauagaaaacgaaacauucuugcccaaacaagucaucagugauaauggagucauaccauaucaauugcacgaagcagaacuugaucgaauacuaaagaaugcugcuuuauauuacccauuccugucugaaaaagaugacgaaggcuacaccaauauggauaaaauaaaagcaauuuucaaauuuagaauaccauauuacguaggaccauuaaauacuuaucauuccgauaaaggcgguaacagcugggcaguacgcaaacaggacgguaaaaucuauccauggaauuuugaaucuaaaauagacgcaggagaaucagcuagaaaauucauuggaagaaugacgaauaaauguacauaccuaauaggaaaagauguacuacccaaagaaucccuauuguacucuaaauuuaugguccuaaacgaauuaaauaaucuacgaauugauggagaaaaaguuaguguagaaauuaaacaagcuguauacgaaaacguauucaagaaauaccagagaguuacaggcaagaaagugaaagacuuuuuaaucagaucaggaauuauuggaagagaacaagaacuaucaggauuugaucaaaauuucaaaucgagccuaaaagcauaucaugauauaaaacaaaucgccggagacauaaaucuaagucaaaaccaaaaagaagauauuauaaaagaaauaacaguuuucgcagacagucagaaaaugcugaagaaaagauuaaaaauaaaauaucccgagcuaucagauaagcaagucacaaaacuugcugccaagaaauauacggguuggggacgacuaagcagagaauuucuagaagagguugaauccguaaacaaagaaacaggugaaguauuaaacauaauuucagcacucugggaaacaaaugaaaaccucaugcaauuauuauccaacaaauacgauuauuuaucagaaauaaaacggcuaaaugaugaggcagaggauaaaagugaagucguaacuuaugacgacguacaaaaacuauacgucagcccugcagugaaaagaccaguauggcaaacuuuaaaaauaguagaagaaauaagcaaaauaauggguucaaaaccagaacguauuuucguugaaauggcaagagaaccgggacaaaaaggagauguuaaaguuucaagaaaaucuagauuauuagaaaaauauaaauauuguaagaaagaagcccccgaaauauaugaaaaccuuguuaaagaagaugauaacaaacuacggagugauaaacuauuucuauauuauacccaaaugggaagguguauguauagcaaugaaguaauagacauagaagaccuauucacgaaccgauacgacauagaccauaucuacccucaaagcaaagucauggacgauucucucgacaacagaguauuagugaaaagagaacuaaauucgaacaaaacagaugucuucccgguaccgaaagaauacauggauaaagcaaaaacacucugggacauguuaaagaagaaagaucuaauuucuaaagaaaaauaucacagauuaacuagacgagauggcuuuagugaaaaugaacuaaguggauucaucgcacgacagcuaguugaaacgaggcaaucaaccaaagcggugacucaacuucuaacaaaagccuauccagaaucagaaaucguguacgcaaaagcaaaugcaguauccgaauuucggcauaaauuuggauucacaaaaguacguaguauaaacgacuaccaccaugcaaaagaugcauaccugaacauagugguaggaaauacguauuauguuaaauucacaaaagaugccgccugguucauaagaaauaaucccggacgaacuuauaaccugaagaaaauguuugaacaaggaacagucucaagaggaggugaaaccgcaugggucucaggugaagacgggacuaucuucaccguaaaaagagucauggguaaaaacaacaucuuauucacuagaaaagcauaugaaguaagagguggauuauucgaccaacaaauaaugaaaaagggaaaaggacaaauacccguuaaaaacaauagugaagaugauagauuaugugccaccgaaaaauauggagcuuauaauaaagcaucaggggcauauuuuaugcucguagagucagaagacaagaaaggaaauaaaauaaggacuuuagaguucguacccguauaucucgccaaagaacuagaaaaaucagaagacgcagcaauacgguacugcguagaaaagcuagaacucaaaaauccugacguuagaguuagaaaaauuaaaauggauaguuuauuuaauguagauggcuucagaaugcacuuauccggaagaacaggcaaacaauugauauucaaaugugcagaacaguugguauuggacgaagaaucccagaaaauuuuaaagaaaacagcaaaaguuuuugcagauuauaaagaaaauaaaaacauaaaaauaucagacaaaauagaauuaacagacgaaaugcuaauuaaauuauacgaacuguucuacaagaaauuaaaagauacaguauacaacauuagacuaaguacacaaguuaaaacgcucgaauccggaaaagagaaauuugaaaaauuaagucuauuagacaaaugccuaguaauugaagagauauuacaccuauuccaaugucaaucaguugcagcaaaccuuaguucgaucggaggugcagcgacagcaggcauacuuguauuaaacaaugagauaagcagaugugguaaaguggaaauaauaaaccagaguaucacagguuuuuacgaacaaguaauagaccucaaaaacauuuga

SEQ ID NO: 8822 - RNA, 4050 nt, Artificial Sequence
  Cas9 variant
augcaaaaauauuaccuaggucuagauauaggaaccaauagcguaggaugggcgguaacagacgaaaauuacaacuuaugcaaguucggaggaaaacgcaugugggguauccgacuauuugacggagcacaaaccgcagaagaaaggcgcaugaauagaucgaaucgaagaagauuaucacgacaaaaacaacgaauagaccuauuacaagaauuauucgcaaaagaaaucgccaagguagauccaacauuuuuuauaagacuuaacgaaucaagguuauauauggaagacaaauccacaggcacaaaauucccauuauuugcagacccagguuacacagacaaagaauacuauaaagaauacccuacgauauaucauuuacgacaagaauuaauaaaaaauccugaaucgcacgacauuagguuaguauaucuggcaugccaucacauucuuaaaaacagaggucacuuuuugauaaacggcuccuucucagaucuuaagaaccuuaguuuuguaugccgagaaauguuagaugcauucaacgaacuaucgaaauaccaacuuaugauaucugacauagaugccuuagaaaagauacucagcgaccgaaaacaacaaaaaagcgcuaaagucaaagaauuaguacaaauauuugaguguguacccagggaagauaaaucugacgccaaaaucugcaaagaaauacuaucaaaucuguguaaauucuugguuggagcuaaaggaaauauaacuagacuguuugacaccgacuucgacgagauggaaacaagcucauuuucuuuuggagauuccaaauacgaagauucccuuuuaccaucacucgaagagaacuacccagacuacgccaaugucauucaaaaaauaaaagccauguacgauuggagcguauugguugaaauaauggcaggagaaaacuaccuuucauuugccaaagugaaugcuuauaaaaaacauaaagaaaauuuaucaauucuaaaaagucuaaugaaaaaauauugcacaccagacgucuaccaaagauuuuuuuaugaaacagacgaaaagaguucauaugguaacuacauaggagcgauccacaauaacggccacucacauacaaugaaaaaaugcgacgaagagacauucuauaaaagucuaucuaaaauucuagauaaacuuguaguccagaaaacggaucaagacaccuuggaaauauuaaaaaaagaagcuaagaaucaaacgcuacuuccccuugcacgcacaaaagcaaauggagucauaccaaaccaaauacauauccaagagcuuagagcaauacuagauaacgcaaaaacauacuugucauuucuuaacgaagccgacgaguacgggacaauagcagagaaaauaauaagaauagcgaaauuuaaaauaccauauuacgcagggccacugucgacaagacacaaagaacagggcgccaacacauggauugucagaaaacaagaaggcagaauauacccuuggaauuuugaggaaaugguagaccuagaacgaaguaauaacgaauuuauaaggagaaugacgaauaaaugcacuuaucuaauaggcgaggacguauuaccaaagaacucacuucuauacaguaaauucaugguuuuaaaugaacucaauaauuuaaaaauaagaggccacaaaauaucugucgaguuaaaacaagaauuauauaaagaauuauuuugcaagaaagcaaaagucacagguaaagcccuacucguauaccuaaagaagaaagacgcagaacuaacauuggaagacauuucuggauuugacgcugacuuuaaaucaucacuaucuaucuacauugauuucaaaaaccauauacuaagagaacaaauagaugacggaaaauaucaaagcauaguagaaaacauaauaaaguggaaaacaauauucgacguagacagcaagaugaucgaaaaauuaauagcuagagaauacccaaauauguucucaucagaacagauaaaaaaaaucugccgacugaaaugucgagguuggggaaacuuuagcaguagauuucucaaugggauccaaggagaaaauacagaaaccaaagaauguuucacuauaauagaagcucuuuggaaaaccaacuauaaccuaaugcagcucuuaagcaaacaauuuaccuucaaagacgcuaucgacugcaucaacgcagauaaaguaggaaagauagacaagguaacauaugagaacacaguaaaggacuuaguaguuucaccagcaaauaagagagcgaucuggcaaacuguacagauuaccgaggaaauaaaaaaaguaaugaaaugugaaccagaaaaaauauuugucgaaauggcaagaggaggagaaaaagaaaaaaaacguacgaucucacguaaagaacgauuauuaaaacuguauauggauuacaaagaugaaaauagagauuggauaaaagaaaucgaaucuagagacgaacaagauuuuacaaauagaaaguuauauuuauauuacacgcaaaucggaagaugcauguauucgggagaagaaauaagcuuagaagaacuaaugcaaaagaauucaaaaugggacaaagaccacauauauccucaaucaaagaucaaggaugauucccucgauaaccuuguuuuagcuagaaaagacauaaauaauaacaaaucuaauaaguuacuuccaaccggaauucaagauaaaaugaaaaaauauuggaagaugcuauuaaaguauggauucaucaguaaaaaaaaauaugaucgauuaaugcgaacagaagacuucagcgacgaagaacuaucaggauucauagcaagacaaauaguggaaacuagacaaagcagcaaagcgguugcugagcuauuagaacauuuaaaugaacacacagagauaguauaugucaaagcugaacuaguuagugacuucagacacgacaauaacauguugaaaaguaggagaaucaaugacuaucaucacgcaaaagacgcauuucucaauaucgucguagguaacgucuauaaugcaaaauuuaccgcuaacccacgaaauuggauaaaaaaaaauagaaauacaaacuauucaauacguagaguauuugauuacaccguaaaaagagggucgacaaucguauggcaaggaguaaaagauggcggacacucuauugauggaauaaagaaaacuauggcaaggaaugauauauuauacacagaaagaacuuacugcgaacagggagaguuguucaacgcaacucuaauaaaaaaaggcaacccgaacgcaauaggacuaaaaaagggucuagauccaaugaaauauggcgguuacaguaguccgaaaaccucggccuucgcuuuuauugaauucgauggaaaaaaaggaagacagaaucaccuagucgaaauaccagucuacauagcaaacauugcugcuaggcagccagaauacaucaaaaaucaucuagaagaaaaaaaaggcuaccaaaauguuaucguaaagaaauaccccauacaaaaaaacgcauuaauaaaauuagauggauacccagcaagacuaagaggagccaacgaaaaaucaaucacacuaaaaaacgcaguacaacuaguauuaaaaccagaguaccaugaaacuauuaggaauguagaaaaguauuuagaauauaucgacaaagaugagagcguaucaaaagcagcacgauucucucauacagaacucgauaaguuguacgaugaauuaugcuuuaaagcagaaaacagcauauauaaaaagagacccgcaaaucaaucagcaaccuuaaaaaauggacaaaaaacguucuuagcuauaaccaauuuaaaagaaaaagcccaagugauaaacaacauaauuacaauguuuagaugcgacgccacaacaaccacaaaccuaaaaacaauaggaggauccgcuaacgcuggaggaaugcaaguuaacaaaaacacucucaccucacaaaaaguaguacuaguacaccaaucgauaaccggucuauuuggcacugaagaagaacuucuguga

SEQ ID NO: 8823 - RNA, 4053 nt, Artificial Sequence
  Cas9 variant
augaaaaaaccauauucaauaggcuuagauauagguacaaauucaguagguugggcaguaguuacagacgauuauaaaguacccgccaaaaaaaugacuguccuaggaaauacagauaaaucccacauaaaaaaaaaccuauuaggagcucuacuauucgacucaggaaauacagccgccgauagaagauuaaaaagaacugcucgacggcgauauacacgacgcagaaaccggauacuauaccuacaagaaauauucgccgaagaaaugagcaagguagacgauucuuucuuccaccgucuagaagauucauuccucguaacagaagauaaaagaggugaaagacauccaaucuuuggaaaccuggaagaagagguaaaauaucaugaaaacuuucccacaauauaucacuuacgccaauaccucgcugacaaccccgaaaaaguagaccuacgacucguuuaccuagcccuagcacacauaauuaaauuucgcggccauuucuuaaucgaagguaaauuugauacacguaacaacgacguacaaaggcuauuucaagaauuuuuggcagucuaugacaauacauucgaaaauuccucccuacaagaacaaaacguacaaguugaagaaauccugacugacaagauaucuaaaagugcaaagaaagaccgcgucuuaaaauuauuuccuaacgaaaaaucaaaugggagauucgcagaauuccuaaaacuaaucguuggaaaccaagcagauuuuaaaaaacauuuugaacuagaagaaaaaacuccacuccaauuuucaaaagacacuuacgaagaagaauuagaaguacuauuagcacaaauaggagacaacuacgccgaacucuuccucagugcuaaaaaacuauaugacaguauucuacugucgggaauauuaacaguuacagauguuagcacgaaagcuccauuauccgccuccaugauacaacgauacaaugaacaccaaauggaccuagcacaguuaaaacaauucaucagacaaaaacuuuccgacaaauauaaugaaguauucucggauguaaguaaagaugguuaugcaggauauaucgacgggaaaacgaaccaagaagcguucuacaaguaccuuaaaggacuauuaaauaaaauugaaggaucaggauacuuuuuagauaaaauagaaagagaagacuuuuuacgcaaacaacgaacguucgauaauggcaguauaccgcaccaaauucauuuacaggaaaugagagcaauaauacgacgucaagccgaauucuauccuuuucuugcggauaaucaagaucgaauugagaagauacuaacauuucgcaucccauauuacguaggcccccucgcaagaggcaaaagcgacuucgccuggcuaucuagaaaaagcgccgacaaaauaacacccuggaauuucgaugagauagucgauaaagaauccuccgcagaagcauuuauaaaccgaaugacgaacuacgauuuauaccuaccgaaucaaaaaguacuaccuaaacacucccuauuauaugagaaauucaccguauauaacgaacugacuaaagugaaauacaaaacugaacaaggaaaaacggccuucuuugacgcaaacaugaaacaagaaauuuuugacggagucuuuaaaguauaucgaaaagucacuaaagauaaacucauggacuucuuagaaaaagaauuugacgaauuuagaauaguugaccuaacaggacuugacaaagagaacaaagcuuucaaugcaaguuauggaacuuaccacgauuuacgcaaaauacucgauaaagauuuuuuagauaacucuaaaaaugaaaaaauuuuggaagauaucguauuaacacucacacuguuugaagaccgcgaaaugauccgaaaacgccuagaaaacuacuccgaucuauuaacaaaagaacaaguaaagaaacuagaacgacgacauuacacaggauggggccgguuauccgccgaauugauucaugguauaagaaauaaagaaucaagaaaaacaauacuagauuaucuaauagacgacgguaauucaaacagaaauuuuaugcaauuaauaaaugacgacgcuuuauccuucaaagaagaaauagccaaagcucagguaauaggagaaacagacaaccucaaccaagucgucucagacauagcaggcucuccggccaucaagaaagggauacuacaaagucuaaagauagucgacgaacuggucaaaauuaugggacaccaaccagaaaacaucguaguugaaauggcacgagaaaaucaauuuacaaaccaaggcagacgaaacucacaacaacgucuaaaaggacuaacagacucaauaaaagaauucgggagccaaauacuaaaagaacauccaguagaaaacucucaacugcaaaaugaucgcuuauuccuauauuacuuacaaaauggacgugacauguacacaggcgaagaacuagauauagacuaucugucucaauaugacaucgaucacauaauaccccaagcauucaucaaagacaauucgauagauaauagagugcuuacauccucaaaagaaaacagaggaaaaucggacgaugugccaucagaagacgucguaaacagaaugagaccauuuuggaacaaauuauuaucuucaggccuaaucucacagagaaaauacaacaauuuaacaaaaaaagaacuaacaccugacgacaaagcagguuuuauaaagagacaacuugucgaaacaagacaaauaacaaagcacguugcaagaaugcucgacgaaagauuuaauaaagaauucgaugacaacaauaaacgaauacgcagagucaaaaucguaacacuuaaaucaaaucucguaagcucuuucagaaaagaauuugaacuuuauaaaguuagagaaauaaaugauuaucaccaugcucaugaugccuauuugaacgcgguaguagucaaagcauuacuaguaaaauacccaaaauuagaaccagaauucguauacggagaauauccaaaauauaacagcuauagagaaagaaaaacagcaacucaaaaaauguucuucuacagcaacauaaugaacauguuuaagucgaaggucaaguuggcagaugaucagauaguagaacgcccaaugaucgaaguaaaugacgaaacaggagaaauagccugggauaagacaaaacacauaacaacaguaaaaaaaguccuaucuuauccccaaguaaacauagucaaaaaagucgaagaacaaacaauaggccaaaaugguggauuguucgacgauaacccaaagagcccuuuagaagugauacccaguaaacucgucccguuaaaaaaagcauuaaaccccgagaaauauggagguuaccaaaaacccacaacagcauaccccauacuacuaauaguagauacaaaacaauugauaccuauaaguguaauggauaaaaaaagauuugaacaaaaccccguaaaauuccucaaagauaaaggauaccaacaaaucgaaaaaaacaacuuugucaaguuacccaaauacacacuaguugauauuggaaacgguauuaaaagacuuugggcuuccaguaaggaaguacacaaaggcaaccaauuggugguaucaaaaaaaucacaagauuuacuauaccacgcucaccauuuggauaacgacuacagcaacgaauaugucaaaaaccauuaccaacaauucgacauccuauucaacgaaauuacgucauuuucuaagaaaugcaagcuuggaaaagaacauauucaaaaaauagaagaagcauacaguaaagaacgggauucggcaucaauugaagaacuagcggacgguuucauaaaacuauuaggauucacccaacuaggagcuacuucaccuuucaguuuuuuaggaaucaaauuaaaccaaaaacaauacacuggaaagaaggauuaccuucugcccuguauggaagcuacauuaauacaccaauccaucacaggucuauaugaaacccguauagaccuuaguaaacuaggaggagacuga

SEQ ID NO: 8824 - RNA, 4053 nt, Artificial Sequence
  Cas9 variant
augggaaaaaacuacuaccucggauuagauaugggaacaucaagugucgggugggccguaacugacgaaaaauauagaauccuaagggccaaaggaaaagaccucuggggcguaagguuauuuucggaagcaaaaacagcagccgaaaggcggacacacagaacaagucgaaggagacucgacagagaaaaagcuaggaucgcaugcuuaaaagaaauguuugcagaagagauaaacaagauagacccaggauucuaucaaaggcucaacgauagcaaauacuuccuugaagacaaaaaagagcaucaaccauacgcuaucuuugcagauaccggauauacagauaaagaauacuacgacgaauacccaaccauauuucacuuacgcaaagcguuauuaaauauagaaaaugauaaaaaaaaauacgauguacgacuaguauacuuagcaauacuuaacauguuuaaacaccgcggccauuucuugaacgcaaaccuagacgacaagucaggaggaaauuuaaaggaauacaucgaaaugcuacaucaaagcaugguuaauauuuuaaacauuaacuuaaaaaacguagagauagaaaaaaucgaaaagauacuaaaaucaacacaauauucgaacucagaacgauuagaaaauuugcucgaacuuuaugaacugaguaaaaacaaaaauaaaauagaaaccgaaauauucaaauucauaugcggccuaaaaggcacaaucuccaaaauuuauguagaagauaaauucgaagaugaauuugcgaaaaugacacuaaguuucagagacucaaacuucgaugaaaaaauaaucgaaaucgaagacaacuuagaugaugacaaguaugacauguuucuacucaucaaacaaauacaugauuggagcguacuagcaaacauaaugaauggugaagaauaucuaucuguagcccgagucaagcuauacgauaaacacaagaaggaccuagaaguauuaaagaaauacuacaaacaaaacagcauggaagaauauaacaaaauguuccgacaaaugaacgacgguaacuacucugcauacguaggaagcguaauauacaaagacaacucaguccgcagaggcugcaagucaaaaaaagaagacuuuuauaaaaacauacuaaacacaaucaaaucaugggaggauugcgaagcaaaagaguacauuacauccgaaauagacaaaggcaacuuccuaccaaaacaaaucacagcaagcaacgggguaauuccuaaucaaguacacaaaaaagagcucaaaaaaauucuaaaaaacgcgucagaauaccucaacuuccuaaacgaaaaggaugaaucaggauacacaauaagcgaaaagaucguaaaacuauuugaauuucaaauaccauacuacguggggccuauagccuacaauaucggaaacgacgaaagcaaacacagacauaacauguggucaguucgaaaagagaaggggccgauauacccuuggaauuucgaacaaaaaauagauauaaaaaaguccucagagaaauucaucaggaaccuaauaaaucauugcacuuaucuaaacgaugaagaagucuugccuaaaaauucacuacuauaugaaaaauucaugguucucaacgaacugaacaaacucaagauaaauggagaaaaaauuagcguugaacuaaaacaaaauauuuuuaacgacuuauucaaaaaggguaaaaaagucacaaaaaaagggcuuauaaaauaccucaaagaacaaggagaaauagauaacugcgaagaaguagaaauaucaggaaucgacggagacuucaccaacaagcuuucaaacuacaaaaaauuugcagauauauuugguguacaaucacugacuuaugaacaaacggauauugcagaaaacauaauucgauacagcacaauauauggagacagccgaaaauucuuagaagaacgcauuagggaggaauauucaaacguauuagaugaaaaacaaauaaagagaauacuaggcaugaaguucaaagacuggggacgauuaagcaaagaauuacuugaauuaagcggaguagauaaagaaacgggggaaauagcgucugucauaucaaggauguggaacgauaauuacaauuugauggaacuuauagccacugaaagauucagcuacgcauacgaaauagaacaacgaagcaaaaaauuagaaaagacaauaaguaccauagaauaugaagaccuggacgaacuauauaugagcaccccgguaaaacgaauggucuggcaaaccauauuaguauuaaaagaauuagaagagguacuuggauguccaccaaaaaggauauucguugaaauggcacgagauguaaacgcaccaaaggaccgaaaagauagcagaaaaaagaaacucuuagaacuuuauaaaaauuguaaaaaagaggaaggggacuggagcaaagaauuaaacgcaagagaagaaagugaauuuaaaucaaaaaaauuauaccuauauuacaugcaaaaaggacgauguauguauucaggaaaaccgauugauuugaagaacuuguuaaacgacaaucucuaugacauagaccacauauacccacgacacuucguaaaagacgacagcauagaaaauaacuugguacuaguagaaaaaaacuucaaugcucacaaaagugauaauuacccaauagaaaacgaaaucagacaaaaaaugcauaguauguggaaaauguuaagagacggaaacuucauuacagaagaaaaauauagccgcuuaauaagaaaagaagaauucaccgacgaugaaaaggccaaauucauaucacgacaaaucguagaaacaagacaagggaccaaaguaauaaccgaucuauuugaacaaacauuuccggaaagcgauauaguauauguuaaggcaggcaaugugucugaauucagacacaaguuuaaacuuaucaaaugcagaaaugugaaugacuuucaucacgcaaacgacgcauaccuaaacauagucguaggaaacguauacuacacaaaauuuacgaagucagcauuaaauuuuauuaaagauuauaaaaagaaucccgaaaaaaauaaauaucacauggaccauauguuucaguauccugucaguagaggaggggucgacgcauggauaacaaaaggcgcggaguccauaagcaugguaagaaaaaugauggccaaaaacacuccgauggucacacgcaugaacuacgaaaaacacagcggucaaaaagguggaauuuccgaucaaaacauaugcucugcuaaaaucgcaaagaaaaacguauauuugccuauaaaaaugggagaugaaaaacucaaaaauguagaaaaguacggaggauauggaagccucacagcaaaauauuuuuuccucguagaacacaccaucaaaaaaaaacgcauacgaacaaucgaagcuuauccaauguaucuagacgcgcucaacaaagaaaacaaguuauuaaacuacuguguucagguguuagaauacgacgaacccaagaucauuauggagaaaauaaaaguaaaaaguuuauuuaaaauaaaugguuacuacuacuaccucaaugcuaaaagcguaaaccgaauaauaugggggaaugcaacacaacuuuuccucgaaaacgacaucaacgaauacguuagaaagaucaguaaaaauauugaguguauagacauaaauagcgaaaacaacaucaaagucuacgacaucuucauagaaaaauauagcaauaaacuuuucucgaaccgcuugggaaaccuuaaagaagccauaauacaaaauagaaacaaguuuaucgaauuaaaaauaaacgaacagaucaacguaauacucgaacuagugcgauacagucaagacggaguauacucaauaaaccuaagucaacuaggauuaucuucaacauaugccauuaaucgaaccaguaaggaaauuagcaaaaugaaagaaugcaaacuaauuaaucaaagcgucacuggcuuauacgagaaugagauugacuuauuaaccguauga

SEQ ID NO: 8825 - RNA, 4053 nt, Artificial Sequence
  Cas9 variant
augcaacaauauuacuuaggugucgacaugggaagugccucaguaggaugggcaguaacagacgaaaaauaucaacucguacggaagaaaggaaaagauuuguggggcguaagaaccuuugacauagcacaaacagcagaaguaagacguguaagccgaacaaauagaagaaggcaaaauagacgcaaacaaagaauccaaauacuacaagaacuucuaggcgaagaaguccuaaagauagaugccggauucuuucaccgcaugaaagaaagccgauauguagcagaagacaagagaacacuggauggcaaacaaguagaauuaccauacgcgcuuuuuguagaucaagguuuuaccgacaaagacuuuuacaaacaguucccaacaauaaaccaucuaauagucuauuugaugaccacaagugauaccccagauaucagauuaguauauuuagcacuacacuacuacaugaaaaaucgaggaaacuuccuacacaguggugacauuaacgaugucaaagauauccaaucaauacuagaacaacuagaaaauguauugaaagaauauguagacgacugggaacugucuuugaaagauaaaguggacgcaauuaaagaaauauauaauaaggaccugggcagaggcgagcgaaagaaagcguucauuaacacacuugguguuaaaacuaaaucagcaaaagccuucugcaguuuaauauccggaggaucaacaaacuuagcugaauuguuugacgauaguggucuaaaagaaucagaauaugcaaaaauagaguucgcaaacgcgaacuucgaagacagcguagaaggaauacaagcucuccucgaagauagauuugcaguaauagaagcagccaagcgguuauaugauuggaaaauacugacagauauacuaggcgauaacgcaagccucgcugaagcacggguaaaaaguuacgaaacucaccaugaacaguuaguagaacuaaaaucauuuaucaagaaauacuuagauagaaaaauauaccaagacauauucauaaauccaaacauugcaaauaauuacccugcuuacguaggacauacuaaaauaaacggaaagaaacaagaacuggaaguaaaaagagcuaaaaggaaugauuucuacgcguacauaaagaaacaagugauugacccaauuaaaaagaaaguaucagacaaagcaguacuagcacgauuagcagagauugaaucucucauagaaguuaacaaauaccuaccguuacaaguuaacagcgacaaugguguuauacccuaucaaauaaaacugaacgaacuaagacgaauauucaacaacuuggagaauagauuaccgguacuaaaagaaaacagggacaaaauaauuaaaacguuuaguuaccgaauacccuauuaugucggaccauuaaauggaguaaacagaaauggaaaaucuacaaauuggaugguucgaaaagaaggggaagaaggaaaaauauacccauggaacuuugaagaaaaagucgaucuagaggcgucagcagaaaaauuuauaagacgaaugacaaacaaaugcacauacuuaguuaaugaagacguacuuccaaaauacagucuuuuauauuccaaauaucuaguacuaagugaauugaacaaccuacgacucgauggccgaccauuagaaguaagugucaaacaagaaauuuacgaaaacguuuuuaaacgcaauagaaaaguaacgcuuaagaaaaucaaaaauuaucuacuaaaagagggcguaauuucagaaaaagaugaacuaaguggauuagcagaugacguaaaaaguagucucacugcguaccaugacuucaaagaaaaacuaggucaccuaaccuuaacugaagaccaaauggagaaaauaauauugaacguaacacuauucggugacgacaagaaacuucuaaagaaaagacuugcagcucuguauccaaacauagaugagaaaagccugucaagaauggcaacguuuaacuaccgagauugggggcgauugucuaagaaauuccuuucagaaauaacaaguguagaucaagaaacgggagaacuacguacuauaauacaaugcauguacgaaacacaaaauaaccuaaugcaacuauuaucagaaccauaucauuucguagaagcaaucgaaaaagaaaacccaaaaguagaucucgaaucaauaucauaucgcauaguaaaugaucucuacguaagcccagcaguaaaaagacaaauauggcagacccuucucgugauaaaagacauaaaacaagugaugaaacaugacccaaaacguauuuucauugaaauggcuagggaaaaacaagaaucuaaaacgacaaaaaguaggaaacaaguauuaagcgaagucuacaaaaacgcugaaaaauacaaaaacuuauucgaaaaacuuaauuccuuaaccgaggaacaacucaggucuaagaaaguauaccuguacuucacacaacuggguaaauguauguacacaaacgacgcaauugauuucgaaaaccucgucuccgcuaacucuaauuacgacaucgaucauauauauccgcaaucuaaaacuaucgaugacuccuucaauaaccuuguauuagucaagaaaggcauaaauaacgacaaaagugaucgauauccaauugauaaaaacauaagagaugacgaaaaagucaaaacccuauggaauacguuacuaucaaaaggacuaaucacaaaagaaaaauucgaaaggcuaauucgaucgacaccauucucggaugaagaauuagcgggauucauagccagacaauuaguugaaacacgacaaucaacuaaagcaguagcagaaauauuaucuaauugguuuccagaaucugaaauaguauacucaaaagcaaaacacauuacuaacuucagacaagacuucgaaauacuaaaaguccgagaacuaaacgauugccaucacgcgcaugacgcauacuuaaacaucgucguuggaaaugcguaucacacaaaauucacuaacucgccauacagauucauacaaaacaaagcaaaccaagaauauaaccuacgcaaauuacuacaaaaagcgaaaaagauagaaucaaacgggguaaucgcauggauaggacaaagugaaaauaacccagggaccauagccaccgugaagaaagucaucucucgaaauaccguauuaauuucacggaugguuaaagaaguagacggccaauuauuugaucaacaacuaaugaagaaagguaaaggccaaguaccaauaaaauccagugacgacagauugauagacauaucaaaauaugggggauacaauaaagcuaaaggagcuuacuucguauucauaaaaucaguaagaagagguaaaacaauaaagagcuucgaauauaucccuguacaccuagcgaagaaauucgauugcaaccuagaacuacucaaagaguaucuagaaucagaaaaagaccuuaacaacguagaaaucuuaaugccgaaaguaaugauuaacucgcuauucaacuauaacggaagccuaauacguauucccggaagauacgacaagaaaucccuacucauaaacguagacgugccuuugcuccuggaaucacagcauauuaaacaacuaaaaguaauugaaaaauacauguauaagaaaagaguauccaaaaauucgaauauauugcuuacaaaauucgcaucagaucaacuaaaagaucuugaugcacuauucgacguccuauccuacaaacuaaacgaaaauauauauaacguaauuaaugauaaauacgacaaauuagucauaugccgagacaaauuuauaucucuagacacagaagucaaaugcgaaaugauauucgagcuacuccaucuauuccaaugcaauucacaauuagcaaauauaacaaaaauaggagccacaagcaaauucgguucaauaucuaugagcaaaaacuuaaaagagaaugauaaaauguccauuauacaccaaucaccaucuggaauauucgaacacgaaaucgagcuaaccgcacuuuga

SEQ ID NO: 8826 - RNA, 4053 nt, Artificial Sequence
  Cas9 variant
augaaaagaauuuuaggucuugaucucggaacugcaucaauaggaugggcuuuaguuaaugaaagcgaaaacgaaaaagagaaaagcgaaauaauaaaacuaggaguccgagucaauccacuaacaacagaugaacaaacagauuuugaaaaaggacgaccacuaaguguaaacgcugauagaacauuaaaaagaggagcccgaagaaacuuacagagauuuaaacaaagaagaaaaaaucuaauugaaauauuaaucaagaaaggguuuauaacaaauauuucucuacuuacggaaauuggcucaaauacaaccuaucaaacccuugaguuacgagcuaaauccguaaaagaaaagaucgaaaaagaagaauuugcacguguacuauuaacuaucaauaagaaacguggauacaaaucauccagaaaagcaaaaaacgacgaggaaggaucacuuauagacggaauguccguugcaaaagagcuauacgacaauaauuuaaccguaggacaguacguauaucaacuucucgaaaaaggaggcaaauacaucccagauuucuacagaucagaucuccaaaaugaguuugacguaauuuggaauuuccaaaaagaauucuaucccaacauauugacaggcgaguuauacaaaaaauuacaaggccaaggacaacaaaacucaaggaaacuauuccuagccauucaucaaauauauacugcagaaaacaaagguaaaagggauacgguuaaaaagcaacacuauaaauggagaaacgacgcgauaaacacucaauuacuaauagaagaaguagcguaugucuuaguagaaauuaacaacaaucugaacaaauccucagguuacuugggagccaucuccgauagaucaaaggaacucuauuucaauaaagaaaccguaggugaaaaucucuauaaacagauacaagagaacccacaaacaucucucaaaaaucaaguguucuauagacaagauuaucuugacgaauucgaacaaauaugggaaacgcaggcaaaguucuacuccgaacuaacaaaagaacuuaaagaagaaguucgcgacguagucauauuuuaccaaagaaaauugaaaagucaaaaacaucuaauaucugaaugcgaauuugaaaagcaccacaaggcaauaccaaaguccucacccuuauuucaagaguucaaaauauggcaaauccugaauaacauagaauucaaacacaaaaaaacaaaagagcuaaaaauccuaagugaagaacuaaaagaaacacuauucgaagaacuaaacaucagaggaaacuuuacaucagacgcaguccuaaaauuugucaaacuugacaaaaaagagugggaacuaaacuauaagaaagguauagaagguaacagaacgaacgaaguacuguacaacguauaccagaagauugccgaauacgaaggcuaugguuucgauuggaguaagaaaucagcugucgaaauuaaggaagaacuaaacacaauuuucucagaaauagguauaaacucuaaaauacuagauuuuaacccagaaaucagugguaacgauuuugacaaacaagaauccuaucaacucuggcaccuguuauacuccgcagaggaggacggauuuuuaaaacaaaaacuccaagacaaauauggauucaaaucagaguacgccaauaugcucgcaaacgugucauuccaaucagacuauggaaguuugucagcacgugcgauaaaaaaaauauuacccaaucuaauagccggccacgaauuuagcgaggcauguagccuaucugguuacaaucauucgaacagucucacgaaggaagagcuagcuaaucgaccacugaaaggaaaguuagaacuccuaaaaaaaaacagccuucgaaacccuguaguggaaaaaaucuuaaaucaaaugguaaaccuaguaaaccaaguuaucgaaucauauggcgaaaucgacgaagucagaauagaacucgcacgugagcuuaagaaaucagcacaggaacgagcacuuaugacuaccaacaucaaugcaucaaaaacaaaauacgaaagcuucagaaaauuacuacaaaaggacuuuggaauaaaaaauccaacucgaaacgacauaauaaaauacagauuauaugaagagcuuaaggcaaauaaguaccauacaaucuacacaaacaaauacauaccgagggacaaacuauucagcaaagagauagauaucgaacacauaauuccgaaagcaaaacuguucgaugauaguuucucaaacaaaacacucgcauuucgaaagccaaaucaagacaaaggaaacaugacagccauagauuacauauuaagcuaucaaucaaaagauaucgacaacuauaaaucaagaauagaaaaucuauuuaagaauggaaaaggagacauauccaaagcaaaaagaaacaaacuccucauggaagaaaaagauauaccagauggauucauugauagggaccuaagaaacagccaauacaucgcaaaaaaagccaaacaacuccuggaagaagucauccgaacuguaaacacaacaacaggaucagucacgaacaaauuaagagacgauuggggccuaauuaacgucaugcaagaacuuaacaugccaaaauucaaagcaauagacgaaucacuaaucgaacaaauagaaaaaaaagacggaacauuuaaaacuaggauaaaggacuggucuaaaagaaaugaccaccgacaucacgccauggacgcucuaacaguugcuuucacgcguuacaaucauauacaguaccuaaacaauuuaaacgcuaaaucggauaaaaaaggcgccaucuacggcauccaagaacucgaaacauacguaaacucaaaaggcaaacggaaguuuaucaaaccaaugcacaacuuccgugaggaagcaaagaaacacauagaagacauacucauaagcuuuaaagcgaaaaacaaagucguaacaaaaaauaucaacaaaauaaaauccaaagauggauucauaaagaaaguacaguuaacgccacgaggucaacugcauaaagaaacaguauacgguaaaauaaacgaagucgucguaaaggaagaaaagauuaacgcaaaguucgaccuagaaaagaucaauaaggucacaaaaccuauauaucgaaacgcucuacuaaaaagauuacaagaguuuaacggcgagccaaaaaaagcuuucacaggaaaaaauucucuaagcaaaaauccgaucuaccuagauguagcccaaaccaagacguuaccagaaagcguaaaaguacaauuuuuugaggaaaacuacacaauacgaaaagaaaucuccccagacuuaaaaauagauaaaauuaucgacaaaggaauacaaaggauacuacuaaaaagauuagacgaauucaaugguaaaccgaaagaagccuucuccaacuuagaaaaaaacccaauuuggcugaauaaagaaaaaggcauugcuaucaaacgaguaaaaauaaaaggcguuaaaaacguagaaagccuccacaauaaaagagaucaccucggaaacgagauccugcaaaaaggaaaaucagcaccaaaugacuacguaucaacgggaaacaaucaucacguagcaauauaucaggauaagaauggaaagcuacaagaaaaaguuguuucauucuacgaagcgguagcaagaguuaauaacaaauugccaaucauugaucaagacuucaauaaagacuuaggguggaaauuccuuuucacaaugaaacaaaacgaaauguucguauuuccgagcgaagauuucaaaccacuagaaacagaccuaauggacaaaaaaaacaacagcaaaauuagcaaaaacuuauucagaguucaaaagcucggaaacaaagauuacacauucagacaccauuuagaaacaaaaauagaagacaucaaaaaacucagagauuucacauacaucagaaaaagaaaccccgaaucaaucaaaaauauuauaaaaguaagaauaaaccaucuuggcaacauaguacacguaggcgaauacuga

SEQ ID NO: 8827 - RNA, 4056 nt, Artificial Sequence
  Cas9 variant
augagcaaaaaauacuauuugggauuagacauuggaacaaacucaguagguugggcaguuacagaugaaaacuauaauuuauguaaauaugcagguaaaaggauguggggaauaagauuauucgaaggaggcgaaaccgcugaacaacgcagaaucucacggucaaauagaaggagauugucacgaaaaaaacagcgaauagacuuacuacaagagcuauuugcagaagaaauagcgaaaauggaccccacauucuucaucagacuuaacgagucacgucuacaccuagaggacaagucaaccggagagaaauuuccuuuauuucgagauaaagauuauacagacauacaauacuacaaagaauauccaaccauguaccaccuaagaaaagagcucauagaaaauucuaaaguacacgauauaagacuaguauauuuagcaugucaccauauacucaaaaauagaggccacuuccuaauaaacggcucauuuagugacgucaaaaaacuaagcucagucugugaaucgauguuaaacucauuuaacggaaucaguaaauaucaaauagaaauaaacgacauagaaagauuagaggaaauucuaagcgaucgaaaaaaacaaaagucagucaaagcuaaagaauuaauucaaauauuugaauguggaccaugugaggacaagacagacgaaaaaacaugcaaagcaauaguuucaaacuuaugcaaauggcuaaccggacuuaaaggaaauaucaauaguauuuuugacaugcaauucgaagaaauagauacuagcucauucagcuucacggaaccaaaauacgaagauaccauuuccgcagcacuugaagaaaaauauccagauuaugccgacguaauacaaaaaauaaaagcaguauaugacuggucgguacuugucgaaauaauggccggcgaagauuaucuaucauucgcaaaaguaaaugcauacaacaaacacaaagaaaaccucugcauacuaaaagaaguuauaaggaaauauugugauagugaaauauaccacaaauucuucaauggcuuugacgagaaaaaugguuacggaaacuacauagguagcauauacaaaaauggccacucauacgcuaugaaaaaaugcagcacggaggacuucuauaaaacauuggggaaaauacuagauaaaauacaaccagaaaaagaagacgaaaauguauuggaagaacuaaaaguagaagucaaaaaucaaacuuuauuaccacuagcaagaacaacugcuaacggaacuauuccaaaucaaguucauauacaagaauuacgugcaauucucgauaaugcaaaaaaauacuuaccguuccuaaaugaagaagaugaguauggaacagucgcggaaaaaauaauaucgauagcaaaauucaggauuccuuacuauguaggaccacucucgacccgacacaaagaacaaggcgccaacucauggauagugaggaaacaagaaggccguaucuauccauggaacuucgaagaaaugguagaccuagaacagucaaacaaagaguuuauccaacgaaugacuaacaaaugcacuuaucugaucggugaagacguguuacccaaaaacucccuguuauacucaagauacaugguguuaaaugaacuaaacaaccuuagaauacgaggcaauaaaauaagcgucaagcuaaaacaagaauuauauaaagaauuauuuugcaccaaggcaaaagucacaggcaaaggacuauuuaauuaccucaaaaaagaagaugaagaacuagcacucgaagauauaucgggauucgauauagacuuuaaaucgucauuaacaagcuauuuagacuucaaaaaacaaauacuuggcgaggaaaucgaaaaagauaaguauaaaggaauaguagagaacaucauuaaauggaaaaccauuuacgaugaugacaguaaaaugaugaagaaaaugauagaaagagaauacccaaacguauuuagcaaagacaaaauaaaaaaaauuugcagguucaaauacucugggugggggaacuucucccuaaguuuuuuaaacgguauacgaggagcagaccgugaaacuggcgaauccuucacaauuauagaggcacucuggaaaacuaauuacaacuuaaugcaacuucuaagcaagcaauuuacguuucgcgaagaaauagacuuaauaaacgcagaaaaagucggaaaaauaaacaaaguaaguuacgacaauacaguaaaagaccuaauugucucacccgcaaacaaaagggcuaucuggcaaacgguacaaauaacugaagaaaucaaaaaaguuaugaaaugcgaacccgaaagaaucuucauugaaauggccagaggaggagaaaaagaaaaaaaaagaacgguaagccgaaaagcacgcuuguuagaacuuuaugcagcaugcaaagacgacguaagagauuggaccaaagaaauagaagacagagaagaaagagaguuuaacucaaagaaauuauaccuguacuauacacaaaugggaagaugcauguacucuggagaagaaauaaauauugaugaauuaaugcaaaaaaauucaaaaugggacauagaucacauauacccacaaagcaaaaucaaagacgacagucuagacaauaugguucuagcaaaaaaaguaauaaacaauucgaaacaaaacaaauugcuaagcagcgacauucggauaaagaugaaaaaauacuggaaugccuuauacaaagguaauuucauuucaaaaaaaaaauacgauagacugacucgaaccgaagauuucacgaaugaggaguuaaguggcuucaucgaaagacaaauaguugaaacaagacaaucaagcaaggcgguagcagaacuccuaaauagacuauaugaacauucggaaauaguauaugucaaagccggauuaguaucagacuuuaggcacgauaacaaauuauuaaaaucacgaagaauaaacgauuaucaucaugcaaaggaugccuuuuuaaacauaguugucggaaacguauacaacgcaaaauuuacaucgaacccccguaaauggauaaaagaaaauaggggaacaaauuacucaauuagacgaguauuugauuacaacguaaaaagaggaaacaccguagucuggcaaggaguagaagacggcggucacucaauugaugagauaagaaaaacgauggcuagaaacgauauccucuacacagaauauacauauugcgauaaaggcgaacucuucaaugcuacacuaauaaaaaaagggaaugauaaggccauaaauuuaaaaaaagccuuagacucagucaaauacggaggguacaauucaccaaaaacaagugcauuugcuuucaucgaauucgacgggaaaaagaaagaacguaaaaaccauauagucgaaauuccaguauauaucgugaacauagcaaagagacagccagauacaauaaaagaguaccuagaacaaaaaaaggguuacaaaaaugucgucguuaagaaauacccaauaaaaaaaaaugcacuaauaaaaauagauggcuacuuagcacgucuacggggcgcaaaugaaacagacauccuacuaaaaaaugcuguacaauuaauuuuaaacgacaaauauuaugaaauaauuagacgaguagaaaaauauuuagaauacaacguaagauaugaggcggaaagcauguuugaaggauuugaccacgcggaccucaacucauuauacgacgagcuuacaucgaaauuagaaacaagcauauauaaaaaaagaccagccaaccaacuaaaugcacuagaaaaaggaaaggaaaaauucaaaaauauacagacucuuagagaaaaagcucaaauuauaaaagaaauguuaauuauguacaggugugaugccgcuacaguagccaaccuaaaagcaaucggaggaagugcaaacgccggaaguaugaaaauaaagaaaaacacgcucacaagccgaagcuuaguuuuagugaaucaaucaauuacaggucuuuucgaaacugaagaggaacuaguauga

SEQ ID NO: 8828 - RNA, 4056 nt, Artificial Sequence
  Cas9 variant
auguauaagaaauauggaaucggauuagauauaggaacaucuaguauugguuggucagugguugacgaauauggacauauaaucagaguaaaaggacaaacaggcuuaggagugagauuauuccgagaaggacaaccggccgccgauaggagaacguucagaacuacacguagaagauuagggcgacgccgcuggcgauuacgacuacuaagagaaaucuuugauccauacauagcugcucaggauccuaauuucuuugcccgacaaaaagcauccgcgaucgcaccaggagauaguagauucaaagcaguauacagacuuuucaaugaucagaccgaccgccaauuuuaugauaaguaucccacugucuaccaucugcgacagaaacuuaugaccgagaaaagacaauucgacauuagagaaauauaucuugcuguccaucauaucguaaaauauagaggccacuuucuaaccggaggcgcagcgaaaaacuuuaaaccaggaaaauuagaucuaaauacauacuuugcaacuauaaacgcacaacuagcugcaaucuuuauggacucccaagucgaacuuccacaacuugauugggacgcaguagucagucuucucacuaacgaccaagaauccccaagugauagacaaaaagcguuaacaaaaaugcuaguggcccaaggagaugcaacccagaaaagauucuacacagaauuuucgaaagcacuauuagguuuaaaagcgaaauuauacguucuaacgggauucgaaggagacaaaacagaccagaaagcauuaacacuaagucuggaaacauuagacgaucaucaagaugaugugacgcaacuacuaggagacgaacagagacaauuaguggaacuccuagcacggguacaaucagccauacaauuagcgauaauaauaccaaacgguaaaacauucagcggucaaaugguacagcaauaccaaacacacuaugaucaacuacgccuauuaaaggacuacagagaacaacuaacugaccaaaagcaccgccgugcacuuaaacaagcguaugccgacuauuuagcaaacgaccaagaucaggaugcucuaguaaaagcagucgaaaagguauuaaaacaaaaucaaccucugucaacuguuggaguccgguuacaaacagccaucgaugccggagauuuccuucccaaacaacguacuaaagccaacucuguaauuccacaucagauacaucaacaagaacucgaccgaaucauugaagcacaaagcguuuauuacccuugguuggccgaagaaaaucccgucgccgcacauagaagcuacgcaccauacaaacuugacgaacucguggauuuuagaguuccuuacuaugucggcccacucgugcaaccacaggcagacaaagcugcuaaggaaacaaaauuugccuggaugacccggaaagaagcccaaucaacaacaccuaucacacccuggaauuucgaacaagagguugaucggaaugcaucugcaaaugcuuuuauacagagaaugaaaacuacagauacuuacuuacuaggagaagacguccuacccaaaaauagucuacuuuaucaacgcuuugaaguacuaaaugaguugaacaauguacgcgucgauggaaaauuacugacuauagcagaaaaacaacgauuauuucaagaucuuuucguugacaggucucaagcauccguuacuauagcacaguuacaagcgaaucuuaucgcucacggagcugccaaagauagagucgaaauaaaggguuuagcugacccaaaacgcuuucucuccucgcuaacaacuuaccaugauuaugcacaaauuaucccagaagcucuugaacaaccagauaaacgagcugauauagagaaaauuauaaauuggucuaccauauuugaagacacgucaauuuucaaagaaaaauuacaggaaauagcaugguuaacuccagaccaacgaagacaacuaagccagaaacgguacagaggauggggacaacucuccgacaaacuucuaacacaacuacgugacgcaacaggacaaagcgucauggaccuauuauggacugaaccaaacaauuuuaugcaaauaaucaggaggacagaauuucaacaagcgauugcacgagugaaucaaacagauuuaaaacagcaagacuuagccaccacaauaaacgaucuauauacaucuccacaaaauaagaaggcaauaagacaaguauuauuaguagucgcagauauacaaacugcaaugcacgaaguugcaccuagcugguuauucauagaggccgcaagaggucccgaacagaauccuaaacgcaaacuagcacgacaacaacaacuacuugaagcauacaaaacaucagcgaaagaaauuguaaacgaagcggucaaggaaaaguugcuaucugcaauagaugaucaucaaaaauuugaagaucaaguagucuuauauuuucaacaaaauggacuagauauguacaccggaaagccauuagacuucgaaagacuuucaaaauaucacauagaccacauaauuccacaaaguguugucaaagacgauucauuagauaacagaguacuaacaacaccagaggaaaacgaaagaaaaggugccagggucccagguccauuauaugcaagucaacagggacgauggagauuacuucaacgggcaggguuaauaucccaaagaaaacuagaccaucuacuauuaaggccagaagaguuagaccaacaagcaacagguuuuguggcaagacaguuaguagaaacacgucaagucauuaaauuaauaacuaauauucugucucagcaauacgauccugaacaaacgaagcuaguaucuguaaaagcaggcuuaagccaucaauuucgaacucgauuaaauuuacccaaacuacgugaguuaaaugauuaccaucaugcccacgaugccuaucuagcagcccgaauuggaacauaucuccuacaaagauacccaaaccuugaaagauucuuuguauauggacaguaucagaaaacuagguuugauuuaaaacgacauuucaacuuuauuggagaaauguuaaaagguaaaccagaagacgccgucaucgugaaggcgccucacucggagacaguuaucugggacaaacaagaugaaguaaaacaacuaaagaaaauaauggaauaccgacaccucuuagucacccacgagguauacgacaaucauggagcacucuucaaucaaacaauacauccagcgaaaaauccuaaaaauagaaaauuaauaccaagaaaaaccacacagucgacagaauuauauggagguuacagcggcgaaacaacgggcuaccuagcaauugcaagaacuguaacuaaaaacaaaauaucauaucaaguccuaagaguaccaacaagauuagucggaagauugcagaggucaucagaguccgcacaaagacaaauccuaaccgauugguuugcgccauccuuuguaagcagaggcaaacaacaaccauuugaaauaguacuaagacauguauucaaaaaucaaacagugauugaugacauacaugaacaaagccaccgauuuggacuacguucagauacuuauuauugcaaucaacaacaacucguuuuaucauuagaacaacaaagaaugauaaucgaucaaaaacuaaauaauacaaauaaacuuaugguaguauaugaggcaguaugcgaccaaguggcaaaauacuucccccucuauagaaugaaccacuuuaaagaaucauuauuagaagcuggaccaaaacuagcagaacucccaaucaacaccguacaauccaaaaauggaaaacuuaaauugggccagcguucaguacuucuacaaacaaugcagggauuacaugcaaauccagaaacaaaagauuuauccaucauuggauguccaaaauacuucggcaaacuucaaguaucaucaggcaucaaacuaacagagaacgcgguauuaauccaugaaucuccuacaggauuguuucaaagaaggguaagauuaucagacuuguga

SEQ ID NO: 8829 - RNA, 4056 nt, Artificial Sequence
  Cas9 variant
augaaaauauuaggucuagacuuaggcacaaacucaaucgguugggcaguuguaaacgaagcagaaaacgaaagagaaaguucaaguauaauaagacuaggaguuagaguaaauccauuaacuguggacgaacaaaauaacuucgaaaaaggaaaaccuauuaccacaaaugccgaucgaacucucaaaagaaguaugagaagaaacuugcaaagauacaagcucagaagagcaaaucuuguaucacuauugaaaacacaaggauggauaaccgacgaaacauuacuuagugagcaagguaauaauaguaccuucgaaaccuaccgccuaagagcagaagcagccacaaaagaaauaacuuuagagcaauucgcaagaguucuauuaaugcucaauaaaaagcgaggauauaaauccucacgaaaaaugaaacaugacgaagauggauccuucguaaauaacuuagacauagcaagagaauuauaugacuccggccuaacaccaggacaauacgcuuacaauuuauuaaaagauggcaaaaaauacauaccugacuuuuacaggucagaucuacaagaagaauuagauaagaucugggcauaccaguacgaauaccaugaaaauauucuaacccauagcuugaggagugcaaucauugaccaaucaaaaacggguacaaccaaaaucuuccugaaaacacacggcauauucacagcagauauuaaaggcaaucgaaacgagagaaauaaacaauuauuugaacuaagauguggagcucucgagagagcgcuaacagcggaagaauuagcgacaguaauugcugaagugaauggacaaauuaacucaucuagcggcuacuuaggugcuaucagcgacagaucaaaagcacuauuuauaaaccaucaaacuguaggccaauacuuaaugcaacaacuagaucgcgacccaaauaaaucauuaaaaaaucaaccguucuacagacaagacuauuuagacgaguucgaacaauuaugggaaacacaagcacauuaccacccagagcugacggccgcuuuaaaacaugagauuagagauauaaucauauucuaccaaagacgauuaaaaucacagaaaugguuaguagccaacuguccauucgaacaccguaaaguaugucccaaauccagcccauuguuccaacauuucagaauauggcaaguuuugaacaauguuacaguaacaguagacaauaaaacguauguacuaaacgaggagcaaaaaucaauucucagcaaagaacuacuauacaaggaaaagaucaguaaaagagacgcacucaaaaugcuauucguuaaagcaaaggguguagauaugaauuucgcaucacuugaaggugacagaaccaugagcaacuuauuaaaagcagcacaagaaauaguaucaauaucuggacauggugauuacgauuuuggcaaaaugcccgcggacgacauacauaacauaauucgcaguguauuugguggauuaggauuugcaacagauuggcuaaaccuagauacagacgcagacgaccuagaacaagagucacaaaugagauuauggcaccuaaucuacucauuugaaggggauaacucgacuaccggcgacaccaaauuagucgagagauuaaugucucucuuaaaccuaccacaggaauaugcaagauuauucgcaaauguacauuuagaagaugacuacugcgguaucuccucaaaagcacucaaaagaauacuaccguucaugaaagccggucacaucuauuccgaagcgugugcacuugcaggauauaaacauagcgaacaaagcuugaccagagaagaaaacaaaaauaggccacugaaagaucauuuagaacaauuaccaaagaauucccuaaggaauccggucguugaaaaaauacugaaccaaauggucaacguaguaaacagcaucaucgauacauacggaagaccagaugaaauaagaauugaguuagccagagaauuaaaaaacaaugcucuaggcagacaagcaauuuuugaagcaauaaacagaaauaccaaagaaucagaacguauucaacaaauauuaaagaaagaguuuggccuaacucacguaagccgcaaugauauaaucagauacagacuauaccaagaauuaucagguaacggauacaaaacauuauacagcaacauuuacauuccacaagagaaacuauuuaguaaagaaauagauaucgagcacauaauaccccaagcccguuuauucgacgacucauucagcaauaaaacucuagaauacagagauguaaauaucaaaaaaagcaauacuacugccauagauuucgucaggaacgaauacggagagaacgaaguggagcaauacaagaaaagaguaaacgaucuccuaaagucaggagcaaucucacaagcaaaagcaaaaaaacuaaaaaugacagaagcugaaauacccaacgacuuuaucgaaagagaucugcguaauacucaauacauaucaagaaaagcccaagagauguuacgagacgucgcaagaguagucacagcaaccacaggaucaguuacggauagacucagacaagauuggcaauugguagacguaaugcaagaacuaaacugggauaaauacgaacgacaagguuuaacuacaguaaucaauggaagagauggacaacaaauuagacgcauuaccgacuggacuaaacguaacgaccaucgacaccacgcuauggaugcauuaacgauagcuuuuaccaaaccagccuauaucaguuaucuaaaucaccuaaacgcaaggucagaggacgacauucgauccauagaacgaagauuccuagaaagagacgcuaacggccaccuaagauuuauuucaccaaucgcucacaauuuuagaagcgaagcaaaaagacaucuugaaaugauauuagugucaaucaaagcaaaaaacaaaguugucacacgaaacaauaacacaacaaaaacaaaaggcggcagaagaaauaggauacaacuaacaccaaggggacaacugcacgaugcaacaguauacggaaguauucucuuaccucauacgaagacaauagccguagauggaaaaaugacggccgaaauaauaggccaaguacaaaacccaguauuccgacaagcacugagucaacgauuagaagcaugcgguaaugacccaaaaaaagcuuuuacagguaaaaacaguuuagaaaaagccccaguauggauugaucaagcucauacugagcaugucccagcagagguaacaauucaacgucuagaaccccaacacacaauccguagagcuguaaauaaagaucuaaauauuaauaaaguccuagauaaaggcauacaacauauccuccaagcgcgcuuagaugcauauggcggcgaugcagcgaaagcauucgcuaacuuggacaacaacccaauuuggcuaaaccaagaaaaaggaauagcuauuaaacgaguaacgacagccgagaauauaagcggagaaccccuacaucacaaacaugauaaagagggaagaccaauucucgauacaaauggaaagccaaugccaucagacuuuguucgucucaugaacaaccaccacguagcaaucuuucaagaugccgaugggaacuuacaagaacauaucguaucauuuuaugaggcaguagcuagaguaacagaauuaggcuuaccaguuauagacaaagaauauaacaaagauaaagguuggcaauuccuguuuacacugaaacaaaaugaguauuuuguauucccaaaucccgcacaaggauucaaccccgaugaaauagaucucacggacgagcgaaauuacagccgaauaaguccuaauuuauauagaguucaaaaaaugucgucaaaguauuacguuuucagacaucauuuagaaacaacaguugaagauaaaaaggaacuacaggguauaacuuggaaaaggauccaaucacugaacaacuuaaaaggaauaguuaaaguccgcauagaccauaucggcaggauuguacaaauaggugaguacuga

SEQ ID NO: 8830 - RNA, 4056 nt, Artificial Sequence
  Cas9 variant
auguuuucacaacaaaacaaccuuuauugugaaucuuuaucgaaacuauacuauaacauaaccaaaaacuuucuaucuaaaaacgaagucugcagaauauaugaaaucuucuucugcagcauccuaacauacuuccugaagaaauacaaucaugauauauucaagaaaucuucuaccaugaaaacuauacuaggauuagaccuagggguaacaucuauaggaugggcagucauaguaacagaugaugacaauaccccaauaaaaauacuaggcaugggaucaaggauuauaccucuaagcacggccgacaaagaagaguuccagaaaggucaagcuauaaguaaaaaucaaucgagaaccauagcuaggacucaacgaaaaggcuacaauaggaaacaauuaagaaaagaggaacuuaagaaaauauuaggagaacugggcauuacaccuucaaaagaauuacuaaacuuaccaucaauugaauuguggaaacuacgugcugacgcagcaucaggcaacgccccacuaagcgcggaacaacuagguaggauuuucuacaugcuaaaccagaaaagagguuacaaaucagcaagaagcgaagcaaaccaagauaagaaagauaccgauuacguagcagccguuaaaggaagacaccaacagcuaaaagaaaaagggcaaacaauaggacaacacuucuauacggaaaugcuaacauuagaagaaaacucuggccacuuucaagucaaaaauaauguauacccaagagaagcauaccuagaagaauuuaacgcaauuauagcugcacaaaaaccacaacacgcuuuccuuacagacgacguaguagacagacuaagagaugaaguaauauucuaccaacgaaaacugaaaagucaaaaagguuuaguaagcauaugugaguucgaaggauuugaaagaacauucuuugacaauguaaaacaaaaagauaaaacaauuuucacaggacccaaaguagcaccaaaaucuaguccacucuuccaacuaugcaaaaucugggaaacaguaaacaauaucaacuuaaaaguuaaaaauacugacgguaguaaaaauaaaugggcagacuacguaccgacacuugaacaaaaacaagaaauaauagaacaucucuucaaaaaugcaggcauaucauuagacgcucuccgaaaaauacuagguuuuaacaaagaugaaauauucgugaacaaacaaauagaaaaaggucuacaaggaaacacaacuuacgcggaaauacacaaaauacugggagacuccaaacccgaacuacuaggauucaauauaaauauagaaccaucaaaacauucggcauuacucguagacaaaagaacaggcgaaauacuggcugaaaaagaaggacaacaaguuuccgccgaaauagaaaaagaaaacuuuuaccagcucuggcauacaauauacucaauaaaagaucuagacgaaugcgcagccgcgcuuaucaaacgauucaacaucgaucccaacguagcagcccagcuagcaaaaauagauuuuaguaaaggugcuuuuggcaacaaaucaaacaaagcuaugagaaaaaucuuaccguaccucaugcaaggcuacaauuaugcagaugcguguaguuuagcuggauacaaucauagcgacucgcaaacaaagaaagaaaaagaggaaaauguuguagacgauaaacucaaacugcucgagaaaaacaguuuaagacaaccaguuguagaaaagauaauaaaucaaaugauacauguaguaaaugccauuauugacaaauauggaaaaccagacgaaaucagagucgaacuagcccgugaucuaaagaaaucaaaagacgaaagaaaugaagcagaacuacaaaacgccuccaacaagaaacuaaacgaagaaguagcuaacagacuuaaagaacuaggacugccagucacaaaacguuucguucaaaaauacaaauuuauauuuccaguccgcgaucguaaaauaaaagaagcacaauuaguaaaucaaugcaucuacugcggagaaacauucaacgugacagaagcucuauccggggauaauuuugacguagaucacauuauccccaaaucaaugcuuuuugaugacucacaaacuaacaaaguguuaguucaucguaaauguaacgcgaaagacaaauccaacaagacagcauaugacuucaucgcggcaaaaggagaaaacgaauuagccauuuacuuagacagggucgacgacugguuuaaaagaggagucuuaagcuauggaaaaaugcaaagguuaaaaguuagcuaugaacaauacgcagaaagaaaacaauuaaagaaagaaacagaagcagacauaaaacuaugggaaaauuuuauagaacgagaccuccggcaaacacaauacaucgcgaaaaagucgaaagaucuacuuaagaaaauuugcaauaacgucaccguaaccgaaggaaaaauaacugcgcaacuacguaaccuauggggcugggacgacguauuaaugaaccuacaacuuccaaaauacaaagcauuagggcaaaccgaaauaaaagaauggacuagcgaacacggaagacgauuacauaagaaagaagaaauaacaaauuggacgaaaagagacgaccauaggcaccaugcuauagaugcucuggugguagcuuguacaaaacaagguuucauucaacgcauaaauacacuaaacagcucagacacaaaagaugcuauggacagggaaauaaaagcagcuaaagaaaaauacaaugaacuauaugauaagaaacuacuaacagaaacuaaugaacaggucaaaaaccauacagaaagauuuaacaaacuugaaacuuacuuaaagagccaacagcccccgcuauuuacaacaagguauguagaacaggaagcagacaaaaucuucguuaguuucaaggccggcaagaaagcugcaacauacggaauuagaaaaauaaagaaagacgguaagaaaguaguaguacaagagaaaauaguagucccccgaggcgcacuacacgaacagagcguauacggcaaaauuaaaacacaagaaaaagauaaaccucuaaaauauuuauucgaaaauccagaaacaauaguagacaauagaauaaaaauccuagucaaagagagacuugacaaauuugaaggagauguaaagaaagcgcuaacgucacugaagaaagaaccacuauucauagauaacgagaaaaacacauuauuagaaaaagcggcauguuacaccgacgcaacaguauuaaaauauaaacuacaagccuuaaaagcaaaucagguaaacgauauaguugaugaaggagucaaaaggauagugaaagcccgacucgcucaacacaaaaaugaaaaagaagcguucaaagauacaguuugguucaaucaagagaaaagaauacccauagucaguguucgaguauuugcacguccugacgccucaaaacuggcgauaauaaaaacagaugaaaauaacaaaccuauaggauucgccuuaacugguaauaaccaccauaucgcaauauacaaagauaauaccgggaaauuaguacaacacaucugcacauuuuggagcgcuguggaaagaaagaaauuuggagucccgacaguaguuaaaaauacagguacacucuggagcgaacucuugcacaaagaccuacccgggacauuucuagauaaauuaccacaagacgguuuagaacucgaauauucacuucaacaaaaugaaauguuuguauuaggacucccaaaagaaucguucgaagaugcaaucaaaaauaacgaucugccauuacuaagcaaacaccuauaucucgucuggucuaucagugauaacgauuacugguucagacaccauuuagaaacuaaaaacuccgaauuaaaaucuacaacaggcgcaaaagaaucaaaacguuacuacagauuccagucaguagguaccuucacgaaagaaaacccuaucaaaguacaauuaaaucacuuaggugaaauuacaaaaauaggggaaccguga

SEQ ID NO: 8831 - RNA, 4059 nt, Artificial Sequence
  Cas9 variant
augaagaaaagaaaccgagaagaguacuauguaggauuagacauuggaacaucaagugucggaugggcgguugcuacaccagauuaucgaaucccuaaauuuagaggacacaaaauguggggaucuagacuauucgcugaaggcaagcgagcugcugagagaaggcaauucagaacaaauagacgaagacuagcaaggagaagagauagacuccaaauucuggaggaacuauuugcagaagaaauggcaaagguagacaacacauucuuuaugagacucaaagaaucaaaguucuuucuagaagacaaaacugugaaggagaaacauauacuguuuucaacagauaaauuugacgcagaccgauuuuacaaagacaaucccacgaucuaccaugucaggaaacgguuaauggaggaggaaccucaagauauaagggaauuauuucuagcaguccaccacauacuaaaauaucgaggacacuuucucuuugcaggaucauuagaacaaaacggagcaaguauagaggaacucguaagaacgcuauuagggaaacaagguuuagcgauuuuagaugacacuauagauagcaacgaaaugguaaauauauugaaaaacacaggagaaacaaaaucagaucguaagaaagacguacaagaacuauggaaccccuugaaagacaaaguaaagaaagcccaagcugccgaaauggcuggccuaguacuagggcuaaaaagugacaucagcaaacucuuugccaacucagacuauaaggauuuggauuccaguaucaaaaacauaaacuuuagcaguggggacuacgaggagaaaagggacgauuaugccaacaguauaggagacgauauaguccuacuagacacaaugaaagcgcuuuacgauacacuuauuuuaucacaaaucuuacaagguaaacgaagcaucagugcagcaaaaguagaagauuacaauacccacaaagaacaauuaagagcauugaaggcaauacuaaaaccgcauaaaagacuuuauaacgaaauguuuagagaaaacaacaagaaagaucuaucaaauuacguagccuacauuagcagcuacucagaagguaaaagaguaaacagggaagguuucuauaaauauguacaagcagugcuaaaacaaguagacgacucagacagcaaacaagcaauauuagaagcuauacgccuagaaacauuuuuaccacuucuaagaguuaaagauaaugcgguaauaccucaucaaauccaucaagcagaauuagaagccauauuagaaacugccagaaagaaauauaauuucuuaaaugacguauccgaugggguauccgucaaagauaaaauaauacaacucuucacauuccguauaccauacuacguaggaccccuuaacccgcacucaggcgaaacaguagccgaccguaaacaaggaacgggaugggucgugcgaaaacagcgagggaaaguauacccguggaacuucgcagauaugguggacguaaaagcgagcgcugaggcauuuauaacaaaucuaaccaacaaauguaccuaucuaaucggagaagauguacuaccaaaaagaucauuauuauacucagaguucaugcuacuaaaugaauuaaauaugauaaaauaugacggucacgaauugccaguagcaauaaaacaauuauauauagaacaaguauucaaacaagaacacaaaaagcaaacaaagggaaggguucuagacuuucuaaaaagaaacggccuaauaacaggaucagcaaccgccgucauaacaggaauggacgaugcaauaaaaggugaccuacaauccuauagagacaugguaagaauuuucggcgcgggauuugaucacucaauggccgagagaauaauuagauggguaacccuguuuggagaagcaaaagauauucuggaaaauaaaauaagagaaguauauggaaauagcauaagugacagucaaaugagagcuauuaagaaauuaaaauacgcagacuggggaagacuaucucaggccuuccuaauugcagugaaagguugcgauaaaucaggaguagaacgaaauauaauaacaugucuacgagcaucaagccaaaaucuaauggaaauacuaucggaucaagggacuuauauaaaacagauaaaagcauggaaucaccaacauacuacaaacaugauggauacauuagacuaucagcuaguggacgacuuauacguagcaccaaguguaaaaagaucaaucuggcaaucacucuguauaguugaggaauuagucaaaauaaugggacaagcacccaagaaaaucuucguugaaguaacucguacuaaacaagcugagaaaacaaagaaagauaguaggaagaaacgccuaguggaacuauauacugcaauaggaaaagaaggagcagcauggaagaaagaaauugaagcgcaccaagcuggagauuuuagacguaagaaauuauacuuauacuacacucagaugggcagauguauguacaguaaugaaccuaucgcaauggaugcacuauuuacaagcgcuuaugauauugaucauauuuacccccaaucacuuaccaaagaugguagcugggacaaucucguccuuguuaaaucucaacucaacaaagaaaaaucagaucaauauccgcugaggccagcaauccgugagaaaaacaaagcucauuggcaguacuuauguagagcaggauuuauaucagaaaagaaauacgaaagacuaaugcggacuacagaauugacagccgaagaauuaucggguuuuauagcacgacaacucguagaaacuucucaagcaaccaaagccguaacgggauuacuagaacgaauauacacgaacacugaaauaugcuucguaaaagcagaaacaguaucacaauuucgccaccaacacaauuuuauaaaaauacgagaacuuaacaauuaucaccaugccaaagaugcuuaucuaaauauuguuguaggaaacguguaccacgaaaaauuuacuaaaaacccaugggaauuuauagcccguucaacagaaagaagaccuuacaauuuaaauagaauguacgacuucgauuuauuaaaacaaggccggguaauuuggcaagugccaaaaucgcuagaaacaguccaagcuaugaugaaaucaaacgacguaagaaucacaaagaaacuucuaguacaaaaaggagaacuauacgaugcaacuauuacuaaagcccacaaagcgaaagaagggacauacuuuccauuaaaaggcgcagaugcaagauuacgggacguacauagguacggaggauaugagaaaauaaaaauagccuacuauucaguuuuuaguugucgagaaaaagcaagcaauacuauacauacccuaauaaucccaauaccaguauauaaagcuggauuacuacaaacagaagcugauuuaacugccuacgccuggcaaacuaaacagaaaacgaaaccaauaaaagauauauauuccgcaaucacaccuauuuauaagaaacucuguauuaauacagugguaaaaauagauggauuuaaauauuuccuaggaggcaaaacaggggauuacaugugguuagauccugcuauaccgguaguauuagacgagcaagcagcagcauaucuuaaagcaaucaguaaagugggcagagccgacgacguagagaauacugcucaagcaauugacuuaauaacagcugaagcgaaugaagcauucuaugauguauuacuaaagaaaauggaagcgaaaauauucgcaaaagcauaucaaacuauaguggaaaaauuggccucagaaacagcaagagaaagguucagagaauuaagcauaggagcacaaugcucaugcuuauuagaaauauuaaaccucuuagcaaacaacaaaacaacuuuuacauucuuuaaagauaaaaugggaguuacaaugucaagaagaaaacaaccaauggacuuaacaaaacuugaagaaugcauagucuacgaaacaucaauaaccggauuguaugaaaaagcgguuagcuuguuauga

SEQ ID NO: 8832 - RNA, 4059 nt, Artificial Sequence
  Cas9 variant
auggguaaacgauaucacauagggcuugacauagguacuucaucaauuggaugggcaguuauggaugaugauuuuaaaauaaugagaguaaaagguaaaaaagguaucggaguaagacuauuugaagaaggaaagacugcggcugaaagacgaggacaucgaacaacuagaaggcguuauagccgaagaaaauggcgccugaaucuccuugaggaaauuuucgaccccgaaauugcgaaaguugaccccaccuucuuugcgcgauuaaaagaguccaaucuaucaccuaaagacgaccgcaaacaauacuccgggaauuuaauauuuccagaaaaagccaaagaggaaauacgugaauggaccgaaaaauacccgacgauuuaucacuuaagaaacgcauuaaugaccgagaacagacaauucgacaucagagaaguauucuuggcauuacaccacaucgugaaauacaggggaaauuuccuauucaacgggaauuuccaaacaggagaaguuaaccuaucugaucguuuugaugacauuaacagcgcuuuuauaucagcaugcggggaagaggaagcgccucaaauaccaagugaacuguauaacgauauccaagaacuucuauuugacaaaaauacucggaaguuagauaaccagaaacagcucgccaccaaguuaucacaggacaacgauaaggacuggaguacucaauucuccaaagcccucuuuggcuauaagacuaaauuuaagguaguucuccaaucuaaugaagaccuagaugauuuucaacuggauagcgacgaugccgacgacaaaauugcauccauuagugaacaaauagacgaugacagaggaucaauccucgacaauauuaaaauauuauauucaagaauaacacuaaacgaaauugucccugacggcaagacucugucucaaaguaugauagaaaaauacaaucuacaccgagaucacuuaaaagaaauaaaagaccaacugaaacauacugacaacugggucaaauuugacgacuuauacucucaauacguuaacggcaaacuagaaucugauagacauaaaaaacuauccagugaugacuucuauaaaaaagucuugacgcuauucgauggugaauuaaaaacacguguaaaagaauggcaagaaaaaggagaauuucuaccaaaacaaaggacaggaucuaacggugucauaccacaccaacugcaccaaaacgaauuggaucaaauaauagaaaaucagaguaaauacuacccaugguuagcaacucucaacccaaacgaaaaaagacaacgaguagcgaaauauaaauuaagugaacuaguagcguuuagaauaccuuacuacguaggccccaugguaacgaaagaccaaagcgacuuugcauggaugguaagaaaauccgaugaaaaagaaauaacgccguggaacuuugaucaaguaguugacagagacaaaucugccgaggaauucaucaauagaaugaccacaaaagacacauaccuaauaggagaagacguauuaccagccaagaguuuacuuuaugaaaaauuuaccguacucaaugaacuaaauaauauaagaaucaacggcaagccacuaacaaccgaugaaaaacaccaaguuuauagagauuuauuucaaaacgcaaaaaguauaucuaccaaaaaauuccacaauuauuuaguuuguaaauuaaauaaaccaaaccaccucaauauaacaggcuucucagaucucacaaaauuuaacagcucacucgauuccuacauagauuuaaaaaaaauauuugcagaucaaaucgacgaucaaucacuccaagaugacuucgaaaagaugauacgauggagcacaguauucgaagauaaacaaauauucgagagaaaguuaagcgaaauaaacuggcucacugaucaagagagaagugaaguagcaaaacuccgguacagaggcuggggaagacucucaaaaagauuacuagcaggaauacacgaugagaacggucaaagaauuauagaugcacuuuggaauaguccaaaaaauuuuaugcaaauacaggcagaaguagcauucaauaaacaaauaaaugaccuuaacacuaaagaauuaucagacaauaacguagaggacguacuagcagacgccuauaccucgccccaaaauaagaaagcaauaagacaaguacuuuuggucguagaagauauacaaaaagcaaugcacggggaugcuccaacaucaauaucacuugaauucgcuagggaagaacaagaaucaaguagaaccagauccagacgugcugccuugagugcaacuuacagacaaauaucagacgagauaguaucugcuacaguaaaaggagaauuaggaaaagcaaccaguaucagcgacagacuauaccuauacuuuacucagggagguagggauauguacacuggcgagcccauaaacaucgacgaaauuagcaggggauaugaaauugaucacauacuaccgcaaagcuucauaaaagaugacucgcuugacaacagaguauuaguaaaaggcgccaucaacaauggaaaaucagcgaacuauguuauggaccaaagcugggcaccagacagguuagcuugguggaaaaaacuguuagauaaccgacucaucucuagaaagaaauaucaaucacucacauuaacaccagggaaaaucaauaaauacucacaaaauggauucauaaauagacaacuuguagaaacaagacaaguuauuaaacuuguagcaaauauucuaaaugaccaauauaguaacgacgacacaaaaauaauaguaguaaaagcagcgcuaaacucacaguugaggggauuuuuagagcuauuuaaaaacagaaauauaaacgauuaucaccacggcauggaugcauaucuaaguacauucauuggaaacuauuuguacaaaaaauacccaaaacuacgaucuuauuuugucuacggugaauucaaaaaauucucagguaaacagaaucuaaaauccuuuaacuuucuucaugaccuagaagacgacaguauuaacauaauaucaaaugaugauggcgaaauaguagggaaucaucaugagaugauagaagaacuagaaaaagcauaccaauacaaauauaugcuaguaagccgagaagucuuugaaaaaacuggugaccuauuuaacgugaccguuuauagcagaaaagcaaaaaagacccuaauacccauaaaacaagacaaaccuauaaacauauauggggguuauagugguaauaaugaugcuuacauggcaauugugaagcucccaggaaaaaaaggaaagccagauacauauaaaauagucgguauuccacuaagguuugcaggagaauuagaaagagccaaacaacucggagaaagugcguacagagaaaaacuuagcgcagucauaaccccccaauucacaaaagaaaaaaaagauagaaaaacaggcgaaauaacaaaaguaguagaugauuuugaaguuguacucgauagagucccauaucgccaauuauucaaagauagugauaaaugguuuaugcuaggaagugcagcuuaccaauauaaugccaaacaacuaguacuaaacaacgaugauguuaaacuacuaaacgaacaaggcagaaaaaaacuagaacuaccaaacgaaaagcuuaguucggcuuuaaacgauguuuuugaccacaucauacaaaucaugaauucaaaguuugggcuauaugacaaaaacggauuucguacaaaguugacagaagcagcaaguauauucuaugaucuaccacuaagagcagaauacaauggaaacaagaaagucacggacggcaagcuggaaguauuagauaacauauuaauaggacuucacgcagauccaucauucgguaaucuaaaacaauuaaacaugaguacaccauucggccaaaugcaaacaaagggaggaguaguacuuaauggaaauaguacuuuaauauaucaaucaccgaccggacucuuugaacgaagaguaaaacucaaagaccuaaguaaauga

SEQ ID NO: 8833 - RNA, 4059 nt, Artificial Sequence
  Cas9 variant
augaagaaaauccuaggauuagacuuaggaacgacauccauaggaugggcauucauaaaugaaggugaaaacgacaaugaaacuucaaguauaauaaacgcggguguaagaauagucccacugacaacagacgaagaagcagacuucaagaaaggaaacacuauaucaauaaacgcagaccgaacacuaaaacgaggagcgagacgaggauugcaaagauuuaaacaacgacgagacgcacuacuacaaucuuuucggggaaucaacuuuaucagcucaaauuacguauacgcagaaacaggaaaacaaacaacauucucaucuuacaaacuaagagcaaaaucugccacagaguuagucacaaaagaggaacucguacaaguucuacuaaugcuaaauaagaaaagagguuacaaaucuucaagaaaagcaaaaacagcggaagaaggggaugcgauagacggaaugaaaauagcuaaagaaauauucgaaaauaauuuaacaccaggacaauggguauacaauuccuuauccauaggcgggaaauucauaccagauuucuaccgaucagacuuacaaaaagaaguagagaaaauagucagauuucaaaaccaauuccauccagaacaaaugaaugaaaaauuacucgaaaacauucaaggaaaagcaagaaccgucacgucacaauacuucuccaggauucuaaauauaccacuggcugaaaacaaaggcacaagagaagaaacaaaacuacaacacuacaaauggcgaaacgaagcacuaacagaagaacucgaccucaaagucuuagcguucauaauaacagaaaucaacaaucaaauuaaccaaucaaauggcuaccuaggagcuauaucugacagauccaaagaacuuuacuuuaaucaagaaaccguuggccaauuccaauauaaccaauuaaaagaaaacgcacacacaaaacucaaaaaccaaguauucuacaggcaagauuaucucgaugaauuugagaaaauaugggaaacccaaucaaaauucuauccagaacuuaacgacgaacucaaaagcgaaguacgagauaucaccauauuuuaccaaagaaaguuaaaaagccaaaaacaccuaguaucguucugcgaauuugaaaaaggacauaaagcaauaccgaaaagcucacccuuauuccaagaguuccguauauggcaaaacauaaacaauauaguagucaaaaaugaaacaacaaaagaaccauucuuacucggugaagaucuaaagaaagucauagcccaagaauuaaguuucaaagaaucuaugacugacagucaauuacucacauuuugugaucucaagaaaggaacacauaccguuaauuucaagaaaauagaaggaaacagaacgaauacgagccuauucaaagcauucgagaaaauucuagucuuagaaggauacgacgaacuagaucuaaguaaacucgaugcaagcgacaucaaaucaauaauaaaaagugccuuuagugacuuagaaaucagcacagccaucuuagacuucgaccccacaauacaaggaaaugauuaugacaaacaaucauauuaucaacucuggcacuuauuauacuccagcgaagaagacgauuuccucaagaaaucauuaauggauaaauucgguuuuaaagaaucucaucuacccuuuuuauuaaacauaaaccuucaagccgacuacggaucauuaucugcaaaagcaaucaagaaaguauuaccacaucucauggauggucacauauacgauaaagccugcacauuaguaggcuacaaccacaguucuagccugaccacagaucaaaauaacgaacgaguacuaaaagauaccuuggaacuccuaaagaaaaauagcuugagaaaccccguagucgagaaaaucuuaaaucaaaugauaaacguuauaaacgcaauuaucaaagacccggccaugggaaaaccagaugaaauacggguagaacuagcaagagaacuuaaaaacaacaacgaacaacgaucagagaugacaaaagcaauaaacaaaagcaccacagaacacgaacaaauaagaaaauuauugcauacagaguucggcauacauagaguuaccagaaaugacauaaucagauacaaauuauggaaagaaugugacgguauaaguuuguacacaggaaaaccaauagaaccaaguaaacuauucacaaaagacuaugacaucgaacacaucauacccaaaucucgauuauucgaugacagcuuuucaaacaaaacaauaugugaaagacaacuuaacauagacaaaucaaacaaaaccgcauauagcuuuuuccaagaaaaacugucagcggaagaguucgaccaauuugagaaaagaguaaaaucucuauuuggaaaaaucuccagaaccaaacaaaauaaacuauuaauggcaaacaacgaaauaccagaaggauuuauugacagacaacucagagagacacaauacaucgcuaagaaagcaaaggaaauacuacuagaggucucuagaaaugucacagcuacuaucggaucuguuacagacaaacuuagagacgacugggaauuaguagacguuaugaaagaacuuaauugggagaaauacgacaaacuaggauuaacuuacaucgaagaaggcaaaaacggagaaagacuuuauaaaauaaaagacuggacaaaaagaaacgaccaccgucaucacgccauggaugcaauaacaguggcauuuacuaaaccagcauauauucaauauuuaaauaauuuaaaugcccgaaccaacacagacaagaaaggcaauucaauaauaggaauagaaaauaaguaccuuaaaagagauaaaaauaauaaacuccgauucaucgaaccgauaccaaauuuuagagaaguagccaagaaacaacuagagucaauccuuauaaguuauaaggccaaaaacaaagucguuacgaaaaauaagaauguaacgaagaaaucuaacggaacuaaucaaaagauacaacuaacaccacgaggacaacuucauaaagaaacaguauacggaaaauuacaacaauacgugacaaaagaagagaaaauaaacgcaaacuuuacacccgaauauguaacaaaagucgccaaaaaggaauaccgagaagcacuccugaaaagacucauagaaaaugaaaaugaucccaagaaggcuuucacaggcaagaacgcucucagcaaaaacccuaucuacauuucucuagaaaacaacauucuaguaccggaaaaagucaaaauaguauggcuaaagagcgacuauacuaucagaaaagacauaaccccugauuuaaaaauagauaaaguaauagauauagguuuaaaaacuauccuacaaaauagauuaaacgaauuuaauggcgauaccaagaaagcauuuguaaaucucgacgaaaauccaauauggcaaaauaaggaaaaagggauagcaaucaaacguguaacaaucucaggaguaucuaaugcccaggcuuugcauaccaaaaaggaccaucuaggaaacgaaauccuagacgaaaaugggcaaccacuaccgguugacuucgucucgacuggcaauaaucaccauguagcaauuuacagagaugaaaaaggcaacuuacaagaagaggucgugagcuucuuugaagcaguuacucgcaacaaccuuggacuaucgaucaucaacaaaaaccacgaaaaaggaugggaauuucucuuuaguaugaaacaaaacgaguucuuuaucuuuccaaccgauggauuuaacccucaugaaauagacuuacucaacacagaaaauuaccauuuaauauccagaaacauguucagaguccagaaaauagccaccaaaaacuauauguuuaaucaccacuuagaaacuaaauccguugacggagaaaugcuaaaaacuaagaaacaacugucaaaaauaaguuaccauuuuauacaaacccccucuuaccuuaacuauauaauaaagauacgcauuaaucaccucggccaaauaguacagcucggggaauacuga

SEQ ID NO: 8834 - RNA, 4059 nt, Artificial Sequence
  Cas9 variant
augaagcaggauuauuauauaggauuagacaugggaacagaaaguguaggaugggcaguaacugacguagauuacaaucugauuaaaaaaagaggacaagacuauuggggaguauaucuauucgaugaagcacaaaccgcucaaggacgaagagcauuuagaacuaaccgaagaagauuagcccgaguucgucacagauuaaaucuacuacaggagcuauuugauuccgaaauaagugcgaaggacuuuggcuucuuuuacaggcuagagaauucaaaauacuucgacgaagauaaacccgaaauagcaagaggcaaguuccuauuauucaaugauaaggauuuuggcgauaaagaauauuauaaaaacuacccaacaauuuuucauuuacgcaaugcucuuagaacacaggagauaaaggacguccgauuacuuuauuuagcaguccaucauauauuaaaaaaucguggucauuuccuauuuggagaacaagacuuuaauguaaaugaugcauccgauguaagcggggaauuugaaaaaauaaaucguuuucuauccgagaacgauggagcuggauuugacagagagaaaaucccugaaaucuucgaaacacuauguaacgagaaccuagcaaaacgagaacgaaaagaaaaaauucuagaacuugcaggaaacucaaaaaacaaauuauuaggagaggcaguaaaugcaguuguaggucugaauuuuaguuugucaaaaauguucggugaggaccgagacuuccaaggugaaaacaaaaugucauuuacagacucguccuuugaagaaaaguuagccaaagccaggauggcacuggaugaugaugaagcagacuuucuugaaacauugaaaaagguccagaguguagcaagccuacacaacauacuacacggaaaagaauuuauaucugaagcuaaaacugaagcuuacgagacacauagaagagaucucagugagcuuaaaaaauaugugagagaaaacuguccagaaaaauacgcguuaguguucagaagacaaguaaaaaaaggaaaaaaaaacacuucaggcgccgaugaaaaugaaaaagacgacaaaaagguaaacaacuacgcagcauacaucgggauggacaaagguaaaggcuuugaaaaaugcaaaaaagaagauuucuacgcauuucuaaaaaaggaaauaggaauaaacgaugaaucucuacuggcaaaaauugaugaaggcaucuucuuaccaaaacaaauaagcgcagaaaacugugauauaccauaucaaguacaucuugccgaauuaaaagcaauauuagcaaaugcagaaaacuauuuucccuucuuaaagcaaaaagaugaaaacugugagaugacaguaagugaaaaaaucaucucauugaugaaguucagaguaccauauuaugucggaccguucacagauaaagaaacaagauuuucauggaugaucaagaaagaaggauugucaacccaaaaaauuacaccauggaacuucgaugacguagucgauagagacgccucagaaaaaaaauuuauagaacgaaugacaaacuucuguaccuacuuaacgggagaaaaaguacuaccugcaaguaguuuccuauauagcgaauacgcguuucuaaaugaacuaaacaaccuaaaaguuaauggaacaaaggaccuucgugugaaaaauauucuauuugauuucgcaaaaacgaacaaaaaacuaacauuaaaaaaaugcugugaacaguuaguaaaaaacggacuacucccagaagggagcaaagcaagagacguauuuuccggaacagauggugauuuuaaaaauucucugagcagcuauauagauuucaagaggauaauaggagacaaagccgaucuauaucgcgacaugugugaaaaaauuauuuuauggauaacaguaauaucagauaaagaacgauugguuaaaauaauaaaggauaaauacggaacaguacuuagugaugaagaaauuaaaggccugaaagcgcuaaauuauacuaaguggggaagacuaucagaaaaauugcuagacggaauauuugaaacugauagcgaaggcgaaguaggaaaugugucaauuauagaaaaaaugcgaacagacacagaaaacuuuauggagcuacuaucaaacaaacacaauuauaaaagagcaauagaacuagcaaacucagaaaguauaguagaugaaagaguaacauauagagcugucgaagaacuauauuguaguccagccguaaaaagaaguauauggucagcucuaaaaauagucagggaaauagucaaaguacagggacauagcccaaaaaaaauauucgucgaaacaacaagagaaaagccugauguaacuagaaaaggacagcgaacaguaagccgcaaacaacaacuauuagacaaauauagagaaaauuuaaggaacgaaaccgaacuaauaaaaaaaauagaagaaaccgaagacaguaaauuuaauagugacaaauuauuuuuuuauuuuacacaaaugggcaaggaugcauauacaggagaaaaaauagaguucgacgacguauuuaaaacagaaaaauacgauaucgaucauauuuacccaaggaguaagauaaaggacgacagcuuggacaaucgaguacuaguaagaagaaaaauaaaucaaagugucaaaaaagauagcuacccgcuaagugccgagauaaggaacagaauggaaggccuauggcgucaacuuagagauaaaaaacuaaucucugacgaaaaguuuuauagauuaacaagaaguacuccuuuaacugaaaaagaauguggcgauuuuauaaaugcacaacucaucgccacaagccaauccgccaaagcugcaauacagcuacugaaacguaugcuaccugaaucugagauaguguacuccaaagcggguaacguaaaugaauuuaagaaaaggcuagaauuugugaaaauacgagaauuaaaugacuuacaccaugcaaaagacgcauauuucaauaucguaguaggcaauguauucaacacaaaauucaaucauaacccugccguuuuucaaagaaguaacgguacagguaacuaugauuucgaacgccuuuaugauuuugauauaacaaacgcauggaaaaaaggcgaugaaaacagaauaagaucaguagcagaaaaaaauacaugcagagucguccgauucucaaaaacagaaaaaggccaauuuuaugacgcaacaauauacccagcaggaaagaacgacaaacucgcacccguuaaaggaaaagcaccgcuaaacgacacuagcaaguauggaggauacgauaaagaaacaacagccuacuucaugcucguaaaaucaagagacaaaaaaaaaaaagauaaaacguuacugucauuagaaugcguaaccguacuagccgacaaaaauuuccgcacagcagaagacaaauuaaaauacugugaaaaagaacuuggcuugaaggaaccugaaauccugauagagaaaauuaagcuaaacacuuuauuuaaaauaaaugguagcuaugcguggauaagaggaagaacaaacgauaggcuaguccuuugcaacgcaaaccaacuuuggcuagacaacggcagugcaaaagaacuaaaaaaaauauccaaccauuuuagggacguaaaaaaauacaauaacaaagacuuaccaguaagagaggaagaguuuagcaaagaacaaaaucucgcuuuauacgauuuauuuacagaaaaacuagguggaaaaauauaugcaggacuaccaguucaagggcaaauuaaaaaucucgaaaaaggacgcgauaaauucgaagcuuuagaauugaaagaucaauuauucguacucauggagauuuuaaaguucaugcaauguaacaguaugacgucuaauauaaaauuaauaggaggagcagaaaaugcugggaagaacagaauaagcaaacuaauacaagauucugaugucaaaaugauuuucuguaguccaacugguuauuuuugcaaaguuguugauuucaaaagauuccuguga

SEQ ID NO: 8835 - RNA, 4059 nt, Artificial Sequence
  Cas9 variant
augaagaaaauauuaggauuagaccuaggaacaacgucaauaggaugggcauucauaaaagaaccagaaaaagacguugucggaagugaaauuguagacaugggaguccguauaguaccacucaguucagaugaagaaaacgauuuugcuaaaggaaacacuauaucaauaaacgcagacagaacauugaaaagaggagcaagaagaaacuuacaaagauucaaacaaagaagaaacgcuuuacuggaaauauucaaagaaaagaaacucauaucgacaaacuuuaaauaugcugaagacgggccuucauccacuuucucuaccuuaaaccuacgagcaaaagcugcaaaagagaaaaucgaacuacaagaucuaguaaaaguuuuauuacaaauaaauaagaaacguggguacaaaagcuccaggaaagcaaaaagugaagaagaugauggauccgcaaucgauucaaugggaauagcaaaagaacuauacgaaaacgaucugacacccggucaauggguauaugaagcauuacaaaaaggacgaaagaauguucccgacuucuacagaucugaucuacaagaagaauuuaagaaaauaguuaacuaccaaagcgaauuuuucccggacauauuuaaugccucauuuguagaagacuggaugggaaaagccuccacaccgacuaaacaauacuuuaacaagaaaggaguccaauuagcggaaaauaaaggcaaacgagaagaaagaaggcuacaagaauacaaauggcgcgcugaagcaguaaacuuuaaaauugauuuaucugaaauagccuuaauacucagccaaauuaacagucaaauaucaaauucaucaggcuaccuaggagcaauauccgacagaucaaaagaauuauauuuuaaaaacuuaacaguuggacaauacuuauaccaacaaaucaagaaaaauccucacacccgccuaaaaggucaaguauuuuauagacaagacuaccuagaugaauuugaaagaauuugguccguccaaucaucuuucuacccacaacuaaaugacgcuuugaaacgagaaguaagagacauaacaauauucuuucaacgaaggcuaaaaagucaaaaacaucuaaucagcaacugcgaguucgaggaucaucacaaaguagugccaaaaagccacccuguauuucaagaauuuagaauauggcaaaauuuaaacaaucuauuacucaucaagaaagacaaucuuaaugaaaaauuugaccuggaauuggagucaaaaauagccuuagccaaugaacucgcauuuaaacgagagcucaauguuaaagacgcacuaaaaauucuaggucuaaaaccgaaugagugggaauuuaacuuuaccaaaauugaaggaaacagaacaaaccaagcauucuucgacgccuucgcaaaaauuaucgaacuagaagacggagaaccaauagauuuaggggauuuaaaagccgacgacauuuuggaucaauucucagaagcauucuuaagaauaggaauagauacagaacuacuccaaguaaauucugacauugaaggagcagaauaugaaaaacaaucguacauacaauucuggcacuuacuuuauuccagcgaagaugaucaaaaauugaaauuaaaccuaauccgaaaauucggauuuaaaccggaacaugcuaaaauucuagcuucgauaagccuccaagaugaucaugcaucccuaucaucaagagcaauaaagaaaaucuuaccucaccuccaaagugggcuuauauaugacaaagccugcacauacgcuggauauaaccacucaagcagcuuuacaaaagaugaaaaugaaaaacgagaauuacgagcagagcuagaauugcuaaagaaaaacagccuaaggaacccugugguggagaaaauucuaaaccaaaugaucaauguuguuaacgccauucuuaaagaucccgaacucggaaggccagacgaaauaaggguugaaauggcccgagaauuaaaggccaacgcagagcaacguaaaaacaugacgagcaacauagccucagccacacgagaucaugacaaauacagagaaauacuaaaaucagaauuuggucugaagagaguaaccaaaaacgaucuucuacgcuacaaacuaugguuagaaacagacgguaucucguuauauacagggaaacccauagaagcaagcaaacucuucucaaaggaauaugacauugagcacauuauacccaaagcgagacuauuugacgacucguuuagcaacaaaacaaucugugaacgccaauuaaacauagauaaagcaaauguaacagccuuuucauuccuccaaaacaagcucagcgcggaugaguucgaacaauaucaaagucguguuaaaucccuauaugguaaacuaucgaaagccaaaauacaaaaauuguuaauggccaacgauaaaauaccagaagacuucauugcaagacaacuacaagaaacgagauauauaaguaagaaggcaaaagaaauucuauuugagauaucaagaagaguuucagucacuaccggcacaauuacagacaaauuaagagaagauugggggcuaguagaaauaaugaaagaauuaaacugggaaaaguacgauaaacugggcuugacuuacacuauugaagggaaacauggagagcgucuaaacaaaauaaaggauuggaguaaaagaaaugaccaccgacaccacgcaauggacgcauuaacuguggcacuaacuaaacccgcauacauccaauauuuaaauaacuuaaaugcaaaaggcuuaaauaacaagaaaggcacggaaguauucgcaaucgagcagaaauaccuaaaaagagaaaacgguaaacuaugcuucauaccaccaauagaaaacauaagauccgaggccaagaaacaccuuucuagaauacucguaucuuacaaagccaaaaauaaaguagucacaauaaauaaaaacaaaacuaaaucaaaagcaggcuuaaaugagcaaaucgcuuuaaccccuagagggcaauuacauaaagaaacagucuacggcaagaguuuccacuacagcacuaaauuugaaaagaucggcgcaucguucaacguacagaaaauuaacaccguagccaagaaagaagaacgcgaagcucuacuaaaaagacuagcagagaacgguaacgacccuaagaaagcauucacaggcaaaaacacacuaaacaaaaugccaauauaucuagaccucggcaaaaauauaaaguuaucagaaaaaguaaaaacagucgugcuugaacaaaauuauacgauaaggaaaaauauagacccagaucuaaaagucgauaaagucaucgaugucggaauaaaaagaauacuagaaaguaggcuagaagaguucggaggaaacgcgaaauuagccuuuucaaaccuugaagaaaacccaaucuggcuuaauaaagaaaaaggcaucucaauaaaaagaguaaaaaucucaggaguaucaaauguugaaucauuacaugucaagaaagaccacuucggugaaccaauacuagaccaagaagguaacgaaauacccguagacuuugugaguaccgguaauaaucaccauguugcaauuuacgaggacgaaaauggaaaccuccaagaagaaguaguuaguuucuuugaagccgucguacgacaaaaccaagggcuuccaauaaucaagaaaaaucacacacucgguuggaaauuucuauuuacacucaaacaaaacgaauauuucguguuccccagcgacgacuuuguaccggcagauguugauuuaauggaugaacaaaauuaucaccuaaucagcccgaacuuauuucguguacagaaaauagcuaggaaaaauuacguauucaacaaucacuuagaaacgaaagcaguagauaacgaccucuuaaaaucaaagaaagagcuuucaaaaauaacauaccauuuuuaccaaacuccagagcaucuaagagggauuauaaaaauacguauaaaucaucucggaaaaauuauacaaauuggggaguauuga

SEQ ID NO: 8836 - RNA, 4059 nt, Artificial Sequence
  Cas9 variant
augaacaagaaauacuaucuaggauuagauauagggacaaauuccguagguugggcgguaacggaugaaaauuauaauuuauauaaauacgcaggcaaaagaauguggggaaucagguuauuugaagcggcagacaccgcagcagaaagaagaaugaagagaucgaaucgaaggagacuaucuagaaagaaacaaaggauagaucuauuacaggaauuauuuucugaagaaauuguaaagaaagauuuaacauucuucauacgcuuaaacgaaucaagacuucauuuugaagauaaaagcaccggcgaaaaauacccucuuuucguagauaaagaauacaccgauauagacuaucauaaacaauacccaacaauguaucacuuacgcaaagaacuuauagagaauccagaaccucaugauauucguuuaguuuaucuggcaugucaucauauccuuaaaaaucgcggucacuuuuuaauaaacggaagcauaagcgacguuaaaaaucugaguuucguauguggugagaugauaaaagaguucaacaguguaagugaauaugaaauaucauuaacugauauccgcgaacuagaaagaauacuuagcgacaagaaaacugcuaaaagcguaaaagcaaaacaaguagcccaacucuucgaauguacaccagcggaagacaaagaacaacaaaagugugcaaaagcgauaauuacaaaucuuucaaaguuaauaguaggacuaaagggcaacauaucgaaaauguuccaccaaccauuagaagaaauaaguacaaaaucauucaaauuuacagaagcaaaauaugaagaugaaaucaugcccgcaauagaagaaaacuauccagauuaugcaaguguaaucgauagaauaaaaggaguauacgauuggagcguauuaguagaaauacucgacggagaagacuaucugagcuucgcgaaaguaaaagccuaugaaaaacauggcaagaacuuacauauacuuaaaaacguaaugaagaaauacugcaaagaugaagucuaccaggcuuucuucaauggaauuaacgagaaaaacggcuauggaaauuauaucggugcaauacgcaaaaauggccauaccuauaaaauggauagaugcaaaucagaagaagacuucuacaaaggauuacaaaagauacuaucaacaauaguacccgaccaagaagacgaagaacuauuagaaaaauuaaaagcagaaguagaaaaccaaacauuauuaccauuagcuagaagcaaagaaaacggaacaauaccaaaucaaguccaucuacaagaacuaaugaaaauucuagauaaugcaaaagaauaucuugacuuccuuaagaaagaagaugaguacgguacaauagcagagaaaaucauaaguauagcaaaauuuaggauuccuuauuacgucggaccacuaucgagaagacacaaagaagaaggcucaaauucauggaugauaagaaaggaagaagguagaaucuauccauggaacuuuggagacaaaguagauguagaacaaagcaauaaagaguucauagaaagaaugacaaacaaauguacuuaccuaauuggagaagauguacugcccaaaaacagccuccuauauaguaaauauaugguucugaacgagcuaaauaaccuaaaaauccgagggaacaaaauuucaguggaacuuaaacaacguauauauaaagaucuauucugcacaauggcaaaaguaacugguaaaaggauacucgaguaccucaaaauggaagauccagaaauaguacaagaagacauaagcggauuugauauugacuuuaaaucagcuuuagcaagcuaccuagauuucaagaaacaagugguaggaaacgaaaucgaaaaagaucacuacaaagagaucauagaagaaauuaucaaauggaaaacaauauacgacgacgacagcaaaaugaugaggcguaugauagaacgagaauacccagagguuuucgauaaagaacaaauaaagaaaauuugucaacucaaauauucagguuggggaaacuucagcgacagauuucuaaacgggguaagaggcgcagauaaagaaaccgaagagucauauacaauaauagaggcccucuggaaaacgaacuauaacuuaaugcaacuauuauccaagcaauuuucuuuuaaggaagaaaucgaccaaauaaacgcagaaaaagcuggugacguaggaaaaauaaauuacgaaaacacuguaaaggacuuaauagugucaccaucaaacaagagagcaaucuggcaaacaauacaaauugcggaagaaauaaagaaaguaaugaaaugcgaaccagaaagaauuuuuauagaaauggcaagagguggagaaaaagaaaagaaaaggacagugaguagaaaaaccagauuacaggaacuauaugcaggcugcaaagaugauacaaggaauuggaugaaagagauaggggacagagaagaacgagaauuuaauucucgaaaacuauaucuauauuacacccaaaugggcaaaugcauguauacuggagacgaaauagacgucgaugcacuaaugaaaggaaacaguaauugggauauugaccauauauacccucagucaagaauuaaagaugacaguuuagauaauauggugcucguuaggaaagacguuaauaacaagaaaagaaacaaaauauuaucgcccaaaauuagagaagauaugaaaggauacuggacaauguugugucaaaaaggucucauauccaaacgcaaauaugauagacuaacaagaaccacagacuuuacagacgaagaauuauccggauucauagaacggcaacucguugaaacccgucaaucuucaaaggcaguagcggaauuauuaaaucgauuauauaaagacuccgaaguaguauauguuaaggccggucuaguaucagauuuuagacaugauaaugaucuacuaaaaaguagaagagugaaugacuaccaccaugccaaagaugcguuuuuaaacauuguagugggaaacgucuaccacguaagauucaccagcaacccuagaaaguggauaaaggauaacagagauucaaauuauuccauacgaagaguauucaacuaugacgucaaacaaggcgacaaaauaguauggcacggaagugaaaacgggggacauucaauugaucaaaucaagaaaauaaugaguaggaaugacauuuuauacacagaauacacauauugugaaaagggacaacuauuuaacgaaacuuuagccaagaaagguaaugaaaaagcaauagcacuaaagaaaaaccuggacccaguaaaauaugguggauauacaaccccaaaaaccucggcauuugcauucguagaguucgaugggaaaaagaaagaacggaaaaaucauauaguagaaauaccgguauacguagucaacauugccaagagagaaccugacgcaguaaagaaauauuuagaagaaaggaaaggauauucaaacguaguaaucaagaaauaccccauaaagaaaaacaguuuaauaaaaauggauggauauuuagcacggcuaagaggagcaaaugaaaaagacaucauacugaaaaacgccguacaacucauacucaacaaagaccuguaugaaauagucagaaaaauugaaaaauaccuagaauauaaccuccaauaucaagcagacgcaaaauucgaaggauuuacaaugaaagaccucaacaugaucuaugaggaguuauauuuaaaacuuaaagaauccauauuucagaaaagaccagcacaacaaaugaaaacacuagaaaaaggaaaagaggcauuuauaagcauagaaaacuugggagaaaaagcaaaagucauaaacgaaaucauugcaauguuucgaugugacgcaacaaccguagcuaaucuaaaggucauaaacgguucgcagaacgcaggaucaaugaaggucaacaagaacacacucaccucaaaaucuuuaaaacuuguacaucaaaguauaaccggauuauucgaaaccgaagaagaacugguuuga

SEQ ID NO: 8837 - RNA, 4062 nt, Artificial Sequence
  Cas9 variant
augaaaaagaaauauuaccucggucuagacaucgggacaaacagcguagguugggcaguuacagacgaaaacuauaaccuaugcaaauucaacggcaagaaaauguggggaauuagguuguucgaagacgcaaaaacagcagcagagcguagaacuaaaaggaguaacagacgaagaauagcgagaacaaaacaaagaauagaccuucuacaagagcucugcgaaaaaucaaucuucgagaaagauccaacuuucuucaucagauuaaacgaaucaagucuacaucucgaagacaaaucuacaggagaaaaauauccacuauuuguagacaaagaauacacagacauagauuaccacagggaauaccccacagucuaucaucucagaaaagaauuaaucgaaaacccagaaccacacgauccuagauuaguuuaccuagcauguugucauauuauuaaaucgagaggucauuuucuuguaaauggauccauauccgaugcuaaagaucucagcuucaucugugaaaacaugauaaauucauucaacgccgcaagugauuacaaaauaaacauacaagacaugacugcucuugaaacgauacugacagacagaaaaauggccaaaucgguaaaagcaaaacaaaucguacaacuauucaaaugcaucccaugugaggacaaagaacagcaaaaaugcugcaaagcaauaauaacuaaucuaucaaaacucaucgucggucuaaaaggagacauaucaaaaauauuuaacgaaucuuucgaagaaaucaaaucguucaaauucgcggagacaaaauaugaagacgaaauauugccuacuauggaagaaauuuauccagaccacgcagaaauaauagagaaaauuaaaagcauauaugauuggucaauacuggacgaaauauuggacggcgaagaauaucucucauucgccaaagucaaagcauaugaaaaacacaagaaaaaucuacacgaccucaaaauccuaauaaagaaauauugcgacgacgaaacauaccagagcuucuuuaauggaaugaaugagaaaaacaaauacaguaacuacauagguucaauacgcaaaaauggacauacauauaaagucgaaaaauguaagucaucagaagacuucuacaaagaauuacuuaaauuauuauccagugucaacccaggacaagaagaugaaucgcuucuagaacaaaucaaauucgaaacagaaaaccaaacacuucugccuuuacugcgaacaaaggaaaacggcacaaucccuaaucaaguacacaugcaagaauuaauaaaaauauuagauaaugccuccaaauauuuagacuuccuaaaugaaaaagaugaauauggaacuacagcagacaaaauuauaagcauugcuaaauucaaaauaccauacuauguagggccacucucagaccgccacaaagaaaauggcucgaacucuuggauggucagaaaagaaaacggaagaauauauccuuggaauuucgaugacaaaguagaugcggaaaaauccaacaaggaauuuauacaacgaaugacaaacaaauguacauacuuaauuggagaagauguacuaccuaaaaauucacuccuuuacucacgcuacaugguucuaaacgaacuaaauaacuuaaaaauucgagguaacaaaauaucuguagaacuaaaacaacaaauauacaaugaccucuuuuguacaaaagccaggguaacagguaaaaauauccuaaauuaccucaagaaagaagacccagaacucgcagcagaagaucuaagcggguucgacguagacuuuaaaucggcucuuacauccuaccucgacuuuaagaaacaaguaguaggcaacgaaaucgaaaaagauuauuauaaagaaauaauagaagaaauaauaaaauggaaaacaauauauaacgaagacaguaaaaugaugaaaagaaugaucggcagagaauacccugaaacacuaaaucaagaccagauuaagaaaauaugccaccuaaaauauaacggaugggguaauuuuucagaaacguuuuugaacggcauuaaaggagcuaacaaagaaaccggagaauguuacacuauaauagaagcacuauggaaaacuaauuauaauuuaaugcaacuucuuaguaaacaauuuucauuuaaagaagaaaucgaccaaauaaacgcugagaaaacaggagccauaggcaaaauaacauaugaaaaccuaguuaaagaucuaguagucaguccagcuaauaaaagagcuauauggcaaacaauacaaaucacagaagaaauuaagaaaguaaugaaaugcgaaccagaacgaauuuucaucgaaauggcaagaggaggagaaaaagaaaagaaacguacaguaucaagaaaaaccagauuacaagaacuuuauacuggcuguaaagacgauacuagagauuggaugaaagaaauuggagaucgagaagaaagagaguucucaucacgcaaacuuuaucuauauuauacccaaaugggaaaauguauguacacaggugaagaaauagauguagacuuacuaaugacagccaauaguaaaugggauauagaccacauauauccacaaucaagaauaaaagacgauuccuucgauaacaugguuuugguacgaaaagacauaaauaacaauguaaaaggaaauaauauaguacccucuucaauacaaaaagaaaugacaaguuacuggaaaaugcuguuacaaaaagaacuaaucuccaaaaagaaauaugaaaggcugacccgcagcacagauuucacugacgaagaacuaaguggcuuuauagaacgucaacugguagaaacacgccaaaguucuaaagcaguagcggcauuacugaacagauuauauaaaaacagugagauaguuuacguaaaggcaggacucgucucagacuucagacacgauaacaaacuacuaaaaucaagaagaauuaaugacuaccaccaugcaaaagacgcauuucucaauaucgugguuggcaacugcuaccgcacuaaauucaccgcaaauccaagacaauggaucaaaaagaauagagacacaaacuauucaauacguagaguauuugauuucgauauaaaacagggagacaaaauuguaugguacgguaacaaaaacgaaaacggaaaacauacaaucgaccaaauuaaaaaggccaugucacgaaaugacauacuguacacggaauauacauauugcgaaaaaggaaaacucuucgaugaaacucucacgaagaaaggcaacaagaaagcaauuccuuuaaagaaaaauuuggacccauuaaaauacggaggauacaccucagucaaaaccucagcauuugcauuuauagaauuugacgacaaaaagaaagaacguaaaaaccacaucguugaaauucccauauacguagcgaauauagcaaaaagagagccugaggccgucaucaaauaucucgaagaacaaaaaggauauguaaauauagucgucaagaaauacccuauaaagaaaaauagucuguuaaaaauagacgguuacuuagccagacuaagagguggagacucuaguauaauaacucucaaaaacgcuguacaauuaguacuagacaagaaaucauacgaaauaauaagaaaaguagaaaaauaucuagaucacaacucuaaauacgaagcaaacucuaaacuagaaaaauucaaugaaaaugaccuaaauauaaucuauaacgaacuuugcuuaaaacuaagaaacuccauauaucagaaaagaccaguacaucaacuugaaaccuuagaacaaggaauagacaacuuucgaagccuagaaucacuaaaagacaaagcuaaaauuauaaaugaauuauuagccauguucaggugcgacgcaaaaacaggaauggaccuacgccucauaggaggagcgucuaacuccggaagaaugagaauauccaaaucccgauuaacaucgaaaucucuaaaacuaauaaaccaaaguguaaccggauuguuugaaacugaagaagaauuaguauga

SEQ ID NO: 8838 - RNA, 4062 nt, Artificial Sequence
  Cas9 variant
auggagaaaaacuauuauuuaggucuugauaugggcacaucuucaguaggaugggccgugacugaugaaaacuauaauuuaaugcggaagaaaggaaaagaucuauggggaguaagacucuucaaagaagcaaaaaccucagcggaaagacgaguaaaaagaaccucaagaagacgguuacaacgcgaaaaagcaaggauuggauacuuaaaagaauuauucgcugaugaaauaaauaaagucgaugcaggauuuuaccaaagaauggaagacucaaaauucaucucggaugauaaaacaguacaccaaaaauuuacacuuuucagcgauacaaacuauacagacgaggacuauuauaacgauuacccaacaauauuucacuuacgaaagaaacuuauugaaucugaugaugaauacgauguaaggaugguuuuccuggcacuuuuaaacauguacaaacaucgaggacacuuuuuaaacgcaaacuuaucagacaaugggaugggcgacauuaacgaacaauaugacaggcuaaaagaacuuuguuccgaauaucuaaacguagaaugggaaaauaaaccugauaaauuugaagagauucugaaagaauguaacugcagcaauagcuugaggaacgaaagacucuuagaaacauucaaucuaaaaaaaacagacaaagaaaagugugaaaugcuaaaacuaaucuguggauuaagugggacauuaucaaaaauauucaaagaccuagacgaugauagugaaacaaaaaaaaugacuauuucuuucagaucaucaaacuaugacgaagaagccauuaacguggaagaaaucaucgguucagaaaacuucgaaauuauagcaguauuaaaagaaauacaugauuggaguauguuagcaaauauaaugcgugggaaaaaauaucuaagugucgcaagaguagaagaauaugaaaagcacaaagaugaucugaagauccuaaaaaaaguuauuaaagaauacucaauagaggaauacaacaauuucuucagaguaauggcagacaacaauuauagugccuauguaaacaguguuaacucuaacaaggaaaguacaagaagaggagcgaaaugcgacaacgacacauucuuuaaagaaauaaaaaaaauaguaaauaaaugcuacgacagcgaggaaaaggaauacauucuuaaagaaaucgaaaaaggaacuuuccugccaaaacagauaauaagcucaaacggcguaauucccaaccaaguacacaaaauagaaaugaaaaaaauauuacagaaugcagaaaaauacuuaccauuucucacagagaaagacgacucugggcuuucaguaucagaaagaauacuacagauguucagcuuucaaauaccauacuauauagguccaauaucuggaaagaucggcagcgacgaaaaaucaaaaaacucauggucaguucgcaaagaaaaaggacguauauacccuuggaauuuuaaagacaaaauagaugaaaaagaaagcgcagaaaaauucauagaacgaaugguaaaucauugcaccuacuuaaauaaugaaaugguacucccaaaaaauagucuacuauacgaaaaauucaugguucuaaacgaacuaaacaaccuaaaaauaaacaacgaaaauauaaguguagagcuuaaacagucacuauacaacaaccucuuuaaaacuggaaaaaaagucacugccaaagguaucaaaagcuauuuagaacgaaacggcuuaugcgaaccaaacgaagauauaaacuugacugguauagauggcgauuuuacaaacaggcuaucaaacuacgcaaaauuuaaaggcauauucaauacugacgaacucaccuaugaacaguggaauauggcagagaaaauaaucaaguggagcaccauauauggggacaguaaaaaauucuuagaagaaaaaauaagaaacgaauacucugaaaaacuagauucacaacaaauuaaaagaauucuagguaucaaauuuagggauuggggaagacucucagaggaauuauugaacauggaaggagcugacguaaacaccggagaaauaaaaaguguaaucggucguaugugggaugaaaauuacaacuuaauggaauugauagcaaccgacaauuucacuuacaaacaagugauaaaagagaaacaaaauggacuugauaaaucauuaucggaaauagauuacgaugauuuagaugaauuguacguaucggcaccaguaaaaaggaugauauggcaaacacuacuaaucauuaaagaacuugucaguguaauaggguaugaaccgaccagagucuucgucgaaauggccaaagauguuaacacagaaaaaaaaagaacagauagucgcaaaaaaaaauuuuuagaccuguacaaacaaugcgaaaaggacgaaagagauuucuggauaaaagaaauagacgauaaaucagaagcugaauuuagaaaaaaaaaauuauacuuauacuacacacaaaaaggaagaugcauguacacaggagaacaaauaaacccauuagauuuaacuaacgacaaucuuuacgauauagaucacauauauccuagacauuucguaaaagacgauucuauagaaaauaauuuaguauuaguuaaaaaagaaaaaaacgcacacaaaucagauacuuuuccaauugaagaugacauacggaaaaaccaauacgccuucuggaaaauguuauaugaaaaaaacuucauuacaaaaguaaaauaccaacgacucaccagaaaagaacccuuuagugacgaggaaaaagcaaacuuuauaaugagacaaauaguagaaacgaggcaaggaaccaaaguuauuacagacaucuuagaaaaaucguuugacaaaacacaaauaguauacgugaaagcggggaaugucuccuuauuuagacaaaaauacgaaugcauaaagugccgagaaaucaaugauuuccaucacgcaaacgaugcuuaucuuaacauuguuguugggaacguauacgacacaaaauuuacaucugacccaagaaacuuuauaaaagaauaccguaaaaacccucaaaaaaacgaauaccauauguauaaacuauucgacuauaacguacaaagaggggacagaguagcauggaccgccuccaauggcgaaaguaugaaaguaguaaaagguacucucaaaaaaaauacaccccuuguaacauucaugaguuaugaagaacauggcggccuauacgaucaaaacauuauaagcgcuaaagauauagaaaaagugaaaggcaaagguuaucuuccgauuaaaucuagugauuccagacuuaacaacacagagaaauauggaggauaugcuaaaguaucgggugccuacuucuuuguaguagaacacacgguaaaaaacguacgaauacgcacgauagaaccaaugccaugcuacuuaaccaagguccuaaccaccaaagaaaagauagaagacuacugcuguaauauauuaaaauacgauucaccaguuguuaaauacgaaaaaauaaaaauguacucauuaauaaaagucaauggauauccgauguaccuaacuggaagaacgggaaaucaauuaauuguuaguaacggaauccaauuaguuuuaagcuacgacgaagcaaaauacauaaaagauuuauuaaaaaucaaucaagaagaguuugaucaaaacagacucgagaaucuugguaucaacaaauucagaaacgaaaaauuauaugacacacucaacaaaaaguacaccaacgaaauauacaaaaaacgccccaacagcaugggcaacaaaaugauagaauggaaaaacacauuccaaaaucuaucaauaaaagaucaaacagaaguacuccugcaacucauccaacugggacaaaaacaaaauagugggguuaacuuggagaaguuaggugcaaguaaaaaaacgggaguaucccuagucucaaaaaaaaucacugauaaagaauccuucgaacuuaucaauaagagcauuacaggacuauacgagaacaaaguagaccuguuaagaguguga

SEQ ID NO: 8839 - RNA, 4062 nt, Artificial Sequence
  Cas9 variant
auggcugcauuuaaauauuaucugggguuggacaugggaacaaacaguguaggaugggcuguaacagacccaaacuauaaucuccuuaaagcaaaaggaaaagacuuaugggguauaagggaauuuaacgaagcaaguacagccguagaaagaagaacacaccgaauaucacgaagaagaagacaaagagaacaagucagaauaggauuacuaaaagacuacuuucacgaugcuaucggagaagucgauccagacuucuuucaacgacuagcuaacucaaaauaccauuuggaggauaaagauacagagguaagauacaaaaacaauguauuuaacgaugaugacuauacagauaaagauuacuucgaccaauauccuacaauuuaucaccuaagaaaagaacuuaucgaaagcacagacaaacacgacgugagguuaguguuucuagcauuacugaacauguuuaaacauagaggacauuuucuaaauaguggauuaggagaaaacucaggagaaaacaauauaaauaaugccuacuuagaauugacuaaccuccuuucggaguucacacaauacaacuuaaacgaaaccauugaugguaagaaaauagaagacauauuaaguagaagggauaugagcagaacaagaaaagcagaaggcuuagccgaaauacuaggaguugacuacaaaaauaaaccauacaaggaacuaauaaggggcuuauguggacuaaaauuuaacgcaugcgcaaucuucccagaaauccaaucggaugaagugccaaaauuagauauaugcuugucugaagccagcuucgaugagaaaagugacgaaauagcaaauauucucggugaagacuacuuugaaaucauuauggcaaugaaagauauuuaugauaucggaucccuagcagggaucaugaaagggcauaauuaucucucccaggcaagaguuacaagcuaugaaaagcauaaggaagaucuaagacuccuaaagaacgucaucagaaaauauugcuccaaagaagacuaugacaauuucuuuaauuccgaagccgauggaagcuaugcaaguuaugugggaucauauaauagcaaaacaaaacaacggagaguaggaaacaaaagaucgagcgaagaauuauauaaagcaauaaagaaaauccugaaaaacguaccagcugaagacgccgacguacagcgaauccuaaugaguauagaaaaugaaacauuucucccgaaacaacuuacggcaaguaacggaguaauaccaaaucaagugcacgcaaaagaaauaaagaaaauacucaguaacgcagaaagauaccuaccauuucuacgugaaaaagaugaaacaggcuuaaguguaagcgagaaaauaaugaaauuauucucguuucaaauaccauauuacgugggaccgacaacagaaaaaucuaguaaagauggaggcaauggguggguaguucguaaagaagaaggacaaguacuuccauggaauauagaugagaaaauagauaugaaagcaacgucagaagcauuuauaucaagaauggucagacgaugcacauacauaaguggcgaacccguacugcccaaaagcagucucgaauaccagagcuuuuguguucuaaaugaaauaaacaacauaaaaauagacggggaaaggauaucuguugaauuaaaacaagacauauauaaagaaguuuuucaaaaaggaaaaagaguaaccaagaaacaacuuuguaaauacuuacacacacgcggaauaauagaagcagaggaacaaguaacgggaauugacguaacaauuaauaacgcuuuaacgacauacggaaaauuuaaagcuauacucggagacgauauauccaaggacucuguacagaaaaugguagaaaacauuguauuuuggugcacaguuuacggcgacagcaagaaauucuugaaggauagaauagaagaaaaauacggggaaaagcugacaaaagagcaaauaaaacgaauaguuggauuuaaauuuaaagacuggggcaaucuaagcaaaaauuuucuagaacuauccggggcggauguaagcacuggagaaucugucaguaucauaagggcucucuggaacaacaaucucaauuugauggaauuaauuaacucacgauuauauaacuacaaagaaagacuagccgaauaccaaaacacaaugaugaaaacacuaucggacauagaggcagaggaccuagacgaauacuacuuuucagccccaguuaagagaaugauauggcaaacgauauuaauuauuaaggaacuugucaaaguacucggaugcgaaccagacaggaucuuuguagaaaugacgagaaggcccgaugaacgcaaaaugcguacagaaaguagaagaaagaaauuugaagaacuauacaagaaaguaaaagacgaagauguagauuggaugaaagugauagcccacgcugacgagacaggcagcauaagaucaaagaaaauguaccuuuacuuaacacaaaaaggacgaugcauguauacagguaaacauauagaauuaucggauuuauucaacaauaacuuauaugacauagaucacgucuauccacgacacuucguaaaagacgauaauauagacaacaaucucgugcuaguaugcaaagagaaaaacgcacacaaaagugacauauauccccuugaagacgaaauacuagccagccagaaaaacauguggucagaacucagacgaaguggcuucaucacagaagaaaaauacaauagauuaauaggaagaaacucauuuacugaugaacaaaaagcuggauuuauagcuagacaauuaguagaaacaagucaaggaacaaaaggaguagcaaacauauuacaacaauuauuaccagaaagcaagauagucuaugcgaaagcuagcaacguauccgaauuuaggaauacaagggauauaccaaaguccagacuaauaaacgaauuucaucaugcccacgaugcauacuuaaauauagucguuggcaauguauacuacguaaaauucacacaaaacccauuaaacuucauuaagaaugacuacgauagagauaaaacgaaaaauaauuauaacuuaagcaaaauguucgauugggaugucgaacggaauggugaaguggcguggauugcccaaaagaaagacggcgaagccggaacuauagcuacgguaaagaaaguacuagguagaaauacaccacuaaugacacgauauucuuucgaagguaaaggagggcuaacuaaugaaacacuauacagugcaaagaaagccaaagaagaaggcuauauaccauuuaaaaguucagacgagaaaaugaaagauguaaccaaauacgguggcuucacaucaguaacuggugcauacuuuuucuuaguugaacauacagaaaagaagaaacggucacgaaugauugaaucagucccauuauaccuagcucagaaaauagaacaaaauccacacgaauuagaaaaauacugcgaacaaguauuaggacuaauagacuucgauauuagaguacgaaaaaucaaaauuggaucauuaaucaaacgaaaaggauacuucuuuuacauaaccgguaaaacaggccaccggcuuauacuccguaacgcuguaaacaugugccugaagaaagaauggguaaaauacauuucaaaauuagaaaaagcaguagacaaaaauaauguugaaggaaucauaacaaaagagaaaaacgaguuacuauacuccgaacuaauugaaaaauucaaaaacucaauuuucagcaaucgacccaauccaguuggagauaaauuagaugaggcgaaagaaaaauucaucaaucuggauauagaaaaacaauguaucguucuaugccaaauccuccaacucuccucaguguuaggaagcgaaugcgacaugacccuucuaggagaaagugcacauugcggcaagauccuaauauccaagaaaauuggagaugaagacauauaucuuauuaaucaauccgucacagguuuauaugaaaagaaaaucaauuuaagaacuguauga

SEQ ID NO: 8840 - RNA, 4065 nt, Artificial Sequence
  Cas9 variant
augaaaaaaauauuaggacucgaccuaggcacaaacucuauaggcugggcauucauaaacgaagcagaaaacgaaauagaagucucauccauugucaauacuggggucagaauagugccccuaacaacugaugaagaaagcgacuucaaaaaaggaaauaccauaucgauaaaugcagacaggacauuaaagcggggugcgagacgggggcuccagagauucaaacaaagacgugaagcauuacucgaaacauucaacaggauaaaauuuauagccacagauuucguuuaugccgaaaccggagccgcaacaacuuuuucuucauaccaauuaagagcuaagucggcaguugaagcagugacaaaagaagaauugguuaaaguauuauuaaugcucaacaagaaaagaggguauaaaucaucaagaaaagcuaaaacagcugaagaaggagacgcuauagauggaaugaaaauagcaaaagaaaucuuugagaacaacuuaacaccaggacaauggguauacaauagucucaguaaaggugguaaauucauuccagauuucuaccacucagaucuucagaaagaacuagaaaaaauuguccgauuccaaaaucaguuucacucagaacaaauaaacgacaaacuguuagcagacauccaagguaaaucacggacacaaacaucacagcauuuuucaaaaacguuaaacauaccacuagcugaaaauaaaggaacacgugaagagacaaagcuccaacauuaucaauggcgcaacgaagcacuagcaaacgaacuagacaugaaaauacucgcuuucauuauaacggaaaucaauaaccaaauaaaccaaucaucagguuaccuuggagcgauaucggauaggucaaaagaacuauacuucaaccaagaaacuguaggccaauaccaauacaaacaacuucaagaaaacguacacgcuaaacuaaaaaaccaaguauuuuaucgccaagacuaccuggaugaauuugaaaaaauaugggaaacacaagccaaauuucacucagaauuaaacgaaaaacuuaaagcagaaauaagagauauaacuauauucuaucaacgaaaacugaaaucacaaaaacauuuaguaucauuuugugaauuugaaaaaggacauaaagcaauucccaaaagcuccccguuguuucaagaauucagaauuuggcaaaaccucaauaacguagucguaaagaacgaaacuaccaaagaggucuucgaacuaagcgaggaacuaaaacaacuaauagcagaggaacuacaauuuaaagaguccaugacagacgugcaaauguuaacauucugugaauuaaaaaaagguacacauacaguaaauuuuaaaaaaauagaaggaaauagaacgaacacuuccauuuauaaggcauuugaaaagauccuggaagucgaaggauaugaaauagacuuuaguaaaaugaaaccacuugaaauaaaagaaacaguugcuccuauauuugaaacacucaauauaaacaccgucauauuagacuucgacccaacaauucaagguaacgacuucgacaaacagccauauuaccaauuauggcaccuacuuuacucggcugaagaugacgauaaacuaaaagaaaccuuaaaaacaaaauucggauucaaagaaaaccaccuuccuuuuauucuaaacaucaaucuacaagcugacuacggaagccuuuccgcaaaagccauaaaaaagauauuaccacauuuaauggauggucauauauacgacaaagcguguuuaaugguuggauacaaucauuccuccagcuuaacuacagcccaaaacaacgauaggguacuuaaagacacacuagaacuucucaaaaaaaauagccuuagaaacccagugguagaaaaaauacucaaccaaaugauaaacgucauaaacgccauaaugaaggaccccgcaaugggcaaaccggaugaaaucagaguggaacuagcacgcgaacucaaagcuaauaacgaacaacgaaaaaaagcuacaucugauaucaauacggccacaacagaacaugaacgcauaagaaaauuacugcacucagaauucaacauuccaagaguaaccagaaacgacaucauuagauacaagcucugguuagaaacuggagguauauccuuauacacaggaaauccaauuaaggccucagaccuguuuucaaaaaacuacgauauagaacauauuauuccaaagucacgccucuuugacgacagcuucucaaacaaaacauugugcgaacgccagcuaaauauagauaagucaaacaaaacagcauauucuuuccuccaagagaaacuaagugaaaacgacuuugcggcauacgaaaauagaguuaaagaucuuuucaagacaggaaaaauuaaaagcuacacaaaauacaaaaaauuacuaauggcggacaacgaaauacccgaaggcuucauagauaggcaguuaagagaaacacaauacauagcuaaaaaagcaaaagaaauacuccuagaaguuuccagaaacguuacagcaacuauaggcagcgucacagacaaauuacgacaagacugggaacuagucgacguaaugaaagaacucaacugggaaaaauaugauaagcuagggcucacacauauagaagaagguaaaaacggcgaaagauuauccaagauaaaagacuggacaaaaaggaaugaccaccgucaccacgcaauggacgccauaaccguugcauucacaaaaccagcauacauccaauaucuaaauaaucucaaugcaaagacccaaggagaaaauaaagcaaauagcauaauaggaaucgaaaacaaacaccucuaccgagacaagaauaacaaguugagauuuauaucgcccaugaaaaacuucagagaagaagcaaaaaaacaacuagaaagcaucuuaaucagcuauaaggcaaaaaacaaaguugucacaaaaaauaaaaauaccacaaaaaaaucuggagguacaaaucaaaaaauccagcuaacuccaaggggacggcuccacaaagaaaccguauacggaaaauuacaacaauacgcuacaaaagaagaaaaagucaacgccucguucacugaagacuacauccaaaaggucgcaaaaaaagaauacagagaagcuuuacugaaaagacuagaagaaaacgauaaugacccuaaaaaagcguucacagguaaaaacgcacuaaacaaaacccccauauauauuagucuaaaagauaacaucaucguaccagagaaaguaaaaacaguuuggcuugaaaccgacuauacuauaagaaaagacauaacaccggaccuaaaaaucgacaaaguaauagacgucggaaucaaacgaauauuacaaaaccgacuaaacgaauuuaauggagaccccaaaaaagcauuugucaaucuaggcgaaagcccaaucuggcuaaauaaagaaaagggaauagcaauaaaacgcgucaccauauccggaguuucaaacgcacaagcauuacauaccaaaaaagaucaucuaggcaacgaaauucuagauaaaaacggaaaucccauacccguagauuucauaaguacggggaauaaccaccacguagcgauauauagagaugaaaaaggaaaccugcaagaagaaguaguaagcuucuacgaugcagucauccgacgaaauuuagggcugaguguaauuaacaaaaaccacgaaaaaggaugggaauuucucuuuucaaugaaacaaaacgaauucuuuauuuuucccagugacggauucaacccacacgagaucgaucugcuuaauccuaacaacuaucaucuaauaaguccaaacauauuucguguucaaaagauaucaaccaaaaauuauauguucaaccaucaccuagaaacuaaagccguggacggugaaaugcucaaaucaaaaaaagaauuaucaaagacguccuaccauuuuauacaaacaccaacgaaucuaaauggcauaauaaaaguuaggaucaaucaucuuggcaaaauaguacaccugggcgaauauuga

SEQ ID NO: 8841 - RNA, 4065 nt, Artificial Sequence
  Cas9 variant
augaaaaagauauuagggcuagacuuagguacaaacagcauagguugggccuucauaaacgaagcggaaaacgaaauugaagucucaucaauaguaaauacuggaguaagaauagucccacuaacuacagaugaagaaagcgauuuuaagaaaggcaauacaaucucuauaaacgcagacagaacacuaaaacguggagcacguagaggccuacaaagauuuaaacaaagacgagaagcacuacucgagacguucaaccgaauaaaauuuauagccacagauuucguauacgcagaaacuggagcagcaaccacuuucaguucuuaucaauuaagagcaaaaagcgcuguagaagcuguaacaaaagaagaauuaguaaaaguacuacuaauguuaaauaagaaaagaggauacaaaucauccagaaaagcuaaaaccgcugaagaaggcgacgcaauagauggaaugaaaauagcgaaagaaaucuuugagaacaacuugacaccaggucaguggguauacaacucccucagcaaaggaggaaaauuuauacccgacuucuaccacucagaccuacaaaaagaauuagagaaaauagucagguuucaaaaccaauuccacagugaacaaauaaaugauaaacucuuagcagacauacaaggaaaaagucggacccaaaccucacaacacuucucuaaaacguuaaacauuccgcucgcagaaaauaaaggaacaagagaagaaacaaaauugcaacauuaccaauggcguaacgaggcguuagcgaacgaauuagacaugaaaauucuugcauucauaauaacggaaaucaacaaccaaauaaaucaaaguucuggauacuugggcgcaauuagcgauagaucuaaagaauuauacuuuaaccaagaaacaguuggacaguaccaauauaaacaacuacaagaaaacguacaugcuaaauugaaaaaccaaguauuuuauagacaagacuaucuagaugaguucgagaaaaucugggaaacacaagcuaaguuccacagugaauugaacgaaaaacuuaaagccgaaauacgcgauauaacgaucuuuuaucaaaggaaacuuaagucacaaaaacaccuaguaucuuucugugaguucgaaaagggccacaaagcuaucccaaaaucaucaccacuauuucaagaguucagaaucuggcaaaaccucaauaacgucgugguaaagaaugaaacaacuaaagaaguauucgaacuaucggaagaauuaaaacagcuaauagcagaagaauuacaguuuaaagaaaguaugacagaugugcaaaugcucacauuuugcgaacuuaaaaaggggacacauacuguaaauuucaaaaagauagaagggaacagaacaaacacauguauauauaaggcuuucgagaaaauucuagaaguagaaggcuaugaaauggauuucucaaaaaugaaaccguuagaaauaaaagaaacaguagccccuauuuucgaaacauuaaauaucaacacaguaauacuagacuuugauccaagcauucaaggcaacgacuucgacaaacaaccauacuaccaacuguggcaccuacucuauagcgcagaagacgacgauaaacuuaaagaaacacuaaaaacgaaauuuggcuucaaagagaaucaccuaccauuccuacuaaacauuaauuuacaagccgacuacgggagucugucagcgaaagcaaucaagaaaauacuaccacaccuaauggacggacauauuuaugauaaagcgugucuaaugguuggauauaaucauagcagcagcuuaacaaccgcacaaaauaaugacagaguauuaaaagauacuuuagaacuacuaaagaaaaauaguuuaagaaaccccguaguagagaaaauacuuaaccaaaugauuaacguaauaaaugcgauuaugaaagaccccgcgaugggaaaaccugacgaaauacgugucgaacuagcccgagaacuuaaagccaacaacgaacaacgaaagaaagccacaucggauaucaauacggccacaacagaacaugaaagaauuagaaaauuacuacauucagaguucaacauaccaagaguaacaagaaacgauauaauacgauacaaacucugguuagaaacaggugggauuucccucuacacaggaaauccaaucaaagguucagaccuuuucaguaaagauuaugacauugaacauauaauccccaaaucaagacucuuugaugacucauuuucaaacaaaacacuaugcgaaagacaacuaaauauugacaaaucaaacaaaacagcauacuccuuccuacaagaaaaacuaagugaaaacgauuucgcugcuuacgagaacagagucaaagaccuuuuuaaaacugguaaaauaaaaagcuacacaaaauacaagaaacuccuaauggcagauaacgagauaccugaaggauucaucgaucgacaacuccgcgaaacacaauacauagcaaagaaagccaaagaaauacuauuagaaguaucccgaaacguaaccgcaacuaucggaagcguaacagauaaacuucgcgaagauugggaacuuguagacguaaugaaagaacuaaacugggaaaaauaugacaaauuaggccuaacacauauagaagaaggcaaaaacggagaaagacuuucgaaaauaaaagacuggacgaaaagaaaugaccacagacaucacgcuauggacgcaauaacaguagcauucacaaaaccugcguauauccaguaucucaauaaccuaaacgcuaaaacacagggagaaaacaaagcaaacucuauuauaggcauagaaaacaagcaccuguacagggauaaaaauaauaaauuaagauucaucucaccgaugaaaaacuuccgagaagaagcaaagaaacaacuagaaaguauucuaauaagcuacaaagcgaaaaacaaaguaguaacuaaaaacaaaaacacaaccaaaaagucaggcggcacaaaucaaaagauucaacuaacaccuagaggccgacuucacaaagaaacaguuuacggcaaauuacaacaauacgcaacaaaagaagaaaaaguuaacgcaaguuuuacagaggacuacauucaaaaaguagccaagaaagaauacagagaagcacuccuaaaaagauuagaagaaaaugauaacgaucccaaaaaggcuuucacugguaaaaacgcauugaauaaaacaccuauauauaucagcuuaaaagacaauauaaucgucccagaaaaaguaaaaacaguaugguuggaaacagacuauaccaucaggaaagauauaacaccagauuuaaaaauagauaaagucauugauguaggaaucaaacgaauccuucaaaacagauuaaaugaauuuaacggagacccaaagaaagccuucgucaauuuaggggaaagcccaauuugguuaaauaaagaaaaaggcaucgcuauaaaaagaguaaccauaagcggaguauccaaugcucaagcacuccauacgaagaaagaucauuugggaaacgaaauacucgauaaaaauggaaauccaaucccugucgauuuuaucagcacaggcaacaaccaucaugucgccauauauagagaugaaaaaggcaaccuucaagaggaaguaguaucauucuaugaugcaguuauuagaagaaacuuagaauuaagcguuauaaacaaaaaccaugaaaaaggcugggaguuccuauuuucaaugaaacaaaacgaauuuuucauauuuccaucagaugguuuuaauccccacgagaucgacuuacuaaauccaaauaacuaccaucuaauaucuccaaacauauucaggguacagaaaauaucaacgaaaaacuacauguuuaaccaccaccuagaaacaaaagcuguagacggagaaauguuaaaaagcaaaaaggaauuaucaaaaaccucuuaccauuucauacaaacacccacgaaccuaaauggaauaauaaaaguaagaaucaaccaccuuggaaaaauaguacaucucggggaguacuga

SEQ ID NO: 8842 - RNA, 4065 nt, Artificial Sequence
  Cas9 variant
auggcggauuucgcaaaauaccaaccaggaauggucgcugaugguagaaaaauaccucuagauuggacacuguacuauuuacgaaagaaagcauuaacgcaagcaauuagaaaagaagaacuugcauggauacuauuaaauuucaaucaaaagcgaggauauuaucaauugaggggagaagaagaagaagaaaacucaaccaaacacgaagaauacuaugaauuaaaagugguaucgguagaagcagcagaagaagguaaaggcgggaacacaugguacaacguaacucucgaaaacgguuggauauacagaagacaaucaaaaaucgaguuaaacgauuggguugggaaaguacggccauucauaguaacaacggaauacgaaauugacggcgugacaauaaagaaagacaaaaacggagaaguaaaaagaucauuucgagcaccaucagagaacgauuggggauuacgcaagaaaagaacggaaucacugcuggaagaaucagguaaaacagucggagcuuucauauacaaucauauucuaucagaaccagcagauaaaauaagaggaaauuucaucagaacaauagaaagaaaauuuuacaagaaagaacucgaagccauauuaagagaacaaaguaaacaucaaaaagagcucaaagauauagauacacuaaucgcaugcauaaaagagcuauaucccaauaauaaaccacaccaagauagucugaucaagaaagauaugacauaccuacuuauuaccgaccuaaucuucuaucaaaggccacuaaaaaguaaaaagagccucauagcagacugcccuuaugaauacuaugaauauguaauaaaggaaaccggagaaaauaaacgacaaucaauaaaauguauagccaaaucgaacccguauuaccaagaauuuaggcuuuggcaauuuaucauaaacuuaagacucuuugacaggaacaacgacaaagaagugacauccgaauaccucucaaguauggaagauuauacaaggcucuuuacauaccucaacgacaggaaagacauaaaccaagaaacacuccucaaagacuuuuucaaacagaaaaagguuaaaagaggaauggaaaaagaguuccccauaagauggaacuacauagaagauaaagaaaagaaauacccauguaaugaaacaagacacgaacuuuuaacugcauuaggcaaagugggaauagaucacagcuggcuagaugauaaagaacuauucuauaggcuuuggcacuuauuauauagcguugaaaguaaagaagaagcggaaggcgcucuaaggaagcuaguagacaacgaugacuuuguaaacgccuuucucaaaaucaaaccauucaagaaagaauauggagcauacagugaaaaagcaauaaagaaacuacucgcagucaugaggaugggaaauuuauggaacgaagucgauauuugcgaacaaacaagggacaggauucaaaacauaauaaaaggcgacauagacgagaaaaucaaagacagaaugggacggaccuucagccaauuaucagauuuccaaggucuaccagaauggcucgcaugcuacgucguuuaugggcaacauucugaagccacagacauucaaagguggaccaaacccgaaaauuuaauggcauacaucaauggauuuaaacaacauagcuuacgaaauccaauuguagaacaauguauauuagaaacauuacgaacgguacaugacauauggaaagaagcaggacacauugaugaaauacauaucgaacuagggagagggaugaaaaguacggcugaucaaagagcgaggaugaguaaaaguauaaugcaaaacgaaaacaccaaucuaagaauaaagagcuuacuuauggaauugaaaaaugcuaaagaguucgaaaaugugagaccguauuccccaaugcaacaagaaauauuaagaauauacgaagaaggagcauuacaagaauuaaccaaagaagacgcucaauacaaugaaauaaguaaaauuagccagauggcccaaccaucggccaaugaauuacucaaauacagguuauggcuagaacaaaaauacuguucgccguacacaggcaaaccuauaucgcucaguaaauuauuuaccucagcguaccaaauagaacauauaauaccccaaagcagauauuucgaugauagcuucacaaauaaagucauuugugaagcagaaguaaaucaacuuaaaagcaacauguuaggauacgaauuuaucaagaaacacggaggagaaaucgugagaugcacaaugauaggagaugucaaacuacuagacgcaaaagaauacuacaacuucguaacugaacacuacacaaacaaucgaaggaagaaagaaaaauuguuaauggaagacauaccacaagaauuucuaaauagacaaaugaacgauagucgauacauaaguaagaaaguaauggcuauucuaucaaauauaguaagggaagaagaugaacaagaagcuaaaucaaaauuuguaauagccugcagcggcgggauaacugacaggcugaaacaagacugggggcuaaacgacgucuggaauaguauuguauacccuagauuugaaagacuaaacaaacuaaccaauacugaaaacuucgggcguugggaaaacaagaaaggaaaacaaguuuuucaaacguccguaccguuggagcuacaaaaagacuucagcaagaaaaggauagaccauaggcaucaugcaauggaugcucuagucauagcaugugccucgaacaauaucauaaauuaucucaacaacgaaucagcaaaaucacaagagaaaagagaagaucuaaggaagaaacucugcgacaaaaaucgaauaauaagaaaaccaugggaaacauucacucaggacgcccacaccgcauuagaaaacgucgucguuagcuuuaaaaauuacaucagaguaauuaacaaagcaacaaauuacuacgaaaaauaugacaaaaacgguaagaaagaaauugcagaacaaaaagggcaagacaugugggcuauaagaaaaccaaugcauaaagagacaguauuuggucaagucaaccuaagacgcaaaaucacaauaaaacuuaaagaugcacuagagaaaauuccagcuauaugugacaaagaauuacgagauuacaucaacauauuaguagccaaacaauucaauaagaaacaaauacuagcucauuuuaaaagcauaaacuauagacuaaauaugaaaaguguagauaaaguagacguuuggcaauucucaaaugaaaaagaacccaugguagcaacccguaaaucaguagacacuagcuuugauacaaaaaggauagcuacaauaacagacacgggcauucagaaaauacuacuaaacuaccuaaaagccaaaaacaacgacccuaauauagccuuuacgccagaaggaauagcugaaaugaacaaacauauuacagaauauaacaacggaaaacaacaucaaccuauacuuaaaguacgugucagugaaccgaaaggagcgaaauaucaaguaggugagacaggaaauaaacggucaaaauuugucgaagcccaaaaaggaacaaaucuguacuucgccauauacgaagauaaagagggaaauaggaguuauaauacaauaccauugaaugaggucauagagcguuuaaaacaaggauuaucacccguaccagacgcaaacgagaaaaguauaccauuaaaauuucauuugagcccaaaugaccugguauauguaccaaaaaccgacgaagaaaacgaaauaaaaaugggucagauauauaaguucguagacucaagcgggacaacggcuaauuucgucccgcauagaguaucaaaccuuauauacaacgucgauaagaaaauagccgaaaauuuuuguaaucaugaaaucauacaaaacgaguauggaauaggaaguccacaauccaaaaaccaaaaaucaauaacuggugaaaugaucaaagcaguauguuggaaacuagaaguugaccgacuaggaaacauacauaaaauaaucaaguga

SEQ ID NO: 8843 - RNA, 4065 nt, Artificial Sequence
  Cas9 variant
augaaaaaaauauuaggauuagacuuagguaccacaagcaucggcugggcuuuuauaaaagaacccgaaaaagaugucguggguucggaaauaguagacaugggagucagaaucgugcccuugaguucugaugaggaaaaugacuuugccaaaggaaacacgaucaguaucaacgcggauagaacuuuaaaacgaggugcacgaagaaaccuacagagauuuaaacaaagaaggaacgcauuauuggaaacguuuaaggaaaaaaaccugauuccauccaauuuucaguacgcagaagaugguccauccucuacauuuaguacucuaaaguuaagagauaaagcagcgaaagaaaaaaucgaguuagaugacuucgucaaaguccuccuacaaaucaacaaaaaaagaggauacaaaucaucaagaaaggcuauguccgaagaagaugaagguaccgcaaucgauucuauggguauugcaaaagaauuauaugaaaaugaucuaacuccugggcaauggguuuacgaagcacucaaaaauggaagaaagaaugucccagauuucuacagauccgaucuacaagaagaauucaaaaaaaucguaaauuaccaaagcgaauucuauccagauauacucaacaccaguuuuguugaagauuggaugggcaaagcaucaaccccaacaaaacaauacuuuaacaaaagaggaguacaguuagcagaaaauaaaggaaaaagagaagaaagacgacuacaagaguauaaguggcgagccgaagcaguaaacuucaaaauagacuuaagcgaaaucgcacuaauacuaagucaaauaaauagccaaauaagcaacaguucaggauaccuaggagccauaagcgaucgaucuaaagaauuauacuuuaagaauuugacaguaggacaauaccuguaccaacaaguaaaaaagaauccucacacaaggcuaaagggccagguauuuuaucgacaagacuacuuagaugaguucgagaaaauuuggucaguccaaucaaguuuuuauccucaacucaacgacgaacuaaaacaagaaguacgcgaugucacaaucuucuuccagaggagauuaaaaagccaaaaacaucuaauaagcaacugugaguucgaagaacaccauaaagucguaccaaaaucacacccgauuuuccaagaauucaggauauggcaaaaccuaaauaaucuuacauuaauaaaaaaagacaauuugaacgaaaagugugaauuggcacuagaagacaaaacagcacuagccaacgaacuugcauuuaaaaaagagcucucggucaaagacgcccuaaaaguauuaggacuaaagccaucagacugggaauuuaacuuuacgaaaauagaaggaaauagaacaaaccaugcauuuuuugaagcauucgcaaaaaucauagaacuugaagacggcgaaccaauugaucuggguaaccuaaaagccgacgauauauuagaucaauuuagugaagcauuccuacgaaucggaaucgacacugaguuauugcaaguuaacagugacauugaaggagcagaauacgaaaaacaaucauauauacaauucuggcaucuacucuacucgucugaagacgaccaaaaauugaaacaaaauuuaauucgcaaguuuggauucaaaccagaacaugccaaaauauuagccucaauaagucuacaagaugaucacgcuucguuaucaucaagggcuauaaaaaaaauuuugccacaccuccaaagcggcuuaauauacgauaaagcuugcacauaugcgggauacaaucauaguucaucuuucacgaaagacgaaaaugaaaagagagaacuacgagcagaguuagaauuauuaaaaaagaacagccuacgaaauccaguaguagaaaagauucuuaaccaaaugauuaaugucgucaaugcaaucuuaaaagaucccaaccugggccgaccugacgaaaucaggguagaaauggccagagaauuaaaagccaacgcugaacaaagaaaaaacaugaccagcaacauagcaagugcaacacgagaccaugaaaaauacagagaaauacucaaaaaagaauucggucuaaaaagagugacaaaaaacgauuuauugagauacaaauuguggcuagaaacggauggaauaagucucuacacaggcaaaccaauagaagcuagcaaacuuuucucaaaagaauaugauaucgaacauauaauaccuaaagcacgacuauucgaugacucauucagcaauaaaacaauaugcgaaagacaacucaacauugacaaagcgaacguuacggcauucucuuuccuacaaaauaaauuaucugcugacgaauuugaacaguaccaaucgagaguaaaaucgcuuuauggaaaacuaucaaaagccaaaauucaaaaauuguugauggcaaacgacaaaauacccgaagauuuuauagcaagacagcugcaagaaacaagauacauaucaaaaaaagccaaggaaauacuuuucgaaauuaccaugagagucucaguaacaacugguaccauaacugacaaacuacgcgaagacuggggacuagucgaaauuaugaaagaacugaacugggaaaaauaugauaaauuagggcuaacauauacuauagaaggaaaacauggagaaagauugaacaaaaucaaagacuggaacaaaagaaaugaccauagacaucacgccauggaugcauuaacgguugcacuaaccaagcccgcauauauacaguacuuaaacaaucuaaacgccaaagcgauugguaauaaaaaaggaacagaaauauuugcuauugagcaaaaauauuuaaagagagaaaacggaaaguuauguuuuaucccacccauagagaauaucagagcugaagcaaaaaaacauuuauccaaaauacuaguaucauacaaagcuaaaaacaagguaguuacgaucaacaaaaauaaaacaaaaaaaaaagccggauuuaacgaacagacagcacuaaccccgcgagggcaauuacauaaagaaacaguauacggaaaaaguuuccauuauaguaccaaauuugaaaaaauaggcgcaucauuugacgcacaaaagauaaacaccgucgcaaaaaaagaagaaagggaagcucuauuaaaacgacuagcagaaaaugguaaugacccaaaaaaagcguuuaccgggaaaaacucguuaaacaaaaugccaauauacuuggacuuaggaaaaaacauuaagcuaucagaaaagguaaaaacuguaguucuagaacaaaauuauacaauacgcaaaaacaucgauccagauuugaaaguagacaaaguaaucgauguagguaucaaaagaauacuagagaguagguuggaagaauucggcgguaaugcgaagcucgcauucucuaaucuagaagaaaacccaauuuggcuaaacaaagagaaaggcauaccgaucaaaagagugaaaauuucaggcguaucaaacgucgaaucacuccacguuaaaaaagaccauuuuggagagaaaaucuuagaugaggaaggaaacgaaauaccaguagauuucguaaguacagggaauaaccaucauguagcaauuuaugaagaugaagacggcaaccuacaagacgaggugguaaauuucuacgaagcaguaauuagaagaaaucaaggagaaucaauaauaaaauacagacacgaagaaggauggaacuuucuguauucaauuaagcaaaacgaguuuuuuguuuuuccaagucaagacuucaacccuaacgacuucgacuuacuagauccaaaaaauuaugaccuaauuucgccaaaucuauauagagcucaaaaauuuucaaagguaauguacgguaacucugcaguacgagauuauguuuuuagacaccaucuagaaaccguacucaacgacguaaaagaacucaaagauguagcguacaaacaauuaaagaguuuacaauauuuaaacgguauaaaaaaaguacgacuaaaccauuuaggacagauuauacaaguaggagaauauuga

SEQ ID NO: 8844 - RNA, 4065 nt, Artificial Sequence
  Cas9 variant
augacacuacacuacaacgucggucuagauauuggaaccaacagcguaggauacacuauagucgacgacaacggaaaaauccuacaaguaaaagguaaaaauggguacggaguaagaguauuuaaagaaggagccacugcagcagaaagacgaauauuucguaccacacaccgucgccuaaaaaggcgaaaauggcgacuaagacuacuucaagauuucuuugaaccauauauacuuccccaagaugacgguuucuuuauacguagaaaagaaucaaaucuuguauuaaaugauagagaugaggacacagcaucacuauuuaaugacagaucagauagagacuucuaucaagccuacccuaccauauaccaucugcggcaggcgcuuaugacagagaaaagacaauucgauguacgagaaauauaccuugcaaugcaccacauaauaaaauaccgaggacauuuucuccuuaaugggacagucaauaauuuuacaaauaacaaaaucgaccuucacagcgacuuugaagaacucaaugcauuacuacucaauguaauaccagaauugaaauuccaaauagaucuggaucacucaacaauguuccaaacaacccugcuaaauacaacuaucucuagaucaggaagacaaagagaucucguuaaaucauuuuauaaugggucagaugauaaacaauuggcaaaacaacaaaaaucuguugccacagaacuauuaaaagcgauacuaggcuugaaagccaaauuccacaaacuuuuuaaucuugauuuacuugaaacaacggaaugggaauuuuccuuugaugccgaagauauagacgauaaacuagcuaaacucgaaccacuaaugacagaaaaccaacaacaaguaauggauauucuccaaaggauuuucgcagccauaaccuuaaacggaauuguaccugaaggcaaaacacuaucagcaucaaaaguugauucguaucaaaaacauaagcaagaucuuaagcuacuuaaagccauagcacaacacuccgauaagaaaaccgcuacaguauugcaaaccgcuuauaaugaauacaucaauggcauugccucuaaaccauugaaacaagaagacuuuuacaaacgacuaacaaacgcaguaaagaaaagcuccgacccacaaguagcagacaugcuagcacuaauugaccaagagaaauuucuaccuaaacaaagaacaaaagaaaacggggcuaucccccaucagcuacaccaacucgaacuagaacgcauaaucgacaaccagaaagacuauuacccauggcuagcagaacuaaauccgaaccaagcacggcaaaaaguagcaaaauauaaacuaucugagcuuguugccuuuagaguaccuuauuacguaggaccacuaauugaaccugagguucaacaagcaacaucgaaugcccauuuugccuggauggcaagaaaagaagccggaccaauaacgccuuggaacuucgaucaaaaaguugaucgaaacgucucagcugaaagauuuaucaaaagaaugacaacaaaagacacauauuuguuagcagaagauguuuuaccgcuacacucccuccuauaccaaagauuuaucguacuuaacgaacuaaauaacgucagaguaaauggacagaaauuaacgaagaaacaaaaacaagcuguuuaucaagaccuauucaaaagacaaccucacgucaccaagaaacaauuuaaaagcuaccuaguucaaaccggcgaauuugcggaguccaguaaaauugaaggccuugcaaacgaaacaucauucaacucaggucuaaccacagaaaaugaauuacguaaaauauuuggagcgcaacuagaugaagcaagguaucaaguugauuuugaacaaauaauagaaugggccacucuuuuugaagacgccaaaauacuaagaacaaaacuagcagagauaacauggcugacaacagagcaaauagaaaaacuagcugguauaagauauagaggauggggaagauuuucacgaaaacuauuagcaggauuacgagaucaaaauggccagcaaauaauagacuuacugugggacacaccaaauaacuucaugguaauuguaucacaagccgccuuuagcgaagccauaacaaaagaaaacgaaaaacucaucgaucgaaggggagcacaggacgucaucacagaucuuuacacaagcccacaaaacaagaaagcacuacgacaaguccuagccauugucgcagauguucaaaaagcaaugggaggcguaccgccccagagaauauuuauagaauuugccagagaagaugagaaaaacccgagaagaucaguagaaagaagcagacaauuagaaaaauuauaucaaacuaucucuaacgaauuucucauaaacucugaaguuagacaagaacuaaaagaagccguagaucaaaaaguaaauuucaaagaucgucuuuuucuuuauuucuuacaaggcggaguggacuuauacucuggaaaaagaaucaacauugaccaacuaucacacuacgauaucgaucacauacucccccaaucuuuuauaaaagacgacucacuugacaaucggguucuaguuagucaaaaacuaaauagaagcaaaucagacuccgugcccuugagugaauuugcaaauuacaaauucggucccgcaaugcaagcuaaauggcuucaacuaaaagaagcaggucuucuaucaaaacggaaauacgauaaucugacacucgauccaacaaaacuuucaaaauuugcuccuuuggguuucgucaaucgacaacuuguagaaacaagacaaguaauaaaacuagcugccaaucuucuagccucagaagaaacaaaaguggucacgauaaaagcaaacaugacgcaccaaguucgcaaagaauuagauuucccgaaaaaccgcaacgucaacaauuaucaucaugcauuugaugcguauuuaacugcguuuguagguaucuuuuuguccaaaagauacccaaaauuaaaaccauacuuuacauauggagacuuccaaaaaggaaauaaacuaccagacuugaaaaauuuuaauuuccuauacgaauuaaagaacaaagauagguccaucgauucaaauacaggcgaaauaauuugggacaaacaaagagauuuagcuuauaugaauaaaaucuacaacuucaagaaaguaacaguaguacaugagguuuuaaccaaaucuggagcccuuuauaaucaaacauuauauaaagcaucugaagacaaagcaucgggacgcgguacaaaacaacucaucaggaagaaagacaauaugccgaccgaauuauacggagguuauacaggauccaccuccgccuucaugagcauugugcgucuauggaagaaagauaaacccuauuauaaaguaguuggcauccccacucgcauggcugcgaaacucgccaaccaagcacaacuacucgacuaccuuacaaagaaauucaccacaagaaaacuugugaagaaaacaggugauuauaaaaccacgguagaaagauuugaauuaguaguuccaaaaguuggauucaaccaacucguuaucgauggcggccaaccuuuuauguuaggaucugcgacauaucaguacaaugcuagggaauuauucauaagcaaagaagcuguaaaagcccuuaacaaacaacuaucaacacacgucgaucucguacaagucuucgacgaaauuuuaguacaaguaaaucggugguucccauuauaugauacuaauggcuuccgcgaaaaacuuucccauggacgcgacagauuuaugaaacuaaacgauucauucgaggagaaauccgauacacagauugauguauuaaaucgaauacuaaucggauuccacgcgaaugccgcgcguacgaaucuuaaaauacuaggacuaggaaccgaucuaggauucaugacacaacaagcagguauucgguuaacagaaaaagcgauauuaguccaucaaaguccaucuggauuauucgaaagaaaaguagcacuuagagacuuaaaaggccuaagauga

SEQ ID NO: 8845 - RNA, 4068 nt, Artificial Sequence
  Cas9 variant
augacauacagcauaggguuagauauaggaacaggcucuguaggcugggcaguaauaggcgacgauuacagacucaaaagagcuaaaggaaagaacuuaauagggguaaggcuauucgacuccgccacaacugcagccgaaaggcggggguaucgcacgacacgacgaagacuaagccgaagacauuggcgacuccguuuauuaaaugauauauucgcauccgacuuagcagaacaagaugaaaacuucuuaccaagauuaaaauauucuuggguaaaccccgaugaugaacaaaauccucaguuaaacuccgacguagcaaacggagcccucuucggauccucagaaacagauaaagccuuucacaaaaauuacccaacaauauaccaucuaagacaugagcucaugacugacacagccaaacacgaucuuagagaagucuaucuggcgauacaucauauaguaaaauacagaggcaauuuucuuaacacagcagauaaaauuaaugccgaaaacaguuucaacgucgauuuauuuaucgcagcauuagacgaauacaaugaguuccuagaaacuccaaucacuucaauuaaagaugcacaauuguuuucagauaaacuuacagacaucaaugcucgaaauaaaaguguaagaguagagaaugcaauguccgagacauacgacgacaaaucuaaaauauucaaagcuauacuuacugcauuaguagguaauacggcaaauuuucaaacaauuuucgaucuuucugaucucgaaaaggaugaagcuaaaaacuucaaauucaaacuugacuuagaagacguagaaacaaaacucgacgucguccgggcaaaacuaucugaugaacaaaaugcauuucuugaagcaguacuaauagcauacgauggaauaacauuaaaaaugauacuaggugauuauaaauccauuucccagucaaugauugaaucauauaaaagucaccaaagggauuggaaauacauuaaaaacaacguaagauuaaaugaacagaaaauugaaccagacaaaaauuccgucaaauuuuucaaacucgauccgaagaaacucauauauccuucuaaucucgcuuaucuccaaguaauaucaucaaacgaagacgaacaucggaaaggucucgauuauuucaaaacagcaauacaggacgcugauauauugcaaagaauagaaaacgacacauuucuaccccgucaaagaacuaaaagaaacggaguauugccauaccaauuacaccuagcugaacuagagcaaauaauuaagaaacaaaguaaauauuauccauuccuugcuaacauuuauacacaggacaauaaaaccgaaaauaaguuaauaggucuacuuaaauucagaguaccauauuauguaggcccacucgucgaagcagaaaaaguaacuggcgacgggaaaaaucacuggcuaaucaaaaaggaacuccaggaaaauacaccaauaaccccuuuuaauuuugacgacgucguggacaaggacaaaucgggagaacaguuuauuaaaagaauaacaggcacggacucauacuuaauaggagaaccaacucuaccagaaaacagucuuuuauaucaaaaauauaacguccugcaagaacuaaacaaugugagaaacgaaagacaccaaaggcuaccaauaaaaguaaaacaagacauauucgaacacguauuuaaaaucgauaaaaaugucaacgcaaagaaagugauggcuuaccucaaauuaaaugguuauggagauuuccaaauugcaggacuauccgacaccagaacagguaaauuuaacucuaacuuaaguaguuauaacuauuucgucgaccuauugggacgugaaaagacagaaaagauuagagaagacagacucgaagaaauaauagaaauacaaaccguauucgaagacaaaauucuaguugcaaaacgucuaucaaaucucgacuuucugaccccacaagaaaaaucaaaacugagugcaaaacacuacaccggcuggggacguuuaucacaaaagcuccucaccacucaauuuauaaaaacagcacucucugaagcaggggacauaaucccacaaucacacucgauaauagacuugcucuauuauaccgacaagaaucugauggaaauucucaaugacaaaacuuuuaauguucgaaacuggcucacugaacaaaauaaaggaacugaaucaggcaacucucuauaugaucaaauagaugcccuagccggaccgaaggauauaaagagaggcauaacucaaguauuuuccauaauagacgauaucaagaaagcaaugggauccaacccugaaacaguauaccuugaauuugcacgagaaacccaaaccucccguuugacaaacaguagacuaaacagaguacaagaaauauauaauuccccugaacucaagacagaguucgccuauuuagcaaagaaacuagaagcagaaacaaaagaauccauucaugacgauagacucuaucuauacuaccuacaagaaggacgggacauguacacaggaaaagaaauacccuucgaccaaauauccagcaacuacgauauagaucauaucaucccucaagcauucacaaaagacgacucccucgacaacagagucuuaguaaaccgagcaaccaaugcaagaaaaagcaauucaccaacguuuacaaaugauaucauagauaaccgaaaaucaugguggcaaucccuagugaaacgaggacuaaugaguaaagaaaaguuugaaagacucacagacaaaagaaaaacauucuccgaaaaccaaacaaaucauuucauagcacgucaacucguagaaacccgccagauaaucaaaaacguagcugaccuaauuaaaaacaacuacgaugggacacaagccguagcuauacgugcuucccuaacaggcgaaaugcgcagauaccucgacuggcccaagaacagggacaugaacgacuaucaucaugcacaugacgcuuuaaugauggcgacaguagguaaauacguagauagacgaggauucuucgauaacggaucaguuucagauggagcugguaacgcauauaaccuauauacaaaagauuggcuuguagcagcucgaguagguacuagaaaugacucacagcgcguaaaccccuauggguuuauaguagguagcaugaacucaaaagcaguaagacagcaagucaauaaagaaacaggagaaauagucuggggaaaugaaaaucuagacuaccuaagacaugucuuaucuuacaagaaaauauuaguaacucgaagacucagcggaucaucaggacgccuauaugcagaaacauuauuuucuccaaacccuaaagcaaaacuuauagcgcaaaaagcaaacaggagcguggcacuguacggcggauucaccaaagcugaaucugcuuauacagcauuaguugaauuuaauaagaaaggagacagaagcuacaaacugauaaaaguaccaauggcgauagcaaacaggguaaacgauaaacaaaucacaguaacagcuuauauagcaucacugaauuugagagauuucucaagaguaguguuagagcauuuacccuuagggacauuaauaagagaaucagauggaucagaauuuuaugccgcaagcagcgaauauaaacauaaugccaaagagcuaugggcuccgaaagaaauacuacgaucaagcaagaaauuagacaaagcuaccgcagauaaccuaauagauauauuugauuuccuaacuaacgauaaaaccaucagcaacuucaaauucuaugaaaaagacuuacuacaucugaaaaacgugcgugacaaauucguagaagccagugacgagaucaaaauuaaagugcuaucugacgucauauacgaacuacauaaugaugcaggauggagagauccauucaaacauauacaggaaaaaccggccuggaccaugcuacaaguaaaaggcgguauaaaacuaucagaaaaagcagcaauaguauaucaaucucccacuggcuuauuugaaacaauaaccauuguaggagaguga

SEQ ID NO: 8846 - RNA, 4071 nt, Artificial Sequence
  Cas9 variant
augaaaaaguuugaggaauauuauauaggcuuagacaugggaacuggaucuguugggugggccguaaccgauuccgcauacaauauaauuaaacgacauggaaaagcucucuggggcauccgacucuuugagucagccaaaacagccgaagaaagaagaauauuucgcacaucaaggcguagaacagaacgaagaaaaaacagacuccacuuacuacaagaaauauucgcagaagaaauaucaaaaaaagauaugggauuuuaucaaaggaugaaagaaaguaaauauuggcacgaggacaaaaaagauauaaacggaaauaugccugaguuaccauaugcacuuuuugcggaugacgguuucaccgauaaagauuacuacaaaaaauacccaacaauauuccaccuacgguaugcucuagcgacaaauacuacagauaaaccagacauacgcuuguuauacuuagcccuccaccauauaauaaaacauagaggccacuuuuuauucgaaggaaaaaaauuaagcgaggugaaggaauucucaacagcaauagaagcucuuguacaacaagcagaggaacaagaaaucgaccuuaaaucacuuacccaagaagagguacugacacaacuagaacacauaaugagcgacgcucaguguacaaaguccgacaaaaaaacgcaaguuagcaagcuaauaguaggaacugacaagcaaaaacaaaaacaagagaaagcuauagcugcgcuuauaacuggaugcaccguuaaacuaucggacauauuugcagacccagaauuagauaaggaggaaauaaguaaaaucuguuuuagugacaauggcuacgaagagaaggaaguugaaauugaaucugucuuagcagauagauuuuuacuaauugcagcagcaaaagguguauacgauuggacaguguuacacgacauucuaggagacgcgagauuucuuagcgaagcaaaaguaaaaacauaugaaaaacaccgcgacgaucuaagaaaaguaaagcagcuacuaagaauggacaaagaaguauaugaagcaguuuucggcgucucggaaaaaaacgaggccaauuacagugccuauauagguauggccaaaaaaaacggaaaaaaacagccaauugaaaaaaaauguucucaggaagauuucuauaaauuucuaaaaaaacaacuagaccguuuaucugucgaugaaaugggucaagaaauuaucgaugaacucaaagcagagauggaccuuggaacacuauucccgaaacaaaugauacgagauaauggaguaauacccuaucaacuacacgaaaaugaacuuaaugcaauauuagacaacgcacaaaaauucuacccauuuuugcuggaaaaagaucaagauggauacacaccuguagaaaaaauccaaaaaauauuuagguuucggauaccauacuauguuggacccuuaaauaccgcacaccaagauaaaggcggucacagcuggaguguacgcaagaaagaagguaagauuuauccauggaauuucagcgaaaugauagacgaagaagaaucagcaacaaaguuuauagagcgaaugaccaauaaaugcacguaucucauaggagaagacguucucccaaaagaaagccuacucuacgcgaaauucaaugucuugaaugaauuaaauaacuuaagaauagauggcgaacuuaucgcaccggaauuaaaacaagauauuuauaauaauguauucaaaaaauaucaaagaguuaccggaaaaaaaguuaaggauuaccuaagaaucaauggaguaauaagcaaggaacaggaacuauccggguuugaccagaacuucaaaucaucacucaaagcguaccacgauuucaaacaaauaguaggaaccggagucuuaucagaaagcgaacaagaagacauaguaagagauauaacauuauuugcugacucccaaaaaauguuaaaacaaagaauacaucguaaauauccaaugcuaagugacaaacaaauugcccaauuggcaaacaaaaaauaugcuggaugggguagacuuucaaggacauuucuugaaaacauagaaagcguuaauaaagaaacuggugaaguaaugaauauuauaacagcucuuugggaaacaaaugaaaaccuaaugaaacucuuaaguggaaaauaugauuacacaaaacaaauagaacaauggaaugcacgacaaaugaaaaagggagaaauagaauaccaagacauagaagaacuguaugucucgcccgcagucaaacgcccaaucuggcagacgauaaaaauaguaagagaaauaacuaauauaaugggaggugcuccaaaaagaauauuuguagaaguagccagagagccaggugaaaaaggcgucagaaaagugaguagaagaaaucaacuauuagaccuauauaaagcauguaaaaaagaggcaccugaacuauaugauagacuagcaaauaaagaaucggauaaugcccucaggucugacaaacuauuucucuacuacagucaaaugggacguuguauguauucuggcgaugcaauugaucucgacgaacuauucacaaaccgcuaugacauagaucacaucuacccucaaaguaaaguuauggaugauucaauagauaaccggguucuugucaagagggaccuuaacuccaaaaaaaccgacacauuuccaguaagcgaagaauauagaaaagcgggcaaagcacucuggagcaccuuauuaaaaaaaggacuaauaaguaaagaaaaauauaaaagacucacccgaacagaaccuuuuggagaggacgaacuagccggauuuauagcucgacaacugguugagacuagacaaaguacaaaagcaguagcucaucuauuagaagaggcguauccggacgcagaaauaguuuaugccaaagcacgagcaguuagcgaauuuaggcauaaauuugacaugauaaaaguacgagagguaaaugauuuucaucacgcuaaagacgcauacuuaaacauaguuguuggcaauacauacuaugucaaauuuaccaaagacgcagcaugguucguaagaaauaaccccggacguacuuauaaccugaaaaaaauguuugaaaacgagaccguaaaaagagguaacgagacagcauggauaccuggggacaacggaacgauaugcaccguaaaaaaguggaugagaaaaaacaauguccuauucacaagaagagccuacgaagucaaaggaggucuauucgaucaaaacauacuaaaaaagggaaaaggccaaaucccgauuaaaggaggagcugacgaacgccuaagauccagagauaaauauggagcuuacaacaaagccucaggagcauacuucauguuaguagaaagugacggaaaaaagggagaaagaaaaagaacaaucgaauuuguuccaguauacuuagcaaaaucacuagaagaaucaguagagcuuaggcgaagauauugcgaagaggaacuaggccuagugaacccugaugucagacuaagcaaaauuagaaaaaaugcgcuaauagacgucgaugguuucaagaugcaccuaguaggcaggacagaaaauaggcuguugcuaauaggagcaacacaguuaguauuaagugaagaugaccaacaauugauaaaaaaaauaggaaaauacugccuagaucauagggaaaacaaagaugcggucuuaucagagaaauacgaguugacaauggauuuauucgagaaauuauaugauauauuuguauuuaaacuagaacaaacagucuaugcaguuaaauuaaguaaacaagcaaaagaccuaaaagaagucaaagaagaauuucuggcccucgacgaugaacaaaaaugucuacuacuaauggaaauucugcaucuuuuccaaugcagcccacaauuagcaaauuuaacaaacauagguggaggaaaaagcgccggaagccucaaaauucucucggacauaacaaaacaacaaucagugcuacuaaucaaucaaagcauaacaggcuucuacgaacagguaaucgacuuaaaaacuaucuga

SEQ ID NO: 8847 - RNA, 4071 nt, Artificial Sequence
  Cas9 variant
auggaaguggguaacuauuacuuaggaauagaugcaggcacagauucaguaggaugggcuguaacagacaaccaguauaacgucauccgcaaaaagggaaaaucccucuggggcauuagauuauucgacggagccaauaccgcgcaagaaagaaggaccuuccgugcacuaagacgccgaaacgaaagaaaaaaacaaagaauuaaccuuuuacaagaauuauucugcaaagaaauauguaaauuagacccaaauuuuuucauaaggcuacgcgacucaucacuguggagcgaggauaaagaagaaaaacaaauauacagccuguuuaaugauaaaaauuuuaacgaccgaaacuaccacaacaauuacaaaacaaucuaccauuuacgugcagauuuaaucaagaauaaagaaaaacacgaugcgagacucguuuaucuugcaauucaccacaucaugaaaaaucggggacauuuccuuuuuaacgggaauaucgaaucaguaacaucauucgaaaauacauuuaacgaguuuaaaaauugucuucucgacgaacuagaaauaaauuuagaaugucccagcauaucugaauucgaaaacauacuuaaagaccgcaccuucaaagggacccaaaaauguaaaaaacuuaaagaacuaugcucaauaccaucauccgacaaaaaguuagacaauauuuuuaaacucauauccggacuaaaagccgaucugucgauuauauucgaagacgaaucuuucaaagaaaacgaacacaacaagauaucauuugccgacuccaauuacgaagaaacacgcgaaguacuaaacagugaaauacaagaaaaaacacugauaauagauauauucaauucgauuuacaauugggucaucuuaucagauauauuaaguggcggagaauauaauggaggcuuauaccuauccauagcaaaaguaaauaccuacaacaaacacuccaaagaccuaaaaauuuuaaaauccgucauuaaaaaauauuucccacaaaaauauacagacauuuucgcaagcaauaaagaaaacaauuauuguagcuacaucggaauguacaaaucagggggaaaaaaauauucaguaaaaaaauguucagacaaaccugaagaauucuauaaaacaauuaaaaacauaauuaauaaaaauacugcggaagagaucucaaaugacaaagauguucaauacauacuaucagaaauagagaacaauucauuccuuccguuacaaauuaacaaaaacaacgguguaaucccuuaccaagcaaauaaaauagaacuagaaucuauacucaaaaaugccgaaaauuaccuccccuuucuaaaagaaauagacacagaauguaauaagaccaccagcgaaaaaauuauagacuuauucgaauuccgaaucccauacuauguaggaccacucaauacaaguaaaggugaaaaugcguggaugauccgaaaagaggauggcacuauccgcccauggaauuucgaacaaaaaguagacaucgauaaaacggcugccgaguuuauaacacgaaugaccaaucaauguacauauuuaaacaaugaaacuguacuaccaaaauauuccuuguuauacuccgaauacaccguucuaaaugagaucaacaauauuagaauaaauggugaaaagauuucgguugaacuuaaacaagauauauucaacauacuauuuaaaaacaauaaacaaguaacuugcaagaaacuccucucacacuuaaauucgaacggcuauaaucuaaaaaaggaugaccucagcgguuuugacggaaauuuuaaaucaagucuguccuccuacauagacuuaaaaaacuauauauucggagacaauauagauaaaccccagauauauaaccuagcagaaaagaucauucuauggaucacacuauacggagacgauucuaaacuccucaaaagaguucuacaaaaaaauugcucagaacaauuaaacccagaacaaauuaagaaaauuacaaaauuaaaauuuaaagguuggggaagacuuagcaaagcauuucuaucagaauuacguggugcugacagagaaaccggagaaaccaugacuauaauaaaaggucucagaaacacacaaaauaaccuuaugcaauugcuuucccaaaacuacacuuucacugaagagugcgaaaaaauaaauagugguuauuuuauuaacccaaacgagauuagcuaugacucaauaguaaagaauauaguugcauccccaaguauaaaaagauccgucuggcaaacgauacaaauuguagaagaaauacaaaaaguaauggggagcaaaccaagaaaaauauucguagaaauggcucgaggagaagaggaaaaaguaagaacuacaagcagaaaacaaaaauuacuagauuuauauaaaaauauaucagacgaaugcgcuaaaggaauguaugaugaaauauacaguaaagaugaguccgacuucaaaaauauacgccuauauuuauacuauacacaaaugggcuguugcauguacaguggaaaacacauagaccuaucacaacugucaaacacaaauauuugggacagggaucacauauacccccagucuaaaaccaaagacgacucacuugauaauuuaguccuaguuuauaaaucuauaaacucagaaaaaucagaugacauaauaucaccgacaauacaaaauaacaugcgcaccuuuuggaaacuacuauucgacagaaaauuuaucuccgaaaagaaauaucaccgucuaacccgcacaaccccauugaccgacgaggaacuggccgguuucauaaacaggcaacucguagagacaagacaaucuaccaaaguaauggccucaaucuucaaaagaaucuauccaaauacagaaauaauauacgucaaggcaaaaaacguaagugacuucagacacaggaaagauugcgagaacggugucaaggugagagaacuaaacgauuaccaccacgcaaaagaugcauaccuaaauaucguagucggaaauguuuacaguaguaaauuuaccaauaaucccuuaauguggcuuaaaaacaaccgaaauguaaaauauagccuaaaccggauguaugauuucaaucucacagucaauaacgaaaacauaugggugguaggaaacgaaggaacacaaaaaacuguuaacaaauacuuaggaaaaaacgacauccuauacacuagauaugcaaugacaaauaaaggcgaacuauucgaucaaaacccacuaaaagcgaccggugauaaaucaaaacaaacaacccugguaccccuaaaaaaaggaaaagaaguauggaaauauggagguuacaacucgauaacaccaucauacuucauguuaguagagucaaaagauaaaaaagguaauuauauccgaacaauagaaacaaugccucuuuacagagaaaaagaauuuucuaaaaacgaagaauucuuauuaaacuacuguaaagaagugcauaaacuaaaagaaccaaaaauaauccuaaaauguauaaaaaaaaaugcacuacuaauaguagacggcuuccccaugcaccucaagggcucaacaggauuacaacuaaaauugcaaggagccguacaacuuauacuugaauccgacauggucauauaucuaaaaaagcuaaugaaauucguaaacgagaacaauauaaauaaaaacaaacucgaaguuacuccuuauauggaacuaagcgcuaaagaaaacaucaaacuauaugacauauucauacaaaaauuaacaacgggaaucuauucaaaaagaccagcaaacccgguugagaaauuaauuaacgcaagagauauauucaucgaacucaccguaaaggaacaauguauagucuuaucagaaauccuacacuuguuucaaugcaaaccucuaacaucagcuaaucuaguaucaauaaaucuaaaaaaaacaguugguauaauccaaauugcaaaaaacauuacagcaaaaaauguaaaacuaguucaucagucuccgaccggcauuuacgaguauaccgucgauuuaaacaaaauauga

SEQ ID NO: 8848 - RNA, 4071 nt, Artificial Sequence
  Cas9 variant
augacgaaaaaggaacaaccauauaacauaggacucgauauuggcacaaguucggucggcugggcagucacaaacgacaauuaugauuuacuaaacaucaaaaaaaaaaaccuauggggaguacgauuguucgaagaagcacaaaccgcaaaagaaaccagacuuaacagaucaacccgucgacgauacagacgucgaaagaaccgcaucaacuggcucaaugaaauuuucagcgaagaauuagcaaaaacagaucccucuuuccugauacgacuucaaaacucauggguaucuaaaaaagacccagacagaaaacgagauaaauauaaccuuuuuauugauggacccuacaccgacaaagaauacuaccgugaauucccaaccauuuuucauuugagaaaagaacuaauucugaacaaagacaaagccgacauacgauuaauuuaccuagcauuacauaacauacuaaaauaccgagguaauuucacuuacgagcaucaaaaauuuaacauaucaaaucuaaacaacaaccuguccaaagaacuaauagaacucaaccaacaauuaauaaaauacgauaucucuuucccagacgacugugauuggaaccacauauccgauauucuaauaggaaggggcaacgcaacgcaaaaaagcucaaacauuuuaaaagauuuuacccucgacaaagaaacaaaaaaauuauuaaaagaaguuaucaauuuaauucuaggaaacguagcccaccucaacaccauauuuaagacaucacuuaccaaagaugaagaaaaacuaaauuuuagcggcaaagacauugaauccaaacuagacgaccuugacuccauacuagacgaugaccaauucacuguacuggacgcagcaaauagaauauacuccaccauaacacuaaacgaaauauuaaauggagaaucauauuucucaauggcaaaagugaaccaauacgaaaaccacgcaaucgaucuauguaaacuaagagauauguggcauacgacaaaaaaugaagaggcagucgaacaaucacgacaagcuuaugacgauuauauaaacaaaccaaaauacggcacaaaagaauuauacacaucucuaaaaaaauuucuaaaaguugccuuacccacaaauuuagcuaaggaagccgaagaaaaaauaucaaaaggaaccuaccuaguaaagccacgcaauucugagaacggaguaguccccuaccaacuaaacaagauugaaauggaaaagauaaucgacaaucagucccaauauuaccccuuucuaaaagaaaacaaagagaaauuacuaagcauacuuagcuuuagaaucccuuauuauguagguccccuacaguccgccgaaaaaaacccauuugccuggauggagagaaaauccaauggacacgcuagacccuggaacuucgaugaaaucguugacagagaaaaauccuccaacaaauuuauaagacguaugacagucacugacucauaucuaguuggagaaccaguacugcccaagaacagucuaaucuaccaaagauaugaaguauugaaugaacucaauaacauacguaucacagaaaaccucaaaacaaacccaauugggagcagacuaacagucgaaacaaaacaacgcauauauaaugaacucuucaaaaaguacaagaaaguuacaguaaaaaaauugacaaaauggcucaucgcccaaggguacuacaaaaaucccaucuuaaucggacucucacaaaaagacgaauucaauucaacccuaacaacuuacuuagacaugaaaaaaaucuuuggcucaagcuucauggaagacaauaaaaauuaugaccaaauugaagaacuaauagaauggcuaacaaucuuugaagauaaacaaauacuaaacgaaaaacuccacucgucaaaauacucuuauacaccagaccaaauuaaaaaaauaucuaacaugagauacaaaggcuggggccgccuaucuaaaaaaauccuaauggacaucacaacagaaacaaacacaccccaacuuuuacaauuauccaacuacucaauuuuagacuuaaugugggccacaaacaauaauuucaucucaaucauguccaacgacaaauacgacuucaaaaacuacauagaaaaucacaaccuaaacaaaaacgaagaccaaaauauaucagaccuagucaacgacauacacguaaguccagcgcuaaagaggggaaucacccaaucaaucaagauaguacaagaaaucguaaaauuuaugggacacgcaccuaaacauaucuuuauagaaguuacacgagaaacaaaaaaauccgaaauaacaacaucaagggaaaagcgaauaaaaagacugcaaucaaaacuuuuaaacaaagcaaacgacuucaagccccaauuaagagaauaucuagugccaaauaaaaagauacaggaagaauugaaaaaacacaaaaacgaccuaucaucugaaagaauuauguuauacuuccuacaaaauggcaaaucacuauauuccgaagagagucucaauauuaacaaauuauccgacuaucaaguagaucacauauuaccccgcacauacauuccagacgauucacuagaaaacaaagcacuaguucucgcuaaggaaaaccaaaggaaagccgacgacuuacuacugaacagcaauguaauagacagaaaucuugaacgauggacuuacaugcuaaacaacaacaugaucggacuuaaaaaauucaaaaaucuaaccaggagaguaauuacugauaaagacaaacugggauucauacacagacaauuaguacaaacuagccaaaugguuaaaggagucgccaacauccuugacaauauguacaaaaaucaagguaccacaugcauccaagccagagcaaaccuuucaaccgcuuuucgaaaagcccuaaguggacaagacgacaccuaccauuuuaaacauccggaacucgugaaaaauagaaacguaaacgacuuccaccacgcccaggaugcuuaucucgccuccuuuuuaggaacauaucgacucagacguuucccaacgaaugaaaugcuucuaaugaauggagaguacaacaaauucuauggccaaguaaaagaauuauauucaaaaaaaaagaagcucccagacucacgaaagaacgguuucauaauuaguccacucgucaacggaaccacccaauaugaccgcaacaccggagaaauuauauggaauguggguuuccgagauaaaaucuuaaaaauauucaacuaccaucaaugcaauguuacaagaaaaaccgaaaucaagacaggacaguuuuaugaucaaacaaucuacucuccaaaaaacccuaaauacaaaaaacuaauugcucaaaaaaaagacauggacccaaacaucuacggcggauucagcggagauaacaaaucuuccauaacaaucgucaaaauugauaacaacaaaauaaaacccguagcgauccccauacgccuuauaaaugaccucaaagauaagaaaacguuacagaacuggcucgaagaaaacguuaaacacaaaaaaucuauccagauuaucaaaaacaacguucccaucggacagaucauuuauucaaaaaaagucggacuacuaucgcuaaacucugaccgcgaaguagcaaacagacaacaacuuaucuuaccucccgaacacuccgcacugcuacgacuauuacaaauuccagaugaagaucuagaucaaauauuagcauuuuaugauaaaaacaucuuaguagaaauccuucaagaacugauaacaaaaaugaaaaaauucuaucccuucuauaagggcgaaagggaauucuuaauagccaacaucgaaaacuuuaaccaagccacuaccucagagaaaguaaacucgcuagaagaacuaauaacacuauuacaugcuaacucaacuucagcccauuuaauauucaacaacauugaaaaaaaagcauucgggagaaaaacacacggccuaacacucaacaacaccgacuucauauaccagucugucacaggacuauaugagacaagaauucacaucgaauga

SEQ ID NO: 8849 - RNA, 4071 nt, Artificial Sequence
  Cas9 variant
augacuaaaaaagagcaacccuacaauaucggacucgauaucggaacaggaucagucggaugggcagucaccaacgacaauuacgaucuacugaauauaaaaaaaaaaaacuuauggggaguaagacuauuugaaggcgcacaaacagcuaaagaaacccgacuaaauagaucaacgagacgaagauacagacgacgcaagaaccgaaucaacuggcucaacgaaauauuuagcgaagaauuagcaaauacugacccaaguuuuuuaauacgacuccagaacagcuggguaucaaagaaagaucccgacagaaaacgagauaaauauaaccuauucauagacaacccguauaccgauaaagaauauuaucgagaauuccccacaaucuuucacuuacguaaagaauuaauaauuaacaaaaauaaggccgacaucagauuaguauaucuagcacuccacaacauacugaaauaccgagguaauuucacuuacgaacaccaaaaauucaacauuaguacacucaacuccaacuuaucuaaagaacuuauugaauuaaaccaacaacuaaucaaauaugacaucagcuucccagacaauugugacuggaaucacauaucagacauauuaauuggaagagguaacgcuacacaaaaaagcucaaacauauuaaauaacuuuacacuugacaaagaaaccaaaaaacuauuaaaagaaguaauaaaccuuaucuugggcaauguagcacaccuaaauacuaucuuuaagacuagccucaccaaagaugaggaaaaacuaucuuucuccggaaaagacauagaaucaaaguuagaugaccuagauucaaucuuagaugacgaccaauucacagugcuagauacagcaaauagaauauacuccacuaucacauuaaaugaaaucuuaaauggagaaucuuacuucucaauggcuaaagucaaccaauaugaaaaccacgcaauagaucuuuguaagcuaagagacauguggcacacaacaaaaaacgaaaaagccgucggacuauccagacaagcauacgaugacuauaucaauaagccaaaauauggaacgaaagaacuuuauacaucucucaaaaaauuucucaaaguugcacuaccaacuaaccuugccaaagaagccgaagaaaaaauaagcaaagguacauaucuagugaaaccaagaaacucagaaaauggaguggucccuuaucaauuaaauaaaauugaaauggaaaaaaucauugauaaccaaucccaauauuaccccuuucuaaaagaaaacaaagaaaaacuccuaucaauuuuaagcuucagaauucccuacuacguaggaccacuacagagcuccgagaaaaauccuuucgccuggauggagagaaaguccaacgggcacgcgcguccauggaauuuugaugaaaucguugaucgcgaaaaaagcucaaauaaauucauaagaagaaugacugugacugacaguuacuuagucggugaaccgguacugccaaaaaacucacugaucuaccaaagauaugaaguccuaaaugaacuaaauaacauuagaauaacagaaaaccugaaaacuaauccgaccgguuccagacuuacaguggaaaccaagcaacacauuuacaacgaauuauucaaaaauuacaaaaaaaucaccguaaaaaaauuaaccaaaugguuaauagcccaaggauacuacaaaaauccuauauuaauagggcuuucacaaaaagacgaauuuaacuccacucucaccacauaucucgauaugaaaaaaaucuucgguaguucuuuuauggaaaauaacaaaaacuacaaucagauugaggaauuaauugaauggcuaacaauuuucgaagauaaacaaauauuaaaugaaaaauuacacuccucgaacuacuccuacacaagcgaccaaauuaaaaaaaucucaaauaugcgauauaaagguuggggaagauuaucaaaaaaaauacucaccuguauaacaacagaaacuaauaccccuaaaaguuuacaacucaguaauuauagcguucucgaucuaauguggaccacaaacaauaauuucauaagcaucauaucuaaugacaaauacgauuuuaaaaacuacauugaaaaucauaaccuaaauaaaaaugaagaccaaaacauuuccaauuuagucaacgacauccaugucucuccugcacuuaaaagaggaauuacacagucuaucaaaauaguacaagaaauuguaaaauuuaugggucacgcaccaaaauacauauuuauagaggucacaagagaaacaaaaaaaucagaaauaacaacauccagaggcaaaagaauacaacgacuacaaucuaaacuauuaaauaaagccaacggcuucaaaccccagcucagaaaguaccuaguuccaaaugaaaaaauacaagaagaauugaaaaagcauaaaaaugaccuauccagcgaacgaauaaugcucuauuucuuacaaaacggcaaaucucucuauagugaagaaucccugaauaucaacaaacugagugacuaucaaguagaccacauauuaccacgcacuuacauaccggaugacucacuugaaaauaaagccuuaguauuggcaaaagaaaaccaacguaaggcagacgacuuauuacuuaacucuaaugucauagauaaaaaucuugagcguuggaccuacaugcuaaacaauaauaugaugggccuaaaaaaauucaaaaaccucaccagaagaguaauuacagauaaggacaagcuagguuuuauacacaggcaacugguucaaaccucucaaaugguaaaaggcguagcuaacauacucaacucaauguauaaaaaccagggaacaacauguauacaggcaagagcuaaucuuucaacagcauuuagaaaagcauuaucagaccaagacgacagauaccauuucaaacaccccgaauuagugaaaaacagaaacauaaacgacuuucaucaugcccaggacgcuuaccuugccucguucuuaggaaccuauagacucagacgauuccccaccgacgaaauguuacucaugaauggcgaauauaauaaauucuauggacagguuaaagaauuauauucaaaaaaaaaaaaacuacccgacaguagaaagaauggauucaucauuucgccacucguaaauggcaccacacaauacgacagaaauacaggcgaaauaauauggaacguaggcuucagagacaaaauccucaaaauauucaacuaccaccaaugcaacguuacaagaaaaaccgagauaaaaacuggccaguucuaugaccaaaccauuuauuccccuaaaaaccccaaauauaaaaaacuaaucgcccaaaaaaaagauauggauccaaauauauauggcggcuuuaguggagacaauaaauccuccauaacaauuguaaaaauagauaauaacaaaauaaaaccaguagcaauaccaauaagguuaauuaacgacuuaaaagacaaaaaaaccuuacagaauuggcuugaagaaaaugucaaacacaaaaaaucuauucaaauaaucaaaaauaauguacccauaggacaaaucaucuauagcaagaaaguaggacuacuaucauuaaacucggaccgagaaauugcaaacagacaacaacuaauacuaccaccagaacacucagcacugcucagaauccuccaaauaccagacgaagauccagaccaaauacuagccuucuaugacaagaauauacuaguugaaauccugcaagaacucauaacaaaaaugaaaaaauuuuauccuuuuuacaaaaaugaacaagaauuucuagccucaaauaucgaaaauuucaaccaagcaacaacuucugaaaaaaucaauucucuagaagaacuaauuacacuccuccaugcaaacucuacauccgcacaccuaaucuuuaauaacauagaaaaaaaggcuuucggucgaaaaacucauggacuaacacuaaacgacaccgacuuuauauaucaaucaguaacaggcuuauacgaaacacguauucacauugaauga

SEQ ID NO: 8850 - RNA, 4071 nt, Artificial Sequence
  Cas9 variant
augaguaaaaaggacucagaauauuacaucggacucgacauaggcacaaacaguguuggcugggcagucacaaacggaaaauacgaccuucuaaauaucaaaaaaaaaaaccuauggggaguuaggcuuuuugaagcagccgaaucagcagcugguaggcgcauuaauagaucaacuagaagacguuaucgaagacgacggaaucgaaucaauuggcuaaacgagauauuugcagaugaauuaucaaaaguagacccaucauuucuaacacgauuaaauucauccuggauaucaaaaaaagauaguucacgaaccagagauaaauauaaccuguucauggacgccgauuauacagauaaaaacuaccaucauaaauauccaacaauauaucacuuaagacgggacuugauguuugacgauaaacaauucgauauacgacuaguuuaccuagcacuccacaauauaaucaaauacagaggaaacuucaccuaugaccacagaaaauucaacguaucagaaaugucuucaaaucuaacaaaagcauuagaaaacuucaaccaagaacuuauggaauuugaagacgcguuuccagauaacacagacuacagugcaauaucggaaguacuccucaaaucuaacaacguauccacaaaaauagacgaaaucauuucgaaucuagaacucgacaaagacacaaaaaaguaucucaaagaagugcugaaacuaaucuuaggaaauuccgcaaaccuaaacacuaucuuucacacaucacuugauaaagacgacgaaaaauuaagccuaagcgcaaaagauaucgaauuaaaacucaacaaccuggacagccuucuuucggacgaacagauccauuuuaucucuucugcaaaugaacuauacucaucaauaacccucaacgacauauuggacggcaaaaccuaccugucauuagcaaaaauaaaacaauaugauacacauuguuccgaccuacaagaauuaaaggaaaugugguauaaaacuacgaacccagaccuuaucaaaaaaucaagaaaagcauacaaggaauauguacacgguaguuauaauacugaagacuuuuauaaagcaauaagucccuuccuaaaaauugcaauccccgaggaccuugcaaaagaugcacuaaagaaaaucgaugcaaauaccuaccucccuaaacaacgcacaaguaauaauggcguaauacccuuucaacuaaaccuaaucgaacucgaaaaaaucauagacaaccaaaguaaauacuauccauuuuuaaaagaaaaucgagaaaagauaauauccauccuuucuuuccgaaucccauacuauguagguccaauccaagcaccaacagauaaaaauuuuucauggauggugaaaaagauacaagcaaaagcuagaccuuggaacuucgacgaaguaauagaucgugagaaaagcuccaauaauuuuaucaaacgcaugacuaccaccgauacuuaccuuguuggagaaccuguguuaccuaaaaacucacucauauaucaaaaauuugaaguucucaaugaacuaaacaauauuagaauaucuaaaaacuuaucucaagacccacuaggcaguaaauuaagcguagaaguaaaacaacaaauauucgaagaauuauuuaaaagauacaaaacaguuaaaagcgaucaacuuaaaaaauggcuaauucgaaacuccuacuucaccgaccccacaauaauaggauuaucaaaaccauccgaauucaacucaagucuaagcaccuucauagauaugaaagccaucuuuggaauggacuucguaaacaauccccgaaacaguucucaacuagaagagcucgcggaaugguuaacaguguucgaggauaaacaaauacuauccgaaaaaauacgucacuccaacuaucccuacucugaccaacaaauccgcaaaauaagcaauaugcgauaccguggauggggacguauauccaaaaaauuacuaugcgauauuaaaguugaaucaaccauauacaaaucucaucaacuucaucccuauuccauauuagaccucauguggucaacuaauaacaauuucuacaguauacuccauaaagacaaauacaauuuugaaucaauacuagaagauuacaaccuagguaccgacgacaaaaccgauauaaaugaacuggucgacaacauccauaccucacccgcacuaaaaagaggaauaauccagucaaucaacaucgucaaagaacuagucaaauucaugggacacgcuccacaacacauauuucuugaauuuacacgcgaagacaaaacuucuacgcuuuccgaaucuagaaaaaaacgccuaaagaaauuauauaacaaucuauccgaagacacaaaaaaauucaaauuagaccuaagggacuaucuugucccagacaaaucuauccagaaagaauuagaaucacacgauaaagaucuuucaaaagaaagauugaugcuuuauuuccuacagaauggaaagucccucuacucagacgaggcacuugacauuaauagauugagcgaauaccaagucgaccacauuuuacccagaaccuacauuaaggacgauucacucgaaaauaaagcgcucguauuagcgaaagagaaccagagaaaagcagaugaucuauuauuacaacccuccauaauaaacaaaaacauggaacgauggauauacaugaaagaucacggaaugauaucacccaaaaaguuuaaaaacuuaaccagaaccacaauaacggaagaugauaaaguccacuuuauaaacagacaacuuguacaaacuucacaaaucauaaagaacguugcaaauaucuuagauaauauguauaaagaacagggaacaacaugcguugaaacaaaggcuaacuuaucaucugcuuucagaacagccuucuccgaacaagacgacaaauaucacuucaaacaccccgaauuuauaaaaaaucgagacgucaaugacuuccaccaugcucaagacgcuuaccuugcaugcuuacucggacuauacagaauccaaagauuuccaucagaugaaaugcugcugaucaaaaaagaauaucgaaaauuuuucgcccaagcccaaaacagcguuaaaaaucacggaaaaauaccugauucacaaaaaaacggcuucaucuuagcaccauuaguaaauggagaaacucuaaucaauaauaaaaccauggaaacgauuuggaauauggacuacaaacgaaaaguuauuaaaauauucaauuacaaacaauauaacauaacaaaaagaacugaaauaaaaacaggcgaguuuuacaaacaaaccuuauauucaccacacgaugaaaauguaaaaaauccuauaccucaaaaaaaaaaccucgauccaaaaaucuacggaggauacucaggcguacaaucaucuuauuuagcaaucauaaaaguagaucaaaaaaaacccacuaugguuaguguaccaaucagauucucaaaaaugauagacgacggaaagcuaucgcugcaaucuuggcucgagaauaauauaaaacauaaaaaaacaauagaaguacucaaaacgaaaauaccgauaggucagcuaacuuauaaccccaaaaacggcuaccuuucaguacaaagugaaaaagaaauagcuaaugcccaacagcuauuccuacccuucgaacacguagccuuacucacacuacuacaugcaccuaccucugaauaugaucaaauacuauccuuuuacgacacagauauacugcuggaaauauucgacgagauaacuaacaagauaaaaacauucuuuccauucuauauagacgaacaagaauaucucguaucaauuagggaaaacuuccagagugcaacaguaaucgagaaaguuaacguacuacagcaacuuuuaauaaugcuacacgcaaauucaaguaggaucuccaucaaacuaggugaagucucgaaaaaagacuuagguagaaaaaaaaaacgcauuccacuagaaaacacagauuuagucuaccaaucaguuacaggucuuuaccagacaaaauuccacauagacuga

SEQ ID NO: 8851 - RNA, 4074 nt, Artificial Sequence
  Cas9 variant
augaacgacagaaauaaaaaauacaauauaggacuagacaucggaaccggcucaguuggaugggcgguaacagacaacaacuauaaccuacuacacgcuaaaaaaaaaaaccuauggggcaucagauuauuugacggcgccgaaacugcagccuccaggcgcacauuccgaagcacaagacgacgauaccguagacgccgaaaccguauaaauugguuaaacgaaauauuugccgacgaacuugcaaaaaaagaccagagcuucuuaguaagaaugaauuccucuuggguaucaaagaaagauaaaaucagacaacgagaccaguacaaucuguuuauggacagcgacuacacugacguugaauaccacagagaauucccgacaaucuuccacuuacgaaaaagacugauagaagacaaaucacaagccgacauuagauuaguuuaucuugcacuccacaacaucauaaaauauagagguaacuucacauaugaacaccaaaacuucgacguaucacauauggacucugguuuagcccuacuacuaaaucaacuaaaccaacaauuacaggcauucgaaguugcauucccagaugaaacaaauuuugaaucaaugucaacuauauuguuagaaaaaaaaacacccacacaaaagauagacgagauaguagaucaaauacaacccgaaaaagaccuacuucaaauuacuaaaaauauaaugaaaauguuguuaggaaacaaagcggaucucguaaaaauauuuucacucgauagugacgacaaaauuacaguugaauuuaguucaaacucgauagaacaagaccucagcaaccucgaagaaacccuuuccgaugaacaauucaauauuaucacacucgcuaacucaauauauucuucuaucguauuaaacgacauauuaucgggugaaacuuaccuaucguucgcaaaagcaagacaauacucagaccacaaaaaagacuuagcgaaacuaaaaacaauguggcgagaaagccccgaccguaaagcaguuggaaaagcgaaaaaagccuaugacgacuaccuacauucuggcaaauauggcaucgaagacuucuacaaagacaugaguaaauuccuagaaacggccacgcccguugaguuagcaaaggaagcuaaugaaaaaauacucaacaaaucauaccuauuaaaacaacgcaauaacgaaaacggaguaaucccauuccaacugaacaaaaacgaaaugaucgaaauaauaaauaaucaagcaaaguacuacccuuuucucgccgaaaauaaagacaaauuauuaucaauacuuucauuucgaauucccuacuauguugguccauuacaauccaaaaaagacaacccauucgcauggauggaaaagaaaucacaaggcaaaauacgaccguggaauuuugacgaaauaguagacagagaagcaucaucaaauaacuucauccguagaaugacaucaacagauacguaucuaauaggggaacccguauuaccauuaaaaucacccauauaccaaaaauaugaaguacucaaugaauuaaguaaugucagaauaaacgccgaugaagucgacaauccacugggugauaaauuauccguagaucucaaacaagcaauuuacaacgaacuguuucuuaaacacagaucagucuccaaagcgcuauugaccaaauggcuaaucaaccaauccuauuuucagaauccacaaaucuccggccuggcugauagcaaaaaguuuaauuccggacuuacaaccuaccaugacuucaaaaaaaucuucggagaagauuuugugaacgaccccacuaaucaaucacaauuagaacaauuagcugaauggcucacaaucuuugaagacaaaaaaauauuaaaaauuaaacuagaugacagccaauucaacugcacuccggaacaaauaaaaaaaaucgccgguaugagauaccaaggauggggacgacuuucaaagaaacuacuaugcgacauaaaaacaacaacugucaccucgaaaaaccaucaacaagcuucuuacagcauauuagacuuaauguggaauacaaaccgcaacuucauaagcgucuuaaaaaacgacacauacaaauuugaagauaagauacagaccuuuaauuuggacaaaaaugaagccgccacuccacaagcaaugaucgaugaauuacaaacuaguccagcauuaaaacguggcauccgucaguccgugacaauaauucaagaacucguaaaauucaugggacacgcgccagaacauaucuuucuagaauucacucgagaagaugauguuucuuccuuaacaaagagucgugacucccgacuuaacaaacucuaugcaagaauagcaaaaaauacaaaaaaaaccgacgacgaacuaaaaaaaagcuuacuucccucaucugacaucaaagccacacucaaagcaaacaaaaacaaccuaagcaacgaucgacuaaugcuauauuauuuacaaaugggcaaaagucucuauucaaaccaaccccucgacauaaacagguuaucagaauaccaaauagaucacauacuaccgcaauccuauaucaaggacaacagucuagaaaauagagcucucgucuuagccucagaaaaucaacacaaauccagugaccuauuacuaaaaccagagaucaucaaccaaaauaucgcccgauggcgauacaugaaagaugcaggacuaaugggcccaaagaaauucaaaaaccuaacaaggauacaaauaacggauucggaccaaaacaacuucaucaacagacaacuaguccaaacaucccaaauuauaaaacacguaucaaauauucuagacuccauguauggagaucaaggcacacaaugugucgaaacacgcgcgcaccuuucaacugaauuucgcaaagcauucagcaaugaagaugacaacuaccauuuucaacacccagaauuuguaaaaaauaggaauauaaacgauuaucaccacgcucaggaugcuuacuuggcaugccuauuggggcucuaccaaaugaaaaaauacccaacagauaauaugauacucuuaaaaaaagaauacaaaagauuuuucaguaauacuaaaaaaauauacgacaaaaagcaccacuucccugauuacgucaaaaauggcuggauaauaggaucaauguuuaauggagaaaaauacguagaugaagaaaccggccaaauaauaugggaucaacaaacgaaagacauggugagcugcaucuuccaauauaagcaguacaacguaaccaaaagaacugaagccgccaacggagaguucuacaaccaaacaguuuauaaaaaagaucccaaugaaaaaagaaaacuaauaucucuaaaacaaggcuuagauaccaaacuauauggaggauacuccggugacaacccagccuacauaguacuuguuaaaauagaugauaaaaaaaauaaauuagucaaaaugcccaucagguuagcagaacaaguagauaacaagacuauagauuuacaaaccuggcuagaagaaaauguaccccacaaaaaaggaauccaagugcucaaaacaaaaaucccauugggacaaguaauauauagcaaaaaaaacggcuaccuugcacucaaaucagauacagaaauugugaacgcacagcaauugguccuccccuaugguuauguagcccucuuaacccuauuacagaagaugccagaaaauaaauacgaugaagucuuagcauguuaugaugacggaauauuagacaacauauucguagccaucauagauaagaugaaacacuucuauccauacuacuccggagaauuaaaaacuuugucagauaacaucgauaauuucaaagaaagcccagacgugaauaaaauuaagacacuccaacaacuacuacuuuuacuucaugcaaguagcacaacagcuagcauagaauucaauaacguuaaaaaaaacucacugggacgaaagccaaauucaaucaacauccagaacacggaucuacuaucauuuagcgccacaggacuauaugagucaagaauacauauagacuga

SEQ ID NO: 8852 - RNA, 4074 nt, Artificial Sequence
  Cas9 variant
auggcagcuaaaaacuauaauaucggauuagauauaggcaccaguaguaucggcugggcuauaguggacgacaauuaucaacuuaugcacgcaaaaggcaaauacggcuacgguacaagaauauauucggaaggacaaacugccgcagauagaagaggauuuaggacaacaaggagacgacucaaucgaagaaaauggagguuacgauuacuacaagacuucuuugaacccuacauauuaccacaagaugaagcauucuuuauucgacaaaaacaaaguaauuuagucccccaagauaccaagaaacaguacccugaaucaguuuuauuugaugauaccucggacaaagacuuuuauacagaauacccgacaauauaucauuuacgucaagcacuaaugacagaaaaccgccaguucgacauuagagaaguauaccuagccauucaccauauaguaaaauaucgaggacauuuucuuaacaaugcaccgguaaaaacauucaaaucggguaaccucgauuuagcaaucaaauuuaaugaacuaaaugaggaauuuaaaucaguauacccugaccuugaacuacaauuuaaccucgaccaaauagaugagauuaagaaaauauuacuagacucaacgaaaucaagguuugaucgacaaggagaggcagucaaacuaaucuacacuguaucagaggucaaaacuauagaaaaacuacaaaauaaaauuguaaaacaauuccuaucugguauacuaggcuuaaacacacgcuucgacguucuuacaaauacagagagugacgauucaauguggaaauucucccuugauucagaaucuucggaugaugcacucgaugaaauuaucgcgcaacuugaugacccagcaauccauguaguagagcuaguaaacgaaauacacucaucuauaaccuuagcaggcaucguaccggaaggacaaggauuaagugaauccaugguagaaaaauacgaagcucauaaagcacaccuccaauuacuaaaagcaguagaaaaauuaguagauaagaaagccgccgauaaacuugagguggccuacgaccaauauaucaacggaaaagacuccaaacaauuuauuaaagaagacuucuauaaagccguacaaagugaaauuaaagguguagcaggagaugaaguggcagagauaaaccaauuaauagaauuagaucaauucaugccaaaacaaagaacaaaggaaaauggagcuauaccacaccagcuacaucaacaugagcuagauguaaucauagaaaaccaaucaaaauauuacgacuggcuaggggagaaaguuggaaaugaauacaaacuagauaagcuagugagcuuuaggguaccauauuauguagggccucuagucgauacagcaucaaaagaaaagaaagacgagacuagauuugccuggaugguaaggaaaaauccagaauccacagaagcuauaacuccauggaauuuugaagauauaguagauaaaaacgcaagcgcggaaaacuucauuaaacgaaugacaacgaaagauaaauaucuucucaacgaagauguauugccaaaaugcagucuacuaacacaagauuuugaagucuauaaugaauugaacaacauccguguaaauggagaaaaauucacagcggaacaaaaacagcuaauacacgacgaacuauuuacaaaacaugcaucuguaaguauaaagcaacuaaaagacuuccuaguaagcgaacuaauguauguaagagauaaccuaaaaguagaaggauuagcagaugaaaagaaacuaaugucaucacuaucaacucaguuugacuaccagaaaaucauaccggaccaaauaaaugacgucaaauauagagaggacauagaacaaauaauagaaugguccacaauuuucgaagaugccgcuauauuuaaaacaaaguuaaaggagaucgacugguuaacagacgaacaaagaaauaaauuagcaaacaaaagauauagaggauggggaucacugucaaaacgauuacuagcaugucuaguagaugagaauggccaacgaauaauugacauuuugagagauucaagugauaacuucaugaugauaguaaaucgaccugaauuuaaacaagcgaucuuugaugaaaacgcaaacuuaacagagacaaauaguaaaaaggauauguucgaaaugaucgacaacuucuauacaucaccucaaaacaagaaagcgaucagacaaguauuauuaguuguacaagauauacaaaacgccaugggcgguguagcaccacagaaaauauucauugaauuugcaagggaggaugagguaaacgggcgccgaacaaauuccagauacucccaaauaagagaaauguauucaaaggucacggaugauguuauaaacaaaaccguaagaggugaauuagaagcaaauaaagggagcuuaaacaaagaaaaauuauuucuauauuuucuccaaggcggaauugaucuuuacagcggcaagaccauaaacauagacaauaucucgucguaugauguugaucacguucugccgcaaucguuuauaaaagaugacucuauaaacaauaaaguuuuaguaaacgcaaaaggcaauagagucaaaaacgacaauguaccaauggaguuauucggagcuaaaauguauccaacauggaaacgaaugguagacaccggaauaauguccaaagcuaaauucaaaaacuuaacccuuaauccagauaacgucgacaaauucaaagcggaagguuucauuaacagacagcuaguugaaacaagacaaauaauaaaacucguagcacaaauccuaaacgauaaacuaggagaugacacaaaaauagucaguguaaaagcaaacuuaacacaugauaugagaguauuuuucgacuucccaaagaacagaaauguuaauaacuaccaccaugcuuuugacgcauaucuaagcgcauucguagguacuuaccuauauaaacgcuauccaaaauuacaaccauacuucgucuauggagaguucaagaaaauggacaaacuuaaaaauaugaccucuuucgauuucuuaagagaucuaaaacacacagauaaagucguugauaaagacacaggugaaauaauagccgauaaacucgcuguaauaacaaauaugaacaaaauauaugauuucaagaaaguccuaguaacccaugaaguacacgagaauaguggugcaauguacgaucaaacauuguauccagcaaaacucgacaaaucgcuagggagaaaaggggcaaaacaacuuauaccuaagaaagacgauaugccaacagcucuauacgggggcuacacuggaucaaaagacgcauucaugagcauaguaagauuaaagaagaaagaugaaguauacuauaaagucauagguauacccgucaggaucgcugacucaguacaacauggaaaagaaguagauguagaagcauuaacucaauucauagaaacuaaauuuaccaaagaaaaucugaauaagaaaacaggcgaaauaaccaggaaaguggaaugguuugagcuaguacuaccuaaaguacuauucggccaagcaguuuucgaugguggacaaccauucaugcuaggaucgaguacauauccacauaacuuaagagaacucguucuaacaaaagacaguguuaagaaaauagccgguaaagaaagcaauaaaucuuauuuagacgcauacgacgaaaucauggaagcgaugaauaaauacuucccacucuaugacacaaauaaauucagagaaaaagugauagaagguagauccaaauuuauagaccuuccagauaaagaugaauaugaaaauaauaaacuuguucaaguugguaaaucaaccaucauugauagaauguuuauaggccuacacgcaaaugcagcaagaacagaucuuaaaaauauaggcauaacaaccccauuuggauuuaugcaacaagcaucagguauuaaacuaacaaaagacacagugguccuauuucaauccaguaccggucuauuugaaagaaaaguagcacuaaaagaucuuuga

SEQ ID NO: 8853 - RNA, 4077 nt, Artificial Sequence
  Cas9 variant
augaaagaaccuuauggcgucggccuagauaucgguacuaauaguguuggauggaccguuguagacgcaucgggucauguacgcaaaauaaaaggacaaacagggauaggaguaagauuauuuaaagagggagccgcagccgccgaccgccgcggauuuagaacuacaagaagacgucuaaaacgcguaaaauggcguuuacgauuauuaagagaauuuuucgaccaaccaauuuccaaaguagauauuaacuuuuucgcccgacgaaaguauuccgauguaagcccccgugaucccaauuauaacggucuggagaaaacguuguuuaaugacagaucagaucaagauuuuuaccaugacuacccaacuauauaccauuuaagagaagcucuaaugacacaacacagaaaauuugauguccgggaaaucuaucuagcuauacaucauauaguaaaauauagaggcaauuucuuaagaaacgaugcagccacggcauauagaaguggaacacuagaccugcaacaacauuucgaaacucuaaaccauuuguucucccaagcagaucuagaguuaaaucuaaaucuuacuaccgauguugcacuucuugauucaaucaagcaaacccuaguaaggacagauauaucucgcagugaccgacaaaaacucauaaugccgcuuuuagcuguuuuaacaggugcaacaaccgccgaaaagaaaagacaaaaagccguaguuacagaguucgcuaaagcauuagucggaaauaaaacaaaaauugauguucucacauuaaccgacaucgacgcuacagaagcuaaagauugggcuuucucacucgaagaaaaccaagauaaacuuccaggaauugaagaucgguucagcgaaguugggcagcaaauaauagaugaaguaauacgcuuauaugccaguguaaaucuggcacaauuaaucccugaaggaaaacgauucagccaauccaugguggaaaaauacaaacggcauggggaagacuuaaaacuuuuaaaggcauacauucgaagccaaucagaugcaaaaagaggucgagcaauaagagcuacauaugaccaauacauagauggaguaaagucaaaacaaguuacacaagaagccuuucaaaaagccuuaggaaaguucguugacgcagacguagacuuaaacucaugggccgcucagaucaaacaagcgauagacucugaacaauucaugcccaaacuaagaacaaaacaaaacggcgcaauaccuuaucaaguucaacaaaacgaacuggaucaaauaauaucgaaucaaaaagaauauuacccuugguuaggugaagaaaauccagugauuaagagacgaggaaaauucccauauaaacuugacgaacuauuuggcuuuagaguacccuacuauguggguccacucauaacaaaggaaaugcaagcggcaacggcuaacgcagguuucgcauggaugguaagaaaagcagauggaccaauuacaccauggaacuucgaugacaaaguggacagaguagccucggcuacagcuuuuauucaaaggaugcagacaaccgauacuuauuuaauaggugaagaaguccucccugcuaggagcuuaauuuaucaaagauuuaugguacuaaacgaacuuaauaacauaagaguagaugauggacaacuuacaccuagacaaaaacaaagacuauacaaccaaguauuuaagaaacauaaacguguaaccgccaaaaacauacaggauaacuuaguugcagcacgcgaauuuccaacggcaccaagaauaaccggacucgccgacccaaaaguauucaauucaagccuaagcacguaccaugacuuaaaacaagugcucccagaagcaaugagcgaugucagaaaacaagccgauauagagaaaauaauauuauggucaacaauauuugaagacucuacaaucuucaaacaaaaacuuacugaaaucucaugguugacagcagcacaauuaaaacaauuaggccaauuaagauaucgagguuggggucaauuacuucgaaaauugcuaacaggguuaaaagacgauaauaaccgaucuauaauggauggcuuaugggaaaccaacgcaaauuuuaugcaacuucgaucacaaccagccauagaaaaucaaauuaaaucagcaaaucaagcuaaucuaacgacagccgaccuacaggauacuaucaaugaacucuauacgucaccacaaaauaagaaagcuauacgugaagucaugguaguacucgcggacauuaaagacgcaaugcacggucaaacaccuaauuggauuuucguugaggcggcgagaggaggaggcguugccggcagaagaacacaaucaagaucaaaacaaauuguagcugcauaucagggcacggcucaggcaauaguaagagaucaaguacaaagagaacucaaagagaaaaucaaaaacaaagcaaacuuuaacacacgacucguacuauacuucuuacaaaauggcagagaccucuacacaggcgacgcaauaaacauagaccgacucagcgaauacgauauagaucacauacuuccacagagcuuagucaaagacgacucuuuagacaaucgaguacuaacuaaugccagaaucaauagagagaaaaaugacacauuugcaagugaaaaauucggaaagaaaaugggugcaaaauggaaagaaaugcaucgaaugggacuuaugacuaaaagaaaacuugaucaccucuuaaugcgaccugacgaaauauccaaauacgcgacuggauucaucaauagacaauuaguugaaacccgacaaguaauuaaacucguagaagaacucauaaaugcagaauaucccucaacggcuauaguaagcguaaaagcuaaucuaacccaucaauucagacaaacauuugauuuucccaaaauucgcgaaguaaacgacuaucaucacgcuuuugaugccgcccuaacagcuuuuauaggcaccuacuuacucaaacgauacccgaaacuagaaagauuuuucguuuauggaaaauuugcaaaacaaccaguuaaucuaacacgcuucaaugucauaagaaaauuagcaaaaacggacacuccuauaacagauaucgacacaggagaaguacuaugggacaaacuaacagacauaaaauacuuugaaacauuauacgauuacaaaagacuauuagucacaagagaaguaagugaaaauuauggagcgauguuugaucaaacguuacuuaaagcaucugauaaugguaaacgauuaauacguaagaaacaaucauucgauacagcaauauacggagguuauacagguaaaacauuagcuuauauggcaauugucaaagucucaacaaagaaagacguucaauaucaaguaguagggguaccgaccacuaugguaacccaaauagaacaacucgaacaacaaggaaugacaaacaaacaagcugucacgaaaguaauagaaccauuaauagccgcaaacaauaagaaaaugcuaacauacgaaguacuucuacccaaaguaagauuugaacaaguuguacgagacagaauuaaaggccaaacacaccgguuugccuuagggacagacacauauuaucacaacauacaagagcuguaccuaccucuaacacugcagcgcgcguuuuugggcaaacaaaacgaaagcgagguccaacugaaccaaaacuuacuaacuguuuuugacgccacccuagcacagguaaauagauacuuuccccucuacgaaaugaauaaauucaagaaaaucuuaaauagcgcaagagaccaaauagaacuauuagaagcgaaaaaucaauuuguuaaaaacaaacugguauuagguaaacaaggaauauuaaccaacauguuuaucggauuacacgcuaacgccucguauggagaccuaaaaguacucggaguaaaaaucgauuuuggcaaauuacaaguacccggagggauaaaacuaacaggggaugcagaaauaaucuaccaauccccaacagguuuauucgagagaaaaauagcgcuaaaagaccuauga

SEQ ID NO: 8854 - RNA, 4077 nt, Artificial Sequence
  Cas9 variant
augaaugaaccuuauggaguaggauuagauauaggaaccaauucagucggauggaccguaguugauaugaacggacguguaagaaaagugaaaggaaaaacugcgcuaggagcacgacuauucaaagagggagcgacagcagaagacagacgaggcuucagaacaacuaggaggagacuuaaaagagucaaauggagacucagguuauugcgugaguucuuugaucaacccauuucaaaaaucgauccaaacuuuuucgcaagaaggaaauacagcgauauaucucccagagacccaaacuacaauggucuugcaaaaacccuuuuuaaugacagaacggaucaagaguucuaucaugacuauccaacaauuuaccaccuaagagauaaacugaugacaagugaucgaaaauuugacauacgagaaaucuaucucgcuauucaucauauaguaaaauauaggggaaacuuucuuagaaccggccccgccucucaauaugguucagcaucguuacacuuagcaaccagcuuucaaaaauuaaaugaucuauucgcucaaagugaagagagcuuaaacuuuaaauugguaacagaugaagcccaauuacaacagauucaacagauauugguaagaacagauuuaagcaggucagaacaacaaagacaaauauggccccuaaugguaguauuaaugggcgcaacggccgcagaaaagaaaagacaaaaagauuuugccaaagaacuagcuaaugcacuuguaggacugaaagcuaaacucaauguugucaccuuaacuaacguagacacaacaguagugaaagauuggacauucacacuggaagaaucacaagauaaacucccugaaauagaagaacaacuaucggaaguagggcaacaaauuauggaugaaguaauucaacucuacgcaagugugaauuuggcccaauuaauucccgccggcaaacgauuuagucaacauaugguugaaaaauacaaucaucaugagaaaaaucucgaauuacuaaaggcuuacauccacucacaaucugacagcaaaagaggaagagaaauacgugcaaccuacgacagauacauagauggaguaaaaaguaaaccaguaacccaagaaauguucuacaaagaucuuaugaaauauguagaagcugacgcaacauccaaccaucuugcggcugaaaucaaagaugaaauagauuccgaacaauuuaugccaaaacuaagaaccaaacaaaacggaucaauaccauaccagguucaacaauaugaacuugaccaaauaauaagucaucagaagaaauacuacccaugguuaggcgaagaaaauccaguagcagaaagaagaggaaaauuucccuauaaauuagaugaauuaguaggauucagggugccuuacuauguugggccauuaaucacuaaagaagaucagcaagcaacaucaggagccggcuucgcauggaugguaagaaaagcggacggaccuaucacuccauggaauuucgaucagaaaguugaccggauagccucugcaacagcauucauacaaagaaugcaaacaacagacacauaccuaaucggugaagauguacucccugccagaucucuaauauaucaacgguucaugguucuaaacgaacuaaauaauaugagaguagaagaccaaaaauuagcaccaaggcaaaaacaaagauuauacaaccaaguguucaaacaacaucaacauguaagugucaaaaacauucagcaaaaccuaauggacgcaggggaauaccgagaaacgccaaaaauaacgggucuagccgacccaaagggauuuaauucuucccugucaacguaucacgacuucaagaaaauacuuccugaagccaucgccgaugaacauaaaagagccgacauagagaaaauaauacuuuggaguacaaccuuugaagacucagcaauauucaaacaaaaacuagaagaaguagccugguugacugaugcacaacgaaaacaacucucugguuuaagauaucgaggauggggucaacuaucacacaaacuccuaacagccuucaaagaugauaacggaagaagugugauggacggucuaugggaaacuucagacaauuucaugcaauuaagaaaacaacccgcaauagaaacacaaauaaaagaagcaaaccaagcaaauuuaacagacgcagauauacaagacacaauaaacgaacuuuauacgagcccacagaacaagaaagcuauaagagaaguaaugcuuguacuugacgacaucaaaaaugcaaugcauggacagaccccgaguuggauuuucaucgaagccgcacgcggaggcggagucgcaggcaggagaacacaauccagaucaaaacagauaguugaggcuuacaaaucaacggcgaaagaaauaguaucugaaaaaguacaacaugaacucaacgagaaaauaaaagcaaaagcggauuuuaacacacgccuaguacuuuauuuucuacagaauggaagagaucucuauaccaacgaagcgauaaauauugauagauuaucugaauacgauauugaccacauacuuccacaaucacugguaaaagacgacucuuuagacaacagagugcuaacaagcgccagaauaaaucgagagaaaaacgacacauuugccucagaaaaauucggaagaaaaaugggagcucaguggcgagaauuacacagaaacggacuuaugacacaaagaaaacugaaacauuuauugaugcgcccugaugaaauuuccaaacacgcuacugauuuuauaaauaggcaacuuguagaaacgagacaaguuauaaagcuaguagaagaauuaauuagcagugaauauccaucugcaaguaucgucgcgguuaaagcaaaccuuacucaccaauucagacaaacauucaauuucccuaaacuacgcgaagucaacgauuaucaccaugcuuucgacgcaucacuuaccgccuuuauagguauguaucuauuaaaacaauauccuaaacuugaaagauucuucguauacggaaaauucgcuaaacaaccaauaaaccucacaagauucaauguaauucgaaaacuagcagucgcggaagaacccauagcgaauaucgaaaccggcgaaauucucugggauaaaaccgcggauauaaaauguuucgaaaaauuauauaauuacaaacgacuauuaguaacacacgaagucagagaaaacuauggggccauguuugaucaaaccauauucaaagcaacagacucacggaaacgacuaauccagaagaagaaaggauuugcuacagaaacuuauggcggauacacuggaagaacacucgccuauuuagccaucgugaaaguugucacaaacaaagauacacaauaucaaguaguaggaauccccacaacaaugguuacgcagauacaacaacucgaagcguccggucuaacgucuaaacaggcgguaaccaaagcgaucggagcuaugauaaacgagaacaauaagaaauuacaauccuaugagguacucuuaccaaaaguaagguuugaacaagucguaagggacgagguaaaaggccacauacauagauuugcacuaggaacugauaccuauuaucauaauauccaagaauuauaccugccauuaaccauacaaagagcuuuccuaggaaaaagaaaugacacagacgcucagaccgagcaaaaccucuuaacaguauuugagaccacucuagcgcaaguaaaccgauauuucccuuuguaugaaaugaauaaauucaaacaaauacugaacagugcucaagaaaaauuugcggccuugccuacuaaaaauaaaacagucaaaaauaagcuaguuaccggcaaagauggagugcuaaauaaucuauuuauaggacuacacgcuaaugcaucccuaggcgacuuaaaaauacuuggaaugaaaacugguuucgguaaacuacaggucccagguggcuuaaaauugacugaucaagcggaaauaauauaucaguccccuacuggauuauucgaaagaaaaguagcacugaaagacuuguga

SEQ ID NO: 8855 - RNA, 4077 nt, Artificial Sequence
  Cas9 variant
augaacgagccuuacgguguuggacuagacauaggcacaaacaguguuggauggacagucguugauaugaauggaagagucagaaaaguuaaagguaaaacggcauugggggcccgauuauucaaagaaggugccacugccgaggaccgcagaggcuuuagaacuacuagaagaagauuaaaacgaguaaaauggagacuacgauuacuaagagaguucuuugaccaaccaauaucaaaaauugauccaaauuucuucgcaagacgaaaauauucggacauuaguccuagagaucccaauuacaacgggcuagccaaaacgcuguuuaaugauaggacagaccaggaguucuaucaugauuacccuacaauauaccacuuacgagauaaauuaaugacaagugauagaaaauucgauauacgagaaauuuaccucgcaauucaccauauagucaaauacaggggaaauuuccugagaacgggaccugccagccaauauggaagcgcaagucuccaccuggcaacgaguuuccagaaauuaaacgaccuauucgcacaaucugaagaaucuuuaaauuucaaauugguaacagaugaagcucaacuacagcaaauacagcaaauucucguccgaacagaucuaucacgaagugaacaacaacgccaaaucuggccauuaaugguaguuuuaaugggagcaacugccgcugaaaagaaaagacaaaaagacuuugcaaaagaacuagccaacgcccuuguaggacuaaaagcaaaacuaaacguagucaccuuaacaaacguagacaccacaguuguaaaagauuggacauucacuuuagaagaaagucaagauaaacuaccagaaauagaagaacaacuaagcgaaguaggacaacaaaucauggaugaaguaauacagcuauaugcaaguguaaauuuggcacaacucauuccagccggcaaaagauucagucagcauauggucgaaaaauacaaucaucacgagaaaaaucuagaacuccuaaaagccuauauccacucacaauccgacucaaaaagaggacgagaaauacgugcuacguaugacagauacauagacggcgucaaaaguaaaccaguaacacaagaaauguuuuauaaagaccuuaugaaauacguugaagccgaugcuacauccaaucaccuagcagcagaaauaaaagacgaaaucgacucagaacaauuuaugccaaaacuacgaacaaagcaaaacgggucaauuccauaccaaguucaacaauaugaacuugaccagaucauaucucaccagaagaaauauuacccauggcuuggugaagaaaauccuguagccgaaaggagaggaaaauuccccuauaagcuagaugaguuaguuggauucaggguuccuuacuauguaggaccuuuaaucacaaaggaagaccaacaagccacaagcggcgcaggauuugcauggaugguucgcaaagcagaugggccaauaacaccuuggaacuuugaccaaaaaguagauaggaucgcaucagcaacugcuuucauacaaagaaugcaaacaacugauacauacuugaucggcgaagacguauuaccagcaagaucacuaauauaucaacgauucaugguacuuaaugaacuaaauaacaugagaguagaagaccaaaaauuagcaccacgacaaaaacaaaggcuguacaaccaaguuuucaaacaacaucaacauguaucagucaaaaauauucaacaaaacuugauggacgcuggcgaauaccgagaaaccccuaaaaucacaggacuugcugacccaaaaggcuucaacucaucguuaagcaccuaccaugacuuuaagaaaauacuuccagaagcaauugcagaugagcauaagagagcagauauagagaaaauuaucuuaugguccacuacauuugaagauucggccauuuucaaacaaaaauuagaagagguagcuuggcuaacugacgcacaaagaaaacaacuuucagguuuaagauacagaggauggggucaacuuucacacaaacuacuaaccgcuuuuaaagacgauaacggucggucaguaauggaugggcuuugggaaacaagugauaauuuuaugcaacugcguaagcaaccagcaauagaaacacaaauaaaagaagcaaaccaagccaaccuaacagacgcugauauacaagauacaaucaacgaguuauauacaaguccccaaaauaagaaagccauuagagaaguaaugcuaguuuuggaugacauuaaaaaugccaugcacggccagacgccaaguuggauauuuauagaagccgccagaggaggcgguguagcaggcagaagaacccagagucgaucaaaacaaauaguugaggcauacaaauccaccgcaaaggaaauagugucagaaaaaguacaacaugaacuaaacgagaaaauaaaggcuaaagcagauuuuaacacacguuuaguacuauacuuucuacaaaacggaagagaucuauacacaaaugaagcuauaaauauagauagacuaucagaauacgauauagaccacauccuaccgcagagcuuaguuaaggaugauagucuugauaacagaguacuuacaucagcacgaaucaauagagagaaaaaugacacauuugcauccgaaaaauucggucgaaaaaugggugcacaauggagagaacuacauagaaauggucucaugacucagagaaaauugaaacauuuauugaugcgccccgacgaaauaucuaaacacgcaacugauuucauuaaccgacaacugguagaaaccaggcaaguuauaaagcuaguagaagaacuaaucaguuccgaauaucccucagccaguaucguugcuguaaaagcuaaucuaacucaccaauuuagacaaacuuuuaacuucccuaaacucagagaaguaaacgauuaucaccaugccuucgaugcaaguuuaacugcuuucaucggcauguaccuauuaaaacaauauccuaaacuagaaagguucuuuguguaugguaaauucgcaaaacaaccaauaaacuuaacgagauuuaacguaauacgcaaacuagccguugcugaggaaccaaucgcaaauaucgaaacaggugaaauauuaugggauaaaacagccgacauuaaauguuuugaaaaacuuuauaauuacaaaagauuacucguaacgcacgaaguaagagagaacuacggagccauguuugaccaaacaauuuuuaaagccaccgauagucgaaaaagacuaauacagaaaaagaaaggauuugcgacagaaacauacgggggauauaccggacgcacacucgcauacuuagcuauuguaaaaguagugacaaacaaagauacccaauaucaaguaguugguauuccuacaacaaugguaacacaaauccaacaacuagaagccucagggcuaacauccaaacaagcgguaacaaaagcaauaggcgcaaugauaaaugaaaacaauaagaaacuucaaucauacgaaguacuccuaccgaaaguuagauucgaacaagucguuagagaugaagucaaaggacauauacauagauucgcccugggcaccgauacauacuaucauaacauucaagaauuauauuuaccucucacaauccagagagccuuucuuggaaaacgcaaugauacagacgcacaaacagagcaaaacuuacuuaccguauucgaaacaacuuuagcucaaguaaauagauauuucccauuguaugaaaugaauaaauucaaacaaauacugaauagcgcccaagaaaaauucgcagcucuaccaaccaaaaauaaaacagucaaaaauaaauuaguaacaggaaaagauggaguauuaaacaacuuauuuauuggcuuacaugcuaaugcaucauuaggagaccucaaaauacugggaaugaaaauuggcuucggaaaauuacaaguucccggcggacuaaaacuaaccgaucaagcagaaauaaucuaucaaucuccuaccggacuauucgaaagaaaaguugcacuaaaagaccuauga

SEQ ID NO: 8856 - RNA, 4077 nt, Artificial Sequence
  Cas9 variant
augaaagagcccuauggcguaggacuagauauagguacaaacaguguugguuggacagucguagaugcaaguggacaugugcgaaaaauaaagggccaaacagguauuggcguaagguuauucaaagaaggagcagcagcagcagaucgucgaggguucaggacgacacggcgcaggcucaaaagagucaaauggagauuaagacuccuuagagaauuuuucgaccaaccuaucaguaaagucgauaucaacuuuuucgcaagaaggaaauacagcgacaucagcccacgggacccaaauuauaauggauuagaaaagaccuuguucaacgacagauccgaccaagauuucuaucacgacuauccuacaauauaccaccuaagagaggcucuaaugacacagcacagaaaguuugauguucgcgaaauuuaccuagcuauacaccauauaguuaaauacagaggaaacuuucuaagaaaugacgccgccacugcguaccgauccggaacauuagaucuacaacaacacuuugagacuuuaaaccaucuauucucacaagcugaucuggaauuaaacuuaaaucuaacaacugaugucgcacuacuagauucaauaaaacaaacucuaguuagaacugauaucagccgaagcgaccgacagaaacuaauaaugccccuucuagcaguauuaacaggagcuacaacggccgaaaagaaacggcagaaagcaguuguuacagaguuugccaaagcauuagugggaaauaagacuaaaauugacguucuaacacuaacagacauagaugcaacagaagcuaaagauugggcuuucucuuuagaagaaaaucaagacaaacuuccagguaucgaagauagauucagcgaaguaggacaacaaauuaucgacgagguaauacgauuauaugccucaguaaaccuagcacaauuaaucccagaaggaaaaagguucucccaaucaaugguagaaaaauauaagagacacggcgaagacuuaaaacuacuaaaagcauauauaagaucacaaagugacgcuaaaagaggacgagccauacgcgcaacauacgaccaauacauagauggagucaaaaguaaacaaguaacucaagaagcauuucaaaaagcccuuggcaaauucgucgacgcggauguagaccuaaacucaugggcagcacaaauaaaacaggccauagauucagaacaauucaugcccaaauuacgaacaaaacaaaauggugccaucccauaucaaguacagcaaaaugaacuagaucagauuauuaauaaccaaaaagaauacuaccccugguuaggagaggaaaauccaguuauuaaaagaagaggaaaauuuccauacaaauuagaugaauuaguaggguuuagggugccuuauuauguaggaccacuaauaacgaaagaaaugcaagcugcuacggcgaaugcagguuucgcauggaugguacgaaaagcagauggccccauaacaccuuggaauuucgacgacaaaguugaucgaguagcaucggcaaccgccuuuauacaaagaaugcaaaccacagauacauacuuaaucggagaagaagucuuaccugcucgaagucuuauuuaccagagauucauggucuugaacgaacuaaacaauauaagaguugaugacggacaacuaacaccaagacaaaaacaaaggcucuauaaucaagucuuuaagaaacauaaacgagucacagcgaaaaauauacaagacaaccuagucgcagcaggagaguucccuacagccccaagaaucaccggacuagccgauccuaaaguauuuaauaguucccucucgacuuaucacgaucuaaagcagguacuaccagaagcgaugucggacguaagaaaacaagccgauauagagaaaauaauacuguggaguacaauauuugaagacucaacaauuuuuaaacaaaaguuaacugaaauaaguugguuaaccgcagcacaauuaaaacaacuaggacaacuaagauacagagguuggggccaacucucaagaaaauuacucacaggccuaaaagaugauaacaauagauccauaauggauggacuuugggaaacaaaugcaaauuuuaugcaacuaagaagucaacccgcgauagaaaaucaaauaaaaucagcgaaucaagcaaaccucacaacagcagaccuucaggauaccaucaaugaauuauauacauccccacaaaauaagaaagcaaucagagaaguuaugguaguacuagcggauauaaaagaugcuaugcauggccaaacaccgaauuggauuuuugucgaagcagcccgaggagggggagucgcgggccgaagaacacaaucacguaguaaacaaauaguagccgcauaccaaggaacagcacaagugauaguaucagaucaaguacaaagagaauuaaaagagaaaauaaagaauaaggcaaauuuuaacacccgauuagugcuuuacuuuuuacaaaacggcagagaccuguauacaggcgacgcaauaaauauagacagacuauccgaauaugauauagaucauauacuaccacaaagucuagugaaggacgauucucuugacaacagaguccuuacuaacgcgagaauuaauagggagaaaaaugacacuuucgcgucagaaaaguuuggaaagaaaaugggggcaaaauggaaagagaugcauagaaugggacucaugacgaaaagaaaauuagaccaccuacugaugagaccagaugaaaucaguaaauaugcuacaggauuuaucaaucgacaauuaguugaaacaagacaaguuauuaagcuaguagaggaacucauaaaugccgaauauccgucaaccgcgaucguaucaguuaaagcuaaccuaacacaucaauuucggcaaaccuuugacuucccaaaaauuagagaaguaaacgauuaucaucacgcauuugacgccgcacuaacugccuucaucggaacguaccuccuaaaaagauaucccaaacuugaaagguucuucguauacggaaaauucgcgaaacaaccgguaaaucuuacaagauuuaauguaauucgaaaacucgcaaaaacggacaccccuauaaccgacaucgacacaggagaaguacugugggauaaauugacagacauaaaauacuucgaaacauuauaugauuacaaaagacuauuaguaacucgugagguaagcgagaauuauggugcaauguuugaucagacucuauugaaagcaucugauaacggaaaacguuuaauccgcaagaaacaauccuuugacacugcgauuuauggaggauacacaggaaaaacccuugcauauauggcaauaguuaaagucaguacuaaaaaggauguccaauaccaaguaguaggagucccaaccacuaugguuacgcaaauagaacaauuagaacaacaagguaugacuaacaaacaagcaguaacuaaaguaauagaacccuuaauagcugcuaacaacaagaaaaugcuuaccuaugaaguauuacuaccaaaagugagguucgaacaaguaguacgcgauagaaucaaaggucaaacucaccgauuugcauuaggaacggauacauauuaucauaacauacaagaacuauaucuaccauuaacucuacaacgagcauucuuaggaaaacaaaacgagucagaaguacaacuaaaccaaaaccuccugacaguauucgacgcaacauuagcccaaguaaacagauacuuuccucuauaugaaaugaacaaauuuaagaaaauauuaaacucagcacgggaucaaaucgaacuccuugaagcuaaaaaccaauucgucaaaaacaaauuaguacuugguaaacagggcauucuaaccaauauguuuauaggacuucaugcaaaugcaucauucggagaccuaaaauccuuaggaguaaaaacuucauucggucaauugcaagugccaggaggaauaaaguuaacaggugaugcagaaaucauauaccaaucuccaacuggacuuuucgaaagaaaaaucgcauugaaagacuuauga

SEQ ID NO: 8857 - RNA, 4077 nt, Artificial Sequence
  Cas9 variant
augaaacaaggaaaacggggguauuauuuaggacucgacauaggaaccgacucuauaggauaugcaguaacagaugaacaauaccaucuauuacgguuucacggcaacgaugcguggggaucacacguauucgacuccgcaucccugugugacgaacgacgaggauucagaucagcccggcguagacuagauagacgacaacaaagaguaaaacuacuacaggaaauauuugcuaaagagauugcuaauauugacccaagguucuuuauacgacuauccgagagcuacagguggagagaugauacagacgacagguauauauacuucaacgaagaagaguacacagauauccaauauaugagagauuacccaacaauacaucacuuaauaugugaauugauggaaaacgaagaagaacacgacauuagauuaguauaucuagcuugugcauggcucguagcacacagaggccacuuccuuagccaacuaagcguggacaauauugacucauuaauagauaucgaaucgguauaucaaaaauucuuacacuucuuuaucgauaauggaugcgagaaccccuggauacaagacgcugaacucguaggcggaauauuaaaagaacauauugguguaacagaaaaacauaaccgauuaggcgaaauaaugcucgggaauagaaaacccagcaaagacguaagagauacauucuuauauucugaauauugcauaauaagacuauuagcaggcggaacuuguaaauuacgagaccuauacggcaaagaagaauaugaagacuucggauccgucagccuagaaauggacgacgauaaacuagccgaaauaaugauaaauauaggagaagauuaugaacuuauagcgguacuacguagcuuacaugauuggagcguuuuagccgauauacucgacggccaaaacggauugacuaauauauccacagcaaaaguagcgauauaugaacaacauaagaaagacuuggcuacgcuaaaauacuuuauaagaaaauauugccccgagaaauacaaugcgauauucaaagacgcuagagaagacaauuacguagccuacagcuaccacuacaacaacaaacuugacggccagauuaaaaagaaagccgauacagaaacguucagcaaauuuuuaauuaaaauaauccacucaauaaaacccgauaaagaagaugaaauuauuuaucaagacauggauaauagauuaggacuaagacaauucuuaccaaaacaaaggaauacagacaaccgagugauaccccaccaacuauacgaauacgaacugaagaaaauuuuagaaaaugcggcaaaauacuuaucauuccuaaaccagaaagaagaugggauaagcaacacggagaaaauuaucuccauauucaaauuuaaaauccccuacuacguaggaccacugaauaaacacuccgaguucgcauggauagauagaaaaucgggaaaaauauuaccauggaauuaugaaaacaugaucgaugacgaugcgagcgaagaagcauucauaaagaaaaugacuaaccaauguacuuaccuuccaggagaaucaguauuaccaaaagauucucuaugcuaccaaaaauucaugguauuaaacgaaauuaacaacauaaaaguggaugguagaaaaauuucgguuggagcaaaacagggcauauacuccgauuuauuuuuaaaauacaagaaaguaaaacgaagccaaaucgaagaauauuuaauuucaaauggacaauuagagaaaaaucgaagagaaacccuaagcggaauugacauccaaauaaaaucaucacuuucgagucacauagccuuuagaagauuacucgaacagaaaauacuaaacgaagcugacguagaaaggauaauagaacgugcauccuacgcagaggauaaaggcagaguagcaaaauggcuaagagcaaaauacccacaccuaacagaagcagacauaaaauauauaugcaaagucaaaauuaaagauuucgguagacugagucgaacuuuccuuacuggcauagaaggagcgugcaaagaaacuggugaaguggcaacaauaauaucuaugaugugggaaucaaacgauaaccuaauggaauuacuaagcgagagauauacauuugcagauaccauacuagaauuuaaaucagauuauuauacugaaagaaaacaaacccugucagaaagauuagaugaaauguauguaucaaaugcuguucgaagaccaauauaucgaacacuagacauuguaaaagauuuagaaaaagcauuugguaaaccggagaaaaucuuuauagaaaugaccagaggagcgaugccagaauuaaaaggaaaaagaaccaaaucaagacaacaacaauuacucgaauauuaugacaaauguaaagaagaagaugucagagaucuaaaacaacaacuagaagcacuuggagaauauguagauaacaaacuccaaucagauagacucuuccuauacuucaugcaauucgggaaaugcgcauacucuggaaugccgaucucacuugaacgauugauggcaggcagcaaagaauaugauauugaccacauauauccacaagcauauguaaaagaugacucgauuaucaauaacaaaguccuaguacuaucagucgccaacggagaaaagaaagauguuuacccaaucaaaagcgaaauaagaaacaaaaugcagaaaacauggagcuucuggcaccacguuggaacgauauccgacgaaaaauacaaacgccuaauaagaucaacacccuucaccgaagaugaaaaauauggauucauuaauaggcaauuaacugaaacaagccaaucaaccaaaguuguagcggaauuacucaaagaaagguaucccgaagcagaaaucguauacagcaaagcaggacuaauaucagauuucagacaugaauuugaccuauauaaaucucgaucguacaaugauuugcaucaugccguggaugcauaccuaaauauaguagucgggaauguauaccacaugcgauuuucgcgacaaugguucaacgugaacucuucauauucaauaaaaacuaaaacacuauuuacccauacaguaaacugcaauggaaaagaaguauggaacaaagauauguuacccggcguauuaaaaacggcaaagaaaaacacggcccauuucacaaaacacgcuacauucaaaacuggaggauuauucgaucaaaauccaguaaagaaagcuccgggucuaacaccauuaaaagcggguuuacccacagaaaaauacggaggguacaauaaagcaggcguaauguucuucauacccgugagguacaaaucaggaaagaaaacaguacuaaugguacuaucaguagagcucuuauacggaaacagauucuuagaggacgaaauauucgcuaaagaauacgcaaaagauaggcuucaacgaaugauaggaaaaucaguagacgaaaucgauuuuccaauaggaaugcgaccauggaaagucaauacaauccugucauuagauggauucagaauauguauaacaggaaacgcaucuggagggaaaugucuuauugcacaaccuauaaugcaauucucuucagacgaauacuggaaauacuauuuaaagaaaguggaaaaauuuguagagaaagucaaaaacaauaguucuuacguauacgacguagauuaugaugcaguccaacacgaagauaaccuuaaacuuuaugaccuuuaccuggauaaacuacagaauagcauauauagaaaaagaauaaacgccccaauacaaacucuaauagaaggaagagaaaaauuuauugauugcucaguaauugaacaaugccaagucuuacucaauauacaccaaguuuuuggacggaugacuucaggaugcgauuugacccuaauaggcggcaaaaccagauccgccagcacagucaauuucucaucaauaauucuuaacuggaagaaaaauuauacagacguacgaauaauugaccaauccgcaaguggacucugggaagucguaagcgaaaauauacuagaauaccuuuga

SEQ ID NO: 8858 - RNA, 4077 nt, Artificial Sequence
  Cas9 variant
auggguaaaauguacuaccuaggccuagauauaggaacgaacuccguaggauaugcugucacugacccuucuuaccaucuacucaaauucaaaggggaaccaauguggggcgcccacgucuucgcagccggcaaucaaucugccgaaagacgaucuuucagaacaagcagacgaagauuagacagaagacagcaaagaguaaaauugguccaagaaaucuuugcaccuguuaucucaccaauagauccaagauuuuucauaagacuacacgaauccgcauuauggagagacgauguagcagaaacugauaaacacauauucuucaaugauccaacauacacugacaaagaauacuacucugacuauccaacgauccaccaccugauuguagaccuaauggaaagcuccgaaaaacaugauccacgauuagucuaccuagccgucgccugguuagucgcgcauagaggccauuuucuaaacgaagucgauaaagauaacaucggugauguauuaucauuugacgccuuuuaccccgaauuucucgcuuuucuguccgacaacggagucucaccuugggugugcgaaucaaaagcacuacaagcuacauuacugagcagaaauucaguaaacgacaaauacaaagcccucaaaucccuaauauuuggcucccaaaaaccugaagauaauuuugaugcaaacauaucagaagauggccucauucaauuacucgcuggaaagaaagucaaaguaaacaaauuauucccacaagaaucuaacgaugcauccuuuacauuaaaugacaaagaagaugcgauagaagaaauccucggaaccuuaacaccggacgaaugcgaauggauagcacauauaagaaggcuguucgauugggcaaucaugaaacaugcuuuaaaagauggaagaacaauaucugaaucaaagguaaaacuuuaugaacagcaccaucacgaccucacucaacuaaaauacuuugucaaaaccuaucuugccaaagaauaugacgacauauuccgaaacguugacuccgaaacaaccaaaaauuacguagcauacucauaucauguaaaagaaguaaaagguacacuacccaaaaacaaagcaacccaagaagaguucugcaaauauguccuagguaaaguuaaaaacaucgaaugcucagaagccgacaaagucgauuucgacgaaaugauacagcggcuuacagacaauuccuuuaugccaaaacaaguuucuggcgaaaacagaguaauuccuuaccaacuauacuacuacgaacuuaaaacaaucuuaaauaaagcugccucuuaccucccuuuccuuacacagugcgguaaggacgcaaucagcaaccaagacaaacuacuauccaucaugacauuuagaauacccuauuucgucggaccucuaagaaaagacaauuccgaacacgcuuggcucgaacgaaaagccggcaaaauuuauccuuggaacuucaacgauaaaguagaucucgacaaaucugaagaagcauuuauuagaagaaugaccaauacauguacuuacuauccuggagaagacguauuaccacuagauucacugauuuacgaaaaauucaugauauuaaaugaaauaaacaauauuagaauagacggcuaccccauaucagucgauguaaaacaacaagucuuuggacuauucgaaaagaaacgacgugucacagugaaagauauccaaaacuuauuguuaucgcuaggagcucucgacaaacacgggaaauuaacaggaauugacacaacuauccacucaaacuacaauaccuaccaccauuuuaaaucauuaauggaacgcggcgugcuaaccagagaugauguugaaagaaucgucgagagaaugacauauucggacgacacaaaacgaguccgauuauggcuaaauaacaacuacggaacucucacugccgacgacgugaaacauauaucacgccuuagaaaacacgacuucggacgacucucaaaaauguuucuaacaggucuaaaaggaguacauaaggaaaccggcgaacgcgcgucaauacuugacuuuauguggaacaccaaugacaaccuaaugcaacuuuugucagaauguuauacauucagcgacgaaauaacaaaauuacaagaggcuuauuacgcaaaagcccaauuaucauuaaacgacuuccuagauucuauguacauaucaaaugcagucaaaaggccaauauacaggacccucgcaguaguaaaugacaucaggaaggcuuguggaaccgcaccgaaaagaauauucaucgaaauggcccgagacggcgaauccaaaaagaaaagaucaguaaccagaagagaacaaauuaaaaaucuauacagaucuauaagaaaagacuuccaacaggaaguagauuucuuagagaaaauacuagaaaacaaaucagauggucaauuacaaucagaugcacuuuaucuauacuucgcacaacucggaagggacauguacacgggagauccaauaaaacuagaacauauaaaagaccaaucauuuuauaacauagaucacauauacccacaaaguaugguaaaagaugauucacucgauaauaaaguauuaguacaaucugaaauaaauggagaaaaauccucaagguacccccucgaugcagcuauucguaauaaaaugaaaccccuaugggaugcuuauuauaaucauggacuaaucagccuaaagaaauaccagagacuuacacgauccacucccuuuacagaugaugaaaaaugggacuucauuaacagacagcuagucgaaacccgacaaaguaccaaagcacuagccauauuacuaaaaagaaaauuuccagacaccgaaaucgucuauucgaaagcaggacuaaguagcgauuucagacaugaguucggguuaguaaaaucgcguaacaucaacgaccuucaucaugcaaaagacgcauuuuuagcaauagucacaggaaauguguaucaugaacgauuuaaucgaagaugguucaugguaaaccaaccauauuccguaaaaacuaaaacauuauuuacacacucaaucaaaaaugguaauuucguagcauggaauggugaagaagacuuaggacgcauaguuaaaaugcuaaaacaaaauaaaaauacaauacacuucacaagauucuccuucgacagaaaagaaggcuuauucgacauacaaccccucaaagcauccacaggacuuguaccuagaaaagcaggacuagauguagugaaauacgguggguacgacaaaagcacagcugcauauuaccugcuaguacgcuucacacuagaagauaagaaaacccaacacaaacuaaugaugauuccuguugaagggcuauacaaagcaaggaucgaccacgacaaagaauuuuuaaccgacuacgcacaaaccacgauuagcgaaauccuccaaaaagacaaacaaaaaguaauaaauauuauguuuccuauggguacaagacacaucaaacuaaacucaaugauaucaauugauggcuuuuauuugagcauagguggcaaaucaucaaaaggaaaaucuguauuaugccaugccaugguaccacuaaucgucccccauaaaaucgaaugcuauauaaaagcaauggaaucauuugcaagaaaguucaaagaaaacaacaaacuaagaaucgucgaaaaauucgauaaaauuacuguagaagacaacuuaaauuuauacgaacuuuucuugcaaaaacuccaacauaaccccuacaacaaauucuuuucaacacaauuugauguacucaccaacggacguucaacuuuuaccaaacuaucuccagaagaacaaguccagacauuauuaaacauacugucgauauuuaaaacaugucguucaaguggcugugauuuaaaauccauuaacgguucagcccaggccgcaaggauaaugaucuccgcagaccugacaggccuauccaagaaauacucugauauccgguuaguagaacaaucggcuagugguuuauuuguuaguaaaagccaaaaccuuuuagaauauuuauga

SEQ ID NO: 8859 - RNA, 4083 nt, Artificial Sequence
  Cas9 variant
augacaaaauuaggaaaaccauauggaauaggagucgauaucgguaguaauagcauaggcuucgcagcaguugaugaaaacucccaccuaauaagacuaaaaggaaaaacugucaucggugcuagauuauuugaagaaggaaaagcggccgcggaccggagagcuucaagaacaacccgcagaagacuuucuaggaacagauggcgauuaucauuccuacgagauuucuuugaaucacacaucaccccuacagaucccaauuucuuuaugagacagaaauacucagaaaucucaccuaaagacaaagcccgauacaaauaugaaaaacgacuauucaacgacagaacggaugcugaguucuaucaacaauaucccacuauguaucaucuaagaaccagauuauuaacugaccccagcaaagccgauguacgagaaaucuacuuugcgauacaucauauucuuaaaagcagaggacacuuccucacaucaggauaugcuaaggacuuuaauacuaacaaaguagcacuaaacgaaauuuuuccagcauuacaagacgccuaugcacaaguuuauccagaucuagacauuacguucgaugaaaacaaaguaaacgaguucaaaacaguucuacuagacgaaaaagccacaccauccgacacccagagagcucuaguaaauuuauuacuugcugaagauggagacaaagacauccuuaaacaacaaaaacagguacuaacugaguucgcaaaggcuguaguuggauugaaaacaaaacuaaauguagcucugggcaccgaaguugacucgucugaagccacagcuuggaacuucucucugggacaacuagaugauaaaugggcugguauagaaucggcaaugacugacgaaggaacugaaauuuuagaucaaauccgggauuuauacagagcaagauugcuaaacggaauugugcccgcaggaaaaacucuaagccaagcaaagguagacgauuaugaacagcaccaugaagauuuagaacuauuuaaagacuacuuaaaacaacuagaagacgauggaauggcaaaggcuauaagacaauuauacgacagguacauagacggcgacgacgcuaaaccauuuguuagagaagauuucguaaaagcacuuacaaaagaaguuacugcacaccccaaugcaaaaucucccgaguuauuagaaaggcuaguccaaccugacuuuauguuaaaacaaagaaauaaagccaauggggcaauaccaguacaaaugcaacaaagagaauuagaucaaaucaucaaaaaccaaagcguauauuaugauuggcuagcugcacccaacccuguagaaaaacacagacaaucaaugcccuaucaauuugacgaacuucuaaacuuuagaaucccguauuacguagggccguugguaacagcuaaggaacaaaaagcagcacaaggcggaguauucgcauggaugguaagaaaagauccagacggaaacauaacaccauacaauuucgacgaaaagguggaccgcgaagcaagugcaaauacauuuauucaacgaaugaagacaacagauacuuaccuaauaggugaagauguucuacccaagcaaucgcuguuauaccagucguaugagguacuaaaugaacucaauaauguucgaguaaaugacaauaaauuaucauucgaccaaaagcaacaaguauugggugaauuauucgaacgacacaacacugucacaaucaaacaauuugucgacaaccuccuagcucacggagacuaugauagaauaccugaagugcgagggcucgcggaugagaaaagauuccuauccagucucucaacuuacaaucaacuuaaagguauacuacacgaagcuauagacgacucagacaaacaaacggauauugagaaaauaaucgcauggucaacaaucuuugaagauaaggcaauauucaaaacgaaacucaacgaaauuucaugguuaaaugccgguaugauuaacucacuagcgaauauaagauacagagguuggggacaauucucucauaaauuacuuaaugaauuaacccucucuacaggaaggacaguguucgaagaacuccuaauuucaucacauaacuuaaugcaaauauuaacagaugaaguucuuaaacagaaaauugcugaacuaaacgcacacgaacuaaaggcuucaggaaucuacgccgcuauagacgacgcauauacaucuccaucaaacaagaaagcucuaagacaaguccucaguguaauugaugauauaacaaaugcagcaggccaagcgccaaacuggcuuuacaucgaaacagcagacggagauggaguaccaggaaaaagaacuaauucucgacaacgaaaaauacaagaaauauacguaaacgcggcucaagaauuaauaacaggaucaguacguggugaacuagaagacaaaauugcaucaagagcagacuuuacugauagacucguacuuuacuuuaugcagggcggucgagacauauacaccggagaaccacuaaauauagauaaucuuucuaguuacgacauugaccacauauugccacaaucucuaaucaaagacaacucauuagacaaucgcguauuaguucauccacucguaaacagagagaaagacacuauuuuugcaaguacacgauucgcaaaacaaaugaauggaauguggagacaguggcacgcagcaggucuaauuaguucaagaaaacuacgaaaccuucaaaugagaccugaugaaauugauaaauacgcaaguggauuuguagccagacaguuaguagaaacacgacaaauuauuaaacuaacagaacagauagucgcagaucaauauccggaugccaaaaucauagcugucaaagccgguuuaagcagucaauuaagaaaagaauuggauuuucccaaaaauagggaaguuaaccauuaucaucacgccuuugacgcguuccuagcagcuagaaucggaacauauuuacucaaacgauacccaaaucuagaaccauucuuuacauauggaaaauuuaagaaaaccgaaguaaagaaauuaaaauccuuuaauuuuauacgggauaugacccacgccaaagauaaaauaguagcaaaagagaccggagaaauaguaugggauaaugcuagugacauaaacgaacucgaccgcauuuacaacuucaaaagaauguuaauuacucacgaaguacgauuugaaacggcaucacuauucaaacagacauuauacgcugccaaaaacuccaaaaaccgcggcgguucaagacaauuaauaccgaaaaagaaaggauaucucguagauaucuacgguggcuauacacaagaaaccggaucauaucuaucaguagucagacuuacaaagaaagccauguaugccguuguuaaagugucuacacgcgacgcagcaaaacuagcaguagcaaaaagcauauccgagcaaaaagaaaaugagacccuaaagaaaaucauugauggaaaauuaucuaaaacgagcaagaaaggaaaaacaacacaucaacuauucgaaauaguccuaccaagaguaggacagaaaacuuuauuuaaaaauuccaaauacaaucaauuuuuaguaaauucggauacuuauaugcacaacuaccaggaacuuuggaugccacgcgaauaucaaagaauguggaaagauauccuucuaagcaaccacggagacgcccaacuagagggacaacuugaccaaauauucaaauucauagucucccaaguaaacucauacuucaaccuauacgacauaaaccaauucagaaagaaaaucgcagaugccacagauaaauucgcaaaauuaccaacccaugacacagacaaugcacgaggaaaaauagccacaauaggucaauuacugauaggccuucaagcuaaugcaaugagaagcgacuuaagaaauuuagacaucaaaacgccguuuggauuacuacaaauaggaacgggaauaacacuagacuuagauacuucuauuauuuaccaaaguccaacaggacuuuuugaacgcgaaguaccauuaaccgacuuauga

SEQ ID NO: 8860 - RNA, 4083 nt, Artificial Sequence
  Cas9 variant
augacaaaacucaaucaaccuuacgggaucggauuggauaucgguucaucaaguauagguuuugcaguaguagacgcaaacucccacuuacuucguuuaaaaggugaaacagcaauaggcgcuagauuauuccgagaaggugagagugcagcuggaaggagagcuucaagaacaacaagaagaagauugagccacaacagauggagacuaagauuccuccaagacuuuuucgauccccauauuucauccauagauccagauuucuuccugcgacaaaaauauucagaaauaagcccaaaagacaaagagagauuuaaauaugaaaaacgucucuuuaacgacagaacagacgcacaauuuuauaaacaauaccccacaauguaccacuuacgucuacaccucaugaaugacgccagcaaagcagauccuagggaaauauucuucgcuauacaccauauacuaaaaucacgagggcacuuucucacaccaggagacgcuaaaaacuuuaacacagacgauguagaccuaaaacacauauuuccugcacuuacagaagcauacgcacaagcauaucccgaucuuacccucaguuucgaacccagcaaagcagaaaaauuuaaaagcauauuacuagaugaagaugcaacaaguaacgauacucagaaagcccuaguuaaacuauuauuaucugacgacggggacaaagaaguacuaaaacagcagaagaaaguauuaacugaauuugcaaaagcaguagcugggcuaaaaguaaaauuuaauguugcccucgguauugaaguaaccgacgcugacguagaaaaauggcacuucggcauggcccaacuagaagauaaaugguccgacauagaaccuagcuugacggaccaagguauggaaauauuugaacaaauacaagauuuauauagagcaaggcuacuaaacggcaucguaccagccggcaaaacuuuaucacaagcuaaaguagaugacuaugaucaacacugcaaagauuuaaaacuauuuaaagaauaucuaaaacaacuuaaugaucacgaccuugcuaagaggauucgacuauuauacgacagauacaucgauggagacgaugcaaagccauuccugcgagaugauuuuguaaaagcacugaagaaagaaguaacugcucauccaaccgaauuagcugaaucucuacuagaacggauggaacaagauaauuuuaugcucaaacaaagaacaaaagcuaacggauccaucccaguccaaaugcaacaacgagaacuugacaaaauaauagcaaaucaagcagaguauuacaguuggcucgcagcugaaaauccaguaaaagaacacagagauucuaagcccuaccaacucgacgaacuauuaaauuuuagaauacccuacuacguagguccuaugauaaccaagaaacaacaagaaaaaucaggacagaauguguuugcuuggaugguccgaaaagaucccucagguaacaucacccccuacaacuucgacgaaaaaguugauagagaagccucugccaacgcauuuauucaaagaaugaaaacuaccgacacauacuuaauaggggaagauguacuaccaaaacaaucccuuuuauaucaaaaauaugaaguucucaacgaauuaaauaauguaaggguuaauggagaaucccucaguaccgaccaaaagaaacgacucauaagagaacuuuuugaacgacacuccaguguaaccuuaaaacaauucguugaaaaccugguugcacauggagauguugcaaaaagaccggacguacgaggacuagcagacgagaaaagauucuuaucuucgcuaucgacuuaucaucaguuaaggggaauauuacaugaugcaauagacgacagaggaaaacaaagcgauauugaaaacauaauaaccuggucuacgguuuucgaagaugcaucaaucuucaaaaguaaacuaggggaaaucucauggcuagauucaaaaacacgaacaacucuuucuaacauucgguaucguggcuggggacaguucucaagaaaauuacuggauggauuaaaauuaggaaauggucauacaauuauacaagaacuaaugcuaucaaguagaaacuuaaugcaaauauuaacugaugaaacacugaagaaagaaauggcaacuuuaaaccaagaaagauuaaaaccagauucaauuaaugaagcaauagacgcagcauauacaucaccuagcaacaagaaagcaauaagacaaguacuaaaaguaguagaugacauuaaacacgcagccaacgaucaagcaccauccuggcuauacauagaaaccgccgacggaggcggccauccaggaaaaagaacccuaagccgucaaaaacaaauacaagcgaucuacgagaauacugcuaaagaauuaauugacuccgcaguucguggugagcucaaagauaaaauugccgauaaaacaaauuuuucugauagguuggucuuauacuuuaugcaaggaggucacgacauauacaccggcacagcacuaaacauugaucaacuaucaucauacgauauugaucauauacuaccucaaagccuaauaaaagacgacagucuagauaacaggguacugguucaugccaaaauaaauagagagaaaaaugcagaauuugcaucaacauuauuugcagcaaaaauggcgucuacauggcaccguuggagagacgcuggucuuauauccggaagaaaauuaaagaaccuacuaaugcgcccggacgaaguugauaaauaugcaaaaggcuucguugcacgccaauuaguggaaacucgacaaauaauaaaauuaacagaacaaauuguugcugcacaauauccagauacuaagauaauagcgguaaaagccggguuaucacaccaauuaagacaagaauuggauuuccccaaaaaccgcgacguaaaccauuaucaucacgccuuugacgcguucuuggcugcucgcauaggcacauacuuguuaaaacgcuauccaaaucuggcaccauucuuuaccuauggagaguucacuaaaaccaacuuaaagaaauuacagucauucaacuuuauaggagcuuuaacacauacggauggaaaaauaacuucaaaagacaccggagaaguccuuugggacaaccaacgagauaucgaagaacucgaucaaauuuauaauuucaaaaggauguuaauuacccacgaaguuuacuuugaaaccgccggacucuuuaaacaaacugucuacgcagcuaaagauuccaaagagcgaggugguagcagacaauuaauaccaaagaagaaaggauacucuacaggcauauacggaggauauacccaagaaacaggguccuauaacgcauuaguacgcuuaacaaaagcaggaaaaguuguguauagaguauucaaaauaagcacacaaaacgccgcagaaauagcagcagcucgaagccuaucugccgaggagggaaaugaacguuuaugccaaauccuugaacaaucgcuuuuaaaaacaaauaaagacaagaaaaacacagucgaucucuucgacguaguaauaccaagacucggcaaagaagcacuuuuccacaauuccaaauauggacuuuuucucguuaauagugauacuuauuaucauaacuaucaagaauuaugguuauccagggaaaaccagaaaauuuuaaagaaacucuucaguacaaaauaugaucaaagcgaaauggauagagaugcauuacacuuauuugaaaccauugccaaacaaguagaacaauucuuuaaauuauacgauaucaaccaauuucgaacaaaaauauccagcgcuuucgaugcauuugaaaaacuaccaguagaaggcgaagaaggaaaaguagaaacacuaaaacagcuacuuauugggcuacaugcaaauccaguuaggucagaccuuaaaaaccuuggaauaaaaacuccuuuuggauuucugcaggccggaaaagguauacaucuagaugaugacaccgaaaucauccaacagucgccagcuggacuauuuaaaagaagaguacgacuagccgauuuauga

SEQ ID NO: 8861 - RNA, 4086 nt, Artificial Sequence
  Cas9 variant
augacaaaacuuggcaaaccauauggaauuggagucgacauaggauccaacuccauaggauucgcagcaguagacgaaaauagccaucuaaucagacugaaaggaaaaaccguaauaggagcuagacuauucgaagaagggaaagcagcugcagaucguagagcgucacgcacaacaagaagacgauuguccagaaacagauggagacucucuuuccuucgugacuuuuucgaaucccacauaacuccaaccgggccaaacuucuucaugagacaaaaauacagugaaauuucuccaaaagauaaagcucgauauaaauaugagaaaagauuauuuaaugauaggacagacgcugaauuuuaccaacaauauccaacaauguaccaucuacgaaaucgauuacuaacagacccaucaaaagcagauguaagggaaauauacuuugcaauucaucauauacugaaauccagaggucauuuccuuaccaguggguacgcaaaagacuucaacacuaauaaaguagcacuaaaugaaaucuuuccagcauuacaagaugcuuacgcccaaguauacccugaccuugauauaaccuuugacgaaaauaagguaaacgaauuuaaaacaguccuauuaaacgaaaaagcaacaccaucugauacgcaaagagcucuaguaaaucuacuucucgccgaggauggcgauaaagauauacuaaaacaacaaaagcaagucuugacagaauuugcaaaagcaguaguuggccuaaaaacaaagcuaaauguagcacucggaacugaagucgacucaucugaagccaccguauggaacuuuucauuaggacaacucgacgauaaaugggccggaaucgaauccgcuaugacggaugaagguacugagauucuagaucaaauuagggauuuauaucgggcucguuuauuaaacggaauaguaccggcuggcaaaacauuaagucaagcaaaagucgaugacuacgcacaacaucacgaagauuuagaacuguuuaaagauuaccuaaaacaacucgaagaugauggaacagccaaggcaauaagacaacuguacgauagguacauagauggcgaugacgcaaaacccuuuguaagagaagauuuugucaaagcauuaaccaaagaagucacagcccauccgaacgccaagucaccugaacuacuggaaagacuagcacaaccagacuuuaugcuaaaacaaaggaauaaagcaaacggagccauaccaguacaaaugcaacaacgagaacucgaccaaauaaucaaaaaccaaagcguguauuaugauuggcuugcagcaccaaauccgguagagaagcacaggaaaagcaugccauaucaacucgaugaauuacuuaacuuuagaauaccauauuacgucggaccauuagucaccgcaaaagaacaaaaagcagcucaaggaggaguauucgcauggauggugcgaaaggaccccgaugggaauauaacaccguauaauuuugaugaaaaagucgaucgggaggcaagugcuaacaccuuuauacaaagaaugaagacaacugacacauaucugauaggagaagauguucuaccgaaacaaagccuacuauaucaaagauacgaaguuuuaaaugaauuaaauaaugugagagucaacaaugaaaagcuaucaauugaacaaaaacaacaagucauacgagaauuauucgaaagacacaacucaguaacgauaaaacaauucgcggaaaaucuaagagcacacggagacuacgcacauaucccagaaauacgaggacuagcagaugagaaaagauuccuauccaguuuaaguacuuauagacagcucaaaucgcucuuaccugacgcuauagaugauccagccaaacaagcagauauagaaaacauaauagcaugguccacaguauucgaagaugcagcgauauuuaaaacaaaacugaaagaaauaaacuggcucgauucucaaacuauuacuaaauuaucaaacauuagauauagaggauggggucaguuuucacacaaauuucuaaacggauugacauuagguaauggucacacuauaauacaagaauuauuccuaaguaacaauaaucuaaugcaaauauugacggacgaaacacuucaaaagaaaaugacugaacuaaacgcagauaaacuaaaagccgccaauauaaaugacgcaauagaugacgcauacacuagcccuucgaauaagaaagcacuacgacaagucuuacgcguaauagaagauauaaaacgcgcagcggauggacaagauccuagcuggcuauauguagaaaccgcggaugguggcgguaccccuggaaaaaggaccagagcaaggcaacaccaauuacaagaaaucuaugccaacgccgcacacgaacucauugacagcgccguuagaggggaacuagaagauaaaaucgcugauaaagcagauuuuaacgaccgcuuaguuuuauauuucaugcaaggaggacgcgauauuuacacaggcacaccacucaauauugaccaacucucguccuaugauauugaccacauccuaccacagucucuaaucaaagauaauucacuagacaauagaguccuaguacaugcaauaaucaaucgagagaaaaacgccacuuuugcuucuaccauuuaugcacagaaaaugaaugcaacguggagacaauggcacgaagccgggcuaaucucaggacguaaauuacgaaacuuacaaaugcguccagaucaaauagauaaauaugcaucaggauucguagcacgacaauuaguggaaacacgucaaauaauaaaacucaccgaacaaauugucgcugcucaauacccagaaaccaaaauaauagccgucaaagcaggccuaagccaccaacuaagggaagaguuagaauuuccaaagaauagagacguuaaucauuaccaccaugcauucgaugcauuuuuagcagccagaauuggaacguaccuacuuaaaagauuuccaaaccuacaagccuuuuucaccuacgggaaauuuaagaaagcagauguaaagaaacuacgagguuucaauuuuauaagagacauaacacaugcagaagacaaaaucgucguuaaagauacaggagaaguaauaugggacaagaaaagagauguagaugaacuggauagaaucuacaacuuuaaacgaauguuaauaacgcacgaaguucacuucgaaaaagcagaucuguucaaacaaaccguuuacggagcaaaagauagcaaagaggccgguggaaagaaacaauuaauuagcaaaaagaaagguuaucccguagacaucuacggcggauauacccaagaaacaggaucauacuuaaguguaguacgccuaaccaagaaagcgauguacgcggucguaaaagucaguacacgagaugcagcaaaauuggcaguugcaaaaucaauaucagagcaaaaagaaaaugaaacccuaaaugauauuauagaugaaaaauuauccaaaauaaguaaaaauggcaaaaucacacaugaauuauucgaaguaguucucccccgaguaggacagaaaacauuauuuaaaaauagcaaauacaaccuuuuccuaguaaauucagacacauacaugcacaacuaccaagaacuauggaugccccgagaauaccagaaaauguggaaagacauuuccuuaaguaaauacggugaugcacaaaccgaagaucaacuagaucaaaucuuugguuucauagucucacaaguuaauucauauuucaaucuauaugauaucaaucaauuucgaaagaaauuaaaugacgccgcugauaaauucgcgacacuaccuaugcgcgacacagaugauaugcaaggaaaaauagccacaauuggccaacuacuuaucggauugcaagcuaacgccgcccgaucagaucuuagaaaucuagacauuaaaaccccacuaggacuguuacaaauuccaaacgggauaucacuugacucagauacaucuguaguguaccaaucaccaacaggacucuuagagagagaaguucacuuaagcgaccuauga

SEQ ID NO: 8862 - RNA, 4086 nt, Artificial Sequence
  Cas9 variant
augaagaaacccuauuccauaggcuuagacauaggcacaaauucaguagguuggagcgucguuacagaugauuacaaaguaccagccaagaaaaugaaaguacucggaaauaccgauaaagaauauaucaagaaaaaucugauuggcgccuuguuauucgauucaggugaaacggcagaagcgacucgaaugaaacgaacagcccggagaagauacacuagaagacgaaaucguauccuauacuuacaagauauauucucaccagaacuaaaccaaguugaugaaucauuucuacacaggcucgaugauaguuuucuuguagcagaggauaaacgaggagaaaggcacguuaucuucgggaauauugccgaugaagucaaauaccacaaagaguucccaacaaucuaucaccugaggaaacaccuagcagauucaagcgaaaaagccgaccuucgacuugucuacuuagcauuagcacacaucaucaaauauaggggacauuucuuaaucgaugaacccaucgauaucagaaauaugaacagucaaaauuuguucaaagaauuucucuuagcauucgacggaauacaaguagauuguuauuuggccaguaaacauaccgacauaucuggaauaauaacagccaaaauaucaaaaucaagaaaaguagaagcaguccuagaacaauuucccgaccaaaagaaaaauucauucuuuggaaauaugguuucguuaguauuuggacucaugccuaacuuuaaaagcaauuucgaacuagaugaagacgcaaaacuacaauuuucgcgagacaguuaugaugaagaucuggaaaaccuacucggcauuaucggugacgaauacgcagacguauucguagccgcaaagaaaguauacgauagcauuuugcuuuccggaauacuaacaacuaauaaccauaguacuaaagcgccuuuaucagcaagcaugauagaucgauacgacgaacacaauagcgacaagaaauuacuuagagacuucauaagaacaaauauagguaaagaaguauucaaagaaguauuuuacgacacaagcaaaaacggauaugcaggauauaucgauggcaaaaccaaucaagaagacuuuuauaaauacuugaaaaaucuauuacaaaaaguugauggaggagauuauuucaucgagaaaauagaacgagaagacuuucugagaaaacaaaggacuuucgauaacggaagcauuccucaucaaguacaucuugacgaaaugaaagcaauauuaagaagacagggagaauuuuauccauuuuuaaaagaaaacgcagaaaagauccaacaaauuuuaacguuuaaaauaccuuauuauguaggaccucucgcucgaggaaauucacgcuuugcaugggcaagcuauaacucaaaugagaaaaugacaccuuggaauuucgacaauguuauugacaaaacgucaucagcccaagcauucaucgaaagaaugacaaacaacgaccuguaucucccagaucaaaaaguguuaccaaagcacagccuauuauaccaaaaauucgcuguuuauaaugaacuaaccaaaauaaaguauguaaccgaaaccggugaagcuagacuauucgauguuuuucuaaagaaagaaauauuugacgguuuauuuaagaaagaaagaaaaguaaccaaaaagaaaauauuaaacuucuuagacaaaaacuucgacgaguucaggaucaccgauauacaaggauuagauaaugaaacuggcaauuucaacgcaucuuacggaacauaucaugauuuauuaaaaauuauuggagacaaagaauuuauggauaguucagacaauguagauguucuugaagacaucguccuaucacuaacuuuauucgaagaccgagaaaugaucaaacaacgucuauugaaauacgaagacauauucaguaagaaaguaauagccaaccuaacacgacgacauuacacggguugggggagauuaucugcaaaauuaauaaacggaauaaaagacaaacauucaagaaaaacuauccuagauuacuuaauugaugauggacacucuaacagaaacuucaugcaauuaauaaaugacgacaacuuaaguuuuaaagacgaaauagcaaacucccaaguuauaggggauggugacgauuuacaucaggucguacaagaauuagcaggcaguccagcuauaaagaaaggcauacuccaaucucucaaaaucguagaugaauuaguuaaagucauggguuacaauccagaacaaauugucgucgaaauggccagggaaaaucaaacaacagcuagagguagaaacaacucacaacaaagacuagggagcuuaacaaaagcuauucaagacuuuggaucagauauccuaaaaagauauccgguagaaaauaaucaacuacaaaacgaccagcuauaucuauacuaucuacaaaauggaaaagauauguauaccggagacacucuugacauacauaacuuaagucaauaugauauagaccacauaauaccacaaaguuucauaaaagacaauucccuggacaaucgcgucuuaaccaauucgaaaucaaaucgaggaaaaucugauaacgucccaagcaaugaaguaguuaaaagaaugaaagguuucuggcucaagcaacuagaugcuaagcuaauaucucaacguaaauucgacaaucuaacuaaagcagaacguggaggacugucagcugaagacaaagcaggcuuuaucaagagacagcuaguugaaacaagacaaauuacaaaacauguagcacgaauuuuagacgaaagauuuaaucgcgauuuugacaagaacgauaaacgaauuagaaaugucaaaauuguaacacuaaaaagcaauuuaguuuccaacuuuagaaaagaauuuggcuucuauaaagucagagaaauaaacaacuuucaccaugcccacgacgcauaucugaacgcagucguagcaaaggcuuuacuaauaagauacccuaaacuagaaccagaauuuguauauggcgaauauccgaaauauaacucuuaucgagaaagaaaaagugcuacagaaaagauguucuuuuauucuaacauaaugaauauguucaaaacuacuaucaaacuagcagacggacgaguaguugaaaaaccaguaauagaagccaacgaggaaacaggagaaaucgcgugggacaagaccaaacacuucgcaaauguaaagaaaguacucuccuauccacaagucucaaucgucaagaaaguagaagaacaaacuggugguuucagcaaagaguccauauuaccaaaaggaggaagugauaaacuuaucgcccgaaaaaccaaaaauaacuacuuauccacacaaaaauauggugguuuugauucaccaacaguagcauacucaaucauguucguagcagacauugaaaaaggaaaaaguaaaagacucaaaacaguuaaagaaaugauaggaauaacaaucauggaaagaucacgcuucgaauccaacucuguuacuuuccuagaagaaaagggauauagaaacaucagagaaaauaccaucauuaaauucccaaaauauucacuguuugaacucgaaaauggccgaaggagacuccuagcaagcgccauagaacuacaaaaggguaaugaaauguuccucccucaacaauuugucaaccuauuauaucaugcacaacaugcuaauaaagaggauucugucauauaccucgagaaacaccgccacgaauugucagaauuguuucaucauaucauaggagucucggagaaaacaauacuaaaaccaaagguagaaaugacacuaaaugaagcauuugaaaaacacuuugaguucgaugaaguaagcgaacuagcacaaucuuuuauaucauuacucaaauuuacugccuuuggagcccccggcgguuucaaauuccuagacgcggacauuaaacaaucaaaccuacgauaccaaacagucacagaaguacuaucaucgacucuaauucaccaaagugugacaggauuauaugaaacuagaauagaccuauccaaacuaggcggagaauga

SEQ ID NO: 8863 - RNA, 4086 nt, Artificial Sequence
  Cas9 variant
augggaaacuauuauuuagggcuagauaucggaacaaacaguguagguugggcuguaacagacgaaaacuacaacauagaacgauucaaaaagaaaaauauguggggaauaagacuauucgacgaagcuaaaacugcagaaucaaggcgcauccauagacaagcaagaagaaugagacaaagaaaaauccaacgacuaaauuuacuaauggagcuuuucgauguagaaauaucaaaaguggacgaaagcuuuuucauuagaaaaaaagagucugaucuucacuacgaagauaaaagccaagauucacgauacgcucuauucaaugauaaagaauucaacgacaaggacuaccauaacaaauaccccaccauauuccaucucauaauggaccuaauagaaaacgaugaaaaaaaggauauucgacuacuguaucuugcaugccauuauuuaauaaagaauaggggccacuuuauauucgaagggcaaaaauuugacgucaacucaaguuuaaacaauaacauuaauaaacuaaagucacaucuagaucaauucuacaacauaugucuggacuucgauaacgauaaacuaauugagauuuuaguaaaccaaaaccuaaauaucucagaaaaaagcaaaaaaauaaaagaauuacucagaaaaacaaaccuugaaguuggcauugcaaaucuaauugcggggggaucgauaaaacuuagcaacauguuugaugaugacgagcuaaaaaacuuagacuacaacucacucucauuuaaaaacucgaacuuugaugaagguagagaacucuuugaggaaguauuagaagaccgauuugaacuaguagaaauucugaaagacauacaugaugcaagcguuuuagagacaaugcugaguucagcaucaaucucuccagacggcggaaaauacauauccucaagcaugaucaacaguuacaacaaacacaaaagagacuuaaaacuucuaaaaaaaauuauaaaaaaauauaaaaaaagcgaauaugacaacaucuuuagggacgaaaauaucaaaaacaauuaccuauccuacacacguaccggaauaaacaaaaauaaaaaaguucaagcagaagauaacacagauagugacggauucuauaaauacauuguuaaaauccuaaaagacauaaaagaaaacgauagcgaugaagacauuaaauacauacuaucggaaauugacaaaaaaaacuucguaccaaaacaacgaaccaaagaaaacucagucauaccauaccaacucagagaaaucgaacucagaaagaucaucgauaaccaaagcaaauaucacaaauuucuaaacgaaguagacgaaaaaggcaucucaguaaaagagaaaauuauaucuuuguugacauucagaaucccauacuacauuggaccucuaaaccccagcuacaacgaagagaaaaacuuuacaacuaguugggugaaacgucuagcaaaaggaaaaguaacaccauggaacuucgaagacaugguugauauagaugcaagccgcgaggcuuuuauagaaaacaaacuaaacaaaugcagcuuccuauuagacgagaccguacuaccaaaagacuccuuacuauaccaagaguacaugguacuaaaugaacuaaacaaucuaaaaaucaauggccagucuauaaauacagaucuaaaaaaauccauauaugaagaacuguuuaaaaaauacaagaaaguaaccagaaaaagguuaauaucauauauaaaagagaaagaaaauauguccggagacauaguaauaaccgguauagacggagacuucaaacaaggacucaaaucauacauugccuuuaaagauauaauaggagaaaaaauagaugaugacauauacagaaaagaagucgaaaaaauaauacgcgauauaucgcuauauggagacgacaaaucauucauacaaaaaaaaauuaagaacgaaaacaaauuggaccuuagcgacgaccaaauaucaaaaauagcaaaacucaaauucaaagacuggggcagauuuucaaaaaaauuauuagucggaaucaaagccagugacaagaauacgggcgaaauugacaacauaauaggcuucaugagaaauuacaacuauaacauaaugcaauuaauggcaaauguuuuuacauucaaggacgagauagagaaauuaaauucuaaauacuauacugaugaaaaaaucaacaucgauuaucuagaugaccuauaucuaucaucgccagccaaaagaaugcuuuggcaaucauuccaaaucguugaugaaaucaaaaacauaaaaaacagcgauccaaaaaagauauuuauugagauggcuaggucaaaagaagacaaaccuacuagaaaaauguccaggaaaaguagacuagaaaaguuauacaccgacucaaaaaaacaauucauaaaacuauucggacccgacgaguacgacaaacuaaauaacgaaauaaagaacaaaagcgaauccgacuuccguugggauaaucuguaucucuacuauacacaauuuggcagauguauguacagcuuagacccuauugaccuagaagaacuguccaauaaaaaucucuacgaucaagaccauauauacccaaaauccaaaaucuaugacgauaguaucgaaaacaggguucucguaaaaaaacagcuaaaccuagacaagagcaacgaauacccaauaccggauaggguucuaaacaaagauaaaaacaaacuacuagcguucuggaaaaugcuuaacgaaaaggagcugauaggcgacaagaaauaugcuagauuaauacguaaaagcccauuuacugaugaagaauuaggagacuuuauugcaagacaauuggucgagacaagacaggccacaaaagaaacagcaaacaugcugaaaagacuaugcccagacucaaagaucguauacgucaaagcaaaaaaugucucagacuuucgccgcaaauuugauauauuaaaaugcagauccauuaaugauuuacaucacgcacaugaugccuacuuaaauauaguaguaggcaauguauucgacacaaaauucacaagcaacccgcuuaauuuuauaaaaaauaauucuaaaaauaggucguauaaucuagaaaaaauauacgacuacgauguaauaaggaacgaaaaaauagcauggcuagccgaaagaaaagaagaaaaucaagauggaucaauagcaacaguucuaaaaaaccuaaguaaaaacgacauaagaguaacaagaaggacauacauaaaaugugaagaucuauucgaugaaaauaucgucaggaaggggaauggcaaauucccgauaaaagaaaacaauaacaaaucggacacgaacaaauacggaggauacaguggaauuaaaaaugcuuacuucgucuuacuggaggaugaaaagcacaaccguauccucgaagccauaccauccuucauauacaaaaaagaaaagaacggagagaaagggagcgugaucaauuaccugcagaacauccuaggaauaaaauccgcaaaaauacugcgagacaaaauuaaaaucggaucacuacuaaaaaucgauaaauuuccauacaaccuagcaggaaaaagcggaaacggaauacucaucuccggagguguccaacuaauuuuagauaaaaacacuucuaaauauaucaaaaagaucgaaaauuacaaauauaaauuagacgaaaacaaagauuaucaaauaaauauauuugacaaauuaucaaaagaagaaaauaucaaacuauuugacuuguuuguagacaaauuugaaaauagcauauauaaaaacagaguaaacauuaaauuaaaagaaauaaaacuagcaagaccaaaauuugaacacuuaagcauagaagaacaaauaaaaacccuaacccaaaugcuuauacuauucggacgagaaaacaacgccgucaaccucgaauacaucggacuaccaaaaaacacaggaaagacaaaaaucaauaaaaaaauuaacaacaaagauauaaaaauaauuaaccaaagcauaaccggguuauaugagacagaagaagaucucgcaaacauauga

SEQ ID NO: 8864 - RNA, 4086 nt, Artificial Sequence
  Cas9 variant
augacuaaacuuaaucaaccauacgguaucggucuagauauuggaucaaauucuauuggcuuugcaguaguugacgcaaacucacaccuacuucgccuaaaaggagaaacugcaaucggggcaagacuauuucgagaaggccaaagugccgcugaaagaagagaaucacgaacaacacguaggagacuaucaagaacacgauggcgacuaagcuuccucagagauuucuuugcuccacacauaaccaaaauagauccugacuucuuucuacgacaaaaguauucagaaaucucaccaaaagauaaggauagguucaaauacgaaaaaagacuuuuuaaugacagaacagaugccgaauucuaugaagacuaucccuccauguaccacuuacggcuacaccuaaugacgcauacgcacaaagcugacccacgcgaaauauuucuagcaauucaucacauauuaaaaucacgaggacauuuuuuaacaccaggagcugccaaagacuuuaauaccgauaaaguagaucuagaggacaucuuccccgcacuuacagaagcguacgcacagguauauccggaccuugaacuuacauuugaucuugcuaaagcagaugacuuuaaagccaaauuacuagaugaacaagcuaccccuucagauacccaaaaagcauuagugaaucuccuauuaucuagugacggugaaaaagaaaucguaaaaaaaaggaaacaaguauugacagaauuugcaaaagcaauuacaggccuuaaaacaaaauucaaucuagcacuugguacugaaguagaugaagcagaugcuagcaacuggcaauuuucaaugggucaacuagaugacaaguggucaaauauugaaacaucaaugacggaucaaggaacugaaauauuugaacaaauacaagaacuauauagagcuagauuauuaaauggaauuguaccggcaggaaugucccucucacaagcaaaaguggcagacuauggccagcauaaagaggaccuagaauuauucaaaacguaccuaaaaaaauuaaacgaucaugaacuagcaaaaacgauacguggucuauaugauagauauauaaauggcgacgacgcuaaaccguuccuacgagaagacuuugucaaagcuuuaaccaaagaaguaacagcucauccaaaugaaguaucagaacaauugcuaaaccgaauggggcaagcaaacuucaugcuaaaacaacgaacaaaagccaauggagcgauaccaguacaacuccaacaacgagaauuagaucaaauaauagcaaaccaaucaaaauacuaugacugguuagccaaaccaaaucccguagagaaacaucgugcauccaaaccuuaccaacuagacgaauuacucacauuucgcauuccuuacuacguagguccauuaauaaccccgaaagaacaagcggaaagccgggaaaacguuuuugcauggaugauaagaaaagauccaucaggcaacauuacacccuauaauuuugacgaaaaaguagacuguccagcuuccgcaaacauguuuauacaacgaaugaaaaauaccgacacauaucuuaucggggaagauguucucccaaaacgcagcuuauuauaucaaaaauacgaaguacuaaacgaauugaauaacgucagcauagauggaagaagauuaggugcggaucaaaaacaaagauuaauaagggaaguuuucgaacgucauucuucgguaacaauaaagcaagucgcagaaaauuuaguugcccauggggacuuugcgaaacgaccagaaauucgcgggcuagcagacgaaaaaagauucuuaagcucacuuucaacuuaccaccaacuaaaaaaaauccuacaugaggcuauagaugacccaacuaaagaacacgauaucgaaaauauaauaacauggucaacagucuucgaagaugcugcaauauucaaaacugaacuggcaaaaauuuccuggcuagacucagauacaauaaaagcacuaucaaacauaagauaccgggguuggggacaguuuagucgcaaguugcuagacggcuuaaaacuaggcaacggccauacgguaauacaagaauuaaugcuaucaaaccacaaucucaugcaaauacuaaccgacgagacguuaaaaacaacaauggcagaacuaaaccaggacaaauuaaaagcugacgacauugaagacgucauuaaugacgccuacaccaguccaaguaacaaaaaagcccucagacaaguccuuagaguagucgaagacauaaaacaugcugcaaacggccaagauccaagcuggcucuacauagaaaccgcugacggcccaggaaccgcugguaaacguacccaaagucgucaaaagcaaauucaaacaguuuacgcaaacgcggcacaagaauuaauagacucagccguaagaggagaacuugaagauaaaauagcugacaaagcaagcuucaccgaccguuuaguacuauacuucaugcaaggcggaagagacaucuacacaggcgcuccacuuaacauagaccaauuaucacacuaugacauugaucauauccucccacaaucucucauaaaagacgauucacuugacaauagagugcuaguaaaugcaacuauaaaucgugaaaaaaauaauguuuucgccucuacauuauucgcaucaaaaauggcagcaacuuggcgaaaauggcaugaagccgggcuaauaaguggcaggaaacuccgaaaucuaaugcuuagaccagacgagauagacaaauuugcucauggauucguagcacgacaacuuguugaaacccgacagauuauuaaauuaacagaacaaauugcagcagcacaauacccuaacacuaaaauaaucgccguaaaagccggacuaucacaccaacuccgagaggaacuagauuuucccaaaaauagagacguaaaucauuaccaccaugcauucgacgcuuucuuagcagccagaauagggacauaccuauugaaaagguaucccaaauuggcacccuucuuuacauauggagaauuugcaaaaguugauguuaaaaaauuuagggaauucaacuucauaggagcauuaacucacgcuaaaaaaaacauaguggcaaaagacaccggcgaaaucguaugggauaaagaaagagacauucaagaauuggaccgcauauauaacuucaaacgaauguugauuacccacgaagucuacuuugagacugcagacuuauucaaacaaacuauauaugcagcaaaggauaguaaagaaagaggaggaucaaaacaguugauccccaaaaaacaagguuaucccacacaagucuauggaggauauacaagagaaaacaccgcauauuuggcaguaguaaaaacagucgaaaaaaaagcagacgucuacagaguuguucgaaucgcuacgucccaagucgccgcacuaaaggaggcacgugcccaaucaacaguaaaagaaagagaauuauuaaaaaaauuucuaacuacaaaguucacaaaaauaggaaagaacggaaaaaaagcaaucacucccuucgauauagucauaccaagaguaccuagggaacaacuauuccacaacaaaagauacggauuuuuuaugguaaacagugauacacuaaugcacaacuaccaagaacuauggaugagccguagugaccagcaaauacuaucaaaacuagucaaaagugccaagaccguagagaacggacaagugggaagauuauuugaaaacauaguagaacaaaucaacaaauauuucccacuguaugauauuaaccaauuuagaaaaaaacuagaucaauccaaggauaucuucucaaaacuaccauuagaaggaaacggaacaacaucaggaaaaagagaaacaauucaaaacauauuaacaggugcuggcacaggagcaaaaaacggagaucuaaaaaauuuaggaauaaaaacuccguuuggauuucuccagguuccaucaggaauagugcuagaugacgacacaacuuuaauauaccagaguccuacagggaugcuaaaccgaaucguuagauugucagaauuauga

SEQ ID NO: 8865 - RNA, 4086 nt, Artificial Sequence
  Cas9 variant
augaaaaaugaagaaaauauauauuuagguuuagauauagguacagacagcguaggauaugcagucaccgacgacaaauauaaaauaaugaaauaccacggaaacgccgccuggggaucgaccauauuugaugcaggagccuuaggugcagaucgaagaguauucagauccgcuagaagaagauuagacagaagacaagaacgaauacaauuauuacaagaaauauuugcuaaugaaauagccaaaguagaugaacgauuuuucauacgacuauuggaaucaggucuauggcgcgccgaugcagaagacagauauguguucuucaaugacaaagaauacacugacguacaauauaugagagacuauccaacuauacaucauuuaauaugugaacuaauauauaauccaaacaaacaugauguacgauuaguauaucuagcaugcgcaugguuaguaacacacagagggcauuuccuuaguaacaucaauacagaaaacauagcagacuuaguagacauacauaacguauacaaugguuucaugagauucuuugaagaaaaugaaauaauuugugauuggagagaaguaaacguugaagaauuaggcagaguacuagcagcgaauaucgguauaaaugaaaaauaccgaaaccucagcacuguccuauucgcaacccgaaaaccagacaagaaagccaaagaaggcuucccuuacagcgaagaugcgauaguccgacuguuggcaggcggaacaugcaaauuaaaagauguuuacauuaaagaagaauacgaugaauuuggaucaaucacucugggaauggaugaugagaaaaugacggaaauaauggcagacauaggagacgacuucgaucuaauuaaagcccucaggucucuauaugauugggguaucuuagcaaacauauuagucaaugaaaacaauucaccacuaauaucacaaucgaaaguuaaaguuuacgaacaacauagagaagaccucgccaaucucaaauaucuaguacacaaauacaucccucauaaauacaaugaaauuuuucgcgaaauucgaggcgacaacuacguagcauacucguaucauuaugaacucaaaaaugaugagaaaauggguaagaaagcugauguagaaaaauuuucuaaauuccugcuaaaaauauuagaaggaauaagcguagaugaacaagauaaagucguauaugauaauaugauagaaagauuaacacuaagguuauuccugccaaaacagaaaaauacagauaaccggguaauaccacaccaacuauacgaauaugaauuaaaaaguauacucaaaaacacgaaaaauuacuuaccguucuuaaaagaaaaagacucggacggcaucucaaacgaagacaaaauaauaagcaucuuuaaauuuaaaaucccauauuucgucggcccauuaaacuguaacucacaauuugcuuggauacaaagaaaagcggauggcaaaauauuuccuuggaacuuugaagauaaaguugacuucgacgcaagcgaacaagccuucauacaaagaaugacaaaccaaugcacuuacuuaccagaagaaucaguucuacccaaacaaucacuguacuaucaaaaauuuaugguauuaaaugaaauaaacaauaucaaaaucgauggucgcaaaauuucagucgcaaugaaacaagaacuauacaacgaaauauuugaaaagaagaaacgaguaagaaagaaagacguuauagacuucuuuguaucaaaugguuacuuagaaggaggcaaagaggcuuuaauaagcgguuuagaugaacaaauacacacuaaucuaaguagcuuccaugcauuccgacgcuuacuacagaaucacauacuaucaguagaagacguagaaagcauuauagaaagagcgagcuauucagaugacaaaagacguguucuuuuauuucucaaaaacaaauauucuuuucugaccgaugaagacaucaaauauauuugcaaaauaaaaaucaaagacuucggaaggcuaagcaagaaauucuuaguagacuucgaaggaacauguaaggaaacaggagaaauuucaaccguauuaagauuaaugugggaaacaaacaauaaucuaauggaacuacuauccgauaaauacacuuuugcuaaugguauaaaagagaacaggaagaaauauuauacagaacaacagaaaaccuuagacgaccgacuggaugaaauguauaucuccaacaguguaaaaagaaccauauaucguacucuaagcgugguuaaagauguaacaaaagccuuugggguucccaagaaaauauuuguagaaauggcaagaacaaauaacccagaccucaaaggaaaaagaacaagaacgaggcaacaacaggucauagaauuauacgcaaaaugugaugaagaagacguacgggaauugaaacaccaaauggaaucauuaggagaguacguagauaacaaacuacaaagcgacaaacuuuuucuuuacuuuauccaauucggaaaaagugccuauagugggaaaaugauagaucuagaaaaauuaaugucaggcucaaaaguuuaugacaucgaacauauuuauccccaggcuuacgucaaagacgacucaaucauaaacaauaaagugcucguauucucagaagaaaacggagcaaaacaagacauuuacccaauaaaaacagaaauaagaaaacaaaugucuggaauauggacuacauggcaccacguaggagcuauaagcgacgaaaaauauaaaagacuuacaaggagcacaccuuuuaacgaagaugaaaaauauggauuuauuaacagacaacugacugaaacaucgcaauccaccaaagcaauugcucagauauuaaacgaaaaauauccggaaacagaaaucguauacguuaaagcagguuuaguaagcgauuuccgacaugaauuugguuuaugcaaaugcaggucguacaacgaccuccaucaugcuauagacgcauacuuaaacguuguaguuggcaaugucuauaacaugaaauucaaccguaaaugguucuccguagauucaaaauauucaauuaagacaaaaacaauauuuagccauaguuuaguaugcaacgguaaaauaauaugggauaaagagaaaauguuacccaugguacugaaaaacgcgaagaaaaauaaugcccauuuuaccaaauaucaauuuaugaaaacugggggauucuuugaccaaaugccuugcaagaaagcaagcggucuagucccuaggaagaaaggacuagauaccgaaagauacggaggcuacaauaaaucaggaauuauguuuuuaacaccaaugcgauauaaaauaggaaagaaaucagauauuauaauacuaaguauugaauuauuauauggcaaacucuucuuaaaagaugaaguauuugccaagaaauaugcagaagaaaggcugcagaaaauaauuggcaagaaagccgaugaaguaaguuucccaauggggaugaaaccguggaaaauuaauaccgucuuaucacuugacggauuuaacguaugcaucacaggaaucggcggcggggguaaauguuuauccgcucaaccaauuaugcaauuaucuuuaccguacgagcucgccaaauaccuaaagaaaauagaaaaauucguagagaaaaauaaaaauaaugcaaacuauauuuaugaugaacaauacgauagcguaucagucgacgaaaacauaaaauuauacgacguuuaucuagacaaauuagaaaauucuaucuacaauaagagaaucaauucaccagaagcuauacuaaagaauggacgagaaaaauuuugcaaauuaaacguacuugaacaagccgucacccucauaaacauacaaagcauauucggcaggaugacgggaggaugcgaucuggaaaacauaggugguaaaaagcauucagcagcaacuguaaacuucucgagcaacguaucaaauuggaagaaauacuauaacgacguaagagucguauaccaaucaccgagcgguaucugggaaagaaggagucaaaacauuuuagaauuauuauga

SEQ ID NO: 8866 - RNA, 4086 nt, Artificial Sequence
  Cas9 variant
augaaugaaccauauggaguugggcuugauauuggaaccaacucaguagguuggacaguaguagacaugaauggcagaguacgaaagguaaaagggaaaacggcguuaggggcuagauuauucaaagaaggcgcuacugcagaagacagaagaggauuccgaacaacacgaagacgacuaaagcgugucaaguggcgucucagauuacuccgugaauucuucgaucaaccaauuucaaaaauagauccaaacuuuuucgcaagaagaaaauacuccgauauaagccccagggacccuaacuacaauggacuggcuaagacacucuuuaacgauagaacugacaaagaguuuuacgacgacuaugcaacaauauaccaucuaagagacaaacucaugacaucgaaccguaaauuugauauaagagaaaucuaucuagcuauacaccacaucguaaaauacagagguaauuuucuacgaacugguccugcgucucaauauggaucagcuucguuacaccucgcuacauccuuccaaaaacuaaacgauuuauucgcccaauccgaggaaacacuaaauuuaaaacuaguaacugaugaggcucuacuucagcaaauacaacaaauuuuaguacgcaccgaucuaagcagguccgagcagcaaagacaaaucuggccgcuaauggcaguucuaacaggagcaagcgcugcagaaaaaaagcgccaaaaaaauguaguaguggaacuaucuaaggcauuaguuggauuaaaagcaaaaaugaacgucguuacacuaacagaaguagaugccgcaguaguaaaagacuggacuuucaccauggaagagagucaagauaaauuaccggaaauugaagaacaacucagugaagucgggcaacaaauuauggacgaagucauacaauuauacgcaucaguaaaccuagcacaacuaaucccugcaggcaaacgauucagccaacacaugguagaaaaauauaaacaucaugaaaaaaauuuagaauuacucaaggcuuacauucauagccaaucagauucaaaacguggaagagaaauccgagcuacauaugacagauauauagauggaguagauucuaaaccaguaacacaggaaauguuuuauaaggacuuaaugaaauaugucgaagcugacgcaacaucaaaucacuuagcugcagaaauaaaggacgaaauugacucugaacaguucaugcccaaacuacgaacaaaacaaaacggaucgauuccuuaccaaguacagcaauacgaacuagaccaaaucauaucccaccaaaaaaaauauuauccauggcuuggagaagagaacccuguugcagaaagaaggggaaaauuucccuacaaacuugaugaacuaguaggcuucagaguuccuuacuacguaggcccucucauaacaaaagaagaccaacaagccacaucaggggcaggauucgcuuggaugguacguaaagccgacggccccauuacacccuggaacuucgaucaaaaagucgauagaauagcuucagccacagcauuuauccaaagaaugcaaacaacagauacauaucuaauuggggaagacgugcuaccagcaagaucucuaaucuaccaaagauuuaugguuuuaaaugaacuaaacaacaugaggguugaagaccgaaaacucgcaccccaacaaaaacagcgacuauacaaccaaguauuuaaacagcaccaacacguaucuguaaaaaauauacaacaaaaccuuauggacgccggagaauaccgaaaaacaccccaaauaacaggacuugcggauccaaaaggguuuaauucaucccuaucgacguaccaugauuucaaaaaaauacucuuagaagcaauagcugacgaacauaaacgugcugacauagaaaaaauaauauuauggucaacaacuuucgaagauagugccauuuuuaaacaaaaauuggaagaaguagcauggcucacagaugcccaaagaaagcaacucuccggccuaagauaucgaggcuggggacaauuaucacauaaacuauuaaccgcuuuuaaagacgauaaagggcgcucgauaauggauggguuaugggaaacaucagauaacuuuaugcaacuccgaaaacaaccugcaauagaaacccaaauaaaagaagcuaaccaagcaaaucuaacagaugccgacauacaagacacaauuaacgaacuuuauacaaguccacagaacaaaaaagcaauuagagaagucauguuaguucuggaugacauaaaaaaugcgaugcauggacaaacaccuuccuggauauuuguagaagcagcacgcggaggcggaguggcagguagaagaacacaaucacgaagcucacaaauaguagaagcuuacaaagguaccgcaaaagaaauugucucagagaaaguacaacaugaacuaaaugaaaagaucaaagcaaaagcggacuucaacacaagacuaguauuauauuuucuacaaaacggaagagaucuuuauacuaaugaagcaauuaauauugacaggcucucugaauacgacauagaucacauauugccacaauccuuagucaaagaugacagccuagauaacagaguucugacuagugcaagaaucaacagagaaaaaaacgauacauuugcaucagaaaaauuuggacgaaagaugggcgcucaauggagagaauugcacagaaauggacuaaugacacaaagaaaauuaaaacaccuauuaaugagaccggacgagaucucaaagcaugcaacagacuucauaaaucgucaauuaguggaaacacgacaaguuauaaaacuuguagaagaacugaucaguagugaauauccggcagcgaguauugucgcaguaaaagcaaacuugacccaucaauuuagacaaacauuuaacuucccaaaacucagagaaguuaacgacuaucaucaugcauuugaugcaagccuuacugccuucauuggcauguauuuacuuaaacaauauccaaagcuagaaagguuuuuugucuacggaaaauucgcaaaacagcccauaaauuuaacucgcuucaacauaauacgaaaacucgcaguagcagagaaaccaauagcgaauauagaaacaggcgaaauucuaugggauaaaacagcagauaucaaauacuuugaaaaauuguacaacuacaaacgauuacuagucacucaugagguaagggaaaauuacggcgcaauguuuaaacaaacacuauucaaagcaaguuacaacaaauccaaaacacucguaccaaaaaagaaucauauggaaacgucuguauacggaggcuacucuaaucaagagaccgcuuaccuugcaaucgucagaauaccuuuuaaaucaggcuuuaaauucaucguaguagggauaccuacaagaaugguagcaaaaaucaagcacuaucaaucacuaggagcaacacuaaaucaagcaacacacaaaguaaucgaaccaaaauuuacaaaaaucucucgaaaaacaaaacaaaccguaauaagugacuacgaaguaguucuaccaaaaguauacuuggaccaaguugugagagaucaagucaagggacaaauguauagauuuagccuaggaucagacaaagaauaucacaacguacaggaauuguaccugcccuuaucaauacaacaagccuuuguaggucauuaugaugaaucggaugaccaaagaucgaaugaucuagugaaagucuacgacgcagcacuaaaacaauuacaacgauacuuccccuuacaucuuucacgaaacuuugaccaagucgcuucacaagcccaucagagcuucgaaggguuaaaaaauaacguacaaaccucagacaaacaacuaggcaagaaagaaguacuaaacucuuuauuuguaggacuacaugcgaacgcuacgagaagcaaccuaagcguauuagguaugucaaaagauuucggacgaauaaaaagcaaugguauaacucuaacagaucaagcagaaauuauuuaccaaaguccuaccggauuauucgagagaaaaguugcuuuaaaagauuuguga

SEQ ID NO: 8867 - RNA, 4086 nt, Artificial Sequence
  Cas9 variant
auggggaauuauuaccuuggucucgacaucggcacaaauucaguuggaugggcaguaacagaugaaaacuauaauaucgaacgauucaaaaaaaaaaacauguggggaauaagacucuuugaugaagccaaaacagccgaaagccguagaauccaccgacaagcacgaagaaugagacaaagaaaaauucaacgauuaaaucuacuaauggaacuuuucgacguagagauaagcaaagucgaugaauccuucuucauaagaaaaaaagaauccgaucuacacuacgaagacaaaucacaagacagccgcuaugcucucuuuaacgacaaagaauuuaacgacaaagacuaucauaacaaauauccaacuauauuucaucuaauaauggauuuaauagaaaaugacgaaaaaaaggauauaagacuacuauaccuagcaugucauuauuugauuaaaaacagaggacauuuuaucuucgaaggacaaaaauucgaugucaauucaucacuuaacaacaacauaaacaaguugaaaucacaccuagaccaauucuauaauauaugccuagacuucgacaaugacaaacuuaucgagauauuagucaaucaaaaucucaauauauccgagaaaucaaaaaaaauaaaagagcuauuaagaaaaacuaacuuagaaguaggaauagcgaacuuaauagcaggcggcucaauaaaauuaucaaauauguuugacgaugacgaacuaaaaaauuuugacuacaauagcuuauccuucaaaaacucaaauuucgacgagggaagagaacuuuuugaagaaguacuagaagauagauucgaauuaguugaaauucucaaagacauacaugacgcgucaguccuagaaacaaugcuauccagcgcaaguaucucacccgacggaggcaaauacaucucauccaguaugaucaacucauauaacaaacacaaacgagaucuuaaacuucuaaagaaaauaaucaaaaaguauaaaaaaucugaauacgacaacaucuucagggacgaaaacauaaaaaacaauuaccucucuuauacgcgaacaggaauuaacaaaaauaaaaaaguacaagccaaagacaacacagauuccgacggauucuacaaauacauaguaaaaauccuaaaagacauaaaagagaaugacucugacgaagacauuaaguauauacuaagcgaaaucgauaaaaaaaauuucgucccaaaacaaagaacaaaagaaaauagcgucauaccuuaccaguuaagagaaauagaguugcgaaagauaauagauaaccaaucaaaauaccacaaauucuuaaacgaaguugaugaaaaaggaaucagcguaaaagaaaaaauuauagcacuacuaacauuucgaauuccauacuauauaggcccgcucaauccaucauacaacgaagagaaaaacuucacaaccuccuggguaaaaaggcuugcaaaaggaaagguaacacccuggaacuucgaagauaugguagacauagacgcaucaagagaagcauuuauagaaaacaaauuaaacaaauguaguuucuuacuagaugaaaccguauuaccaaaagacagucugcuauaucaagaauauaugguacuaaaugaauuaaacaauuuaaaaauaaauggacaaucaauaaacacagaucuaaaaaaaucaauauacgaagaacucuucaaaaaauacaaaaaaguaacacgaaaaagauuaauuagcuacauaaaagaaaaagaaaacaccucuggcgauauaguuauaaccggaauagauggugauuuuaaacaaggcuuaaagaguuauauagccuuuaaagagauaauuggcgaaaaaauugauaacgauaucuauagaaaagaagucgagaagauaauacgagauaucucccucuacggagacgauaaaucauucauucaaaaaaaaauaaaaaacgaaaacaaacuagaccucuccgacaaucaaauuucuaaaauagcaaaacuaaaauucaaggauuggggucguuucagcaaaaagcuucuaguaggaauaaaggccucagacaaaaacaccggagaaauagauaauauuauaggauucaugagaaacuauaauuacaacauaaugcaacuaauggccaacguauucacguuuaaagacgaaauagaaaaauuaaauucaaaauacuacacauacgaaaaaauaaacgucgacuaucuagacgaccucuaccucucagcacccgcgaagagaaugcuauggcaaaguuuucaaaucgucgaugaaauaaagaauauaaaaaauucagcuccuaaaaaaauauucauagaaauggcgcgaagcaaagaggacaaaccaacaagaaaaauguccagaaaauccagauuagaaaaacuuuauacagauagcaagaaacaauuuauuaaauuauuuggcccagaugaauaugacaaauuaaauaacgaaaucaaaaauaaaucggagucagacuuuagaugggacaacuuguaccucuacuauacacaauucggaaggugcauguacagucuagaccccaucgaucuagaggaauuaucaaauaaaaaccuuuacgaucaagaccacauauaccccaaaucuaagauuuacgacgauucaauagaaaauagaguacuuguaaagaaacaacuuaacuuagauaaaucaaacgaauacccaauaccagaucgaguuuuaaacaaagacaaaaacaagcuacuagcauuuuggaaaauguuaaacgaaaaggagcuaauaggugauaaaaaauacgccaggcuaauccguaagagcccauucaccgacgaagaacucggcgauuuuauagcacgccaacuugucgaaacccgccaagcgacaaaagagacagcaaacaugcugcgacgauuauguccggauucaaaaauuguauauguaaaagcgaaaaacguauccgauuuuagaagaaaauuugacauauuaaaaugucgcagcauaaacgacuuacaccacgcucacgacgccuauuuaaacauagucguagguaacguguucgacacgaaauucacaagcaauccauuaaacuuuaucaaaaacaacucaaaaaauagaucguacaacuuagaaaaaauauacgauuaugacgugauaaggaaugaaaaaauagcaugguuagcagaaagaaaggaggaaaaccaagacggcaguauagcaaccguacucaaaaaccuuaguaaaaacgacauuagaguaacacgacguacauacauaaagugcgaagaucuguucgaugaaaauauaguaagaaaaggcaauggaaaauuuccacucaaagagaacaauaauaaaagugacacaaacaaauauggaggauauucaggcaucaaaaaugcauacuucguccuauuagaggacgaaaaacauaauagaauuauugaagcuauuccuucuuucauauauaagaaagaaaagaacggugaaaaaggcaguguuauaaacuacuuacaaaacauccuaggaauuaaauccgcaaaaauacuaagagauaaaauaaaaauuggaagcuuguuaaaaaucgacaaauuuccguauaacuuagcuggaaaauccggaaacggcauccuaauaagcggaggaguacaacuaauacuagacaaaaauacaagcaaauauaucaaaaaaauagaaaacuauaaauacaaauuagacgaaaacaaagauuaucaaauuaacauauuugauaaauuaucaaaagaggaaaauaucaaacuauucgacuuauuuguagacaaguucgaaaauaguaucuacaaaaaccgaguaaauaucaaauuaaaagaaauuaaacuagcgaggucaaaauucgaacaucuaucaauugaagaacaaauaaagacacuuacacaaaugcucauauuauuuggaagggagaauaaugcuguaaacuuggaauauauaggacuacccaaaaacaccggaaaaacaaaaauuaauaaaaaaauaaacaauaaagauauaaaaauuauaaaccaaucuauaaccggucuauacgaaacagaagaagaucucgcgaauaucuga

SEQ ID NO: 8868 - RNA, 4089 nt, Artificial Sequence
  Cas9 variant
augaaaaaaccuuacagcaucggauuagacauuggcacuaacucggucggaugggccgucauaacugaggacuacaaaguaccggcaaaaaaaaugaagguucugggaaacacaucacgagauuuuauaaaaaagaaccuacuuggcgcucuauuauucgauagcggcgaaaccgccgaggcuagacgacuaaaaaggacagcaagaagacgcuauacaaggagacggaacagacuaagauaucuacaagaaaucuuccucgaugaaaugaauaaauuagauuccggauuuuuucaccgauuagacgauucguucuuaguaccagaagaaaaacggggaucacgauauccgauauucggcacucuccaagaagaaguaaacuaucaugaaaauuucccaacgauuuaccaccugcguaaaaaauuagcagauuccaaagagaaagcagaucucagauuaauuuaucucgcacuugcacauaugauaaaauacagaggccauuuuuuauacgaagaaucauucgacucgaauaacaacucaauucaggaaauuuucaaugaauuuacagcugaauaucauaauacgauagagggaucaugucucuccggucaaauagaacaaguagaagcgauucucaccgacaaaauaucuaaaagcgcaaagcgagaaagaauacuaaaacuauuccccgccgaaaaaucaacaggcuuguuuucagaauuccuaaaacuaauaguaggcaaccaagcagacuucaaaaagcacuuugauuuagaagaaaaaacaccauuacaauucagcaaagacacuuaugaagaagaccuggaaaaucugcuugaacaaauaggugacgaauuugccgacuuauucuuacuagcaaaaaaauuauacgacgcaacauuacuagcaggaauacuuacagcaaccgacguaaguacaaaagcaccacuaucugcuaguaugauaaauagauaugaaacccaccaacaagaccuagcagcauuaaaacaauuuauaaaaaacaaauuaccugagaaguacagugaaguauucagugauuuaagcaaagauggauacgcaggcuauauuaacggaaaaacgacccaagaagcguuuuauaaauauauaaaaaaccuauugauaaaauuugaaggcgcaguagacuuccucgaaaaaaucgaaagagaagacuuuuuaagaaaacaaagaacuuucgacaacgguucuauuccucaccaacuccauuuacaagaaaugaacgcaauuuuacgucggcaaggagaucauuauccauuucuaaaagaaaauagagaaaaaauagaaaaaauacuuacuuuccgaaucccguacuacgucggaccucuagcuaggggaaaccgagacuucgcauggcucaccaggaacucagaccaagcaaucagaccguggaauuuugaagaagugguggacaaaaccucaucagcagaagacuucauuaauaaaaugacuaauuacgauuuauaucuccccgaagaaaaaguauuaccaaaacauuccauacucuaugaaaccuucgccgucuacaaugaacuuacaaaaguuaaguuuauagcagaaggacuacgagacuaccaauucuuagauucaggacaaaaaaaacaaauaauaaaucuccuuuucaaagauaagagaaagguaaccgaaaaagacauaauacauuaccuccacacaguagacggauacgauggaauagaauuaaaaggaaucgacaaacaguucaacgcaucccuaagcaccuaccacgauuuacuaaaaauaauaaaagacaaagacuucauggacgaugcagacaaugaagcuauucuagaaaacaucguacacacauuaacgaucuucgaagaucaagaaaugauaaaacaaaguuuggcacaauaugacgcaauauucgauagaaaaguaaugaaagcauugacucgaagacauuacaccggauggggcgagcucucugcaaaacucauuaacggcauacgagauaaacaaacuggaaaaaugauauuagaauaucuaaaggacgacggagaaauaaauagaaauuuuaugcaacuaauaaaugacgacucacuaucauuuaaagaaacuauucaaaaagcacagguuauaggagaaaccgaaaauauuaaacaaauuguacaagaacuuccaggaagccccgccaucaaaaaaggaauacuccaaucaauaaagauaguagacgaauuagucgaaauaaugggcuacaauccagaauccaucgucgucgaaauggcaagagaaaaccaauuuacaaaccaaggacgaagaaacucucaacaaaggcuaaaaaaacuaacagacucgauaaauaagcuugguucaucaauacuugaagaacacccugucgacaacucacaauuacaaaaugauagauuauuccucuacuaccuacaaaacgguaaagauauguauacaggcgaggccuuagaauuaucaaaacucucaagcuacgauguugaccacauuauaccccaagcguuuauuaaagacgacagucuagauaaucguguauuaguauccuacgccaaaaauagaggcaaaagugaugauguaccaucacucgagaucguccaaaaacgcaaagcauuuuggagacaacucuuagauagucagcuaauuucagaaagaaaauucaacaaccuaacaaaagccgaaagaggcggauuaacggaagacgauaaagcaggcuucauuaaacgacaacuaguagaaaccaggcaaaucaccaaacauguagcacagauauuagacgcacgauuuaacacagaaguaacagaaaaaggaaaaaaaaagcgggccguuaaaaucauaacacucaaaucgaaucuaguaucaaauuuccgaaaagauuucgaguuauauaaagugagggagauuaaugacuaccaucaugcacaugaugcauaccucaacgcggucguagguacugcgcuguuaaaaaaauacccaaaauuagagccagaauuuguauauggagauuacccgaaauauaacagcuaucgagaacgaaaaacagcgaccgaaaaagucuacuucuacucaaauauaaugaacuucuuuaaaaccacaguaaaauuagcggacggaucugaaaaaaaacgacaucaaaucgaaacuaacgaagaaaccggagaaauuguuugggauaaaacaaaacacuuugaaauaguuagaaaaguuuuaucuuauccacaaguaaacauaguaaaaaaaacagaagaacaaacaguaggacaaaacggcggacucuucgacaauaacauuguauccaaaaacaaggugguagacgcauccaaacugaucccaauuaagucaggauuaagccccgagaaauacggaggauaugcaaggccaacuaucgcuuacucaguacuugugauagcagacauugaaaaaggcaaggccaaaaaacuuaaaagaauaaaagaaaugguaggaauaacuauccaagacaaaaaaaaauucgaagcaaauccaauagcuuaucuagaagaaugcggauuuaaaaauaucaauucaaaccacauuaucaaacuuccaaaauacucgcuguuugaauuugaugacggucaaagacgacuacuagcaagcuccauagaguuacaaaaaggaaaugaauuaauacucccauaccaucuaacagcuuuacuauaccaugcccaaagaauuaauaaaauaucggaaccuauacacaaacaguacguagaagcccaccaaaacgaguuugaagaauuacuaaccacaauuauaagccuauccaaaaaauacauacaaaaaccaaacguagaauccuuguuacagcaagcauucgaccaaaccgacgaagauaucuaucaguuaagcgaaaguuuuaucucccuucuaaaacuuauaucuuucggugcccccggagcauucaaauuuuuaggaguagacauaucgcaaaguaacguuagguaccaauccguuucuucaugcuuuaacgcgacgcuaauacaccaaucaauaacuggauuauacgaaacuaggauugaucucuccaaacucggcgaagacuga

SEQ ID NO: 8869 - RNA, 4089 nt, Artificial Sequence
  Cas9 variant
augaacgaaccauacgguguaggccucgacauaggaacaaauagugugggguggacuguaguagauaugaauggaagaguaagaaaaguaaaaggaaaaacagcauuaggcgccagacuauuuaaggaaggagcgacagccgaagacaggagaggauucagaacaacaaggcgaagacuaaaaaggguaaaauggagacuaaggcuccuaagagaauuuuucgaccaaccaauaaguaaaauagauccaaacuuuuucgcaagacgcaaauauagcgacauaagcccgagagauccaaauuauaauggcuuagcaaagaccuuauuuaaugaccgaacugauaaggaguucuaugacgauuaugcaaccauauaccauuuacgagacaaacucaugacaucaaaucgcaaauucgacauucgagaaauauacuuagcaauccaccacauagucaaauauagaggaaacuuuuugaggacaggaccagcuucucaauauggcucggcaagccuacaccuagccaccaguuuccaaaaauuaaacgaccuauucgcccaaucugaagaaacuuuaaaucuaaaauuaguuacagacgaagcgcuuuuacaacagauacaacaaauauuaguccgaacagacuuaucuagaucugaacaacagagacaaauauggccacuaauggcuguauuaaccggugccagcgcagcggaaaagaaaagacagaaaaauguagucguugaacuaagcaaagcauugguaggauuaaaagcuaaaaugaacguuguuacacuaacagaaguagaugccgccgucgugaaagauuggacguuuacuauggaagaaucacaagacaaauuacccgaaauagaagaacaacuauccgaaguuggccaacaaauuauggacgaaguaauucaacuuuacgcuagcgucaaccuagcacaacuaauuccagcuggaaaaagauuuucacaacauaugguagaaaaauacaaacaccacgagaaaaaccuugaauugcuuaaaaccuacauccacagucaaucugacucaaaaagaggacgagaaauaagagccacauacgaccgauauauagacggaguagauaguaaaccgguaacacaagaaauguuuuacaaagaccuaaugaaauauguagaagcagacgcaacaucuaaccauuuagcagcagaaaucaaggacgaaauagacagugaacaauucaugccaaaacuaaggacuaaacaaaauggaucaauaccguaucagguacaacaauacgaauuagaucaaauaauaucacaucaaaagaaauacuacccauggcuaggcgaagaaaaccccgucgcagaacgaagaggcaaauuuccuuauaaauuggaugagcuaguaggcuucagaguuccuuacuauguuggaccuuuaauaacaaaagaagaccaacaagcuacuagcggggcgggauucgcuuggaugguacgaaaagccgauggcccgauaacaccuuggaacuucgaccaaaaaguagacagaauagcauccgcaacagcauuuauacaacgaaugcagacaacugacacuuaccuaauaggagaagaugucuuaccagccagaucucugauauaucaaagguucaugguucuaaaugagcuaaauaauaugagaguagaagaccgaaaauuggcuccacaacaaaaacaacgacuuuauaaccaagucuucaaacaacaucagcauguaagcguuaaaaauauacagcaaaacuuaauggaugcgggugaauaccgcgaagccccaaaaauaacaggucucgcugauccuaaaggauuuaauaguagucugucaacauaucacgacuuuaagaaaauauuacccgaagccauagcagacgaacacaaacgugcagauaucgagaaaauaauauuaugguccacuacuuuugaagauucagcaauauuuaaacagaaauuagaagaaguagcauggcuaacagaugcacagagaaaacaacuaucgggacuccgauauagagguuggggacaacucucacauaaacuccucaucgcauuuaaagacgacaacggucguucaauaauggacggacuuugggaaacuucagacaacuucaugcaacuucgcaaacagccagcaauagaaacacaaauaaaagaagcaaaucaagccaaccuuacagacgcugauauacaggacacaauaaaugaacuauauacaucaccacaaaauaagaaagcaauccgagaaguaaugcucguauuagaugauaucaaaaaugcaaugcacggacaaacuccaucauggauauucguagaggccgcaagaggugguggcguagccgggagacgaacacaaaguagaucaucucaaauaguugaggcuuacaaaggaaccgcgaaagaaauaguauccgaaaaaguacaacacgagcuaaaugagaaaauuaaagcuaaagcagacuuuaacacacgucuuguacuauacuuuuuacaaaacggacgcgaucucuauacuaacgaagcgaucaauauagaccguuuaucagaauacgacaucgaccacauacucccgcaaaguuuagugaaggacgacagccuugacaacaggguauuaacaucagccagaauuaacagggagaaaaaugauaccuucgcaagugaaaaauucggaaggaaaaugggagcucaauggagagaacuacauagaaauggacucaugacccaacgaaaacuaaaacauuugcuuaugagaccagaugaaauuagcaaacacgcuacagauuucauaaaucgacagcuaguugaaacucgucaaguaaucaagcuaguagaagaacuuaucucaagcgaauauccagcugcaucaauaguagcaguuaaagcgaaccuuacacaucaauuccgacaaacguucaauuuuccuaaauuaagagaagucaaugauuaucaucacgcuuucgaugcuagucuaacagcauuuauagguauguauuuacuaaaacaauauccaaaacuagaaagauucuucguauacggcaaguucgcaaaacaaccaauuaaucucacucgauucaauauaauaagaaaacuagcuguugcggaaaaacccauagccaauauugaaacuggcgaaauacucugggauaaaacagcagauauaaaauauuuugaaaaacucuacaauuauaaaaggcuacugguaacacacgaaguacgcgaaaacuacggagcaauguuuaaacaaacacuauuuaaagccucugacaacaaaaguaaaacauuaguucccaagaaaaaccauauggaaacaucaguauauggcggauacucaaaucaggagacagccuaucuugccauaguuaggauaccauucaaaaguggcuuuaaauucauaguuguagguauaccaacaagaauggucgcuaaaauaaaacacuaccaaagucuaggagccacacuaaaacaagcuacccauaaaguaauagaaccuaaguucacaaaaauauccagaaaaacaaagcaaacaguaaucagcgauuacgaggucguacuaccaaagguuuauuuggaucaaguaguaagagaccaagugaaaggacaaauguaucguuuuucccuaggcuccgauaaggaguaucauaacguucaggaacuauauuuaccacuuagcauccaacaagcauucgucggucauuacgaugaaucagaugaccaaagaaguaacgacuuaguaaagguuuacgaugcagcauuaaaacaauuacaacgauacuucccgcuucaucuaucacgcaacuucgaccaaguugcaaaucaagcgcaucaaucguuugaaggacugaaaaacaauguacagaaaagcgauaaacaauuggguaagaaggaagucuuaaacaguuuauucguaggcuuacacgcaaccgcuacaagaucaaauuuaucaguccuuggaaugucaaaggauuucggaagacugcaaucuagaucuggaaucacguuaaccgaucaagcagaaauaauuuaucaaucaccuacaggccuguucgaaagaaaaguggcauuaaaagauuuauga

SEQ ID NO: 8870 - RNA, 4089 nt, Artificial Sequence
  Cas9 variant
augacaaaacuaggaaaacccuacgggauagguguagauaucgguuccaauuccauagguuucgccgcugucgacgagaacagucaucucauacgccuaaaaggcaaaacaguuauuggcgcacgcuuauuugaagagggaaaagcagcagcaaaaagacgagcaggacgaacuacccgaagacgacucucaagaaacagauggcgucuauccuuucuaagggauuucuucgaaagccacauuaccccaacugaucccaacuucuuuaugaggcaaaaauauagugaaaucucaccaaaagauaaagcuagauauaaauacgagaaaagacuguuuaaugacagaacagacgcugaauuuuaccaacaguauucaaccauguaucacuuacguaauagacuaaugaccgauccgucuagagcagauguuagagaaaucuauuuugcaauccaccauauacuaaaaaguagaggccauuuccuaacaccuggagacgcaaaagacuucaacacaaacgacgucgcucuugacgaaauauuucccgcauuacaagaugcuuacgcacaaguauauccagaccuaggcaucacauucgacgaagauaaggcaaaugaguucaaaacaauauugcuuaaugaaaucgcuacuucuauugacacacaaagagcgcuaguaaaguuacuccucgcggaagaagaugacaaagacauacugaagcaacaaaaacaaguauuaacagaguucgcaaaggccguagugggccuuaaaacaaagcuaaaccuugcucuaggaacagaaguagacucaagugaagcaaccgcuuggaacuucucacuaggucaacucgacgauaaaugggcaggaauagaaagcgccaugacugacgaaggaaccgaaauuuuagaccaaaucagagaccuauaccgugcuaggcuguuaaauggaauugucccaaccgguaagacguuaucacaagcaaaaguugaugauuacacucaacaccacgaagaccuacaacuauuuaaagcauauuuaaaacaacuggaagaugauggcacggcuaaagcuauccggcaauuauaugacagauacauagauggagacgacgccgcaccauuccuuagggaaaauuuugucaaggcucuaacuaaagacguaacggcccauccaaauacaaaaucuccagaauugcuagaaaggcuagcgcaacccgacuuuaugcucaaacaaagaaauaaagcaaacggcgcaauuccuguacaaaugcaacaaagagaacucgaccaaaucauuaaaaaucaagcaguauauuacgacuggcuugccgcacccaauccaguagaaaagcauagaaaaagcaugcccuaucaauuagaugaacuccucaacuuucgaauaccauauuaugucgguccacuuguaacagccaaagaacaaaaagccgcucagggaggaguuuuugcauggaugguuagaaaagauccugaaggaaacauaacuccauacaauuuugaugaaaaaguagacagggaagcaagcgccaauacuuuuauacaaagaaugaaaacaacugacacuuacuuaauaggagaagaugucuuaccaaaacaaucacuauuauaucaacgauaugaaguacuuaaugaacucaauaaugucagagucaauaaugaaaaauuaucuauagagcaaaaacaacaaguaauuagggaauuauucgaaagacauaacucaguuaccauaaaacaauucgccgaaaaccuaagagcccauggagacuacgcucacauucccgagauaaggggacucgcagaugaaaaacgguuuuuaucuucacuaucaacauaucgucaauuaaaaucucuacucccugaagcaauagaugacccagcuaaacaagccgauaucgaaaauauaauugcuuggucaacuguauuugaagaugcagcaauuuucaaaacaaaacucaaagaaauuucaugguugggaucagaagccauaacaaaacuaagcaacauucguuaucgcgguuggggacaauucucaagaaaauuccucaauggccuaacuuuagguaaugggcacacuauaauccaagaauuauugcucucaaccaauaaccuaaugcaaauauuaaccgacgaaacucuccaaaagaaaaugacagaauuaaacgcggacaaacucaagacugcaaacauaaacgaugcgauugacaacgcuuacaccuccccaucaaauaagaaagcacuacgacaaguacuaagaguaguggacgacauaaaaagagcagcugauggacaagaccccagcugguuauacgucgaaacagcugacggcggagguacaccagguaaacguacuagagcaagacaacaucaacuccaagaaauauacgcaaaugcagcacaugaauuaauagauacagcaguuagaggcgaguuagaagauaaaaucagugacaaagcagauuucaaugacagauuaguacuguacuucaugcaaggaggucgagauauauacacaggagcacccuugaacauagaccaacucucgucauaugacauagaucacauccucccacagucacuaaucaaagacaacagcuuagauaacagaguguugguucaugccauaauuaacagagagaaaaaugcaaccuuugccuccaccauauaugcacagaaaaugaacgcgacauggcgacaauggcaugaagcuggccuaauaucaggaagaaaacuccgcaauuuacaaaugcgcccagaucaaauugauaaauacgcgucugguuucguagcuagacaauuagucgaaacaagacaaauuauaaaacuuacggaacaaauaguugcagcucaauacccugauacuaaaauaauagcaguaaaagcuggacuaagucaccaauuaagagaagaauuagaauuuccaaagaacagagaugucaaccauuaccaccaugcauuugacgcguuuuuagcagcaagaauagggacuuaccuauuaaaaagauucccgaaccuucaagccuuuuucacguauggaaaauucacuaaggccgauguaaagaaauuaagagguuucaacuucauaagagacaucacccaugcagaagauaaaauugucgccaaagacacuggagaagucguaugggauaagcaaagagacguagaugaacuagacagaauauauaacuucaaacgcaugcucaucacgcaugaaguacguuucgaaacagccgaucuuuucaaacaaacuguauacggugcaagagauucaaaagaagcuggagguagcaaacaauugauuccuaaaaagaaaggauacccuguagauauuuacggaggauacuuccgagaaaacacugccuaucuugcaguagucaaaguuacuaagaaaacagaaaccauauucaaaguagucaaaauagcaacaagucaagucgccgcauuaaauaaagcaagaucccguucaacugcagaagaacuuucaguccuaacugaacuauuaaaaccuaaauucuccaaaguagggaaaaauggaaaaauaacagacacaccauucgaaguaguauuaccccgaguuccacgcgaacaacuauuuuacaaugcaaaauauggauucuuuaugguaaauucagauacuauguuccauaauuuccaagaaaucuggguaucaagaucugaucagaaaauauugcaacaaauaagaaaagcuaaaaucgauuauccaaaugucgaucaagaccuagauaaccuguuccacaaccucgcagaucaaauuguaaaauacuucgauuuauauucuauagcaggauucaaagagaaaauaucucaaucacaaaauacauuuaacgacuuagccguagacgauaccgaucaaagcguaggaaaaauaacggucauaaaugaacuacuaaaaggagcacaagcuaacggaaugacagggagcuuaaaaguacucaaaauaucaaccccuuucggauucacucaggauaaaucaggaguacugacaaaagacucaucaaucauauaccaaucaccuaccggacuguucgagcguucaguaagauuaacugacuuauga

SEQ ID NO: 8871 - RNA, 4089 nt, Artificial Sequence
  Cas9 variant
augaccaaacuagguaagccauauggaauaggcguagacauuggaucaaauucaauaggauuugcugcggucgacgaaaauagccaccuaauacgacuaaaaggaaaaaccgucauaggagcgagauuauuugaagaaggaaaagccgcagcaaaacguagagcagggagaaccacaagaagaagacuuagccguaaccguuggcgauugucauucuuaagggacuucuuugaaucucacauuacuccuacugacccaaacuucuuuaugaggcaaaaauauucugaaauaagcccaaaagacaaagcuagauacaaauacgagaaaagacuauuuaaugacagaacagaugcagaguucuaucagcaauauucaacuauguaccauuuacggaacagauugaugacagacccaucacgagcagacgugcgcgaaauauauuucgcuauacaccacauccucaaaagcagggggcauuucuuaaccccaggagacgcaaaagacuuuaacacuaacgaugucgcgcuagaugaaauuuucccagcauuacaagacgcguacgcccaaguuuauccggaucuagguauuacuuuugacgaagacaaagaaaacgaauuuaaaaccauauuauuaaacgagaucgcaacaucaauugauacucaacgagcgcuaguaaaauuauuauuagcagaagaagaugauaaagacauacuuaaacaacaaaaacaaguguuaacugaauuugcaaaggcaguagugggguuaaagaccaaacuaaacuuagcacucgggacagaagucgacaguagcgaagcaacagccuggaauuuuucgcuuggacaauuagaugacaaaugggcaggaaucgaaagcgcaaugacagacgaaggaacagaaaucuuagaucaaauuagagaccuauacagagcgagacuucuaaaugggauaguaccaacaggaaaaacuuuaucucaagcuaaaguugaugacuauacucaacaucacgaagauuuacaacuauuuaaagcauacuuaaaacaacuugaagaugauggaacagcaaaagcuaucagacaauuauacgaucgauauauagauggggacgacgcugccccguuuuuaagagaaaacuucguuaaggcuuuaacaaaagacguaacagcgcauccuaauacaaaaagcccugaauugcuagaaagacuagcacaaccagauuucaugcuaaaacaacgaaauaaagccaacggugcaauaccuguacaaaugcaacagagagaauuagaucaaaucauuaaaaaucaagcaguauacuaugacugguuagcagcaccaaaccccguagaaaaacaccgaaaaagcaugccauaccaacuugacgaacuauuaaacuucagaaucccauacuauguagggccacucgugacagcaaaggaacaaaaagcggcccaaggagguguuuucgccuggaugguaaggaaagacccugaagguaacauaacuccauauaacuucgaugaaaaaguagaucgagaggcaagugcaaauacauucauccaaaggaugaaaacaacagauaccuaucuaauaggagaagacguacuaccuaaacaaucgcuauuguaucaaagauaugaaguuuuaaacgagcugaacaauguaagaguuaauaaugagaagcuaucaauagaacaaaaacaacaaguaauacgagaauuauuugagagacacaauucgguuacuauaaaacaguuugcagaaaaucuaagagcacacggcgacuaugcucauauaccagaaauacgaggacuagcagacgaaaagagauuuuuaucaucacuuucaacauacaggcaguuaaagagcuuauuacccgaagcaauagaugauccggcaaaacaagcagauauagaaaacaucauugcuugguccacagucuuugaagacgcggcaaucuucaaaacaaaacuaaaagaaaucucauggcuuggcagcgaagcaauuacaaaauuaucaaacauacgauauagaggauggggacaguuuucaagaaaauuucugaauggacuuacacuaggaaauggccacacaauaauacaagaacuucuacuaucaacaaauaaccuuaugcaaauacucacagacgaaacauuacaaaagaaaaugacugaauuaaacgcugauaaacucaaaacagcaaacaucaacgaugccauagacaaugcauacacuucacccucaaacaagaaagcacucagacaaguccuaaggguagucgaugauauuaaaagagcagcugauggacaagaucccaguuggcuauacguagaaacggcagauggcggaggaacgccggguaaaagaacaagagcaagacaacaccagcuacaagaaauauacgccaacgcagcacacgaacuuauagacacagcagugcgcggagaacuagaggacaaaauaucagacaaagcagacuucaaugacagauuaguucuuuacuucaugcaaggcggcagagauaucuacacaggcgcaccacuaaauauagaucaacucagcucuuaugacauagaucacauacuaccacaaagccuaaucaaagacaauagucuagauaauagaguccuaguacaugcaauaauaaauagagagaaaaacgcgacguucgcaaguacuauauaugcccagaaaaugaacgcuacauggagacaauggcaugaagcaggucuaauuagcgguagaaaacugagaaauuuacaaaugcgcccagaccaaauagacaaauaugcaucaggcuuuguagcaagacaacugguagaaacacggcaaauuaucaaacuuacagaacagaucguagcggcacaauacccugauaccaaaauaauagccguuaaagcgggcuuaucacaccaacuaagagaggaacucgaguuccccaaaaaucgggacguuaaucauuaucaccacgccuuugacgcuuucuuagccgcuagaauuggaaccuaucucuuaaagagauucccaaaccuacaagcauucuucacauacggcaaauucacaaaagcugauguuaagaaauugagaggauucaacuucauccgugauauaacucacgcagaagacaaaauuguagcaaaagauacaggcgaaguaguuugggacaaacaaagagauguugaugaauuagaccgcauauauaacuuuaagagaaugcuuauaacgcaugaagugcgauucgaaacagcagauuuauuuaaacaaacugucuauggagcucgugauucaaaagaagcuggcggcucuaaacaauuaauucccaaaaagaaaggauauccagucgacauuuauggcggauacuuuagggaaaacacagccuaucuagcugugguuaaagugacgaagaaaaccgaaaccaucuucaaagugguaaaaauagcuacaagccaagucgcagcacuaaauaaagcacgcucaagaagcacagcugaggaacuuaguguuuuaacagaacuauuaaaaccuaaauuuaguaaaguaggcaaaaacggaaaaauaaccgauaccccuuuugaaguaguucuaccacgugucccaagagaacaauuauuuuacaacgcuaaauauggauucuuuaugguuaauagcgauacuauguuucacaauuuucaggaaauuuggguuucaagaucugaccagaaaauacuucaacaaauaagaaaagcaaaaauagauuauccaaacgucgaccaagaucuagauaauuuauuccauaaucucgcagaucaaauugucaaauauuucgaccuauacucaauagccggauucaaagagaaaauuagccaaagucaaaauacauuuaacgacuuagccguagacgauacagaccaaagcguaggaaaaauaaccgucauaaaugaacuauugaaaggcgcacaagcaaauggaaugacaggcucccugaaaguuuuaaaaauaaguacacccuucggguuuacacaagauaagucugguguauuaacaaaagacucaucaauaauauaccaauccccgacagguuuauucgaaagaaguguucgacuuacggaucuuuga

SEQ ID NO: 8872 - RNA, 4089 nt, Artificial Sequence
  Cas9 variant
augacaaaacuagggaaacccuacggaauuggaguagacauagguaguaauucaauaggauucgcagcaguugacgaaaauucacauuuaauaagauuaaaaggcaaaacuguaaucggcgcacgauuauuugaagaaggaaaagccgcagcugaucgacgugcaagcagaacgacaaggcgaagacuaucucgaaacagauggaggcuaucauuucuacgugacuucuucgaaagucauauaacgccgacagacccuaacuucuuuaugcgacaaaaauacuccgagaucucaccaaaagauaaaucaagauauaaauacgaaaagagauuauuuaacgaccguaccgaugcagaguucuauaaauaugaaaauugcccaaccauguaccaucucagaaaccgauuaaugacagauccaucgaaagcagacgugagagaaaucuauuucgcaauccaucacauacuaaaaucaagaggacacuuucucacuccaggagaugcuaaagacuuuaauacaaauaaagucgcaguaaauaaaauuuuucccgcgcuacaagacgcuuaugcucaaguauacccagaucuagacaucacauucgacgaaaauaaaguaaacgaguucaaaacaguacuuuugaaugaaaaagcaacaccuucugacacucaaagggcccuaguaaacuugcuacuggcuaaagaaggagacagagauauccuuaaacaacaaaaacaggcauuaacggaauuugccaaagcaguaguaggacuuaaaacgaaauuaaaugucgcucuagggacugaaguggauaguagugaagcaacagccuggaauuucucccuagggcaauuagacgacaaauggacagguaucgagucagcaaugaccgacgaggguacagaaauacuugaccaaaucagagaccuauacagggcuagacuauuaaacggaauaguaccugcuggaaaaaccuuaucacaagcuaaaguagaugacuaugcccaacaccacgaggaucuugaacucuucaaagacuaucucaaacaacuagaagacgacgguacugcuaaagcgauacgacaacucuaugaccguuauauagauggcgaugaugcaaaaccauuuguuagagaagacuucguaaaagcacuaacaaaagaaguaacagcacauccuaacgcuaaaagcccagagcuucuagaaagacuagcacaaccagauuucaugcuaaaacaaagaaauaaagcaaacggagcuauacccguacaaaugcaacaaagagaacucgaucaaauaaucaaaaaucaauccguauauuacgacugguuagccgccccaaauccaguagaaaaacauagaaaaucuaugccuuaucaacucgacgaauuacucaauuuuaggauuccguacuacguagguccacuugucaccgccaaagaacaaaaagcagcacaaggaggaguguucgccuggaugguuagaaaagauccugaugguaacaucacuccguacaauuuugacgaaaaaguugauagagaagcaagugcaaauaccuuuauacaacggaugaaaacaacagauacauaccuaaucggcgaagaugugcuaccaaaacagagcuuauuguaucaaucauaugaaguuuuaaacgaauuaaacaauguucguguuaaugacaauaaauuaucauuugaccaaaaacaacaaguccugggcgaauuauuugaacgucacaacaccguuacaauaaaacaauuuguugacaauuuacuagcacauggggacuaugaccguauucccgaaguaagaggacuugccgaugagaaaagauucuuaucgucacuaagcacauauaaccaauuaaaagguauauuacacgaagcaauagaugacuccgacaaacaaaccgauauugaaaacauaauagccuggucaacaauauuugaagacaaagcuauauucaagacaaaacuaaaugaaauaaguuggcuuaacgcaggaaugauaaauucauuagccaauauccgcuauaggggauggggucaauuuagucacaaauuacuuaacgaacuaaccuuaucaacagggagaacaguuuuugaagaacuccuuaucaguucccauaaccuaaugcaaauccuuacagacgaaguauuaaagcaaaagauugcagagcuaaacgcacacgaacuaaaagcaucaggaauauacgcagcaauagacgacgcuuauacaaguccgucaaauaagaaagcauuaagacaaguauuaucuguuauugacgacauaacaaacgcugcuggccaagcaccgaacuggcuauacauagagacagcagacggagaugggguuccagguaaaagaacaaacucgagacaaagaaaaauccaagaaauauaugcaaacgccgcucaagaacuuauaacaggaucaguaaggggagaauuagaagacaaaauagcaucgagagcagauuuuacggauagauuaguacuauacuuuaugcaaggcgguagggauaucuauaccgguaaaccacuaaacauugacaaccugucuaguuaugauaucgaccauaucuuaccucagagucucauaaaagauaacucccuagacaacaggguacuuguacauccacuuguaaacagagaaaaagacacaaucuucgccucaacuagauuugcaaaacagaugaacgguauguggagacaauggcaugcagcaggacucauaucaagucgaaaacuacgaaaccuacaaaugcguccagacgaaauagauaaauaugcaaguggauucguugccaggcaauuaguagaaaccagacaaaucauaaagcucacagagcaaauaguagcagaccaauauccagauaccaaaaucauugcagucaaagcaggucuaagcagucaacuaaggaaagaauuagacuucccuaaaaaucgcgaagugaaucauuaucaccaugcauuugacgcauuccuugcugcaagaauaggaacauauuuacuaaaaagauauccaaacuuagaaccauuuuucaccuauggaaaauucaaaaagacagaagucaaaaagcuaaaaucauucaauuucaucagagauaugacacaugcaaaagacaaaauuguagcgaaagaaaccggugaaaucguuugggacaacgcaagugacauaaacgagcuagaucgaauauauaacuucaaaagaauguuaaucacccacgaagucagauucgaaacugcaucucuuuuuaaacagacacucuaugcggccaaaaauagcaaaaacagagggggaucaagacagcuaaucccgaaaaagaaagguuaucuuguagacauauacggaggauacacucaagaaacagggucauacuuaucagucguuaggcuaacaaagaaagcuauguaugcaguaguaaaagucagcacaagagaugcagcaaaauuagccguugcaaaaucgauaagcgaacaaaaagaaaacgaaacacuuaagaaaauaauagaugggaaacucagcaaaacaagcaagaaaggcaaaaccacacaccaauuauuugaaauaguucuuccaagagucggucagaaaacucuauuuaaaaacucaaaauauaaccaauucuugguuaacucugacacguauaugcauaacuaucaagaacuauggaugcccagagaauaccaaagaauguggaaagacauauuacuauccaaccacggagaugcacaacuugaaggccaauuagaucaaauauucaaauucauugugucccaaguaaacucauauuucaacuuguacgacaucaaucaguuuaggaagaaaaucgcggacgcuacagacaaauucgcaaaauuaccaacccaugauacggauaaugcaagaggaaaaauagccacaauaggacaacuacugauagguuuacaagcaaacgccaugaggucugaccuacgcaaccuugauauuaaaacucccuucggauuacuacaaaucggaacggguauaacauuagaccuagacacuucaauaauauaucaaaguccaacaggacuauuugaaagagaagugccuuuaacugaucucuga

SEQ ID NO: 8873 - RNA, 4089 nt, Artificial Sequence
  Cas9 variant
augaaccaagagccauacgccaucggauuagacauaggcacuucaagucuaggaugggcaaacgcagacauggauggauacauagcaagagucaaaggacaaacagguuuaggcguaagacuuuuugaggaaggacaaccugcggcugaccgaagaaguuucagaacaaccagaagaagacuaucaagaagacguuggcgacuaagauuacuaagagaaauauucgacgagccuaucucaucuaucgauccaaacuucuuugcacgucagaaagcgaguucaauaucacccaaagacgacagauuugaaacuacauaucaauuguuuaaugauaaaaccgaucaagaguucuacucuaaauauccaacaauauaucaccuaaggugggcacucaugaccgaacacagaaaauuugaccuccgagaaaucuaucuagcgguccaccauauugucaaauacagaggaaacuucuuaagauccggaaacccaaaaaguuucaaaccaagcgaacuagauuucucccaaagauucaaagaaguaaacggacucuggcaccugaucuuugaugaaguagcgccucaacuuccaacagacaauuuagaagaaauaacaaagcuaguacucgacacuacgagaacacgagcagaucgacaacgagaaagcguaaaauuacuuauggccgcaaccgauaaccauaaagauuggaaaccuuaccuuacggaguucacaaaagcaauacuaggacuaaaaacaaaauuauaccuccuuaccggaguagauguugcaaaagcagaccagaaaacguggacuuucagcuuagaagacauugaagaucauagggccgaccuagagaccgccuucgacgaccguagucuggaauuaauagaaaaacuuguagaccuccaagccgcaauccaacuaacagaaauuaugccaucuggacaauacuucagccaaucgaugauuuauagguacgaccaacacaaagaacaucucagauggcuaaaagauuacgcagaacaacaaacagacgccaauaaaagaaaagcuguacgguuagcuuacgaccauuacauagaaggagacgcaaaagggaaacccgaaauugcagacgauuuuuauaaagaacuaaacagaauccuaaaaggagauacaagugaacucgcuaagaaaauaaaucaugaaauagcauuagaacacuuuaugccaaaacaacgaacuaaagaaaaugguguaauaccuuaucagauacaucaacaagaacuggacucaauaauagacaaccaaaagaaauacuaccaguucuugggcgaagauaauccugucguaucucaccauggaucacaaccauauaaaauagaugaguuaguaucuuucagaguaccauacuacguagggccaaugauaacagcagaucagcagaagaaaacugcugccgggcaauucgcauggauggugcgaaaagacucaggggacauaacaccuuggaacuuugaugacaaaguagaccgaacagcaagugcaacgaauuuuauacaacguaugaaaaccacagacacauauuuaauaggugaagauguccuucccuugcaaagucuuaccuaccaaaaauuuaugguccugaaugaacuuaauaauaucaggauaaacggcgaauuauuaacuagagagcaaaaacagcgaaccuauaacgauguauuuaaaggucauggaacaguuaacguaaaauccuuaauuaaaucauuggaaugucauagcgaaguuaccggggcaauaaaaguagagggacuagcagauccaaaaagauuuaauucugcacuaaccacuuauagagacuucaagaaaauacuaccaguugcuaucgaucagccccaaagacaagcugacauugaacgaauaauaaacugguccacaauuuucgaagacgcagacauuuuuaaagcgaaauuacaagaaauugauugguuaacugacacacaaagagaucgacugaguacuaaaagauauaggggguggggucguuuaucagccaaauuacuauuaaauauaaaagacacucaaggccuauccaucauggaccaacuauggaacacccaacauaauuuuaugcaaauuguacaugaaccugacuaugcagaaaagauagagaaaacuaaugcgaaaggauuaaaacagcaagacauauucgaaacaaucaacgaaauguacaccaguccacaaaacaagaaagcacuaaggcagauccucgcagugguacgagacauucaaaaagcccaucacggacaagcaccaucaaggaucuuuauagaagcagcacguggagcagaacaaaauccacaaagaaccagacaacgacagaaacagcuagcugaccuuuucgcagaccaagcaaaagaaauaguaaaugaaacgguagcccaagaauuaaacgaugagacugauaacaaagccagauuuacagaccgacuuaugcuauacuuuuuacagaauggccaagacauguacacaggagaaaaauugaacauagauaaauuauccaccuaugacauagaccauauacucccucaaucacuuguuaaagaugauucacucgacaaucgaguguuaguaucuaaaguugaaaauuuaaagaaaaaugaccauuuugcuucagagcuauacgcaagaaaaaugcagggcaccugggaauuauggagaucagcaggacuaauaucagcaagaaaacuuaaacaccuacucaugcguccagaugaaauaaauaaauaugccacaggauucauucguagacaacuuguagaaaccagacaaguaauaaaacugguuaccgauguauuaucaaaugaauaugauagcgauaaaacuaaaauaauaucuguuaaagcaggccuuucacaucaauuaagaauggaacuagauuuaccuaaaguaagagaacuuaacgacuaucaucacgcuuucgacgcauuccucgcaguccgaauuggaacauauuuacucaaaagauacccgaagcucgaaagauuuuucgucuauggccaauaucaagucgcaccacaacuugacuuacguagauuuaauuuuauacacgaccugguaucaggcaaacaagagaaaauuguggcagaagaaacaggagaaauaguguggaacagagaaaaggauguaucauacaugaaacacuuacucuccuuaaaacacuuauugguuacccacgaaguaaaagaagaccauggcgcauuguucaaccagacaauauauaaagcaaagaaagauaacggcaauguaggaggaaaaaugaaauuacuaccuaccaaaucaaacaggccaacagaaauauaugggggacacucaucacaagcaauagcauacuuagccaucguacgcgucaauggaaaagaaccuucauacagaguaaugggcgucccuauuaggauauuagaccaauuaaaacaagcaaagaaacaaggagaauacgcugaaagauuagccuugaaacaauuuuucacaccagauuucaccaaaggaaaagguaaaauaguauccgacuuugauguagucaucccucauauaccacuauuacaaccaguaauagaugaaauaucaggucaaagccaucguuuugcacuaggaacaaauaccuauuauagaaacuuacaacaacuaauacucacacucgccgaccaaaaaguacuaauuucuaaagaaacuggaguggaugaagaaaagaaauuaguugaaguuuacucacacauaugucaacaaguaaugaaauucuucccacuuuaugauagaaacaaauucagagaacuacuuguugauucacgcagucauuuugaacaacuuccuauaguaaacagauacucagaugcaggaaaacucgagauugcaggaaaaagaggaauauuacaacaaaucauggucggccuccaugcaaacgcaacaccaggagaccuuaaagaauuaggaguaaaaacuccauuuggaaaauuacaagucccaggcggaauaaaauuaacagaaaacgccaaacuaauuuaugaaucaccaacuggacuguucaaaagggaagucaaaauaacgacagaauga

SEQ ID NO: 8874 - RNA, 4089 nt, Artificial Sequence
  Cas9 variant
augaaaaaaaaagcagaaaagauuuaucuugguuuaaaugucgguacaaauucaaucggauaugccgugacggaugaacaauaucgcuuacuaaaauucaacggcaacgacgcauggggauccauaguauuugaugcagccagcaguaacgaagauagaagaaaccauagauuggcccguaggaacuuagaucgcagacaacaacgcaucguauggcuacaagaaauauuugcaaaagaaauaucuaagguugacgaucgauuuuuuauacgucucucagaaucuuucagguggagagaagacguacaagaccgauauguauucuuuaaugauaaagaauauacggacguccaauauaugaaagaauauccaacuauccaucaucuaauaugcgaauuaauggauaauaaaacuccccacgauguaagacuuguauaucuugcaugugcuuggcuaauaacacaucgagggcauuuucucaacaaucuaaauguagagaaacuagacgaaauaauggauuucuccagcguauaucaaaacuucauaaacuauuucacggaaaauggauacaaaaggccauggggggaaauagauguuagugcccuauccgaaguacuaaaacaaaaaacagguauaaccguaaaaaauaaagaauuacaaaacauacuucuugaaggcaaaaaaccagaaaagucgggcaccgaggaauucccauucucgcaagacucuauaaucagacuacuagcaggaggacaguguaaauuaaaggacgucuucuguaaagaggaauacuuagauuuaggcagcguuagccugggcauggacgaagaaaaguuugacgaaauauccggaagcaucggcgaagauuacgaccuacuaauagcauuaagaggacuauaugauuggucaguuuuagcaaaccuacuuaacggacauucugaaacuauaucaauggcaaaaguucaaauguacgagcagcacggaaaagaccuacaaaucuuaaaauacuuuguacguaaauaugugccggauaaauacaaugaaguguuucgaaaggcaaaggccgacaauuacguagccuauacuggacacauggacaaagacacugccagucagaucaagaaaaaagccaaagcagaggaauuuucaaaauacguacuaaaacuaaugagcccaaucaaaccugaaaaaacagaccuacaaaguuaugaagacaugugcgaacgauugaaacucaauagauuccuaccaaagcaaaaaaacacagacaaccguguaauuccacaucaauuauaugaauacgaguugauacaaaucuuaaaaaaugccuccguuuacuuaccauuuuuaaacgacacaaauaaugguauaucagaagccgacaaagugcuaucaguauucagauauaaaauaccauacuauguaggaccacucaaugaagaaaguucauucgcuuggauaagcagaaagcaaggaaaaauuacaccauggaacuucaaggaaaugguagaugaagaugcaucagaaaaugcguuuaucagaaggaugacuaauaaauguacauaucucccaacagaagauguacuuccaaaagacucguuauguuaucaaaaauucauggucuuaaaugagauaaauaaccuacaaauagauggacuaaaaauuccuguuaaggcuaaacaaggcauauaucaugaacuguucgaaaaaaauaaaaagguuaagcgaaaagauauagaagaauauuuaauaaggaauaacuacuuagacaaagauucgacggaacuaauaucaggcauugacgaacaaauacauucaggcuuaagcucauauugugcauucuucaaucuacuaaauaaaaaaauauuaucugaagaugauguagagcgaauaauagaacgagcauccuacgcggaagauaaaucacgaguaauaaaauggcuacgcaaagaauacccuggacuaucagaagacgauauaagauauaucgcaagaauaaagaucagggauuucggacgcuuaucuaaaacauuccucacaggccugaaagguugugauguaucaaagggauucgacggucaggacguagaaaugauaucgauauuacaaacuaugugggagacaaacgacaauuuaauggaaauccuuagugacaaauauaccuuucuugaagcacuagaagccuucacucaggaauacuauacaggaaagaagaaaaguuuaaaagaacgacucgacgaaaugcgaguuuccaauucaguaagaagaccaguuuaccgaacccuagcuguaguaaaagacauagagaaagcuuuuggaaaaccaaauaaaauauuuguagagaugaccagggguggacaagcggaccagaaagguaaaagaauaaaaucucgaaaacaacaaauauuagaucucuaugauaaaugcaaagaugauguacacgacuuaauguggcaauuagaaucacuaggagaauaugcagacaguagacuacaaucugaucgacuauaucuauauuuuaugcaauucgguaaaugcgcauacaguggugcgcacauaggauucgaacaauuaauggcaggaagcguugaauaugauauagaucacauuuauccacaaagcuacguuaaagaugauucauugaacaacaaaguuuuaguccuauccgacuuaaacggaaccaaggacaauauuuaccccgugucucccgaaauaaggggcaaaaugcagggucuauggucuugguggaaccauguaggagcaauuucugacgaaaaauauaaacgacuaauaagaagcgcaccauucacugacgaagagaaaaugggauuuauaaacagacaauuaacggaaacaagccaaucaacaaaauucauagcagaccuauuaaaagaaagguucccugaugccgaaguaguauauguuaaagcgggcuuaguaagugauuucagacacgaauucgauuuaccaaaaucacgaucauacaaugacuuacacaacgcagcagacgcuuuuuuauccguagucgcaggcaacgucuacgauaugagguuuaguaaaaaaugguuuagaaucgacgaaaaauauucuguaaaaguaaaaacaauauuuacacacgaagugaaauguagaggagacauaaucugggauggaaugccuaugcuggaaaaaguugaggauacagcacgaaaaaacacugcucauuuuguuaaauaugcugccuucaagacaggagguuuauuugaucaaaacccaguuaagaaaggaacagguuuaauaccgcuuaaagcagguuuaccuacagaaaaauauggaggauacaauaaagcagguauuauguucuugaucccaguccgcuacaacauagguaaaaaauccgaaauacucauucucccagucgaacuuaugcacgguaaacauuuuuuagaagauaaaguauucgcaagaaacuauaccuucacaagacuagaaaauauacucggcaaaaaaguaggugaggucucauuuccaauggguaugaggccauggaaaauaaauaccauguuaucuuucgauggauuucguguuugcuuaacagguacuaguggucgcggaaaaugccucguugcccaaccaguaaugcaguuuuccgcagacgagcauuggagauucuauguaaaaagacuagaaagauuuguugaaaaaauagggauaaacccagaccucuuguacgauaaagaucacgacaaagugagcaaagacgagaacuuaaaauuguaugaacuauacguugauaaauuacaaaauaccauauacaaaaaaaggguaaauagccccgugcagacacuacuuaaaggaaaagaagaauucaaaaaacuuucuauagaagaacaaugccaaguauuguuaaauauccaaagcguuuucggacgcaugacuggaggaugugaucuaacuuuaauaggagguagugcucacucagcggcaacaggcucauugagcaccacaauaaguaacuggaaaaaaaaauauucaacgguucguauaaucgaccaaucaccaucaggaaugugggagaaaucaucagaaaacuuacuggauuuuuuauga

SEQ ID NO: 8875 - RNA, 4092 nt, Artificial Sequence
  Cas9 variant
augacaaaauuaggcaaacccuauggcauaggaguagacauaggcaguaauucuauuggauuugcagcaguugaugaaaauagucauuuaauuagauuaaaaggcaaaaccguaauaggagcacgccuauuugaagaaggaaaagcugcugcugaucgacgagcuucaaggacaacucgaagaagacuaucaagaaacagauggaggcugucauuccuuagagacuucuuugaaucccacauaacccccacagauccaaacuucuucaugcgacaaaaauacucagaaaucucaccaaaagauaaagcccgauauaaauacgaaaagagacuguucaaugacagaacagacgcagaguucuaucaacaauacccuacuauguaccacuuaagaaauagauuauuaaccgacccaucaaaagcggacguaagagaaauauacuucgcaauacaucauauauuaaaaucaagaggacauuuucuaacuagcgguuaugccaaagauuuuaacacaaauaaaguagcgcuaaaugaaaucuucccugcauuacaagaugcuuaugcccaaguauacccagaucuggauauuacguuugaugaaaacaaagucaaugaguucaaaacaguucuauuagacgaaaaagcaacaccaucagacacacaaagggcauuaguuaacuuacuguuagcggaagauggcgacaaagauaucuugaaacaacaaaaacaaguguuaacagaguucgcgaaagccgugguuggauuaaagaugaaauuaaaugucgcccuuggaacagaaguagacucuucagaagcaacggcuuggaauuuuagccuuggacaauuagacgacaaaugggcaggaaucgaaucugcaaugacagacgaaggcacagaaauucuugaucaaauaagagauuuauaccgagcacgauuauuaaaugguauagucccugcgggaaaaacucuaucgcaagcaaaggucgaugacuacgagcaacaccaugaggaccucgaauuauucaaagauuaucugaaacaauuagaggaugauggaauggcaaaagugauacgccaacuauacgacagauacauagauggagaugaugcgaaaccuuucguccgugaggacuuuguaaaggcccuuacaaaagaaguaaccgcacauccaaacgcuaaaucacccgaacugcucgaacgauuagugcaaccagauuuuaugcuuaaacaaagaaauaaagcaaauggugccaucccuguucaaaugcaacaaagagaacuagaccagauaaucaaaaaccaaucaguauauuaugacugguuagcugcaccaaacccgguagaaaaacaucgacagucaaugccauaccaacuagacgaacuccuaaauuucagaauaccauauuaugucgguccuuuaguaaccgcaaaagaacaaaaagcugcgcaagguggugucuuugcauggaugguacggaaagaccccgauggaaacauaacaccguacaauuuugacgaaaaaguagauagagaagcaucagcaaauacauucauacaaagaaugaagaccacagacacauaucuaauuggugaagacguucuaccaaaacagucacuuuuguaccagucauacgaagucuuaaaugaauuaaacaacguacguguaaaugauaauaaauugucuuucgaccaaaagcaacaagucuuaggggaacuauucgaacgucacaacacgguaacaauaaaacaauucguagauaaccuacuagcccauggggacuaugauagaaucccagaaguaagaggcuuagccgaugagaaacgcuuccugaguaguuuauccacuuacaaccagcuuaaaggaauacuacaugaagcaaucgacgauucugauaaacaaacagacauagaaaagauaauagcauggagcacaauauuugaagacaaagcaauauuuaagacuaaacuaaaugaaauaucuuggcuuacagccgggaugauuaauucccuugccaacauaagguacagaggauggggucaauuuucucauaaauuacugaaugaacuaacauugagcacaggaagaacugucuuugaagaacucuuaauaucaucacauaaccuuaugcaaaucuugacugacgaaguacuaaaacagaaaauugccgaacuaaaugcucacgaacuuaaggcaucaggaauauaugccgccauagacgaugcauacaccucacccaguaauaagaaagcacuccgccaaguacuaucaguaauagacgauauaacaaacgcggccggacaagcacccaacugguuguauauagaaacugccgacggcgacggagugccaggaaaacgaacaaacagucgacaaagaaaaauacaagagauauacgccaaugccgcacaagaacuuauaacuggcagugugagaggcgaauuagaagacaaaauagcuagcagagcagacuuuacggacaggcuaguuuuauauuuuaugcagggagguagagacauauacacaggcgagccauuaaauauagacaacuuaaguucauaugacauagaccauauacugccacaaucauuaauaaaagacaacagcuuagacaaccggguacucguccauccuuuagucaacagagaaaaagacacaauauuugcaaguacacgcuuugcaaaacaaaugaauggaauguggaggcaauggcaugcugcgggacuaauauccagccgcaaacuucguaauuuacaaaugcgcccagaugaaauugacaaauacgcaucagguuuuguagcaagacaauuaguagaaacaagacaaauaauaaaauuaaccgaacaaauaguugcagaccaauauccggaugcaaaaauaaucgcugucaaagcaggucuuaguucacaauuaagaaaagagcuugacuuccccaaaaacagagagguaaaucacuaccaucaugccuucgaugcauucuuagcagcccgaauuggaacauaccuuuuaaaacguuacccaaauuuagaaccauucuuuaccuacggaaaauucaagaaaacagagguaaagaaacuaaaauccuuaaaaaguuucaauuuuauaagggauaugacacaugcaaaagacaaaauuguggcgaaagaaaccggagaaauaguaugggauaacgcuucggacauaaacgaacuagacagaauauauaacuucaaaagaaugcuuauaacacaugaaguaagguucgagacggcaucuuuauucaaacaaacucucuacgcagccaaaaauaguaaaaaucgcggaggaagcagacaacuaauacccaaaaagaaaggauaucucgucgauauauauggcggauacacacaagagacagguuccuauuuaucaguaguuaggcucacaaagaaagcaauguaugcaguaguaaaaguuaguaccagggaugcugcgaaacuagcaguagccaaauccauaucugaacaaaaagaaaaugaaacacuaaagaaaauaauagauggaaaacuuagcaaaacuuccaagaaaggcaaaacuacacaucaacuuuuugagauagucuuaccacgaguaggacagaaaacucuauuuaaaaacagcaaauauaaucaauucuuaguaaacuccgacacauauaugcauaauuaucaagaauuguggaugccaagggaauaucaaagaauguggaaagacauacuucuaagcaaucacggggaugcacaacuagaaggacaacuggaccaaauuuucaaauucauaguaagccaagucaacucguacuucaauuuauacgacauuaaccaguuucgaaagaaaauagcggaugcaacagauaaauucgcaaaauuaccaacccaugauaccgauaacgccagaggcaaaauagccaccauaggacaacuauugauagguuuacaagcuaacgccaugagaagcgauuuaagaaauuuagauauaaaaacuccuuucggacuucuacaaauuggaacaggaauuacacuggauuuagacacuagcauaauuuaccaaucaccaaccggacuuuuugaaagagaaguuccucuaacugacuuguga

SEQ ID NO: 8876 - RNA, 4092 nt, Artificial Sequence
  Cas9 variant
augagaggaaacuaucacauuggauuagauauuggaaccucaagcauaggcugggcagugauugacgauaaugcaaaagucaugcgcgcaaaaggaaaaacagcaauaggagcacgauuauauaaugaaggacaaaccgcagcagacagaagacuuuuucguacaacacgcaggagacuaaauagacgaaaauggagacuuaaacuucuugacgaaaucuuugaccccuauauuacacccguagacgccgcauucuuugcgaggcucaaacaaucuaauuuaucaccaaaagaccaaaauagagauuggacgggcucaaugcuauuccccgaucgaaccgaucgaaaauuccauaaagauuacccaaccauauaccacuuaagacacaaauuaaugacagaggaucaucaauucgacauacgugaaauauaucuugcuauacaucacauaguuaaauaucgcgggaauuucuuaaacacaacgcccguaagcucauucuccguaucagacguaaaauuugaugaacaauuugaccgacucaacgaacuauaugcagcgguaucacccgaugaaccauuugcuauuaauggcgauaacucaaaagccaucgaaacguuacuucuuuccgacgaaacaaagaaauuugauaaacaaaaacaaagcgcuaaacuaauacuaagugaaaccggugauaaagcccuugacaaagaaaacaccaaagucgccacacaaaucagcaaagccauccuuggauauaaaacacaacuagacguucuauuaaaauacgacgcaauaaauaguucugccuggaaaauugaauuagacgaugaaaauaucgaugacacccucccgggcuuauuaucccaauuagacgagaaccgacaagagaugguuagcauaauacaaaacuuguacgcacaaguaacccuuaaccaaaucguaccaaauggaaugagucuuucugaguccaugauagaaaaguacaacgcccacagagaccaucucaaacuccuaaaacagcucgaagacaagauagacgacccuaaaaagaagaaaggcuuagaagcugcuuaugacgcauacguaggcaaaaauaugaaaguugcuaaucaagacguauucuacgccucaguaaagaaaaaccuugaugacagcgaucuagcaaaacaaauagcagaucuaauugaagcccaaaaauuuaugccaaaacaacguacaucccaaaauggaguaauaccucaccaauuacaucaauuagaguuagaucaaauuauagaaaaccaaucaaaauauuaccccuggcucacagccgcaaaccccaauccaaaacggauacaccaagccaaauacaaauuggaugaauuaguagcauuccguauuccauauuacguaggaccauuaguuaccccagaagaacaagaaaaaucagccaaucaaguauucgcguggaugaaaagaaaacaaccgggcacaaucacacccuggaacuucgaucaaaaaguagacagaauggcauccgcaaaccgcuucauuagaagaaugacaacaaaagauacauaccuuauuggugaagacguacugcccgaugcaagucuuaucuacgaaagauucaaagucuuaaacgaacucaaccuaguuaaagcuaauuaccacagauuggcuccagcucagaaacaagcagccuaccgagaccuauucgaaaaucaaaaaucuauuuccaccaagaaacuacaaaauuaucuaguagaucaaggauauuucacagcuaaaccaaaaauaacgggcuuaucagauccagaacgauuuaacucaucacuugguacauacaucgauuucaaagaaaucuucggagaucagguugauaaucccgaucgccaagacgacuaugagaaaauaaucgaauggucaacaguauuugaagacaggcaaaucuaugaagcuaaacuacgaacauuagauugguuaacagaagaucaaauucaagcacuaaaaaccaaacgcuauaacggauggggucgauuaucaaagaagcuacucacuggaauaguagacgaaaauggagaacguauaaucgauguacuuuggaauacaaaucaaaauuuuaugcaaguacaaucacaagaaucauuugccaaacgaauacaugaagcaaaugccaaacaaaugaagguaacuggaguugaagacauucuagcagaugcguacacgagcccucaaaauaagaaagcuaucagacaaguaauuagaguaguagacgauauacaaaaagcgaugggagguguagccccuacgucagucagcauagaauuuacacguucagaagaccaaaauccacgaagaacucaaucaagagaaucacaacuccaaaacacauuuaaaguagacgccaaagaaauaguagacucagaccuagucaccgaacuagaaacagucucaaaaucgaaaaagggauuaaccgauagguuauaucuauacuucacacaacuugguaaagauauguacacaggcgacccacuaaauaucgacgaacuaucaacauacgacauugaucacauacuuccccaagcauuuauaaaagaugacucguuagauaaucgcguacuggucucgaaagccgucaacaauggaaaaucgaacaauguccccgucaaacuuuuuggaggaaaaauggguggauuuuggaaagaauuagcagaccacagauuaauaaguaaacguaaauuaaaacaucuauuaacagaccccgacacaauagacaaguauacaaugagaggauucauaagacgucaauuaguggaaacaagccaaguaauaaaauugguugcacaaauauuaggggacaaauaucagaacgaugacacaaaaauaauagaaguaacagcaaaaaugaaucaucaaaugagggaaaauuucaaacuaauuaaaaauagagaagucaaugacuaccaucacgcaguugaugcguauuuaacagccuucgucggacaauaccuauauaaaagauaccccaaguuaagaccauacuuuguuuacggaaauuuuaagaaauucaaugaagaccaugucagcuuuagguauuucaauuuucuacacgaacuuauggaugaaaacaacaaaaggauaguagagccugagacuggagaaguaguauuagaaagagaaccagcaauagcauauaugaaaagaguauaccacuuuaaauuuaugcucaucucccaggaagucuauaccagacgcgacgcaauguucaaucaaacgauauacccagcaaaagaagcaaacagacgaaaacuuauagcaauaaaacaugguaaaccaguagauguauauggagguuacucaggcuccguagaugccuacauggcaauaguaagaauacaugacaagaaaggagauaaauauaaaguaguaggaguaccuaugagagccuuagaaauucuaaacgcaacccaugauaagaaagauuacgaugcaaaacuaaaacagauuuuaguuccaaaauuuaccaaagugaagaaaaguagaaaaacuggggaaauaaccaagaaaguugaagauuucgagauaguucuugguaaagugauguacagacaacuugucauagacggcgauaagaaauucauggucgguucuuccacauaccuuuauaaugcuagacaacucguauuaagcgauuccagcuuagauacucuagcauccaaaggaacucuugacucagacgcagauucaaaaagacuuguagcaguguacgacgaaauagucgaaaaaguagacaaauacuucccauuauaugacaaaaacgcauuucgaagcggacuacauaaagguagagacaaauacuuauuacuacccaauagaagcacauucaauggagcaaagaaaguacauucaggaaaaagggaaauucuaaaugaaauacucaacggacuucacgccaacgcuaccuuagguggacucaaagauuuaaaaaucagcacgccauuugguaaaaugcaaggacaaagugguauaccucuaagcaguaacacaauuauaugcuaccaaagucccacaggcuuauuugaacaccgaguuucauuaaaagaucuauga

SEQ ID NO: 8877 - RNA, 4092 nt, Artificial Sequence
  Cas9 variant
auggaaaauaacagauauaaugucgguuuagacauaggaacuucaucuauagguuucgcagucacagacgaacaagacgaacuuguacaaguaaaaggcaaaaauuacauaggaguacgccuauucaaagaaggccaaacggccucagaaagaagaaguuuuaggacuacaagacgcagacuaaaaaggcgaaaauggagacuaggccuauuagaagaaauauuugcuccauaccuggcacaaggcgacccauauuuccuagcucgaaugaaagaaucaaauauaaguccucgugacgaaaggaagaaauacuacggcucgcuauuauuuagugaugacacaguauucuaugauaaauacccaaccguguaucaucuuagacacgcguugaugacagaagacagaaaauucgauauaagagaaauuuacuuagcaguucaucacaucaucaaauauaggggaaacuucuuaauaaauacauuaauaaacgaauuuucuagcaaagccgucgacuuuaagaaagacgcugauauuuuaaacgaucuauucgaacaauuuuauauaucugauauaaacgauucuuuccaacugaauacagcagauaugaaugaaauuagugaacuacuguuagacaacucaaaaacaagacuagacagacaaagggaaucacucaagaaacucgcgaagaaagucgaugacaucagcguugcgaagaaacaccagaaaauagccacagaguucagcaaagcuauauugggcaacaaagcuaaauuugacguaauacuaaaugucaccacagacucaaguaacgauuggaguuucaaacuagaagaugaagacgcagaugagaaaauaguaguacugcuagaagaauuaaacacuccacaacaagaagcucuuaauauaauacaccaaugguauucccaaauaaguuugaacggaauagugccagacggaaaauccaucagcgaagcaaugauaagcaguuacgaacuucacaaagaacaccuugcgcuauuaaaacaacaaauaaacaauacuaaagauaaaaagaaagcccauggcuuacacgaagcauacaaugaauacguacauggaaacaauaauaagaaauuaaaccaagccgacuucuacagcaaaguaaaacaaaaucuagaaucaucuuuaauaacugaugaaauacuagaacuaauaaacgcagaaaauuuuaugccaaaacaacgaacguccgcaaacggcgugaucccucaccaacuucaucaacaagaacuagaccgaauaauacaaaaccaagcaaaauauuauccauucuuagccgaaacaaaucccaacgaaaaacgaucaaaaguggccaaauauaaacuggacgaacucguagcauucagaguaccuuacuacgugggaccacuaauaaccgcaacggaucagaagaaaacauccggaaaagaauuugcuuggaugguacgaaaacagccaggacgaauaacaccuuggaacuucgaugaaaaaguaaacaaaauggaaucagcaaacacguuuauccguaggaugacaaccaaagacaguuacuuaauagcugaagacguacuaccagacgaaucccuacuuuaucaaaaauuuaaaguccugaacgaauuaaauaaucuacgagcagacgguagaaaacuaaaaguaagcgucaaacaaaaaguguuuaaagaauuguuccaacaacagaaaacuauaaccauaguaaaacugcaaaauuauuuaaaagcugaauguagcuucuuaacaacaccagaaaucucaggcuugucaaaaccagaacauuucguaucuucauuagcuacauacaucgaccucaagaaaauauucggagaagacauagauaauccagcccgacaaaacgacuucgaaagaaugauagaaugggccacuaucuuugaagacaaaaauaucuauagugaaaaacucaacgaaauaaaaugguuaaaugaccgacaaaagaaagaauugaaaaauaaaaauuaucauggauggggaaagcuaucagcuaaacuucuuaaaggacuacgcgacucugaugaauguucaaucauagaacacauguggaacacucaacagaacuucaugcaaguucaagcggaagaagacuucgcacaaagaauacaagaagaaaacaaccagcauuuaaaaggaaacacucuagaagaagucuuagcugacgcuuauacaucaccucagaauaagaaagcgauaagacaaguagucaaaguaaucgaagacauacaaaaagcaauggguggaauagcuccacagaaaauaagcauugaguucacgcgagccccagaagaaaaaccaaggagaucaguagaaagacaacaacaaaucgagaaaauauauaaaucaguugccaaugaagucgaaaaugcaggaguaaaagacgaacuacaaagauuuagugacagaaaacaaacccuuacagauaaauacuuuuuauacuuuacacaauuaggaaaagauauguacacaggaaaauccauuaauauagaucaaauagguaauuaccaaauagaccacauacuaccccaggcuuucauaaaagacgauagccuugauaaccgagucuuaguaucagcagcuguaaauaaugguaaaucugauaacgucccaaccaaaaaugacagguacaaagugagagaacacggccaaaggcuauaugaccaaggucuaauuagcaaaagaaaauucaacaaccuaaucacagacccagauagcauaaauaaauucacagcacgcgguuuuguaaaaaggcagcuaguugaaacaucucaagugaucagauuagucgccgaguuccuauauaauaaauaccaaagcaaaagcgaaaucauugaaguccgagcuaaaaugaacucccaacuaagaaaagacuuuggguuaauuaaaaacagaaacgucaaugacuaucaccaugcgcuagaugcuuaccuaaccacauuuauagguaauuaccucuauagacgauauccaaaauuaagagcauacuuuacguauggaugcuuuaagaaaguggaugacagucaacucaaauauuuuaauuuccuucaugacauagaagacgauaagaagaaaauaauaaaagauaaugauacgggggaaauacuauggcacagagaugaagggauagccagauucaaacgcauauacaauuuuaaauacauguuagucacacacgaaguacucacacgacaaggggccauguuuaaacaaacuguauauucagccgcagucgccggcucgaagaaauuaauuccuguaaaagaagacagaccaauagauauauacgguggauacacaaauaacaaugacgcauuucuugccauagucaaagucaccaaaaagaaacaauacaugguagucggcauuccacaaagggcaguaguaaaacucaaugaugcugcaaaacaagguaguaaagcauaccagaaaguuuuauauaauguaauaaaaccacaauuuauaaagaagaagaaagaccguaaaacagguaaaaucacacaaaaauuagaaaacuuugaaauagucgucaguaaaacauuguacagacagcuuauaauagauggggaccaaaaauacaugcuagguucaucagcguauaaauacaacgccaaacagcuaguacuauccgaguacgcauuagaaguauuagaccguucaaucuuugagaagaaagaauauacaacagucgaucuagacaauguauaugacgaaauauuagcacaaguagauaaauauuucagccucuaugacaaaaacaaauuccgacaaaaauuacacgaaucaagaaaaauauuuacagaacucccgauuaacaacuuauucuccggaacaaaacuacucaagagcgguaagagagaaacauuaaaugaaauacuugaaggccuccaugcaaaugcgaccaagaaagaccugaaaagccuaaaauuuuccacaccucuaggaaugauacaauaccccucagguauaauacucagugaaaaugcaauauuaugcuaucaaucucccacaggcauauuugagagacgugucacccuaaaagaucuauga

SEQ ID NO: 8878 - RNA, 4092 nt, Artificial Sequence
  Cas9 variant
augacuaaacugggaaaaccauauggaaucggaguugauauagguuccaauucaauagguuuugcagcaguagaugaaaauagucaucuaaucagacuaaaaggcaaaacuguaaucggagcacgacucuuugaagaagguaaagcugcugcugaccgacgggcaucacggacuaccagacguagacuaucucgaaaucgauggcgccuaaguuuucucagagacuucuuugaaucucauauaacaccaaccgauccaaauuucuuuaugcgacaaaaauacagugaaauuucuccuaaagacaaaagcagauacaaauacgagaaaaggcuauuuaacgaucgaacagacgcagaguucuacaaauaugaaaauuguccaaccauguaccacuuaagaaaucgacuaaugacagauccaagcaaagcagacguacgagaaauauauuucgcaauccaccauauacuuaaaucacggggacacuuuuuaacaccaggagacgcaaaagacuuuaauaccaauaaggucgcaguaaauaaaauauucccugcacuacaagacgcauaugcacaaguauacccagaucuugacauaacauuugacgaaaacaaagucaacgaauuuaaaacaguauuauugaaugaaaaggcaacacccucagacacacaaagagcucuuguaaaccuacuacuugcuaaagagggagauagagauauauugaaacaacaaaaacaagcacugacagaauuugcaaaagccguugucggauuaaaaacaaaacugaauguugcccuaggaacugaagucgacucaagugaagcaacagcguggaauuuuucccuaggacaauuagaugauaaauggaccggcaucgaaucggcaaugacagaugaaggaacugagauacucgaucaaauccgagauuuguacagagcacgauugcuaaacggaauaguaccagcuggcaaaacauuaucccaagcaaaaguugacgauuacgcacaacaucacgaagaccuagaacuauucaaagacuauuuaaagcaacuugaagacgacggaacggccaaagcuauaaggcaauuguaugauagauacaucgacggagacgaugcaaaaccuuucguacgagaagauuucguuaaggcacugacaaaggaagucacagcacaccccaacgccaaaucuccagaacuauuagagagauuagcacaacccgauuucaugcuuaaacaaagaaacaaagcgaacggcgccauaccagugcaaaugcaacaaagggaauuagaucaaauaaucaaaaaccagucaguauauuaugacuggcuagcagcccccaauccagucgaaaaacauaggaaaaguaugccauaucaauuagacgaacuacucaauuuuagaauaccauauuaugugggcccucuaguaacagcgaaagaacaaaaagcagcacaaggcggcguauuugccuggaugguaagaaaagauccagauggaaauauaacgccauauaauuuugaugaaaaggucgauagagaagcaagugccaauacuuucauacaaaggaugaaaacaacagauacauaucuuauaggugaagauguacuuccaaagcaauccuuacucuaucaaagguaugaaguucugaacgagcuaaacaauguucgaguaaauaacgaaaaauugucaauagaacaaaagcagcaagugauaagggaacuuuuugagagacacaauucagucacaaucaaacaauuugccgaaaaucuacgagcgcauggcgauuacgcgcauaugccagaaauaagaggccuagcagaugaaaaacgauucuuaagcucccuaucaaccuaucgacaauuaaaaucucuucucccagaagcaauagaugacccagcaaaacaagccgauauagaaaauauaauagcauggagcacugucuuugaagacgccgccaucuuuaaaacgaaacuaaaagagauaaacugguuagacucgcaaaccaucacuaaacuaaguaauauaagauaccgaggauggggucaauucagucauaaauuccuaaauggacuaacucucggaaauggacauacaauuauccaagaacucuuucucucaaauaauaaccuuaugcaaauacuaacagaugaaacacugcaaaagaaaaugacagaauuaaaugcagacaaacuuaaagccgccaauauaaaugaugcaauagacgacguguacaccuccccuucuaacaagaaagcgcuaagacaaguccuaagaguaauagaagacaucaaaagagcagccgauggacaagaucccaguugguuauaugucgaaacugccgacggcggagggaccccaggcaaaagaacacgagcuagacaacaucaacuucaggaaauauaugcuaacgcagcacacgaacucaucgauucagcaguccgaggagaauuagaagacaaaaucgcagacaaagcagauuuuaacgacagacugguauuguauuuuaugcaaggaggaagggacauuuauacaggaaccccuuugaacauugaccaauuaucaucuuaugauauugaucacauacuaccucaaucccugauaaaagacaacagucuagacaauagaguucuagugcacgcaauaaucaacagagagaaaaaugcaacuuuugcuucaacaauuuacgcacagaaaaugaaugcgacauggagacaauggcaugaagcaggucuaauaucaggucguaaacucaggaaccuacaaaugagaccggaccagaucgacaaauacgcgucagguuuuguagcacgacaacuggucgaaacaagacaaauaauaaaauuaacagaacaaauuguugcagcacaauacccagagacuaaaauaauagcggucaaagcaggccucucacaucaacuaagagaagaacuugaguuuccuaaaaauagagacgucaaccauuaucaccacgcguucgacgccuucuuagcagcgagaauuggcacuuacuuacucaaacguuucccaaaucuacaagccuucuuuacuuacgggaaauucaagaaagcagaugucaagaaauuacgcgguuuuaauuuuauaagagacauaacacaugcagaagauaaaauuguaguuaaagauacaggagaaguaaucugggacaagaaaagagacguagaugaguuagacaggaucuauaacuucaaaagaaugcuuauaacucacgaaguccauuucgaaaaagccgaucuuuuuaaacaaacuguauauggcgcuaaagauaguaaagaggcaggagggaagaaacaauuaauauccaaaaagaaaggcuauccaguugacaucuauggaggauauacacaagaaacagguucauaucuaaguguaguacgacuaacaaagaaagcaauguacgcagucgucaaaguuucaacgagagacgcugcuaaauuagcuguugcaaaaagcauaagcgaacaaaaagagaaugaaacucugaaugacauuauagacgaaaaauuaagcaaaaucaguaaaaauggaaaaauaacacaugaauuguucgagguagugcuaccgcguguaggacagaaaacuuuauucaaaaacaguaaauacaacuuauuucuaguaaauagugauacauacaugcacaauuaccaagagcuauggaugcccagggaauaucagaaaauguggaaagauauuucguugucaaaauacggugacgcacaaaccgaggaucaauuagaucaaaucuuuggauucauaguaucgcaagucaacucauacuuuaaucuauacgauauuaaucaauuuagaaagaaacuuaaugacgcagcggauaaauucgcaacguuaccuaugagagauaccgaugacaugcaagguaaaauagccacaauaggucaacuauuaauaggacuacaagcaaacgcagcaaggagcgauuuaagaaauuuagauauaaaaacuccacuuggauuauuacaaauccccaacgggauuucccuagacucagauacgucaguuguauaucaaucaccgacggguuuauuagaacgcgaaguccaucugucagauuuauga

SEQ ID NO: 8879 - RNA, 4092 nt, Artificial Sequence
  Cas9 variant
augacaaaacuaaaccaaccauacgguauaggcuuagacauaggaucaaacucuauuggguuugcagucguagaugcaaacucacauuuauuaagauuaaaaggagaaaccgcgauaggcgcccgacuauuccgugaagggcaaucagcugcagauagacgcgaaucaagaacaacaaggcgucguuuaucucgaacacgauggcgauuaucuuuucuaagagacuuuuucgccccacauauuacuaaaauugauccggauuucuuuuuaagacaaaaauacagcgagauaagucccaaagacaaagacagauuuaaauacgagaaaagauuguucaaugacagaacagaugccgaauuuuacgaagcguacccuucgauguaucaccugaggcuacgccuaaugacagaugcaagccaagcugaccccagagagaucuuccuagcgauccaucacauauuaaaaucgcguggacacuuucuaacaccaggcgcggcaaaagacuuuaacacagaugaaguagaucuuaaacacauuuuuccagcucuugcagaagccuaugcucagguauauccagaccuggaacuuaauuucgacuccgcauuagcggaugauuuuaaagcaaaauuacuagacgaagaugcaaaaccauccgauauacaaaaggcauuggugaauuuacuuuuaucuucugacggagaaaaggaaaucgucaagaaaagaaaacaaguguuaacagaguucgcaaaagcuauaacaggacuaaaaacuaaauucaaccuugcuuuaggaacugaagucgaugaagccgaugcuaguaauuggcaauucuccaugggacaauuagaugacaaauggucaaauauugaaaccuccaugacagaccagggaaccgaaaucuuugaacaaauacaagaacuguauagagcaagauuacuaaauggaaucgucccagcuggaaugucacuaagucaagcaaaaguugcagacuauggucaacauaaagaagacuuagaauuauucaagacauauaucaagaaauuaaacgaccaugaacuugccaaaacaauaaggggacuauaugaucgauacauaaauggagaugacgcuaaaccguuuuuacgugaagauuucguuaaagcacuaacuaaagaaguaacagcgcacccaaaugaaguaagugaacaacugcuuaaccguaugggacaagcaaacuuuaugcuaaaacagcgaacaaaagcaaauggagcaauuccgguacaauuacaacaacgagaacuagaccagauaaucgcuaaccaaucuaaauauuaugacuggcuagccaaaccuaaucccguugagaaacaucgcgcaucaaaacccuaccaacuagacgaacuacuaacauuccguauucccuauuaugucgguccauuaauaaccccaaagcaacaagcagaaagcggugaaaauguauuugccuggaugguacggaaaaauccaagugguaacauaacaccuuacaacuuugaugagaaaguagauagagaagccagcgcuaauacauuuauacaaagaaugaaaacuacugauacauaccugauagacgaagauguauuaccaaaacaaucucuacuuuaucaaaaauacgaagucuuaaacgaacuaaauaauguacgaauuaauaacgaagcguuaucaacggaccaaaagcaaagacuaauacgagaaguuuucgaaaggcauaguuccgucacaauaaaacagguagcggacaaucuaguagcacacggugauuuugcccaaagacccgaaauaaggggccuagcugacgaaaaacgauuuuuaucaagccuuucgaccuaccaccaacucaaagaaaucuuacacggugccauagacgauccgacaaaacuucacgacauagaaaacauaauaacauggucaacaguuuucgaagaugccgccauauucaaaaccaaauuagcagaaaucgacugguuagaucccgcaacuauaaagaaacuaucuaacauuagauaccgaggauggggucaauuuucaagaaaauuacuagauggccuaaaacuaggaaauggucacacaguaauucaagaacucauguuaaguaaccacaaucuuaugcaaauacuagcagacgaaacgcuaaaagaaacaaugacagaacuuaaucaagauaaauuaaaaacagaugauauagaagauguaauuaaugaugcuuacacaagucccagcaauaagaaggcucuaaggcaagugcucagagucguagaagauaucaagcaugcggccaauggacaggaccccucauggcuauauauagaaacagcagacggacccggaaccgccggaaagagaacccagucucgacaaaaacaaauccaaacaguauacgcgaacgcagcccaagaauuaauagacucagcagucaggggagaauuagaagauaaaauugcagacaaagcgagcuuuacagauagacugguucuauacuucaugcagggugggagagacauuuauacaggcgcuccacuaaacauagaccaacuuucccauuaugacauagaucacauauuaccacaaucauuaaucaaggaugauagucuagacaaucgaguucuaguaaaugcuacaauaaaccgagaaaagaacaacgucuuugcaagcacacuauuugcaggaaaaaugaaagcuacauggaggaaauggcaugaagcaggacuaauuucugguagaaaauugagaaacuuaaugcuucguccagaugaaauugacaaauuugcaaaaggauuuguagcacgacaauuaguugaaacaaggcaaauaaucaaacuuacagaacaaauagcagcugcacaauauccaaacacaaaaaucauugcaguaaaagcaggacucagucaccaguuaagagaagaacuggacuuucccaaaaaccgcgauguaaaccauuaccaccaugcauucgacgcuuuucuagcugcuaggauagguaccuacuuauuaaaacgauaucccaaacuaacuccuuucuuuacuuacggagaauuugccaaaguugaugucaagaaauuccgagaguucaauuuuauaggugcacucacucacgccaagaaaaauauaauagcaaaagauacaggugaaauaguuugggauaaagaacgagauauacaagaacuagauagaaucuacaauuucaaaaggauguuaauaacacacgaaguccauuuugacauggccgaccucuuugaccaaacaauauaugcggccaaagacaguaaagagaggggagguucuaaaaaucuaauacaaaagaaacaaggauaucuaacaggaauauacggcggauauucaacggagagaggaaguuauguuucaauaauacgaacuuucaagaaaggugcccccauauauaacaucguaaauauuagcacagcagauguuucacuauuaagugauaaacagagagugucagaagcaucagccgauguucuucuaaaagaacuaauaaagaagaaauuagcaaaacguaaaucuggugagaacacaaaaagcggugcuuucgaaauaguucuaccuagaguugguaaaaauacacuuuuuaaaaacaagaaauauggccuuuucuuaguugagucaacaaccgaauuucacaauuaccaagaacuauggcucccaagaaacgaucagaugcuaauaaaaaguauacaaagucacaaaauagaagaaaguaaagcagauuacgaacucacacguauguaucgaaauauagccucccaaguugaucauuacuuuggucuauauacuauaagaaaauuuuccgaaaaacuaacagcauccauaaacgauuacggagcacuaccuguauacaaauccgagacaacagauggaaaauaugaaguauuaucaaaucuuuucgaaggacuuggauccggaacaucaaccggaaaccugacagcagugaaacugcaacccaauuuuggacgaguauauuuaaccucagggauaguacuagaggacgauacuuccaucaucuaccaaucuccaaccggccucuuugaaagauccguaaaauuagcagauuuauga

SEQ ID NO: 8880 - RNA, 4092 nt, Artificial Sequence
  Cas9 variant
augacaaaauuaaaccaaccauacgguauaggcuuagauauaggcucaaacucgauaggauuugcagucgucgacgcaaauucccauuugcucagauugaaaggagaaacagcaauaggugcaagacuuuuuagagaggggcaaucugcagcugaucgccgaggcagccguaccacucgaagaagauuaucacgaacgagauggcgcuuaucguuucuacgagacuucuuugcaccacauaucacaaaaauagauccagacuucuuucugcgccaaaaguacucagaaauaucaccaaaagauaaagauagauuuaaauacgagaaaagacuuuuuaaugacagaacagaugcagaauuuuacgaagauuauccauccauguaccauuugagacuucaccuuaugacacauacucacaaagcugauccaagagaaauauuucuagcaauacaucacauccugaaaucaagaggacacuuucucacaccaggggcagcuaaagauuucaacacggacaaaguagacuuagaagauauauucccugcguuaacagaggccuaugcccaaguauauccagaucuugaacuaaccuuugaucuagcgaaagccgacgacuuuaaagcaaaguuauuagacgaacaagcaacaccauccgauacacaaaaagcguuagucaaucuacuucuuucgagugacggugaaaaagaaauagugaagaaaagaaaacaaguguuaacggaguucgcuaaagcuauaacagggcuaaaaacuaaauuuaaccucgcucuagggacagaaguagaugaagccgacgcaucuaauuggcaauuuuccaugggccagcuugacgauaaauggaguaacauugaaacaucaaugacagaccaaggcacagaaauauuugaacagauacaggaauuauacagagcaagacuuuuaaacggaauugugcccgcaggaaugucacuaucucaagccaaaguggccgacuacggucaacacaaagaagaucuagaacuguuuaaaaccuaucuuaagaaauuaaaugaccacgaauuagcgaaaacgauaaggggauuauacgauagauacauaaauggugacgacgcaaaacccuucuuaagagaagacuuuguaaaagcacugacaaaagaaguaaccgcacauccuaacgaagucagugaacagcuuuuaaacagaaugggacaggcaaauuuuaugcuaaaacagcgaacuaaagcaaauggcgcgauacccauacagcuacagcaacgcgaacuagaccaaauaaucgcaaaucaaaguaaauauuaugacugguuagcagcuccaaauccagucgaagcacaccgauggaaaaugccauaccaacuagacgaacuacuaaauuuccauauaccauacuacguuggaccuuuaaucacaccaaaacaacaagcagaaucaggagaaaauguauuugccuggauggucagaaaagauccauccgguaauauaaccccauauaauuucgacgaaaaaguugauagagaagcaucagcuaacacauucauacaacguaugaaaacgaccgauaccuaccuaauaggagaagacguuuugccaaaacagucauuacuuuaucaaaaauacgaaguauuaaacgagcuaaauaauguaagaauaaacaacgaaugucuaggcacagaucaaaaacaacgacuaaucagagaaguauucgaaaggcacuccucaguaacaauaaaacaaguugccgacaauuuaguugcccauggagauuucgcacguagaccagaaauuaggggauuagcagaugagaaaagguuucuuaguaguuuaucaacauaccaccaauuaaaagaaauauugcacgaagccaucgaugauccgacaaaauugcuagacauugaaaauauuauaacuuggagcacaguauuugaagaucauacaauauucgaaacaaaacucgccgaaauugaauggcuagaccccaagaaaauaaacgaauuaucaggaauacgguauagaggauggggucaauucaguagaaaauuacucgauggucuuaaauuaggaaacggacacacgguaauccaagaauuaauguuaagcaaccacaaucucaugcaaauauuagccgaugaaacucuaaaagaaaccaugacggaacugaaucaagauaaacuaaaaacagaugauauagaagacguaaucaaugacgcguacacaucacccagcaauaaaaaggcuuuaagacaagucuuaagaguugucgaagacauaaaacaugcagccaacggacaagaccccucuugguuauucauugaaacagcugaugguacuggaacagcagguaaacgaacacaaaguagacaaaaacaaauacagacaguauacgcaaaugcagcacaggaacuuauagacucagcaguaagaggugaauuggaagauaaaauagcugacaaagcaucauuuacugacagauuaguguuauacuuuaugcaaggaggaagagacauauauacaggcgcaccacucaacauagaucaauuaucccauuaugacauagaccacauucuaccacagucacuaauaaaagacgauucauuagauaacagaguacuggucaaugccaccauaaauagggagaaaaacaauguuuucgcaucaacacuauuugcuggcaaaaugaaagcuacguggagaaaauggcaugaagcuggcuuaauuucaggaagaaaauugagaaaccucauguuacgucccgacgaaaucgauaaauucgcuaaaggauuuguugcaaggcaacuuguagaaacaaggcaaauuauaaaacuaacggaacaaaucgccgcagcacaauauccuaauacaaaaaucauagcagucaaagcaggauuaucacaucaacugagagaagaacuagauuuuccuaaaaauagagauguaaaccauuaucaucaugcauuugaugccuuuuuagcagcaagaauaggaacuuauuuauuaaaaagauauccaaagcuagccccauucuucaccuauggagaguucgcaaaaguugacgugaagaaauuuagagaauuuaauuuuauaggagcucuaacgcaugccaagaaaaacaucauagcaaaagacacuggagaaauugucugggauaaagaacgagacauacgcgaacuggauagaaucuacaauuucaaacgcauguuaauaacccaugaaguuuauuucgaaaccgcugaucuauuuaaacaaaccauauacgccgcuaaagauucaaaagaaaggggagggaguaaacaacuuauaccaaagaaacaagguuaccccacucaaguauauggcggcuauacacaggaauccggaagcuacaaugcacuuguaagagucgccgaagccgauacuacagccuaucaaguuauaaaaauuucggcgcaaaacgcauccaaaaucgcaucugcuaacuugaaauccagagaaaaaggaaaacaauuacuaaacgaaauagucgugaaacaauuagcuaaaagacgcaaaaacuggaaaccuagugcaaacagcuucaaaauaguaauuccuagauuuggaauggguacacucuuccaaaacgcuaaauacggauuauucaugguaaauucugauacguauuacagaaauuaucaagaguuaugguuaaguagagaaaaucaaaaguuacugaaaaagcuauucaguaucaaguacgagaaaacacaaaugaaccaugacgcccuucaaguuuauaaagcuauaauagaucaaguugaaaaauucuuuaaacucuacgacauaaaccaauuuagagcuaaacugagcgaugcaauagaaagauuugaaaaacuaccaauaaacacagaugguaacaaaauagguaaaaccgaaacauuaagacaaauauuaauagggcuacaagcuaacggaacuagauccaauguuaaaaaucucggaauuaaaaccgauuuaggacuauuacaaguaggaagugggauaaaacuagacaaagauacacagaucguauaccaaucacccucaggauuauucaagagaagaaucccauuagcagaucuauga

SEQ ID NO: 8881 - RNA, 4095 nt, Artificial Sequence
  Cas9 variant
augggagauaggaaauacaaccuaggucuugacauugguacauccucaaucggcuuugcagcugucgaugaaaauaaccaaccaauaagggucaaaggaaaaaccgcaauaggcguaagacuauuugaagaaggaaaaacagccgccgauagaaggggauuccgaacuacaaggagacgucucucacggagacgguggagaauaaauuuauuaaacgaaauauuugaugcccaccuagccgagguagauccuacauuccucgccagacuaaaagaaucaaaucgcucuaaucuugaccccaaaaaauccuuucaagggaguuuacuuuuuccugaaagaaaagacuaucaauuuuaugaggaauacccaaccauauaucaucuucguaaagcucuuauggaaaaagaccgaaaauuugauuuucgagaaauuuaccuagcaguucaccacauaauaaaguaucgagggaauuuucuaaauggaacgccaaugcguagcuuuaagguagaaaacauagaauuagauacuuuauuugaccaacuaaaccaauuauaugcugaaaucguacccgacaaugaguuggccuuugauuuagcucaaguugcggauguaaaagacguacuaucuucaacgacaauauacaaaauggacaaaaaaaaacaauuaguaaaaaugaugcuguugccagcaucaaacaaagccuuacaauccgaaaauaaaaaaauagucacacaauucguuaaugcgauacuaaacuacaaauucaaauuagacguauuauuacaagucgaaaccgacgccgauuggucauuaaagcuuaaugacgaaggggcagaugauaaacuagaggaauucacaggugaccucgaugaaaaccgauuagaaauaaucgaucuacuucaaagguuacauaauugguuuagcuuaaacgaaauaacgaaagacggaaauucacucuccgcugcaaugguugaaaaauaugaaaaccaccaccaccaccuaggcuuauuaaaaaaaguaauagagaaucacccagaugccaaaaaagccaaggcauuaaaagaaacauacacagcauaugucggaaaaacagacgacaagacacaaaaucaagaugacuucuauaaagcgguugaaaaaaaccuggaugauucaccugaugccaaagagauaaaaaggcuaauacagcuagaucaauucaugcccaaacaacgcacaggacaaaacggagcaauaccccaccaacuccaucaacaagaauuggaucaaauaauagaaaaacagucuaaauauuaucccuuuuuagccgaaccuaaucccaaugucaaaagaagaaaagacgcucccuauaaauuagacgaacuaauagcauucaaaaucccauauuacguugguccacuagucacaccagaggagcaagcucaaaauggcgaaaaugucuuugcauggaugaaacguaaagcagcaggaccaauuacaccauggaacuuugacgaaaaaguugacagaauggaaucagcuaaucgauuuauucgcagaaugacaacaaaagacacauacuuauucggagaagacguacuaccggcagaaagcaugauauaucaaaaauucgucguacucaacgaacuaaacaauuuaaaaauaaacggcagacaucuaucauugaaagacaaacaagacguuuauaacgauuuauucaagcaacaaaaaacugugucaauuaaagcacuccaaaacuauuacgucaccaaaaaaaaagcagcaacggcuccaaccgucgguggacuagcagauccaaaaaaauucuuaaguucucuaucaacuuacauagacuucaaaaacauguuuggugaacgcgucaacgacccacaauuucaggaagauuuagaacaaauagucgaaugguccaccauauucgaagauagaggaauauucaaagccaaacuacaagcacucggguggcuuucggaaaaacagauacaacaacuaguagcaaaacgauauaaaggauggggcagacuaucaaaaaaacuacugacuggacuaaaaaaugcagagggguauagcauauuagacgaaauguggagaucuacgggcaacuuuaugcaaauucagucuagaccagaguucgcugcacuaauucagcaggcaaaugaaaaacaauucgaaggaaacgauccagacaacguaugggaaaauaucgaaaacauacuuggagacgccuauacuucaccgcaaaacaaaaaagcaauccgccaaguugucaaaguaguucaagauauagaaaaggcgguagguaauccaccagagaaaauagcaauagaauucaccagagaagcagcugccaauccucaacgaacacaaucacgucuaagaaccuuggaaaaacuauacgaaagugcugaagaagucguagaugccggacuaaccgcagaacuugcugaauucaaagaaaacaaacacguauuaagugauaaauacuaucuuuacuucacacaauugggaagagauguuuacacaggagacacaaucaguuuagauaaacugaaugacuaugaugucgaccacauacucccccagagcuucauaaaagaugacagccucgauaaucgcguucuuacaaucagagccguaaauaacggaaagagcgacaacguaccugccaaaauguucggaaaaaaaaugggaucuuuuuggagguaccuacuagauaauggcaugauuucgaaaagaaaauauaacaaccuaaucaccgacccugacaacauuucaaaauacgcccaaaaaggguucauaaaccggcaauuaguagaaacuagccaggucauuaaacuaaccgcaaauaucuuaaacgggaucuaugauaaagauacugaaauaaucgaagucccagccaaaaugaauucacaaaugaggaaaauguuugaccuaguaaaaguaagagaaguaaaugauuaccaucaugcauucgaugcuuacuuaacaauauucauagguaacuauuuguacaaguguuacccaaaguuacaaccauacuuuguguacgacaacuucaaaaaauucgggaacaaagaagacaucgggcacaaaagauuuaauuuccuaggcaaaauugaaagagaaaaaaaaguaguagcaccagaaacaggagagauacucuggucaaacguagcacccaacgaaaccauaaaacaaauaaagaaaguauacgacuauaaauuuaugauugucucacgugaaauuacuacuagaagagcagaauuauucaaccaaacggucuauccuaaaaauuaccauggaaaauuaauaccaaucaaagaagauagaccaacagaucuauacggcggauacucaggaaauacagacgcauauuuagcgauaguagcauuagaagacaaaaaaaaggggaaguacuuuaaaguaguaggaauaccuacaaggguagcagcaaaacuggaaaaauuaaagcaacaagacagucagcaauauuuacaagcguuacauaaaguaaucgcaccucaauucacaaaaagcacaaaaaaaggcauuaaaaaaaccgaauucgaaaucguccuagacaaaguucauuaucgacaacucguacaggauggaccagucaagaugaugcuaggaagcucaacauacaaauacaacgcaaaacaacuaguucucagcgaaaaagcgcuccaaguuauagcugaugaucggaaguuugacgaaacacaaaaagaugauaaucuaauugccguuuacgaugaaauacuaucaauuguaaaucaaucauucgaucuauaugacauuaauggguucaggaaaaaauuaaaugacaauagagaucaguucauagauuuacccgcagaaacgaaauaugaaggaagaaaaguaguugcacauggaaaaagagaaaugauuuuagaaauccuuaaaggacuccacgcgaacgcugcauuugguaaucuaaaaccuauuggauuuucaacagcuuuuggacaacuacaagucccaaauggaauaauucugucuaaaaaugcaauauuaauacaucaaucgcccucaggucuauuugaaagaaaaauaaaauuaucagaccucuga

SEQ ID NO: 8882 - RNA, 4095 nt, Artificial Sequence
  Cas9 variant
auggaaaaacaagaauauuauuuaggccucgauaugggaauuagcaguguagguugggcagucacgaacgacaaauacgagcuucuaagaaagaaagguaaagacaugugggggauaagagaguucgaagaagccgacaguagugcggagaggagaacacaucgaguuaaccgaagaagaaggcaaagacaaguagcaagaaugggcuuauuaaaagaguacuucagugacgccauagaaaaagucgacaguaauuucuucauuagaaucgaaaauucaaaauacuucuuugaagauaaagacgguagauuaucaucuaaaaacggaauauuugacgacgcggauuacaaggacgucgauuacuacacugaauacccaacuauuuuccauuuaagaaaagcccuuuuagauauagaagauacaggaaaagaguaugauguaagacugguauaccuagccuuaguaaacauguuuaaacaucgaggucacuuucuguuaaauacggaaggggacgcacuuucaagugaacaagugaacaccacauaucaagaacuucuagagauacuagaaaacaacuaugauauaaguuuagaaagcagggauauuaaagauguaaucgauauaauaaguucaucagauaauggacggaaaaagaaacaugaacaaauacuugaguuauuugggguaaagaaaagugacaaaagagcaaacgaauuauuaaagugccuaugcgguuuaucaguaaacgcuaaauuaauauucgaugaaaauuacgaagaaaaaguagaucuuuguuuucaugauuucaguuauacggacaaaauuccagaucugauggaaaaauuaagugaagaagaauauuacguaguugaacaauugaaaucaauauaugauuauaguauacuagcaggaacauuaaaaggauaugauuaccuuucgugcgcuagagucgaacuauaugaaaagcaucgcgaagacuuaaaacugcuaaaagcucuauacaggagauacaaaacgaaugaagaauacaacgauauguucaaaagcgacaaagaaggaacauauuccgcguauguuaauucguuuaacaguucugacucaucagugaaaauuaagaaauauagauggaacaugaaagguagaacaauagauaaucuguauggaacaauaaagaaagcauuuaaagacaacaccgacgauaaagauguccaaucaaugauggaaagcauagauaaagagcaauuccuaccaaaacaacuaacuggagcuaauggaguuauaccaaaccaaguccauaagaaagaaauggaacgaauacuaaagaaagcacaaaacuaccuuccauuuuuaaaagaaaaagaugaaagcgaacucacuguuagugaacgaauacucagauuguucacguuucaaauaccauauuacgugggaccgcuaggcgaaaauucaaaaacggguuggguaguaagaagagagggaggucguguucuaccauggaauauagacgagaaaaucgacaugucugcaacaagugaagccuucauagggaacuuaauaagaaaauguacauacuuaucggacgaaaaaguuaugccaaaagcaucccuaaguuaugaaagauauugcguacugaacgaaaucaacaacaucuguauagacggugaaagacuagauacugaacuuaaacagaaaauuuacacagagugcuucaugaaagggaaaagagucacaaggaagcaaaucuguaacuacuuaguagcccaaggauguauaaaaagugacgagcaaguaacagguauagacauuaauguuaacagcagccuaucaaguuacgguaaaauguucgccauauucggagagcaucugaaagaagacgccauuagaaaaguagcagaagaaauaauauacugggguacaauauucagcgacucgaagaaaauguuuagaaaacaccuaaccaaauacguagaacaagguauauuaggcgaaucacaagucaaaagaauacuuggcuacaaauuuaaagauugggguagauuuucaaaagcacuauugacacuacaaggcauagauaaaaguaccggagaacuacuaagccucgaaaaugcaaugugggaauauucacucaacuuuauggaauuaauaaacucagacgacuucacuuuuaaggaugaacuagccaauagaagaacaucugcaauaaaaucccuauccgaauuuacauaugaagaucuagaagacacauauuucucuguuccugugaaacggaugauauggcaaacaauccuaguuguacgagaaauagaacaaauaaugggguacgcacccaaaaaggucuuuguugaaauggccagaagugaagaagaaaaaggagacaagggaagaaaagauucuagagguacucaacuucucgaacuguacaagaauauaaagaauacagaaaaucacgauuggaagaaagaaauaagcgaagccaaugaaucgggaaaacugagaagcaagaaauuauaccuauauuacacccaaauggguagagacauguauaccggagaagaaauaaacauagauaugcuuuaugacgauaguauguacgauauagaccauauauauccuagacauuacguaaaagaugacucaauugugaauaaucucgugcucguuaaucguagagcuaaccaagacauuaagaaagauuuauacccaauucccgauaaaauuaucucgaacccaaaaguacaagaacuauggaaaaugcuacauaaacaaaacuuaaucacagacgaaaaauauaaacgcuuaaugaguagaucuccuuucacagaaaaacaacuaggagauuucauagcgagacaacuuguagaaacuagacaaggcacaaaaggaaucgcagaauuauuagggcaauuauuuaaagacacugaaauaguauaugcaaaagcaacaaacguuagugacuucaggagggacaauggauuuguaaaauccagauuggucaaugauuuccaucacgcucaggacgcauacuugaauauaguaguagguaauguuuacuauacgaaauucacuaaaaacccauggaauuucauaaagaaagauuuugacaaagacaggaauaaaaacggauauaacuuagccaaaauguuugaccgugacguaguacgaggagacgauaccgcauggauagcaucaaagaaagauacacagggaacuauagaaacuguacgaaaaaugaugcgcaaaaauacgccucuuaugacaagaaugucguuugaacaacacggaggcauagccaacgcaacacuauacucagccaagaaagccaaaguagaaaacuauaucccgcucaaaucaucagacauaagacuuucagauguaaagaaauauggcggguucacaucggcuacaguagcauacuacuucauuguacaccacaaagaaggcaagaaagaaaauaccacaauagaggcuuuaccacuauacuguaaaagaaaaguagaaaaugaagaaaaugguuuauuaaaauauugugaagaaguuuuggguuauggagacgucaaaauauuauuuaauaaauuaaaaauucaauccuuacuugauauaaacggauaccaagcacaccuaucugggaaaacggggaaccaauugacauuaagaaaugcaaugaaccuauguguacccgaaaaauggacagcauacauuaagaaauuggaaaaauuaguuguaggccacguaaaagagcaggaaauaucaagcgaggcaaauauugaacucuaugacuuacugaccgacaaacaccuaaacucaguauaugcaaaaagaccaaaugcauauggacaaaaauugauagauaaccgaucaagguucguaaaccugaaaccagaaagccaaugcgaagcaauauuacaaauacuuaaacuuacgaaaauagguaauaaugaaaccaauuuaaaauuaauaggagaaagugaacacucaggcaaaaugcucauaucgaaaaacuuaaaagacacagauaaacccgcaauaauaugucaaucagugacgggcuuauaugaacgaaaaauuuauauauuugacgaacaacuagacaaauga

SEQ ID NO: 8883 - RNA, 4095 nt, Artificial Sequence
  Cas9 variant
augaauaagagguacaauaucggacuagacauagguacaaacucaauagguuggaguguugucaaugaucaaagucaacuugucagaauaaaaggaaaauuggguuacggcguaagauuauaugaugaaggacaaacagcugaggacagaagauuauuuagaacaacuagaagacgauuaaaaaggcgaaaauggcgacuaggucuguugcgagaaauauuugaaccauacauuacuccacaagacgcuaccuucuuuuuacgacaaaaacaaucaaauuuaucacccaaagacuuacaaaaacaacaaccgcaaaucggcuuauucaacgaccgacuagacucagauuuccacuaccaauauccaaccauauaccauuugagauaugcucucaugacagaaaaacgacaguucgaucucagagaaauauaucuagcaaugcaccauauaguaaaauauagaggacacuucuuaaaugcggccgcugcaucuucauuuaaaagcggcgaaauagaccucgcuaaagauuuugcagccuuaaaccagauauucggcaccauuuuuagcgagguaggcuuuucacuaagcgaauccaaccucgaugaaaucaagucaauccuccuagacaauaauuuaucugcaucuguaaggcaaagaaaagcguuaccguuaauauaucaaacagccgcaucaaaagauuccgagaaacaauauaaagccaucgcaacagaauuacuaaaagcuauauuagguuuaaaagcuaaauuuaacuuaauaacagggauagagguagaagacguaaaagcauggacacuguccuucaacgcagaagauuucgacgcaaaacuaucggaucuuaauauagcagacaacgaugaugcaguacaaauuauugaaauccugagagccuuguauagcggaguauuguuaaccggcauagugccagaaggacaaaguauaucacaggcaaugauagacaaauaugaagcacauaaagcacaccucauaaugcuacgaagcauacgagaacaacuaucagacaaagaaaauaaggccuuagaaaaagcguaugaugauuauauugaucaucccgaagauaagcaacacggcucacgagaagauuucuaugccgccaucacaaaaguacuaaagaaagacucagaagacacaaacauuauugaaauuuuaaaauuaaucgaacuagaucaauuuaugcccaaacaaagaacaaaagauaacggggcaauaccccaucaguuacaccaacaagaacuagaccaaauaauagaaaaucaaaaacaauacuacccaugguuagcagacauaaauccgaacgaacaacggcagaaaauggccccauacaaauuagacgagcuaguaaccuuccgaguuccuuacuacguaggaccgaugauaacagcagaggaacaauuucaaacuuccaacaagaaauuugcauggaugaucaggaaagagccuggggcuauaacuccuuggaauuucgaucaaaaagucgaccgucaagcauccgcgaaugaauuuauaaaaagaaugaccacuacagacacauaucuacuagcagaagauguacuccccaaacagucucuccuuuaccagcgauuugaagugcucaacgaacuaaauggaauaaaaauagacgaucaacccauaaccguagaacaaaaacaagccauauucaacgauaaauuuaugcaacaagcccauguaacagucaaaaauauucaggcauaccuuguaucagaaggucaauaugcaucuagacccaacauaacuggauugucugauggugagaaauuuaauucuucccuaucuaccuaccaugaucuuaagaaaauauucggagacaugauagacgacccaaauaaacaaacagauuuugagaaaaugaucgaauggucaacaaucuucgaagauggaaaaauauucgcugacaagcuacgcgaaauaaacugguuaacugacgaacaacggcaaagauuaaguaauaaaagguaccgcgguuggggacaacuaucaacgaaacucuuaacaaaaauuguggaucaaaauggucaaagaauuauagauauauuauggaacaccaaugauaacuucaugcguauaauccacagugaugacuucgaccaagcagugacccaagcaaaucaaaugcuccucgcggacaaugauacacaagaugucauaaacgaacuuuauacaucaccuaguaacaagaaagcacucagacaaauccuacugguagucgcugauauacaaaaagccaugaaagggcaagcaccggcaagaauacucauagaauuugccagagaaaaacaagcaaauccgagauuaucuacccaaaggagacgacaagucgaacaaguauaucaagaauuaaacaacgaccaacuaaacaaagaauuagcugacccacaauacgcuaaucuaucaaaagacagauuauuccuauacuuuaugcaaggaggaagagauauguacacgggagaaucacuuaauauugaccgucuuagugaauaugauauagaccauauacuaccacaagcauucauaaaagauaauagucuagauaacaggguccucguuagcgcgaaaaugaacaggucaaaaagugaucauguuccauuagacuucacugaagaaagauuuggucagaaaaugcgaagccaaugggaacaaaugcuuagagccggucuacuaacccguaggaaauacaauaaccucacacuaaauccagauagucuaaacaaauauacaaugucaggcuuuauaaacagacaauuaguugaaacccggcaagugauaaaguuagcaaccaaucuauuaguagaccaauacgcagacgaagauguucaacucgucacgguaaaaucggggcuaacacaccaaaugcgggaagacuuugacuuuccuaaaaauaggaaccuaaauaauuaccaccaugcauucgaugcauaucuaacagcuuucguugguuuauauuuacuuaagaaauacccaaaacuagcgcacuauuucguauauggacaauaccaacaaggauuuaaagcaaaugaccaauggcgcaacuuuaauuuccuaaacggauugagacaagagcaacaaguggaugcggaaacuggcgaacuuauauggcaaaaagaucaugacuuagcuuacaugaacaaaauauaugauuucaagaaaauauuaguuacaagagaaguacacaccaaccauggcgcuuuauauaaccaaacucucuacaaagcuaaagacgauaaagccucaggccaaggcggccgacaacugauagcugcaaaagaaaauagaccaacugcaauuuacgguggcuacucaggaaaaacuguugcauacauguguuuaguaagaauaacggaaaagaaaggagauuuuuauagaauauguggcgugcaaacugcauggguagaugaacuagaacacauagaagacgcaacaauaaaauuacaaaggcuaacagcccuccuaacgccacaauucucagcuaccaagaaacaaaaagacgaaguuguaacaguaguaaaaccauucgaaguauuacuaccaaaaauauuaauaaaccaaagguucuaugauggaggacaagagcuaacguuagcuuccgcaacauacaaaaauaacgcacaagaauuaguauuagacaagaaagcaguacaaguuuuaaauggacaacuaccaaaagcugaauuagaagcucaagccacaguaguuuaugaucaaauucucgaacgaguucagaaauauuucccgcuuuaugauaugaacucauuucgcgaaaaauuauuuguugggcgagacaaauuuaaugaauuacccuggcaagaccaaugggaaaaucacaaacucauacaaguaggacagaaaacaauucuugauaggauacuaauaggucuccaugcaaacgccgcaaugggagauuuaaaagcccuaaacaugagcacaccauuuggaaaacuacaaaaauccaacggaauaucgcuaagcccagaaacgcaaauaaucuaucaaucaccaaccggauuguuugaacgacgagucgcuuuaaaagacuuauga

SEQ ID NO: 8884 - RNA, 4095 nt, Artificial Sequence
  Cas9 variant
augaaaaaccucaaagaauauuauauaggguuagacauaggaacagcaucagucggcugggcaguaacugacgagagcuacaacauaccgaaguuuaauggaaaaaaaauguggggagucagacuuuuugacgacgcaaaaacagcugaagaaagaagaacacaacguggaaguagacgucgacuaaacagaaggaaagaacggauaaauuuacuacaagauuuauuugccacagaaauaaguaaaguagacccaaauuucuuccugagauuagacaauagcgaccucuaucgagaagacaaggacgaaaaacugaaaaguaaguauaccuuauuuaacgauaaagacuucaaagaccgugacuaccacaaaaaauacccuacuauacaccaccugauaauggauuuaaucgaggacgaagguaaaaaagacauacgauuacuauacuuagcaugccauuacuuguuaaaaaacagggggcacuuuaucuuugaaggacaaaaauucgacacuaaaaacuccuuugauaaaaguaucaaugauuugaaaauacaccugcgagaugaauacaauaucgauuuagaauuuaauaacgaagacuuaauagaaauuauaaccgauacaacccuaaauaaaacaaauaaaaaaaaagaacugaaaaauaucgucggagauaccaaauuucuaaaagcaauaagugcaauaaugauagggucaagucaaaaacuaguugauuuguuugaagauggcgaauuugaggaaacaaccguaaaaucaguggacuuuucaacaacggcauuugaugauaaguauucggaauaugaggaagccuuaggagauacaauuagucuccuaaacaucuuaaaaucgauauacgauucaagcauacucgaaaaucuacugaaagacgcagauaaaucaaaagacggaaauaaguacauaaguaaagccuucguaaaaaaauuuaauaaacacggaaaagacuuaaaaacacuaaaacguauaauaaaaaaauaccuaccaucugaauacgcaaacauuuuccgaaauaaauccauaaaugauaauuacguugccuacacgaaaucaaacaucacgagcaauaagagaacgaaagccaguaaauucaccaagcaagaagacuuuuacaaauucauaaagaaacacuuagauacaaucaaagaaacgaagcuuaacucaucagaaaacgaggaucuaaaacuaaucgacgaaaugcucacagacauagaauucaaaacauuuauaccaaaauuaaagagcuccgauaacggaguaaucccauaccaacuuaaauuaauggaacuaaaaaaaauacuagauaaccagaguaaauacuaugauuuccuaaaugaauccgaugaauacggaacaguuaaagacaaaguagagucgauaauggaguuccgaauaccauauuacguagggccacuaaauccugacagcaaauacgccuggaucaaaagggaaaacacaaaaauaacuccauggaacuucaaagauauaguagaccuagauaguagcagagaagaguucauagacagacucauaggaagaugcacauaccuaaaagaagaaaaagucuuaccgaaagccucgcuaauauauaacgaauucaugguccucaaugaacuaaacaaccuaaaacuaaaugaauuuuuaauaacagaagaaaugaaaaaagccaucuucgaagaacuuuucaaaacaaaaaaaaaaguaacacuaaaagcaguaaguaauuugcuaaaaaaagaauuuaaucuaacaggggacauauuacucaguggcacagacggcgacuucaaacaaggauuaaacucuuacauagacuuuaagaauauaaucggagacaaaguagaucgcgacgacuacagaaucaaaauagaagaaauuauaaaacuaauaguacucuaugaggaugauaagacauaccuaaaaaaaaaaauaaaaucagccuacaaaaacgacuuuacagacgacgaaauaaaaaaaauagcagcgcuuaauuauaaagauuggggcaggcuaucaaaacgcuuccuaacgggaauagaaggcguagauaaaaccacaggagagaaagguucaauaauauacuucaugcgagaauacaaucuuaacuuaauggaauuaaugucuggacauuacaccuucacugaagaagucgaaaaacuaaaccccguugaaaauagagaauuaugcuacgaaaugguagacgaauuguacuugucacccucgguaaaaaggaugcuauggcagagccuaaggguaguggacgaaauuaaacguauaauaggaaaggauccuaaaaaaauauucauagaaauggcccgcgcgaaagaagccaaaaauucccgcaaagagucaagaaagaauaaguuacuagaguuuuacaaguuuggaaaaaaagcauucauuaaugaaauaggggaagaaagauacaacuaucugcuaaacgaaauaaacagcgaagaggaaucaaaauuuagaugggauaaccuauaccuauacuauacacaauuagguagaugcauguacucacuagaaccaauagaccuagcugacuuaaaaucaaauaauauuuacgaucaagaucacauuuaucccaaaaguaaaaucuacgacgacagccuugaaaaucgaguacuaguaaaaaaaaaccuuaaccacgaaaaagguaaccaguacccuauaccagaaaaaguauugaauaagaacgccuauggauucuggaaaauauuauucgauaaaggacuaauaggacaaaaaaaauacacaagguuaacacgacggacaccauuugaagaaagagaacuagcggaauucauagaacgacaaauuguugaaacccgccaagcuacuaaagaaacagcaaaccuauuaaaaaacauaugucaagacagcgaaauaguauauucaaaagcagaaaacgcuagcagauuccgacaagaauucgauauaauaaaaugcagaacaguaaaugauuugcaccauaugcacgacgccuauuuaaacauaguaguuggaaauguguauaauacgaaauuuaccaaaaauccacuaaacuuuauuaaagauaaagacaacguucgaucguacaacuuagaaaacauguucaaauacgacguaguucgcggaucauacacagcauggauagcagacgacagugaaggaaauguaaaggcugccacaauuaaaaaggucaaacgagaauuagaaggcaaaaauuacagauucaccagaaugagcuacauaggcaccggaggucuuuaugaucaaaaccuaaugcggaaaggaaaagggcaaaucccacagaaagagaauacuaacaaguccaacauagaaaaauacggaggauauaacaaggcuagcuccgcuuacuucgcacuaauagaaucagacggaaaagccgguagagaaagaacacuagaaacaauaccaauaaugguauauaaccaggaaaaauacggaaacacagaagcaguagauaaguaucuaaaagacaaccuggagcuacaagauccaaaaaucuuaaaagauaaaauaaaaauaaauaguuuaauaaaacuagacggcuucuuauauaacauuaaaggaaagacaggagauagccuuucaauagcaggaagcguacaacuaauaguuaauaaagaggaacaaaaguuaaucaaaaaaauggauaaguuucuaguaaaaaaaaaggacaauaaagacauaaaagucacuagcuuugauaacauaaaagaagaagaacuaauaaaguuguacaaaacacucagcgauaaauuaaauaauggcauauacucaaacaaacgaaacaaccaagcaaaaaacauauccgaagcccuggacaaauucaaagaaauuucaauagaggaaaagauugauguacuaaaccaaauuauauuacucuuucaaagcuauaauaauggguguaauuuaaaaaguauagguuuaagcgcaaaaacuggagucguauucauaccaaaaaaacucaauuacaaagaaugcaaauuaaucaaucaaucaauaacaggacuauuugagaaugaaguagaucuccuaaaccucuga

SEQ ID NO: 8885 - RNA, 4098 nt, Artificial Sequence
  Cas9 variant
auguauaagaaagacuacacaguggggcuagacaucggcucaaccagcguaggauuugccgccaucgaugacgauuaccaaccuauacguuugaaaggaaaaaggguaauaggggugagacuguucgaagaagggaaaaccgccgcagaaagaagaaacuuccgaaccacaagaagacgguuaaacagaaggaaauggagacuguccuuacuagaagagauuuucgaccccuacauggcaaaaguagacccaacauucuucgccagacucaaacaaucuaauuuauucccaaaagacaaaaacaagaaauucacaggaucccuacuauucccaaaaacuacagauucgaaauucuacgacgaauacccuacaauuuaucaucugagauaucaucuuaugaaugauagccgaaaauucgaucuccgugaaauauuccucgcaauacaucacaucguaaaauacagagguaacuuccuaaauucagcccccauagcguccuucaguacagacaaaaucaacuuaguugacgacuuugaaacuguuaacgcagcauaucuccaaaucaacuccucaaacccaguacaacuagauacagaccaagcagaucaaguaucccguauucuacuagacaauaaauuaucuaacuuagacaaacaaaaacaagcagcuaaagcacuugcacagaaaaguggcgacaagaaacaagauaaaauaaacaacacaaccauuaaacaaaucugcaaagcucuacuagguuauaaauucgaccuagcagucguacuuaacauagauucugacgaccacaauaaauggaaacuacaacuaucagacgaaaacauugacucccgauuagcagaguugacaggcgaacuaaaugaagcucaacuugauauccuaaacguccugucacgauuauacagucaaauaacccuaaacgauauaguccccucagguaugacacuaucagaggcaaugauagaaaaauauaaagcucacaagaaacaccuaaaaaugcucaaagauuuugcaagauccuuaucaaagaaagauuaugggcaaguaauggaagcauaugcggaauacaucggaaacauaccagaaagugcuaguagcaaagcacaaaagaaaaucagccaggaugauuucuauaagaaaaucaaaagauaucuagaugacagcaaacuaggccagaaaaucgccgaauuaauagcuaaaaaugaguucaugccuaaacaacgcacaaaccaaaacgggguuauaccuuaucaacuacauuugaaagaacugaaccaaauaaucgaaaaccaaagcaaauauuaccccuggcuggcggaauuaaacccuaacgagaaaagacgaggcaaagcuaaauauaaacuaucagagcuaguagccuuccgcauaccauacuacguaggcccucuaauaacccaagaagaacaacagaaaacauccaacgcaaauuucgcauggaugauacgaaaauccgaaggaagaauuaccccuuggaacuuugaugaaaaaguagauagaaucgcuacagcaaaucguuucauaaaacgaaugacaacaaaagacacauacuuaaucggcgaagauguccuaccagcccacucacuacuauacgaaagauuuaaaguccucaacgaacugaacaugauacgcgucaauaaccauagacuaucaguaggucaaaaacaagaugucuucgaaaaacuguuucaaaaacauaaaaccguaaaaaccagagaacuaaucaaacaauugauggccucaggcuuaccuacacaaccacgaauaacuggacuaucagauccagcuaaauuuaacacaucauuagguacauauaacaacuucgccaaaauccuaggagacgaaauaaaucaaccggacagacaagaagauuucgagaaaauuaucgaauggauuacuauauucgacgauaaagacauauuaaaaacgaaacuuucagaacucaguuggcuagaugaaaaacaaauuaacgcgcuuauaaauaaaaacuacaguggaugggguaggcuguccagaaaauuauuaaccgaacuuacaaacaagaaaggccaaucuaucaucgaucgaauguggaacacacagaaaaguuuuauagaaauaauuaacgaaccaguauucgcugaacaaauaaaagacgccaaucaagaccaacucgacgaagaugacuacgaaacaguucuccaugacgcuuauacaucuccacaaaauaagaaagccauaagacaaguaauaaaaguaguugacgacauaguacgagcagcuggccgagcaccaaaauuuauaagucuagaguucgcuagagaagaucaagaaucaaggcguacacaaagcaggcuaucgagaauaaagaaaauauacgaaacaacaaccaaagaauuagucgccaacgaucaaaucagagaagaauuaggaaauguaaaagaucuaaacgaucgauuauuuuuauauuuuacacaacuaggccgcgaugcuuacacgggugaaagaauaaauauugaugacauaagcacgaaauacgacauugaucacauauucccuagagcauuuauaaaagacgauucuuuagauaacaaaguccuaguaaaacgagcaguaaauaacgggaaaucaaauaacguuccauuaaaacucuuuggagcgaaaaugaaaccaaucuggaaaauguggaaagaccaucaauuaauuucaaaacgaaaauaugaacaucucaugaccaacccagaugcgauagauaaauauaaagcaaaugguuucauuaacagacaacuaauagaaacacgccaaaucauaaaacuugcagcaaacauacuugcaaaccgcuauucaacagaagacacaaaaauaauagaaguuaaagcgaaucucaaccaucaacuccgacaaucauuacaccuauauaaaaaccgacaaguaaaugauuaccaucacgcaguagauggauacuuaagugcuuucgugggccaauaucuauaccauagauacccaucacuacaaucuuauuucgucuacggucaguaucagcgauuuuucgauaaacaaguacaggaaaacaugaaauuuaauagguuuaacuuuuuauaugacuuaacagauagagacaaugaccaaauuguuguaaaaucgacaggggaaauagugggagaaaaauccaaacuaauugaacaaauaaaauggguuuaccgcuacaaauuuaugcucgucagccaagaaguauucacaaagacagguccuuuauucgaccaaacaauauaccccgcuggaagcaauaaaucgagacugaucccaaucaagaaagaccguccaacagacaucuacggugguuacagcucaagcacggaugcauauaugagccuaauaagaguuccugacaagaaagaagauaaauauaaaguagugggcguaccuucaagaucccuagcaagucuaaauagagcggaaaaacgcggccacgacgcauaucuugaccaacucagacaagucauagcgaaaagccagaagaaagaguuccaaauaauaaucccaaaacuacgauauaggcagcucaucauagauggaggacuuaaauauacacuaggauccuccgccuaccaauauaacgcgagacaauuaguacuaagcgaaaaaucaauggaaguuuuaguuaccgauuucagcaaagugacuacagaucuugacaaacagaaccaaaaacuaauagccguguaugaugacauuuuagacaaaguaaacagaugccucccacucuacgauaaaaaucaauucagaaaagcauuaaacggcgcuagagacaaauucguccaacuuccaauacuuccuaaauuuaacggcaauaagaaagaagaagcaggaaaaguagaaauccuaaacgaaauacuacuaggacuacacgaugaugcaucaacaggcaaccuaaaaccucucggaauaaaaacucccuuuggcaugcuacaaacucaaagcgguauaacaauguccuccaacgcuguaauagucaaccaaucuccuacuggcuuauucgaacauagaauauauuugaaagcucuacugaauaaacucaauaaauga

SEQ ID NO: 8886 - RNA, 4098 nt, Artificial Sequence
  Cas9 variant
augacaaaauugaaccaaccauacggaauuggacucgauauaggaaguaauaguauaggguucgccguaguagacgcaaauucacaucugcuacgacuuaaaggcgaaacagcaauaggagcaagacucuucagagaaggccaaucagcagcagaucgcagaggcucacgaacuacaagacgcagauuaucgcgaacaagauggagacugucuuuccuaagggacuucuucgcuccacacauaacgaaaauagacccagacuucuuccuaagacaaaaauauagugaaaucucaccgaaagauaaagacagauucaaauaugaaaaacgauuauucaaugauagaacggacgccgaguucuacgaagauuauccauccauguaccaucucagauuacaccuaaugacacauacacacaaagcugauccccgagaaaucuuccucgcuauacaucacauacuuaaaucucgaggacacuuuuugacuccuggugcugcgaaagauuuuaauacggacaaaguagaccuagaagauauauucccggcucucaccgaagcauaugcacaaguuuacccggaccuagaacuaaccuucgaccucgcaaaagcggacgauuuuaaagccaaauuacucgacgaacaagcaacaccauccgacacgcaaaaagcccuagucaaacuccugcucucaucugacggugaaaaagaaauaguaaagaaaagaaaacaaguauuaacagaguucgcaaaagcaauaacaggauuaaaaacgaaauucaauuuagcauuaggaacggaaguugaugaagcagacgcaaguaauuggcaauucucaaugggacaacucgaugauaaguggagcaauauagaaacguccaugacagaccaaggaacggaaauauucgaacaaauacaggaauuauacagagcaagauuacucaauggaauaguaccggcaggcaugucuuugucacaagcaaaaguagcggauuacggucaacauaaagaagauuuagaacuuuucaaaacauaccuaaagaaauugaacgaccaugaauuggcuaaaaccauaagaggccucuaugaucgauauauaaauggagacgaugcaaaaccauuccucagagaagauuuugucaaagcauuaacaaaagaaguaacugcucauccaaacgaaguguccgaacaauugcuaaauaggaugggacaagcaaacuucaugcuuaaacaaagaaccaaagcuaauggugcaauaccaguacaauugcaacaaagagaauuagaucaaauaauagcgaaccaaucuaaauacuaugacuggcuggcaaaaccgaacccgguagaaaaacauagggcaagcaaaccauaccaauuagaugaauuauuaacauuccguauacccuauuauguaggaccguuaaucacuccgaaacaacaagcagagaguggugaaaacguguuugccuggaugguaaggaaaaacccaagcggaaacauaacuccauacaacuuugacgaaaaaguagaucgagaagcaucggcaaacacguucauacaaagaaugaaaacuacagauacauauuugaucgaugaagacguacuccccaaacaaucccuauuauaucaaaaauacgaaguacuuaacgaacuaaauaauguacggauaaauaaugaagccuuaagcaccgaccaaaaacaacgacuaauacaugaagucuuugaaagacauagcaguguaaccaucaaacaaguuguagauaaucuuguagcacauggagacuucgcacaacguccagaaauaagaggacucgcugacgaaaaacgcuuccuauccucacuuucaacuuaccaucagcuaaaagaaaucuugcauggagcuauugaugacucaacaaagcuacacgacauagaaaacauaauaacauggucaaccguauuugaagaugcggccauauuuaaaacuaaacuugcagaaauugauuggcuugauccagcaaccauaaagaaauugagcaacauacgauaucggggauggggacaauucucacgaaaauuauuagacggauuaaaauuaggaaauggccauacugucauacaagaacuaauguuaagcaaccacaaucuaaugcagauacuagcugaugaaacauuaaaagaaacgaugacugaauuaaaccaagacaaauuaaaaacagacgacauagaagauguaauuaacgacgcuuauacaucacccagcaacaagaaagcauuacgccaaguacuacgaguggucgaagauauuaaacaugcagccaaugggcaagacccaagcuggcucuauauagaaacggcagacgggacgggaacagcaggaaaaagaacucaaucacgccaaaaacaaauccaaacgguuuaugcgaacgcagcgcaagaacucauugacagugcaguaagaggggaacucgaagacaaaaucgcggauaaagcaucuuuuacggauaggcuagucuuauauuuuaugcaagggggaagagacauuuauacgggugcaccucucaacauagaccagcuaucacacuaugacaucgaccacauccuaccacaaagccuuaucaaagaugauucacuagauaacagaguauuagucaaugccacuauaaaucgagagaaaaacaacguuuucgcuuccacauuauucgcgagcaaaauggcagcaacauggcgaaaauggcacgaagcuggauuaaucaguggaagaaaacuaagaaaucuaaugcuacgacccgacgaaacagacaaauuugcgcauggauucguagcaagacagcuuguagaaacaagacaaauuaucaaacuaacagaacaaauugcagccgcccaauauccaaacacuaaaauuaucgcgguaaaagcgggcuuaucccaccaacuaagagaagaacuagacuucccuaaaaaucgagauguaaaucacuaucaucaugcauuugaugcauuucuagcagcaagaauaggaacuuaccuccugaaaagauacccaaaacuagcgccauuuuucaccuacggugaauuugcaaaaguggauguaaagaaauuuagggaauuuaacuuuauaggggcacuuacacaugcgaagaaaaauaucauugcaaaagacacaggagaaauaguaugggauaaagagagggacauucaagaauuagaccggaucuacaauuuuaaaagaauguugauaacucaugaaguucacuuugagacagccgacuuauuugaucagacaauauaugcagcaaaagauaguaaagagagaggaggaagaaugucacucauacccaagaaacuuggauacuuaacgggaauauacggcggauaucaaacagaaagaggaucauauguaucuaucauaagaacauuuaagaaaggagaaaccauauacaaaguaguaaauauacucaccgccgacguaucacucuugagcgaaaaagaaaaaguaaguaaaacgcuggcagacaucuauuuaaaagaacucaucgcaaagaaauuaucaaaaggaaaaucaggcaaaaacauagccagugaaccuuuugaaaucguacuaccgcgaguuggaaaagauucauuauuuaaaaacaagaaauauggacucuucuuaauagaaucagcuacugaacuacauaauuaccaagaacuauggcuaccaagaaaugaucaacuacuaauaaaacgaauacaggcaagacaaauagaggaaaguaaagcagacuacgagcuaacacgaauguacagaaauauagcauggcaaguggaucacuacuuccgacuauacaaaaucagaaaauuugcagaaaaauuacaagcaucuguugaagauuucgcaggauuaccaguguacaaaaaugagacaagugacggaaaaguugaaguucucgcaagcguacuuaaacgauuaaauggagcagcugauaaaggaagaacaaacccaacaacagucaaauuacaaucagacuuuggaagaacuuuguuaacuaacgggauaguacucgaagaugacaguucgauaguguaucaauccccaaccggacucuucaaaaggaguguaaaacucgucgaucuauga

SEQ ID NO: 8887 - RNA, 4098 nt, Artificial Sequence
  Cas9 variant
augaccaaagaauauuacuuaggauuagauguaggaacaaacuccguaggaugggccguaacggacucacaauacaaccuauguaaguucaagaaaaaggauauguggggaaucagacuauuugagucagcaaauaccgccaaagacagaaggcuccagagaggcaacagaagacgacuagaaagaaaaaaacagagaauagauuuacuccaagaaauuuucagcccagagauauguaagaucgacccuacguuuuuuauccgucuaaacgaaaguagacuccauuuggaagauaaaucaaaugacuucaaguacccauuauuuauagaaaaagauuacucagacauagaauacuauaaagaauuccccaccauauuccauuuaaggaaacaccuaaucgaaagcgaggaaaaacaagacauacgacuaauauacuuagcacuucauaauaucauuaagacccgcggccauuucuuaauagauggagaccugcaauccgcuaaacagcuccgaccaauacucgauacuuuccuacuaagcuuacaagaagagcaaaacuuaagcguauccuugagcgaaaaccaaaaagacgaauacgaggaaauauugaagaaucguucaauagcaaaaucagaaaaaguaaagaaacuaaaaaauuuauucgagaucuccgacgaauuagaaaaagaagaaaaaaaagcacaaagugccguaauagaaaauuucugcaaauucauaguaggaaauaaaggggacgugugcaaauuucuuagagucaguaaagaggagcuagaaauagacucauucagcuucucagaaggaaaauacgaagaugauauaguuaaaaaucuagaagaaaaaguaccggaaaagguauauuuauuugaacaaaugaaagccauguacgacuggaauauauugguagacauauuagaaacagaagaauauauauccuuugcaaaaguaaaacaauaugaaaaacacaaaacaaaccuaagguuauugcgagauauaauauuaaaauacuguacuaaagaugaauauaacagaauguucaaugacgaaaaagaagcuggcagcuacacugcguauguaggaaaacuaaaaaaaaacaauaaaaaauacuggauugaaaagaaaagaaacccagaagaauuuuauaaaagucucggaaaacuuuuagacaaaauagaaccccugaaagaagaucuagaaguauuaacaaugaugauagaagaaugcaaaaaccauacacuucuuccaauucaaaaaaauaaagacaacggugucauaccacaccaggugcacgaaguggaacuuaaaaaaauacuagaaaaugccaaaaaauacuauaguuuuuuaaccgaaacagauaaagacggauauucaguaguacaaaaaauagaaucaauuuuucgauuuagaauaccauauuacguagguccccuauccacuagacaucaagagaaagguaguaauguauggauggugcgcaaaccaggcagggaagauagaauauaucccuggaacauggaagaaaucauagacuuugaaaaauccaacgaaaauuucaucacaaggaugacuaacaaauguacuuacuugauaggcgaagauguauuacccaaacacucacuacuauacagcaaauacaugguccuaaacgaacuuaacaacguaaaaguaagagggaaaaaauuaccgacaagccuaaaacaaaaaguguuugaagauuuauuugaaaacaaaagcaaaguuaccgguaaaaauuuacuagaauacuuacaaauucaagauaaagacauucaaauagacgacuuauccgguuucgauaaggauuucaaaacaagcuuaaagagcuaucucgacuucaaaaaacaaauauuuggagaggaaauagaaaaggaaucaauccagaauaugauagaagacauuauaaaguggauaacaauauacgggaacgauaaagaaaugcuaaaaagaguuauucgagcaaauuauaguaaccaacugacugaagaacaaaugaaaaaaauaacagguuuccaauacucaggauggggaaacuucucgaagauguuccuaaaagguauuucaggaagugacguuucaacuggagaaacauuugacauaaucacagcaaugugggaaaccgauaauaaucugaugcaaauauuaaguaaaaaauuuacguucauggacaaugucgaagacuucaacucagguaaagugggaaaaaucgacaaaauaaccuacgauucaacaguaaaagagauguucuugaguccagaaaauaaacgugccgucuggcaaacaauucaaguugcggaagaaauuaagaaaguaaugggcugcgaaccaaaaaaaauauuuauagagauggccaggggcggcgaaaaaguaaaaaaacgaacuaaaagcagaaaagcacaacuacucgaacuauaugcugcaugugaggaagauuguagggaacuaauaaaagagauagaagacagagaugaaagagacuuuaauaguaugaaacucuuccuauacuacacucaauucggaaaauguauguacaguggcgacgacauugacauaaaugaauuaauaagagguaauagcaaaugggauagagaucacauauauccgcaauccaaaauuaaagacgacucaauugacaaccuaguacuaguuaauaagacguacaacgcuaaaaaauccaacgaacuacuaucagaagauauacaaaaaaaaaugcauaguuuuugguuaucacuacucaauaaaaaacuaauaacuaagucaaaauaugacagacuaacaagaaaaggcgauuucacagacgaagaacugagcggguuuauagcaaggcaacuaguugaaacaagacaauccacaaaggcaauugcagacauuuucaaacaaauauacaguagcgaagucguauauguuaagaguucacuuguauccgauuuucgaaaaaaaccccuaaacuacuugaaaucgaggagaguaaacgacuaccaccacgcaaaggacgccuauuuaaauauuguuguaggaaacgucuacaacaaaaaauuuacuucaaacccaauacaguggaugaaaaaaaauagagacacaaauuacagucuaaacaaaguauucgagcacgacguaguuauaaacggagaaguaauaugggaaaaauguaccuaucaugaagacacaaauacauacgauggcgguacacuugauagaauaaggaaaauaguagaaagggacaacauacuauacaccgaauacgccuauugcgaaaaaggcgaacuauuuaacgcaacuauucagaauaaaaacggaaacucuacagucagcuugaaaaaaggucuagacgugaaaaaauauggcggauacuuuagcgcaaauacaucauauuucagucuaaucgaauucgaagauaagaaaggcgaucgugccagacacauaaucggcguuccaauauacauagcaaauauguuagaacauucacccagugccuucuuagaguacugcgaacaaaaaggauaucaaaauguacgcauucuaguugaaaaaaucaagaagaauagcuuacugauaauaaauggguacccauuacgaauaagaggagaaaaugagguagacaccucauucaaaagagcaauacaacuaaaguuagaccaaaaaaacuacgaacuagugagaaacauagaaaaauuccucgaaaaauacguugaaaaaaaaggcaacuaucccauagacgagaaucgugaccauauaacacacgagaaaaugaaucaguuauaugaaguacuacuaucaaaaaugaaaaaauuuaauaaaaaaggaauggcggauccuagugauagaauagaaaaaucaaaaccgaaauucauaaaacuugaagacuuaauagacaaaauaaauguaauaaauaaaaugcuaaaccuacuacgaugugauaacgauacaaaagcggacuuaagccuuauagaacuaccaaaaaacgcaggcucuuucguagugaaaaaaaauacgauaggaaaauccaaaauaauuuuaguaaaccaaaguguaaccggacucuaugaaaauagacgugaacuguga

SEQ ID NO: 8888 - RNA, 4098 nt, Artificial Sequence
  Cas9 variant
auggacacagccaaaacuaacaaacaaccauacuauauugguuuagacaugggaacgagcaguguugguugggcaguaaccgaugcaagcuacaauguagucaaaaaacacggcaaagcauuauggggaguaaggcuauuugaagaagcucaaaccgcagcugaccgucgacuccaucguaccgcgagaaggagaauucaaaggagaaaacaaaggcuggcauuauuacaagaauuauucgcaaaagaaauaugcaaaguagauccgggcuuuuuuauacgguuacacgaaucaagauuauggcaagaagauaaaucgauugaucaaccaaauacccuuuuuaacgaugaagauuuugacgacaaagcauaccacaaagcauaucccacaauuuaccaccuaagauaugccuuaaugaccgaaaauaaaagcuucgauguaagacuaguauacuuagcgauucaccacauuaucaaacacagaggucacuuucuauuagaaaauuacgaucuauccaaucaagaaacuucaggauuugaugaaaguuacaucgcauugacuaacgcuauaaaggaacuacugcaaaaagagaucccuguaggucacguggaaaagauacaaauaauauuaaaagauaagucacucucaaaacgagaaaagacagaaaaaauauuacaaguuugggacguaauaaaagacaaacaacuaaaagaaguuguucaacuaauaugcggugggacagcaaaccuaagcacacucuucauggaugagagccuaaaagaggcauuaaaaguauuugaaauaaaggauucaaaaauuucuuuuucuacagccguuuaugaagaaaaggaaagcgacuugcaaaguguucuagaacaacguuuugacuugguauacgcugccaagaugcuuuacgauuggucacuacuugcugaacuaaugggggaccguaaaacacuuagugaggcaaaaauugccaucuaugaaacacauaagaaagaucuagaaguccuaaaacgccuaacacgacaagauaaaagccucuacagaaaacuauuccgcgggaccgauaaagauucuuauucggccuauguuggaucauguaugauucauggagaaaaacugguuaucgaaaaaagaggaagcacagaagaauuuuacaaauuucuaaaaaaagaaauaucaaaacuaccagacugcgaagauaagauauacguauuguccaaaauagaagcagaaaacuucuuaccgaaggcugucagcacaauaaauggaaucaucccuuaucaguugcaagaacaggaacuugacauaauauuaaaaaaagcagaacaguacuuacccuuccucauggaaaaagacgcuuacggaacgauaagcgagaaaauuaaacaacuacuaacauuccgaauaccuuuuuauguaggaccacucaauagacacucagauaaaucaugggcaguacauacugauaaagaaggaagaauacucccauggaauuuuaaugaacguauaaacgaggaaaaaucagccgaaaaauucauuacaagaaugaccaauaaaugcacauaucuauuggguaaggauguauuaccaaaaaacagccuacuauacaccgaauauauguuguuuaaugaauugaacaauguaaaaauaggcaaggcaggaacauaccucaccgaagaacaaaaagaaaaacuuuggaaagaacuauucuuaacaacgaaaaagguuacuuuaucuaaauuuucuaaauucuuaauaaaagaaggaauagacaaagaagaagcaguugaaauaaaaggauuagauggaggguucaagaguucauuagcaccauggauagacuuaaaaaauauacuaggugaagauuucacaagagauaaagcagaagaaauuauaaaagcuauaacgcuauuuagcauggacaaaaaaaucuuaaaaaaauacuuaaugagaauuguaagcgaaccaguagcaaaacaauuaucaaaauuacgauauacaggcuggggaagauucucuaaagaauuccuaacugaaaucacacccagaguaacagaugauguacaaguauugguagauaccucaacaggugaaaucaugaauauaaucacagcccucaaaaaaaccucauuaaaccuaauggaaauauuaagcuccacuuauggguacucagcagcaauuagcgaagcaaacaaagaacuagucggaaauacagugcucucuuaugaaacugugaaagaauuaacaguaagcccagcugugaaacgacccauuuggcaaacauuaaaaauuauaaaagaaaucacccauaucaugggcgcagagccagcaagaauauucauagaaauggcgcgagauaaacaaccagacaaaggacggacggacucccgcaaaaaacaacuaauagaacuguacaaaaagugcaaggaagauguacguucauggagcaacagagaaucuaaggauuggguagaagaaauagaaucaaaaucagauagccaacucaggaguaacaaacuauuucucuacuacacucaaaugggaaaaugcauguacacaggaaaaccgauugaccugggagcacuccuuaaaggucaacuauacgacagagaccauauuuacccccaaucacaaacaaaagacgacagucuugacaaucuagucauaguagauaaucgagaaaaccgagauaaaucaaacaccuacccccuaucaaaaaacauaagagaacgacaaauuggguucuggaaacuacuaagagauaaaggauucaucucgaaagagaaauacuucagauuaacaagaaauacaccguuuucagaugcagaaaaagccgaauucaucgcccgucaacuaguggaaacacgacaaagcacaaaagcaguggcagaaauauugaaaagaguauuaccuaaaucaauaauaguauauguaaaagccggucuaacuuccagauuuagacaauacggagaauuuauaaaaguaagggaccugaaugacuaucaccacgcaaaagaugccuaucuaaacaucgucacagggaauguucauuacaccaaguucacaagcaauccaauacgauucguuaaagauugccaaauauauucacugaacgaacacgcgcuguauaaauacaccguagaacgcaauggagucguggcaugggcacccaacgaagaagguaugaugccuucagucacaagauggaugaauaagaacaauauacuggucacgagaaugaguuaugugggccaaggagaacuauucgaucaauuaccucucaagaaaggcaaaggucaagugucauuaaaaaaagaaggagccaucagugauaucucaaaauauggcggcuacaacucagcuaguacugcauauuucauguauguggaaggcgaagauaacaaaggaaaaccgguuuauguuaucgaaacaaugccauuacaucuugcagcucgccuuaccacuuuagaagaaaaacaaaaauacugugaagaacuuuggaugagcacaggcggaaaguuaaaaaauccaaaaguauuaauagaacaaaucccaauccaaucauuauuuucaguagauggauucagaguaaccaucgcuggaaaaacagguaaacaauauggaugcagacuagcagaagaacuuguuuuaaacaacggcuacgcaaugacauuaaaggcugugcuuaaauucguaaaccgaagaaaaaugaauaaggaggcacuaauuacaucuuacgaucaucuagaagaaagucagcuauuagccuuauacgaugucuucuuagauaaauuagaacacucaugcuucaguaaaagauucaguacgcagagagauguucuaaaaaauggaagagaaucauacauagcauuaagucuagaagauaaaugccaaauccuaagugaaauacuucauuuguuccaauguaacgcuacuuuaagcaauuuaucacuucuaggaucuaguaaacaaucgggaagacuguacaugucaaaaaauuuaucagacaaagacucuugguacauaauucaucaaucagucacuggauucuacgaacaacauauaccauuagccccuuacaaaaaaucguga

SEQ ID NO: 8889 - RNA, 4098 nt, Artificial Sequence
  Cas9 variant
augguuaaaaaaaaauacgcaauaggaaucgacauagguacaaauucaguaggauggucaguuguaacagacgauuacaaaguaccaucuaaaaaaaugaaaguauucggaaauaccgagaaacgauauauaaaaaaaaaccuacuagggacauuacucuuugacgaaggcaacacagcugaaaacagaagacucaaaagaacugcccgacgccgauauacacgaagacgaaauagaauuuuauacuuacaagagaucuucgcugaagaaauaaauaaaaucgaugacuccuucuuccaacgacuagaugauagcuucuuaaucguagaagacaaacaaggaagcaaacacccaauuuucggaacccuacaagaagaaaaaaaauaccacaaacaauuuccgacaauauaccacuuaagaaaacagcuagcggacaguucucaaaaagcagauauacgccucauauaccuggcacuugcacacaucauuaaauaccgaggacauuuccuguuugaaggagaccucaaauccgaaaacaaagauguacaacaucuauuuaaugacuuuguagaaauguuugauaaaacggucgaaggaagcuaccuaucagaaaaucuccccaauguagcagauguccuaguagaaaaaguaucaaaauccagacgccucgaaaacauauugcauuacuuucccaacgagaaaaaaaauggacuauuuggaaauuuuuuagcucuagcucuaggccugcaaccuaauuucaaaaccaauuucgaacucgcagaagaugccaagauccaauucucuaaagagacauaugaagaagaccuugaagaauuacucgguaaaauuggagacgacuaugcagacuuauucauagcgacuaaaagccucuaugacgguauccuauuggcuggaauccucucaacaacagacucaacaacuaaagcuccauuaucaucuaguaugguuaaccguuaugaagaacauaaaaaagaccuagcacuuuugaaaaacuucauacaccaaaacuuaucugacaguuacaaagaaguguucaaugacaaauuaaaagacggguacgcaggauauaucgaaggaaagacaacucaagaaaacuucuauagguucauaaaaaaagccaucgaaaaaauugagggauccgauuacuucauugacaaaaucgaucgugaggauuuucuaagaaaacaacgcaccuucgacaacggaucgauuccccaccaaauacaucuucaagaaaugcacgcaauuaucagaagacaggcagaguucuauccauuuuuagucgaaaaccaagacaaaauagaaaaaauauuaacauucagaauaccauauuacgucggcccauuagcuagagguaaaucggaauuugcauggcuaaaccgcaaaagcgaugagaaaauaagaccguggaacuucgaugaaaugguagacaaggaaacaagcgcagaaaauuuuaucacuagaaugacaaacuacgaucaauaccuuccagaucagaaaguacuaccaaaacauagucuccuguacgaaaaauucgcagucuacaacgaauuaacaaaaguaaaauucauagcagaaggcaugagggacuaccaauuccuagacagcggacaaaaaaaggacaucguaaaaacccucuuuaaaacaaaacgcaaaguuacagcaaaagauaucaaagcuuaccuagaaaacucaaaugguuaugccggaguggagcuuaagggccuagaggaacaauuuaaugcaagcuuacccaccuaccacgaucucuuaaaaauauuacgcgacaaggcauuuauugaugcggaggaaaaccaagaaaucuuagaagacauaguccuaacauuaacccucuuugaagacagagaaaugauaagaaaaaggcuagaaaaauauaaagacauauuaacugaagaacaaaggaaaaaacuugaacgcagacauuauacugggugggggagacucagugccaaacuaauuaacggaauucuagauaagguaacuaggaaaacaauacugggauaccucauagacgacggaacaagcaauaggaauuucaugcaacuaauuaacgaugacacacuaucuuucgucgacgaaauaagacuagcucaggguagcggagaagcagaagacuaucgagcagaaguacaaaaucuagcaggaucuccugcaauaaaaaaaggaauacuccaaucauuaaaaauaguagaugaauugaucgaagucaugggauaugaccccgaacacauuguagucgaaauggcacgagaaaaccaauuuacgaaucaaggaagaagaaauucacaacaaagauacaaaaagauagaaaaugcuauaaaaaaucuugacaguaacuuaaacucuaaaauacuaaaggaauaccccacaaacaaucaagcucuacaaaaugaucgacuauuccucuacuauuuacagaaugggaaagauauguauacagacgaagaacuagacauagaucaacuuagccaguaugauauagaucauauaauaccacaggcauucauaaaagaugacucgcuagacaacaaaguauuaacaaaaucagcaaaaaacagagguaaaagcgacgacguuccaucacucgaaauuguacauaaaaaaaagaauuuuuggaaacaacuucuagauucacagcucaucagucaacgcaaauuugacaaccucaccaaagccgaaaggggaggucuaacaaaugaagacaaagcaagauucauccaaagacaauuagucgagacacgccaaaucacaaaacauguugcacguauauuagauacaagauuuaauaccaaacuagaugaggcaggcaauagaauacgagaccccaaagugaacauuauaacacuaaaaucgaaucucguaagccaauuuagaaaagacuaucaguuguauaagguacgagaaauuaauaacuaccaucaugcccacgaugccuauuuaaacgcgguaguagccacugcccuacugaaaaaauauccucaauuagcuccagaauucguauacggagauuauccuaaauauaauuccuacaaaucaagaaaaucagcaacugaaaaagugcuauucuauuccaauauaaugaacuucuucagaagaguacuuguauauaguaaaacaggagagguaagaauaagaccaguuaucgaagucaacaaagagacaggagaaauaguuugggacaaaaaaucagauuucagaacaguacgcaaaguacuaucauauccccaaguaaaugucgucaaaaaagucgaaaugcaaacuggagguuucagcaaagaaagcauucuucagcacggagacagugauaaguuaaucccccgaaaaacggaaaaauuuuaccuagauacaaaaaaguacggugguuucgacagccccacuauagcauauucaguucuccuuauagcagauauugagaaaggcaaggcaaaaaaauugaaacgggucaaagaacuuaucggcaucacuauuauggaaagaauggccuucgagaaaaacccaauagaauuccucgaacacaaaggcuacaagaacauacuugaaaaaaacaucauaaaauuaccgaaauacucgcuauucgaguuagaaaacggaagaagaagacuacuggcaucggccaaagaauuacagaaaggaaacgaaaugauauuaccaccucaucuaguaacacuucuauaccacuccaguaacauacacaaaauaaccgaaccuauacauuuaaacuacguaaauaagaauaaacacgaauuuaaagaacuacugcgacauaucagcgauuucucaacuagauauauauuagcccaggaucgacuaucuaaaauugaggaacuauaugauaaaaaugacggagaugacauuucggaccuaacaagcucauuuguaaaccuuuugaccuuuacugcgaucggcgcaccagcagcuuuuaaauuuuuggggucaguaauugacagaaaaagauacaccaguauagcagaaauauuagaagcuacucuaauccaccaaucuguaacagguuuguaugaaacaagaauugaucucucuaaauuaggaggugauuga

SEQ ID NO: 8890 - RNA, 4101 nt, Artificial Sequence
  Cas9 variant
augaagaaaccauauuccauagguuuagauauuggaacaaacucuguaggaugggcugucauuacagaugacuacaaaguuccagcgaagaaaaugaaaguccuaggcaacacaaauaagaaaacaauaaagaaaaacuuaauaggugcccuguuauucgacgcaggcaacaccgcugcagauaggagguugaaaagaacagcaagacgaagauacacaagaaggcgaaauaggauacuauacuuacaagaaaucuucgcugccgaaaugaacaaauuagacgagagcuucuuucaucgccuggacgacuccuucuuaguacccgaagacaaaggaggaagcaaauaucccauauucggcacauuagaagaagaaaaagaauaccauaaacaauucccaacuaucuaucaucuacgaaaaucgcucgccgauucaaaagagaaagccgacuuaagacuaauauacuuagcccuugcucacauaauaaaauaccgaggccacuuuuuguacgaagauacuuuugauaucaaaaauaaugauauacagaaaaucuucaacgaguucaccucaaucuacaacaacauauuugaagaaagcaguuuaucaaaugaaaacgcccaaguagaagaaauauucaccgacaaaauuucaaaaucagcuaagaaagaccgaguucuaaaauuauucccugacgaaaaaucaaccggauuauuuucagaguuccuaaaacucauaguaggaaacaaagcugacuuuaagaaacauuucgaccuggaagaaauggcucccuuacaauuuucuaaagauaccuacgaugaagaccuagaaagucuacuaggacaaauaggagacgauuaugcagaccuguucguagucgccaagaaauuauacgacgcgaucuugcuagcaggaauacuaucuguaaaagaccccgcaacaaaagcacccuuaagcgccucaaugauagaacgguaugacaaccaucaaaacgaucuaucagcucuuaaacaauucauuagauccaaccucccagaaaaauaugccgaaguauucucagacgacagcaaagacggguacgccggauauauugaugguaaaacuacacaagaaggauuuuacaaauacauuaaaaaccaaauaaguaaauuugaaggaaccaaauacuuccuugagaaaauagaacgagaagacuuucuacgaaaacaaagaaccuucgauaauggcucaauaccacaucaaauacaucuucaagaaaugaaugccauacuacaaaaucaaggagguuauuaucccuucuugaaagcgaacaaagaaaggauugaacaaauuuugacauucaggauaccauacuacguagguccccuagcacgagggaacuccgauuucgcauggcuaacaagaaauagugaugacgcgauuagaccauggaacuucgaagaagucguagauaaagcaucaucggcugaggauuucaucaacaaaaugacaaauuaugauuuauaucucccagaagaaaaagucuuaccuaaacauagcuuauuauaugaaacauuugcgguguacaacgaacucacgaaaguaaaauucaucgcagaagcuaugaaagacuacgaguucuuggauagcggacaaaaacgaaaaauagucgaaaacauauucaaaaaccauagaaaaguaaccgaaaaagauauaauaaacuacuuacauaacguugacggguacgauggcaucgaaauaaaaggaaucgaaaaacaauucaacgcaucacuaucgacauaccacgauuuauuaaaaaucauaaaagacaaagaguucauggauaaccccaaaaacggugaaauccuagaaucaaucauccauacuuuaacaauauucgaagacagggaaaugauuaaacagcuuuuggcacaauacaauaguguuuuugaugaaaaaguaauuaaagcucuaucaagaaaacauuacacggguuggggaaaauuaucugcuaaacuaaucaauggaauuagagauaaacaaacaggcaacucaauucucgauuaucuaauggacgaugguaaaucaaauaggaauuucaugcaauuaauaaaagacgacggcuuaucauuuaaagaaauuaucgacaaagcucaaguaguuggcgaaacagauaaucuccgacaaguaguacaaaaccuuccaggaagccccgcgauaaagaaaggcauacuccagucaauaaaauuaguugacgaacuuguuaaaguaaugggaagcgauccagaauccauaguaauagaaauggcaagagaaaaucaaacuacaaacaaaggaaaaucaaaaagccaacaacgucuaaaaacacuuucagaugcuauaucagaauuaggaucgaacauucugaaagaacauccaacggauaacauucagcuacagaaugacagauuguuucuuuauuacuuacagaacggaaaagacauguauacuggagaagcgcuagauauaaaccaacuaucaaacuacgacauagaccauaucauaccacaagccuuuauaaaagaugacucccuagacaauucaguacuaacaagcucuaaagacaaucgcggaaaaucagacaauguaccuagcuuagaaauuguagagaaaaugaaagguuuuuggcaacaacuccuagauuccaaauuaauuagugaaagaaaauucaauaaccuaacuaaaguagaacgagguggccuagaugaaagggacaaaguaggcuucauaaaaagacaauuaguagaaaccagacaaauaacaaaacauguagcgcagauccucgaugcccgcuucaacgcagagguaaaugagaaaaaucaaaaauuaagauccguaaaaauaauuaccuuaaaaucaaacuuaguaucaaauuucaggaaagaauuuggucucuacaaaguacgggaaauaaacgauuaucaucaugcucacgacgcauaccuaaaugcuguaaucgcaaaagcaauacucaaagaguacccaaaacuagaaccagaguucguguauggcgauuaccaaaaauacgaucucaaaagauauauaucccguacaaaagacccgaaagaaauagaaaaagcaaccgaaaaauacuuuuucuacagcaaucuacuaaacuuuuucaaagacaaagucuacuacgcugacgguacaaucauacaacguggcaauguagaauauaguaaagacaccggagaaauagcguggaauaagaaacgagacuuugcaauaguuagaaaagucuuaucauacccacaaguaaauauaguaaagaaaacagaagaacaaacuggaggcuuuucaaaagaaaguauucuaccuaaagguaacagcgacaaauugauaccaagaaaaaccaaaaauauacagcuagacacaacaaaauacggagguuucgacucacccguaauugcauauagcaucuuacucguagcagauguagaaaaaggcaaaucgaagaaacuaaaaaccgucaaauccuuaauuggaauaacaauaauggagaaaguaaaauuugaagcaaaccccguagcauuccuagaagggaaagguuaccaaaauguagucgaagagaacauaaucagacuuccuaaauacucccuuuuugaacuagaaaacggccgucgaagaaugcucgcauccucaaaagaauuacaaaaaggcaacgaaaugguauugccaagcuauuuacucgcacuauuauaccacgcuaagaaaauucagaagaaagacgaaccagaacaucuugaauauauaaaacaacaucauagugaguuuaaugaccuacuaaauuucguaucggacuucagucaaaaauauguacuagcagaaaguaauuuagagaaaauuaaaaauuuguauaucgauaacgaacaaacgaaucucgaagaaaucgcaaacucauuuauaaaccucuugacauuuaccgcauuuggagcaccagcaguuuuuaaauuuuucggaaaagacauugaaagaaaaagauauagcaccguuacagaaauacuaaaagcaacucuaauacaccaaucaaucaccggauuauaugaaacacgaauagaccugucaaaauuaggagaagaauga

SEQ ID NO: 8891 - RNA, 4101 nt, Artificial Sequence
  Cas9 variant
auggauaagaaauauaauauaggccuugacauaggaacuucaucuaucggauuuguugcaacugaugaggauaaucaugucauacgggcaaaaggcaaaaacguuauuggaguacgccuauucgacgaaggucaauccgcugcggaacgacgaggauuuagaacaacaaggcgaagacucaauagacgaaaauggagauuaaaucuccuacgagaaauauucgagccgcauauauauccaauagacgcgagcuuuuucaugaggcaaaaauacucaaaucuuaguaaacaagauccaaaccagaaaaucgaguucaaagacauccuauucucagacaaaagcgaugcagaauuuuacagacaauauccaaccauauaucaccuacggcaagcacucaugacugagaaaagacaauucgauuuaagagaaaucuacuuagcaauacaucauauaguaaaauaccgaggacacuuucuugaugaaacaccaacugacaaauuuaguuuugaccaacuggaucucacacaagaauuugaaagauuaaauguucuauuuucugagcaaaacccagaagaaccguucgaaauaguagucaaucaaaaccaaagcauugaagacauccucucaaaccaaaguaugacagcuagcgaucgaagaaaacaagcacuuguuguguucuaccaacaaagugaaaacaaagaaaacgaaaaacaauauaaagcuauagccacagaaauucucaacuuguuacuagguaacaaagcaaaacuaaacgucauacuagcacaagaaguugacaaagaagcagcuaaagacuggagccuuucccuaaguucugaaacuuucgacgacgaccucgaaaaagccucuagugguuuaaaugauucacaguuagaaauggucggaaucuuugaaagaauauacagcucacuaauauuaaaaucgauuauaggagaccacaacagccuaucagcagccaugguugacaaauucaaaacacaugcucaacacagagacuugcucaaagacgugaucaaaaauagcgacgcaacuaaaggagaacaguuacaauuugcauaugaucauuaccuccaaagacacuccgcagacggcaaagcauaugguaaagacgauuuuuauaaagaagugaagaaaaaccuagaugacagcgaugccgcacaacaaauacaacaacuuauagauacagaccaauuuaugccuaaacaacgaacgaaagcaaauggcgcaauaccacaccaaguacagcaaaaagaacuugauuuaauaauagaaaaucaaugucaauacuauccauggcuagcagaagagaauccaaauuccgagcgccacaacguugcaaaauacaaauuagacgaacuuguaaguuuccguguacccuacuauguaggcccauuaauaaguccggccgacgacgaaacagacccccaagcaauucaaaauaccaaauuugccuggaugauuaggaaagaugcucaaggccguauaacaccauggaacuuugacgauaaaguagauagagaaaagucagcagauaaauucauaaaacguaugacaacaacugauacauauuuaaucggagaagacguccugcccgaucaaagccucaucuaccaacguuauaaagugcucaacgaguuaaacaacguacgaauaaauggaaggccgaucgaaguacaaaucaaacaaaacauauauacugaccuguuuaagaaauucaaauccguaucagucaagaaauuacgaucauaccucgaagaaaugaguuacuauccagggaguuuuaaaauaucaggccuaacaaauccaggaaaauucgacaauggacuuaccaguuaucucgauuacaaaaauauuuuaggcgauucuguagaugcaaacgacaaaagagcugauaucgaacaaaugauagaauggucaaccauauucgaggauaacaaaauauuugcgcaaaaauuagaaucuaugacuuggcucacugcagaacaaaggaaagccaucuccagaaaaagauacacuggguggggccgucuuucaaauaaauuauugacccaacucaaaaaucaagacaaccgaagcaucauggaccuauuaugggaaacagaagaaaauuuuaugaaaauacagagcgcaccagauuucagcaaaaugauagaggcccacaaccaacaguucaucaaaaaugaagcuaacauacagcaaguuauaucugaccuauacaccucaccacagaacaagaaagcaauuagacagauacugcuuguaguagacgauauccagaaagcaguaggacacgcccccgaacacauugcuauagaauuugcuaaaggagaggacaaaaauccaagacgaacaaucagcagagaaaugaaaauacaagacguguaccaacagauaucagacgacauacucgugagcccagaaguuagggcccaauuaaacgaaaagaucgaaaaccgccauggaagauuaagugacagacucuuucuuuauuucaugcaaggugguagagauauguacacggguaaaccuauaaauauaaacaacauaucacauuaugacauagaccacauacuaccacaagccuucauuaaagaugauucacuagacaaccgaguacucguuuccgauaaauugaauagagaaaaaucagauacaguuccacgugacuuauuugguagagaaaugaugaguacaugggaaaagauggccgauagaggccuaauuaccaaacguaaauuagcaaaucucaaaacuauacccggaucuaucgacgcucauaaagcacaaggcuucauuaaucgacagcuaguugaaacaaggcaagucauaaaacuugcugucggcauaaugauagaccaauauccagaaacgcaaaucguuaguguaaaagcaaaucucacacaugaaaugcgcgaaauguucgacuuagucaaaaauagagauguaaacgauuaucaucacgcauucgacgcuuaccuaacagcauuuguuggaaauuauuuauuacaaagauaccccaaacuugaaccauauuucgucuacgauaaauuuaagaaacuaaaagaucaaaauauuucaaugcgugacuucaaccuacuauaugacuuaaagaaaaacgaagacgucuacgaccagagaaccggucauucagcucacaaaauaugggaucaacacggaaguauagauuacauaagacaucucuuugccuacaagaaaauucuagucucacaugaaguacaucagaacggaggagcauuauauaacaugacugucuacggaaaagcagacgacgccaaaagaaaauuaauaccaauaaaagcugauaaaccaacagaauuauauggagguuauacaucaagaaaauuagcauauauggccauugucaaaacaaagaaagguaagaaagaacaauaccaaguaaccgguguuccuguaucagcucucacaacgcuaagacaguucaaagaagauucaccagaacaaaaacaggcuuuggaagaaaucguuagaagaaacuuugacgagaaaacagagguagaaauaauugucccaaaagucuuauucaaccaauuaauaguagaugaaaaaugcagauucaugguagggucagauacauaccgauauaaugcacaacaacugguacuaucagcagacgaucuagaaauuaucaaugcaucacauaaagacauacaaaccauugacaguagcgauuauucccaacaacuagaucaaguuuaccaaaauauccuaacaauaguagacaaacauuucccaauguacgacaucaacaaauuccgaacuaaacuacacgacauauacgaacaauacauagaacuaccgaacgaggacgugugggaaaauaauaaacuaacaacucuaggcaaacauacuaucauaaucagaauacuucaaggcuuacacgcuaacgcaaccguaguagaucuuaaacaacuggguaucaaaacgccauucggcuucaugcaacaagcacgcggaauagugguuagccccgaugcccaacuaaucuaccaaucaccaacgggacuauaugaaagaagaguaagacucggagaccuauga

SEQ ID NO: 8892 - RNA, 4101 nt, Artificial Sequence
  Cas9 variant
augggagaucguaaauacaaccuuggacuagauauaggcacaucaucaaucggauuugccgcaguagaugaaaacaaccaaccuaucagagucaaaggcaaaacugcuauaggcguacgcuuauucgaagaagggaaaacagcagcagaucgccgcggcuucagaacaacucgacgacgauuaucucggaggagauggcgaauuaaccuacuuaauggaauuuucgaugcacaccuagcggaagucgaccccacuuucuuagcaagacuaaaagaaagcaacagaagcaauuuagacccaaaaaaaucauuucaagguagccugcuauuuccagaaagaaaagauuaucaauuuuauaaagaauauccgacaaucuaccacuuaagaaaagcucuaauggaggaagacagaaaauuugauauaagagaaaucuacuuagcuguacaccacauaauuaaauacagaggaaacuuuuuaaauggaaccccgaugcguaguuucaaaguagaaaacauugaauuagacaccuuauucgaccgacuaaaucaauuauacgaagaaauaauuccagauaacgaacuagcuuuugaccuugaacaagucgcagacgugaaagaaguucuuaguucgacgacuauauacaaaauggauaaaaaaaaacaacuaguaaagaugaugcuucuuccaacuaguaacaaagcauuacagagcgagaauaaaaaaauagucacccaauuuguuaacgccauuuuaaacuauaaauucaaauuagacguauuauuacaaguugaaacagaugcagauuggucauugaagcuaaacgacgaaggagcugaugauaagcuugaagaauucacuggagauuuagacgaaaacagacuagaaauuauagaucuuuuacaacgauuacacaacugguuuucacuuaacgaaauaacaaaagacgguaacucuuugucagccgcaauggucgaaaaauauaaagaucauaggcaucauuuggaacuucuaaaaaagguuauagaagaccauccagaugcaaaaaaagcaaaagcauuaaaggaaacauauacagcuuacgucggaaaaaccgaugacaaaacccaaaaucaagacgacuuuuauaaggcaguagaaaaaaaucuagacgauucuccagacgccaaagaaauaaagcgauugauccaauuagaccaauuuaugcccaagcaaagaacaggacagaacggagcaauaccgcaccaacuccaccaacaagaacucgaccaaaucaucgaaaaacaaaguaaauauuacccauuccucgcagaaccuaacccaaacgucaaaaggaggaaagaugcgccauacaagcuagacgaacuuauagcauuuaagauuccauauuauguagguccacucguaaccccagaagagcaagcccaaaauggggaaaacgucuuugcauggaugaagaggaaagucgcaggaccuaucacaccauggaauuuugauaagaaaguagacagaauggaaagcgcgaaccgguucauaagacguaugacuaccaaagacacauaucuauuuggugaagacguacuacccgcggaaucaaugauauaugagaaauucgucgucuuaaacgaacuaaauaaccuuaaaauaaacgguagacacuuaaguuuaaaagacaaacaagauauauauaaugacuuauucaaacaacaaaaaacgguaaguauaaaagcuuuacaaaauuauuacguaacaaaaaaaaaagcugcuacagcuccgacggugggaggacuagcugauccaaaaaaauucuuaucaucacuaucuacauauauagauuucaaaaacauguuuggagaacaaguuaacgacccacaguuucaagaagaucuagaacaaauuguagaauggucaacuauauuugaagaccgaggaauauucaaagcgaagcuccaagcccucgguugguugucagaaaaacaaauacagcaacuaguagcaaaaagauacaaaggauggggucgauuaaguaagaaacuacuaacuggauuaaaaaacgccgaaggauauucaauauuagacgaaauguggcgaagcacagaaaacuuuaugcaaauacaaucucgaccagaauucgcggcauuaauacagcaagccaaugaaaaacaguucgaaggcaacgaccccaacaauguuugggagaauauagaaaacauccugggugacgcguacaccaguccacagaauaaaaaagcuauacgacaaguaguaaagguaguacaagauaucgaaaaagcgguaggcaauccacccgaaaaaauagccauugaauuuacaagagaagcagcagcaaacccacaaagaacacagucuagacucagaacauuagaaaaacuauaugaauccgccgaggagguaguugaugcccgacugaccgcagaauuagcggaguucaaagaaaacaaacauguacuaucggacaaauauuaccuuuacuuuacacaauuaggaagagacguuuacacaggagacacuauuucacuagaccgacuaaaugacuacgacgucgaccacauccuuccccaaucguucauaaaagaugauagcuuggacaauagaguacucacuauacgagcuguuaacaauggaaagucagacaacgugccagcaaaaauguuugguaagaaaauggguuccuuuuggagauacuugcuagacaacgguaugauaucuaaacgaaaauauaacaaccucauuacggauccagacaauaucucaaaauaugcacagaaagguuuuaucaaucgacaacucguggaaacaucacaggucaucaaguuaaccgcaaauauccuaaauggaaucuaugacaaagauacggaaauuauagaaguaccugcaaaaaugaacucccagaugagaaaaauguuugaccuugugaaagucagggaaguaaacgauuaccaccacgcuuuugaugcguaucucacaaucuuuauaggaaacuacuuauacaaaugcuauccaaaacuccgaccauacuucguuuacggaaaauuuaaaaaguuuucugacaacgaagauauagaaguaggagacggaagauuuaauuuucuuaaccgcauagaaagauuaaaaaauguuacagacccagaaacuggugaaauacuauggaguaacguugccccaaacgagacaauaaaaaggauuaaaaaaguuuauaauuacaaauuuaugauuguaucgagagaaauaaccacuagaagagcagaacuauuuaaccaaacaguuuauccaaaaaacuacagggguaaacucauaccaauaaaagaagauagacccacagaccucuacggagguuacucgggaaacacggaugcauaucuagcaauagucgcuuuagaagauaaaaaaaaagguaaauauuucaaagucgucgguauacccacaagagcagcagccaaacucgaaaaauuaaaacaacaagauagucaacaauaucuacaagcuguacacgaagucauagccccucaauuuaccaaaucgacaaaaaaaggaauaaaaaaaaccgaauuuagaauaguccuagacaaaguacauuacagacaauuaguacaggacgggccuguaaaaaugaugcuagguucuucuacuuacaaauauaacgcuaaacaauuaguacucucggaaaaagcacuacaagucauaaaagacgauagaaaauucgacgaaacucaaaaagaugauaaucucauagcuguauacgaugaaauacucaguauaguaaaccaaaguuucgaucuauacgacauaaauggauucagaaagaaacucaacgacaacagaaaucaauuuauagauuugccagccgaaaccaaauaugaaggaagaaagguuguggcacacggcaaacgagaaaugauccucgaaauacucaaaggauuacacgccaacgccucauucgguaauuuaaaaccaaucggauuugcaacuccauucggacaaaugcaauccaaaaacggaauagaacuuucggagaaugccuuucucauacaucaaaguccaaguggucuauuugaacacaaaauaaaauuaagcgaccuauga

SEQ ID NO: 8893 - RNA, 4101 nt, Artificial Sequence
  Cas9 variant
augacuaaauuggggaaaccuuacgguaucgggguugacauuggaaguaauaguauuggcuuugcagccgucgacgaaaacucacauuuaauucgauuaaaaggcaaaacagucauaggcgcgcgccuauucgaagaaggaaaagcagccgcauaucggagagcgagcagaacuacaagaagaagauuaucacgaaaucgauggagacucucauuuuuaagagauuucuuugaaucacauauaacaccaacagacccaaacuuuuucaugagacaaaaauauagcgaaaucagucccaaagacaaagcucguuacaaauaugaaaagagacuauucaaugaccggaccgacgcagaguucuaccaacaauauccaacaauguaucaucugagaacacgacuccucacagacccgucaaaagcagaugugagagaaauuuauuuugcaauccaucauaucuuaaaaagucgggggcacuucuugacaccaggauacgcaaaagacuucaauacaaacaaaguagcacuaaaugaaaucuuucccgccuugcaagaugccuaugcacaagucuacccagaucuugauauaacguuugaugaaaacaaaguaaaugaguucaaaacaguacuucuaaacgaaaaagcaacuccgucagauacacagagagcucugguaaacuuauuauuagcuaaagaaggcgaucgagauauucuaaaacaacaaaaacagguuuugacagaauuugcaaaagcagugguaggauuaaaaacaaaacuaaacguagcccucggaacagaaguugauucaagcgaagcaacugccuggaacuucuccuuaggccaacuagaugacaaaugggcagggauagaaucagcaaugacagaugagggaacagaaauuuuggaccaaauaagagacuuauaucgugcaagguuauuaaacggaauaguaccugcagguaaaacccucucucaagcaaaaguugacgauuaugcgcaacaucaugaagaucuugaauuguucaaagacuaucucaaacaauuagaagaugaugguacugccaaagcaauacgacaacuauaugaccgauacauagauggagacgacgcaaaacccuuugugagagaagacuucguaaaagcacuaacaaaagaagucacugcccacccgaacgccaaaagucccgaacuauuagaacggcuagcgcaaccagauuuuaugcuaaaacaaagaaacaaagcuaauggugcaauaccaguacaaaugcagcaaagagaacuugaucaaauaaucaaaaaucaagcaguauacuaugacugguuggcagcaccgaauccuguagaaaaacacaggcaaaguaugaccuaucaacuagacgaacuccuaaacuuuagaaucccguauuauguaggaccucucguaacagccaaagaacaaaaagcggcgcaagguggaguguucgcauggaugguuagaaaagauccagauggaaauauaacccccuauaacuuugacgaaaaaguagaucgggaggcuucugccaacaccuucauacaaagaaugaaaacaacugacacauauuuaaucggagaagauguuuuaccaaaacagagucuacuauaccaaucauacgaaguccucaacgaauuaaacaauguacgaguaaaugauaacaaacuuagcuuugaucagaaacaacaaguucuaggcgaauuauucgaaagacacaacacaguaacaauuaaacaauuuguagacaaucuauuagcucacggagacuacgacagaauaccugaaguacgcgguuuggcagaugagaaaagauuccuaucaucuuugucaacguacaaccaauuaaaagguauacuccaugaagcgauugaugacgcggauaaacaaacagacauagaaaauauaauagcauggucgacuauauucgaagacaaagcaauauucaaaacaaaacucaaugaaauaaguuggcuuaacgcuggcaugauaaauucacuagcaaacauaagauaccgaggauggggucaauuuagccacaaacugcuuaaugaacucacacuaucaacagggaggacuguauuugaggaauuauugauaagcucaagaaauuuaaugcaaauccuaacugaugaagugcuaaaacagaaaauugccgagcuaaaugcucaugaauuaaaagcuaguggaaucuaugcagccauagacgacgcuuauaccaguccaagcaacaagaaagcucucagacaagucuuaagcguaaucgaugauauuaccaacgcagcugggcaagcuccaaacuggcuuuauauagaaacagcugacggugauggagucccgggaaaacgaacaaacucaagacaacguaaaauucaagaaauauacgcaaacgcggcacaagaguuaauaacgggauccgucagaggcgaauuugaagauaaaauagcaagccgagcugacuucaccgauagacuuguauuguauuuuaugcaaggaggcagggauauuuauacuggagaaccacugaacauugacaacuugaguucauaugacauagaccauauauugccacaaucguugauaaaagacaauucucuagacaaucggguccuaguucaucccuuggugaauagagaaaaagauacaauauucgcgucuacaagauuugcaaaacaaaugaacgguauguggagacaauggcacgcagcuggacuaauauccagcagaaaacucagaaauuuacaaaugagaccugacgaaauagacaaauaugcuagcgguuucguagcgagacaacuugucgaaacacgacaaauaauaaaacuaacagaacaaauaguagcagaccaauacccagacacuaaaauaaucgcuguaaaagcagguuuaaguucacaacuacgaaaagaauuggauuuuccuaaaaacagggaagucaaccauuaucaucacgcauuugacgccuuucuggcugccagaauaggaacauauuuacucaaaagauacccaaaucuugagccuuucuucacauauggcaaauucaagaaaacagaagucaaaaaguuaaaaucacuaaaaucauugaaaucguucaauuucauacgcgauaugacucacgcaaaagauaagauuguagcaaaagaaaccggagaaauaguaugggacaaugccucagacauuaacgaacucgauaggauauauaacuuuaaaaggaugcuaaucacacaugaaguuagauuugaaaccgcaucauuauucaaacaaacccuauaugcagcgaaaaauucaaagaaucgaggaggaaguagacaacuaaucccaaagaagaaggguuaucuuguugauauauacggagguuacacucaagaaaccggaucauaucugaguguuguacgacucacuaagaaagcaauguaugcaguaguaaaagucucaacaagagaugcagcaaaacucgcaguagcaaaaucaauaucugaacaaaaagaaaacgaaacacuuaaaaagauaaucgauggaaaauuauccaaaaccaguaagaaaggaaaaacuacccaucaacuauuugaaauaguacucccuagaguaggacagaaaacauuauuuaaaaauagcaaauauaaccaauuccuaguaaauagcgacacuuauaugcacaauuaccaagaauuauggaugccacgcgaauaucaacggauguggaaagacauccuacucucaaaccacggugacgcccaaauagaaggacaauuagaucaaauauuuaaauucauaguaucacaaguaaacucauacuuuaacuuauacgacauaaaccaauucaggaagaaaauugcagacgcuacagacaaauucgccaaauuacccacacaugacacagacaacgccagaggaaaaauagccacuauaggucaacuacuaauugguuuacaagcaaaugcaaugagaagcgaucuaagaaacuuagacauaaaaacaccauuuggcuuacuacagaucggaaccgguauaacgcucgaucuagacacuucaauaauauaccaaagcccaacuggauuauucgaaagagaagugccguuaacugaucuauga

SEQ ID NO: 8894 - RNA, 4101 nt, Artificial Sequence
  Cas9 variant
augaccaaagauuacagucuaggacucgauaucgguacaggaucaguuggauuugccgcauuggauacaaauuaucgacuguuacgugccaaaggcaauaaugugauaggaguaagacuauucacaccugccgagacagccgaagaacgaaggggauuucguacugcacggcgcagguuaucacgaaggcguuggagguuaggagcgcuuaacggaaucuucgcgcccgagcuugcuaaaguugacccaaacuucuuacauagauuaaaauaugcauggguucacccagcagaccaacaaaacaagggaaaauauucagcagcaccacuauuuaacgaugcagccuuagaucggcaauuucaugaugauuauccaacaauuuaucaccuaagauuaaaauuaaugacagacacaagucagcaugaccuuagagaaguuuacuuagccauacaccauauaauaaaauucagaggaaacuuccuaaggggcgaagguccgauaaacgcaagcgaagccuuugacauuaacacauucaucgaccaaaugaccgcauucuaugaccaagcauucccagauuucaaaauagucgaucaagucgaucaacaaauaauuuucaaaggauuaacagacaugacuuuaucaccagcagauagagcaaauaaagcuuuaauggguuucaacaaugcagcacagcaaccaaacaagagaauuuuuaaagcuaucuuaucuggccucguaggcaaucaaguugaucuuauggcaauauuucaauuagacggaauaccuaaagaagaccaaaaagaauucaaauucaaauuugucgacaaugauauagaagagaaacuagccgcacuaggugauaacccggcucuaucagacgaacaaaaugaauuuuuaaccacucuauaugcagcauucucaggauuaacguugaaaggauuacuaggcgaugccacaagcauuucugccgcaaugguagcaagauaugccucccacaggacagacuggacguacauuaaagaucacguacucacaccacaaaauaacagagaauuaagacuagcauaugcagaucuaaugacagauaacgaagacguacgacucaaggcuggaaaaaaauuugcuaaagcaauugaggcugcagauauaccagcagcaaaaaaaucugaauuuucacuaaaaauugauaauaacgaauuccugccuaggcaacgaacaaaagccaauggaacaauuccacaccaauuacacuuaaaugaauuacaacaaauuauugaaaaccagggacaauauuacccguuuuuaaaggcuacauuugaacaagacggucacacccucaacaaaauagaaggguuaguuaaauuuagaguaccauacuauguagguccgcucguuccaaaacauaaagucgcagguaauaacgcgaaucauuggaugguaccaaaagagcccggagccauaacaccguggaacuacaccgaaaaaguagauagggauaagagcggaaacgaguucauacgacgaaugacagguacugauacauaucuuuuaggggagccuacacuuccaaaaaauaguuuaguguaccaagaauucaaugucuuacaggaauuaaauaauuuaagaaucgaaaagagacgccuagauauugcaguuaaacaagauauauuugaacaugucuucaaaacaaacaaaacugugacaguaaaacgaauugaagaauaucuaacaacagaauucgggucgccaguaacacuaagcgguuuugcaaacguuaaugaaagaaaguuaaauucaucauuaagcacguaucacuacuucguaggaauuuucggcgccgaauuuguagaugacccaaaaaauuuaacucuacucgaacaaauuguagaacuacaaacuguuuucgaagacagaaaagccuuacaacgacaacuaaaauugagacccgaauuaagcgaaaaacaaguaaagcagcuagcaagaacgcauuauacagguuggggacgacuaagucaaaaacuauuaaccucuaaaauaguacaugucgcacuugaaggcgagcgagaaccaggacaauauucaauacuggaaacgcuauauggcacacaaaugaauuuuauggaaauagucaacgauaugaaagacagguaugguguaaaaucuuggcuagaucaagaaaauucugguagcgaaaauaauuuauccuuaaaacagagaauacuagauaugccaggacccaaaaauaucaaaagaggaaucaaccaggccuuccacauaauagacgaaauaacaagggccguagggaacgcacccucucgaauuuacaucgaauuugccagagaaucucaacaaucaaaucuaacaaacgcaagaguuaauagacuaaagcaacucuauucaaaccaagcacuuaaaaaagaauucgcuaaauuagccucugagauaaaagaucugacaaaagagcaauuaaaagacgacagacuuuaucuauacuaccuacaacaaggcaaagauauguacacagaaacagacauagacauaacuaaaauuucaucaaauuaucaaauagaccacauaauaccacaagccuacacaaaaaauaacagccuagauaauaggguacugguaaauagugaaaugaacgcacgaaaaagugacucaccaacuuuccucccaagucugauacaagaaaggaaagcuugguggcgucaauuacgcgacacuggacuaaugaguaccauuaaguacaauaauuugacucgcacaucugaugauuucucagcagaucaaaaagaaagauuuauagcaaggucauugguagaaacacgccaaguuauaaagaacguagcaacucuaauaaaagaauauuaugaugacagccaaguagaagcacuacccucugaaauaaccgcggagaugagaagauaccuaaacguccgaaaaaacagagacauuaacgauuaucaccaugcccacgacgcauuacuauuugcaaccgcgggcgaauuuucgagaaaaguaggaauaauggaaaaaggcagaguuagcgauggugcaggaaauaucuacaaucgauauaccaaagauauaauucaacgcgcucgcgcaaaagccggacaggacaaaaaaguucguccguucacauuuaucguaggaucaauggcaaauccagacacaaaauuucaaacaaaccaaaccaccggagaaauuguauggacgccagaagacguugcauauuuaagaaagguaaucgacuacaagaaaaugcuugucaccaaaaugacacuagaucaaacgggcacuuuauacaacgaaacccgauacggcuccggugauaaacauguagcaguugcacuaucaaaagacaaggcugcagaccuguacggcggcuuuggaucccuaaaacccgcauaugcagcccuaguauauucuaaaaagaaauuucgccucguaaauguauuacgucuauggcuacccgaaauaaaaaaaaacgcaucuguucuagaaagaaaaguacaaucaguauuaggugaugauaacgcaaaaguaauaagggcucauguaccuuguggacaacuacuaauaaaagacggcgcccuaguaaccguaagcagugccaccgaacuucauaacuucagacaauuaugguuaccaaaagcggacuaccaagauauaucgauucuauuaggagcaccagauaaaguaacggcggaaaaccgauuacaagcagaaucacacuuugaugauguagaccaacguuuugaaaguuuacuaaaagauguuauagaucaagcacgccaguauuacccuuuaaaaacacaccaaacgucccuagaaaaacuaauaggaaaaauuggaaaauucgaugaacuuaaauuugcacaaaaacagcaaguauuuagcaggcuacugucugcacuucaugcaaacgcaacuaauagcgauuuaaaacaaauuggacuauccacagccugggggagauuaaucuacccaaaaggcguaucucuuacagacgaagacaaacuaaucaacucuucauuuacagggcuauuuaaugauguaauguccauuaaagaguuucacgauuucagcauaaauuga

SEQ ID NO: 8895 - RNA, 4104 nt, Artificial Sequence
  Cas9 variant
augaaaaaacaaaaauucagugacuacuacuuaggcuucgauauaggaacuaacaguguugguugguguauaacagacuuagauuacaauguucucagauucaacaaaaaagacauguggggaagccgacuuuucgaagaagcaaaaacagcagccgagcgacgaguacaacgcaauagcagaagacgacuaaaacggagaaaguggagacuaaaccuacuagaagaaauauuuaguaaugaaauacuaaagaucgauucaaacuucuucagacgccuaaaggaaucgucacucuggcuagaggacaaaucaagcaaggaaaaauucacauuauucaacgacgauaauuauaaggauuaugauuuuuacaaacaauacccuacuaucuuccaucuacgcaacgaauuaauuaagaauccugaaaaaaaagacauaagacuggucuacuuagcaauccacagcauauucaaaagcagaggccacuucuuauucgaaggacaaaaccucaaagaaauaaaaaacuuugagacacuuuauaauaaccuaauagcauuucucgaagacaauggaauuaacaaaaucauagacaaaaacaauauagagaaauuggaaaaaauagucugugauaguaaaaaaggguuaaaagacaaagaaaaagaauuuaaagaaauauucaauucggacaaacaauugguagccauauucaaacucucaguggguaguagcgucucacuaaaugaccuguucgacaccgacgaauauaagaaaggcgaaguagaaaaagaaaaaauaucauucagagaacaaaucuacgaagacgacaaaccuauauauuacaguauuuuaggagaaaaaauagaauuacucgauauagcaaaaucuuuuuaugacuuuaugguauuaaacaacauacuggcagauucacaauacaucagugaggcaaaaguuaaacucuaugaagaacacaaaaaagaucuaaaaaaccugaaauacauuauaaggaaguauaacaaagguaacuaugauaaauuauucaaagacaaaaacgaaaauaacuauuccgccuacauaggauugaauaaagaaaaagggaaaaaagaaguggucgaaaaaagccgacuaaagauagaugaccucauaaagguaauuaaagguuacuuaccaaaaccagaaagaauugaagaaaaagacaaaacggucuuuaaugagauucuaaguaaaauugaacucaaaacgauccuaccuaaacaaagaauaagcgacaacggaacauugcccuaccaaauccaugaaguagaauuagaaaaaauauuagaaaaucaauccaaauacuacgacuuucucaacuaugaagaaaacggaguaagcacaaaagauaaacuauuaaaaacauuuaaauuccgaauaccauacuacguaggcccacucaacuccuaucauaaggauaaaggagggaauucauggauaguaaggaaggaagaaggaaaaauacuaccguggaauuuugagcaaaaaguugauauugaaaagagcgcagaagaauucauaaaacggaugacuaauaaaugcacauaccucaauggagaagacgugaucccaaaagauacauuucucuacagugaauacguuauacuaaacgaacuaaacaaaguacaaguuaaugacgaauuuuuaaaugaagaaaacaaacguaaaauaauugaugaauuauucaaagaaaacaagaaagucucagaaaaaaaauuuaaagaauauuuauugguaaaacaaauaguugacggaacaauagaguugaaagguguuaaagauagcuucaacuccaacuacauaucauauauaagauucaaagauaucuuuggagaaaaacuaaauuuagauaucuacaaagaaauuuccgaaaaaucaauauuauggaagugccuguauggagaugacaaaaaaauauuugagaaaaaaauaaaaaaugaauauggagacauccuuacaaaagacgaaauaaaaaaaaucaauacauucaaauuuaauaacuggggacgacuuagcgaaaagcuauugacaggcauagaauucauaaaccuagaaacaggcgaaugcuacucaagcguaauggacgcacuucgacgcacgaacuauaacuuaauggaauuauuauccucaaaauucacauugcaggaaucaaucaacaacgaaaacaaagagaugaaugaagcaucauaccgcgaccugauagaagagucauauguuucacccaguuuaaaaagagcuauuuuccaaacauuaaaaauauaugaagaaauaagaaagauaacaggccgcguacccaaaaaaguauuuaucgaaauggcaagaggcggagacgaaaguaugaaaaauaaaaaaauaccagccagacaagaacaacucaaaaaacuauaugacucauguggcaacgacauagcaaacuucagcaucgacauuaaagaaaugaagaacucacuaauaucuuaugauaauaacucauuacgacaaaaaaaacucuaucuguacuaccuacaauuuggaaaaugcauguauacaggaagagaaauagaccuugaucgauuauugcaaaacaaugauacauacgacauugaucacauauacccacggucaaaaguaauaaaagaugauaguuucgauaaucuaguauuaguacucaaaaaugaaaacgcagaaaaaagcaaugaauaucccguaaagaaagaaauacaagaaaaaaugaaaucauuuuggcgcuuucucaaggaaaaaaauuuuaucucggacgaaaaauauaaacgacuaacugggaaggacgacuuugaacugcgaggauuuauggcaagacaacuuguaaauguaagacaaacaaccaaagaagucggaaaaauauugcagcaaauagaaccagaaaucaaaauaguauauagcaaagcugaaauugcgaguaguuuccgugaaauguucgauuuuauuaagguuagagaacuaaacgauacacaccaugccaaagacgccuaucugaauauaguagcuggaaacguauacaacacaaaauucaccgaaaaaccauaccgauacuuacaagaaaucaaggaaaauuaugacguaaaaaaaauauauaauuaugacauuaaaaacgcaugggacaaggaaaacucucuagaaauagugaaaaaaaauauggaaaaaaacacaguaaauaucacacguuucauaaaagaagagaaaggucaacuauucgauuuaaauccuauaaagaagggagaaaccagcaaugaaauuauuaguauaaaaccaaaagucuacaauggaaaagacgacaaacuaaaugaaaaauacggauauuacaaaucacugaauccagcauauuucuuauauguugaacacaaagagaaaaacaaaagaauuaaaaguuucgaacgaguaaaccugguagacguaaacaauauaaaggacgaaaaaucuuuagucaaauaccuaauugaaaauaaaaaacuugucgaaccacggguaauuaaaaaaguauacaagcgacaggucauacuaauaaaccauuacccguauagcauaguaacauuagauucaaacaaauuaauggauuucgaaaaucuaaaaccacuauuucuagaaaacaaguacgaaaaaauauuaaaaaacgucauaaaauuucuggaagacaaccagggaaagagcgaagaaaacuacaaauucauuuauuuaaaaaaaaaagacagguaugaaaagaacgaaacccuagaaaguguuaaagauagauacaaucuagaauucaaugagauguaugacaaauucuuagagaaacuugauagcaaagacuacaaaaacuacaugaacaauaaaaaauaccaagaacuucuugauguaaaagaaaaauuuauaaaauugaacuuguucgauaaagcauucacacuaaaauccuucuuagaccucuucaacagaaaaacuauggcagauuuuaguaaaguaggacuuacaaaauaucuaggaaaaauucaaaagauaucguccaacgucuuaagcaaaaacgaacuuuaucuacucgaagaaucagucacgggacuauuuguaaaaaaaauaaaacuauga

SEQ ID NO: 8896 - RNA, 4104 nt, Artificial Sequence
  Cas9 variant
augaaaaaacaaaaauuuagugacuauuaucuaggguuugacauuggaaccaacucaguagguugguguguuacagaucucgauuauaacguacuuagauuuaauaaaaaagacaugugggggaguagacucuuugacgaggcuaaaacugcggccgaacgccgaguacaaagaaauucccgucgcagacugaaaagaagaaaauggaggcuaaacuuacuggaagaaauuuucuccgaugaaauaaugaaaaucgauagcaauuucuucagacgauuaaaagaaucaucacuuuggcuagaagacaaaaacagcaaagagaaauucaccuuauucaaugacgacaauuauaaagauuaugacuuuuacaaacaauacccaacgauauuccaucuacgggacgaacuaauaaagaaccccgaaaaaaaggacauaagacugauauaucuagcgcugcacagcauuuucaaaagccguggacacuucuuauucgaagggcaaaauuuaaaagaaauaaaaaacuucgagacauuauacaacaaccuuauuagcuuccuggaagauaauggaauaaacaaauccauagauaaggacaauauaaaaaaacuagaaaaaauaauuugugauagcggaaaaggguuaaaggacaaggaaaaggaauuuaaagaaauauucaauagugauaaacaacucgucgcaauauuuaaauuaagcgugggaaguucuguaucacuaaaugaccuauucgacacugacgaauauaagaaagaagaagucgaaaaagaaaaaauaaguuucagagaacaaaucuaugaagacgauaaaccaauauacuacagcauucucggggaaaaaaucgaacugcuagacauagcaaaaucuuuuuaugauuucaugguacucaauaauaucuuaucagauucaaacuacaucucugaagcaaaaguaaaacuuuacgaagaacacaaaaaagaccuaaaaaaccuaaaauauauuauacguaaauacaacaaagagaauuacgauaaacuauucaaagauaaaaacgagaauaacuauccagcauacauaggccuaaauaaagaaaaagguaagaaagagguuguugaaaaaucaggacugaaaauagacgauuuaaucaaaguaauaaaaggcuacuuaccaaaaccagaaagaauugaagaaaaagauaaaaccaucuuuaacgaaauccuuaacaaaaucgaacucaagaccauacuuccuaagcaaagaaucagcgacaauggaacacucccuuaccaaauacacgaagucgaauuagaaaaaauacucgagaaucaaaguaaguacuacgacuuccuaaauuaugaagaaaacggcguaagcacaaaagauaaacuacugaaaaccuuuaaguuucgcaucccauauuauguagggccacuuaacucauaucacaaagacaaaggagggaacucauggauaguuagaaaagaggaaggcaaaauacuaccguggaacuuugagcaaaaagucgauauugagaaaucggcagaagaauucauaaaaaggaugacaaacaaaugcacauacuuaaacggcgaagauguaauaccaaaagauucauuccuauacagcgaauauauaauacugaacgagcuaaacaaaguacaaguaaacgaugaauuuuuaaaugaagaaaacaaaagaaagauaauugacgagcuuuuuaaagaaaauaagaaagugucagaaaaaaaauucaaagaauaucuucucguuaaucaaauugcaaaccgcacaguagaauuaaaaggcauaaaagacaguuucaacucaaauuacguaucauacauaaaauuuaaagauauuuucggagaaaaacuaaacuuagacauauauaaagaaauuucagaaaaaucaauauuauggaaaugccuuuacggcgaugauaaaaaaauauuugaaaaaaaaauaaaaaaugaauacggcgauauucuaaauaaggacgagauaaagaagauuaauagcuucaaauucaacacauggggaaggcucagugaaaagcuacucacaggcauugaauucauaaaucuggaaaccggggaaugcuauaguucgguaauggaggccuuaaggcgcacaaacuauaacuugauggaguuacuaucaucaaaauucacacuacaagaaucuauagacaauggaaacaaagagaugaaugaggucuccuacagagacuuaauagaggaaaguuacgucagcccaucuuuaaaacgagccauacuucaaacucuaaaaauauaugaagagauaaaaaaaaucacaggaagggugcccaaaaaaguauucauagaaauggccagaggcggagacgaaaccaugaaaaauaaaaaaaucccugccagacaagaacaacuaaagaaacucuacgacuccugugggaacgauaucgcuaacuuuaguaucgacauuaaaaaaaugaaaaguaguuuaucaucauaugacaauaacucuuuaagacaaaaaaaacuuuaccuauauuacuuacaguuuggcaaauguauguauacaggacgggaaaucgaucuagaucgccuccuacaaaacaacgauaccuaugacaucgaccauauauacccccgauccaaggucaucaaagacgacucauuugacaacuuggugcuuguucugaagaacgaaaacgcagaaaagucaaacgaauacccuguuaaaaaggaaauacaagaaaaaaugaaaaguuuuuggcgauuucuaaaggaaaaaaacuucaucucagacgaaaaauacaaaagacucacaggcaaagacgacuucgaacugaggggauucauggcaagacaacuagucaacguacgacagacaacgaaagaagucggaaaaauauugcaacaaauagaaccggaaaucaaaauaguauauagcaaagcagaaaucgcgaguuccuuuagagaaauguuugauuucauaaaagugagagagcuuaacgauacacaccacgcaaaagacgcauacuugaacauaguagcagguaacguuuauaauacaaaauuuacagaaaaaccguacagauaucuucaagaaaucaaagaaaauuaugauguaaaaaaaauauacaauuacgacauaaaaaacgcaugggauaaagagaacagucucgaaauagucaagaaaaauaugaaaaaaaacacagugaauauaacaagauucauuaaggaagaaaaaggacaacuuuuugaucucaacccaauaaaaaaaggagaaacaagcaaugaaauuauaucaauaaagccuaaacuauauaauggaaaagaagaaaaacuaaaugaaaaauacggcuacuacaagucauuaaacccagcauacuucuuauacguggaacauaaagaaaaaaacaaacggauaaaauccuuugaaagagucaaccuaguagacguaaauaauauaaaggacgaaaaaucgcuugucaaauauuuaauugaaaacaaaaaacucguugaaccaagguuaauaaaaaaaguauacaaaagacaagugauacuaaucaaugauuacccauauuccauaguagcucuagacucaaauaaacuaauggauuucgaaaauuuaaaaccacuauuccuagaaaacaaauaugaaaaaauacucaaaaauguaauaaaauuuuuagaagacaaccaaggaaagucagaagaaaauuauaaauuuaucuaucucaaaaaaaaggacagauacgagaaaaacgaaacauuagaaagcguaaaagaccgauauaaccuugaauuuaacgaaauguacgauaaauuccuagagaaacucgauucaaaagacuacaaaaacuauauaaacaacaaaaaguauaaaaaucugcuagaugucaaagaaaaauucaucaaacucaaccuguucgauaaagcguucacacuaaaaaguuuucuagaucucuuuaaucgcaaaacuauggcagacuuuucaaaaguaggacucaccaaauaccucgggaaaauacaaaaaauuucaagcaacguacucagcaaaaacgaacuauauuugcuugaagaaucugucacgggauuauucguaaagaagaucaaauuauga

SEQ ID NO: 8897 - RNA, 4104 nt, Artificial Sequence
  Cas9 variant
augaaaaaacagcaauuuagcgauuacuaucucgguuuugacauaggaacaaacucaguaggauggugugucacagauuucaacuacaacguacuacgauuuaacaaaaaagauauguggggauccagacuuuuugaugaagcaaaaaccgcggcagaaagacgaguacaaagaaauuccagacgaagacuuaaaagaagaaaauggagguuaaaccuccuugaagaaaucuucagugaugaaauccuaaaaaucgacuccaauuuuuuccgacgacuuaaagaaagcaguuuauggcuagaagacaaaagcucaaaagaaaaauuuacacuauucaacgaugauaacuacaaagacuacgauuuuuauaaacaauacccaacaauuuuccacuuaagaaaugaacuuauaaaaaauccagaaaaaaaagacauacgguuagucuaccuagcccuacacagcaucuuuaaaucacguggacauuuucuuuuugaaggacaaaaccucaaagacaucaaaaacuucgaaacacucuauaacaaccuaauggccuuucuugaagacaaugacauauacaaaaauauagacucuagcuacauagguaaccuagaaaacaucauaugugauucaaaaaaaggacuaaaggauaaagaaaaagaauucaaagaaaucuuuaacagcgauaaacaauuagucggauuuuucaaauuguccguuggauccagcguuucacucaacgaccuauucgauaccgacgaauacaagaaaggugagguagaaaaagaaaaaauaucuuuuagggagcaaauauaugaagacgauaaaccaauauacuauucaaucuuaggagaaaagauugaauucuuagacauagcuaaaucguucuacgauuucaugguacuaaacaacauacucgcagacucacaauacaucuccgaagccaaaguaaagcuguaugacgaacacaaacgugauuuaaaaaaccuaaaauacauaauuagaaaauacaauaaggaaaacuaugauaaacucuucaaagauaaaaaugaaaguaacuacagugcauacauaggacucaacaaagaaaaaggcaaaaaagaaguaauagagaaaucacgucuaaaaauagaugacuucgccaagauaauaaaaggauaccuaccaaaagccgaaaaaauagacgaaaaggaccguagcauuuucaaugaaauauuagauaaaauagaacuaaaaacuauacuuccgaagcaaaggauauccgauaauggaacucuacccuaccaaauacaugaagccgaacuagaaaagauauuagaaaaccaggcaaaauauuaugacuuccuaaaccaugaagaaaaugguauuucaacuaaagauaaauuacucaugacauucaaauuuagaauucccuacuacguaggaccacucaacagcuaucacaaaaacaaagguggaaauucauggauuguccgaaaggaagaaggaaaaauuuuaccauggaacuucgaacagaaaguagacauagaaaaaucggcagaagaauuuaucaaaagaaugaccaacaaaugcacauaccuuaauggagaagacguaauaccaaaagacaguuuucuauacucagaauauauaauauuaaacgaacucaauaagguacagguaaacgacgaauuccucaauaaagaaauaaaaaaaaaaaucaucgaagauuuauucaaaaaaagcaaaaaaauaucagaaaagaacuucagagaauaucuacuaguaaaucaaaucacaaacaaaaccguagaguuaaaaggaguaaaagaugcuuuuaauagcaacuacguauccuauaucaaauucaaagauauauuuggugacaaacuaaaucucgacauauacaaagaaauaagcgaaaaaaguauauuauggaaaugccucuauggagacgacaaaaaaauauuugaaaaaaaaauaaaaucuguauacggugauauacuuacaaaagaugaaauuaaaaaaaucaacucguucaaguuuaauacuuggggaagacuaucagagaaacuacuuacagaaauagaauuuauagaccuggaaacuggagaaugcuauagcagugugauggacgcacucagaagaacaaacuacaaucugauggaacuguuaaguucuaaauuuacauuacaggagaauauagacaacgaaaauaaagagguuuccgaauuuucauaucgggacuuagucgaagaauccuacgucucaccgucacuaaagagagccaucuuacaaacacucaaaauauacgaagagauaagaaaaauaacuggaagaauaccaaaaaaaguauucauagaaauggcacgagguggggacgaaacaaugaaaaauaaaaaaauaccggccagacaagagcagcuaaaaaaauuauaugauucauguggaaaagauauaucaaacuucucaauagauauaaaagaaaugaaaaacucauuaaacucauaugauaacaauucacugagacaaaagaagcucuaucucuacuauuuacaauucggcaaaugcauguauacaggaaaggagauagaccucaaccgccuacuacaaaacaacgauacauacgacaucgaccacauauaucccaggucaaaagugauaaaagacgacucuuucgacaaccuaguauugguauuaaagaacgagaaugcagaaaaauccaacgaauacccucugaaaaaagaaauacaggaaaagaugaaaagcuuuuggaaauuuuuaaaggaaaaaaacuucauaucugacgaaaaauauaaaagguuaacagguaaagaugaauucgagcuaagaggcuuuauggcacggcaacuggugaacguuagacaaaccacaaaagaagcaggaaaaauacuucaacaaauagaacccgaaaucaaaauagucuauaguaaagcagaaauagccucaucauuuagagaaauguucgacuuuauaaaaguacgggaacuaaaugacacccaucacgccaaagacgcauauuuaaauauuguggcaggaaauguuuacaacaccaaauuuaccgaaaaaccauaucgauacuuacaagagaucaaagaaaacuacgaugucaaaaaaauauacaacuacgauauaaagaaugcaugggacaaagaaaaaucccucgaaauugucaaaaaaaauauggaaaaaaacacaguaaacauaacaagauucaucaaagaagaaaaaggucaacuguuugaucuaaacccgauacgaaaaggagagacaaguaaugaaaucauagcuauaaaaccaaaauuuuaugaaggaucaacagaaaaacucaacgaaaaauacgguuacuacaaaucacuuaacccggccuauuucauauaugucgaacauaaagaaaaaaauaaaaucaucagaagcuucgagcgagugaacuuaguagacguaaauaaaauuaaagacgaaaaaucacuaaucaaauacuugauagaaaacaagggauuaaucgagccaaaaguaauaaaaaagguuuacaagaggcaagucauccuaauaaacaacuucccuuauucaauagucgcccuugacuccaacaaacugauggacuuugaaaauuuaaaaccacuuuuucuagaaagaaaauacgaaaaaauucuaaaaaacgcgauaaaguuccuagaagauaaccagggaaaaaccgaagaauauuauaaguuucuuuaccuaaaaaaaaaagacagaaaugaaaaaaaugaaacuauagacucagucaaagaacgguacaacauagaauuuaacgaaauguacgauaaguuccucgaaaaauuagauagcaaagauuauaaaaauuauauaaacaauaagaaauacucagaacucgucaacgucaaagaaaaguuuauaaaacuaaauuuauucgauaaagcauucacccuaaaaagcuuuuuagaccucuuuaaccgaaaaacuauggcagacuucucaaaggucggcuuaaccaaauaccucgguaaaauacaaaaaauaucgagcaacguauuauccaaaaacgaacuccacuuguuagaagaaucaguaacaggacucuuugucaaaaaaaucaaacuauga

SEQ ID NO: 8898 - RNA, 4104 nt, Artificial Sequence
  Cas9 variant
augaaagauuauuaucuagggcucgacaugggauccucuucaguagguugggcacugucugaugaacgguacaaccuacuaagagcaaaaggcaaagauuuguggggcguucgucucuuugaugaagcaaagaccgcggcagagcgccguacuuuucgaucacagcgacgacgacucgaacgcuccaaauggcgauuauccuuacuaaccagccuuuucgaagaggaaaucuccaaaauugacgauaaauucuuugauagauuaaaagauucgaaauucuuuaucgacgauaaaucagaucaacagccaaacaccuuguuuaaugacguaaacuuuaccgauaaagaauaccauaaaagauacccaucaaucuaccaccuccgaaacgcauuauucaaccaaaacgauaaauuugacauacgacucauauuccuugcguuaucacauauaguaaaaaagagagggcacuuccucuuugauggagacaaagccggcuucggugaagacauagacguaauucucgacgaacuaaaagcauaucuucaggaugcuuuccacacaaaacuagaauuuacaucagaguuuaaaucaauuaugcucgauaaaaaccucagaaaaaaacagaaagaagaagaauuaaaaaacuccaucaaaaucucaagugacacaauaaacagcaaagacggcaaaagcauuuugauaaaacuauuucuuggguaugaggcaaaccuuaaaccguuuuucuuagaauauaaagucgaaaaagacaacgaauauaaaauaaauuucucaaaagaggauuacgaagaaaaacuacuagauaugacuagcaaauucgaagaaacaaccuacuucauugaaauugccaaaaaaauacacgauuauuuuuuacuugaagaaauaaugcuaggauucaaaaacauuucagcuucaaaagugucaaucuaccaaaaacauaaaaacgaucuaaaaacccuaaagaacauaguaaaaaaccaaauaaacaacuccuauaacgcaaucuucaaagacauaggccuagauaauuauccagcauacguuucauguuggaauucaaaaaaacacaaggaaaaacaaaaaggaugcacaaaagauaaauucuacgcuuuccuuaaaacgaaauuaaaaaauaucaacaacgcaaaagaaauauuagacucgauugacaaugaugauuucuuaccuagauuaguagacaagaacucaauaaucccucaccaaauucaucucgcagaguuaaucaaaauaauagauaaucaaucacaauacuacccauuuuuaaaagaaauuaaagauaaaauaauaaguauauucaaauuuaggauuccauucuacgucggaccccuuaacaauuuccauaaagauaaagggggcaaugcauggaucgaaaaguugaaagaugagagaauauuucccuggaauuuuaacgacgucguagaccuaaauaaaagcgcagcuaacuucaucgaaaaaaugaucaacgaauguucuuacuuaaaaggagaaaaaguacuagcaaaaaacucauuacucuauacuaaauacagugucuuaaaucucauaaacaaacuaaaaauaaacgguaccgcuguguccguggaaacaaaacagaaaauauacaacgaacuauugcuaaaacaaaaaaacauaaaaaaaaccgcaauuaaaaaauuucuuauaaauaacucaauaaucgacaaaaacgacgaaauuucaggcaucgaugacuccuuaaccucaaacuuagcaguauucauagacuucgaaaaaaucucuaaccgccucagguaugaccaaaaagaagacauaaucaagucgaucucgcuguuuggcuacgauaacgcaaugcugaaaaaacagauaauaacaauagcacccgaucucagugaagaugaacuagaaaaacuaucuaaauugagauacucaggauuuggacgguugaguaaacgccugcucaccuccauaaaacacaaugguaaauccauaauugaaaugcuaugggauacaaacgauaaccuaauggaauuauuaucagaucgauauacuuucaucgaacaaauaaauaaacacaaugauggauucaaagaagacaucaauuuaaauuuccaaaacguagacacacuauacgucucgccgagcguuaaacgacaaauauggcaagcauuuaaagucauaaaugaacuaaucucagucaugggccgugaaccaaaaaaaauauucguagagauggccagagaagaaggcgagaaaaagagaacccaagcaagaaaggacaaaguacuugaauuauauaaaucaauaaaaaauaacgaaauauccacauuuuuaacuaauuucaaagauauaaaaacaaaacuagagggcgaaucaaaucuaaacaguaaaaaauuauacuuauacuaucuacaacuaggaguagauauauacaccggugaaaaaauaccauucgaaaaacuauucgaccaaaacaucuacgauauugaccacguaauaccacgaucauuaaaaaaagacgacaguuucgauaaccuuguacuaacaagcaaaacaaauaacgcaaaaaaaacagaugaauucccugucuccucagaaauacaaucaaaaaugcaaaccuucuggaagguucuaaaagacaaggacuuaaugagugaaaucaaauauacaaaucuaacacgcaaaacacaccucagcgacgacgaacuaggcgacuuuauugcuaggcaacuaguagaaacgcgccaaucaacuaaagcccuaacacaaauccuaaaaaaugucuaugcuaacagcgauauaguuuacguaaaagccggcauagucucagaauuucgacaacaauucgacaugcuaaaaaucagagaauuaaacgauuuccaccaugccaacgaugcauaucuaaacauugucaucggaaacguauacaacauuaaauucacaaaaaauccaagaaauuauguaaaagaauacuacaaaaaaggagaacauuauaacuuaaagaucgaaaaaaugcuagagaaagauauagcaaggggcggcaauuucgguugggauaaaaaacauucuaucgaaaccguucaaaagaccaugaaaaaacagucccccuuaauaaccuacagaacauucgagaacaaaggugaauuuuucaaucaacagccaucaaaagcaucggcuaacuuacucgcauuaaaauccucugacaaacgcuuacucgacacaguaagguauggagguuauaaaggaacacaauaugcucacauguucuuaguagaacacuucaacggcaaaauaauaaaagaaauuaugggagugccaaucuaccuaucaaaagaaauaaaagacgauaaagcaaaauuacuagaguauugcaaugacguacuaaaacuuaaaaauccuaaaauacuuuuuaguaaaauaccauauaauucucuaaucguauacaacggauacccaauccuacugagaggacucacaggaguaagaggggcagcccaauuaaaacuugaccagacauccacucaaguaguaaaaaauauagugaaacuauacgauugguuaucgcaaaaacaaaaagaacuaucagacuugagcaagaaaaucgaauuuuuccaagaaaacaacaagaaagacgaagugaaggcggccauguuagaagcagauaacauucucuuuauauuaaacgacagauucaaaaauacaaaaauagguaaagacauaaugaaugauaaucaccuuaauaaccuauacgauacauuuauaaacaaauuagaaaacaguaucuauaaaaacaaaccaggcggaaaacaagacguauuaaugaaagaaaagagagaccuauuccuguccuucucgaugucaaaaaaaugcauaacacucuacaaaauaaucaaaauauucggaaguugcgaucaaggcgucgacuucagugauaucgccgaaaaaauuuccaaauccgguggaauaggcggcaaaaaucuagguaaaaacacauucgaccucguguuuaaagaaaauucaacuuacacuuugguacaauccagcguuacagguuuauacgccaaaaaaaccgaccuccacaaacucuga

SEQ ID NO: 8899 - RNA, 4104 nt, Artificial Sequence
  Cas9 variant
augaaaaaacaaaaauucucagauuacuaccucggauuugacaucggaaccaacucaguuggcuggugugucaccgauuuagacuacaacguacuacgauuuaauaaaaaagacaugugggguaguagauuauuugaagaagccaaaacagcugcagaacguagaguccaaagaaacagccgacggagauuaaaacgaagaaaauggagacuaaaccucuuagaggaaauauucagcaacgaaauacuuaaaauugacuccaauuucuuccgaagacucaaagaauccagccuaugguuagaagacaagucaucaaaagaaaaauucacgcucuucaacgaugacaacuacaaagacuacgacuucuacaaacaauaccccacaauauuucaccuaaggaaugagcucauaaaaaacccagaaaaaaaagacauacgauuaguauacuuagcuauccacucuauauucaaaaguagaggacacuucuuauuugaaggacagaacuuaaaagagaucaaaaauuucgaaacauuauacaauaacuuaauagcauuucuagaagauaacggaauaaauaagauaaucgauaaaaacaauaucgagaaacuagaaaaaauuguaugcgacuccaaaaaaggacuuaaggacaaagaaaaagaauucaaagaaaucuuuaauucggacaaacaacugguagcaauauuuaaacuuaguguuggcucaagcgucagccuaaacgauuuauucgacacggacgaauacaaaaaaggagagguagaaaaagaaaaaaucucauucagggaacaaauauacgaagaugauaaaccaaucuauuacagcauacuuggugaaaaaauagaacuacuagacauagcaaaaacuuuuuacgauuucaugguacuaaacaacaucuuagccgauagccaguauauaucagaggccaaaguaaaacuauaugaggaacacaagaaagaccucaaaaacuuaaaauacauaauacgcaaguacaacaaagguaauuaugauaaacuauucaaagacaaaaacgaaaacaacuauucagcuuauauaggguuaaauaaagaaaaaagcaaaaaagaaguaaucgaaaaaagccgcuuaaaaaucgacgaucuaauuaaaaacauaaaaggauaccuaccuaaaguugaagaaauugaagagaaagacaaagcaauuuucaacaaaauacuaaauaaaauagaacugaaaacaauccucccaaaacaacgcauaucagauaacgggacacuaccauaccaaauacacgaggccgaauuagaaaaaauauuagaaaaucaaaguaaauacuaugacuuucugaacuacgaagaaaacggcauuauaacaaaggauaaauugcuaaugaccuuuaaauuucgaauuccauauuauguagggccccugaauagcuaccacaaagauaaaggcgguaauucauggauaguaagaaaggaagaaggaaaaauauuaccauggaauuucgaacaaaaagucgauaucgaaaaaagcgccgaggaauuuauaaaacguaugacuaauaaauguaccuaucugaacggagaagacgugauucccaaagacacauuccuauacuccgaguauguaauucuaaacgaacuaaauaaaguacaaguaaacgaugaauuucucaaugaagaaaacaaaagaaaaauaauagacgaauuauuuaaagaaaauaaaaaagucuccgagaaaaaauucaaagaauaccuauuaguuaaacaaaucguugacggaaccauagaauuaaaaggaguaaaggacucauuuaacucaaacuauaucucauacaucagauuuaaagauauauucggcgaaaaacuuaaccuagacauuuacaaagaaauaagcgaaaaaagcauauuauggaaaugccucuacggcgaugauaaaaaaauauucgaaaaaaaaauaaaaaacgaauacggcgauauacugaccaaagacgaaauaaaaaaaauaaacacuuuuaaauucaacaacuggggcagacugagugaaaaauuguuaacaggcauugaauucauaaaccuagaaacaggcgaaugcuauaguucaguuauggaugcauuaagaagaacaaauuauaaccuaauggagcugcuaagcuccaaauuuacauuacaagaaagcauuaacaacgaaaacaaagagaugaacgaagccagcuaucgcgacuuaaucgaagaaagcuacguaucgcccucacugaaaagggcuauauuucaaacacuaaaaauauaugaagaaauacgaaaaauaacagguagagugcccaaaaagguauuuauagaaauggcacgaggaggagacgaaagcaugaaaaacaaaaaaaucccagcgcgacaagaacaacuuaaaaaacuauacgacucaugcgggaacgacauagcaaacuuuagcauagauauaaaagaaaugaaaaauucucucauaucauaugacaacaauagucuaagacaaaaaaaacuauaccuguacuaccuucaguucggaaaaugcauguacaccggcagagaaauagaucuagauagacucuuacaaaacaaugacacauaugauauagaccauauuuaccccagaagcaaaguuauaaaagaugacagcuuugacaaucuuguucuaguauuaaaaaacgaaaacgccgaaaaaucaaacgaauacccugugaagaaagaaauacaagaaaaaaugaaaaguuucuggcgauuccuaaaagaaaaaaauuuuauaucagaugagaaauauaaaagauuaacaggaaaagaugacuuugaauuaagaggcuuuauggcccgacaguuggugaauguucgucaaaccacaaaagaggucggaaagauacuacagcaaauugaaccagaaaucaaaaucgucuauuccaaagccgaaauugccaguaguuucagagaaauguucgacuucauaaaaguaagggaacuaaaugauacucaccacgccaaagacgcauacuuaaacaucguagcaggcaacguauauaacacaaaguuuacagaaaagccguauagauauuuacaggagauaaaagaaaacuaugacguaaaaaaaauuuacaauuaugacaucaagaaugcaugggacaaagagaacucauuagaaauaguuaaaaaaaacauggaaaaaaacacgguuaacauaacacgauuuauaaaggagaaaaaaggccaacuauucgaccuuaaccccauaaaaaagggagaaacgucuaacgaaauaauaaguauuaaaccaaaaguauacaauggaaaagacgauaaguuaaaugaaaaauacggauacuacaagucucucaauccagcuuacuuucuauacgucgaacauaaagaaaaaaacaaacgcauaaagagcuucgagcgagucaaccuaguagacguaaacaacaucaaagacgagaaaucccuagucaaguauuuaauagaaaauaaaaaguuaguagaaccuagaguaauuaagaaaguauacaaaagacaagugaucuuaauaaacgacuaucccuacucaauaguaaccuuagacagcaauaaacuaauggacuuugaaaaccuaaaaccacuauucuuagaaaauaaguaugaaaaaauacuaaaaaacguuauaaaauuccuagaagauaaucaagggaagagcgaagagaacuacaaauuuauuuaucuuaaaaaaaaagaccgauacgaaaagaacgaaacauuagaaagcgucaaagauagauacaaccuggaauuuaacgagauguaugacaaguucuuagaaaaacuggauaguaaagacuacaaaaacuauaugaacaauaaaaaauaccaggaacuacuagauguuaaagaaaaauucauaaaguugaacuuauucgauaaagcauuuacuuugaagagcuuccuagaccuauucaauagaaagaccauggccgacuucagcaaagucggacuuacaaaguacuuaggcaaaauacaaaaaaucuccucaaacguacuaagcaagaacgaacuauacuuauuagaagaaagcguaacaggauuauucgucaaaaaaauaaaauuauga

SEQ ID NO: 8900 - RNA, 4104 nt, Artificial Sequence
  Cas9 variant
augaaaaagcaaaaauucagugacuacuaccuagguuuugacauaggaacgaauuccgucggauggugcguaacagauaugaacuacaacguucuuagauucaacaaaaaggauauguggggaucgcgguuauucgaagaagcgaaaacggcugccgaacguagaguacaaagaaacaguaggcgaagacucaagcgaagaaaauggcgccuuaaccuauuagaagaaauuuucucuaaugaaauccuaaaaauagauagcaacuuuuuuagacgauuaaaagaauccagcuuauggcuagaagauaaaagcucgaaagaaaaauuuaccuuguuuaaugacgacaacuacaaagacuacgacuucuacaagcaauauccaacaauauuucaucuuagaaaugaacuaauaaaaaaccccgaaaaaaaagacauaagacuaguauaccuagcgauccacagcaucuucaagagcaggggccacuuucuauuugagggacaaaacuuaaaagagauaaagaacuucgaaacacuauauaacaaucuaaucgccuuucucgaagacaacgguauaaauaaauccaucgacaaagauaaccucgaaaaauuagaaaaaaucguaugugacucugguaaaggccuaaaagauaaagaaaaggaauuuaaagaaauauuuaacucagacaaacaacucguagccauauuuaaauuaucgguaggacucagugucucacuaaaugauuuauucgauacugacgaauacaaaaaaggagaggucgaaaaagaaaaaaucagcuuccgugaacagauauacgaagacgauaaaccaaucuacuauagcauacuaggugaaaaaauagaacuauuagacaucgccaaaagcuuuuaugacuuuaugguacuaaauaauauccucgcagauagccaauacaucagugaagcaaaaguaaaauuauaugaggaacacaaacgagaucuaaaaaaccucaaauauauaaucagaaaauauaacagggaaaauuaugacaagcuuuucaaagacaaaaacgaaucuaacuauccagcauacauaggacuaaacaaagaaaaaucaaaaaaagaaguaaucgaaaaaaguaaacuaaagauugacgaccuuauuaagucgauuaaaggauaucuaccaaagguagaagaaaucgaagaaaaggauaaagcaauauucaaugaaaucuuaaacaagauagaacucaaaaucauacuccccaaacaaagaauaucggacaacggaaccuuacccuaucaaauacacgaggcggagcuagaaaaaauauuggaaaaccaauccaaauauuacgacuuucuuaacuaugaagaaaacggaaucauuacaaaagacaaacuacuuaugacauuuaaauucaggauaccauauuacguaggaccacuaaauucauaccacaaagauaagggaggaaacucuuggauaguuagaaaagaagaagggaaaauauuacccuggaauuuugaacaaaaaguagacauagaaaaaucugcagaagaauuuauaaaacgaaugacgaacaaauguacauaucuuaauggcgaggacguaauaccaaaggauucuuuuuuauauucggaauacauaauacuaaaugaacuuaauaagguccaaguaaacgaugaauuccuaaacgaggaaaacaaaaggaagauaauugaagaauuauuuaaaggcaauaagaaaguuuccgagaaaaaauuuaaagaauaccucuuaguuaaccaaauaacaaccgggacuauagaacucaaaggaauaaaagacucuuucaacagcaacuacauuucauacauaaaauuuaaagacaucuuuggagaaaaacugaaccuagacauuuacaaagaaauuuccgaaaaaucgauauuauggaagugcuuauauggagacgauaaaaaaauuuuugaaaagaaaauaaaaaaugaauauggagacauccucacaaaagaugagaucaaaaaaauaaacacauuuaaauucaauaacugggggaggcugagugaaaaguuauuaacaggcauagaauuuauuaaccuagaaacaggagaaugcuacagcagcguaauggaagcccucagacgcacaaauuacaacuuaauggaacuacuaagcucaaaauucacucuacaagagaauaucgacaaugaaaacaaagacaucucucaauucagcuauagggaccuaguagaagaaagcuauguguccccaagccuaaagagagcgauacuccaaacauuaaaaauauacgaagaaauaaaaaaaauaaccggaagggucccaaaaaaaguauuuauugagauggccagagggggagacgaaagcaugaaaaacaaaaaaauaccggccagacaagaacaauuaaaaaaacuauacgacagcuguggaaacgauauagcaaacuuuagcauagacauaaaagagaugaaaagcucauuaucauuauaugacaauaacucacuacgacagaaaaaauuauaccuauacuaccuacaauucgguaagugcauguauacaggaagagaaauagaucuggauagacuacuacaaaacaacgauacauacgacaucgaucacauauauccaagauccaaaguuaucaaggaugauuccuucgauaacuuaguucuaguacuaaaaaaugaaaaugcugaaaaaucaaaugaauacccaguaaaaaaagaaauacaagaaaaaaugaaauccuucuggcgcuuucucaaagagaaaaauuuuauaucagaugaaaaauauaaaagguuaacagggaaagacgauuucgagcuaagaggcuuuauggccagacagcuaguaaacguuagacagaccacaaaagaagugggaaagauauuacagcaaauugaaccagaaauaaaaauuguauacuccaaggcugaaauagcuagcagcuuccgagagauguucgacuuuauuaaaguuagagaacucaaugauacgcaccacgcaaaagaugcauacuuaaauauaguagcaggcaacguuuauaacacaaaguuuacagaaaaaccauaucgcuacuuacaagaaauuaaagaaaacuaugacguaaaaaaaauauacaguuacgauauaaaaaacgcaugggauaaagaaaacucgcucgaaauagugaaaaaaaauauggaaaaaaacacgguaaauauaacacguuuuaucaaagaagaaaaaggucaauuauuugaccuuaauccaauaaaaaagggugaaacaagcaacgaaaucauaucuauaaaaccaaaagucuacaacggaaaagacgauaaacuaaacgaaaaauacggauacuauaaaucucuaaauccagcauauuuccuguauguggaacacaaagaaaagaacaaacgaaucaaaagcuucgaaagaguaaaccuugucgacguaaauaauauaaaagaugagaaaucccugauaaaauauuuaguagaaaacaaaaaacucguugaaccaagaguaaucaaaaaagucuacaaacgucaagucauauuaauaaacgauuacccauacucgauaguggcauuagauucaaacaaacuaauggacuucgaaaacuuaaaaccacuauuuuuggaaagaaaauacgaaaaaauauuaaaaaauguaauaaaauuccuagaagauaaccaaggcaaaagugaagaaaacuauaaauuuauauaccuaaagaaaaaagacagguacgaaaaaaacgaaacauuagagucaguccgugaacgauauaacauugaauuuaacgaaauguacgacaaguuccuggagaagcucaauucaaaagauuauaaaaacuacauaaacaauaaaaaauaccaagauuuacuggauguaaaagaaaaauucauaaaauuaaaucucuucgauaaagcauucacacuaaagagcuucuuagacuuauuuaacagaaaaacaauggcagauuuuucaaaagucggacucacaaaauaccuugguaaaauucaaaaaauaagcaguaacguccugucaaagaaugaacuauaccuauuggaagaaucuguaacuggacuauuuguaaaaaaaauagaacuauga

SEQ ID NO: 8901 - RNA, 4104 nt, Artificial Sequence
  Cas9 variant
auggucaaaaagaaguacgcuaucggaaucgacaucggaacaaacucaguagguuggucaguagugacagaugauuacaaagucccuagcaagaaaaugaaaguauucgguaauacagaaaaacguuauaucaagaaaaacuuacugggaacacuuuuauucgacgaaggcaacaccgcugaaaauagaaggcucaaaagaacagcaagaagaagauacaccaggagacguaacagaauauuauacuugcaagaaauauuugcagaagaaauaaacaaaauagacgacagcuuuuuccagagauuagacgacuccuuuuuaauaguagaagacaaacaaggaucaaaacacccuauuuucggcacauuacaagaagaaaaagaauaccauaaacaauucccuacaauuuaucacuuacgcaagcaauuagcugacucaucucagaaagcagacauaaggcuuauauauuuagcacucgcucacauaauuaaauaccggggacauuucuuauuugaaggagaucugaaaucagaaaacaaagacguccagcacuuauuuaacgauuucguagaaauguuugacaaaacuguagaaggaagcuaccuaagugaaaaccuacccaacguagcagacguucuagucgaaaaagucuccaaaagcaggagacuagaaaacauacuucacuacuuuccaaaugaaaagaaaaauggacuauuugguaacuucuuaacauuagcacucggacuacagccaaauuucaaaacaaacuuugaauuagcagaagaugcaaaaauacaauuuucuaaagaaaccuacgaagaagaccuagaagaauuacuaggaaaaauaggugacgacuaugcggacuuauuuauagcaacaaaaucccuguaugacggaauacuccucgcaggaauauugucaacaacagacuccacuacgaaagcaccacuaagcucguccaugguaaaccgauacgaagaacaccaaaaagaucuagcacuauugaaaaauuuuauacaucagaaccuaucagacucauacaaagaaguuuucaaugacaaacuaaaagacgguuacgccggauacauagaaggaaaaaccacacaagaaaauuuuuauagguucaucaagaaagcaauagagaaaauugaagguagcaacuacuucauugacaaaauagauagggaagauuuccuaagaaaacaacgaacuuuugacaacgggucaauaccucaucaaauacaccuacaagaaaugcacgcaauaaucagaagacaggcagaauuuuauccauuuuuaguugaaaaucaagauaaaauagagaaaauauuaacuuucagaauaccauacuacguuggaccacucgcccgcggcaaaagugaauuugcuuggcuaaauagaaaaucugacgagaaaauucgaccauggaauuucgacgaaauggucgauaaagaaacauccgcugaaaacuucauaaccagaaugaccaacuaugaccaauaccuaccugaucaaaaagucuuaccgaaacacaguuuacucuacgaaaaauuugcuguuuacaaugaauuaacaaaaguuagauaugucacagaacaagguaaauccuuuuucuucgaugcaaauaugaaacaagaaaucuucgauggcguauucaaaguuuauagaaaaguaacaaaagaaaaauuaauggauuucuugggaaaagaauuugaugaauuuagaauaguagauuuacuaggacuagauaaagauaacaaauccuucaacgccagccuaggcaccuaccaugaccuaaagaaaauaguaucgaaagacuuauuagauaauccagagaacgaagacauauuagaaaacguuguccuaacacuaacauuauucgaagacagggaaaugauacgaaaaaggcuagagaaauacaaagacguccuaacggaagaacaaaggaagaaacuagaaagaaggcauuacacaggcugggggagguuaucagcgaaacuaaucaauggaauaagagauaaagucacaagaaaaacaauuuuagacuaucucaucgacgauggaacaucuaauagaaauuuuaugcaacuaauaaaugacgauaccuuaucauucgucgaugaaauccgauuagcucaagguuccggugaagcggaggacuauagagcagaaguacaaaaccucgcugguagcccugcaaucaagaaagguauauuacaaucccucaaaauuguugacgaacuaauagaaguaauggguuaugauccagaacauauaguuguugagauggcacgugaaaaccaauuuacaaaccaagguaggagaaacucacaacaaagauacaagaaaauagaaaaugcaauuaaaaaucucgacuccaaccuaaauucuaaaauacuuaaagaauaucccacaaacaaucaagcauuacagaacgaccgauuauucuuauacuaccuacaaaauggaaaagauauguacacagacgaggagcuugauauagaccaacuaagccaauacgacauagaccauauaauaccacaggccuucauaaaagacgacucacuagauaauaaagucuuaaccaaaucagcuaaaaauagagguaaaucagaugacguaccaucauuagaaauaguccacaagaagaaaaauuucuggaaacaacuacuugacagccaauuaauaagccaaagaaaauucgacaauuuaacuaaagcagaaagagguggacuaaccaacgaagauaaagcuagguucauccaaagacaauuaguggaaacacgacaaauaacaaaacacguagccagaauccucgacacacgauuuaauacaaaacuagaugaggcgggaaaccgaauuagagacccaaaaguuaauauuauaacacuaaaaucaaauuugguuucucaauucagaaaagauuaucaauuauauaaagucagagaaauaaacaacuaucaucacgcccacgaugcauacuuaaaugcagugguagccaccgcauuacuaaagaaauauccucagcuggccccugaauuuguauauggugauuauccgaaauacaauucuuacaaaucucgaaaaagugcaacagaaaaaguauuauucuacucaaacauaaugaacuuuuucagaagaguauuaguauauaguaaaacaggcgaagugcgcauaagaccaguuauugaaguuaacaaagaaacuggagaaauaguaugggauaagaaaucagauuuccgaacuguucgcaaaguacuuaguuauccccaaguaaacguagucaagaaagucgaaaugcaaacaggagguuucuccaaagaaucuauacuucaacauggugauuccgacaaacuaauuccacguaaaacugaaaaauuuuaccuagacacuaagaaauacggaggauuugauucuccaacaauagccuauucagucuuauuaauagcagauauagaaaaaggaaaagcuaagaaacuuaaaagaguuaaagaacucauagguauuaccaucauggaaagaauggccuucgagaaaaaccccauagaauuuuuagaacacaaaggauauaaaaacauccuagagaaaaacaucauuaaacuacccaaauauucauuauucgaacuagaaaacggcagacgacgucuauuagcaagugcaaaagaguugcaaaaaggcaaugaaaugauccugccaccacacuuaguuacauuauuauaucacucaucaaauauucauaaaauaacggaaccaauccaccugaacuacguaaauaaaaacaaacaugaguucaaagaacuauuacgacacaucagugauuuuucgacaagauacauauuagcucaggacagacuuuccaaaauugaagaacucuacgacaaaaacgacggcgaugacauaucagaccuaacaucaucauucguaaacuuacuaacauucacagccaucggagccccagcagcguucaaguuucugggaucuguuauagauagaaagcgguacacaagcauagcugagauacuagaagcaacauuaauucaucaauccgucaccggauuauacgaaaccaggauagaccuaaguaaauuagguggcgauuga

SEQ ID NO: 8902 - RNA, 4104 nt, Artificial Sequence
  Cas9 variant
auggugaaaaagaaauacgcgauaggcauugauauagguacaaauaguguaggauggagugucguaaccgaugauuauaaagucccuagcaagaaaaugaaaguauucggaaacacagaaaaacgauacaucaagaaaaaccuauuaggcacccuacuauucgaugaaggaaacacagcagaaaaccgucgacuaaaacggacagcaaggagaagauacacacgaagaagaaauagaauauuauaccuacaagaaauauucgcugaagaaauaaacaaaauagaugacuccuucuuccaacgcuuagacgacucguuucugauugucgaagauaaacaaggaucaaaacacccaauauuuggaacccuacaagaggagaaagaauaccacaagcaauucccaacaauauaucaccuccguaaacaacuagcagacuccucacaaaaagcugacauaagacuaauuuaccuugcauuagcacacauuauaaaauaucgcgggcacuuucuguucgaaggggacuuaaaauccgaaaauaaagauguucaacaucuauuuaaugacuuuguagaaauguucgacaaaacaguagaaggaucauaucuaucagaaaacuuacccaauguugcagacguauuaguagaaaaaguaucaaaaucaaggcgauuagaaaacauauuacauuacuucccaaacgagaagaaaaacggcuuguuuggaaauuuccuugcacuagcacuaggacuacaacccaauuucaaaacaaacuuugaacuugcagaagacgccaaaauacaauuuucuaaagaaacuuacgaagaagacuuagaagaacuacuuggaaaaauuggcgacgacuaugcagaccuguuuauagcaacaaaaucucuauacgauggcauauuauuggcaggaauacucucaacaacagauagcacgacaaaagcaccacuaucaaguucuaugguuaauagauacgaagaacaccaaaaagaucuagcacugcucaaaaauuucauacaccaaaaucuuuccgauucauauaaagaagucuucaacgacaaauuaaaagacgguuacgccggauauauagaaggaaaaacaacacaagaaaacuucuacagauucaucaaaaaggcaauagagaaaauagaagguaguaacuacuuuauagauaaaauugauagagaagacuuuuuacgcaaacaaagaacauuugacaaugguuccaucccucaucaaauacaccuacaagaaaugcacgcuauaauaagacgacaagccgaguucuacccauucuuagucgaaaaccaggauaaaauagaaaagauauuaacuuucaggauuccauacuauguagggccacucgcaagagguaaaagugaguucgcauggcuuaaccgaaaaucagaugaaaagauaagaccauggaacuuugaugaaaugguggacaaagaaacaagugcagaaaauuuuauaacgcgcaugacaaacuacgaccaauaccuaccagaccaaaaaguucuucccaaacacagccuacuauaugaaaaauucgcaguguacaaugaauuaacaaaaguuagauauguuacugaacaggguaaauccuucuucuuugaugcaaauaugaaacaggaaauauuugauggaguauucaaaguauaucgcaaaguuacuaaagaaaaacuaauggauuuucuaggaaaggaguucgaugaguucaggauaguagaccuccuaggauuagauaaagacaacaaaaguuuuaacgccagucuaggaaccuaccacgaucuaaagaaaauugugagcaaagacuuacuagauaacccugaaaacgaagacauacuggaaaauguaguacuaacucuaacacuuuuugaagauagggaaaugaucagaaaacgacuagaaaaauacaaagacguguugacugaagaacaaagaaagaaacuagaaagacgacauuauacaggaugggggcgucucuccgcuaaacuaauaaacggaauaagagacaaaguaacuagaaaaaccauccuugauuacuugaucgacgaugggacaucaaauagaaauuuuaugcaguuaauuaacgacgauacccuaucguuuguagaugaaaucagauuggcccagggaucaggagaggccgaagacuaucgcgcagagguacaaaacuuagcggguagucccgcuauaaagaaagguauauuacaauccuuaaaaaucguagacgaauuaauugaaguaauggguuaugacccugaacacauaguaguagaaauggcacgagaaaaccaauucacgaaccaaggacgcaggaacucacaacaacgauacaagaaaauagaaaaugcgaucaaaaaccuggauaguaaccuuaauagcaaaauacucaaagaauauccaacaaauaaccaggcauugcaaaacgaccgucucuuucucuacuaccuacaaaacggaaaagacauguauacugacgaagaacuagacauagaccaauuaagccaauaugacauagaucacauuaucccacaagcauucauaaaggacgauagccucgauaauaaaguuuuaacaaagucugccaaaaaucguggaaaauccgacgacguaccaucccucgagauagugcacaaaaagaaaaauuuuuggaaacaauuacuagacucgcaauuaauaucacaaagaaaauuugauaaccugaccaaagcagaaagggguggccuaacaaacgaagauaaagcccgguuuauccaaagacagcuaguagaaacuagacaaaucacaaaacauguagcuagaauccuagauacgagguucaacacaaaacucgacgaagcagggaaucguauaagggacccuaaagucaauauaauaacccuaaaaagcaaucucguaucacaauuuagaaaagauuaccaacuauauaagguuagagagauaaacaacuaccaccaugcccaugacgcauauuuaaaugcaguagucgcuacagcgcuacucaagaaauacccacaauuagcaccagaguucguguauggcgacuacccuaaauacaauucauacaaaucuagaaagucugcaacagagaaaguacuauucuauucaaauauuaugaacuucuucagaagaguccucguauacagcaaaacaggagaaguaagaauccgacccguaaucgaagucaauaaagaaacaggagaaauaguuugggacaagaaaucagacuuucgaacagugagaaaaguacugucuuauccgcaaguaaacguggucaaaaagguagaaaugcaaaccggaggcuuuucuaaagaauccauacuucaacauggagacagcgacaaauuaauaccucgaaaaaccgaaaaauuuuaucuagacacaaagaaauacggaggauucgauagcccaacaaucgcguacagcguacuacuaauagcugacauagagaaaggcaaagcuaagaaauuaaaacgaguaaaagaacucauaggcauuacaauaauggaacgaauggcuuucgagaaaaacccaauugaauuucucgaacacaaaggauauaaaaacauuuuagagaaaaauauaauuaaauuaccaaaauacucacucuuugaacuugaaaacggcagaagaagauuauuggcaucagcaaaagagcuacaaaaaggaaacgaaaugauacuaccaccgcacuuagucacccuacuauaucauucaagcaacauccacaaaauaacagaaccuauccaccuaaacuauguaaacaaaaauaaacaugaauuuaaagaauuauuaagacauauuucugauuuuagcaccagauauauacucgcacaagacagacuaucaaagauagaagaacuauacgacaaaaacgauggagaugacauauccgaccuaaccagcuccuucguaaaucuauuaacauucacggcaauaggggccccugcugcauuuaaauuucucggaucuguuauagacagaaaacgauacacaucaauugcagaaauacuagaagcaacauugauacaccaaagcguaacaggacuauacgaaacacgaauagaccuaaguaaacuaggaggagacuga

SEQ ID NO: 8903 - RNA, 4107 nt, Artificial Sequence
  Cas9 variant
auggacaagaaauacucaauaggauuagacauagguacgucaagcaucggauucgugggaguagacgaaaacggauggccucuuaacauaaaaggaaaaagagcgauaggagcacaccuuuuucgggaaggcgaagcggcagccgagacacgaggauuccguaccacacgcagacguuacaaccguagaaaauggcgccugcgcuuauuacgcgaaauauuugacgaaccaauauccagaguggauccuacauucuuugccaggaugaaagagucauccguaucuccaaaagauccaaauuaugacggacuugcuaaagaaauacuaauuccgagggacaaagacggcaaaauauuauaucccaccauauaccaccucagacacgcacuaauguacgaagaucaucaauuugacauccgcgaaauauauuuagcaauacaccacauuguaaaauaccgaggacacuuccugcuggauggagcagcuaaaaacuucgaauccucaaauuuagaccucaaaagugacauucaugaaauaaacgcaauuuuaguaggcauauuugguaacgaacaaguucaauuuaaugaucaguacgucgaaaaauuaaaagaaguucuacuagauagcacccaaagcagaucagaucgacaaaaagcagcagccaaaguuuuauuacccacaaacgauuuagacaaagauacuacaaaaauauuaaaaacaguaagcaccgaaauuacgaaagcaauaacuggcuuaaaagccaaauucuuugucauaaccgguaacgauaucgcgaaagaccaacaaaaagauuggacauuuuccaucgauacacucgaugagaaaaugucagucauugaaccaucauucagcgagaaaaacuuuagucuaauaacaauacuucaaaaacuauauucuaguguaacucuagcaggcauagucccaaauggacuguccuuaucggaagcuaugauacaaaaauacgaucggcacgcaucugaucuaguuuuacucaagaaauacugggacaccaaaccaaaaguauuaaagcaucaauuacaaaauaccuaugcagaauacauugaaauucaucaggugguagacgaguucuauagugacuuaucaaaacugauuaaaaacgaugaugacacgcuugcacaggagauaaaaaguaaaauaacuauuggaaacuucuugccaaaacaacgaacuacggaaaacggcguaauaccauaccaacuacaacagcgagagcuagacacaauaauuaaaaaccaacaagaauauuaccccuggcucgcagaagaaaacccagucgcagaccaucaaauagccuuuccguauaagcuggacgaguuagucggauuccgcauaccauacuauguaggaccaaugauagcuaaagaagauacaucuaacagcaaaaauucuaaauucgcauggaugauaagaaaacaauccggagaaguaacaccauggaauuucgacgagaaaaucgacagaacggccagugcuacugcauucaucgaucgcaugacuacgacagacaccuaccuaauaggugaagauguguuacccaaacaaucacucauauaucaacgcuuugaaguacucaacgaacuuaauaaaauaucaauagacggacaaccgauaacaagaaaacaaaaacaaagugucuacacacauguauuugaaaagaagaaaacaguacaaguaaaagauguacaaaaauuucuaguaaguucaggagaagugaugucacuucccaaaauaggaggacucgccaaugaaaaacaauucaauucaucacucagcaccuuauaugacuauaacaaaaucauaccagacgcccuagaagaucggaacaaaguggacgauauagagaaaauaauacuuuggucaacuauauuugaagacaauagcaucuuuguugaaaaauuagacucgauagauuggcuaacaucgucacaaagaaaacguuuagcccagaaaagauacagaggcuggggaagacuaagccuacgcuuauuaacaacauucaaaaauaaagaugguuauucaauacuggaugaacuauggaacucuaaucacaauuucauggaaauacaagcacaaagugauuuuucugaacaaauugccacagcaaacaacaacaaccuaagccaaguucuucccgcuaaaugggaaccaggaagaaagaauuuggcaagccuagaugaauuuauaaguaacuuauauaccucaccacaaaacaagaaagcguuaagaaaagccauacgaguuguacaggacaugaugacagccgcaggacacaugccugagaaaauauucauugaaguagcacgugacacgucaaacucacaccaacaaaccauugcuagacaaagacaacuccaacaauuauaccaaagcgaagcaaaagaaguaauagacucaucaguuagaagcgaacucgacgacauucuuaaaaaccgagccaauauaaaagaccaacuauucuuauacuuucaacaaggagggcgcgaucuauauacaggaaaagcuauaaacaucgauaaauuaucacuauaucacauugaccauauacuaccacaaucguuagucaaggaugauuccuuagacaacagaguucuaguaagucagaaaacuaacgaagauaaaggaguaacauucguaucagauaaauauaugaacaacauguuaccuaccuggaaaagauggcacgaaaugggauuaauaagugccagaaaacuuaaaaaccuaaccaugagacccgacgaaauagacaaguacgcaccgggauucauucaaagacaauugguagaaacgagacaaguaacuaaauuggugauagaacuauuggaugccuuguuaggaaacagucaaacagaaauaauaacaaucaaggcuucuuuaucacaccaauuccgacaacaauuugaucuaguuaaaauacgugaaguaaaugauaaccaccaugcauucgacgccuucuuagcagcacgcauaggaacuuaccucuauaaaagauacccuaaauuaagaccauauuucguauauggccaauacaugcaaaaccacaaaaauuugaaaaguauaaaucuaauaaaaacucucgacucagacaaagcaauaguugaugaaggaacuggcgaaauccuaugggauaagaaaucugaccuagcuaaaaugaucaaaaucuauaauuaccaaaggcuccuaauuacacaugaaucaagaacaucauuuggcgcuauguauaaacaaaagauauuaaaggcuaccgacgcuaaacaaaacgggggaggauucaaguuaguaccaacaaagcgcaauuggccaguagacaucuauggaggcuacacaggacaaacagccgcauauuuaaccauuguucgagucuacuccaaaaagacuucagaauuacgcguacuuccaauauacacgaacaaaguccaacaaauagaaaaagcaaugacucaaggugauaaagcaaccaugcucgccuuuaaaaagguaauagcgccucaguuagguaaagaaaacaagaaaacccacgaaaucaaaauaccugaauuugauguuguuauacccaaagugcucuuagaucagcuaguuauugaugacauugcaggaagcccgcacagauuucgauuggguacagacacuuauuaccacaacagucaacaauuguuucuacccuugucaaugcaacgucagcuaauggaucgagaaucagaugacaaagucuaucucgacaucuucaacgacguucugaaacaagucgauucauacuuuaacuuauaugacguaaauggcuuccgagcagcccuucagaaaaguaagaaagcauucgaacaacuaccaauaaaugacuucccuaaagauguacccgauaauaaaaagaagaaagggaaaagaucaauuuuaaaagaaauuuuuaucggacuacacgccaaugcuacucuuggaaaucuaaaacaaaugggcauaaaaacagauuuuggaaaauuacaaaaauccaacggacuacgaauaacagaaaacuguaaaauuauucaucaauccccaacuggucuuuuugaacgaauaguucccauaaaauga

SEQ ID NO: 8904 - RNA, 4107 nt, Artificial Sequence
  Cas9 variant
augucacgaccauacaacaucggccucgauauugggaccucaucaaucggcuggucaguagucgacgaucaaucgaaacugguuuccguaaggggaaaauaugguuauggaguacgucucuacgacgaaggccaaacagccgcagaaaggaggagcuuucgaaccacgagaagaagacuaaaacgacgaaaauggagauuaggcuuacuccgugaaauauuugaacccuauauaacucccguagacgacacguucuuccuacgacaaaagcaaucgaaucuuucccccaaagaucaaagaaaacuauacccacaaacaucacuuuucaacgacagaacagaucgagcauuuuaugaugauuaccccacaauauaccauuuaagguauaaguuaaugacagaaaagcgccaauucgacauaagagaaauauaucuugccaugcaccauauaguaaaauaucgaggucacuucuuaaaugaagcaccuguuucuagcuuuaaaaguagugaaaucaaucuaguagcucacuucgauagacuuaauacaauauuugcagaucuauuuucugaauccggauuucaauuggaaaccgacaaacuugcagaaguaaaagcccuacuccuagauaaccaacagucggcaucgaaccgacaacgacaggccuuaucacuaauuuacacaccuuccacaaauaaagcaguugaaaaacagaacaaagcaauugcaacggaauuauuaaaagcaauacuaggauugaaagcaaaauuuaauguuuuaacaggaauugaagcagaagauguaaaagccuggacccuuacauucaacgcagaaaacuucgacgaagaaaugguaaaauuagaaucaagccuagacgauaaugcacaccaaauaauagagucccuacaagaauuauauucagggguucuauuagcgggcaucguaccugaaaaccaaucccuuucccaagcuaugauaacuaaauaugacgaccaucaaaaacaccuaaagaugcucaaagccguaagagaagcgcuagcuccggaagaccgacaacgauuaaaacaagccuaugaucaguaugucgauggacaagaaaauacuaaagcguauagcaaagaagacuucuacggcgauauaacaaaagcccucaaaaacaauccugaucacccaauagugagcgaaaucaagaaacucaucgaauuagaccaauuuaugcccaaacaacgaacgaaagauaacggugcaauuccccaccaacugcaucaacaagaacuagacagaauaaucgaaaaucaacaacaguacuacccauggcucgcagaacugaauccuaacaguaaaaggcaaacagucgcaaaguacaaacuagacgaacugguugcauuuagggucccauacuauguuggaccacuaauuacagcagaacaacaaagacaaucaagcgaugcaaaauucgcguggcucauuagaaaagcagaaggucgcauaacuccauggaacuucgacgacaaaguggauaggcaagcaucagcaaaugaguucaucaaacguaugacaacaaccgauacguaucuuuuagcugaagauguauuaccaaaacaaucauuaaucuaccaaagauuugaaguucugaaugaauuaaacggauuaaaaauagacgaccaacccauaaccacugaacuaaaacaagccauauuuaccgaccuauucaugcagaaaauaucuguaacaguuaaaaacauccaagauuaucuagucucugagaaaagauacgcaagccgucccgcaaucacaggccuuagcgacgaaaacaaauucaacucucgauugucaacauaucacgauuuaaagaugauuguuggagacgccgucgacgaugucgauaaacaagcagacuuagagaaauguauagaauggucaacgauauucgaagacggaaaaauuuacagugcaaaacugaacgaaaucgacuggcuaacagaccaacaaaggguacaauuagcugcuaaaagauauagaggauggggccgcuuaucugcuaaacuauuaacacaaaucguaaaugcaaauggacaacgcauaauggacuuacuuugggacacuacagacaacuucaugcgaauaguacacucagaagacuuugacaaacuuauaaccgaagccaaucaaaugauguuggcagaaaaugacguucaagacguaauuaaugaucucuauacuucuccgcaaaauaagaaagcucuacgacaaauauuauuaguagugaaugauauacaaaaagcaaugaaaggacaggcuccagaaagaauccucauagaauuugcacgagaagaugaaguuaauccacgccuuagcguacaaagaaaacgacaaguugagcaaguauaucaaaacauuucaaaugaacuauuaaauaauacagaaaucagaaacgaauuaaaagaccuuucuaauagugcauuaagcaauacacgacuguuuuuauacuucaugcaagguggacgagauauguauacaggagacucauuaaauauagaccgucuauccacauacgacauagaccacauacugccucaaucauuuguaaaagacaacaguuuagauaauaggguucuaguaucgcagaaaaugaacagaagcaaagcagaccaaguccccacagacuuuacaagcguagaacuuggcaagaaaaugcagcuccaaugggaacaaaugcucagagcaggucuuauaaccaaaaagaaauaugacaaucuaacucuaaauccagaucauauaagcaaauacgcaaugaaaggauuuaucaacagacaacuuguagaaaccagacaagucaucaaauuagcuacaaacuuauuaauggaacaauauggcgaggauaacaucgaacuaaucacaguaaaaaguggacuuacccaucaaaugcgcacagaguucgacuucccuaaaaaucggaaccucaauaaucaucaccacgcuuuugaugcauaccuaaccgcguucguaggauuauaccuacuuaaacgauauccaaaacugaaaccauacuucguauacggagaauaccaaaaagcaagccaacaagauaaauggcgcaacuucaacuuccuaaauggcuuaaagaaagaugaacuuguagacgaaaacaccgaagcaguaauuugggacaaagaaagcggacucgcuuaccuaaauaaaauauaucaauuuaagaaaauccuaguaacaagagaaguccacgaaaacucaggcgcccuauucaaccaaacauuauaugcagcaaaagacgacaaagcaucaggccaaggaggaaaacaauuaauaccagcaaaacaagaucgaccaacagcauuguacggcggguauucaggcaaaacaagcgcauacuuaugucuaguaaaaaucaaaaauaaaagcgaauauauuuaccgcauauuuggugucaacacaaguuggaguagugaacuaaaacaaauucaagauccggcugaacgguuaguaagacuagaaaaacuauuaacuccgcaacuaacaaucaauaagaagaagaaaggugagcccgucccgguaacaaaagacuuuaaaauuauacucccccguauauuaauuaaccaaaaauuuuacucacgaggccaagauauaucaaucgcuucugaguucuauuuacauaacgaacaagaauuaguucuagauaaaucagauaucaaaauucuaaacggugcaaucaaagugaauaauagcaauaaacagguaaucaaccuauuuaaccauauucuagaacaaguaaaucaauacuuuccuguuuacgacauauauaaaucccgagaaguacuaaacucaaguaaagaaauauucgaaaaucuaacauggaacgaccaauggcgcaaucgaaaacuaauaaacguaggccagaaaacaauccuaaauaggauccuaaucggucugcacgcaaacgcagcaagaauuaagauauccgaacuagguuucaaaaacgacuuuggcuuacuaacucaaacaucaggcaucacauucacuccagacacacaaauaaucuaccaaucaccaaccggcuuguucgaaagacgggucgcauuaagggaccuauga

SEQ ID NO: 8905 - RNA, 4107 nt, Artificial Sequence
  Cas9 variant
augaaacgaucauacaacauuggacuagauauaggcacuaacagcaucggaugggcgauuguagaugaccaaaguaaacucauauccguaaaaggaaaauacggauauggaguacgacuuuacgaugaaggccaaaccgcagcagaaaggcguaguuuccgcacaacaagaagaagauuaaaacgaagaaaauggagacucggcuuacuuagggaaauuuucgaaccauauaucacaccgauagauucaacauucuuccuacgacaaaaacaaaguaacuuaagucccaaagaucaacgcaaguuauauccucaaacaucauuguucaaugacagaccagacgcagacuucuaccaacaauaucccaccauauaucauuuaagauaccaacuaaugacggagaaaagacaauuugauauucgggaaauuuaccucgcaaugcaucacauaguaaaauacagagggcacuuucuaaaugaagcuccaguagccagcuuuaaaaguagugaaauaaacuuagccgaacauuuugaccaauuaaacacuauuuuugccgauuuauucagggaaucaggauuccagcuagaaacagaugaauuagucgcaguaaaagcucuacuaauggacaaucagcaauccgcauccaaccgacaaagaaaagcacuaccgaaacuauauacaccuagcgcagacaaaaguaucgaaaaacaaagaaaagcuaucgcuacagaaauucuuaaagcaauucuaggacuaaaagccaaauucaauguaguuacaggcauagaagccgaagaugucaaagcaugggcccuaacauucaacgcugaaaauuuugaugaggaacuggccaaacuugagucuagucuagacgauaacggccaugaaguaaucggaauauuacaagaauuauacucagguaucuuacucgccgguaucguaccagagaaccaaucacuuagccaggcaaugaucacuaaauacgaagaacaucaagcacaucuaaaaaugcuaaaagcaguaagagacgauuuagcaacagccgaucaacaaaaacuaaagaaagcauacgaccaguauauagacggccaggaaaacacaaaagccuauucgaaagaagcguucuacgaugauguuacaaaagcauuaaaggacuacuccgaacaaccuuugguaucagaaauucaaaaacuaauugaguuagaucaauuuaugccuaaacaaagaaccaaagacaauggagcaauaccucaccaauuacaccaacaagaauuagacagaauuaucgaaaaucaacaacaauacuauccguggcuggccgaguuaaacccuaauccaaaaagacaaacaguagcaaaauauaaacuagaugaauuggucgcguucaggguacccuauuauguaggacccuuaauaaccgcagagcaacaacaacaaucaucaaaugcaaaauuugcauggaugauaaggaaaacggaaggaagaauuacacccuggaacuucgaugauaaaguagacagacaagcaagcgcaaacgaguucauuaaaagaaugacuacaacugacaccuauuuauuagcugaagauguacucccaaaacaaagucuaauauaccaaagguucgaaguacuaaaugaacugaacggacugaaaaucgaugaucaacccauaacaaaugaacuaaaacaggcaauauuuaacgacuuauucaugcagaaaacauccguuucggucaagaauauacaagacuauuuggugagugaaaaacguuacgccagucgaccagcuauuaccggacucagugacgaaaagaaauuuaauagcagacuuagcacauaucaugaucugaaagucauagugggcgaugccguagaugauguagacaaacaagcugacuuggaaaaaugcauagaauggucaacaauauucgaagauggcaagaucuacuccgcaaaacuaaaugaaauuacaugguuaacagaacaacaacgaggacaauuagcaaccaaaagguauagaggauggggacgucucagcgcaaaauuacucacucaaaucguaaacgcaaacggacaacguauaauggacuuacuaugggacaccacagacaacuuuaugagaauuguacacuucgaggacuuugauaaacucauaacagaagcaaaccaaaugguucuagcagagaaugauguucaagauguaauaaacgacuuguauaccucuccacaaaauaagaaagcccuaagacaaauauuauuaguaguaaaugacauucaaaaagcuaugaagggccaagcgccagaaagaauauuaauagaauuugcuagaggcgcacaaaaagauaaaucacuaaccguaagaagaaaaagaaaacuugaugaaauguacucccaaauaagugacgcuguacuugcugaugaaucaguacgacaagagcucaaaucuucaaaccaagaugacuuagucaaagaaaaaguauaccuauacuucaugcaaggugggcgugauuuauacacugggaaugcccucaauauugacagacuaagugauuaucacguggaucacaucauuccacaagcauacaucaaggacgacucguuagauaacaaagcauuggucaguuccagaaugaacgaaaucaaagcugaccggguaccccuucaaguaguucaaaaacaauuugggaaaaacauggccucagaauggggauacaugcaccgagcuggacucauauccagaaagaaauaugauaacuuaauguuuaauccagaaaaucuaaauaaauaccaaauuaaccguuuuaucagccgacagcuagucgaaacucaacaagucauaaaauuaguagccaacuuacuuucuaaccaauaugaaggugacaacguaaaaauaauuacagugaaaucaaaauuaacacaaacuauaagauccgaguucgacuucccuaaaaaccgagaagugaauaacuaccaccaugcauucgaugcauaucuaacagcauucguuggaauguacuuauuaaaacgcuauccaaaacugaguucauauuucacauauggcgaguaccuaaaaggaaaccaacaagacaaaugguccagcuucaauuuccuaaaugaccuuaaacgggccaaacuugaagacaagaccaauaaggagauauucuggcacaaagaaaguggccuagccuaccuuaauaaaaucuaucaauucaagaaaauacucguaacaagagaaguacacgagaacucuggagcucucuucaaucaaacacucuacgcagcuaaagacgacaaagcaucaggacaaggagguaaacaacuaauuccagcuaaacaagcaagaccgacugccuuguacgggggcuacaguggaaaaaccguugcauacauguguauaguaagaauuaaaaacaagaaaggagaccuauauaaagucugcggagucgaaaccaguuggcucgcacaacuaaaacaacuaaaagaugaagauagccaaaaagcauucuuaaaacagaaaauauccccucaauucacaaaagccaagaaacagaaaggaacaauaguaaaaguggucgaagacuuugaaguuauagcuccgcauauauuaauaaaccaaagguuauucgauaauggccaagaauuaacauuagggucugcgacuuacaaacacaaugagcaagaauuaauacuagauaaaacugcaguaaaauuauuaaacggagaacuaccacuagcacaaucugaagaauuagcagaauuaguauaugaugaaauccuggaucaagugaugcacuacuucccucuauaugacacaaaucaauucagggccaaacuauuagcuggaaaaaccgcauuuaugcaacuaccuuggaaaucaaauccugacgacaacaaaacuguccagauaacacaacccauuguucuuaagaaaauacuccagggguuacacgcggaugccggucgugucucccuaaaagaacuuggaaugacaacagauuucggaauguuacaaaaagcaacaggaauuaccuuuacaccagauacccaaauaauuuaccaaaguccgacaggacuauucgaacgccgagucgcacuacgugaucuuuga

SEQ ID NO: 8906 - RNA, 4107 nt, Artificial Sequence
  Cas9 variant
auggauaagaaauauaguauaggacuagauauagguacaaacagcguagguugggcagugauaaccgacgacuauaaagugccaaguaagaaauucaaaguauuaggaaauaccgauagacauucaauaaagaaaaacuuaauaggagcucugcuuuuugauucaggagaaacagcugaagccacaagacuuaaaagaacagcaaggagaagauauacaaggcgcaaaaauagaaucugcuaccugcaagaaaucuucucaaaugaaauggcuaaaguagacgauucauuuuuccacagacuagaggaauccuuuuuaguagaagaagauaagaaacacgaaagacaccccauuuuuggaaauauaguagaugaaguggcuuaccaugaaaaauaucccacuauauaccaucucaggaaaaagcuaguugauucaacagauaaagcugaccuaagacuaauuuacuuggcucuagcucauaugaucaaauucagaggccacuuccuaauagaaggggaccuuaacccagacaauagugacguagacaaacuuuucauccagcuaguacaaacuuacaaucaacucuuugaagagaauccaauaaaugcuaguggaguugacgcgaaagcaauucuguccgcacgacuaucgaaaucaagaagacuugaaaaccuaauagcucaauuaccaggagaaaagaaaaauggauuauucggaaaucuaauugcauuaucuuuaggucuaacgccuaauuuuaaaucaaauuuugaccuagcggaagacgcaaaacuccaacucuccaaagauacauaugaugaugacuuggauaacuuacuagcacaaauuggggaccaauacgcagaucuuuuucucgcugcuaagaaucuuuccgacgcaauacuauuaagugacauacuuagagucaacacagaaauaacaaaagccccacugagugcaagcaugauuaaacguuaugacgaacaucaccaagaucuaacccuccuaaaagccuuaguaagacaacaauuaccagaaaaauacaaagagauauucuucgaccaaaguaaaaacggauacgcaggguacauagauggcggagcgucucaagaagaguuuuacaaauucauaaaaccaauauuagagaaaauggauggcacugaagaacuauuagugaaacucaaucgagaagaucuauuaagaaaacaaaggacauucgauaacggauccauaccucaucaaauacacuugggagaauugcaugcuauauuaaggcgacaggaagauuuuuauccauuuuuaaaagauaauagagaaaagauagagaaaauccugacauuuagaauaccuuauuauguaggcccgcuggcaaggggaaacucaagauuugcauggaugaccagaaaaagugaagaaaccaucacaccuuggaauuucgaggaaguuguggacaaaggagccagcgcacaaaguuucauagaaagaaugacuaauuucgacaaaaaccucccuaaugaaaaaguacuaccaaaacauaguuugcuuuaugaauauuuuaccguauacaaugaacuaacuaaagucaaauaugucacagaaggcaugagaaagccugcauuccuaucaggagaacaaaagaaagcuauaguagauuuauuguucaaaacaaacagaaaaguaacaguaaaacaacucaaagaagauuacuucaagaaaaucgaaugcuuugauucagucgaaauaagugguguagaggaccgauucaaugccagcuuaggcacguaucaugaccuuuuaaaaaucauaaaagauaaagacuuccucgacaaugaagagaacgaggauauauuagaagacaucguuuuaacacucacuuuauucgaagauagagaaaugaucgaagaaagacugaaaacuuacgcacaccucuucgaugauaaagucaugaaacaacucaaaaggagaagauauacaggaugggggagacuaucacgaaaauuaauaaacggaaucagggauaaacaaucaggaaaaacgauacuagauuucuuaaaaucugacgguuucgcaaacagaaacuucaugcaauuaauacacgacgauucccuaacuuuuaaagaagacauucagaaagcacaaguuuccggccaaggugauucacuccacgaacacauagccaacuuagcuggauccccugcuauaaagaaaggcauacuucaaaccguaaaaguaguagaugaacuuguuaaaguaaugggucgacacaaaccagaaaauauuguaauagaaauggcaagagaaaaucaaacaacccaaaaaggacagaaaaauucucgugaacgaaugaaaagaauugaagaaggcauaaaagaacugggaucacaaauucuaaaagaacacccgguugaaaacacgcaacuacaaaacgaaaaacuguaccuauacuacuuacaaaauggacgcgauauguauguagaucaagaacuugacauaaacagauuaagugauuacgacguagaucacauuguuccacagagcuuucuuaaagacgacuccauagauaauaaaguacucacaaggucagauaaaaaccgaggaaaaagcgauaauguuccuagcgaagaaguaguaaagaaaaugaaaaacuauuggagacaacuacuaaaugccaaauugauaacucaacgaaaauucgacaaccucacuaaagcugaacgaggugguuuaagcgaauuagauaaagcugguuucauuaaaagacaauugguagaaacacgucaaaucaccaaacacgucgcccaaauacuagacuccagaaugaacacaaaauaugaugaaaaugauaaauuaauacgugaaguaaaaguaauaacacuaaaaaguaaacucguaucagauuuuaggaaagacuuccaauuuuauaaaguccgagaaauaaauaauuaccaucacgcucaugacgcauaccucaaugcggugguagggacagcuuuaauaaagaaauacccaaaauuagaaagcgaguucguauauggagauuacaaaguauaugacgugagaaaaaugauugcaaaaucagaacaagaaaucggaaaagccacagccaaauacuucuucuauagcaacauaaugaacuuuuucaagacugaaauaacacuagcgaauggagaaaucagaaaaagaccacugauugaaacuaauggugaaacuggagaaaucgucugggauaaaggaagggauuuugcaacaguucguaagguccuuucuaugccacaaguaaauauagucaagaaaacugaaguccaaacuggaggcuuuaguaaagagagcauauugccgaaacgaaacucagauaagcucaucgcacguaaaaaggauugggacccaaagaaauauggcggauuugauagcccaacaguagccuauagcguucuaguaguagcgaaaguagaaaaaggcaaaagcaagaaauuaaaaaguguaaaagaacuuuugggaauaacaauuauggaaagaucgucuuucgagaaaaauccaauagacuuccucgaagcaaaaggauauaaagaaguaaagaaagacuuaauuaucaaauuaccaaaauauucucucuucgaacucgaaaauggcagaaaaagaaugcuagcaucugccggagaauuacaaaaagguaaugaauuagcauuacccucaaaauacguaaauuuucuguauuuagccagucauuaugaaaaacuaaaaggaagcccggaagauaaugaacaaaaacaacuguucguagaacaacacaaacacuaccuagaugagauaaucgaacaaauaucagaguucuccaaacgaguaauacuagcagacgcaaaucuagacaaaguacuuucagccuacaacaaacaccgagauaaaccaauuagagaacaagcagaaaacauaauacaucuauuuacauuaacaaacuuaggugcgccugcagcauuuaaauacuucgacaccacuauagaccguaaaagauauaccucaacaaaagaaguguuagacgcaacacuaauacaucaaucaauuacaggucuauaugaaacgcguauagaucuuucacaacucggcggcgacuga

SEQ ID NO: 8907 - RNA, 4107 nt, Artificial Sequence
  Cas9 variant
auggacaaaaaauauaguauaggucucgauauaggcacaaauucugucgguugggccgugaucacagacgacuacaaagucccaaguaaaaaauuaaaaggacuaggaaauacagauagacacggaauuaaaaaaaaccuaauuggugccuuacuauucgacucaggugaaaccgcagaagccacgcgcuuaaagcguacugcucgccgaagguacacuagacgaaaaaauagaauuugcuaucuucaagagauauucuccaaugagauggcuaaaguagaugauucauuuuuccauagacuagaagaaaguuuccucguagaagaagacaaaaaacacgaaagacauccgauuuucggaaacauuguugaugaaguagcauaccaugaaaaauacccaaccauuuaucacuuaagaaaaaaacucgcagauucaaccgacaagguagaucuaaggcuaaucuaucuagcuuuagcucacaugauuaaauuuagaggacacuuuuuaauagaaggagaccuuaaucccgacaauuccgacguagacaaacuauucauccaauuaguacaaacauacaaucaacucuucgaggaaaauccaaucaacgcuaguaggguagaugcaaaagcaauacuaucagcacgucuaaguaaaucucgacgucuagaaaaccuaauagcucaacuaccaggugaaaaaaaaaauggacuauuuggaaacuuaauugcccuaucucuuggacuaacaccgaauuuuaaaucaaauuucgaucuagcagaagaugcgaaacuccaacucucaaaagauacauaugacgacgacuuagacaaucuucuugcacaaauaggggaccaauacgcagaucuguuccuggcagcaaaaaaucuaucugacgcgacauuguuauccgauauucuaagaguaaauucagaaauaacuaaagcacccuuaucagcaagcaugaucaaaagauacgacgagcaucaucaagacuuaacauuacucaaagcauuaguaagacaacaacuaccugaaaaauauaaagaaaucuucuucgaucagagcaagaauggauacgcaggauauauagacgguggagccagccaagaagaauucuauaaauuuaucaaacccauuuuagaaaaaauggacggaacagaggaauuauuagcgaaacuuaauagagaagaucuucuccguaaacaaagaacauucgacaauggaucuauaccauaccaaauacaccuaggggaauuacacgcaaucuuacgaagacaggaagacuuuuacccauuuuugaaagacaaucgggagaaaauagagaaaauacuuacuuucaggaucccauacuacguugguccucuagccaggggaaauucaagguucgcauggaugacgaggaaaucagaagaaacaauaacaccuuggaauuucgaagaaguaguugauaaaggugcaagcgcacaaucauucauagaaagaaugaccaauuuugauaaaaauuuaccuaacgaaaaagucuuaccgaaacacucauuacuauaugaauacuuuaccguauacaaugaacuaacuaaagugaaguacguaacagaggguaugagaaaaccagcauuucuauccggcgaacaaaaaaaagcaauaguugaccuacuguuuaaaaccaauaggaaaguaacaguaaaacaacugaaggaagauuauuuuaaaaaaauugaaugcuuugacaguguagagauaucaggaguagaagaccgguucaacgcaucccugggcacauaccacgaucuauuaaaaauuauaaaagacaaagauuuccuagauaacgaagaaaaugaagacauauuggaagacauaguucuuacauugacccuauuugaagacagagaaaugaucgaagaacggcucaaaaccuaugcacauuuauucgaugauaaaguaaugaaacaauuaaagagaagacguuauacaggauggggacgucuuagccguaaguuaauaaaugggaucagagacaaacaaaguggcaaaacaauacucgauuuucuaaaaagcgacggcuucgcaaacagaaauuuuaugcaauuaauacaugaugacagccuuaccuuuaaagaagacauacaaaaagcccaagucagcggacaaggagauucacuucaugagcauauugccaaucuggcagguucuccagcuaucaaaaaaggaauucuacaaacagugaaaguaguagaugaguuaguaaaagugaugggaaggcacaaaccagaaaacaucguuauugaaauggcucgagaaaaccagacaacacaaaagggacaaaaaaauucgcgggaaagaaugaaaagaauagaagaagguauaaaagaguuaggaagugauauucuaaaggaguauccaguagaaaauacccaacuacaaaaugagaaacucuacuuauauuacuuacaaaauggccgugacauguacguagaucaagaauuagacauuaauagguugucagauuaugauguagaccacauagucccccaaucguuuuuaaaagacgacaguauagauaauaaaguauuaacaagaagcgacaaaaaccgaggaaaaagcgacaacgucccuuccgaggaaguaguuaaaaaaaugaaaaacuacuggcggcaguugcuaaacgcaaaacuaaucacucaaagaaaauuugauaaccuaacuaaagcggagagaggaggauuaagcgagcuagacaaagugggcuucauaaaaaggcaacugguagaaacacgacaaaucaccaaacacguggcucaaauacuggauagcagaaugaacacaaaauaugacgaaaaugacaaacuuauuagggaaguaagaguaauaacuuuaaaaucaaaauugguuagugauuucagaaaagauuuccaauuuuacaaggugcgagaaauaaauaauuaucaucacgcacacgaugcauacuuaaacgcaguaguuggcacagccuuaauaaaaaaauacccuaaacuugaaucagaauucguauacggggauuacaaaguauacgacguacgaaaaaugauagcaaagucagaacaagaaaucggcaaggcaacagcaaaauacuucuucuacuccaacauaaugaauuuuuuuaaaacagaaauuacacucgccaacggugaaauacgaaaaagaccauugauagaaaccaacggagagacaggagaaauuguaugggauaaaggucgagauuuugcaacaguucgcaaggugcugucuaugccacaaguuaauaucguuaaaaaaacagagguucaaaccggaggcuucucaaaagaaucuauacucccaaaaagaaauagcgauaaauugauagcacgaaaaaaagacugggaucccaaaaaauauggaggauuugauuccccuacaguagcauacaguguacuuguaguagcaaaaguagaaaaaggcaaaucgaaaaaacuaaaaucaguuaaagaacuuuuaggaauaacaauuauggaacggagcaguuuugaaaaagauccaauagauuuuuuagaggccaaaggguacaaagaagugaggaaagaucugaucauuaagcugccaaaauauagcuuauuugaacuagaaaacgggagaaaacgaauguuagcauccgcaggugaacuacaaaaaggaaaugaacuagcccucccaucuaaauauguaaauuuuuuauaccucgcgagccacuacgagaaauugaaagguucacccgaagacaaugaacaaaaacaauuauuugucgaacagcauaaacacuaccuagacgaaauaauagaacaaauuucagaauuuucaaaacguguuauauuagccgaugcuaaucuugacaaagugcuaucagccuacaacaagcauagggauaagccaaucagggaacaagcagagaacauuauacauuuauuuacauuaacuaacuuaggggcgccagcagcauucaaauauuuugacacuacaauagauaggaaacguuacacuaguaccaaagagguauuggaugcaacauugauacaccaaucuauaacaggauuauacgaaacaagaaucgaucuaagccaacuuggcggggacuga

SEQ ID NO: 8908 - RNA, 4107 nt, Artificial Sequence
  Cas9 variant
auggauaaaaaauauucuaucgggcuagacauaggaacaaacucaguagggugggcaguaauuacagaugacuacaaaguuccuucaaaaaaguucaaagugcuaggaaacacugacaggcauuccauaaaaaaaaauuuaauaggagcccuucuguucgauucaggagaaacagcagaagcaacuagacuaaaacgcacugcacgcagaagauauacccgacgcaaaaacagaaucuguuaucuccaagaaauauuuucaaaugaaauggcgaaaguagacgauucauuuuuucaccgauuagaggaaucguuccucguagaagaagauaaaaaacaugaacgacaccccauuuuugguaauauagucgacgaaguugcauaccaugagaaauaccccaccauauaucaucuacgcaaaaaauuagcugauucgaccgacaaagcugaccuccgauugauauauuuagcacuggcucauaugaucaaauuccggggccacuucuuaaucgagggagacuuaaauccagacaauagugauguagacaagcuuuucauacaauugguccaaacauauaaucaacuauuugaagaaaaccccauaaacgcaaguaggguagacgcgaaagccauacuaagcgcgagauuaucaaagucccgaagacucgaaaauuuaaucgcacaauuaccuggugaaaaaagaaaugggcuauuuggcaaccuuauagcacuaaguuuaggccuaacaccaaauuucaaaaguaauuuugacuuagcggaagaugcaaaacuacagcuuucaaaagacacguacgacgaugacuuagacaacuuacucgcucaaauaggagaucaauacgcagaucuauucuuggcagcuaaaaaucuguccgacgcaauucugcuaucugauauucuaagagugaacuccgagauuacaaaagcaccacugucugcuucaaugauaaaaagauacgaugaacaucaucaagaccuaacauuacucaaagcuuuagugaggcaacaacucccagaaaaauauaaagaaauauucuucgaucaaagcaagaacgguuacgcugguuauauagaugggggcgcuagucaagaagaauuuuacaaauuuauaaaaccuauacuagaaaaaauggaugguacagaagaacuuuuagccaaauuaaacagagaagaccuacucagaaaacaaagaaccuucgauaauggaucgauaccacaccaaauucacuuaggagaacuacaugcaauucucaggagacaggaagacuuuuacccauuucuaaaagacaacagagaaaaaauagaaaaaauauuaacauuuagaauaccauacuaugucggcccgcuugccagaggaaacagcagauuugcuuggaugacccgaaaaucugaagaaacuauaacgccauggaauuuugaggaaguagucgauaaaggagcaagcgcacaaucauuuaucgaaagaaugaccaacuuugacaaaaaucuaccaaaugaaaagguauuaccaaaacauucuuuauuauaugaauauuuuaccgucuauaacgaauuaacaaaagucaaauacguaacggaagguaugagaaagcccgaauuccuaagcggagagcaaaaaaaagcgauugucgacuuacucuucaaaaccaauagaaaagucacggucaaacagcuaaaagaagauuauuuuaaaaaaauagaauguuucgacucgguagaaauaaguggagucgaagaccgauuuaaugccucauuaggaacauaccacgaccuacuaaagaucauaaaagauaaagauuuuuuggauaaugaagagaaugaagacauauuagaagacauugucuugacacuaacuuuguuugaagacagagagaugaucgaagaaagacuaaaaaccuacgcacauuuauuugacgacaaaguaaugaagcaacugaaaagacgaagauacacuggcuggggccgacucagcagaaaacuaauuaacggaauaagagacaaacaaucagggaagacgauauuagacuuucugaaauccgaugguuucgcaaauagaaacuucaugcaacuaauucacgacgauucauuaacauucaaagaagacauucaaaaagcacaaguaucuggacaaggagacagccuucacgaacacaucgcaaacuuagccggcagccccgcaauaaaaaaaggaauucuacaaacuguaaaaguagucgaugaauuaguuaaaguuaugggacgacacaaaccagaaaauauaguaaucgaaauggcucgggagaaccaaacaacacagaaaggacaaaaaaacuccagagaacgaaugaaaagaauugaagagggcauuaaagaauuagggagugauauauuaaaagaauacccgguugaaaacacacaauuacaaaacgaaaaacuuuaccuauacuaccuucaaaacggccgagauauguacguugaucaagaauuagacauuaauagacuaagcgacuacgauguagaccacauuguaccccaaucuuucauaaaagacgauagcauugacaauaagguacuaacuagaucggacaaaaauagaggaaaaagcgacaacguuccuucagaagaaguagucaaaaaaaugaaaaacuauuggaaacagcuauuaaacgccaaacuaaucacccagaggaaauuugauaaucucacaaaagcagaacgagguggccucucagaauuagauaaagcaggauucauaaaacggcaguuaguagaaacuagacaaauaacaaaacacguugcucaaauacucgacagccgaaugaacacaaaauacgacgagaaugacaaacugauuagggaaguaaaaguaaucacgcucaaaucgaaguugguaucugacuuccgaaaagauuuucaauuuuauaaaguacgagaaauuaacaacuaucaucaugcccacgaugcguauuuaaacgccguagucgguacagccuugauaaaaaaauauccuaaacuugaaucagaauucguauacggcgauuauaaaguauaugauguuagaaaaaugauagccaaaagugaacaggaaauagguaaagcaacagcaaaauauuucuuuuauucgaacaucaugaauuucuucaagacagagauuacacuggcaaauggcgagauuagaaaaagaccauuaauugaaacuaacggagaaaccggagaaauagucugggacaaaggaagggauuuugcuacuguaagaaaaguccuaucaaugccccaaguaaacauagucaaaaaaaccgaaguacaaaccgguggauucucuaaagaaucuauuuuaccuaagcgcaacagcgauaaacuaauagcaagaaagaaagauugggaccccaaaaaauauggaggauuugacaguccuacgguagccuauucaguucuagucguugcaaaaguugaaaagggaaaaagcaaaaaacuaaaaaguguaaaagaauugcuaggaauaacaauuauggaacggucaucauucgaaaaaaauccaauagauuuccuagaagcaaaaggauauaaagagguaagaaaagaccuaauaauuaaauugccaaaauauucacuauuugaacucgaaaauggaagaaaacgaaugcuugcgucggcaggagaacuacaaaaaggaaacgaacuagcauugcccucaaaauacguaaacuuccuauaccuagcuagccauuacgaaaaacuaaaaggaagucccgaggauaacgaacaaaaacaauuauuuguagaacaacauaagcacuaccucgacgaaauaaucgaacaaauaagcgaauuuucaaaacgagucaucuuagcugacgccaaccucgacaaaguccuuagcgcguacaacaaacaucgagacaaaccaaucagagaacaagccgaaaauauuauacauuuauucacccuaacaaacuucggagcaccagcugcuuuuauauauuucgauacgacuauaggacgaaauagguauaaaucaauaaaagagguacucgacgcaacacuaauacaucaauccauaacuggauuauaugaaacacggaucgaccucucccaauugggaggagacuga

SEQ ID NO: 8909 - RNA, 4107 nt, Artificial Sequence
  Cas9 variant
augaaauaugaaagcgaagaauacuauauuggucuagauaugggaaccucaucaguagguugggcaguaacagacccacauuaucacuuaauacgaaagaaaggaaaagauuuauggggcgcacgccuauuugaaaaagcaaauaccgcacaggaacgccguacaaacaggauaaaccgccgacgcaaccaaagacgaaaacagagaauugcauucauccgagaagcguuucgaaaagaaguagaaaaaguugauguaaauuucuuucgccggcuagacgaaagucaacuauaucuagaagauaaauccauaaaagaaccauaccuacuauuuaacgauuuaaacuacacagauaaagacuuuuaucaccaauauccuaccgucuuccacuuaaucacagaucuucuaacaucagaccgaaaauuugauauacgugaaauuuacauagcaguaagcucacucuacaaucauagaggaaauuuccuaaauaaaagucucggaaacgaaacacaagaugaagauuuaguguucaaaaaucuagacgaagcguucuccgcaugcgggaugaauuggaauaccaaagccgagaacaucgaagucguaaaacaaauucuaugugacagaucauuaaauaagaaagaaaaacaagaucaacuagcacauugucuagaaauaaauaagaaaacagaaaaagagaaaauagaauuucuaaaauugcuaacaggugguaaagcagacucaaagaaaauguucccacaauaucacuacgaaagagacgaaaaacuaucauuugcauucgcagaugaaaacggagaugaaaacugggaagaaacacucaaugcaaucgaagaaagacuuaccucagaugaauacggucucauacuagcucuuaaaagcgucuacgacugguccauucuagcagaccuaaugaaaaaugagaaaacaggagaaacuuauccauaucuaucaauggcucgaaaagauagcuaugaaaaacacaaagcagauuuaagacuauugaagucaguaauaaaacgauuaauaccaaacgaauacaaucacuucuuuagacaguacgacggaaaaggaaaaacuuacacuaacuacauaggaagugugcaauaccacgagaagaggcauagauucaagcauauaacaacaaaggaguucuaugaugggcuaaagaaauuacuaaaaccguauucagaagaugaagaaauuaaacaaauccuacaagacaucgaaucagagacauuccuaccaaaacagaucacaaacaugaacggaguaauacccaaccaaguucacgcaaaagaauugaaaguaauauuggagaaagccucccaacauuacgacuuuuuaaaugaaacuaaugaaucaggguuaacaguaaaggaacaaaucaugcaaauguucacguuccagauccccuauuauguaggaccccucgcaaacuuaaauggcaaagguaacggaugggccguacgcuacgugggaaaagaaaggacaaagguauauccuuggaacauggaugagguaauagaugaaaaagaaaccgcugaccaauucauuaagagaaugauaucaaccugcacauauuuaggggacgaauauguacuaccuaaguccaguauacuuuacgaaaaguucgccgugcuaaacgaacuaaauagccucaaaaucaauggccagccgguaucagucgaccuuaaacagaaaauauaucgcgaccucuuuacuaaaggaaaaaggguaacacaaaaaggauuacuguuauacuuaaaacgagaaggaguaauuucaaaaucugaggaaacaaucuuaucaggauucgauauagacuuuaaaaacacuuuaaguaguuaccgaaaauucugcgagguauucgccacaaacgaauugaacgaugaacaaauaagaauggcagaggauauaauagagugguuaacugucuuuggagacaguaagaaauuuguucgagagaaaauacaugggaauuacccucaaauaacagccaaucaacuaaaaaggauauuaucguucaacuucaaagauuggggaaaacuauccaaacaguuucucgaacuugaaggcgaagauagagagaccggaaaaagcuguucacuaauucaagcauuaugggacacaaacaacaauuuaaaccaauugcuaucaucaagauucacauauaaggaaaacuuagaaaagaaaaggaagaaaauagaaauggaucuuuucgaguucacacacgaagaucuagaugacuuauacauauccgcuccaguuaaaagaaugauauggcaagcacucaaaaucaugaaagacauaguaauaguuaugaaagaaucgccaacaaaacuuuucauagaaaugacaagaaacaaugaaaacgagaaaacacguacaguuucucgaaagaacaaacucguagaccuauauaagaaaaucaaaggagaaucuagggacuggauaaaagaauuagaaagauacgaagaaaaagacuuucgcucaaagaaacuauaccucuacuauacacaaaugggcaaaagugcauauaguggagaaccaauugauauggauaaauuauuugauaaaaauguuuaugauauagaucauauauauccuaaaucaaaaguaaaagacgauagccuacuaaacaacuguguauuaguaaaacgaaaagaaaacauggauaaaggaaauaacuuuccaaucgacccugacauucaaacuaaacaggaacaucuuuggaaauucuggcucgaaaaaggauuaauaacucaagaaaaauuuaauagacuaacaagaaagaaaccauucacuaaugaugaacuugcagacuucguaaauagacaauuaguagaaaccggacaagcuaccaaaaccauagcagaucuauucaaaaugacauuccccaauagugacauaguauacguaaaagccggaaacguaacggacuucagacaauacauagaagucuauaaaugccgugagguaaauaaccuccaucacgcauacgacgcuuaccuaaacguugucgugggcaacguuuacgacacaaaauuuacaaagaaccccaugaacuauaucaaagaacaacgaaaagaaaauucuaaugaacgcuaccacauggauaaaauauucgaguucccagucaucagaaaugggaaggaagcguggauuacuaaaaaggacgaaaguauaaauaucguacgaaaaacauuagcaagaaaaacaccccuaguaaccaaacgcaauuuugaagcaaauggaacgauagcaaaagcaacaaucuauccuaaagggaaugucaaggaucaaggauacuuaccacgcaaaacaagcauaccagcacucagggacaugaagaaauacggaggcguaacaucuauacaaauugcuuacuuuuuccuuguagaacaugaagugaaaaagaaacgaauccgaacaauagaaugcguaccaauauaucgaaaagaagaauuaaaaacaaaagaacaacuugaaagauauugucgagaagaacucaaacuaauuaacccgaguauaagacucgagaaaaucaagccauacagccuucucaaaaugaacgguaacuuuuucuauaucacaggaaaaacaaaugaccgauucucgcucgcuaaugcaauggaacuuuacguagauaaagucagugaaaaucacauaagagaccuugucaaauauaaaaauuguggcuacuuuaacguagacgauaaagaagcaagaaaacguaaugaaagauuauauaccaucuuaacaaagaaacaucuaaccguguuuaaaggauccccgaaaccuaugggagagaaacuacaacaauaccaacaacuauuucucgagcucgaaguaucaaaacaaguguacguacuacuucaaauacuacaacuaacugcaacgaacgugaaaaccaaagcagaucuaacagcaaucggaggaaaggcaaaugaaggcacaauggacauaucaaagaauuuagaaaauguaauuaaaaaccaaauaaagaaaggucuaguuccagaacuaaugcuaauaaaucaaagccccacaggacuauuugaaucugaaauagaucuauuaacaauuuga

SEQ ID NO: 8910 - RNA, 4107 nt, Artificial Sequence
  Cas9 variant
augucaaggccguacaacauaggacucgauauuggaacaaguucgauagguuggagcguugucgaugaucaaucuaaacugguauccguucgaggaaaauauggguacggagucagacuauaugaugagggacagacagcagcggaaaggagaucuuucaggacaaccagaaggagauuaaaaagaagaaaauggcgcuuagggcuauuacgagaaauauucgaacccuacaucacacccguagaugauaccuucuuucuacgaaagaaacaaucaaaccuuaguccaaaagaucaacgcaagcuauacccacaaacaucacuauucaaugauagaacugaccgagcauuuuaugacgacuauccaacaauauaucacuuacgauauaagcucaugaccgagaaaagacaauuugacauacgagaaauauaucuugcaaugcaucauauaguuaaauacagaggacauuuucucaacgaggcgccuguaucuagcuucaaaaguagcgaaauaaaccuaguagcccacuuugauagauuaaauacaaucuuugccgauuuauucucagaaagcggcuuucaacucgaaacggauaaacuugcagaagucaaagccuuacuccuugauaaccaccaauccgcaaguaauaggcaaagacaagccuuacuacuaauauauacaccauccaccaacaaagccguagaaaaacaaaauaaagcuauagcgaccgaacuacuaaaagcaauacuaggguuaaaagcaaaauucaauguucucacugguauugaagcagaagacguuaaaacuuggacauuaacauuuaacgcagagaauuuugaugaggaaauggugaaacucgaaagcagucuugacgacaaugcucaucaaauuauugagucacuacaagaauuauauaguggcguacuccuagcaggaauaguuccagaaaaucaaucauuaucgcaagcuaugauaacgaaauaugacgaucaccaaaaacaccuaaaaaugcuuaaagcuguacgagaagcccuagcaccagaagacaggcaaagauuaaaacaggcuuaugaccaauaugucgauggacaagagaauacaaaagcauacaguaaagaagacuuuuauggcgacauaaccaaagcauuaaagaauaauccagaccaccccauaguaucagaaauaaagaaauuaauagaacuagaucaauucaugccuaagcaaagaacgaaggauaauggcgcuauaccacaccaauuacaccaacaagaacucgacagaauaauugaaaaucaacaacaauacuauccauggcucgcugaauugaauccaaauucuaaacgacaaacaguugcaaaauacaaacuagacgaauuaguagcguuccgaguaccuuauuacgucggaccacuuaucaccgcagaacaacaacaacaaucuucugacgcaaaauucgcauggaugauaagaaaagcagaaggacaaauaacaccuuggaacuucgacgacaaaguagacagacaggcuucagccaaugaguucauaaaacguaugacaacaacggauaccuaccuuuuggcugaagacguccuacccaaacaaagucuuauauaucaacgguucgaaguacuaaacgaacuaaauggguuaaaaaucgacgaucaaccaauaacaacugaacucaaacaagcaaucuuuacagaccuuuucaugcagaaaaccucaguuaccgugaagaacauacaagacuauuuaguaucagagaaaagauaugcuucuagaccugcgaucacagguuuaagcgaugaaaauaaauucaauucuaggcuauccacguaccaugauuuaaaaacaauaguuggagaugcaguagaugacguugacaaacaagcggaccuggaaaaaugcauagaaugguccacaauauuugaagacgguaaaauauauuccgccaaacuaaaugaaaucgauuggcucacagaucaacaaagaguacaacucgcugccaaacgauaucgagguuggggccgauuaagugcaaaauuauuaacccaaauaguaaacgcaaacggacaaagaauaauggauuuacucugggauaccacagacaacuuuaugagaauaguccauagcgaagacuucgacaaacucauaacagaagcgaaccaaaugauguuggccgaaaacgacguccaagacguaauaaaugaucuuuacacuucaccacagaauaagaaagcucugagacaaauucuauuaguagugaaugacauccaaaaagcuaugaaaggccaagcaccagaaagaauccuaauagaguucgccagggaagacgaaguaaauccuagacuaucaguacaacgaaagcgacagguagaacaaguauaccaaaacauaucuaacgaauuacugaauaauacggaaauucguaacgaacuuaaagacuuaucaaauagugcacuaagcaacacaagacuauuuuuguauuucaugcaggguggccgagauauguacaccggagauucacuuaauaucgacagauuaucaacuuacgauauugaccacauucuaccccaauccuuuauaaaagauaauucauuggacaaccgcguucuaguaucacaaagaaugaauagaaguaaagcagaucagguaccaacagacuucacaucuguagaacuaggucagaaaaugcaaauccaaugggaacaaaugcucagagcagguuuaauaacaaagaagaaauaugacaaccuaacuuuaaauccggaccacauuucaaaauacgcuaugaaaggauuuauuaacagacagcuaguugaaacaagacaaguuauuaaauuggcaacaaacuugcucauggaacaauacggagaagacaauauugaauugauaacgguuaaaucaggcuuaacacaccaaaugagaacagaguucgacuucccgaaaaaucgcaaccugaacaaccaccaccaugcauucgacgcuuaccuaacagcauuuguaggauuguaccuauuaaaaagauauccaaaacucaaaccuuacuucguauacggagaauaucaaaaagcaucacaacaagacaaauggcgcaacuuuaacuuucuaaacgguuugaagaaagacgaacuggucgaugaaaacaccgaagcuguaaucuggaauaaagaaucaggguuagcuuauuuaaacaaaauauaccaauucaagaaaauacucguuacaagagaaguccacgaaaacucaggggccuuauucaaccaaacauuauacgcugccaaagacgacaaagccaguggacaaggagguaaacaacuaauccccgcgaaacaagaccgaccaacagcucuauauggagguuauagcgguaaaacugucgcauauaugugcauaguacguauuaaaaacaagaaaggagaccuuuauaaaguguguggugucgaaacauccugguuagcacaacuuaaacaacuuacagacgaagacucaaagaaagcauuucuuaaacagaaaauaucgccucaauucaccaaagucaagaaacagaaaggaaccauaguaaaaguaguagaagacuucgaaguaauugccccacauauauugaucaaccaaagauucuucgauaauggccaggaguuaaccuuggguucagcaacauacaaacacaaugaacaagagcuaauacucgacaaaacagcaguuaaacuacuaaacggagcacuaccucucacccaauccgaggaacuugcagaacagguauaugacgaaauacuggaccaagugaugcauuacuucccacucuacgacaccaaucaauucagagcaaaacuuagcgcgggcaaggcugcauucaugaaauuaccguggaaaucacaaugggauggaaacaaaaugguacaaguuggccaacaaguaaucuuagauagaguccuaaucggacuacacgcaaaugcagccguaucagaucucgggguauuaaaaauaucaacaccccuagguaagaugcagcaaccaaguggaaucucauuaucaccugacacacaaauaaucuaccaaaguccuacaggucuauucgaaaggcgagucgcacuaagagaucuauga

SEQ ID NO: 8911 - RNA, 4107 nt, Artificial Sequence
  Cas9 variant
augagccgucccuacaauauaggauuagauauugguacaaguucaauuggauggagcgucguugacgaccaaucaaaauuagucaguguacgaggaaaguauggauacgguguaagacuauaugacgaaggacaaaccgcagccgagaggagaaguuucaggacaacacgaagaagacucaaaagaagaaaauggcgucuuggauuauuacgagaaauauucgaacccuauauaacuccaguagacgacaccuucuuucugagacaaaagcaaucuaaccugagccccaaagaucaaaggaagcuauacccacaaacaucacucuucaaugauagaacagacagagcguuuuaugaugauuauccuacaauauaccaccuacgcuauaaacuaaugacagaaaaacgacaauucgacaucagagaaauauaucuagcaaugcaucauauaguaaaauauagaggacauuuucuaaacgaagcuccuguaaguuccuucaaaucaucagaaauaaaucuaguugcacacuucgauagacuuaauacuauuuucgcugauuuauuuucagagucaggauuucaacuugaaacagacaaauuagccgaaguuaaagcccugcuacucgacaaucaacaaucagcauccaauagacaacgccaagcacuaucacuuauauacacgccaaguaccaauaaagcaguagaaaaacagaacaaggccauagcaacagaauuacucaaagcgauacuaggacucaaagcaaaauuuaacguguugacccguauagaagcagaagacguuaaagccuggacauuaacauuuaaugcugagaauuuugacgaggaaauggucaaauuagaaucuaguuuagacgacaacgcacaccaaauuauagaaucacuacaagaguuauacagugguauucuccuugcaggaauuguacccgaaaaccagagcuugagccaagcaaugauuaugaaauacgaugaccaucaaaaacacuugaaaauguuaaaagcggugagagaagcauuagcucccgaagauagacaaagacuaaaacaagccuaugaucaauauguagacggacaagaaaauacaaaagccuauagcaaagaagacuucuauggagauauuacaaaagcacucaagaauaacccagaccauccuauuguaagcgagauaaagaaacuuauagaacuugaucaauuuaugccaaaacaaagaacuaaagauaacggagcaauuccucaucaauuacaccaacaagaacuagaccgaauuauagaaaaucagcaacaauacuaccccuggcuagcggaacuaaacccuaacaguaaaagacaaacuguugcaaaauacaaacucgacgagcuaguagcauuucgagugcccuacuacguuggaccauuaaucaccgccgaacaacaacgccagagcucagaugcaaaauuugcauggcuuaucagaaaagcagaaggaagaaucacacccuggaacuuugaugacaaaguugauaggcaagcauccgcuaaugaauuuauaaaaaggaugacaacaacugauacuuaccuauuagccgaagauguucuuccgaaacaaucucuaauauaucaacgguucgagguauuaaacgaauuaaacggucuuaaaauagacgaccagccaauaacuaccgaauugaagcaagcaaucuuuacugauuuauuuaugcagaaaaccucagugucugugaaaaacauacaggacuaccuaguaucagagaaaagauaugcuucaagacccgcaaucacaggacuaucagaugaaaauaaauuuaauucaagacucucuaccuaccaugaccuuaaagcuauaguaggagaugcgguagaagaugucgacaaacaaguagaucuagaaaagugugucgaauggucaaccauauucgaggaugguaaaauuuauucagcaaaacuuaaugaaauugauuggcuaacugaccaacaacguguacaauuagcagcaaaacgauauagaggauggggacgcuuaucagcaaaauuauuaacacaaauagucaacgcaaacggacagaggaucauggaccuucucugggacacaacagauaacuuuaugagaauaguacacucugaagauuuugauaaguuaauaacagaagcaaaucaaaugaugcuugcagaaaaugacguucaagacguuauaaaugaccuauacaccucaccacagaauaagaaagcgcugcgccaaauacuauuaguuguaaacgauauacaaaaagcaaugaaaggccaagccccagaaagaauacucauugaauuugcacgugaagacgaaguaaauccaagacuaucaguacaacgaaaacgacaaguagaacaaguauaccaaaacauaucuaacgaacucuuaaauaacaccgaaauacgaaacgagcuuaaagaccuaucaaauagugccuuauccaacacaagauuauuuuuauacuucaugcaaggaggcagagacauguacacuggagacucauuaaacaucgaucgacuaagcacuuacgauauagaucacauauuaccacaaucauuuaucaaagacaacucgcuugacaauagaguauugguaagucagaaaaugaaccgcucaaaagcagaucaagucccuaccgauuucacaaguguagaauuagguaaaaagaugcaauuacaaugggaacaaauguugcgagcggguuuaauaacuaaaaagaaauacgauaauuuaacacuaaacccagaucauaucagcaaauaugcuaugaagggauucauaaaccgacaauuaguugaaacuagacaggucauaaaacuagccacaaaucuucuaauggaacaauauggcgaagacaacauugaacuaauaacuguaaaaucuggccuaacucaucaaaugagaacagaguucgacuuuccgaaaaauagaaauuuaaacaaccaucaucacgcauucgaugcauaucucacagccuucguaggcuuauacuuacuaaaaagauauccaaaauuaaaaccuuauuuuguguauggagaauaccagaaagccucgcaacaagauaaauggagaaauuucaacuuucuaaauggacuaaagaaagacgaauuaguagacgaaaauacggaagcaguaauaugggauaaagaaucuggacuagcauaccuaaacaaaaucuaccaauuuaaaaagauauuagucacuagggaaguacacgaaaauucuggcgcccucuuuaaccaaacacuauaugccgcuaaggacgacaaagccucaggacaaggcggaaaacaacuuauccccgcuaaacaagauagacccaccgcccuuuauggcggauauagcggaaaaacuguggcuuacaugugcauaguucgaauaaagaacaagaaaggugaucuuuacaaagucugugguguagaaaccaguuggcuugcucaauuaaaacaauugacagacgaagacucucaaaaagcauuucuuaaacagaaaauaaguccacaauucacuaaaguaaagaaacaaaaagguaccauagucaaaguaguagaagacuuuaaaguuauagccccucauauacuaauuaaucaacgcuucuuugauaauggccaagaauuaacauuaggaucagcaacauacaaacacaaugaacaagaacucauauuagauaaaacagcagucaaacuucuuaauggcgcacuaccauuaacucagagugaagaacuggcugaacaaguuuacgaugaaauucuagaccagguuaugcacuacuucccucuauaugacacaaaucaauucagagcuaaguuaucggcagguaaagcggcauucaugaaauuaccauggaaauccaucugggaugguaacaaaaugacacaaauuggccaacaaauaauauuagaucggauucuaauuggauuacacgccaacgcagcggugucagacuuaggcguucuuaaaauaucaaccccuuuaggaaaaaugcaacagccuucaggaauuucccugucacccgacacucagauuauauaucaaagcccgacaggacuauuugaaagaagaguagcacucagggaccuuuga

SEQ ID NO: 8912 - RNA, 4107 nt, Artificial Sequence
  Cas9 variant
augguugagaaaaagucuuauagcauaggguuggauauaggcacaaacucugucgggugggccgucauaacagacgacuauaagguaccggccaagaaaaugaaaguacuaggaaacacaagcagacagucaauaaagaaaaacaugaucggcgcacuacuauuugaugaaggcggccccgcagcaucaacuagaguaaaacgaacaacacguagaagauacacccgaaggaaaaaucgccuuugcuacuuaagagauauauuugaaucggaaaugcauacaauugacaaacauuucuuucuaagauuagaggauucauuucuccauaaaucugacaaacgauaugaagcccacccaauauuuggaacacuacaagaagaaaaggcuuaucacgacaauuacccaaccauauaucacuuacgaaaagcacuggcagauaauaccgaaaaagcagaccuuagguuaaucuaccucgcacuagcucauauaauaaaauucagaggacacuuucucaucgaaggagcacuuagcgcaaauaacacggacguacaacaauuaguucaugcauuaguugacgcauacaauauuauguucgaagaggaucaauuagauauugaagcgaucgauguaaaagcaauacuaaccgagaaaauaucaaaaacaagaagacuggaaaaucucaucagcaauauacccggacaaaagaaaaauggccuauuugguaaccuaauagcauuaucccuaggacuaacaccgaacuuuaaaagucacuuuaaucuuccugaagaugcaaaacuacaacuagcuaaagauacguaugaugaagaacugaacaaccuauuaacccaaauaggggaugaauacgcagacuuguuucuaagugccaaaaauuuaucggacgcuauucuacucucugacauccuuacagucaacggagacggcacacaagcaccacuaucagcuucucuuauuaaacgauacgaagaacaucgacaagaccuagcacuauuaaaacaaauguucaaagaacaauuaccagaucuuuaucgagauguauuuacagaugaaaacaaagauggauacgccggcuauauaucuggaaaaacaucccaagaagcguuuuacaaauauaucaaaccaauauuagagacacuagacggugcugaagacuuucuuacuaaaaucaacagagaagacuuucugagaaaacaaagaacauucgacaacggaagcauaccccaccaaauacacuuaggcgaauugcaagcaauucucgaaagacagcaagcguacuauccguuucucaaagauaaccaagagaaaauagaaaagauuuuaaccuucagaauaccauauuacauaggaccauuagcaagaggaaacagcagauuugcaugguuaaccagaacaucugaucagaaaauuaccccuuggaauuuugaugaaaugguugaucaagaggcuucagcccaagcauuuauagaacggaugacaaauuuugacgaauacuuaccacaagaaaaaguacugccaaaacacucucuaacauacgaauacuuuacugucuacaacgaauuaaccaaaguaaaauauguuacugaaggaaugacaaaaccugaauuuuuaucagcaggacaaaaagaacaaaucguagaacuauuauucaagaaauaccgaaaagugacaguuaaacaauuaaaagaagacuucuucucaaaaauagaauguuuugacacaguggacauaucuggaguugaagacaaauucaaugcaucacuugggacuuaucaugacuuacugaaaauaauaaaagauaaagcguuccuugacaacagcgaaaacgaaaacauaauagaagauauaauacuaacacuaacauuauuugaagauaaagaaaugauagcgaacaggcucgccguauaugaagauuuguuugaccaaaacguacuaaaacaauuaaaaagacgacauuacacaggcuggggaagacuauccaaacaauugauaaauggcaugcgcgacaaacauaccgguaaaacaauauuagacuuucuaaaagccgacggauucauaaacagaaauuucaugcaacuaauuaaugacgacaaucuauccuuuaaagaagaaauaaagaaagcacaggagggcggcuuaaaagacucuaucaacgaccaaauaagagauuuagcagguucaccagcuauuaagaaaggcauacuucagacaauaaauauaguagacgaaauaguaaaaaucaugggaaaagcaccucagcauauuguagucgagauggcccgagacguucagaaaaccgacauaggaguuaaacaaagccgcgaacgcaugaaacgaguccaagaaguucucaagaaacuagguucccaacuccuaaaagaacacccaguugaaaacuuucaauuacaaaacgaaagauuauauuuguacuacuuacaaaacggcaaagacauguacaccggcgaagaacuauccauaagcaaucuaucccacuaugacaucgaccacauuauacccagguccuuuaucaaagacgauucuaucgauaacaaaguuuuaacaagaagugaacauaauagaggaaaaaccgacaauguaccuucaauagaaguaguaaaaagaaugaaaccauauuggcaaaaauuacuugauacaaaaguuaucucacaaagaaaauucgacaaucuaacuaaggcugaacggggaggacuucaagaaucagauaaagccaauuuuauacaacgacaguuaguugaaacccgacagauuacuaaacacguagcccaaauacuagacagcagauucaauacugaaagagaugaaaaggacagaccaauacgccguguaaaaguaaucacccuuaaaucaaaauucguaucagacuuucgccaagacuucgguuucuacaaacuaagggaaaucaacgauuaccaccacgcgcacgaugcauauuuaaacgcaguaguaggaacagcauuacuaaagauguacccaaaacuagcauccgaguucgucuauggcgacuaucaaaaauacgaucuaaaacgcaugguuggaaaaucgggaaaagcuaguggacaugcaaccgcgaaauacuuuuucuacuccaaccuaaugaacuucuucaaaucagaagugaaacuagccaauggaaauauaaucaaacgaucaccuauugaaguuaacgaagaaacaggcgaaauuguuugggacaaaacaaaagauuuugguacuguacggaagguacuaucagcaccccaaguaaacauaguaaagaaaacagaaauacaaacgggaggauucagcaacgaaaccauucuuucaaaaggaaaaucaucuaaauugauaccacgcaaaaacaaauggcgagauacgaccaaauacggaggauuuaauaccccuaccguagcauacucgguucuaguaguagccaaaguagaaaagggcaaagcaaagaaacuaaaaccaguuaaagaacucguugguauuaccaucauggaaagaacaaaauuugaagcuaauccaauagcauuccuggaaaguaaaggauaucacgacauacaagaacaucuuaugauaacgcuaccaaaauauucauuauuugagcuugaaaauggaagaagaagacuucuagcuucagcuacugaauuacaaaaaggcaaugaaaugguacuaccacaacauuuagucacauuuuuauacagaguuaguaaacgagacaaaggaacucaaucagagaacauggaauacauuuccaaccauaaagaaaaauuuauagaaauauuccauuacauaauacgauaugcagaaaagaaugugaucaaaccgaagguuauagagcgauuaaacgacacauuuaaccaaaaguuuaaugacucagaccucaccgaacuaucaauauccuucuuaaaucucuuuaaguuuacaucauucggagcaccagaaaaauuuacauucuuaaacucagaaauaaaacaagaugacguacgauauagaucaacaaaagaaugccugaacagcacauuaauacaccaauccguuaccggucuuuaugaaaccaggauugaucuuucacaauucgguggggacuga

SEQ ID NO: 8913 - RNA, 4107 nt, Artificial Sequence
  Cas9 variant
auggacaagaaauauucaaucggacuagacauaggaacaaauucaguaggaugggcugugauaacagaugacuauaaaguuccaucaaagaaauucaaaguauugggaaacacagauagacacaguaucaagaaaaacuuaauaggcgcacuuuuauuugacucaggcgagacagccgaagccaccagauuaaaacguacugcaagaagaagauauacaagaagaaagaaucgaauuugcuauuugcaagaaaucuuuucaaacgaaauagcgaaaguugacgacuccuuuuuccacagauuagaagaaaguuuucucguugaagaggauaagaaacaugaaagacauccaaucuucgguaauaucguagaugaaguagcauaucaugaaaaauauccaaccauauaccaccucagaaagaaacuagcugauaguaccgacaaagcagacuuaagauuaaucuaccuagcacuggcucauaugauaaaauuuagagggcacuuucuaauagaaggagacuugaauccugauaacucagacguagacaaacuguucauacaguuaguacaaacauacaaucaacuauucgaagaaaaucccauuaaugcaagccgcguagaugccaaagcuauucuaucugcaagacuauccaaaucacgaaggcuagaaaaucuuauagcgcaacuaccuggugagaaaagaaauggacuauucggcaaucucauugcguuaucucucggauugacgcccaauuucaaaagcaauuuugaucuagccgaggacgcuaaacuucaauuaaguaaagauacauacgaugaugaucuagauaaucuauuagcccaaauuggagaccaauacgcugaccuauucuuggcggccaaaaaucuuuccgacgcaauacuauuaucagauauacuuagggucaacaccgaaauaaccaaagcaccccucagcgcaaguaugauuaaaagauacgaugaacaucaucaagaccuaacauuauuaaaagcacucguacgacaacaacucccagagaaauauaaagaaaucuuuuucgaccaaaguaaaaauggauacgcuggauacauagauggaggagcaagccaagaagaauuuuacaaauucauaaaaccgaucuuagagaaaauggacggaacugaagaacuacuugcuaaauugaaccgugaagaucuauuaagaaaacaacggacuuuugauaauggaaguaucccucaccagauacaucuuggagaacuccaugcgauacuccgacgucaagaagacuuuuauccauuccuaaaagauaauagagaaaagaucgagaaaauacuaacauucaggauaccauacuauguaggaccccuagccagagguaacaguagauuugccuggaugacacgaaaaucagaagaaacaauaacgccuuggaauuucgaagaaguaguggacaaaggugccucggcacagagcuuuauagaaaggaugacaaacuuugauaaaaaucuccccaacgaaaaaguccucccaaaacauagucuacuguacgaauauuuuacaguauacaaugaauuaacaaaaguaaaauacguaacagaaggaaugagaaaaccugcauuucuaucaggcgaacaaaagaaagcgauuguagacuuauuguucaaaacaaacagaaaaguaacagugaaacaacucaaagaagacuauuuuaagaaaauagaaugcuuugauucaguagaaaucucaggaguagaagaucgauucaaugcaucgcucggcacuuaccaugaccuuuugaaaauuauaaaagacaaagauuuucucgacaacgaagaaaaugaagacauccuggaagacauagucuuaacauuaacauuauuugaagauagagaaaugauagaagaaagacuuaaaacguaugcacaccuauucgacgauaaaguaaugaaacaauuaaaaaggagacgauacacaggcuggggaagacuaagucgaaaacuuaucaacggaauaagggauaaacaaagcggaaaaacgauauuagacuuuuuaaaguccgauggauuugccaaccggaauuucaugcaacuuauacacgaugauucacucacguuuaaagaagaucuacaaaaagcacaggucucagggcaaggagacucguuacaugaacacauagcuaauuuagcaggaagcccagcaauaaagaaaggaauauuacaaacuguaaaagucgucgacgaacucguuaaagucaugggucgucauaaaccagaaaauaucguuaucgagauggcacgggagaaucaaacuacccaaaaaggccagaaaaauucgagagagaggaugaaaagaauagaagaagguauaaaagaguuaggaucagacauacuaaaagaauauccaguagaaacuacgcaauuacaaaacgagaaacuuuacuuauacuaucuacaaaacggaagggacauguacguagaccaagaacucgacauaaauagauuaagugauuaugauguggaucauaucguaccccaaucuuuccuaaaagacgauuccaucgauaauaaaguucuaacaagaucagacaaaaacagaggaaaaucagauaauguacccucagaggaaguaguaaagaaaaugaaaaauuacuggaaacaacuacuaaaugcaaaauuaauaacacaaagaaaauucgacaaucuaacuaaagcggaaagaggaggauuaucagaacucgauaaagcagguuuuauaaaacgacaauuagucgaaacaagacaaauaacgaaacauguagcacaaauccuugauucucggaugaacacaaaauacgacgaaaaugauaaacucauacgagaaguaagaguuauuacguuaaaaucaaaacuugucagcgacuuuagaaaagacuuucaauuuuauaaaguaagagaaauaaacaacuaucaccaugcacacgacgcauaucuaaaugccguaguaggaacggcacuaauaaagaaauacccuaaacuagagagugaauuugucuacggcgauuacaaagucuacgauauaaggaaaaugauagcaaaaagcgaacaagaaauugguaaagcaacagcgaaauauuucuucuauuccaauaucaugaacuuuuucaaaaccgaaauaacacuugccaacggagagauacguaaaaggccauuaauagaaacuaauggggaaacaggggaaauugugugggauaaaggaagagauuucgccacaguuagaaaaguuuuauccaugccccaaguaaacaucgucaagaaaacagaaguccaaacagguggcuucuccaaagaaucaauacuaccgaaacgaaauucagacaaacuaauugcaagaaagaaagacugggauccuaagaaauauggcggauuugacucaccaacaguugccuacucagugcuagugguugcaaaagucgaaaaagguaaaucaaagaaacuaaaaagcguuaaagaauuaguaggcauaacaauaauggaacgaucaucauuugagaaagacccagucgacuuucuggaagcaaaaggauauaaagagguacggaaagaucugauaauuaaacuaccgaaauauucccuauuugaauuagaaaauggaagaaaacggauguuagcuucagcuggugaguuacaaaaaggcaacgaacuagcauuaccguccaaauacguaaauuuucuauaucuagcaucacacuacgaaaaacuuaaaggaagcccugaagauaaugaacaaaaacaacucuucguugaacaacacaaacauuaucuugaugagauuauagaacaaauuucagaauuuagcaaaaggguaauucuagcagacgccaaccucgauaaaguccuaagcgcuuacaauaagcacagagauaaaccuaucagggaacaagcagaaaacauuauacauuuguuuacuuuaacaaaccuaggugccccugcagcauuuaaaugcuuugauacaacaaucgggaggaauagauauaaaagcauaaaggaaguauuagacgcuacacuuauacaccaaucaauaacuggccuguaugaaacuaggauugaucucucgcaauuagggggagacuga

SEQ ID NO: 8914 - RNA, 4107 nt, Artificial Sequence
  Cas9 variant
auggauaagaaauauucgauaggacucgauauaggcacaucauccauaggcuucguaggagucgacgaaaaugguuggccucuaaauauaaaaggaaaaagagcaauaggcgcucacuuauuuagagaaggugaagcagccgcagaaacucgaggcuuccgcacaacccgacguagauacaacagaagaaaauggcgauuaagacuccuuagggaaauauuugacgaaccuaucaguagaguagacccaaccuucuucgccagaaugaaagaauccucaguauccccgaaagacccaaauuaugacggccuugccaaagaaauuuuaauaccucgagacaaagauggcaaaauacuauauccuacuauauaucacuuacgucaugcacugauguacgaagaccaccaauucgauaucagggaaauuuacuuagcaauacaccacauugucaaauaccguggacacuuccuacuugacggcgcagccaaaaauuucgaaucuaguaaccucgacuugaaaucagacauacacgaaauaaaugcgaucuuaguuggaauauucggaaacgaacaaguccaauucaaugaucaauauguugaaaaacuaaaagaaguucuucuagacuccacacaaucaagauccgauagacaaaaagcagccgcaaaauuacucuuacccacuaaugaccucgacaaagauacaacaaaaauucuaaaaaccguuucaaccgaaaucacaaaagcaauaacaggccuaaaagcgaaauucuucgucauaacuggaaacgauauugcaaaagaccaacaaaaagacuggacauucucaauugauacauuggacgaaaagaugucuguaaucgaacccucauuuucagagaaaaauuucagccuaauaacaauacuacaaaaauuauacuccagcguaacacuggcaggaaucgugccaaauggccuuagcuuaucagaagccaugauacaaaaauacgauagacacgcaucagauuuaguauuacuaaagaaauacugggacacuaaaccaaaaguacuuaaacaucaauugcaaaacacauaugcagaauacauugaaauacaucaaguagucgacgaguucuauucagaccuuuccaaacugaucaaaaaugaugaugacacacuagcacaagaaauaaaaucuaaaaucacuauaggcaauuuucuaccaaaacaaagaacaacagaaaauggcguuauaccuuaccaacuacaacaaagagaacuugacacuauaaucaaaaaucaacaagaauacuacccaugguuggccgaagaaaauccaguugcggaccaccaaaucgcuuucccguauaaacuugacgaacucgucggauucagaaucccuuacuauguaggcccaaugauagcuaaagaagauaccucuaacucuaaaaacaguaaauucgccuggaugauaagaaaacaaucgggagaaguaacuccuuggaacuucgaugagaaaauagacagaaccgcaucagcaacugcauucaucgauagaaugacaacaaccgauaccuauuugaucggagaagacguucuuccaaaacaaagucugaucuaucaacgauuugaaguauuaaaugaauuaaauaaaauauccauagauggacaaccuaucacaagaaaacaaaaacaaucaguauacacacacgucuucgagaaaaagaaaacaguucaaguuaaagacguccaaaaauuucucguaagcucgggcgaaguaaugagccuaccaaaaaucgguggacuagcaaaugaaaaacaauucaacaguaguuuaucuacccuauacgacuauaacaaaauaaucccggaugcauuggaagacaggaauaaaguagaugacaucgagaaaauaauauuguggucaacaauauucgaagacaauucaaucuucguagaaaaacuugacucuauagacugguuaaccucaucucaacguaaaagacuagcccagaaaagguaccgaggguggggucgacucucccuuagacuacuuacaacauuuaaaaacaaagacggcuauucaauacucgacgaauuauggaacucaaaucacaauuucauggaaauacaagcacaaucagacuuuagcgagcaaauagcaacagcaaauaacaauaauuuaucacaaguacuaccagccaaaugggaaccaggaaggaaaaaucucgcaucacuagacgaguucauuucaaauuuauacacaucuccacaaaacaagaaagcgcuucgaaaagccauccgagucguucaagacaugaugacagcugcaggucacaugccagaaaagauauuuauagaaguagccagagacacaucgaacagccaccaacaaacaauagcaagacaacggcaacuacaacaacuauaucaaucagaagauaaagaaguaauugauuccucaguuaggagugaacuagaugacauauugaaaaacagagcuaacauaaaagaucaauuauuccucuauuuccaacaaggugguagagacuuauacacuggaaaagcuauaaacaucgauaaauuaaguuuauaccacaucgaccacauacucccacaaagccuagugaaagaugacucauuagauaaucgaguccuaguaucucagaaaacgaaugaagauaaggggguaacauuuguaagugacaaguauaugaacaauauguuaccaaccuggaaaagauggcaugaaaugggacuaauaucagcucguaaacuuaagaaucuaacaaugagaccagaugagauagauaaauaugcuccaggguuuauacaaagacaauuaguggaaacucgacaaguuacaaaauugguaauagaguuauuagacgcacuuuuagggaacucacaaacagaaaucaucaccauaaaagcaaguuuaucccaccaauuccggcaacaguucgaccuaguuaaaauaagggaaguaaaugauaaccaucacgccuucgacgcauuucuagcugcucguauaggaacauaucucuauaaaagauaccccaagcucagaccauauuuuguuuacggacaguauaugcaaaaucacaaaaaccuuaaguccaucaauuuaauaaaaacacuagacucagauaaagcaauaguagacgaagguaccggggaaauacuuugggauaagaaaagugaucuugcgaaaaugauaaaaaucuacaacuaccaaagguuacuaauuacacaugaaagccgaaccucuuuuggagcuauguacaaacagaaaauucucaaagcaacggaugcuaaacaaaacggcgggggauuuaaauuagucccaacaaaacgaaaccgcccaguagacauauacggagguuacaccggucaaaccgcagcuuauuuaacaauaguccgagucuauucaaagaaaaccucagaauuacgaguguugccuauauauaccaauaaaguucaacaaauagagaaagcaaugacucaaggagauaaagcaacaaugcuagcauuuaagaaaguuauagcuccgcagcuaggaaaagaaaauaagaaaacacacgaaaucaaaauaccugaguucgaugucguaauuccaaaaguacuauuagaucagcuaguaauagacgacauugccggaucaccacaccgguuccgucucggaacugacacauauuaucauaauucacagcaacuauuuuuaccguuauccaugcaaagacagcuaauggacagagaaucagacgauaaaguauauuuagauauauucaaugaugucuugaaacaaguagacucauauuuuaacuuguacgacguaaauggcuucagggcagcauuacagaaaagcaagaaagcguucgaacaacuaccaaucaaugauuucccuaaagacgucccagauaacaagaagaagaaaggaaaacguuccauucucaaagagauauuuauuggacuccaugcaaacgcaacauuaggcaauuugaaacaaauggggauaaaaacugacuucgguaaacuacaaaaauccaauggucucagaauuacugaaaacuguaaaauaauacaccaauccccaacgggucuauucgaaagaauaguacccauuaaauga

SEQ ID NO: 8915 - RNA, 4107 nt, Artificial Sequence
  Cas9 variant
auggauaaaaaauauaguauaggccuagauauaggaacaaacaguguugguugggccguuauaacagacgacuacaaagucccauccaaaaaauucaagguacuuggcaacacagacagacauagcauaaaaaagaaccuaauaggcgcacuacuguucgacaguggcgaaaucgcggaagcuacaagauuaaaaaggaccgcacgacgaagauacacaagacgaaaaaauaggaucugcuacuuacaggaaauauuuagcaacgaaauggcaaaaguagaugauagcuuuuuucacagacuggaagaaucuuuucuagucgaagaagauaaaaaacacgaaaggcaccccauauucggaaauauagucgacgaagucgcauaucaugaaaaauauccaacaauauaucaccuacgaaaaaaacuaguagacucaacagauaaagcagauuuaagauuaauuuaucuggcgcucgcucacaugaucaaauuuagaggacacuuccuuaucgaaggcgaucuaaaccccgacaacucagacgucgauaaauuauucauucaguuaguacaaacauacaaucaacuauuugaagaaaauccuauuaaugcaucaggaguagaugcaaaagcuauucuauccgcucgacuaucgaaaagccgacgucuagaaaaucuaauugcccaauuaccuggggagaagaaaaauggauuguucgguaaccuuaucgcacucucacuagggcuaacaccaaacuucaaaaguaauuuugauuuagcugaggaugcaaagcuucaacuaucaaaagauacguaugaugacgaucuagacaacuuauuagcccaaauaggagaccaauacgccgaucuuuuccuagcagcuaaaaauuuauccgacgcaauacuacuauccgauauuuuaagacuuaacucagaaaucacaaaagcaccauuaucggcaagcaugauaaaacgguacgacgaacaccaucaagacuuaacacuacuaaaagcucucguacgccaacaacuacccgaaaaauacaaagaaaucuuuuucgaucaaucaaaaaauggauaugcaggcuacauagacggcggagccucgcaagaagaauucuauaaauuuauaaaaccaauauuggaaaaaauggauggaacagaggaacugcuagcaaaauuaaauagagaagaucuacugagaaaacaacgcacuuuugacaaugggaguauaccgcaccaaauucaucuaggagaauuacaugcaauccugagaaggcaagaggacuuuuauccauuuuuaaaagauaacagagaaaaaauagaaaaaauacuaaccuuuagaauuccauauuacguuggcccuuuagcgcguggaaauagccgcuuugcguggaugacuagaaaaagugaagaaaccauuaccccuuggaauuucgaagaagugguagacaaaggagccucagcucagucauucauagaaagaaugacaaauuucgacaaaaaccuccccaaugaaaaggucuugccaaaacacaguuuacucuacgaauacuucacaguauacaacgaauuaaccaagguuaaauacguuacggagggaaugcgaaaaccugcuuuucucucaggcgaacaaaaaaaagcaauuguggacuuauuauuuaaaacaaacagaaaagugacaguuaaacaacuaaaggaagauuauuuuaaaaaaauagagugcuuugacucaguggaaauuucaggagucgaagaucgauucaaugcgagccuuggaaccuaucacgaccucuuaaaaauaauaaaggacaaggauuuccuagacaacgaagaaaacgaagacauauuagaagauauaguccugacuuuaaccuuauuugaagaucgcgagaugaucgaggaacgacuaaaaacuuacgcccaccuauucgaugacaaaguuaugaaacaacuaaaaagaagaagauauacagucuggggcagacuaaguaggaaauugauaaacggaauuagggauaaacaaucgggaaaaacaauuuuagauuuucuaaaaucagacggguucgcaaacagaaauuucaugcaacucauacacgaugacucucucacuuuuaaagaagauauacaaaaagcacaggugucggggcaaggcgacagucuccaugaacauauugccaaucuagcaggaagucccgcaauuaaaaaaggaauucuucaaacaguuaaaguaguagacgaauuagucaaaguaaugggacgacacaaaccugaaaacauaguuauugagauggccagagaaaaucaaacaacacagaaaggacaaaaaaauagcagggaacguaugaaaagaauagaagaaggcauaaaagaacugggaagucagauacucaaagaacauccggucgaaaauacccaacuacagaacgaaaaauuauaucuauauuaucuacaaaacggcagagacauguacguagaucaagaacuugacauaaauagauuguccgauuacgaugucgaucacaucguaccacaauccuucauaaaagaugacagcauagauaauaaaguauuaacccgauccgacaaaaaucgcggaaaaucagauaauguaccaagcgaagaaguuguuaaaaaaaugaaaaacuacuggagacaacucuugaaugcaaaauuaauaacccaacgaaaguuugacaaucugacgaaagccgaaagagguggucuaucagaacuagauaaagcagguuucauuaaaagacaguuaguagaaacccgacaaauuacaaaacauguagcucagauacuagauucgagaaugaacaccaaguacgaugaaaaugauaaacuaauaagggaagucaaaguaauaacacuaaaguccaaacucguaagcgauuuuagaaaagauuuucaauucuacaaagucagagaaauuaacaacuaccaucacgcccaugacgcauaucucaacgcgguugucggcacggcccuaauaaaaaaauacccaaaacuagaauccgaauucguauauggugacuauaaaguuuacgacgugagaaaaaugcuagcgaaaucagaacaagaaauaggcaaagcaacugcaaaauauuuuuucuauucuaacauaaugaauuuuuuuaaaacagaaaucacauuggccaauggagaaauacgaaaaagaccauuaauagaaacuaauggggaaacuggagaaauaguuugggauaaaggccgagacuuugccacuguuaggaaaguuuuaucuaugccacaaguaaacauagucaaaaaaaccgaaguacaaacaggagguuuuagcaaagaauccauauuaccaaaaagaaacagcgacaaauuaauagcccguaaaaaagauugggauccaaaaaaauacgguggauucgauucuccaacagucgccuacuccguucuaguagucgcaaaaguagaaaagggaaaaagcaaaaaacuaaaaucaguuaaagaacuucuagggauaacuaucauggaaagaaguaguuuugaaaaaaauccaauagauuuccuagaagcaaagggauauaaagaagucaggaaagaccuaauaauaaaacucccgaaauauagccuauucgaauuagaaaauggacgaaaacgcaugcuagcaagugcuggagaacuacagaaagguaacgaauuagcacuaccaagcaaauacguaaacuuucuuuacuuagcuucacauuacgaaaaacuaaaaggcucacccgaagacaacgaacaaaaacaacuauucgucgaacaacauaaacauuaccucgacgaaaucaucgagcaaauuuccgaauuuagcaaaagagugaucuuggcugacgcuaaucuagauaaagucuuauccgcuuauaacaaacaccgcgacaaaccaauacgagaacaagccgagaacauaauacauuuauuuacucuuaccaaccuuggagcaccaaccgccuucaaauacuuugacacaacaauagaccgcaaaagguacacauccaccaaagaagugcuagaugcgacauuuauacaccagucuaucacuggacucuaugaaacacgaaucgaccucucacaacuuggaggugacuga

SEQ ID NO: 8916 - RNA, 4107 nt, Artificial Sequence
  Cas9 variant
auggacaaaaaauauuccaucggauuagacauagguacgaacucugucggcugggcuguuaucacagacgauuauaagguaccauccaaaaaauucaagguauuagguaauacagaucggcacucaauaaaaaaaaaucuaauaggggcacucuuauucgacucgggcgaaacugcggaagcaacaagauuaaaaagaaccgcaagaagaagguacacacguaggaaaaaucgaaucuguuauuuacaagaaauauuuucaaaugaaauggcaaaaguagaugauucauuuuuccacaggcuagaagaaucauuucuaguagaagaagacaaaaaacaugaaagacauccaauauucggaaauaucguagaugaaguugcauaccacgaaaaauacccaaccauauaucaucugagaaaaaaauuagucgauucaacagacaaagcugacuuaagacugauauacuuagcccuagcucauaugauaaaauucagaggacauuucuugaucgagggagaucuaaauccugacaacucagacgucgauaaauuauucauucaacugguacaaacuuacaaucaauuauucgaggaaaauccuaucaaugcaagcgguguagaugcuaaagccauacuuucagcccgccuaagcaaaucgagaagacucgaaaacuuaauagcccaauuaccuggagaaaagaaaaaugguuuauuugguaaucuaauagcccuaucacuaggacuaacaccaaacuuuaaaaguaacuucgauuuagcugaggaugcuaaauuacaauuaucuaaagauacauacgacgacgaucuagacaaccuacuagcccaaauuggugaccaguacgcugaucuauuccuagccgcaaaaaaccucuccgacgcuauacuuuuaagcgauauuuuaagauuaaacucggaaauaacaaaagcgccucucucagcaagcaugaucaaaagauacgacgaacaucaucaagaucugacgcuauuaaaagcuuuaguacgccaacaauuaccagaaaaauacaaagaaauuuucuuugaucaaucaaaaaacggauacgccgguuacauagauggcggggcaagucaagaagaauucuauaaauuuauuaaaccaauacuggaaaaaauggacggaacugaagaacuacuagccaaguuaaaccgcgaagaucuacuaagaaaacagagaaccuucgacaauggaagcauuccacaucaaauucaucuaggugaguuacaugcaauccuuaggaggcaagaagacuuuuauccguuucuuaaagacaaucgugagaaaaucgagaaaauacuaacuuuuagaauaccauacuacguaggaccucuugcacgagguaacagccgauucgccuggaugacaagaaaaucugaagaaacaauaacaccguggaauuucgaggaaguaguugauaaaggggcguccgcccagucauuuaucgaacgaaugacuaacuucgacaaaaaucuaccuaaugaaaaaguucucccgaaacauagccuacuauaugaauauuuuacaguauacaaugagcuuacuaaaguaaaauacguaacagaaggcaugcgaaaaccugcguuccuaucuggagaacagaagaaagcaauaguagacuuacuuuuuaaaacaaacaggaaagucacaguaaaacaacuuaaagaagacuacuucaaaaaaauagaauguuuugacucaguggaaaucucaggaguagaagaccgauucaaugcgucuuuggggacauaccaugaccuccuuaaaaucauaaaagacaaagauuuucuagauaacgaagaaaaugaggacauacuagaagacauagugcucacauuaacgcuauuugaagaccgugagaugauugaagaacgauuaaaaacauaugcacaucuuuuugacgacaaaguaaugaagcaauuaaaaagacgaagguacacaggauggggccgauuaucaagaaaauugauuaauggaauacgcgacaaacaaagcggaaaaacaauacucgauuuccuaaaaucagaugguuucgcuaaccgaaauuucaugcaauugauccacgaugauucacuaacguuuaaagaagauauacaaaaagcucaagucucaggacaaggagacucacuacaugaacacauugcuaaucuggccggcaguccagccauaaaaaaaggaauuuuacaaacaguuaaaguaguagacgaacuaguuaaaguaaugggaaggcacaagccagagaacauuguaauagaaauggcgcgugaaaaucaaacgacacaaaaaggacagaaaaauucaagagaaagaaugaaacgcaucgaagaagggauaaaagaacuaggaucacaaauucuuaaagaacauccaguagaaaauacacaacuccaaaacgagaaauuauauuuauacuauuuacaaaacgguagagauauguaugucgaucaagaacuagacauuaacagauuaucagauuaugauguagaccauauagucccacaaucuuuuauaaaagacgacuccauagacaauaagguccuaacuagaucggacaaaaauagaggaaaaucgaacaacguuccaucugaagagguaguaaaaaaaaugaaaaauuauuggagacaacuauuaaacgcaaaacuaaucacgcaaagaaaauucgauaauuuaaccaaagcagaacguggaggauugucagaacuagauaaagcgggauucauaaaacgacaacuaguugaaacgcgacaaauaacaaaacauguagcacaaauccuugauagccgcaugaacacuaaauaugaugagaaugacaaguuaauucgagaagugaaaguaauuacacucaaaaguaaauuaguaucugauuucagaaaagacuuccaauuuuauaaaguacgugaaauaaauaacuaccaccacgcacaugacgcauaccugaaugcaguaguaggcacugccuuaaucaaaaaauauccuaaauuagagucagaauucgucuacggagauuauaaaguauaugacguaaggaaaaugauugcgaaaagugaacaagaaauaggaaaagcaacagccaaauauuuuuuuuauucaaacaucaugaacuuuuuuaaaacagagauaacccuagcaaauggagaaauaagaaaacguccacuaaucgaaacaaacggagaaaccggcgaaauaguaugggacaaaggccgagacuucgcaacgguaagaaaaguacucagcaugccacaaguaaauauagugaaaaaaacagaaguacagacagguggauuuucaaaagaaucuauauuaccaaagagaaauucagauaaacuuauugcuagaaaaaaagacugggauccaaaaaaauauggaggauuugacucaccaacaguagccuauagugugcuaguuguugccaaaguugaaaaagguaaaucuaaaaaauugaaauccgucaaagaacuauuaggaauaacaaucauggaacgaagcucuuuugaaaagaaucccauugauuuccuagaagcaaaaggauauaaagaagugaggaaagaucucauagucaaguugccaaaauacagcuuauucgaauuagaaaaugguagaaagaggauguuggcaucagcuggcgaacugcaaaaaggaaaugaacuagcucuaccuucgaaguacguaaauuuuuuauacuuagcaucacauuacgaaaaacuaaaaggaucaccagaagacaaugagcaaaagcaacuauuuguggaacagcauaaacacuaucucgaugaaauaauugaacaaauaagcgaauucuccaaaagaguuauacuugcugaugcgaaccuagauaagguacucagugcuuacaauaaacacagggacaaaccaaucagggaacaggcugagaacaucauacaucuauuuacccugaccaaccuaggagcccccgcggcauuuaaauacuuugauacuacaaucgacagaaaaagauacacaagcacaaaagagguccucgacgccaccuuuauacaccaaaguauaacgggauuauaugaaacacgaaucgacuuaucacaacuuggcggagacuga

SEQ ID NO: 8917 - RNA, 4107 nt, Artificial Sequence
  Cas9 variant
augucaagaccauauaauauaggguuagacaucggaacaucaucaauaggauggagcgugguagacgaccaaagcaagcuagucuccgucagggguaaauacggcuauggcguccgacuauacgaugaaggccaaacagcagcagaaagacgaucuuuuagaacgacuagacgaagacugaaacgucgaaaauggagacugggauuauuacgagaaauuuuugaacccuauauaacacccauagaugacacguucuuuuuaagacaaaaacaaucaaaucuuagcccuaaagaccaacgcaaauuauauacccaaacaagccuauuuaaugaucgaacagacagagcauuuuacgaugauuacccaacuauauaccaccuucgauaccgauuaaugaccgagaaaagacaauuugacauaagagagauauauuuggcaaugcaccauaucguaaaauaucgaggacauuucuuaaacgaagcucccgucucgucauucaaaucauccgaaaucaaucuaguggcgcauuucgauagacucaacaccauuuuugcugauuuauucagugaauccggauuucagcuagagacagacaaauuagcugagguaaaagcucuacuguuagacaaucaacaaucagccagcaaucggcaaagacaagcucugucucuaaucuauacaccaucgaccaacaaagcaguugaaaaacaaaauaaagcaaucgcaacagagcuccuaaaagcaauauuaggacuaaaagcaaaauucaauguauuaacagguauugaagcagaagacguaaaagcauggacguuaaccuucaaugcugaaaauuuugacgaggaaaugguaaaauuagaaagcagucuugaugacaacgcacaccaaaucauugaaagucuacaagaauuauauucaggaguccucuuagcagguauaguaccagaaaaccagagcuuaagucaagcuaugauuaccaaauacgacgaucaucaaaagcauuuaaagauguuaaaagcgguucgagaagcauuggcaccaggagauagacaaagacuaaaacaggcuuaugaccaauacguagauggccaagaaaauacgaaagcauacucuaaggaagauuucuacggagauauaacaaaggcacuuaaaaacaauccugaccauccuauagucucugaaauuaagaaacuaauugaacuagaucaauuuaugcccaaacaacgaacuaaagauaauggcgcaauuccgcaccaacuucaccaacaagaauuagauagaauaauagaaaaccaacaacaauauuauccguggcuagcagagcuaaacccaaauucuaaaagacaaacagucgcaaaauacaaauuggacgaauuagucgcauuucgaguacccuacuauguaggcccucucaucacggcagaacaacaacgacaaagcagcgacgccaaauuugcauggcuaauuagaaaagcagaaggucgaauaacaccauggaauuucgaugauaaaguggaccgucaggcuuccgcuaaugaguuuaucaaaagaaugacgaccacagauaccuauuuauuagcagaagacgugcuuccuaaacaaucacuuauuuaccaacgauucgaaguccucaaugaauuaaacggccugaaaauagaugaccaaccaauaaccacagaauuaaaacaagcaaucuuuacugaccucuucaugcagaaaauaagugugacagucaaaaacauccaagacuacuuaguaucagagaagagauaugccucaaggcccgcaauaacaggauuauccgaugaaaauaaauuuaacaguagauuauccacauaucaugauuuaaaaaugauuguaggagacgcaguagaugacguagacaaacaagcagauuuagaaaaauguauagaauggucaacaauuuuugaagaugggaagauauacucagcuaaguuaaacgaaauagacuggcuaaccgaccaacaaagaguacaacuugcagcaaaaagguacaggggaugggggcgacuauccgcaaaauuauuaacacaaauaguaaacgccaauggccaaagaauaauggacuuauuaugggacacgaccgacaauuuuaugagaauaguacacucagaagacuucgacaaacuuauuaccgaagcaaaucaaaugauguuagcugaaaaugauguacaagauguaaucaacgaccuuuauaccaguccccaaaauaagaaagcucuaagacaaauacuccucguaguaaaugacauccaaaaagcaaugaaaggacaagcaccagaaagaauacuuauagaguucgcaagagaagacgaaguaaacucacgauuaucaguucaacgcaaacgacaaguagaacaaguuuaccaaaauauaucgaaugaacuauuaaacaauacagaaauaagaaaugaacuaaaagaucuaagcaauucagcacugucuaacacacgcuuauuccuauacuucaugcaagggggcagggauauguacacaggagauucacuaaacauagacagacuuucaacauacgauauugaucacauauuaccacaaucuuucauaaaagacaauucucuagauaauagaguacuuguuucacaaaagaugaacaggucuaaagcagaucaaguaccgaccgauuucaccuccguagaacuuggucagaaaaugcaaauacaaugggaacaaaugcuacgcgcaggcuugaucacgaaaaagaaauaugauaaucuuacauuaaacccugaucauauuagcaaauacgccaugaaaggcuucauaaaccgucaauugguagaaacacgccagguaaucaaacuagccacaaacuuacuuauggaacaguacggcgaagauaauauagagcugauaacaguuaaaagcggccucacacaucaaaugagaaccgaguucgacuucccuaaaaacaggaaucucaauaaucaucaucacgcuuucgaugcguacuuaacagcuuuuguaggccuuuauuuauuaaaaagauauccaaaacuuaaacccuauuucgucuacggugaauaucaaaaagcaucucaacaggauaaauggaggaacuucaauuucuuaaauggauuaaagaaagaugaguugguagaugaaaauacagaagcaguaaucugggacaaagaaucuggucuugcauaccugaacaaaauauaucaauucaagaaaauauuaguaacacguggaguacacgaaaauucaggagcccucuucaaucagacccuauaugccgccaaagaugauaaagcauccggacaaggaggaaaacaauuaauaccagcaaaacaagacagauccacagcauuauauggaggauacaguggaaaaacuguggcuuauaugugcauaguaaggaucaaaaacaagaaaggcgacuuauacaaagugugcgggguugaaaccucauggcuagcccaauuaaaacagcuaacugacgaagacucacaaaaagccuuccuugaacagaaaauaucaccacaauuuacaaaagucaagaaacaaaaagguaacauaauagaagcaguugaagaauuugaaguaauagcaccgcauauacuaaucaaccaacgauucuuugacaacggacaagaacuaacacuagguucagcaacauauaaacauaaugaacaagaauuaauccucgauaaaacagcaguaaaacugcuaaauggugcauuaccccuaacccaaucugaggaauuagcagaacaaguguacgacgaaauuuuagaccaaguaaugcacuauuuuccacuauacgacaccaaucaauucagagcuaaacuuucaacagggaaagccgcauuuaugaaacuacccuggaaaucacagugggacgguaauaaaaugguacaggugggacaacaaguuauucuagacagaauauuaauuggucuacaugcaaacgccgcaaugucagauuuaaaaguacuaaaaaugacaacaccauucggcaugauacaacagagcacaggaauaacgcuaucugcagacacccaaauaaucuaccaaaguccaacaggccucuucgaaagacguguagcuuuaagagaucuauga

SEQ ID NO: 8918 - RNA, 4107 nt, Artificial Sequence
  Cas9 variant
auggacaagaaauacucaauagguuuagauauaggcaccaauagugucggaugggccguaaucacagaugauuauaaaguaccuuccaagaaauuuaaaguacuggguaauacagaccggcacaguauaaagaaaaaucuuauuggggcucuacuauucgauucaggcgaaacugcagaagcuacacgacucaaaagaaccgcuagacgacgauacacucgucguaaaaaccgaauauguuaccugcaggaaaucuucagcaacgaaauggcuaaaguagaugauucauucuuccauagacucgaagaaucauuucucguagaagaagauaaaaagcacgagcgacaucccauauucggcaauauuguggaugaaguagccuaccacgaaaaauauccaacuaucuaccaucuacguaaaaagcuagucgacucgaccgacaaagcagaccuacgcuuaaucuaccuggcauuagcacacaugauuaaauuucgaggucauuucuuaauagagggggaucuaaacccggacaacucagaugucgacaaacuauucauacagcuaguucaaacauauaaucaacuauucgaagaaaacccaauaaacgcuucuggaguagacgccaaagcgauauuaucagcaagacuaaguaaaagcagaagauuagaaaauuuaaucgcacaauuacccggugagaagaaaaacggccuauuuggaaaccucauagcauuaagccuaggcuuaacucccaauuuuaaaagcaauuucgacuuagcugaggacgcaaaacuucaacucucaaaagacacguacgacgaugaccucgauaaccuacuagcccagaucggcgaccaauacgccgaccuauuccuugccgcuaaaaacuugucagacgcaauauuacuuuccgacauauuacgccucaauuccgaaauaacuaaagcaccacuaagugccagcaugauaaagagguaugaugaacaccaccaagauuugacacuucuaaaagcucuaguucgacaacagcuaccagaaaaauauaaagaaauuuucuuugaucaaucuaaaaacggauacgcaggauauauagauggaggagcaucacaagaagaguucuauaaauucauuaaaccaauuuuagagaaaauggacggaaccgaagaauuacuagcuaaacuaaauagagaagauuugcuaaggaaacaaagaacuuuugacaauggaucaaucccucaccagauucaucucggagaauuacacgcaauauuacgccgucaggaagauuucuacccauucuuaaaagacaacagagaaaagaucgaaaagauauuaacauucagaauccccuauuacguagguccgcuagcaagaggcaauucaagauucgcauggaugacacggaaauccgaagaaacaauaacacccuggaauuuugaagaagugguagacaaaggagcauccgcacaaucuuuuauugaacgaaugacaaacuuugacaaaaacuuaccgaaugaaaagguacuaccaaagcacucacuucuauacgaauacuucacaguauauaacgaacuaacuaaggucaaauacguuaccgaaggaaugagaaaaccggcauuccucuccggagaacagaaaaaggcaauaguugauuuacuauucaaaacuaacagaaaaguaaccguuaagcaacugaaggaagauuacuucaagaaaauagaaugcuuugauucaguagaaauaucagguguagaagaccguuucaacgcaaguuuaggaacuuaccacgaccuucuuaaaauaauaaaagacaaagacuuuuuagauaacgaagaaaaugaagacauacuggaggauauaguauuaacccuaacccucuuugaagacagagagaugaucgaagaacggcuaaaaaccuaugcacaucuuuucgacgacaaaguuaugaaacaauuaaaaagaaggagguauaccgguuggggaaggcuaagucgaaaauuaauaaauggaauuagagacaaacaaucagguaaaacaauacucgacuuuuuaaaaucagauggauucgcaaauagaaauuucaugcaauuaauucacgaugauagucuaacauucaaagaagauauccaaaaagcacaagucagcggacaaggugacucacuacaugaacacauagcgaaucucgcaggaagcccagcaauaaagaaaggaauauuacagacggugaaagugguugaugaauuagucaaaguaaugggcagacacaaaccagaaaacauaguaaucgaaauggcuagagaaaaucaaaccacacaaaaaggucagaaaaauaguagagaaaggaugaaacgcauagaagaaggcauuaaagaacuagggucacaaauccucaaagaacacccagucgagaauacacaacuccaaaaugaaaaacuuuauuuauacuaccuacaaaauggaagagauauguauguugaccaagaauuagacaucaaccgacuuucagauuaugacguagaucauauagucccacagagcuucaucaaagacgauucaauagacaauaaaguacuaaccagaucagacaaaaauagaggaaaauccgauaauguaccaucagaagaaguaguuaaaaagaugaaaaacuauuggcgacaacuacuaaaugcaaaauugauaacacaaagaaaauuugacaaccuuacaaaagccgaaagaggcggauuaagcgaauuggacaaagcuggauucauaaaaagacaacuuguagaaacaagacaaauaacaaaacacguagcacagauauuagacucaagaaugaauacaaaguaugaugaaaacgauaaauuaauuagggaaguaaaaguaauaacauuaaagaguaaauuagucucagacuucagaaaagauuuucaauucuauaaaguaagagaaauuaauaauuaccaccaugcacaugaugcauacuuaaacgcgguaguagguaccgcccucauaaagaaauacccaaaauuggaaagcgaguucguauacggggauuauaagguauacgacguaagaaaaaugauagcuaagucagaacaagaaauaggcaaagcgacagccaaauauuucuuuuauagcaauauaaugaauuucuuuaaaacagaaauaacuuuagccaauggagaaauaagaaaaagaccacugauagaaacgaauggcgaaacaggagagauaguaugggacaaaggaagagacuucgcaacuguaagaaaaguccuaucaaugccacaagucaacauuguuaagaagacagaaguccaaaccggcggauuuaguaaggaaucaaucuuaccaaaaagaaauuccgauaaacuaaucgcacguaagaaagacugggacccuaagaaauauggcggcuucgauucaccaacaguagcauauagcguauuaguaguagcaaaaguagaaaaagguaaaagcaagaaauuaaaaucaguuaaagagcuauuaggacucaccauaauggaaaggucaucauucgagaaaaacccaauagauuucuuagaagccaaaggcuacaaagaaguaaagaaagaccuaauaauaaaauuaccaaaauauaguuuauucgaauuagaaaaugguaggaaaagaaugcuugcuucagcuggugaacuucaaaaagggaacgaacuagcauuaccaucuaaauacgugaacuuuuuguaucucgcuucacacuacgaaaaacuaaaaggcuccccagaagacaacgaacaaaaacaauuauuuguagaacaacacaaacacuaccuagacgaaaucauagaacaaauaucugaguucucuaagagaguuauacuugcggaugcuaacuuagacaagguacuuucagcuuauaacaaacacagagauaaaccgaucagagaacaggcugaaaauauaauccauuuguuuacacuaacaaaccuuggagccccagcagccuuuaaauacuucgauacuacaauugaccgcaaacguuacacgaguacaaaagaaguacucgaugcuacccuaauucaccaaucaaucacuggccuauacgaaaccagaauugacuuaucucaacugggaggagacuga

SEQ ID NO: 8919 - RNA, 4110 nt, Artificial Sequence
  Cas9 variant
augaaacgaauacuaggccuagaccugggaacuaacaguauaggaugggcacuuguaaacgaagcagaaacuguaaaugagaaaagcucuauaguaaaacuaggcguacgcgucaacccauuaacagucgacgaacagaaaaauuucgaagcaggaaaaucaauaccuacaaaugcaggaaggacguuaaaaagagggaugcgacgaaaccugcaaagauauaaacuacgaagagauuaucuaauacaauguuugaaagaauaugguuggaucacuagcgacacacuauuauaugaaugcggaaacaggaccacuuucgaaaccuacagguuacgagcaaaagcagucgacgaagaaauagcauuagaagaauuagguagagugcuacuaaugauaaauaagaaaagaggcuauaaaaguaaucgaaaagcgaaaucuucggacgaaggacaauuaauugacggaauggcaaucgcuauggauauguaucacaacggcacuacuccuggagaauauguuuauucacuucuuagcaaaggcaaaaaguauaucccuguguuuuauagaucagauuuauuagacgaauuugauagaauaugggauuaccaaugugcuuacuacccugauauacucacgagccaauucaaggaauuaauacgaggaaaaucaucgcaaguaacuuccaaauuauuuaagcaacaauauaauuuauuuacagcagacaauaaagagaaagacaaaagauuacaagcauacugucgcagagccgacgcauuaaagaaaagacucccaguagaagaagucgcagccgcacuuugcgauguuaacagagauguaaaugcuuccagcggauauuuaggaacaauaucugacagaaguaagaaacuauucuuuaauaaacaaacugugggucaauaucugaugcuagaauuagauaaagauucacacuucucagucaaaaacgaaguauucuauaggcaagacuaccuuaacgaguucgaagcaauaugggaaaaacaagcugaauaucauccagaacucaccccagauagaaagaaaauacucagggacguaguaauauuuuaucaaagaccccuuaaaagucaaaaagacuugguagccugcugugaacucgaacgcagaagaauagaaguaaugaaagacggaaaaguaagaaguguggaaaucggcccaaaagugugcccgaaaucuagcccacuauuucaagacuucaaaauauggcauguucuaaacaaucuaaaaguacgcgauaaagcaacaggugacgagagguuccuggaauuggaugagaaagagauccuauuuucugaguuagcaauaaaaagcaaauuaucaaaaacagaagcacuuaaacuuuuauaccaaaaaccaaaaggacuagaccugaauuaugacaguguagagggaaauacaacucaggcagcacuauuugaagcauaccaaacgguaauagcuaugacaggacacggugaguauguauucucaaaaaugucagcaagugaagucaugucaguaguagaaggaguauucgguggacugggauucaauacaucaguauuaagguucgauagccuauuacaaggcaaagaauuagaaaaacaagacaguuaucgacuuuggcauuuacuauacucauaugagggagauaauuccguuacaggaacagauggauuaguggcgaaaguugcaucacuuuugcguugcgaugaagaauaugcaaaaguagucgcggguguaacauuucaaccagacuauggcucuuuaucagcaaaagcaauacgaagaauuuuaccccacaugagagcaggaaaugaauauagcuuagcuugcgaauacgccggauacaaacauucaagaagaucguugaccaaagaagaacucgaacaaaaagauuauaaagaccaccuagaauuacuaccucgaaacucauuaagaaauccggucguagagaaaauauuaaaucaaaugguaaacguaguaaaugcaguaguagacgcauauggcaaaccagacgaaauaagaauagaaauggcacgggaauuaaagaaaagugcgaaagaaagggaagaaaugacagcagcaauuaauaaagccacuucagaacaugaaagaauaaaagagauauuaaauaaagaauuugggauccaacacguaagccauaaugacauagugagauauaaacuguauugugagcugaaaaacaauggauacaaaacuuuauauagugauacauacauuccgcaagaaaaauuauuuagcaaagaagucgauauugaacacauucugccacaagccagacuauuugaugauucuuucucuaauaaaacucuggaauaucgaucaguaaacauagaaaagaguaaucaaacugcaugggacuauguagccgcuaaguggggagaggaaggaucacuaagauauaagaaaagaguugaugaucuauuagcugcuggcguuauagggaaaucgaaacaugacaaacuccuaaugaaacaagaagacauuccaacagacuucauuaaccgcgaccuaagagauacacaauacaucgcaagaaaagcuagagaaauacuagaagaccucgucccuaugguaguaucuaccacaggggccguuacagaucggcuccgagaagauuggcaauuagucgauguaaugcaagaauuaaacugggacaaauaugcaaugaagggauuaaccgaagaauggacagauaaagacggucgaagaauaucaagaauaaaggaguggaccaaacgaaaugaucaucgacaucaugcaauggaugcucuaacuauagcauuuacuaaacacaguuucauacaauacuuaaauaacuuaaacgcccgcagugauaaaaguggaaguauauacgcaauagagcaaaaggaauuauauagggacaaucauggaaaacugagauuuauaaugcccuuugaaggauucagaucagaagcaaaaagacaauuagagaauauuuuagucagcauuaaagcgaaaaacaaaguaguuacacguaacguaaacaaugcaagaagagguucaggcagacaagcuaaaguacaacuaacaccaaggggacaauuacacaaugaaaccauauacggaaguauacaucgauauguaacuaaauuagaaaaagugggaggaaacuucgauggagaacaaauugccaagguugcaaaccuucgauauagagaagcacuacaagcccgucaugaagcauuuggcggugacgcuaagaaagcauucacagguaaaaaugcacuagacaaaaacccauuauaccuaaaagauaccagaacagaaguuccguuaaaagugaaaacuguuucuacagaaacacuauauaccauucgaaaagcaguggcaccagaccuaaauguagacaaaguuauagaugcuaaaguuaggaaaguuuuagaagaaagauuacaagaauauggaggagauccgaagaaagcauucgucaaucuugaugaaaacccaauuuauuuaaacaaagcuaaagggauaacaaucaaaagaguggccauaacugggguuaauaacgcgauugcccuucacgacaagaaagauguaggaggacauguaaugcuagacgcaagugguagaaaacaaccuguagauuuuguuaauaccgguaauaaccaccacguugcuaucuauagagaugcagaaggcagucuucaagaaguaguagucaguuuuuaugaagcagucgccagggucucacuaggguuaccagugauagaccgagaguaccgaaaagaggaugguuggcaauuccuuuucacaaugaaacaaaaugaauauuucguauucccuaaucccgagaccggauuuaacccccaagagguagacuuaacagacgaaaccaauuacgcucuaaucagcccuaacuuauuucgagugcaaaaauucacgauuaaagauuacuuuuucaggcaccaccuugaaacaacaguagaagauagaaaagaacuaaaagauaugacauggaaaagaugugguuuagggggaauaauaggcauaguaaaaguacgaguaaaucauauaggaagaauaguaucaguaggugaauauuga

SEQ ID NO: 8920 - RNA, 4110 nt, Artificial Sequence
  Cas9 variant
auggcuaaaacauauaauauaggucuagacauaggaacuaacucaauaggaugggccguaguagacgaccaaaaccacuuaaugucaauaaagggcaaauauggcuauggaguaaggcuauacgacgaaggaaaaacugcagaagaacgaagaucauuucgaacgacacggagacgauuaaaaagacgaaaauggcgauuaucauuauuaagagaaauauuugaaccucaaauaacaccacucgacaacaccuucuuccuaagacaaaaacagagcagccuaagcucaaaagacaaucgcaaacuauacccagaaauguccuuauuuaacgauagaacagacacagacuuuuauacgcaguacccaacgauauaccaucuaucgagagacuuaaugaccaaaaauaaacaauucgauauaagagagauauaccuggcaauguaucauaucguaaaauacagaggucacuuuuuaaaugaaagccccgugucauccuucaaauccucagaaaucaaauuagcugaaaacuucgaaacacuaaaucagaucuuuaaugaaagauuuaaugaauccauguuucaacuagccgugaaugacuuugacgaccucaaagcauuacuacuaaacgaucaacaaucugccucaaacagacaaaagaaagcccuagguaugaucuacguaccgaacgaaaauaaaucacuugaaaaacaaaauaaagcuaucgcaacagaauuauuaaaagcuauacuagggcuaaaagccaaauucaauguccucacgggaauugaagucgacgacgcaaaaccuuggacccucucauucaacucugagagcuucgaugaagacauagacaaagcugcaacaaacauugacgaugauucaagagaaauaauugcaauacuucaagggcuuuauuccggcauucuauuagcuggaauaauacccgaaaaucagagcuuaagugaagccaugguagaaaaauaugaucaacaugcagcacaucuaaaacaauugaagucaauauauccacuucuauccauaucagacaagaaagcaauucaacaggcuuauaacuauuacauagauggacaagacaacgcuaaagccuauuccagagaagacuuuuaugccgcaacaacuaaggcccuaaaauccuaccaagacaaugaaacaauugcggaaauacuaaaacuaauagaacuagaacaauucaugccaaagcaacgaaccaaagacaacggagcgauaccacaccaauuacaccaacaagaacuugaaagaauaauugaaaaucaacaaaaauauuaucccuggcucgcagaauugaacccaaacgaaucuagacgcaagauagcaaaauauaagcucgaugagcucgucgcauucagagugcccuauuacguuggaccacugauaacuucagagcaacaacaacaaucaucuaacaagaaauucgcuuggaugauaagaaaagcagaaggaaaaauaacuccauggaacuucgacgaaaaagucgaucgacaagcgucagcaaacgaauuuaucaaaagaaugacaaccacugacacguaccuacuagccgaagacguccuuccuaaacagucucuaguauaucaaagguucgagguucuuaacgaauuaaacgguaucaaaauugacgacguucccauaacugucgaacaaaaacaacgaauauucaacgaucuauucaugaugcaagcaucaguaucaguuaaaaauauucaagacuaccuaguaucaaaaggauauuuugcaucaaggcccgagauaaccggacuuucagacgaaaacaaaguaauauccagacucuccacauaccacgauuuaaaagcuauuuuagguggaauaguggacgaagcuaauaaacaagcagaccuagaaaaaugcguagaauggucuacaauauuugaagacggaaagaucuucguagagaaacuaaaugaaaucgaauggcucacagacgaacaacgaaaaagauuaucuaguaaaagauaucguggaugggguagacuaagcaauaaauuacucaaucaaauaguuaaugaaaauggacaaagaauaauggacuuguuaugggacacaaccgauaauuuuaugcgaauaguccauagcgaggaauuugacaaacuaauuagcgcagcaaaucaaacucuauugagcaaaaaugauguacaagacguaauaaaugaccuauacacaucaccacaaaacaagaaagcacuacgacaaauauuauugguagucucagacauucagaaagcgaugaaaaaucaggcaccaucaaaaauccuaaucgaauuugcacgggaagacgaagcaaauccaaggcuaucuguacaaagaaaaagacaaguugaacaaguuuaucaaaacaucaguaaagauauacuaucugacucagauguaaaggcagaauuaaaagaucuuacaaacaccgccuuagcuaauacucgccuauuccuuuacuuuaugcaagguggacacgauauguacacaggggaaacacucaacauagaucgguuaucagaauaugacauagaccauauccuaccucaggcuuucauuaaagauaauagccucgacaacagaguacuugugucagcaaaaaugaauagaaguaaaucagaccaaguaccacuuaaugacuacaccgaagaaagauucggaucgaaaaugcgcgugcaaugggaacaaaugcuacgcgcgggauuaauuaccaaacguaaauaugacaaucuaacacugaauccugacagaauuaguaaguacgcaaugaaaggcuucauaaaucgacagcuaguggaaacucgacaaguuauaaaauuagucacaaauuuacucauggaccacuaugaagacgacgaaguacaacuuaucaccguaaagucaggacuaauccaucaaaugagagaaauguucgauuucccuaaaaaccgaaacuuaaacaaucaccaccacgcauucgacgccuauuuaacugcauuuguagguauauaucuacuaaagagauacccaaaacuaacucccuuuuucguuuaugguaguuaucagaaaaacaacacaaacgauaaauggcgaaacuucaauuucuuaaaugauuuaaagaaagaagaggucauagacucggauagccacgaaguuaucuggaacaaggcccaagggcuaguagaacuugacaaaauauaccaauuuaagaaaauauuaguaacacgagaaguacacgagaacaccggcgcucuauauaaccaaacucuauacucugccaaagaugauaaagcuagcggccaaggagguaaacaacuuauacccgcgaaacaagauagaccuacggcacuauacgguggauacuccgguaaaacaguugcauacaugugcaucguuagaauuaaaagcaagaaagaagauacauauaaaguaugcgguguaaaaacaagcuggguugcggaauuggaaagauuaagcgacaguaaugaacaacuagcuucacuuaaagcgaaacuaaugcccaaauuuaccaaaaacaaaaagcaaaaaggaaaaacaauacaggucacagaagauuucgaaauaauaguaccacgaguauuaauaaaccaaagauucuacgacaacggacaagaaauaacacuaggcagcgcuacguacaaacauaaugaacaggaauuaauguuaaacaagaaagcagucaaauuauuaaacggacagcuauccuuaguagaagcagaaacauuagcgccccaagucuacgaugaaauacugaaacaagugaugaaauacuuuccguuauacgauacaaaccaauuucgaacaaaacucaagaugggaaaagaacaguuuauuaaauugcccuggaaaaacaagugggacgguaauaaauuaauacauguaggacaacaaacuguguuagaccgaauauuaauuggacuccaugcuaaugcagccguaucagaucuaaguacgcuuaaaguuacuacuccauucggaaaacuacaacaaccuucaggaauugccuuaagccuaaauacuaaaauaauauaccaaucacccaccggauuauucgaaagaagaguggcauuaagaggacuauga

SEQ ID NO: 8921 - RNA, 4110 nt, Artificial Sequence
  Cas9 variant
auggacaaaccuuauaauauaggacuagacaucggaucccauucuauaggcuggacgguugucgacgauaauucuaaacuaguaaggauuaaaggcaaacuuggauaugguguaagacuguucgaugaaggaaaaaccgccgaagagagacgucaauucagaacaacaagaagacgacuaaaaagacgcaaauggcgauuaagauuauuacgagaaauauucgaaccucacauagcuccuuuagacgaaacauucuuucuacgccaaaagcaaagcaaucucguaccaacacagaaaaaacuaccucaacuaucacuuuuuaaugaccgauccgacgcagaauuuuaccacaaauacccuacuauauaccaucuucgaaacgcacuaaugacagaaaaaagacaauuugaucuccgagaaaucuaucuugcgauucaccacauuguaaaauaccguggacacuuucuaaacgccgcaccagcagcaucuuucaaaucuggcaaauucgaccuagaaaauaaguucgaccaacuaaauuuacuauuugcaagcgcguacagcgauuuagacuuuacacuucgaacagacaauguugaucaaguaaaagcaauauuauuaaacgaggacuuaucagcuaguacacgacaacgacaagcacucccucuuauauaucaaaccucagcggaucaaaaagcagcgaaaaaacuaacgaaaucauuagcuaccgaauuauuaaaagcaauauuaggauugaaagcuaaauucgauguucuaaccggaauagaaacagaugauaccaaagcauggcgacuuacauucaacgccgaagauuuugacgacaaacuaaaugaauugaacgucacagacaaugaagcagcaacucaaaucauagaaaucuuaagagaacuauauucaucaauauuacuugcagcaauaguaccagaaaauuauacgcuaagucaggcaaugauggcuaaauacaacgcacauaaacaacacuuaucauugcuaaggcaaguaaaaacuacccugccagcaaaaaaacaaaaggaauuacaagcggccuacgacgauuacauagaccaacacuuacccuuagacaaauuuuacgccaaacuuacaaaaguacuccccaaagaaaaagacaccgauaacccacaaauaauccaaauacuuaaucuaauagaucucgaccaauucuuaccaaaacaaagaacaaaagacaauggugcaauuccacaucaacuacaucaacaagaauuagaccaaaucauagauaaucaaaaagcuuacuauccuugguuagcucaacuuaauccaaacgagaaaagacaaaaaauugcuaaauacaaacuagaugaacuuguugccuucagggucccguauuacguagguccucuaaucgaagcaaagacucaacaaaaaacuagcggagccaacuucgcuuggaugaucagaaaagaaccggguacaacaacaccaauaaccccauggaacuucgaugaaaaaguaaaucgacaagcuucagccaacgaauuuauaaaacgaaugacaacaacagacacuuacuuacuuggagaagacguccuucccaaacauuccuuauuauaccaaagauuugaaguccucaacgaauugaacgguauuaaaauagaccaaaaacgaguuacuguccgacaaaaacaggccauauucaaugauuuguuccuuaaacaaccgaacguaacuguaaaaaaacugcaacaauaucuacaagcaaaaggcgaauaugcaucggccccaauaauaacaggccuaagugaccccaaaaaauuuaacucccaacucuccacguaccacgaauacaaaaaaauauucgguggucuaauugacgaccccgauaaacaagcagacuuugaaaaauguaucgaaugguccaccaucuuugaagauucccaaauacuaaaagacaaacuaaaggagauaaacuggcuaacaccugaacagcgucacaaaguagcaaauaaacgcuaucaaggcuggggacgacuaucaaaaaaauuacugacacaacucguagacuacaauggacaaagaauuauugacauuuuauggaauacaacugacaauuucaugcaaauuguacacucagaagcauucgacaaagccauuaucaaagaaaaucaagcccuacuaacacaauauaacccacaagcaguaauagaugaucuauauacaucaccacaaaacaaaaaagcuuuacgacaaauacuccucgucguaaaugauauccagaaagcacuaaaaggccaagcaccuucacgcauucuuauagaauucgcucgugaaggccaagagaacccaagauuaucgacacaaagaaaacagcaagucgaaaaugcauacaaagaagcaagcgacgcccuacuuagcucggccgaaguacgucaagaacuaaagggccuagacaacaaggcucuagcaaacacaagacuauuuuuauacuucaugcaaggaggccgcgauauauauacagguaagucccuaaauauugacgauuuaucaaaguaugacauugaccacaucuuaccacaagcauuuauaaaagacaacucacucgauaaccguguucuggucucugcuaaaaugaaccggucuaagagugaccaaguuccccucaacgauuucgccgagaucagauacgguaaacaaaugagacaacaaugggaaaaaauguuacgugcaggauuaauaacaagaaaaaaauaucacaaucugacacuuaacccugaaucuauaaauaaauacaccgccaaggguuucauaaaccgacaauuaguagaaacaagacaaguaacuaaacuagcgacuaaucuacuuguagaccaauacgcugaagaugacguucaacugaucaccguaaaauccaaucucacacaucaaaugcgugaagaauucgauuuuccaaaaaacagaaauguaaauaaucaccaccaugcguucgacgcauaccuaacggcuuuuguaggacuauaucuauuaaaacgcuauccaaaauuagcaccauacuuugucuacggagacuaccaaaaaggagcaucucaaaacuccaaauggcgaaacuuuaacuuuuuaggcaauuuacacagagagaaaguaguugauaagaauaccggugaaaucaucuggcaaagagaugcaggacuaggcgaauuaaacagaauauacaacuuuaaaaagauccuagucacccgugcauuaagaguuaaucgcgggccaauguuuaaacaaacaauuuauaaagcagaagaagacaaauccuccggucgaggguccaaacaacuaauccccacaaaaaaaaaucguccaaccgaacuauauggugguuacacgaacaaagaaacagcauauuuaugccucguuaaagaaccccauaaaaaaggcgauaucuaccguauuuguucagucuuaaauaugugguugacagaacuagaucgaaucgcagauccuauagccaaagcucaaaaacuaacagaauuacucacuccacaauucacaacaacgaaaaaaaaacaaggccaaaagauuccagucgucaaaccuuuuaaaguaguaauacccaaaauauuaauaaaccaacgcuucuucucuagaggucaagaauugacaguagcgucgcccauguacaugcauaaugaacaagaauuauuucucaacaaaaaaacuauaaaacuccuuaacggacaacuagcuaaaaaugaagcccaugaacuugccccgaaaaucuaccaacaaaucuuagaccaaguaaacgacuauuuuccccuauacgauauguacaaauuccgcgacacccuaaacgccaguaaagaaaucuuuguuaacuuaccauggcaagaccaaagacaagauaaaaaaauuagucaaagcggacaaaaaucaauacuaaacaagauccuaauaggauuacacgcaaaugccgccagaaucaaacuaacagaacugaacuucaaaucggacuucggccuauugucacaacguucuggaauugcuuucuccccagaugaccaaaucauuuaccaauccccaacaggacuuuuugaaaggcguguaacucuaaaagaucuuuga

SEQ ID NO: 8922 - RNA, 4110 nt, Artificial Sequence
  Cas9 variant
augaaaguaaacaauuaucauauaggccuugauauaggaacaucaagcauagguuggguugcgaugggagaagacggaaaaccacuacgaguaaaaggaaaaacagcaauaggcgcccgauuauuucgagaaggaaacccggcggcagaccguagaauguuccggacaacacgacgccgcuuaaacaggcgcaaguggagacucaaacuauuggacgaaauauucgacccuuauauuaccccgguagauagcaccuucuucgcacgacuuaagcagagcaacuggucaccuaaagacucucgaaaagcuuucaaggauaguaccuuauucccagaucucacagauaaacaauaccaucuagacuaccccacuauauaccaccucaggcaugcauuaaugacccaagacaaacaauucgauauuagaaugguuuaccuagcauugcaucauauaguaaaauauagaggcaacuuucuaaauucgaccccgguagauucauucaaagcgucuaaagugaacuuugacgaucaauucaaaaaacuaaacgaauuauauacagcgaucaacccagaagaaagcuuccagauaaacuuugccaacucugaaaaaauaggccaacaauuccuagacccaucaauucgcaaauucgauaaaaaaaaacaaauaucaaaaauuguacccguaacaauggaugauaaggcuguagacaaacucaauggcaaaauugcuagcgaaaucgucaacgcgauucuaggauacaagagcaaauuggacguggcaguacaaugcgacccagaggauagcaagcccugggcuguaaaauuugacgacgaggauauugacgccaaauuacaaaaaauauuaccagaaauggacgagaaucaacaaagcauuauagguauaauacaagauuuauauagccaagugacauuaaaccaaauaguaccuaacggaaugagcuuaagcgaaucaaugaucaaaaaauauaacgaucaccaugaccaucuaaaauuauacaaaaaacuuauaggucaaauaucagauucuaaaaaaaaaacagcuuugaaaaaagcauaugaccaauacguagguaacgacgguaaaguaauagaacaagacgacuucuacucuagcguaaaaaaaaacuuggacgacucagaacuauccaaacaaaucauggaccucauagacgcagacaaauuuaugcccaaacaaagaacaagucaaaauggaguaauaccacaucaacuccaccaacgugaacuagacgaaaucauagaacaucaaucaaaauacuauccuuggcuagcagaaucuaacccuaacaaacacgacuuacaccuagcuaaauauaaaauagaagaauuagucgcauucagaauuccauauuaugucgguccuaugauaacuccagaagaucaaaaaaaauccggagcagcuguuuucucauggaugaaaagaaaagagcccggccagauaacaccguggaacuucgaucaaaaaguugacagaauggaaagcgccaauaaauucauaaaacguaugaccacgaaagacacauacuuaauuggugaggacguacuaccugaugaaagcuuauuauacgaaaaauuuaaaguacuaaacgaacuaaauaugguaaggguuaacggggacucacuuaaaguagcugauaaacaagcgauauaucaagaucuauuugaaaacuacaaacacaucagcguuaaaaaaaugcaaaauuauauaaaagacaaaacaggcuuaccaaauaaucccgauaucagcggccucucggaccccgaccauuucaacaacagcuuaggaacauauaaugacuuuaaaaaauuauuuggugauaagguagaugaccccgaccuacaagaugacuuugaaaaaauuguagaauggucaacaguauucgaagacaaaaaaauauuaagagcaaaacuuaaugaaauuaguuggcuauccgauaaacagaaagaugaccuagaaucauccagauaccaaagauggggcagacuaucgaaaaagcuauugacuggaauuguaaacgaccaaggugaaagaauuaucgaugaacuuuggaauacaaauaaaaauuuuaugcaaauacaaucagacgacgauuuugcaaaaagaauacacgaagccaacgcugaccaaaugaaagcaacagacguagaagacguucuagcagacgcguauacaucaccacaaaauaaaaaagcuauacgucaaguaguaaaagucguugacgacauucaaagagccaugggaggagucgccccaaaauuuauaucaauagaauuuacacggagcgaagacagaaauccaagacguacaauuagccgagaaagacaauuagaagauacauuaaaagacacugcaaaaacauuaguaaaaucaaugaacccagauauauuaagcgaauuagauaaugcuaguaaaagcaaaaaagggcuaacagacagauuauacuuauacuuuacucaacuaggucgagauauguacacaggaaaaccaauaaacauagaugaaauaaguaauuaugacauagaucacauacuaccccaagcauucauuaaagaugauuccuuaagcaaccgaguauuaguaaguaaggcuguuaauaacggaaaaucagcuaacgucccuuuaaagcuauuuggagucaaaauggcccacuucuggaaacaauuagcagaagcaggucuaaucaacaaaaggaagcuuaaaaaucuacaaacaaacccagacacaaucucuaaauucgcaaugcauggcuucauucgacgacaacuaguagaaacuagccaagucauaaaacugguagcaaauauucuuggcgacaaauauagaaaugacgauacgaaaauaaucgaaauuaccgcgcgaaugaaucaucaaaugcgugacgaauuugcguuuauaaaaaaucgcgaaauaaaugacuaucaucacgcauucgaugcauaucuaacagccuuuuuaggacgauaccuauaucacagauauauaaaacuaagaccguauuuuguuuauggagauuuuaaaaaguuuagagaagauaaaguaacaaugagaaauuuuaacuucuuacaugaccugacugacgauacgcaagcaagaauagcggauaccgaaaccggagaaguaauaugggauagagaaacauccaucaaacaacuaagagacguauaucacuacaaguuuaugcuaauaagccaagaaguauacacucugcgaggcgcaauguuuaaucagacaaucuaccccgcagaugaagccgguaggaaaaaauuaauaccaacgaaagcagauaaagcaguagauguauacggcggauauucuggaucgaaugaugcuuacauggcuaucguccgaauacaugauaaaaaaggggauaaauacaaaguaguaggaguacccaugagagcacuagauagacuuaaugcagcaaaaaacguaucagaugcaaaauaugaccaaguacucaaagacguccuaacuccacaauuuacgaaauccaaaaaaagcaggaaaacaggagaaaucagucaaacaguugaagauuucgaaguaguucugggcaagguuauguauaggcaauugguaaucgacggcgacaaaaaauucaugcucggaucgagcacauaccaguacaaugccaaacaauuaguacucagugacgaaucagucaagacgcuugccucaaaaggaaaacuggacgaagcucaagaauccgccgcauacgacaauguauaugacgaaauauuagacaaaguagauagauauuucgcauuauaugaucaaaggaacuaucgaacaaaucuacacgaaggcgagcaaaaauucauaggccuaccccuacacgacacauuugauggaagcaaaaaagucgccaauggaaagagagaaacaauaucagauauacuaaauggccuucaugcaaacgcuacaaugacgaaccuuaaaguacugggaauaucaucaccauucgguauguuccaaucccauggcccaaucaaucuaaauccggagacuaucauucuaugucaaucuccgacuggauuauucgagcgacgaauaauacucagagaccuuuga

SEQ ID NO: 8923 - RNA, 4113 nt, Artificial Sequence
  Cas9 variant
augaaaaaaagaaauuauaacauagguuuagacauaggaacaagcucuauagguuggacgauaguagacgauaacgcacaaauaaugagagcaaaaggcaaaaacggauauggcguaagaauauuugcagaaggcaagacugcugccgaccgaagaggcuuuagaaccacacgacgaagauuaaaaagaagaaaauggagacuucgccuccuacaagaauuuuucgaaccuuauaucuuaccgauugacgaaaacuuuuuuaugagacaaaaagaaagcaaucuuguuccacaagauccaaacaaacauuuuaaagggucuauauuguuuaacgaucgaacagaucaagaauuccacgagcaauauccaacaauuuaucacuuaagauaugcauuaaugacggaacauagacaauuugacguacgagaaauuuacugggcaauacaucacauaguaaaauacaggggccacuuccucaacucaacuuuggccuccaaauucaaagguggagaguuaaggcuagcagacaaauucgaaucauuaaacaaacuguuuuuaagaguacaagcugaaacaggauuugaguuaagugaagauaacguagacaaaauaaagacaguucuauuagauaacggaaagagccgauuagaucgacaacgagaaguccucaaaauuguauaucuaacaucugaagacaaagacaccgaaaaaaaaagaaaagcuguagcaacggaauucauaaaagcuguacuaggacuuaaaacaaaacuauuuauaguuuuggcaaagaaucccacagcggagacugacuggaaauucucauuugaugcagaagacauagaugacaaacuugacucaauuagcgaacaacuaacggacgaugaucaugaaauaguugaacucauaucagaaauucacagcauaauaacccuaacugguguuguaccagaagguaugggucuaagugaaucaaugauagcaaaauacgaccaacaucaacuagacuuaaaaaaacucaaaucacucaugcgagaccuagacgucaaacaagcucgaaaacuacaagacgcauacgaugaauauaucgacggacuuaaaccaucagaagaagcauucuauagugcuguaaguucuguaauccaaaaaauggacgauccaagagcuaaaaaaauaacugccgaaauugagcuggaagaauuuaugccuaaacaaagaacaaaagcgaauggucagauaccacaucagcuucaucagcaagagcuagaccaaaucauagaaaaccaaaaagaauauuauccaugguuggcugaagaaaacccaaacaagcgcgaacacaacgcagcaccacauaaauuagacggacucguuacuuuucgaguaccauacuaugucggcccucuuaucgaagccucaguucaacaaaaaacuaguaauucaaauuucgcuuggauggaacguaaaguuaaaaaugauaccuccagaaucacaccauggaacuucgaagagaagguggauagaaacgccagcgcagaaaacuuuauaaaaagaaugacuacaaaagacacauaucuacuuaacgaggacguacuaccucagcaaucacuacuauaccaacgcuaugaaguuuuaaacgaacucaauaauguacgaguuaaugacaaaaaauuagaaaacaauuguaaacaagaugucuauaaagaccuuuucaaaaacaacaccaccguaucaauuaagaaauucaaagacuacuuaguagcaaauugcgaauaugcagauaacccuaaaauagaggggcuagcagaugagucuauauucuuaagcucauuaucuacagaaaacaaauucaaagacaucuuuggcgcacaaaucgaugacccaaauuacuucgaagacuuugaacauaucauagaaugggcaacuauuuucgaagacaacaaaauauuaagggcaaaacuagacgaaaucaguuggcucaaugaaagccaaaaaaaagaacuagcgaaauuaagaaugcguggauggggcagauuaucgcgaaaacugauagcugaaauaacagacgaaaacggaucacgaaucauugaccuguugugggaacauauggauaacuucaugguagugguaaaccaagaugucuucaaagaaaaaaucguggccgaaaacaaacaaguuuucaaagaauuaaacccauuagauauaauaaacgaacaauuuacuuccccucagaauaaaaaagcucuucgucaaauccuacuaguaguagcagacauccaaaaagcuaugaacggaguuacaccaucaaacauuuucauagaauucgcaagagaagacgaacgcaaccccagaagaucaauacaaagacuaagacaaguggagaacauguaccgcgacauuucagauacagugcuagccgacccagaaguaagaaaugaauugucgaacauaaaaaauacagaguuagcaagagaccgaguuuucuuauacuuccuacaaggaggaagagacguauauacaggagaaccucucaacauagauaaacucagcgaauacgacauagaucacauauuaccccaagccuucaucaaggauaauagccuagacaauaggguucuagucuccgcuucauuaaaucgaaguaagucagauaguguaccucucgacgacuuuaccagcgaaauguucggaaggaaaauggaaccacuaugggaacaaaugcaaagagcuggauugauaucaaaaaaaaaacuugcuaacuuaaaauuuaauccggaaaauauaaauaaauacacaagaaacgguuuuauaaauagacaacuaguagaaacucgccaaguuaucaaacuagcagcuaacauccuaaaggaccacuacggagaagaaacagaaauagucaaugugaaagcuggacucacacaccaauuccgaaaagauuuugacuuuccaaaaaaccggaacgugaacaauuaucaucaugcauucgaugcauaucuaacagcauuaguaggcacauaccuauuaaaaaaauacccuaaacuugaaaguuauuucguauacggaaaauucaaaaaaggagacgguaucacaaaucuuaaaaacuuuaauuuccuacacggauucaauaagccggguaaaauaauuaacaaagaaacaggagagauacuauucgauagggacaaacaacucggauauaugaacucuauauacgauuuacgaaaaguaauuguaacacaugagcucaguacaagacacggggcaauguacgaucaaacacuuuauaaagcuagcgacgacaaagauucaggacgcggaggaaagcagcuaauccguaaaaaagacaaccuaccuacugaaauuuacgguggcuauaccggaucgacagacgccuucaugucuauaauaagaaugaaaaagaaagacaaacuuuacuacaaaguaauuggcguaccuacacgaguagcacaugaaguauuacaaucagauggaaagauuaacaucuuuacauuaaauaaauucauagaacaaaaauuaacuaaagaaaaaguuaauaaaaagacuggagccauaacaagaauaaccgauugguuugagcuaguuaucgccaaaguaauguaugggcaagugauagacgauggaggacaaccauuuauguuagguucaucaacacuaccauacaacgugcgagaauuauaucuagcaaaagaccugguaaaagugauaaacaaaggcaguaccuccaaauccucauaccucgacguauaugacgaacucgucaaaucccuaaacaaauauuuuccaauguaugaucguaacauguucagacaaaaaauaacagacgcaagagacaaauucgaaaaacugcccaaaagagacaaaguaucuaacggaaaauuacaacaaauuggucaaguaacaauuauugacagaauauugauuggacuucauacaaacgcaggaguuucuaacuugaaagaccucggaauagcaacaccauucggauucaugcaacaaggaaacggcaucagccuaacuucaacugcaaaaauaaucuaccaaagcuccacagguuuauucgaaaaaucuaaagcccuagaugacuuaaacccgcuugcauga

SEQ ID NO: 8924 - RNA, 4113 nt, Artificial Sequence
  Cas9 variant
augaauaaaccauacucaauaggauuggauauaggaaccaacucaguaggauggagcaucauaacagacgacuauaaaguuccugcaaagaaaaugcgcguacucgguaauaccgacaaagaauauaucaagaaaaaucuaaucggagcacuuuuauucgauggaggcaacacagcagccgacaggcgauuaaaacgaacagcaaggcgacgauacacccgaagaagaaacagaauacuguaucuucaagaaauauuugcagaagaaaugagcaaagucgaugacuccuucuuccaccgguuagaagacucguuucuaguagaagaagauaaaagaggcuccaaauaccccauuuucgcaacaaugcaagaagaaaaauacuaccaugaaaaauuuccaacgauuuaucacuugcgaaaagaauuagcagacaagaaagaaaaagcagaccuaagacuaauauaccucgccuuagcacauauuaucaaauucagaggccacuuccucauugaagacgaccgauucgauguuagaaacacagauauacaaaaacaauaccaagcauuccuagaaauauuugacacuacauucgaaaacaaugaucuguuaucacaaaacgucgauguagaagccauacuaacugacaaaauaaguaaaucagcuaagaaagauagaauacuagcccgauauccaaaccagaaaaguacaggaaucuuugcagaauuucucaaauuaauaguugguaaccaagcagauuuuaagaaacacuucaaucuggaagauaaaacuccacuacaauucgcuaaagauagcuacgacgaagauuuagaaaaucugcugggacaaaucggagacgaauuugcagauuuauucucagcagcgaagaaacuauacgauagcguauuacucaguggaauacucaccguuaccgaucucucgacuaaagcgcccuuaucagcaucaaugauucaaagauacgacgaacaccgggaagaccugaaacaauugaaacaauuugucaaagcaucacuuccagaaaaauaccaagaaauauuugccgauaguucgaaagauggauaugcaggauauauugaaggaaaaacaaaccaagaagcauuuuacaaauaccucucaaaacuucuaaccaaacaagaaggcagcgaauaucuccuagagaaaauuaaaaacgaagacuuucuuaggaaacaacgcacuuucgauaauggauccaucccacaucaaguacaccuuacggaacuacgggcaauaauaagacgacaaucggaguacuauccguuuuuaaaagaaaaucuagaucgcauagagaaaauccuaacauucagaaucccuuauuauguaggaccacucgcaagagaaaaaucagacuuugcauggaugacacgaaaaacagaugacucgauacgaccauggaauuucgaagauuuaguagacaaagagaaaagcgccgaagcauucauacauagaaugacaaacaaugaucuauacuuacccgaagaaaaaguuuuaccuaaacauagccucauauacgaaaaauucaccguauacaacgaauugacuaaagugcgauuuuuggcagaaggauucaaagauuuucaguuccuaaauagaaaacaaaaagaaacuauauuuaacagucuauuuaaagagaaaagaaaaguaacugaaaaagacauaaucuccuuccucaauaaaguagacggauaugaaggaauagccaucaaagguaucgaaaaacaguuuaaugcaucuuuaucaacauaccacgaucucaagaaaauauuagguaaagacuucuuagacaauaccgauaaugaauugauucuagaagauauaguacaaacauuaacacucuuugaagaccgcgaaaugauacgaaaaagacuggacauauauaaagacuucuuuaccgaaagucaacuaaagaaacuauacagacgacauuacacaggauggggaagacuaucugcaaaacugauuaacgggauccgaaacaaagaaaaccagaaaaccauauuagacuaucuaauagacgacggaucagccaaccguaacuuuaugcaauuaaucaaagaugcaggacucucauuuaaaccuauaauagauaaagcaagaaccggaucucauucugacaaccucaaagaaguagugggagaguuggcaggauccccagcaaucaagaaagguauacuacagucgcuaaaaauuguugacgagcuaguaaaagucaugggauaugaaccagaacagauugugguagaaauggcaagagaaaaccaaacaacugcaaaaggauuaagcagauuacgacaacgccucaccacacucagagaaucauuagcaaauuuaaaaaguaauauccuagaagagaagaaaccaaaauauguaaaagaucaaguagaaaaccaucacuuaucagaugaucgacuauuccuauacuaucuacaaaauggaaaagauauguacacggacgacgaauuggacauagacaacuuaucccaauacgacauagaccuaauuaucccucaagccuuuaucaaagacgacagcauagacaauagaguccuaguaucaucagccaaaaacagaggaaaaucagacgauguaccuuccguagaaauaguaaaagauuguaaagucuuuuggaagaaacuacucgaugcaaaacuaaugagucagagaaaauacgacaacuuaacgaaagcagaaaggggcggacuaacaucagaugacaaagcaagauucauacaacgacaguuaguugaaacaagacaaauuacuaaacacguugccagaauacuagaugaacgcuuuaacaacgaauuagauaguaaaggacgaagaauaagaaaaguuaaaauaguaacacuaaaaaguaaucugguaucaaacuuuagaaaagaauuuggauuuuauaaaaucagagaaguaaauaauuaccaucaugcacaugaugcauaucugaacgcaguaguugcuaaagcaauauuaacaaaauacccacaacuugaaccagaguuuguauauggcgauuaccccaaauacaacaguuauaaaacaaggaaaucagcaacagaaaaauuguucuucuauucuaacauaaugaacuucuuuaaaaccaaaguaacauuagcagacgguacuguuguuguaaaggacgacaucgaaguaaacaaugauacaggggaaauagugugggacaagaagaaacacuuugcaacaguccgaaaaguucuaagcuacccacaagucaauaucgugaagaaaacagaaauucagacuggagguuuuuccaaagaaagcauuuuagcacacgggaauagugacaaacuaaucccacggaaaacaaaagauauauaccuggaccccaagaaauacggaggauucgacucuccaauuguugcuuauucugucuuagucguugcagacauuaagaaaggaaaagcccaaaaacucaaaacgguuacagaacuauuaggaauuacuauaauggaacguucaagauucgagaaaaaucccagcgcuuucuuagaaaguaaaggauaccuaaauauaagggacgacaaauuaaugauucuccccaaauacucauuauucgaacuagagaacggaagacgucgucuacuagcuucagcugacgaauuacagaaaggcaaugaauuggcccugccgacacaauucaugaaauuccuguaucuagcgaguagguauaaugaacuaaaaggcaaaccagaggaaauugaacaaaaacaagaguucguaguacagcauguaucuuacuucgacgacauccuacagaucaucaacgauuucucaaacagaguaauccuagcagacgcaaacuuagagaaaauaaauaaacuauaucaagauaacaaagaaaacauaccuguugacgaauuagcuaauaauauaauaaaccuauuuaccuuuaccagcuugggagcaccggcggcguucaaauucuuugauaaaauuguggaccguaaaagguacacaaguaccaaagaggucuugaauagcacacucauacaucaaucaauuacuggucucuacgaaacaagaauagaccuaggcaaacuaggugaagacuga

SEQ ID NO: 8925 - RNA, 4113 nt, Artificial Sequence
  Cas9 variant
augacuaaaaagaacuacucaaucggccuugauauaggaacaaacagcgugggaugggcuguaauaacagacgacuauaaaguaccagccaagaaaaugaaagucuuaggaaacacugauaagaaauacauuaagaaaaaucuacuaggugcucuacuauucgacuccggugaaacagcagaagcuacucguuuaaaacgaacagcaagaagaagauauacucggaggaaaaacagacuaagauauuuacaagaaauauucgcagaagaaaugacaaaaguugaugaaucauucuuuuauagauuagacgagagcuuuuuaacuacagacgaaaaagacuucgaacgucauccaauauuuggcaacaaagcagaagaagaugcauaucaucaaaaauucccgacaauuuaccacuuacgaaauuaucuagcugacagcagugaaaaagcagaccuaagauuaguauacuuagcucucgcgcauaugauaaaauaccgagggcacuucuuaaucgaagguaaauuaaacgcugaaaacacugauguacaaaaacuguuuacggauuuuguuggaguuuacgacagaacauucgaugacagccacuuaagugaaaucacaguagacguagcgagcacucuuacugagaaaauuucaaaauccagacgacucgaaaaccuaauaaaauauuacccaacugaaaagaaaaacaccuuauucggaaauuuaauagcacuagcucucggauuacaaccuaacuuuaaaaugaauuucaaauuauccgaagacgcgaaacuacaauuuaguaaagauacauacgaagaagaccuggaagaacucuuagggaaaauuggagacgacuacgcggaccucuucacaucagcgaaaaacuuauaugaugcaauucuacuuucugguauccuuacagucgacgacaacuccacaaaagcacccuuaucugcuucaaugauaaaacgcuacguagaacaccaugaagauuuagaaaaacuaaaagaauuuauaaaagcaaauaaaagugaacuauaccacgauauuuucaaagacaaaaauaaaaauggauacgcagguuacauagaaaauggcguaaaacaagacgaauuuuauaaauaucucaaaaauacuuuaucaaaaauagauggaagugauuacuuccuugauaaaauagaaagagaagacuuuuugagaaaacaaagaaccuuugacaacggcucaauaccccaucaaauacaucuacaagaaaugcacgcuauacuaaggcgucaaggcgacuauuaccccuuuuuaaaagaaaaacaagaccguaucgagaaaauacuaaccuucagaauaccauauuauguaggacccuugguacgaaaagauucaagauuugcaugggcagaauaucguagugacgagaaaauaacaccguggaauuucgacaaagucauagauaaagaaaaaucggcagaaaaauuuaucacacgaaugaccuuaaaugaccuuuauuuaccugaagaaaaaguacugccuaaacauagucauguauaugaaaccuacgcaguuuauaaugaacuaacaaaaauaaaauaugucaacgaacaaggcaaagagagcuucuuugacucaaacaugaaacaagaaaucuucgaucauguauucaaagaaaauagaaaaguuaccaaagaaaaacuauuaaacuaccuaaacaaagaauuuccugaauaccgaaucaaagauuuaauaggacuagacaaagaaaacaaauccuuuaacgccucccuaggaacauaccacgaucucaagaaaaucuuagacaaagcauuccuagacgacaaaguaaacgaagaagugauugaagacauaaucaaaacauuaacauuauucgaagacaaagauaugauacaugaacgucuacaaaaguauucggacauuuucacugcaaaucaauuaaagaaacuggaaagaagacacuauaccggguggggacgcuuaaguuacaaacucauaaauggcauucguaauaaagaaaauaacaaaacaauacuagacuauuuaauugacgaugguucggcaaacagaaacuuuaugcaauuaauaaaugaugacacacuaccguuuaaacaaauuauucaaaaaucacaggucguaggagauguagacgauauagaagcaguaguacacgaucuaccaggaucacccgcgaucaagaaaggcauacuucaauccgucaaaauaguagacgaacucgucaaaguaaugggcgauaacccugacaacauuguaauugaaauggcccgugaaaaccaaacaaccaaccgcggacgaucucaaucccaacaacgacuuaagaaacuccaaaguucacuaaaagaauuaggaagcaacauacuaaacgaagaaaaaccuuccuacauagaagauaaagucgaaaacucccacuuacaaaaugaucaacucuuucucuacuauauccaaaacggaaaagacauguacaccggugacgaacucgacauagaucaccugucggauuaugauauugaccacauaauaccucaagcauuuauuaaagacgauaguauagauaauagagucuuaacaaguucagccaaaaauagggguaaaucugaugacguuccaucuuuagacauaguucgugcucgaaaagcagaauggguucgacucuauaaaagcggauuaauaucaaaacggaaauucgauaaucuaacaaaagcugaacggggugguuuaaccgaggccgacaaagccggguucaucaaaaggcaauugguagaaacuagacaaauaacaaaacacguagcacaaauauuggacgcaagauuuaacacggagcaugacgaaaacgacaaaguaauccgagacguaaaagugauuacauugaaaucaaaccucguaucacaauucagaaaagacuucgaauuuuauaaaguacgggaaaucaaugauuaucaucacgcccacgacgcauauuuaaaugcugugguuggaacagccuuacuaaagaaauacccaaaauuagcaagcgaguucguauacggagaauauaagaaauaugacauccgcaaauuuaucacuaauucaagcgacaaagcgaccgcaaaauacuucuuuuacucuaaucuaaugaacuucuuuaaaacgaaagucaaauaugcugaugguacagucuuugaaagaccgauaaucgaaaccaacgcagacggugaaaucgcguggaauaaacaaauagacuuugaaaaaguucgaaaaguacugagcuauccccaaguaaacauagucaagaaaguagaaacacaaacagguggauucucaaaagagagcauacuaccaaaaggggauucugacaaauugauuccacguaaaacaaagaaaguauauugggacacaaagaaauacggaggcuucgacagccccacuguggcauacucuguguucgucguugcugauguggagaaaggaaaagcaaagaaauuaaaaacaguuaaagaguuaguugggauuuccauuauggaacgguccuucuuugaagaaaacccuguagaguuccuagaaaauaaaggauaccacaacauuagagaagacaaauuaaucaaauuaccuaaauauagucuuuuugaauuugaagggggaagacgucgacuacuagcaucagcaucugagcuacaaaaaggaaaugaaaugguucuaccaggauaccucguggagcuacuuuaucacgcucacagggcagacaauuuuaauucgacagaauacuugaauuauguaucugaacauaagaaagaauuugaaaaaguucuaaguuguguugaagacuuugcaaaucucuauguagauguagagaaaaauuuaaguaaaauucgagcaguagcagauucgauggacaauuucucaaucgaagaaaucucaaacucauuuaucaaucuucuaacacuuaccgcacucggugccccagcagacuucaauuuccuuggugaaaagauaccucgaaaacgcuauacaaguacaaaagaaugucuaacagcaacgcuaauacaccaaucaaucacaggacuauaugaaaccagaauagacuuaucuaagcucggcgaagaauga

SEQ ID NO: 8926 - RNA, 4113 nt, Artificial Sequence
  Cas9 variant
augaaaaaugcaaacaaaguaacagguaaauacuaccuugguuucgacauuggcacaaacucagugggaugggcagugacagacgaaaauuacaacuuauguaaauucaaaaagaaaucgauguggggcauuagacuuuuugaagacgcuaaaacugcggaagaacggagaggacaacgugcaaguagacgacgacuacagagaagaaaacagcggauagauuugcuacaagaaauauucgcugaagaaauaaauaaaguagaugaaacauucuuuauaagacuaaaugaaucaagauuacauuuagacgacaaaacaguuucugaaaaacauccauuauuuaucggauccgaauauagcgaaaaagaauacuauagagaauaucccacgauuuuucauuuaagaaaagaacuuauggaaucauccgaaccacacgauaucagguuaguuuaccuagcaauccaucauauacuuaaaaacagagggcacuuccuaauugacggcgaacuaaguaaagcaaacaguuuugacgccgcauuuuaucaaaugaaagaaguauuaugcaaugaacuagacuuagaaauagacggagaaaacacaacagaaguugaaagaacgcuucgugauagaaauauaagcaaaagugauaaagucaaacuauuagccgcucuguuagcgaugaaccaaaaugaaacagaaucuaaagaaaccaaaaagaaaauugaaaacauaugcaaauuacuagcaggcaacaaaggagauauauccaaaauauuuggacaaacuccagaaggcguagagaaaacuucuuuuuccuucggggaagccgacuacgaugaaucaauacgaccaaacuuagaagaaucaauaccagaucaguguuuuguaaucgauucaaucaaagcauuauaugauuggaauguacuagcagauauuuuaaacggucagacauacuuaucaugcgccaaagucaaccaauaugaaacacacaaaaacaaccuaaaagaauugaaauuacugguuaauagauauuguucaagagaagaauauaaaagauucuuuaaaucagcaguagaaaaagcaaauuauucuaauuauauugggucagccaaacaaggcaacaaaauaaucgacguaaaaagaugcgcagaagaagauuucuauaaagaacuaaaaauccuacuaucuaaaauagaacccgaagaagccgacagagaacuauacgaaagaauaaaaagagaagcagaagaaggcucauuauuaccgcuacaaagaaauaaagauaacuccguaguaccuaaucaaaugcauaaagcagaauuagcucuaauacuggaaaacgcgggaucauaucuaggcuuucuaaacgaaaaagacgaagauggauuaagcccugcagagaaaaucauagaauuauuuucuuuuagaauaccauauuauguuggacccuuaucagauagacauaaagauagaggaucuaacgcuuggaucgugagaaaagcagaaggcagaaucuuaccuuggaacuuugacgaaaaagucgauagagaaaaauccaaugaagcauucaucgaaaggaugaccaacaaaugcacuuaccuacuaggaaaagauguagucgcuaaaaauaguuuaauauacucucacuuuaugguuuuaaaugaauuaaauaacuuaucugucuguggaaauaaaaucuccguacaaguaaaacaagacauauacagggaauuauuucaaaggcauacaaaagugucuaagaaaaugcucuuacaauauugucgagagaaaaugaugaacaaagacuuagaagaagaagaucuaaguggguuugauggcgauuucaaagcaaaauugagcagcuaccucgauuucgaaaagaaaguauuuggagccaaaauggaagaagaccggauaagaaaaauaacugaagacauaauaagauggaaaacaauuuauggagacgauggaaaaaugcuacaagcgguaguagaaaaagaauauccaggugaauuagacucagaccaacuaaaagcuguaaaacaguuuagguauucaggaugggggaacuuuucugaagaguucuuaaacggaauaguaggaaccgaaaaacccacaggucaaauguucacgaucauagaagcacuuuggcaaacgaacugcaaccuaaugcagcuacuaaguaaaaacuuuacauucauggaagaaaucgaaaaacacaauagagaauuagcgggacaaauaacagacauauccuacgacaaauuaguaaaagaccuauauaucagcccagcaaauaaaagggcaguauggcaaacagucaggauagcggaagaagucaagaaaauaauggguugugaaccagccaaaauauuuguugaaauggcacggggaggugaaaaagagaagaaaagaacuaucuccaggaaaaagaaacuacuagaacucuaugcagcuuguaagaaagaugcuagggacuggaauagggaaauagaagauagggaugaacgagaauuuaauagcgacaaauuauaccucuacuauacccaaauggggcgguguauguauaguggugaacgcaucgaccuucaugaauuaaugucagcaaauaguaaaugggacauagaccacaucuauccacaaagcaaaguuaaagacgauagucuagacaaucgaguucuaucacucaagaaaauuaauaacgaaaaagggaauaagccccucucacgcgauauacaacaaagucaacaaaaaugguggacagaacuacuucaacucgaauuuauaacgaaaaagaaauacgauagacuuaugcacagaggggaguuaucugaagaagaauuaucuggauuuaucaauagacaacuuguagaaacacgucaaucaacaaaagcagcagcagaacuauuaggucguauguacaauaacucaaaaguaguauacguaaaagcccccuuaguaagucaauucagaaaagaugaccuaaauauccucaaaucacgauuagcuaaugauuaccaccacgccaaagaugcuuaucucaacauagcgguuggaaacguuuacaacgaaaaguucacggauaacccacuaagauggauagagaaacaugccggagaaaauuauagcaucaacagaguuuucgauuaugauauaguugcuggugacggggccccaguaugggcugcaccccuacgugaugagaaaaacaaguugcguaaaaaugaagugggagaaaaauauggaggaacaauagauguaaucaggaaaacgguaaagagaaacgacgugcuuuauacagagcacacauauugcgguaaaggugaacuauucaaugcaacaauagcuaagaaagacggaggagcggaaauuccuuuaaaagcugggcuacagaccggaaaauacggcggcuacaaaagucccaauacaaguuauuucgcagcaauagaguuugaugggaagaaaggcgaaagaguuaaaaacauaauggaaguuccagucuauauugcaaauauacuacuccaugacaucgacgcguacauaagauacugcgaaacaguaaaaggacucaaaaacgucaaaauuuuaagaccaugcaucaagaaaaaugcauuaauauccguagacggcuacccaaugagaauaagaggagcuaaugaaaagaauauacuccucaaaaauaaucuacagccaauauucggaagacacgaagaaacaguacgacgaauugaaaaauacguggagaaaaaccaagaguucgaaguagacgaaaaguucgaugggcuaaaugaagcgaacuuaacagauuuauaugaugacauuacagagaaauuauguggaccauauguugaacgccccucaaaccaaggagaauaucuaauggaaaacagagaaaaauuccucaauauaucuuuaaaagaaaaagcaaaacuacuggcacaaaugauuaaguuagucagaugcgacaccgagacgaaagcugaccucagaagcauaggugccagcaaaaacgcaggaguaauaagcguaaauaaaaacacacucggaggaaagcgccuaauacuaauaaaucaaucaguuacgggacuauuugaaaaccgaauagaauuauga

SEQ ID NO: 8927 - RNA, 4113 nt, Artificial Sequence
  Cas9 variant
augaacaaaccauacucaauaggcuuagauauagguacaaauagcguagguuggucgauuauuacagaugauuauaaaguaccagcgaagaaaaugaggguauuaggaaacacagauaaagaauacaucaagaaaaaucuaauaggagcacuauuauucgaugguggaaacacugcagcagauaggcggcucaaaagaaccgcaagaagaagauauacgcggcgcagaaaucguauauuauaccuacaggaaauauucgcagaagaaaugagcaaaguugacgacuccuucuuccaucggcucgaagauucguucuuagucgaagaagauaaaagaggcucaaaauacccaauauucgcaacaaugcaggaagaaaaauauuaccaugaaaaauucccgacaauauaccacuuaagaaaagaacuagcagacaagaaagaaaaagcagaccuccgacuaauauaucuagcccuggcacauauuaucaaauuccgaggucauuuccugaucgaagaugaccgauucgacguaaggaacacggacauacaaaaacaauaucaagcauuuuuagaaauauucgacacuacauucgaaaacaacgauuuacuuagucaaaacguagacguagaagccauucuuacagacaaaaucucgaaaagugcuaagaaagauagaauauuagcacguuauccaaaucagaaaaguaccggaaucuuugcagaauuuuuaaaacucauuguaggcaaccaagcagacuucaagaaacauuuuaaccuugaagauaaaacaccccuacaauucgcaaaagacagcuaugacgaagaucuugaaaaccuccuuggacaaauaggagacgaauuugccgauuuauuuucggcagcaaagaaauuguaugauucaguauuacuaaguggaauacuaacuguaacagaccuauccaccaaagcacccuuaucagcuucgaugauucaaagguacgacgaacaccgagaagacuuaaaacaauuaaaacaauucgugaaagccagcuuaccagaaaaauaucaggaaauauucgcggacucuucaaaagacggauaugcaggauacaucgaaggaaaaaccaaucaagaagcauucuauaaauacuuaucaaaacuauuaacaaaacaagaagguagugaauaccuauuagagaaaaucaaaaaugaagacuucuuacgaaaacagagaaccuucgacaacggcucaauaccccaucaaguacauuuaaccgaacuacgagcaauaauaagaaggcaaagugaauacuacccauuccucaaagaaaaccuagacagaauagagaaaauacucacuuuccguauaccuuauuacguaggaccauuagcacgcgaaaaaucagauuuugccuggaugacacgaaaaacggacgauucaauuagaccauggaauuucgaagacuuaguagacaaagagaaaagcgcagaagcauuuauacaccgaaugacaaauaacgacuuauaccuuccagaagaaaaaguucuuccaaaacauagucuaauauaugaaaaauucacagucuauaaugaacuuacgaaaguacgauuccuagcugaaggauucaaagauuuucaauucuuaaaccgaaaacaaaaagaaacaauauuuaauucacuuuuuaaagagaaaaggaaaguaacagaaaaagacaucauaaguuucuuaaacaaaguagauggcuacgaagguauugccauaaaaggcauagaaaaacaauucaacgcaucacuaucgacauaucaugaccuaaagaaaauucuaggaaaagauuuucuagacaauacagauaacgaacuaauuuuggaagauauuguacaaacauuaacgcuauucgaagacagagaaaugauaagaaaaagacuagauauauacaaagacuuuuucacagaaagucaacuuaagaaacuauaccgacgacauuacacugguugggggcgacucagcgccaaauuaauaaacggaaucagaaacaaagaaaaccagaaaacgauacuagacuaccuuauagaugacggaagcgcuaaucgaaacuucaugcaauuaauuaaagaugcgggcuugucauuuaaaccaauuauagacaaagcaagaacaggaucucacucagacaaucuaaaagaaguaguaggagaacuagcagggagcccugcaaucaagaaaggaauauuacagucauuaaaaaucguugaugaacuugugaaaguaaugggauaugaaccagaacaaauaguaguugaaauggcccgagaaaaucagacgaccgcuaaaggauuaucaagaagccgccaacgccuaaccacucuuagggaaucacuagcuaaucugaaaaguaacauacuagaagagaagaaaccaaaauauguaaaagaucaaguugaaaaucaccaucuaagcgaugauagacucuuccucuauuauuuacaaaacgggaaagacauguauacagacgacgaauuagauauagacaaccucucucaauacgauauagaucauauaauaccgcaggcauucauaaaagaugauagcauagauaaucgaguucuaguaucaagugccaaaaacagaggaaaaucagaugacguuccaucggucgaaauagugaaagauuguaaaguuuucuggaagaaauuauuagacgcaaaacuaaugagccagagaaaauacgauaaccuaaccaaagcagaaagagguggacuaacaagcgaugauaaagcacgauucauacaacgacaacuuguugaaacaagacaaauuacuaaacacguugcaagaauccuugacgaaagauuuaauaacgaauuagauaguaaagggcgaagaauccgaaaagucaaaauuguaacgcuuaaauccaacuuagucucgaauuuccgaaaagaauuuggauucuacaaaaucagagaaguuaauaacuaccaccaugcucaugacgcauaucuaaaugccguaguagcaaaagcgauuuuaacaaaauacccucaacuagaacccgaguuuguauauggcgacuaucccaaauacaauucguacaaaacaaggaaaucugcuacagagaaacuauuuuucuacaguaacauaaugaacuucuuuaaaaccaaaguuaccuuggccgacggaacagucgugguaaaagacgauauugaagucaacaacgauacuggggaaauagucugggacaaaaagaaacauuuugccacgguaagaaaaguucuaucauacccacaaguaaacauugucaagaaaacagaaauacaaacagguggauucaguaaagaaaguauacuagcucauggaaacucagauaaauuaauuccaagaaaaacaaaagauaucuauuuggaucccaagaaauauggcggcuuugauucaccuauagucgcuuauuccgucuuaguaguagcugauauuaagaaaggaaaagcacaaaaacucaaaacagugacagaacucuuaggaauuaccauaauggagagaucaagguucgaaaagaacccuagcgcauuuuuagaaucaaaagguuaucuuaacauuagagacgacaaacucaugauacuuccuaaauauagucucuuugaacuugaaaauggcagaagacgacuucuugcauccgcuggagaacuccaaaaaggcaaugaacucgcgcucccaacgcaauuuaugaaauuccuauacuuagcgucacgauauaacgaacucaaaggaaaacccgaagaaauagaacaaaaacaagaauuuguuguacaacacguaucauacuuugaugacauauuacaaaucauuaacgauuuuucaaaccgaguaauacuugcagaugcgaaccuagagaaaauaaacaaacuuuaccaggauaacaaagaaaacauuccuguagaugaacuagcaaauaauauuauaaacuuauucacguuuacgagccuuggagcgccugcagcauucaaauucuucgauaaaauaguagauagaaaaagauacacaagcaccaaagaaguucuaaacuccacccuuauacaccaaucaaucacaggccuauacgaaacaagaauagaccuugguaagcuaggugaagacuga

SEQ ID NO: 8928 - RNA, 4113 nt, Artificial Sequence
  Cas9 variant
augacaaaaauaaaagacgauuacauaguaggacuagacauagguacagacagcuguggaugggucgcgaugaacuccaauaacgauauacuaaaacuccaagggaaaaccgcgaucggaucgagauuauuugagggcggcaaaucagccgcagaacgacgccuauucagaacuacacacagacguauaaaaagacgacguuggagacucaaacugcuagaagaguucuuugaccccuacauggcagaaguagacccauacuucuuugcucguuuaaaagaaagcggacuaagcccccuggauaaacgaaaaacggucucaucgauagucuuuccaaccagcgccgaagacaagaaauuuuacgacgauuacccaacaauauaucaccuacguuauaaacuaaugacagaagacgaaaaauuugaccuucgcgaaguauacuuagcuauacaucauauaauaaaauauagaggaaacuuucuuuacaacacaucaguuaaagacuuuaaagcuaguaaaaucgaugucaaaucuagcaucgaaaaauuaaacgaauuguaugaaaaccucggauuagaccuuaacguagaauuuaauauaaguaacacagcagaaauagaaaaaguacuaaaagauaaacaaauuuucaaaagagauaaaguaaagaaaauagcagaauuauucgcaaucaaaacggauaacaaagaacaaagcaaaagaauaaaagacauaagcaaacaaguugcuaaugccguauuaggcuauaaaaccagauuugacacaauugcuuuaaaagaaauauccaaagacgaauuaucagacuggaacuuuaaacuaagugauauagacgcagauagcaaauucgaagcucucaugggaaaccucgaugaaaacgaacaagcaauauugcuaacaauaaaagaauuguucaacgaagucacauuaaaugguauagucgaggauggcaacacacuauccgaaagcaugauaaacaaauacaacgaucacagagaugaucuaaaacuccuaaaagagguuaucgaaaaccacauugaccggaagaaagcuaaagaguuagcgcuggcuuacgaccucuauguaaauaacaggcacggaagauuacuucaagccaaaaagaaauuaggaaaaauaaaaccgcgaucaaaagaggacuuuuauaaaguagucaauaaaaaucuagaugauucgagggcaucaaaagaaaucaaaaagaaaauugaacuagauagcuucaugccgaaacaaaggacaaacgccaacggagugauaccauaucaauuacagcaacuagaauuagacaaaauaauagaaaaucaaucuaaauacuacccguuuuuaaaagaaauuaauccaguaucaagccauuugaaagaggcgccauauaaacucgacgaacuaauucguuuuagaguacccuauuaugugggaccacucauaagcccgaaugaaucaaccaaagauauacaaaccaagaaaaaccaaaauuuugcauggaugauaagaaaagaggaagguagaauaacaccuuggaauuucgaucaaaaaguugacagaauagaguccgccaacaaauuuauaaaacgcaugaccacaaaggacacauaucuuuuuggcgaagauguccucccagccaacaguuuacuauaucaaaaguucacaguccuaaacgaacucaauaauauaaggauuaauggcaaaagaauuucaguagaccuuaaacaagaaauauaugaaaauuuauucaaaaagcauacgacaguaacugucaagaaauuagaaaacuaucuaaaagaaaaucacaaccuggugaaaguagaaauaaaaggacuagccgaugaaaagaaauucaacucagggcucacaaccuauaaucgauuuaaaaauuuaaacauuuucgauaaccagauagaugacuuaaaauacagaaacgacuucgagaaaauaaucgaauggucaaccauuuucgaagauaaaucaauauauaaagaaaaacuaaggucuauagauuggcucaacgaaaaacaaaucaacgcccuuucaaauauaagguuacaaggauggggacgccuuucaaagaaauuacuugcccaacuacaugaucauaacggacagacuauuauagaacaauuaugggauagccaaaacaacuucaugcaaauaguaacgcaagcugauuucaaagacgcgaucgcaaaagcaaaucagaaucuucucguugcgaccaguguagaagacauacuaaacaaugcauacacaaguccugcaaauaagaaagcaauccgacaaguaauaaaaguaguagacgacaucguaaaagcagcaucaggaaaagucccaaaacaaauugcgaucgaguucacgcgugaugccgaugaaaacccaaaaagaucacagacgcgcggcaguaaacuacaaaaaguauacaaagacuuaucgacagaacuagcaucaaaaacaaucgccgaagaauuaaaugaagcuauaaaagauaagaaacucguccaagauaaauacuaucuuuacuucaugcaauuaggaagggacgcauacacaggagaaccuauaaauauagaugaaauacaaaaauaugauauugaccauauccuaccacaaucauuuauaaaagaugaugcgcuagacaauagaguacugguaucacgagcuguaaauaauggaaaaucugauaauguccccguaaaacuauucggaaacgaaauggcagcuaaccuuggaaugaccauaaggaaaaugugggaagaauggaaaaauauaggccucaucucgaaaacaaaauauaauaaccuuuuaacagauccagaccauauaaacaaauacaaaucagcaggauuuauuagacgccaauuagucgaaacaagucaaauuaucaaauuagucaguacuauauuacaaagccgauauccuaauacagaaauaauaaccguaaaagcaaaauacaaccacuaucuaagagaaaaauuugaccuauacaaaucaagagaggucaaugacuaucaccacgcuauagaugcauaucuaucagccaucugcggcaauuuacuauaccaaaacuacccaaaccuaaggccauucuuugucuacgggcaauacaagaaauucuccagcgauccugacaaagaaaaagaaauauuuaacaaaacaaggaaauucucuuucauuagccaaauacuuaaaaacaaauccgaaaacucaaaagaaauagccgaaaaacuaaaacgagcauaucaauuuaaauacauguuaguaucacgagaaaccgaaaccaaagaucaagaaauguuuaaaaugaccgucuuuccucgagaaacgccagguaaccuaauacccaaaaagaaagggauggccccagaaaucuauggaggauauaccaaaaacagugacgcauauaugguaauaguuaaaaucgauaaaaagaaagaaacagaauacagaauacuuggaauaccaaccagagagcucguuaaucuaaagaaagcugaaaaagaagaucauuacgaaaguuaccuuaaagagauauuagcaccacgaauacuauacaacaaaaacggcaaacgcgauaagaaaaucacuucauucgagauaguaaaauccaaaauaccauauaaacaaguaauucaagauggugauaagaaauuuaugcuaggaucauccacauacguuuauaaugcaaaacaacuaacauuaaguaccgaaaguaugaaagccauaacuaauaauuucgacaaagacucagacgaaaacgacgcgcucauaaaagccuaugaugaaauacuagauaaagucgauaaauaccuaccuuuauucgacauaaaugcauuccgaaagaaauuacauucaggcagagaaaaauuuguagaacuaagccuagaggauaagaaagacauaaucuuaaaaguccuaauagguuuacaugacaacccggcaacaucagaucucaaaacucuaggcuucaguucaaccgaacuaggaaaaaugcagaaaaacucaggaauuguacuaagcggaaacgcaaaacuaauauaccaaagcccaacaggccucuuuaagaaaucaguaaaaaucagugaucuauga

SEQ ID NO: 8929 - RNA, 4113 nt, Artificial Sequence
  Cas9 variant
augacuaaaaucaaagacgauuacauaguaggacucgauaucgguacugauucauguggauggguugcgaugaacucagauaaugacauuuuaaaauuacaaggaaaaacagcgauaggaucucacuuguucgaagcugguaaaagugcagcagauagaagauuauuuagaacaacacacagaagaauaaaaagaagaagauggagacuaaaacugcuagaagaauuuuucgauccuuauauggcuaaaguagacccauauuucuucgccagacucaaagaaucaggguuaaguccucuggacaaacguaaaaacguauucucgauaguauucccaaccgcagcagaagacaagaaauucuaugacgacuacccaacaauauaccacuuacgauacaaacuuaugacagaagaugaaaaauucgaccuaagagaaguauaucuugccauucaccacauuaucaaauacagagguaacuucuuauacaauacaagugucaaagauuucaaagcaucaaaaauugaugucaaaagcucaaucgaaaaacuuaacgaacuauacgaaaacuuaggacucgaccuuaacguugaauuuaacauuuccaacaccgccgaaauagaaaaaguauuaaaagauaaacaaauauuuaaacgagacaaagucaagaaaauagcugaacuauuugcaauaaaaacagacaauaaagaacaauccaaaaggauaaaagacauaagcaaacaaguugcaaacgcagucuuaggcuacaaaacaagauucgacaccaucgcccuuaaagaagucucaaaagaugaacucucugacuggaacuuuaaauuaucagacauugaugcagauuccaaauucgaggcuuuaaugggaaaucuagacgaaaacgaacaagcaauauuacugaccauaaaagaacucuucaacgcuguaacccuuaauggcaucguagaagauggaaacacacugucagaaucaaugauuaauaaauacaacgaccaucgagaugacuugaaacuacucaaagaagucaucgaaaaccacauagacaggaagaaagccguaaaacuugcacuagccuacgaucuauaugugaacaacaggcacggacaacuaauucaagccaaaaagaaacuagggaaaaucaaaccaggcuccaaagaagauuuuuauaaaguuguaaauaaaaaccuagaugacucucaagcaaguaaagaaaucaaaaagaaaaucgaacuagauuccuuuaugccaaaacagcgaaccaacgccaacggaguaauacccuaccaacuccaccaacuugaacuagauaaaauaauagaaaaucaaaguaaauauuauccuuuccuaaaagagauaaacccugucagcucccaccuuaaagaagcaccauacaaacuagacgaacuaauacgauucagaguaccauacuacguaggaccccuuauuucaccuaaugaauccacaaaagacauccaaaccaagaaaaaucaaaauuuugcauggaugauuagaaaagaagaaggcagaauaacaccauggaauuucgaucaaaaaguugacaggaucgaaucagcaaacaaauuuauaaaacgcaugacaacuaaagacacauaccuuuuuggugaaaacguucucccagcuaauagcuuacuauaucaaaaauucacuguucuuaacgagcucaacaacauaaggauaaacggaaaaagaauaaguguagacuuaaaacaagaaauuuaugagaaucucuuuaagaaacauacaacaguaacagugaagaaacuugaaaauuaucuaaaacaaaaucacaauuuagucaaaguagaaaucaaagggcucgcagacgagaagaaauuuaacucgggauuaacgacauacaacagauuuaaaaaccuaaacauauuugauaaccaaaucgacgaccuaaaguaucgaaaggacuucgagaaaauaauagaaugguccacaauauuugaagauaagaguaucuacaaggaaaaauuacguucaauagauuggcuuaaugaaaaacaaaucaacgcauuaucaaauauaagacuacaaggaugggguagacucaguaagaaacuacuagcacaacuccaugaccacaacggucaaacuauaauugaacagcugugggacucccaaaauaacuucaugcaaauuguaacccaagcugacuucaaagacgcaauagccaaagcaaaccaaaaccuuuuagucgccacaagcguagaagacauccuaaacgaugcauacacaucaccagcaaauaagaaagcgauuagacaagugaucaaaguagucgaugacauagugaaagcugccucuggaaaagugcccaaacaaaucgcaauagaguuuacacgcgacgcagacgacaauccaaagagaucacaaaccagaggcucaaaacugcaaaaaguuuacaaagaccuaucaacugaacuagcuuccaaagcaaucgcagaggaauugaaugaagcaauuaaggacaagaaauuaguacaagacaaauacuaccuauauuuuaugcaauuaggaagagacgcauauacgggugaaccaauaaauaucgaugaaauacaaaaauacgacaucgaucacauucuuccucagagcuuuauuaaagacgaugcacuagauaauagagucuuaguuucuaaggcaguaaacaaugauaaaucagacaacguaccaguaaaacuauuugguaacgaaauggcugggaaucuuggaauaacaauuagaaaaaugugggaagaauggaaaaacaucggccucaucagcaaaacaaaauacaauaacuuauuaacagacccagaucacauaaacaaauacgaaucugcaggauucauaagaagacaauuaguugaaacuucucaaaucauaaaguuaguaucaaccaucuuacaaucccgcuacccuaacacagaaauaauaacuguaaaggcaaaauacaaccauuaucuaagggaaaaauuugaucuuuauaaaucucgagaaguuaacgacuaccaucacgcgauagaugccuaucuaucagcaauaugcgguaaccuacuuuaccaaaacuacccaaaccuucggccauucuuuguauacgggcaauacaagaaauucagcuccgacccagauaaagaaaaagaaauauucaauaaaacccguaaauucucauuuauaucacaaauacuuaaaaauaagagugaaaacucaaaagaaaucgcagagaaacuaaaaagagcauaccaauucaaauauaugcuaguaagcagagagaccgagacaaaagaucaagaaauguucaaaaugacgguuuuccccagagaaacaccaggcaaucuaauacccaagaagaaagggauggccaccgaaauuuacgggggauauaccaaaaauucagacgcuuacauggugauaguuaaaauagauaaaaagaaagaaaccgaauacagaauacuuggcaucccaacaagagaauugguaaaccucaagaaagcggaaaaagaagaucacuacgaauccuaucucaaagaaauacuagcaccaaggauacuauauaauaagaauggcaaacgugauaaaaagauaacaucauuugaaauagugaaaagcaaaauuccuuauaaacaaguaauacaggacggcgauaagaaauuuauguuaggauccuccaccuacguuuauaaugcaaaacaacuaacauuaucaacagaaagcaugaaagccauaacaaacaauuuugauaaagauagcgacgaaaacgacgcacuaauaaaagcauacgacgaaauacuagacaaaguagacaaauaccuaccauuauucgacauaaacgcauuccgcaagaaacuccacucaggacgggaaaaauuuguagaauuaagccuagaagauaaaaaggacauaauacugaagguacuaauagggcuacaugacaacccggcaaccuccgacuuaaaaacccucggauucagcucuacagaacuaggaaaaaugcagaaaaauaguggaaucguucucucggguaaugcaaaacuaaucuaucaaucacccaccggacuuuucaagaaaucaguaaaaauuagcgaccuguga

SEQ ID NO: 8930 - RNA, 4113 nt, Artificial Sequence
  Cas9 variant
augaauaaaccuuacucaauaggacuugacauaggaacuaacaguguaggcuggucaauuauaacggacgacuauaaagugccagcaaagaaaaugcgaguauuaggcaacacugauaaagaauacaucaagaaaaaccuaauaggagcacuacuauucgacggaggaaauacagcagcagacagacgguuaaaaagaaccgcacgccgaagauacacuagacgaagaaacagaauacuauacuuacaagaaauauucgccgaagaaauguccaaaguagacgauucauuuuuccaccgccuagaagauucauuucuaguagaagaagauaaacguggaucaaaauaucccauuuucgcaacaaugcaggaagaaaaauacuaccacgaaaaauucccaaccaucuaccaucuaagaaaagaauuagccgauaagaaagaaaaagccgaccuuagacucauauacuuagcacucgcccauauaauaaaauuuagaggccauuucuuaauagaagaugaccgauuugacguaaggaauacagauauacaaaaacaguaccaggcuuuccuugaaauauucgacacaaccuuugaaaauaacgaccuacuaucacagaacguagacguugaagccauucuuaccgacaaaauaucaaaauccgccaagaaagaccguauucuagcaagauauccaaaucaaaaaucaacaggaauuuucgcugaguucuugaaauuaauaguagguaaccaggcagacuuuaagaaacauuucaaccuagaagauaaaaccccacuacaauucgcaaaagauagcuaugaugaagauuuagaaaaucuccuuggacaaauaggagacgaguucgcagacuuguucucagcagccaagaaacuauacgacuccguacuauugucugguauucuaacuguaaccgacuuaagcacaaaagcuccgcuaucugcguccaugauacaaagauacgacgaacauagagaagacuuaaaacaacuaaaacaauucguaaaagcaucacucccagaaaaauaccaagaaauauuugcggacaguaguaaagauggauaugcaggauauauagaaggcaaaaccaaucaagaggcuuucuauaaauacuuaaguaaacuguugaccaaacaagaaggaucagaauaucuacuagagaaaaucaaaaacgaagacuucuuacgaaaacaaagaacauuugauaaugguaguauaccccaccaaguacaucuaacggaauuaagggcgauaauuagaagacaauccgaauacuaccccuucuuaaaagaaaacuuagacagaauagagaaaauacuuaccuucagaauacccuacuacgucggaccacucgcuagggaaaaaucagauuucgccuggaugacaagaaaaacagaugacucaauacgacccuggaacuucgaagaucuaguagauaaagaaaaaucagccgaagcauucauacaccguaugacaaacaaugauuuauauuuaccagaagaaaaagucuuacccaaacauucucuaauauaugaaaaauucacaguauacaacgaacuaaccaaaguacguuuucuagccgaaggcuuuaaagacuuccaauuucugaaccgaaaacaaaaagaaacuaucuuuaauucuuuauucaaagaaaaacggaaaguaacagaaaaagacauaauaucauuccuaaacaaaguugacggauacgaagguauagcuauaaaaggaauagaaaaacaauuuaacgcauccuuauccacauaccaugacuugaagaaaauucuaggaaaagacuuuuuggacaauacagacaacgaacuaauacuugaagacauaguacagacacuaacacuauuugaagaccgagaaaugauuagaaaaagauuagacauauacaaagacuucuuuacagaaucccaauuaaagaaacuuuaccgacgccacuauacaggguggggaagacucuccgcgaaacuaaucaauggaaucagaaacaaagaaaaucagaaaacgauucucgauuaccuaaucgaugauggaucagcaaaucggaacuucaugcaacucaucaaagacgccggacucaguuuuaaaccaauuauagacaaagcgagaacuggaagucacuccgacaaucucaaagaaguagucggagaauuagcagguagccccgcuaucaagaaaggaauauuacagagcuugaaaaucgucgacgaacugguuaaaguaaugggcuacgaaccagaacaaauaguuguugaaauggcgagagaaaaccaaacaacagcuaaaggucuaucucgaagucggcaaagacuaacgacucuacgugaaagucuagcuaaucugaaaagcaacauacuagaagaaaagaaacccaaauauguaaaagaucaaguagaaaaucaucaucuaagcgaugacagacuguuccuguauuauuugcaaaaugggaaagacauguauacggacgaugaauuagacauugacaaccuaucacaguacgacauagaucacauuauuccccaggcuuucauuaaagaugacuccauagacaaucgaguacugguaucauccgccaaaaaccguggaaaaucagaugacguacccaguguugaaauaguaaaagauuguaaaguauuuuggaagaaacuguuagaugcaaaauuaaugagucaaagaaaauaugacaaucuaacaaaagccgaaagaggcggucucaccucagaugacaaagcgagauucauucaaagacaauuaguagaaacaagacaaaucacaaaacacguagcucguauacuagacgaacgcuuuaacaacgaauuagauucaaaaggucguaggaucaggaaagucaaaauagugacccucaaaucuaacuuaguuuccaauuucagaaaagaguucgguuuuuauaaaauaagagaagucaacaauuaccaccaugcccaugacgcuuaucuaaaugcaguuguugcuaaagcaauacuaaccaaauacccacaacucgaaccugaguucguuuacggagacuauccaaaauauaauucuuauaaaacgcgaaaaucagcaaccgagaaacuauuuuucuauucaaauauaaugaauuucuuuaaaacaaaggucacacucgccgacggaacagucguaguaaaagaugauauagaaguuaauaacgauacaggagaaauaguaugggacaagaagaaacacuucgcaacaguccgcaaaguacucaguuauccucagguaaacauagucaagaaaacugaaauacaaacagggggauuuuccaaagaaaguauauuggcucacggaaacagcgauaaacuuauuccgcgcaaaacaaaagacauauaccuagaucccaagaaauacggaggguucgacagcccaaaagucgcauacuccguccuuguagucgccgauaucaagaaagguaaagcacagaaacucaaaacaguaacagaauuacuugggauaacaauaauggaacgauccagauucgagaaaaaucccagugccuuucuagaaucaaaagguuauuuaaacauccgcgaugauaaacucaugauacuucccaaguacucuuuauuugaacuagaaaauggaagacgcagauuauuagcaagcgcaggcgaacuucaaaaagguaacgaacuugcacuccccacacaauucaugaaguuccuauaccuagcaucacgguauaacgaauuaaaaggaaaaccagaagaaauagaacaaaaacaagaguucguaguucaacacgucagcuacuucgacgauauuuuacaaauuauaaaugauuucucaaacagggucauacuagcggacgcaaauuuagagaaaauaaauaaacucuaucaagauaacaaagaaaacaucccugucgaugagcuggccaauaacauaaucaacuuauuuacauucacaaguuuaggcgccccagcugcauuuaaauucuuugauaaaauaguugauagaaaacgauauacgucaacaaaagaagucuuaaauucaacucucauacacaaaucgauaacaggccucuacgaaacucguauagacuuagggaaacuaggugaagacuga

SEQ ID NO: 8931 - RNA, 4113 nt, Artificial Sequence
  Cas9 variant
augaacaaaccauacagcauugggcucgauauaggaaccaacucaguaggauggaguauaauaaccgaugauuacaaggucccagcgaagaaaaugcgaguauuagggaauacggauaaagaauacaucaagaaaaauuuaauaggagcgcuacuguuugauggaggaaacacagcagccgauagacgccuaaaaagaacggcucgcagaagauauacacgcaggagaaaccgaauacuauaucuacaagaaauauucgcugaagaaaugagcaaaguagaugauaguuucuuccaccggcuggaagacagcuuucucguagaagaagauaaaagagguucaaaauacccaauauuugccacauuacaagaagaaaaagauuaucaugaaaaauucucuacaauuuaucaccuaagaaaagaacuagcagacaagaaagaaaaagcagaucuuaggcuaauauauauagcacuugcucauauuauaaaauucagaggccauuuucuuauagaagacgauaguuucgaugucagaaauaccgacauaucuaaacaauaccaagauuuucuagaaauauuuaauacaacauucgaaaacaacgauuuauuaucacaaaauguagaugucgaggcuaucuuaacagacaaaauaaguaaaucagcaaagaaagaccggauacuagcccaauaccccaaccagaaaaguacaggcauauucgcugaauuuuugaaacuaauaguggguaaucaagcugacuuuaagaaauauuuuaaccuggaagacaaaacaccacuucaauuugcaaaagacagcuacgaugaagaucuugaaaauuuauuaggacaaauaggagaugaauuugcagaucuauucucugcggcgaagaaacucuacgacuccgucuuacuaucaggcauucugacuguaauagacuuauccacuaaagcaccacuaucugccagcaugauacaacguuacgaugaacaccgagaagaccucaaacaacuaaaacaauucguaaaagcaagccugcccgaaaaauaucaagaaauauuugcugacucaucuaaagauggauacgcaggauacauagaaggaaaaacaaaccaagaagcauuuuacaaauacuuaagcaaacuacuaaccaaacaagaagacagcgagaauuucuuggagaagaucaaaaacgaagacuuuuuacgaaaacaacguaccuuugacaauggauccauaccccaucaaguacacuuaacagaacuaaaagcaauaauaagacgacaaucugaauacuauccauuucuuaaagaaaaucaagacagaauagaaaagauacuaaccuuuagaauaccauauuacauaggaccuuuagccagggaaaaaucagauuucgcauggaugacacgaaaaacagacgacucaauaagacccuggaauuucgaagauuuaguagacaaagagaaaagcgcggaagcauucauacauagaaugaccaauaaugacuucuauuuacccgaagaaaaaguccuaccuaaacacucacuuauauacgaaaaauuuacgguuuauaaugaacuaacuaaggucagguacaaaaaugaacaaggagaaacuuacuucuucgacuccaacauuaaacaagaaauuuucgauggagucuucaaagaacauagaaaggucucgaaaaagaaauuacuugacuuuuuagcaaaggaauaugaagaauuuaggauaguagacguaauugguuuagacaaagaaaacaaagccuuuaaugcaucacuaggcacuuaucacgaucuagagaaaauauuagacaaggacuuccucgauaauccagauaacgaaucaauacuagaagacauaguccaaaccuuaacauuauucgaagaucgagaaaugauaaagaaacgacuggaaaacuacaaagacuuauuuacggaaagccaacugaagaaacuuuauagaagacauuacacaggcuggggaagauuguccgccaaacucauaaauggaaucagagacaaagaaucacaaaagacgauauuagacuauuuaauugacgacgggagaagcaacagaaacuucaugcaauuaaucaaugaugacggucucagcuucaaaucgauaauuagcaaagcgcaagcaggaucucauucagauaaucuuaaagaaguaguaggcgaauuagcgggcaguccagccaucaagaaagguauacuacaaagccuuaaaauaguagacgaauuagugaaaguaauggguuacgagcccgagcaaauagucguugaaauggcgcgcgaaaaccaaaccacaaaccaagguagacggaacagcagacaaagauauaaacuucucgacgauggagucaaaaaucuagcgagcgaccuaaauggcaauauacuuaaagaauaccccacagauaaccaagcacuacaaaaugaacgauuauuuuuguacuauuuacaaaacggcagagauauguauacuggagaggcuuuagacauugacaaccuaagucaauaugacauagaccauauaauaccacaagcauuuauaaaagacgacucuaucgacaaccgaguauuagugucgucugcuaagaaucgagggaaaagugacgauguaccuucucuggaaauaguaaaagauugcaaaguauuuuggaagaaacuacuggaugcaaaauuaaugucacaaagaaaauacgacaacuuaacaaaagcggaaagagggggucuuacaucagacgacaaagcccgauuuauacaaagacagcuaguagaaacacgccaaauuaccaaacacguugccagaauacuagacgaaagauucaauaacgaauuagauucgaaagguaggcgaauacgaaaaguuaaaauagugaccuuaaaaaguaaccuagucaguaauuucaggaaagaauuuggguuuuacaaaauacgugaaguaaauaauuaucaccacgcccaugaugcuuaccuuaacgcuguaguugcuaaagcaaucuuaacuaaauauccacaacuagaaccagaguucguauacggagacuacccaaaauauaacucuuauaagacaagaaaaagugcgaccgaaaaauuauucuuuuacaguaauaucaugaauuucuucaaaacaaaggucacacuagcagaugggaccguaguagugaaagaugacauagaaguaaacaaugauacaggagaaauaguaugggacaaaaagaaacacuucgcuacgguacgaaaaguguuaagcuacccacaaaauaacauaguaaagaaaaccgaaauacaaacaggcggauuuagcaaagaaucaauuuuagcucauggaaacucagacaaauuaauaccccgaaaaacuaaagauauauauuuagacccaaagaaauacggcggauucgacucaccaauuguagcuuacucgguauuagugguagcugauauaaagaaaggaaaagcccaaaaacuaaaaacagucacagaacuucucgguauaacaaucauggaacgaucaagauucgagaaaaaucccagugccuuccuugaaucaaaaggauacuuaaacaucagagcugauaaacuaaucauacuaccuaaauacucccucuuugaauuagaaaacggucgacggcgauuauuagccucugccggugaauuacaaaaaggaaaugaacuagcacuuccuacucaauucaugaaauucuuguauuuagcaucucgauauaacgaauccaaaggaaaaccagaagaaauagaaaagaaacaagaauuuguaaaccaacacguaucuuacuuugaugacauauuacagcucauaaaugacuucaguaaacgagugauacuagcagaugcaaaucuugagaaaaucaauaaacuauaccaagauaacaaagaaaacauuucgguugaugaacuagcaaacaacauuauaaaccuguuuacguuuacaagucuuggugcccccgcagcguuuaaauucuuugauaaaauaguugaucgcaaaagguacaccaguacuaaggaaguuuuaaauucaacucuuauucaccaaucaauuaccggacucuacgaaacccgaauagacuugggcaaacuaggagaagacuga

SEQ ID NO: 8932 - RNA, 4113 nt, Artificial Sequence
  Cas9 variant
augaauaagccuuauaguauaggacuagacauuggaacaaauucagucggauggucaauuauaacugacgauuacaaagucccagcgaaaaagaugcguguccucggaaacacugacaaagaauacauaaagaaaaauuuaauaggugcauuauuguuugaugguggaaacacagcagcagaucggagacuuaaaaggacggcgagacguagguauacuagaaggagaaacagaaucuuauauuuacaagaaaucuuugccgaagaaaugaguaaaguggacgauagcuucuuccaucgccuggaagauaguuuccuuguagaagaagacaagcgagguuccaaauacccgaucuuugcaacacuacaagaagaaaaagauuaucacgaaaaauuuuccacaauauaucaccuaagaaaagaauuagcggauaagaaagaaaaagcagauuuaagacucauauauauugcccucgcacacauaauuaaauuucgcggacacuucuuaauugaagaugacucuuucgauguaaggaauacagacaucucaaaacaauaucaagauuuccuagagaucuuuaacacaacguucgagaauaacgacuuauuaagucagaauguagauguugaggcgauauuaacagauaaaauaucaaaaucagcgaaaaaggaccgaauacuugcccaauaccccaaccaaaaaucuaccggaauauuugcugaauuucuaaaauuaauugucggcaaucaggcagacuucaagaaauauuuuaauuuagaagacaaaacaccacuccaguucgcaaaagacucauaugaugaggaccuagaaaaucuccuuggacaaauaggagacgaguucgccgacuuauuuuccgccgcaaagaaacuauaugauagcguacuacuuagcgguauauugaccgugauagacuugaguaccaaagcuccucugucggccucaaugauacaaagauaugacgaacaccgcgaggauuugaaacaacuuaaacaauuuguaaaagccagccuaccagaaaaauaccaagaaauuuuugcagacucaagcaaggacggauacgcaggauacauagaaggaaaaacaaaccaagaagccuucuauaaauaccuaucaaaauuacuaacgaaacaggaagauagcgagaacuuccuagaaaagaucaaaaacgaggauuuccuaagaaaacaacguacauucgauaacggaaguauaccacaccaaguacaucuaacagaacuuaaagccauaauacgaaggcaauccgaauauuauccauuccuaaaagaaaaucaagaucggauugagaaaauacuuaccuuuagaauaccauacuauauaggccccuuagcaagggagaaaagugacuucgcguggaugacccgaaaaacagaugacucaauaagaccauggaauuuugaagaccuuguagacaaagaaaaaucugcggaagcauuuauccauagaaugaccaacaaugauuucuaccuaccggaagaaaagguauuacccaaacacagcuuaauauacgaaaaauucacagucuauaacgaacuaacaaaaguacgauauaagaaugaacaaggugaaacauauuucuucgauuccaauauaaaacaagaaauauuugauggaguguucaaagaacauagaaaaguuagcaaaaagaaacuauuagacuuccucgcaaaagaauaugaagaauuuagaauaguagacguaaucgggcuagacaaagaaaauaaagccuuuaacgcuaguuuaggaacauaucacgauuuagaaaagauauuggauaaagacuucuuagacaaccccgacaaugaaucgauauuagaagauauaguacaaacgcuaaccuuauucgaagaccgagaaaugauuaagaaaagguuagagaacuauaaagaucuauucacggaaucucaacuaaagaaacuuuaccgcagacacuacaccggauggggaagacucucagcaaaacucauaaacggaauacgugacaaagaaucacagaaaacaauucuagacuacuuaauagacgacggaagauccaauaggaauuucaugcaacuaaucaaugacgauggacuuaguuucaaaucaauaauaucaaaagcccaagcagggucacacucagacaaucuuaaagagguaguaggagaacuugcaggaucaccggcaauaaagaaagggauauugcaaagucuaaaaaucgucgaugaacuuguaaaaguaaugggauacgaaccagaacaaauagugguagaaauggcacgagaaaaccaaacuaccaaucagggacgacgaaauucuagacaaagauacaaacuacuggaugauggaguuaaaaacuuagcauccgacuuaaacggaaauauacuaaaagaguacccuacagacaaucaagcucuacaaaaugaacgccucuuucuauacuauuugcaaaaugggagagauauguauacaggugaagcacuagacauagauaacuuaagucaauacgacauagaucauauaauuccccaggccuuuaucaaagacgauucuauagacaaccgaguucuaguaucaagcgcuaaaaacagagggaaaucagacgacguaccgucacucgaaaucguuaaagauugcaaaguauuuuggaagaaacuacucgaugccaaacugaugagccagcgaaaauacgauaaccuaacaaaagcagaacgcgguggacugaccagugacgauaaagcccgauucauacagaggcaauuaguagagacucgacaaauaacaaaacacguagcccgaauauuagaugagagauucaauaacgagcuagacucuaaaggacgaagaauaagaaaaguuaaaaucguaacacuuaaaucuaaccuuguaucaaauuuucgaaaagaauuugguuuuuauaaaauacgagaagucaauaacuaccaucacgcucaugacgcuuaucuaaaugccgucguagcgaaagccauacuaacuaaauacccacaacuagaaccagaauuuguauauggagacuaucccaaauacaacaguuacaaaacacgcaaaagcgccacagaaaaacuauuuuucuacucgaacauaaugaacuucuucaaaacaaaaguaacauuagcagauggaacaguaguagugaaagaugacauagaagugaauaaugacacaggcgaaauaguaugggacaaaaagaaacacuuugcaacuguacgaaaaguacuaucuuauccacaaaauaauauagugaagaaaacagaaauccaaaccggagguuucagcaaagaaaguauacuagcacauggcaacagugacaaacuaaucccacgaaaaacaaaagacauauauuuagauccaaagaaauacggaggauucgacuccccgauaguugcuuacucgguucuaguaguagcagauauaaagaaaggaaaagcacaaaaauuaaaaacuguaacagaacuuuuaggaauuacaaucauggaaaggagucgcuucgagaaaaacccaagugcauuccuagaaagcaaaggcuaucucaauauacgcgaugacaaacugaugauacuaccaaaauauucacuauuugaacuggaaaacgggcgaagaaggcucuuagcuucagcaggagaacuacaaaaagguaaugaacuagcauuaccaacacaauucaugaaauuccuauacuuggcaaguagauacaacgaaucaaaagggaaaccagaagaaauagagaagaaacaagaguucguaaaccaacauguaagcuauuucgacgacauauuacaacuuaucaacgauuucucaaaaagaguuauacuagccgaugccaaucuagagaaaauuaacaaacuguaccaagauaacaaagaaaacauuucgguugaugaauuagccaauaacauuauaaaucuauuuaccuucaccucauuaggggccccugcagcauuuaaauucuuugacaaaauaguagaucgaaaaagguauacaucuacaaaagaaguacuaaauucaacacuaauacaccaaucuauuacuggucuauaugaaacccgaauugauuugggaaaacuaggcgaagacuga

SEQ ID NO: 8933 - RNA, 4113 nt, Artificial Sequence
  Cas9 variant
augaauaaaccauauucaauuggacuagacaucggaacaaacagcguaggauggucaauaauaacagacgauuauaaaguaccagcuaagaaaaugagagugcuggguaauacagacaaagaauacaucaagaaaaaccugauaggcgcacuauuauuugauggagguaauacagcagccgaucgacgucuaaaaagaacagcuagacgacgauacacgagacgcagaaauaggauauuauauuugcaagaaauuuuugcugaagaaauguccaaaguugaugauucuuucuuucacagauuagaagacucuuuucugguagaagaagacaaaagagguucgaaguaccccaucuuugcaaccaugcaagaagaaaaauacuaucaugaaaaauucccgacaauauaucaucugcgaaaagaacuugcagauaagaaagaaaaagccgaucuaagauuaauuuaccucgcuuuagcacacauaauaaaauuuaggggccauuuucuaauagaagacgauagauucgacguucgcaauacugacauccaaaaacaauaucaagcguuccucgaaauuuucgauacgacuuucgaaaacaaugauuuacuaucacaaaacguagauguagaagcuauacuaacagacaaaauuuccaaaucagcaaagaaagacaggauacuagccagauauccaaaucagaaaaguaccggcauauuugcagaauuucuaaaauugauagucgggaaucaagccgacuucaagaaacacuucaaccucgaagauaaaacaccucuacaauucgcaaaagacucuuacgaugaagauuuggaaaaccuacuaggacaaauaggugacgaguucgcagaccuauuuagugcagcaaagaaacuauaugauuccgucuuacuauccggaauacuaacaguaacugauuuaagcaccaaagccccacuuuccgcgucaaugauccaaagauaugaugaacauagagaagaccugaaacaauuaaaacaauuuguaaaagcgucccuccccgaaaaauaccaagaaauuuucgcagacaguagcaaagauggguacgcaggauacauagaaggaaaaacaaaccaagaagcauuuuacaaauaucuaucaaaauuauugacaaaacaagaaggaucugaauaccuacuagagaaaaucaaaaacgaagacuuuuugagaaaacaacguacuuucgauaauggaucgauaccccaucaaguucauuuaacagaauuacgagccauaauuagaaggcaaucagaauauuaccccuuacuuaaagaaaaccucgaucgcauagagaaaauauuaacauuuagaauacccuauuacguagguccucucgccagagaaaaauccgauuucgcuuggaugacuagaaaaacugacgacucuauaagaccuuggaacuuugaagaccucguagacaaagaaaaauccgcagaagcauucauucaucggaugacaaauaacgaucuguaucuaccugaagaaaaaguucuacccaaacauucucuuauuuaugaaaaauuuaccguuuacaacgaauuaacuaaaguuagauuccuagcagaaggauuuaaagacuuccaauuuuuaaauagaaaacaaaaagaaacaauuuuuaacagcuuauucaaagagaaaagaaaaguaacggaaaaagauaucaucucguucuuaaacaaaguugauggcuacgaaggcaucgcaauaaaaggaauagaaaaacaauucaaugcgucucugagcacuuaccacgaucuaaagaaaaucuuaggaaaagacuuccuagauaacacggacaacgaacucauccucgaagauauaguacaaacacuaacccuauucgaagacagggaaaugauaagaaaacgacuagauauauacaaagacuucuuuacagaaagccaacuuaagaaacuuuacagaagacacuacacaggcugggguagacuaucggcaaaacucauuaacgguaucagaaacaaagaaaaucagaaaacaauccuagauuauuuaauagacgauggcagcgcaaacagaaacuuuaugcaacuaauuaaagacgccggacuuuccuuuaaaccaauaauagacaaagcaagaacaggaagccacagugauaaccuuaaagaagugguaggugaacucgcaggcaguccggccauaaagaaagguauauuacaaaguuuaaaaauagucgacgaacuuguaaaaguuaugggauaugaaccggaacaaauaguagucgaaauggcccgcgaaaaucaaacuacagcuaaaggacucaguagaucaagacaacgucugacuacauuaagagaaucacuagccaacuuaaaaucuaauaucuuagaagaaaagaaaccaaaauacguaaaagaccaaguagaaaaccaucauuuaagugaugauagauuauucuuauauuaucuucaaaauggcaaagacauguacacagaugacgaacuggauauagacaacuuaagucaauacgacaucgaucauauaauaccccaggcuuuuauaaaggaugacucaauagacaaucgcguucuaguauccagugcuaaaaaccgaggaaagucagacgacguaccaaguguagaaauaguaaaagacuguaaagucuucuggaagaaacuacuagacgcaaaacugaugagccaaaggaaauacgauaaccuuacaaaggcagaaagaggagguuuaaccagugacgacaaagcuagauucauucaaagacaauuaguagaaacuagacaaauaacaaaacauguagcuagaauauuagacgaacgcuuuaauaaugaauuagacagcaaaggacgaagaauacgaaaaguaaaaauagucacucucaaaucaaacuuagugucaaauuuuaggaaagaguucggauucuacaaaauaagagaagucaauaacuaccaccacgcucacgaugcauaccugaaugcaguuguggccaaagcaauacuaacuaaauacccacaacucgaaccggaauuuguguacggagauuauccaaaguauaauaguuacaaaacaagaaaaucugcaacagaaaaauuauucuucuauucaaacaucaugaacuuuuucaaaaccaaagugacacuggcagauggcacaguagucguaaaagaugacauagaaguaaauaacgacacuggagaaauaguaugggacaaaaagaaacacuuugcgacgguaagaaaagugcuauccuauccacaaguaaauauuguuaagaaaacagaaauacaaacaggaggcuuuucgaaagaaaguauacuagcgcacggaaacucagacaaacucauaccaaggaaaacaaaagacaucuaccuagacccuaagaaauacggcggauucgacaguccaaucguugcauauucaguuuuaguaguggcagauaucaagaaagggaaagcacaaaaacuaaaaacaguaacugaacucuuaggaauaacgauaauggaacguagccgcuuugagaaaaauccaucagcuuuccucgaauccaaaggauacuuagacauucgcgacgacaaacuaaugauucuuccaaaauauagucuauuugaacuugaaaacggacgacgaaggcugcuagcuucagcuggagaacuacaaaaaggcaacgaacuggcacuaccaacacaauucaugaaauuccuuuacuuagcuuccagauacaacgaacuaaaagguaaaccagaagaaaucgaacaaaaacaagaguucgucguccaacacgugucuuauuuugaugacauacugcaaauaauaaaugauuucucuaauagagucauucuagccgaugcuaaccuagagaaaauuaauaagcuauaccaagauaauaaagaaaacaucccggucgacgaacucgcaaacaauauaauaaauuuauuuaccuucacuucucuaggagccccugcagcauucaaauucuuugauaagauaguagaccguaaaagguacacuuccaccaaagaaguacuaaacaguacucuaauucaucaaucaauuaccggguuauaugaaaccagaauagacuugggaaaacuuggagaagauuga

SEQ ID NO: 8934 - RNA, 4113 nt, Artificial Sequence
  Cas9 variant
augaagaaaccauauagcaucggacuugauauaggaacaaacagcguaggcugggcaguaguaacagaugacuacaaagucccagcaaagaaaaugagaguauuuggugacaccgacagaucccacauaaagaaaaaccuacuagguacccuucuauuugaugacggcaacacagcagaaaguagaagauuaaaacgaacugcaagaaggagauacacgaggagaagaaacagaauauuauauuuacaggaaaucuuuacagaaucuaugaaugaaauugacgaaucauucuuccaccguuuagacgauucguuucuaguccccgaagauaaacgaggaagcaaauauccaauauuugcaacgcuucaagaagaaaaagaauaccauaaacaauuuccaacaauauaccaccuacgcaaacaacuugccgauucaaaagaaaagagcgauguaagacuaauauaccuugcucuagcccauaugauaaaauaccgaggucacuuccucuacgaagaaacauuugauauuaaaaauaacgauauacaaaagauauucaacgaauuuauuaacauauaugacaacaccuucgaaggauccagcuuaaguggccaaaaugcccaaguugaagcaauauuuacggauaaaauaaguaaauccgccaaacgagaacgaguauuaaaacuauuuccagaugagaaaagcacaggccuauuuucagaauuuuuaaaauuaauaguggggaaucaagcagauuucaagaaacacuuugaccuggaagaaaaggcaccacuacaauucucaaaagacacauaugaugaagaauuggaaaacuuacugggccaaauaggggacgauuuugccgaucuauuuuuaauagcaaagaaauuauaugaugcaauauuauugaguggaauacuaacuguaacagauccaucaacaaaagcaccucucucagcaagcaugauagagagauaugaaaaccaccaaaaagauuuagcagcacuaaaacaauucaucaaaaacaaccuaccagaaaaauauguugaaguauucucagaccaaagcaaagauggauacgcaggcuacauagacgggaagacaacccaagaagcguucuauaaauacaucaagaacuugcuaagcaaguuugaaggagcggacuacuucuuggauaaaauagaacgugaggauuuucucagaaaacaaaggacauucgauaacgggucaauaccccaccaaauacacuuacaagaaaugaaugccaucuuacgaagacaaggcgaacacuauccguuccuaaaggaaaacagggagaaaaucgaaaagauacuaaccuucaggauuccauacuacguuggcccacucgcacgagacaaccgggacuuuucaugguuaacaagaaauuccgacgaaccaauuagaccauggaauuuugaagaaguaguagacaaagcaagauccgcugaagacuucauacaucgcaugacaaacuaugaccucuauuuacccgaagaaaaaguuuuaccgaaacacucacuuuuauacgaaacauucgcuguauacaaugaacuaacaaaaguaaaauuuauagcagaaggacuacgagauuaucaauuucuggacaguggccaaaagaaacaaauuguaaaccaauuauucaaagaaaaacgaaaaguaacagaaaaagauauaauacacuaucuucacaacguagauggauaugauggcaucgaacugaaagguauagaaaaacaauucaaugcaaauuuaucuaccuaccaugaucuccuuaaaauaacaaaagacaaagaauuuauggaugaccccaaaaaugaagaaauacuggaaaauauaguccauaccuuaacaauauucgaggaucgagaaaugauaaaacagcgacucgcccaauaugacacguuauucgacgaaaaaguaauaaaggcacugacccgaagacacuacacagguugggggaaacucagcgccaagcuaauuaauggaauccgagauaaacaaucuggaaaaacaaucuuagacuauuuaaucgacgacgauaagauaaaccggaauuuuaugcaacuaaucaacgacgaugggcuaaguuucaaggagauaauacaaaaagcacaaguuguaggaaaaaccgacgauguuaaacaaguaguccaagaacuaccaggcuccccagcuauaaagaaagggauauuacaaagcauaaaaauuguagaugagcuaguaaaaguaaugggcuaugcucuagaaucaauaguuauagaaauggcacgugaaaaucaaacaaccgccagaggcaagaaaaacucccaacaaagauacaaacgaauagaagaugcacuaaagaaucuagcaccaggauuagauuccaauauucugaaagaaaauccaaccgacaacauacaguuaaagaaugaccgauuauuuuuauauuaccuacaaaauggaaaagacauguacacugguaaaccacuggauauaaaccaauuauccucauacgacaucgaucauaucaucccacaagcauuuauaaaagacgauaguauagauaaucgcguacuuacaucaucuaaagacaauagagguaaauccgauaauguacccagccuugaaguuguacagaaaagaaaagcauuuuggcaacaacuucuagacucuaaacucauuagugaacguaaauucaauaauuuaacgaaagcugaaagaggcggacucgacgaaagagacaaaguuggauucauacgcaggcaauuaguagaaacacaacaaauuaccaaaaaugucgcucaaauacuugacgcuagauucaacacagagguaaaggagaaaaaucagaaaauaagaacaguaaaaauaauaacauuaaaaagcaaccuuguuucaaacuuucgaaaggaauuuggccuauauaaaguaagagaaauaaacaauuaucaccacgcucaugaugcuuauuuaaaugcaguagucgcaaaagccauacuuaagaaauauccaaaacuugaacccgaauuuguauacggggauuaccaaaaauacgacuuaaagaaauacauaucaagauuuaaacccucaaaagaaaucgaaaaagcuacagaaaaauacuucuuuuauaguaaccuauuaaacuuuuucaaagaagaaguccuauaugcagaugguacuauucguaaaagagagaauauagaguacucaaaagauacaggugagaucgccugggauaaagagaaagacuucgcaacgauaaagaaaguuuugucauauccucagguuaacaucguaaagaaacgcgaaguacaaacagguggcuuuagcaaagagucuauacucccaaaagggaauagcgacaaauuaauaccaagaaaaacgaaagacauauuaugggauacaacaaaauauggaggcuuugacagcccagugauagccuacucaauuuuauuaauagcggacaucgaaaaaggaaaagcgaagaaacuaaaaacagugaaaacucuaguuggaauaacuauaauggaaaaagcagccuucgaggaaaacccaaucacauucuuagagaauaaaggcuaucacaauguaagaaaagagaacaucuuaugccucccaaaauauucauuauucgaacuagaaaauggccggagaaggcuucuagcuagcgccaaagaacuacaaaaaggaaacgaaauaguauuaccaguaugcuuaaccacacuguuauaucauaguaaaaacuuacacaaauuagaugaaccagaacaucuugaauacauucagaaacaccgcaacgaauuuaaagaccuauuaaaccucgucucagaauuuucacagaaauacauauuagcugaagcuaaccuagagaaaauuaaagacuuauaugcagacaaugaacaagcagacauagaaauauuagccaacaguuucauuaaccugcuuacauucacagcccuaggagcacccgcugcauucaaauucuuuggaaaagaugucgaucgcaaacguuauacuacaguaagcgaaauccuuaacgcaacauuaauacaccaaaguauuaccggccuauaugaaacaaggaucgaucucaguaaacuaggagaagaauga

SEQ ID NO: 8935 - RNA, 4113 nt, Artificial Sequence
  Cas9 variant
augaaaaaaccauacucaauagguuuagacauuggaacaaacaguguaggaugggcagucauuaccgaugauuacaaagugccagcaaaaaaaaugaaaguacucgguaauacagauaaaaacuacauaaaaaagaaccuuuuaggagcuuuacuuuuugauucaggaaauacagcagaagaccgaagacuaaaaaggaccgcacgcagaagauauacaagaagacgaaauagguuauuauauuuacaagacauuuuuucugaugaaaugaauaaagucgacgaaagcuucuuucaccggcuagaagacagcuuucuagucagugaggauaaaagaggugaucaucauccaauauuugguaaugugguagaugaaguaaaauaccaugaacaauucccaacaauauaucauuugagaaaauaucuagcagacacaccagaaaaggcagaccuuagauuaguauaccuagcucuagcacacaugauaaaauucagaggccacuuuuuaauagacgauccuaaacucgacguaaagaauaccgacucccaagaauuauucagccaauuucuaacagcuuacgauguaacccaagaagacucacauuuagccgauguaaaaauaaauauuucggacauaauuaccgaaaaaaugaauaaaucacguaaaguagaggcucuauuauuucacuuucccagucagaaaaaaaacagcuucuuugguaaccuuguaucacuaguauuuggacugcucccuaauuucaaaacuaauuucaaccuagcugaggacgcaaaacuucaauugagcaaagacucauacgaugaagaucuugaaaaccuuuuaggacagauaggagacgaauacaccgacguauuuguagccgcacgaaaacuauaugauucaauauuacuaucaggaauuuuaacagucaacgaucuauccacuaaagcgauacuaucagccagcaugguaaggcgauaugaagaacauaauaaagaucuugcgaaacugaaagcuuuuguaaaagcgaacuucacacacgacguuuucaaagaaguauuuucagacgcgagcaaaaacgguuaugcaggcuauauugaaggaaaaacaucccaagaagacuucuacaaauaugucaaaaauuuaauugguaaaguugauggaagugcagacuucauugagaaaaucgaccgagaagauuuucugcgaaaacaaagaacuuuugacaauggauccauuccacaccaaguacaucuagcagaaaugaaagcgauuuuaagaagacaaggcgaauauuauccauuccuaaaagaacaugcugagaaaauacaacaaauacuuacauuccgaauaccauauuaugugggaccacuagacaggcauggacacagcgauuuugcgugggcaucauucaacagcgaagaaaaaguaacuccauggaacuucgaggaaauaauagauaaaaauaaaucugcccaagccuucauagaacgcaugacuaaccaagaccuguacuugccaaacgaaaaaguucucccaaaacacucaccccucuacgaaaaauauacagucuauaaugaauuaacaaaaauaaaauacguuacugaaaccggaacagcaaaauucuucgaugcuaaucuaaaacaagaaauauuugacggguuauuuaaaaaggagaggaaaguuacuaaaagaaaacucuuaacuuucuuagaaaaaaacuucgaugaguucagaaucguagacauccaaggucuagacaaggaaacagaaacauuuaaugcaaguuacggaaucuaucaagacuuauuaaaaauuaucaaagacaaagcauucauggacgauagugagaacgcagacauacuagaggacauaguucuaacacuaacuuuauucgaggacagggaaaugauuaaacaacgacuugccaaauaugcugacuuauucgacaaaaaaguaauagauaaucucgcaagacgaagauauaccggauggggaagacuaucagcaaaacuauuaaacggaauuagagauaaacguuccagaaaaacaauaauggauuacuuaguugacgauggacgaucuaauagaaaccuuaugcaauugauaacagacgauaaucuaacauuuaaagacgagaucgcuaaagcacaauauucagacaauucugaugaucuacaucaaguaguacaagauuuagcaggaucaccagccauaaaaaaaggaauacuucaaaguguaaaaauagucgaugaguuaguuaaaguaaugggguaugagccugaacagaucguuguugaaauggcaagagaaaaucaaacuacagcaaaaggacguagaaacucacaacaaagguacaaacgacuugaagaggcaauaaaaaacuuagaucgagaccuaaauuacaaaauuuuaaaagaacaucccacggauaaccaagccuuacaaaacgacagacucuucuuauauuacuuacaaaacggacgagacauguauacaggagagucacuagauauaaaucgacuaagcgacuacgauauagaccacauaauaccacaagcuuucauuaaggacaauagcauagacaaucguguguuaguuucaagcgcaaaaaaucgugguaagucagaugacguacccagugaagacguaguaaaccgaaugaggcccuuuuggaauaaacuacuuaacugcggacuaauaagucaaagaaaguauuccaaucuaaccaaaaaagaguuaacucccaacgauaaagccggauuuauaaaaagacaauuagucgaaacacgacaaaucacuaaacacguagcuagaauccucgacgaacauuuuaacaaagaauucgacgaagacaagaagagaauaaggaaaguaaaagucgucacucuaaaaucgaaucuuguaucaaauuuucgaaaagaauucgaacucuacaaaguaagagaaauaaacgauuaccaccacgcacaugacgcuuaucuaaaugcagucguagccaaagcacugcuaaugaaauaucccaaacucgagcccgaauucguguauggagaauauccaaaguacaauucauaccgugaaagaaaaaccgccacccagagaauguucuucuauucaaauauuaugaauauguucaaaucaaaagugaaauuagcagacgaacggauaauagaaagaccuaugaucgaagucaacgaugaaacuggagaaauugcaugggacaagacaaaacauauagcaacuguuaaaaaaguuuuauccuauccucagauaaauauaguaaaaaaaguugaagaacaaacggguggucucacaaaugaaaccauauauccgagaggcagcuuugacaaauugcugaacagaaaaaauaccuuagaagcaagcaaauacgguggauuugguucaccaacaguggcauacugcguacuaguaguggcagacaguaaaaaugaaaacggaaaagucaaaaaauuaaaacuuggaagugaauuguuagggaucacuauacuagaaaaaaacgacuuugaaaauaacucucuagauuuccuuaguagaaaaggauaucaaggagugcaagaaaaaaaaauaauaaaauuaccaaaauacagccucuuugaauuucaagaugguucuagaaggaugcucaguagcguaauggccaacgauaacaaaaggggagacuuacagaaagcuaacgaaaugauacuccccgcauacuuaguaaaacuacuuuaccacgcgaaacauaucaauagcguaggugagccagcgcauaagaauuacaucaacgaacauuguagcgaauuccaggaccuacuaaauuauauuagacaauuugcugacaaauuuguagauguugacaaaaaucuaucuaagauacgcucacuaaguaaaucuauggccgaauacagcguaucugaaauauguucaaguuucguaaauuuguuaacccuaacugcgcuuggagcaccagcagacuucaaauuuuucggaacaacaauuccaagaaaaagauaugggaguccacaaaguauacuaucagcaacccucauacaccagagcauuaccggucuauacgaaacgcgaauagauuugucgaaauugggugaagacuga

SEQ ID NO: 8936 - RNA, 4113 nt, Artificial Sequence
  Cas9 variant
augaacaaaccuuacucuauaggacuagauauaggaacuaauagcguuggguggucaauaaucacagacgauuacaaaguaccagcuaagaaaaugagaguacuagguaacaccgauaaagaguauauaaagaaaaaucuaauaggagcucucuuauuugacggaggaaacacagcugcagacagacgacuaaaaaggacagcaagaagacgcuacacacgacgaagaaaccgaauacuguaucuacaagaaauauucgcagaagaaauguccaaaguagaugacuccuucuuucauagauuagaagacucguuuuuggucgaggaagacaaaagaggaucuaaauauccaauauuugccacgaugcaggaagaaaaauauuaccaugaaaaauuuccaacaauauaccacuuacgaaaagaacuagcagacaagaaagaaaaagcagaccucagacugaucuaucucgcccucgcacacauaauuaaauucagaggccacuucuuaauagaagaugacagauucgacguuagaaacacagacauucaaaaacaguaccaagcguuucuagaaauuuuugauaccacauucgagaacaaugaucuucuuucucaaaauguggauguggaagccauucuaacugacaaaaucucuaaguccgcaaagaaagaucgaauacuagcuagauauccaaaccagaaaaguaccggaauauuugcagaauuucuaaaauuaauaguagggaaccaagcugauuuuaagaaacacuuuaaucuagaagauaaaacccccuuacaauucgcaaaagauagcuacgacgaagauuuagaaaaccuacuaggucaaauaggugaugaauuugcggaccuguucuccgcugcaaagaaauuguacgauucgguacuuuugagugguauuuuaacugugacagauuuaucgacuaaagcuccacuaagugccucgaugauacaaagauacgacgaacauagagaagaucuaaaacaacuaaaacaguucguaaaagcgucgcucccggaaaaauaucaagaaauuuucgcugauucaucaaaagaugguuacgcuggcuacauagaaggaaaaacaaaccaggaagcauuuuacaaauauuuaagcaaauugcuaaccaaacaagaaggguccgaauaucuacuagagaaaaucaaaaacgaagacuucuuacggaaacaacgcacuuucgacaacggaucuauaccgcaccaaguacaccuaacagaacugagagccauuauacggagacaaagugaauauuacccuuuucugaaagaaaacuuagaucgaauugaaaagauacuaaccuuucgaauaccauacuacguuggcccccucgcacgagaaaaaucagacuuugcuuggaugacaaggaaaaccgaugauucuauuagaccuuggaauuuugaagacuuaguggacaaagaaaaaucagcagaagcguuuauccacagaaugacuaacaacgacuuguaucuaccagaagaaaaaguccuaccaaaacauucacucauauaugaaaaauuuacuguuuauaaugaacucacaaaaguaagauuccuagcugaagguuuuaaagauuuccaauucuuaaaucgaaaacaaaaagaaaccauuuuuaauaguuuauucaaagagaaaagaaaaguuacagaaaaagauauaaucuccuuucuaaacaaaguagacggauaugaaggaauagcgauaaaaggaauagaaaaacaauucaaugcuucauuaagcacuuaccacgacuuaaagaaaauacuaggaaaagacuucuuagauaacacagacaacgaacuaauauuagaagauauaguucaaacacucacacuguuugaagaccgcgaaaugauaagaaaacgacuagacauuuacaaagacuuuuucacagaaucucaauuaaagaaacuauacagaagacauuauacaggcuggggccgacuuagcgcuaaacuuauaaauggaauuagaaauaaagaaaaucagaaaacaauccuugauuaucugauagacgauggaucagcaaaucguaacuuuaugcaauuaauuaaagacgcuggacuaucauucaaaccaauaauagauaaagcacguacuggaagccauucagacaauuuaaaagaaguuguaggugaauuggcuggaucaccagcaauaaagaaagguauucuucaaucacucaaaauaguggacgaauuaguaaaagucaugggguacgaaccagaacaaauuguaguagaaauggcaagagaaaaccaaacaacagcaaaaggccuaagcagacugagacaaaggcuuacgacuuuaagagaaagccuggcuaauuuaaaaucgaacauccuagaagaaaagaaaccuaaauaugugaaagaccaaguggaaaaucaucauuuaagugaugaucgacucuuucuuuauuaccuacaaaauggaaaagauauguauacugaugaugaacuggacauagacaacuuaucacaauaugauauagaccacauuauaccacaagcauuuauaaaagaugacucuaucgacaauagaguauuaguaagcucagcuaaaaacagaggaaaaucagacgaugucccaucaguagagauagugaaagacugcaaaguauucuggaagaaauuacuagacgcgaaacuuaugucucaacgcaaauacgacaaucuaacaaaagcagaacgcggaggauuaaccagcgaugacaaagcgagauucauacaacgucaguuaguagaaacaagacaaauaacaaaacacguggcaagaauauuagacgagagauucaacaacgaauuagauaguaaaggacgcagaauacgaaaagugaaaauuguaacccuaaaauccaaucuuguaaguaacuuuagaaaagaguucgguuucuauaaaauaagagaaguaaacaauuaccaucaugcgcacgacgcuuaucuaaacgcagugguugcuaaagcaauauuaaccaaauacccccaacuagaacccgaguucgucuacggagacuacccuaaauauaacucguauaaaacucggaaaagugcaacagaaaaacuauucuuuuacucaaacauaaugaacuucuuuaaaacaaaagucacacucgcagaugguacagugguaguaaaagacgauaucgaaguaaauaaugauacaggggaaauugucugggacaaaaagaaacacuuugcuacagucagaaaaguacuaucauauccacaagugaacaucguaaagaaaacugaaauacaaacuggugguuuuaguaaagaaucaauccuagcacauggaaauucggauaaacuaauaccacguaaaacuaaagauauuuauuuagauccuaagaaauacggcggauucgauucaccaauaguagcauacagcguucuugugguagcagacauaaagaaagguaaagcacaaaaacucaaaacaguaaccgaauuacucggaauaaccaucauggaaagaucaagauuugagaaaaauccuucugcauuucuagaauccaaaggauacuuaaacauacgggaugauaaauuaaugauauuaccuaaauauagccuguucgaacuagaaaauggaagaagaagacuacuugccucagcagacgaauuacaaaaaggaaacgaauuagcauuaccaacccaauucaugaaauuccuauaccuugcaucaagauacaaugaacucaaaggaaagccggaagagauagagcagaaacaagaguucguaguucaacauguauccuacuucgacgauaucuuacaaauaauaaaugauuucucaaacagaguaauacuagcagacgcaaacuuagaaaagauaaacaaacuauaucaagacaauaaagaaaacauaccgguugacgaacuagcaaacaacaucauaaaccuauuuacauuuaccagccucggggcaccggcagccuucaaauucuuugacaaaaucguagacagaaaaagguauacaaguacuaaagaaguacucaacagcacacuaauacaccaaagcauaacaggucuguacgaaacaagaauagacuugggaaaauuaggagaagacuga

SEQ ID NO: 8937 - RNA, 4113 nt, Artificial Sequence
  Cas9 variant
auggagaaaaauaaagaauauguuaucggguuagauauaggaacaggaucuguaggguggagugcuauaagcacugauaauuaucaacuuauacgacaaaaagggaaaaaccuuauugguguacgucuuuucaacagcgcagaaacagcagaagaaagacgagguuaccgcacgacaagacgcagacuaaguagaagaagauggagaaugagucuccucaaugacauauuuagaccagaacuaaaugaaauugacgaaaauuuucuagcuagauuaaaauauagcuggguuucaccacuagaucagaaaaauccacaacuaaaugaacaaggaacaaaugcaaguuuauauggagauauagaagcagaccaagcauuucaccgcgcauacccaacaauauaccacuugagaaaaacacugauggaagacaaccaaaaacacgaccuacgagaaguauauuuagcuauacaucauauuguaaaauacagaggacacuuccucacaccagacuuugacgcaaacucacaaacaauugauauuaaaggcuuguuuaaacaauuaggugacguuuccggcuccauugaacuccaagcagaccaaacaaguacuguaauugcagcauuucaaucaauacuauuagauuuuacaaaaaccccaacagaaucaggacgacuagcaggucaacuauuuuccgaccaaaacaaagauaaacaagccaagaaacaaguugaagaacuuuucaaacuacuaagaggaggaaaaggcucccuagcagacauguucuuacucaccgaccuggacaaaguagucaaaaaccaacucaaauuugcauucgaugacgcaguagaugaaaaucuuaaccugauaucaaauuuaauaaaugaagaacaauaugaauuacuccuuaauauacaaaaacuaagaggcacgauuauucucaaacaaauauuaggugacgacgaaacaguaagcgaugcgaaaguacgaucauaugaagaacacgcacaucaacuaaaagaacuaaaagcucaaguacuaacaaaagacaacaaagaaaaauucgaagaagcauaccaacuaauucaaaaaggagacgcaagcaggauagauggccuuaagaaacuaaaaacaauuauaaaucaagaacaugaagcacuucgacuagacaaauacgaagccgauaaauuacucaaacuuauagaauuagaucaacuacuuccaguucaacgauccaaaagaaauggagaaauuccacaccaacuacaugaauuugaauugaagaaaauaauagaaaaacagggcagauauuaucccuuccuacgugagaccuuugaaagagaugggcaagaauuuaacaaaauaggccaguuagugaacuucaggauuccauauuacguaggaccacuuguggacccuaggcuggcuggcauccaguccggugaucagacaaaucauuggaugacucagaagaaagcagguaaaauaacaccauggaacuacacagaacuaauagauauagauaaaucugcugcagaguuuauaaaaagaaugacaggaacagacacauaucuugugggagagccaucuuuacauaaagcaagucuuauauaccaagauuauaauguauuacaagaacuaaauaacuuacgauacgacggcaaaccacuuccuguagacgcaaagcaagaaauauacagcaaucugcagguaagccucaagaaugcaaccaaaaauaagauaaauucauucuuaauauccgaaggauaucuacaggacggagaagaacucacaggauuugcuggaaaagaacucaaaaacaaacuuagcucauuucauuacuuuaagaauauauuugguccagaaagaaugaauacgcuaggcacugauaacuuagagaaaauaacggagcuacaaacgguuuucgaggacagacauaugcugaaaagacaauuacaaaagcugggcuuucuagacgacgacgaaugcgagaaauuagccggaaaacacuucacaggauggggaaaccuaagcaagaaacuguuaaauaccccugcgauaauagauccggaaauaaaugaaaacaaaauaucacuaauagacgcacucuacaaaggucagagaaaccuaaguuuuuacguaaauaacauggacgacaaauaccaauuccgcgacuggauagaaucagaaaaccagucacaacaaguugaaauaagccuugacgagaaaaucaaaaacuuagccggaagcccagccauaaaacgcgguauaacacaaucaauggcaguaauacaagacauuauaagggcaaauaacgguauuucaccaaaaagaauauaucuagaauuugcacgcgaaucccaaaauuccuaucaacccaacucaagaaucaaacaaauagagaaaauauaugaccaaaacaagaaagagcucaugaaaguauauccugacguuuuuaaagacguucagggaguacuuaacaacguagaugaaaacaacagucuauccgaaaaagcauucuuauauuuuaugcaacuaggaaaagauauguacacaggugaagcucuagacuuugauaaacuauacacauaugacauagaccacauaauaccacaagccaugacaaaagacaacucaugggacaacaaaguauuagucacagcuaucaaaaacagggaaaagucaaaucagguauuagauaacgcaauccaagccaaaaugcauaauuuuugguuacaacugaagaaaguuaaucuauuaucucagagaaaauaugauacccugaugaaaaccaacuucuccaaaggagaugaaaagaaauucauagcacgaucauuaguagagacaaggcaaauaaucaaaaaugucgcggaauugaucaaaucugaguuugaucacguugaagcuaucccgaucagacaggaacucacaucagacaugcgucaacucauggacuauaagaaaaauagacucguaaacgacuaucaccacgcacacgacgcccuucuaauagcaacaguuggagaguucaugcaaaaacgaggauuuaugcaagguaugaauccaucacaaaauguauaccauggauauacacaauacgucaagaaaugguuaucuauggccaagaaagccagaucagcagaaaaaccagaaagaaucuuuccacuacaguucguuguagguagcaugagaauggcaguaagagauggacaaguagauaaagugacacacccggcuacuggagaaauaugcuggaccgcagacaaugaagcauaucuucgcaaaguauuaggauauaaaaauauacucguaacaagaaaagucaaaaacgcagguaaacucuaccaacgaguaacaguaaaacccaaggggaguggagaagcacccguaaaccaccaaaaaucagauauaaacauuuaugguggagugacauccgagcaggccgcagaauuaguauuaauccgaauaaaagcaaagaauaacgcuaaaaauaugguaaucaaaauacccaccgcaauugcuaaucaaguugcaaacaaaacaacuacauaugaugcauacgugaggagcuuaaauauaccgaauuacgcggguaucauucuggaucaaauaccucuaggccaauuagucuuugaugaaagaaccagcuuuuaccuggcaucggcagaaauaaaacauaaugcccgacaauugugggucaaccagcacauaaauaaugucuuaacgaagaaaaauauaaacgaugaggaaagggacaauauauuaaauuuacuaacaaaugagaaaaaccuagaaagauucaaacuccucgaaccggaccucaaaaggguaaaggcagcaaagcaacaaugggcaagcugugaugaccaagaacaaaugcaaauacucaggauuauaauuaauaaaaugcacgacgacgcaaguccucaaauaccaggaaaaauagauccauucaaaaacuacuuagacaaacaagggaagggauggagagaccuccgaacaaagaaagguaugaaacuuucggauaacgcugaguucguguaucaaucaccaacaggacuuuaccacaggaaaauuuccauuaaugaacuacuaaaacaaaaacaacuagaguga

SEQ ID NO: 8938 - RNA, 4113 nt, Artificial Sequence
  Cas9 variant
augaauaaaccuuauucaauaggcuuagauauagguacaaacagugucggaugguccauuauuacugaugauuauaaaguacccgcaaagaaaaugagaguauuaggaaacaccgauaaagaauacauaaagaaaaaucuaauaggagcccuacuauucgauggcggaaauacagcagccgacagacgguuaaaaagaacagcucgaagaagauacacaaggagaagaaaucgaauauuauacuuacaagaaauauuugcagaagagaugagcaaaguagacgauucauucuuccaccgauuagaagacuccuuccuuguagaagaagacaaaagaggaagcaaauauccaauauucgcaaccaugcaagaggaaaaauauuaucacgagaaauuuccaacaauauaucaucuuagaaaagaauuagcugacaagaaagaaaaagcagaccucagauuaauauacuuagcuuuagcacacauaaucaaauuuagaggacacuuucuaauugaagaugaccguuuugacguuagaaacacagauauucaaaaacaguaccaagcauuucuagaaauuuucgacacaacuuucgagaauaaugacuuauuaucccaaaacguagacguugaagccauuuuaacugacaaaauaaguaaaucugcaaagaaagaccgaauacuugcaagauacccaaaccaaaaauccacugggaucuuugccgaguucuuaaaacuaauaguuggaaaccaagccgacuucaagaaacacuuuaacuuagaagauaaaacaccgcuucaguucgcuaaagauucguaugaugaagaucuugaaaaucuguuaggacagauaggagacgaguucgcagauuuauuuucggcagcaaagaaauuauacgacucaguucuacucucaggaaucuuaacgguaacagaccuaagcacaaaagccccauugagcgcgagcaugauacaaagauaugaugaacaccgagaagaucucaaacaauuaaaacaauuuguaaaagccucauuaccagaaaaauaucaagaaauauuugcagacaguucaaaagacggcuacgcgggauauauagaaggcaaaaccaaccaagaagcauucuacaaauaccuaaguaaauuacuuacgaaacaagaagguagugaauaccugcuagagaaaaucaaaaaugaagauuucuuacgcaaacaaagaacauucgacaauggcucaauaccucaccaaguacaucuuacagaauuaagagcaauaauucgacgccaaucagaauacuaucccuuucugaaagaaaaccuugacagaauagagaaaauacucacauucagaauaccauauuacguuggcccccuagcgcgcgaaaaauccgacuucgcuuggaugacuagaaaaaccgaugacaguauaagaccauggaauuucgaagaucugguagacaaagaaaaaucugcugaagccuuuauacacaggaugacaaacaaugaccuuuaccuaccggaagaaaaaguacuaccgaaacacucuuuaaucuaugaaaaauucacaguauacaacgaauuaaccaaaguacgauuccuagcagaaggcuucaaggacuuucaauuccuaaaucguaaacaaaaagaaacaauauuuaauucuuuauuuaaagagaaaagaaaaguaaccgaaaaagacauuauuucauucuuaaacaaaguagacggcuaugaagggauagcaauuaaagguaucgaaaaacaauucaacgcaucacuaucaacuuaucacgaccucaagaaaauauuaggaaaagacuucuuagacaauacugacaacgaacuuauccuagaagauauaguacaaacuuuaacuuuauuugaagacagagaaaugauacguaaacgccuagauauuuacaaagacuuuuucacugagucgcaauuaaagaaauuauaccgacgucauuauacugguuggggaagauuaucagccaaacuaauaaaugguauacgaaauaaagaaaaucagaaaacaauuuuggauuaccuaauagacgauggcucagccaaccguaauuucaugcaacuuauaaaagacgcaggccucagcuucaaacccauaauagauaaagccagaaccgguagucacuuagauaaccuuaaagaaguugucggagaacucgcaggaucccccgcaauaaagaaaggcauuuuacagucacugaaaauaguagaugaacuuguaaaaguaaugggcuacgaaccugaacaaauugucguagagauggccagagaaaaucaaacuaccgccaaaggauuaucaagaagccgccaacgacucaccacacuuagagaauccuuagcaaaccuaaaaucaaacauuuuagaagagaagaaacccaaauauguaaaagaucaaguagaaaaccaccacuugucagacgacagacuguuucuauacuaucugcaaaacgguaaagacauguacacggacgaugaacuugacaucgauaaucuaucucaauaugauauagaucauauuauaccccaagcguucaucaaagacgauucgauugacaacaggguacuuguaagcuccgccaaaaacagaggaaaaagcgaugauguaccaucacuagaaauagucaaagacuguaaaguauuuuggaagaaacuacuugaugcuaaacucaugagccaacgaaaauaugauaaucucacgaaagcagaaagaggcggacuaacuucagaugacaaagcacgcuucauccaacgacaauuaguugaaacaagacaaaucacuaaacacgucgcccgaauauuagaugagagauuuaacaaugaguuagacucaaaagguagaagaauuagaaaaguaaaaauagugacgcuuaagagcaaccuaguaaguaauuuucgcaaagaguucggauuuuacaaaauaagagaaguuaacaacuaucaccaugcacaugacgccuaccuaaaugcagugguagcuaaagcaauccuaaccaaauauccacaacuagaaccagaguucguauacggagauuacccaaaauauaacuccuacaaaacaagaaaaagugcaacugaaaaacuauucuuuuauucaaacauaaugaacuuuuucaaaaccaaaguaacacuagccgaugggacagugguagucaaggacgauauugaagucaauaaugauacaggagaaaucgucugggauaaaaagaaacauuucgccacuguccguaaaguauuaucuuacccccaaguaaauauagugaagaaaacagaaguacaaaccggagguuucagcaaagaaucaauacuagcucacggaaacagcgacaaacucauaccuagaaaaacaaaagacauuuaccuugacccgaagaaauaugguggauuugacucacccauaguagcuuauucagugcuaguaguagcugacaucaagaaaggaaaagcgcaaaaacucaaaacaguaacagaacuacucgguaucacaauaauggaaagaucacguuucgagaaaaauccuucugcuuucuuggaaucuaaaggguacuuaaauauucgaacggauaaacuaauuauacuaccuaaauauucccuauucgaacucgaaaacggaagacggagauuauuagccucagcgggugaacuacaaaaaggcaacgaauuggcguuaccuacacaguacaugaaauuucuauauuuagcaagcagauauaacgaacuaaaaggcaaaccugaagaaaucgaacaaaaacaggaguucguaguucaacacguuucauacuuugacgacauauuacaaaucauuaaugacuuuucaaacagaguaaucuuggcugaugcaaaccuagagaaaauuaacaaacuauaccaagacaauaaagaaaauauaccgguggacgaauuagccaauaacauaauuaaucuuuuuacauucaccagcuugggcgcaccagcugcauucaaauucuuugacaaaaucguagaucgaaaaagauacacgucaaccaaagaaguacuuaacagcacccucauccaucaaaguaucacaggauuauaugaaaccaggauagauuuaggcaaauuaggcgaaggauga

SEQ ID NO: 8939 - RNA, 4113 nt, Artificial Sequence
  Cas9 variant
augaacaaaccuuauucaauaggcuuggacauagguacaaacuccguugguugguccauaauaacagacgacuacaaaguaccagcaaagaaaaugcgaguacuagguaacacagauaaagaauauauuaagaaaaaucuuauaggugcucuccuguucgacggaggaaauacagcagcugaucguagacuaaaacgaacagcaagacgacguuacacacgacgaagaaaccggauucuauaucuucaagaaauuuucgccgaagaaaugucaaaaguugaugauaguuucuuucaucgacucgaagacucauuucuuguagaagaagacaaacgaggaaguaaauacccaauauuugcaacacuccaagaagaaaaagacuaccaugaaaaauucuccacaauauaucacuuaagaaaagaauuagccgauaaaaaggaaaaagcagauuuaagacugaucuacauagcacuggcacauauuauaaaauucagaggacacuuuuuaauagaagaugauucauucgacguaagaaacacugauauaucgaaacaauaccaagacuuucuagaaauauuuaacacaacuuucgaaaacaacgauuuacucagucaaaacgucgauguugaagcaauauuaacagauaaaauaucaaaaucugccaagaaagaccgaauauuagcgcaauacccuaaccaaaaaucgaccggaaucuucgcagaauuuuuaaaacugauaguuggcaaucaagccgacuuuaagaaauacuuuaacuuagaagauaaaacuccuuugcaauucgcaaaagauaguuaugaugaagacuuagaaaacuuacucgggcaaauaggagaugaauuugcugaccuauuuucggcggccaagaaacuauaugauucaguccuccuaagcgguauauugaccguaauagaucucaguaccaaagcaccauuaucggcuucuaugauacaaagauacgacgaacauagagaagaccucaaacaacuuaaacaauucguuaaagcaucgcuaccagaaaaauaucaagaaauauucgcagacaguucgaaagacgguuacgcaggauauauagaagggaaaacaaaccaagaagcauuuuacaaauaccuuaguaaacuauuaacuaaacaagaagauucagaaaacuuuuuagagaaaaucaaaaacgaagacuuucucagaaaacaacguacauucgauaauggaucaauaccacaccaaguccaucuuacagaguuaaaagccaucauccgacggcaaagcgaauacuaccccuuccuaaaagaaaaucaggaccgaauagagaaaauacuaacauuucgaauaccauauuauauuggcccacucgcgagagaaaaaucugauuuugccuggaugacaagaaaaacagacgacucaauaagacccuggaauuucgaagaucucguggauaaagaaaaaucggcggaagccuuuauacauagaaugacaaacaacgauuucuaucuaccggaagaaaaaguauuaccuaaacauucuuuaauauacgaaaaauuuacaguauacaaugaacuuacaaaaguuagauauaaaaaugaacagggagaaacguacuuuuucgauagcaauauaaaacaagagauuuucgacggaguuuuuaaagaacauagaaaaguuaguaagaagaaauuauuagauuuucuagccaaagaauaugaagaguucagaaucgucgacguaauaggacucgacaaagaaaauaaagccuuuaacgccucauuaggcacauaccaugaucuugagaaaauauuagacaaagacuuuuuagacaaccccgacaacgaaucaauauuagaggauaucguacaaaccuuaacacuuuuugaagaccgagagaugaucaagaaaagacuagaaaacuauaaagaucuauucaccgagucacaacuuaagaaacucuauagaagacacuauacuggcugggguagauuaucagcaaaacuuauaaauggaauuagagauaaagaaucucagaaaacaauacucgauuaucuaauagacgacggaagaucgaacagaaacuuuaugcagcugauaaaugaugacggacuaaguuucaaaaguaucauuuccaaagcacaagcaggcagucauucagauaauuuaaaagaggugguaggagaacuagcaggaucaccagcaaucaagaaaggcaucuuacaaagccuaaaaauuguggaugaauuaguaaaaguuaugggauacgaacccgaacaaauaguaguagaaauggcucgagaaaaucagacaacuaaucagggcaggcgaaauucacgacaacguuacaaacuccucgaugauggagucaaaaauuuagccagcgacuuaaauggaaauaucuuaaaagaauauccuacagacaaucaagcccuucaaaacgaacgacucuuucuauauuaucuacaaaacggaagagacauguauacaggagaagcauuagacaucgaugacuuaucacaauaugauauagaccacaucauaccgcaggccuucauaaaagaugauagcaucgacaaucguguccucguuagcagcgccaaaaaccgcgguaaaucagacgacguacccucgcuagaaauagucaaagauuguaaagucuucuggaagaaauuacuagacgcaaaacuuaugucacaacgaaaauacgacaaucugacaaaagcagaaagaggaggcuugacuagcgacgauaaagcaagguucauccaaagacagcuuguagaaacacgacagauaacaaaacauguagcacgcauccuugaugaacgcuucaauaacgagcuagauagcaaaggacgacgaauuaggaaaguaaaaaucgucacucugaaaaguaauuuaguuucuaauuuuagaaaagaauuugguuucuauaaaauaagagaaguuaacaauuaccaucacgcacacgacgccuaucucaaugcaguaguugcuaaagccauuuuaaccaaauacccacaauuagagcccgaauuuguguauggagauuacccaaaauauaauuccuacaaaacaagaaaaagcgcaacagaaaaauuauucuuuuauucaaauauuaugaauuucuucaaaacaaaaguuacccucgcagacggaacagucguuguaaaagacgacaucgaaguaaacaaugacacaggagaaaucguaugggacaagaagaaacacuuugcaacugucagaaaaguauuaaguuacccgcaaaacaacaucguaaagaaaacagaaauacaaacggguggauuuagcaaagaaucuauccuagcacacgggaacagcgacaaacuaaucccuagaaaaacaaaagauauuuaccuggaccccaagaaauauggcggcuucgacuccccaauaguagccuauaguguacuuguaguggcagacauuaagaaaggaaaagcccaaaaacucaaaacaguaacagaauuacuaggcauaaccaucauggaaagauccagauucgagaaaaauccuucggcauuccuagaaucaaagggguaccuuaacauuagagcagauaaauuaauaauacuaccaaaauauucacuauucgaacuagaaaauggacguagacgccugcuagccucagccggagaacuacaaaaaggaaaugaauuagcucuaccaacacaauucaugaaauuucuauaccuagccuccagauacaaugaaucgaaaggcaaaccagaagaaauagagaagaaacaagaguucguaaaccaacauguaucauauuucgaugacauauuacaacuaauuaacgacuucuccaaacguguaaucuuagcugacgcuaaccuagagaaaauuaacaaacucuaccaggacaacaaagaaaauauaaguguagaugaacuagcaaauaauaucaucaaucucuuuacguuuacaagucucggcgcacccgcagcauucaaauuuuucgacaaaaucguggaccgaaaaagauauacaagcaccaaagagguucucaacagcacacugauucaucaaucaauaacaggccuauacgaaaccaggauagaucuaggcaaacuuggagaagauuga

SEQ ID NO: 8940 - RNA, 4113 nt, Artificial Sequence
  Cas9 variant
augaacaaaccauauaguauuggcuuagacaucggaacuaauucaguuggauggagcauaaucacugaugauuacaagguaccugccaagaaaaugcggguauuaggaaacacagauaaagaauacauuaagaaaaaucuaauaggagcauuauuauucgacgguggaaacacugcagcugacaggagauuaaaaaggacagcaaggagacgcuacacccggcgacgaaaccgaauacuuuaucuacaagaaauauucgccgaagaaaugagcaaaguagacgacagcuucuuccacagacucgaagacuccuuucuuguagaagaagacaaacgagguucaaaauacccaauuuuugcaacccugcaagaagaaaaagacuaucacgaaaaauucagcacuauauaccaucugagaaaagaacucgcagauaagaaagaaagagccgaucuaagauugauuuauauagcauuagcacauauaaucaaauuucgcggacauuucuugauagaagaugacaguuuugauguuagaaacacagauauaucaaaacaauaucaagauuuucuggaaauauucaauacaacauuugaaaacaacgaucuacuaucacaaaacguggauguagaagcuauacuaacagacaaaauaucaaaaagugcaaagaaagacagaauauuagcacaauacccaaaucaaaaaucaacgggcauauucgcagaguucuugaaauuaauuguaggaaaccaagcagauuucaagaaauacuuuaaccucgaagacaaaacuccauuacaauuugcuaaagauuccuacgacgaagacuuagaaaaccuacuaggucagauaggggacgaguucgcagaccuauuuagugcggcuaagaaauuguaugauucuguccuccuaucugguauccugacgguaauagaccuuuccacgaaagcuccacucucagcaucaaugauacaaagauaugacgaacaccgcgaagaucuaaaacaacugaaacaauuugucaaagccucacuaccagaaaaauaucaagaaaucuucgcggacucaucaaaagacggauaugcuggcuacauugaagguaaaacaaaccaagaagcauucuacaaauaucuuucaaaacuccuaaccaaacaagaagauuccgaaaacuuucuggagaaaauaaagaacgaagacuuuuuaagaaaacaaagaacauucgauaauggauccauaccucaucaaguacaccucacugaacucaaagcaaucauccgccgucagucagaauauuacccauuuuuaaaagaaaaucaagauagaauagaaaagauacucacauuuagaaucccuuauuacauugguccccuugcucgagagaaaagcgacuuugcauggaugacaagaaaaacagaugacuccauacgaccauggaauuuugaagaucuaguagauaaagaaaaaucugcggaagcauucauccaucgaaugaccaauaaugacuuuuauuuaccugaagaaaaaguucugccaaaacacagccuaauauacgaaaaauucaccguguacaacgaacuaaccaaaguacguuacaaaaacgaacaaggagaaacauacuucuucgacucaaacaucaaacaagaaauauuugaugggguauucaaagaacacagaaaaguaucaaagaaaaaguugcuagauuuucuugcuaaagaauacgaagaguucagaauaguagaugucaucggacucgacaaagaaaauaaagcauuuaaugcgucacuaggaaccuaucaugacuuagagaaaauucuugacaaagauuuccucgauaacccagacaacgaaucaauucuugaagauaucguucaaacccuaacauuauucgaagauagagaaaugauaaagaaaaggcuugaaaacuauaaagaccuauucaccgaaucacaauuaaagaaacucuacagaagacacuauacgggauggggaagacucucagcuaaacugaucaacgguauaagagacaaagaaucacagaaaacaauccuugacuauuuaauagaugaugggagaucaaauagaaauuuuaugcaacuaauaaacgacgauggacuuucauucaaaucaauaauaucuaaagcucaagcaggaagccacucugacaaccucaaagaaguagucggagaauuagcaggcucaccagcaaucaagaaagguauuuuacaaucacucaaaaucguugacgagcuaguuaagguaaugggcuacgaacccgaacaaauaguaguagaaauggcaagagaaaaccaaacuacaaaucaaggaagaaggaacucaaggcaaagauacaaacuauuagacgauggcgugaaaaaucucgcaagcgaucuaaauggaaacauacuaaaagaauacccaacagacaaccaagccuuacaaaacgaaagauuauucuuauacuaucuacaaaauggacgcgacauguacacaggagaagcauuagacauagaugaucuuucucaauaugauauagaccauauuauuccccaagccuucauuaaagacgauucuaucgacaauaggguacuuguauccucagcgaaaaauagaggaaaaagcgaugauguaccaucccuagaaauagucaaagacuguaaaguauucuggaaaaagcuacuggacgcaaaacucaugucgcaaaggaaauacgauaaccucacuaaagccgaaagaggagguuuaacaagugaugacaaagcccgauucauucaaagacaacuugucgaaacaaggcaaauuacaaaacacgucgcucggauuuuagaugaaagauucaauaaugaacuagauucuaaaggaagaagaauaagaaaaguuaagauaguaacauuaaaaucuaacuuagucaguaacuuuagaaaagaauuuggcuuuuauaaaauucgagaaguuaauaauuaccaucaugcacacgaugcauaccuaaacgcuguaguagccaaagcaauacuaacaaaauauccgcaauuagaaccagaguucguuuauggugacuacccaaaauauaacagcuauaaaacaagaaaaagcgcaacugaaaaacuuuucuuuuauagcaauauaaugaacuucuuuaaaaccaaaguaacauuggcagacggaacaguuguggucaaggaugauauagaaguaaacaacgauacuggcgaaauaguuugggacaaaaagaaacauuucgcaacuguacgcaaaguacugucauacccucaaaauaacauagucaagaaaaccgaaauacaaacaggaggcuuuucaaaagaaucaauccuugcccacggaaauuccgacaaauuaauaccgcgaaaaacaaaagacauauacuuggacccgaagaaauauggaggcuucgauaguccuauaguugcuuauucaguucuagugguugcagauauaaagaaaggcaaagcacagaaauuaaaaaccguaaccgaacuauuggguauaaccauaauggaaagaucucgauucgagaaaaacccuucagcguucuuagaaucaaaaggauauuuaaauauuagagcagacaaacuaauaauacuaccaaaauacucacuauuugaacucgaaaacggacgaaggcgacuucuggcaucagcaggagaacuacaaaaaggaaacgagcucgcacuacccacgcaauuuaugaaguuccuauacuuggcaucucguuacaaugaaagcaaagggaaacccgaagaaauagaaaagaagcaggaauuuguaaaccaacauguaagcuauuuugacgacauauuacaacuaauaaaugacuucucaaaaagagugauacuggcugaugccaaccuggagaaaauaaauaaauuguaccaagauaauaaagaaaacaucucugucgacgaauuggcuaacaauauaauaaaucuauucacauuuaccucacugggugcacccgcugcuuucaaauucuuugauaaaauagucgaucggaagagauacaccuccaccaaagaaguauuaaacucaacauuaauacaccagucaauuacuggcuuguacgaaacaagaauagaccuuggaaaguuaggcgaggauuga

SEQ ID NO: 8941 - RNA, 4113 nt, Artificial Sequence
  Cas9 variant
augaauaaaccguauaguauaggacuugauauagguacaaacuccguaggcugguccauuauaacagaugacuauaaaguaccagcaaagaaaaugagaguacugggaaacaccgacaaagaauacaucaagaaaaaccuuauaggagcacuacuguucgacggagguaauacugcaucagaccgaagguuaaaacgaacagcccgacgaagauacacgagaagaagaaauaggauucuauaccuacaagagauauuugcagaagaaaugaguaaaguugaugacagcuuuuuccacagauuagaagacuccuuccucguugaagacgacaaaagagguaguaaauacccaauauucgcaacaaugcaagaagaaaaagacuaucaugaaaaauucccaacaauauaucauuugcguaaagaacuagcagacaagaaagaaaaagcugacuugcgucuuuucuauuuggcucuugcucauauaauaaaauuucgaggacauuuccucauagaagaugauaguuucgacgucagaaacacggacauucaaagacaauaucaggcuuuccuagaaauuuucgacacgacguuugaaaauaaccaucugcuuucacaaaacauagacgucgaagguauauuaacagauaaaaucucaaaaucugcuaagaaagauagaauacuagcccaauaucccaaccaaaaaucaacuggcauauucgcagaguuccucaaacuuaucgucgguaaccaagcagacuuuaagaaacacuucaacuuagaagacaaaaccccacuccaauuugcaaaagauuccuaugaugaagaucuagaaaauuuacuaggacaaaucggcgacgaauuugccgaccucuuuuccguagcaaagaaauuauacgacucaguuuuacuaucgggcauccuaaccguaaccgaucuaucaaccaaagcuccacugagugcuucaaugauccaaagauaugaugaacaccgagaagaucuaaaacaguuaaaacaauucgucaaagcaucguuacccgaaaaauaucaagaaauauuuacggauaguaguaaagacggauaugcagguuacauagaaggaaaaacgaaccaaggcgcauucuacaaauacuuaaguaaacuacuaacgaaacaagaagggucagaauacuuucuagagaaaauuaaaaacgaagauuuccuacgaaaacaaagaacauucgauaacggaucaauaccccaccaaguacacuuaacagaauuaaaagcuauaauacgcagacaauccgaauauuauccauuucuuaaagaaaaucuagauagaauagagaaaauacuaacauuucggauuccuuacuauguaggcccgcuggcaagagaaaaaucagauuucgcguggaugacuagaaaaacggaugauaguaucaggcccuggaauuucgaagaauuaguagacaaagaagcaagcgcagaagcguucauccacagaaugaccaacaacgaucuauaucuaccagaagaaaaaguacugccgaaacauagccucauauaugaaaaauucacggucuacaacgaauuaaccaaagucagauacaaaaacgaacaaggugaaacauacuucuucgacucaaacauaaaacaagaaauauucgacggagucuuuaaagaacaucgaaaaguuaguaaaaagaaacuucuagacuucuuagcaaaagaauaugaagaauuuagaauaguugacguaauaggauuggacaaagaaaauaaagcauucaaugcaucccuuggaacauaccaugaucuaaagaaaauacuugauaaagacuuucuugacaauccagauaacgaaagcauacuggaagacauaguucaaacauuaacucucuucgaagacagagagaugauuaagaaacgacuugaaaacuacaaagacuuauuuacugaaucucaacucaagaaacuauauagaagacacuauacggguuggggacgccuuucggccaaacuaauaaacgggaucagggauaaagaaucucagaaaacaauccuugacuacuuaaucgacgacggaaaaucaaacagaaacuucaugcaauuaauccacgacgauggauuaucuuuuaaaucaauaauaucaaaagcacaagcuggaucccauuccgauaaccucaaagaagucguaggggaacuugcaggaucgccagcaaucaagaaagggauacuacaaucucuaaaaaucguagaugaauuaguaaaaguuaugggauaugagcccgaacaaauuguggucgagauggcgcgagagaaucaaacaacaaaucaaggaagacgaaacaguagacaaagauauaaauuacuagaugauggaguuaaaaaucuagccagugacuuaaauggaaauauacuaaaagaauauccaacugauaaucaagcacuacaaaacgaaagacuauuccuauauuaccuucaaaacggacgcgacauguauaccggaaaagcacuagacauagacaaccuaagucaauaugauauagaccauauuauaccacaagccuuuauaaaagaugauucaauugacaacagaguccuuguaucaagcgccaaaaacagaggaaaaagugaugacguaccuucacuugaaaucguuaaagauuguaaagucuuuuggaagaaacuauuagaugcaaaauugaugucacaacgaaaauaugacaaucuaacaaaagcugaaagaggaggauuaacaagugaugacaaagcacguuuuauacaaaggcaauuaguagaaaccagacaaauuacaaaacaugucgcuagaauacuagacgaacgauucaauaacgaauuagauagcaaaggccguagaaucagaaagguaaaaauuguaacacuaaaaagcaaucuugucucaaauuucagaaaagaguucgguuuuuauaaaauaagagaaguaaacaacuaucaccacgcacacgacgcuuaccuaaaugccgucgucgcgaaagcuauauuaaccaaauacccccaacuagaacccgaguucgucuauggcgacuauccuaaauauaauaguuauaaaaccagaaaaagugcaacagaaaagcuauuuuucuacucaaauauaaugaacuuuuucaaaacaaaaguaacacuagcugaugggacuguggucguaaaagaugacauagaaguaaauaaugauaccggagaaaucguaugggacaagaagaaacacuucgcuacgguacgaaaaguccuaucuuacccucaagugaacauugucaagaaaacggaaauucaaacaggugguuucucaaaagaaucaauacucgcacauggaaauucagacaaacuaauaccccgaaaaaccaaagacauauaccuagauccuaaaaaguacggcggauuugauagcccuauugucgcauauagcguauuaguaguagcagauaucaagaaagguaaagcccaaaaacuaaaaacuguaacagaauuauuaggaaucacaauaauggaaagaaguagauucgagaaaaaccccucagcuuuccucgaauccaaaggauaccucaacauucgagacgacaaauuaaugauauuaccuaaauauucccuauuugaauuagaaaauggaagaagaagacuacucgcaagugcuggagaauuacaaaaaggaaaugaauuagcauuacccacccaguucaugaaauuucuauaucuagccagcagauacaacgaauuaaagggaaaacccgaagaaauagaacagaaacaagaauuuguaguacaacacguuucauacuuugaugacauccuucaaauaauuaacgauuucaguaaucgcguuauacuugcagacgcaaaccuagagaaaauuaauaaacuuuaccaagacaauaaggagaauauauccguggacgaauuagcaaauaacauaauaaaucuauuuacuuuuacaagccugggagcucccgcagcauucaaauuuuucgacaaaauuguagaucgaaagagauacacaagcacaaaagaaguauuaaacucaacacuuauacaccaaagcauaacggguuuguacgaaacgagaauagaccuaggaaaacuuggggaagacuga

SEQ ID NO: 8942 - RNA, 4113 nt, Artificial Sequence
  Cas9 variant
augaauaaaccuuacucuaucgggcuugacauuggaacaaauucaguaggauggaguaucaucacugacgacuauaaaguaccugcuaagaaaaugcgaguacuaggaaacaccgauaaagaauauauaaagaaaaaccuaaucggcgcacucuuauuugauggaggaaacacggcugccgacagaagacuaaaaaggacagcaagaagacguuacacccguagaagaaauagaauacucuaccuccaagaaauauucgcggaagaaaugaguaaaguagaugacucuuucuuccauagguuagaagacucauuccuagucgaagaagauaaaaggggcucaaaauacccuauuuuugcgacaaugcaggaagaaaaauauuaccacgaaaaauuuccgacuaucuaucaucugcgaaaagaacuugcagacaagaaagaaaaagcugaccucagacugauuuaucuugcucuagcacacauaauaaaauuuagaggccacuuccucaucgaagacgacagauucgacgucagaaacacagauauccaaaaacaauaccaagcauuuuuagaaauauuugacacaacauucgaaaauaaugaucuacuaagucaaaacguagacgucgaagcgauucuaacugauaaaauaagcaaaucugcaaagaaagauaggauacuugccagauauccaaaucaaaaaucaacagguauauuugcggaauuucuaaaauuaauaguagggaaccaggcagauuucaagaaacauuuuaauuuagaagauaaaaccccguugcaauuugcgaaagauaguuaugacgaagaucuagaaaaucuuuuaggucaaauaggagaugaguucgcagauuuauuuagcgcugcaaagaaacuauaugauagugugcuauuauccggaauauuaaccguaacagaucuaagcacaaaagccccucuuagcgcaagcaugauacagcacuacgaugaacacagagaagauuuaaaacaacucaaacaauuuguaaaagcaucccuccccgaaaaauaucaagaaauauuugcagacucaucaaaagaugguuaugcagguuauauugaagguaaaacuaaucaggaagcauucuauaaauaccucucaaaacuacuaacuaaacaggaaggaucagaauacuugcuugagaaaauaaagaacgaagacuuccuaagaaaacagcggacguuugauaaugguuccaucccucaccaaguacauuuaacugaacuccgagcuauaauaagacgacaaucugaguauuauccauucuuaaaagaaaaucuagaucgaauagagaaaaucuuaacauucagaauaccuuacuacgugggcccccuagcacgagaaaaaucugauuucgccuggaugacaagaaaaacagacgacaguauuagaccauggaauuuugaagaccuugucgacaaagaaaaaucugcagaagccuuuauacacaggaugacaaacaacgaccuguaccucccagaagaaaaaguacuaccuaaacacucucuaauauaugaaaaauucaccguguauaacgaacuaacaaaaguacgauucuuagccgaaggauuuaaagacuuccaguuucucaaucgaaaacaaaaagaaaccauauuuaacucgcuguuuaaagaaaaacgcaaaguaacagaaaaagacauaauuucauuccuaaauaaaguagaugguuacgaaggcauagcaauaaaaggaaucgaaaaacaauucaaugcaagucuaucaacguaucacgacuuaaagaaaauauuaggaaaagacuuccucgauaauacagauaaugaguuaauccucgaagacaucguccaaacccuuacacuauuugaagaccgcgaaaugauaagaaaaagacuagacauuuacaaagauuucuucacagaaucucaacuaaagaaauuguacagaaggcacuauacuggcugggguaggcuuagcgcuaaacuaauuaacggcauaagaaauaaagaaaaccagaaaacaauccuugacuacuuaauagacgacggauccgcaaacagaaacuucaugcaacuaaucaaagaugcuggucugaguuuuaaaccaauaaucgacaaagcaagaaccggaucucacagcgacaauuugaaagaagucgucggcgaacuagcagggucacccgccaucaagaaaggaaucuuacaaagccuaaaaauaguugaugaauuaguaaaagucaugggauaugaaccagagcaaauagugguagaaauggcucgagaaaaucaaacuacggcaaaaggccuaaguagaucacgacaaagacuaacaaccuuaagagaguccuuagccaaccuaaaaaguaauaucuuagaagaaaagaaaccaaaauauguaaaagaucaaguagaaaaccaccaccucucagacgaucgccuuuuccuauauuaccuucaaaauggcaaagauauguacacagacgaugaacuggacauugacaaucucagccaauaugacauagaucacaucauuccacaagcauuuaucaaagaugauuccauagauaaucgaguccuagucucaagcgcuaaaaaucgugguaaaucagacgacguacccuccguagagauugucaaagacuguaaaguauucuggaagaaacuccucgaugccaaauuaaugucacaaaggaaauacgacaaccucacaaaagcugaaagagguggccuuacauccgacgacaaagccagguucauccaaagacaacucguagaaacacgucaaauuaccaaacacguagcgaggauacuggacgaaagauucaacaacgaacucgauucaaaaggaagacguauaagaaaaguuaaaauagucacuuugaaaucaaaucuugucucaaacuuuagaaaagaguucgguuuuuauaaaauaagagaagugaacaacuaucaucacgcacaugacgcuuauuuaaaugcaguaguagcuaaagcaaucuuaacaaaauacccacaacuagaaccugaguucguauacggggacuauccaaaauacaacuccuauaaaacccgaaaaagcgcgacagaaaaacuauucuuuuacuccaauaucaugaacuucuuuaaaacaaaaguaacccuagcugacggcacaguaguuguaaaagacgacaucgaaguaaacaaugacacaggcgaaauagucugggacaagaagaaacauuuugcaacaguaagaaaaguucuaucauacccccaaguaaacauaguuaagaaaacggagauucaaacaggaggauuuucaaaagaaucaauccuagcccauggaaacuccgauaaacucauaccuagaaaaaccaaagauaucuacuuagauccaaagaaauauggagguuuugauucaccuauuguagcauacucaguacugguuguugccgacauuaagaaaggcaaagcccaaaaacuaaaaacaguaacagaauuauuaggaauaacaaucauggaacgaucgagauuugagaaaaauccaucagcauuccuagaaaguaaaggauacuugaauauccgagaugauaaauugaugauacuuccuaaauauagcuuauucgaauuagaaaacggcagaagacggcuacuagcuagugcgggugaacuucaaaaaggaaacgaacuggcacuaccuacacaguuuaugaaauuucucuaccuagcaagucgauacaaugaauuaaaaggcaaaccagaagaaauugaacaaaaacaggaauuugugguucaacacguaucguauuucgaugacauacuacaaauuauuaaugacuucucaaaucgaguaauacucgcagacgcuaaccuagagaaaaucaauaaacuuuaucaagacaacaaagaaaacauacccguagacgaauuagcuaacaacauaauaaaucucuucacuuucacgucauuaggagcgcccgcagcauuuaaauucuuugauaaaauaguagaucgaaaaagauauaccuccacgaaagaaguacuaaauagcacacucauacaucagaguaucacugggcuauaugaaacgagaauagacuuagguaaauuaggagaagacuga

SEQ ID NO: 8943 - RNA, 4116 nt, Artificial Sequence
  Cas9 variant
augaaaguaaacaacuaucauauaggauuggauauaggaacuaguaguauugguuggguugcgauaggagaggauggaaaacccuuaagaauaaaaggcaaaacagccauaggcgcucgacuuuuccaagaaggcaaucccgcagccgaccgacgcauguuuagaacaacccggaggaggcuaucgcgacguaaauggagauuaaaacuccuggaagaaaucuucgacccauacauaaccccaguagacucuacuuuuuuugcaagacugaaacaaucaaacuugaguccuaaagacucaagaaaagaauuuaaagguucuaugcuuuuccccgaccuuaccgacaugcaauaucacaaagacuacccaacuaucuaucauuuacgccacgcgcucaugacucaagacgaaaaauucgauauacgaauggucuaccuagcuauacaucauauaguaaaauauagaggaaauuuucuaaauaguacuccuguagauucuuucaaagccaguaaaguaaauuuuguagaccaauucaaaaaacucaaugaacuauacacagcuauuaaccccgaagaaucauuccaaauaaacuuagcgaacuccgaagauauaggacaucaauuccuagauccgucaauuagaaaauuugauaaaaaaaaacagauaccuaaaauuguaccugucagcguagaugauaaagcaacagacaagauaaacggaaaaauagcgucugaaaucauaaaugccauacuaggcuacaaaucuaaacuagacguuguaguacaauguacacccguagacucaaaaucuugggcacuaaaauuugacgaagaagacauugaugccaaacugcaaaaaauacugccagaaauggaugaaaaucaacaaagcauaauagcgauucuacaaaaucuauauagucaaguuacucuaaaccaaaucgugcccaacggaaugucauuaucugaauccaugauagaaaaauauaacgaucaucacgaccaccuaaaguuauacaaaaaaauuaucgaccaauuagcugacccgaagaaaaaagcugcacuaaaaaaagccuacagccaauacguaggugacgauggaaaagugaucgaacaggcugacuuuuggucaucaguuaaaaaaaaucuagaugacagugaccuaucaaaacaaauuauggaccucauugacgcagaaaaauuuaugccaaaacaaagaacaucccaaaaugguguuauaccccaccaauuacaucagcgagaacuugacgaaauaauagaacaccaauccaaauacuaucccuggcucgcagaaaucaacccaaauaaacaugacuuacaccuugcaaaguauaaaauugaagaacuaguagcuuuuagaguuccuuauuaugucgggccaaugauaaccccugacgaucaggcaaaaucagccgaaacagucuuuaguuggauggaaagaaaagggaaagaggccggacaaauaacaccuuggaacuuugaugaaaaaguagauagaaaugccagugcgaaccgcuuuauaaaacgaaugacuacaaaagauacuuacuuaauuggugaagauguacuuccagacgaaagcuuacuuuaugaaaaauucaaaguucuuaaugagcugaacaugguuagagucaauggaaaauuauugaaagucgcagauaaacaagcaauauuccaagauuuauucgagaauuauaaacauauaucuguaaaaaaacuucaaaacuacauaaaaaguaaaacaggccucccaucggaucccgaaauaucgggccuaagugauccugaauacuucaauaacuccuuagguaccuacaaugauuucaaaaaacuauucgggaacaaggucgaugaacccgaccuacaagacgacuuugaaaaaauagucgaguggucaaccguauuugaggauaaaagaauacucagggaaaaacucaacgaaauuacuuggcuaucagaucaacagaaagacguauuagagagcaguagauaccaaggauggggaagacuauccaaaaaauuacuaacagguaucguaaaugaccaaggcgaacgaauaauagacgaacuauggaacacuaacaaaaacuuuaugcaaauacaaucugacaaugauuucgccaaacguauacacgaagcaaacgcagaccaaaugaaagcaguagacguugaagacguucucgccgaugccuacaccucgccacaaaacaaaaaagcuauucgacagguagucaaaguaguugaugacauacaaaaagcaaugggagggguagccccaaaauauauaaguauagaauuuacaagaucagaagaccgaaacccuagaagaacaauaucaagacaacgacaauuagaaaauacucucaaagauacggcaaagagccuggcaaaaagcauaaacccagaacuauuaagugaacuggauaacgcugcuaaaucaaaaaaaggcuuaaccgauagacuauacuuauacuucacacaacucgguaaagacaucuacacgggaaaaccaauaaacaucgacgagauuaguacauacgacaucgaucauauacucccccaagcuuucguuaaagacgauucucuuaauaaucgagucuuggucuccaaagcaauaaacaacggaaaaucggacaauguaccgguacaacuauuuggagcuaaaaugggccauuucuggaaacagcuagcugaagccggauuaauaucaaaacgcaaacuaaaaaacuuacaaacagacccagacaccauaucaaaauacgcaaugcauggguuuauaagacgacagcuagucgaaaccucucaaguaauaaagcugguagcuaacauccuaggugacaaauauagaaaugauaacacaaaaaucauagaaauaacagcaagaaugaaccaccaaaugagagacgaauucggauucaucaaaaauagggaaauuaaugauuaccaccaugcguuugaugcuuaccuaacagccuucuuaggccgauaccuuuaccaucgauacauaaaauuacgaccauacuuuguuuauggagacuucaaaaaauuuaaagaagacaaaguaacaaugaggaacuucaauuuccuacacgaucuaaccgaugauacacaagagaaaauugcagaugcagaaaccggcgaaguaauaugggaucgcgaaaauagcauccaacaacuaaaagacguauaccacuacaaguuuauguuaaucucccaugaaguauacacacuaagaggggcaauguucaaucaaaccguguaccccgcauccgacgcugggaagagaaaacucaucccuaucaaagcagaccgaccaaucaacguauauggcggcuauucaggcagugccgacgcuuacauggccauagugagaauacauaacaaaaagggcgauaaauaucgcguaguaggaguaccaaugagggcaagagacagacucgacgcagcgaaaaaagugucugacgccgacugcgaucgcgcucuuaaagauguauuaacaccccaauuaaccaagacaaagaaaagcagaaaaacaggggagauuacacaggugguggaagauuucgaaauagucuuaggaaaaguaauguaucgacaacuuaugauagacggagacaaaaaauucaugcuaggaagcuccacuuaucaauacaaugcaaaacaauuaguauuaucagaucagucuguuaaaacuuuagcaucuaaaggucgacuagacccacuccaagaaucaauggacuacaacaauguauauacagaaauauuagauaaagucaaccaauauuucuccuuauaugauaugaacaaguuccgucacaaacucaaucuaggauuuucuaaauuuauaaguuucccaaaccauaacgucuucgauggaaauacaaaagcaaguaguggcaaacgugaaauacuugaagaaguauuaaauggccuccacgcaaaccccacauuuggcaaucuaaaagacauuggaauaacaacaccauucggacaauuacaacaaccuaacgguauucuuuuaucagacgaagccaaaauaagauaucaaucaccuacaggauuauucgaacguacugugaguuuaaaagacuuauga

SEQ ID NO: 8944 - RNA, 4116 nt, Artificial Sequence
  Cas9 variant
auggauaaaaaguauucaauaggucuagauaucggaacuaauucagucgguugggcuguaaucacugacgacuacaaaguaccgagcaagaaauuuaaaguacuggguaauacagaucgacacucaauaaagaaaaauuuaauaggcgcauugcuuuuugauucuggagaaacagcagaagcaacacgauugaaacgaacugccagaaggagguauaccagaagaaagaaccgaauccgauacuuacaagaaaucuucaguucagaaauguccaaaguagaugacaguuucuuccaccgacuagaagaaucuuucuuaguugaagaagauaagaaacacgaacgacauccgauauuuggaaauauagucgaugaaguugccuaccaugaaaaauauccaacuauauaucaccucagaaagaaauuagccgacucuaccgauaaagcagaccuuagacucauauacuuagcccucgcucacaugauuaaauuucggggacacuuccucauugagggagaccucaaucccgauaacucagauauggacaaacuauuuauacaacucguucaaacuuacaaccaauuauucgaagaaaacccaauaaacgcaagucgcguggaugcaaaagcaauacuaucagcuagacuaucaaaaagucgacgauuagaaaacuuaauagcacaacucccaggagagaaacgaaacggacuauucggaaaucugauagcucuaucacuaggccuaacuccaaacuucaaaucaaauuuugacuuagcggaagaugcaaaacuacaacuuaguaaagacacauacgaugaugaucucgauaacuuauuagcacaaaucggagaccaauaugcagaccuauuuuuagcagccaaaaacuugucagacgcaauacuauugagugacaucuuaagaguaaacagugaaauaacaaaagcaccauuaucagccuccaugaucaaaagauaugacgaacaucaucaagaccuaacacuauuaaaagcauuaguucgucaacaauugccugaaaaauacaaagaaauauucuucgaccaaagcaaaaacgguuaugcaggauacaucgacggcggggccucacaagaagaauuuuacaaauuuauaaaaccaauacuugagaaaauggauggaacggaagaauugcuggcaaaacuaaacagagaagaucuacuacgaaaacaacgaacauucgacaacgguucaaucccucaccaaauacaccuaggagaacuacaugcaauuuuacgaagacaagaagacuucuaucccuuccuaaaggacaaccgagagaaaauagagaaaauuuuaacuuuccgaauaccuuauuacgucgguccauuagcaagaggcaacagccgauucgcauggaugacccgaaaaagugaagaaacuauuacaccauggaacuucgaagaaguaguagacaaaggugcaagugcacaaaguuucaucgaaagaaugacaaacuuugacaaaaaucuccccaacgaaaaaguacuaccuaaacauagucuacuauacgaauacuuuacaguauauaaugaauuaacuaaaguaaaauaugugacugaaggcaugagaaaaccggaauuuuuauccgggaaacaaaaagaagcaauaguagacuuauuauucaagacaaacagaaaaguuacagucaaacaauugaaagaagacuacuuuaagaaaauagaaugcuucgauaguguagaaauuucuggaguagaagaucgguucaacgcaucacucggcaccuaucaugacuugcuaaaaauuaucaaagauaaagacuuuuuagauaaugaagaaaaugaagacaucuuagaagauauuguucuaacacucacauuauuugaagacaaagaaaugaucgaagaacgcuugaagaaauacgcaaacuuauuugacgauaaaguaaugaaacaacuaaaacgaaggcacuacacuggguggggaagauuaucacgaaaauuaauuaacggaauuagagauaaacaaagcggaaaaacaauacuagacuuucuuaaaucugauggcuucgcaaaccgaaacuucaugcaacuaauaaacgaugauucccuaacauucaaagaagccauccaaaaagcccaaguaaguggucaaggacauucacuucacgaacaaauagccaaucucgcugguaguccagcuauuaagaaaggaauacuacaaaguguaaaaguagucgacgaauuaguaaaaguaaugggacauaaaccagaaaauauaguaaucgaaauggcuagagaaaaccaaacgacacaaaaaggacagaaaaauaguagggaacgcaugaaaagaaucgaagaagguauaaaagaacugggcagucaaauccuuaaagaacauccaguagaaaauacccaacuucaaaacgagaaacuauaucuuuacuaccuacaaaauggaagggacauguauguagaucaagaacuagacauaaacaggcuaagcgauuaugacguagaccacauaguuccacaaucauuuauaaaagacgacucuauugacaacaaaguacuaacaagaucagacaaaaacagaggcaaaagcgauaacguaccaucagaagagguaguaaagaaaaugaaaaauuauuggagacaacuucucaaugcaaaauuaauaacucaaagaaaauucgacaaucuuaccaaagccgaacguggcggacuuucugaacuagauaaagccgguuucauuaaacgacagcuaguagagacacgacaaauaacuaaacauguggcacaaauauuggacucacgaaugaauacuaaauacgaugagaacgacaaacuaauaagagaagugaaaguuauuacacucaaaucgaaacuuguauccgacuuccguaaagauuuucaauucuauaaaguacgggagaucaauaauuaccaucacgcacacgaugcguaccuaaacgcaguggucggcacagcguuaauaaagaaauacccaaaacuugaaucagaauuuguguacggggacuacaaaguguacgaugugagaaaaaugauagcaaaaucugaacaagaaauagggaaagcuacggccaaaagauucuucuacuccaacauaaugaacuuuuucaaaacagaaauuacacuugcgaauggugaaauaagaaaacgaccgcuuauagaaaccaaugaagaaacuggagaaaucguaugggacaaaggaagagacuuugcaacaguccgcaaaguuuuaucaaugccacaagugaauauuguaaagaaaacagaaguacaaacuggagcccucacaaaugaaucuauauacgcacgggggagcuuugacaaauugauuucaagaaaacacagguuugaaaguucaaaauacggaggauuuggcucacccaccgugacauauagcguucuaguaguagccaaauccaaaguacaagacgggaagguaaagaaaauuaaaacgggaaaagaacuaaucggaauaacauuacuagacaaauuagucuuugagaaaaacccccuaaaauucauagaagacaaagguuacggaaauguacaaaucgauaaaugcauuaaauuaccaaaguauucuuuauuugaguucgaaaauggaacaagacgaauguuagcaucaguaauggcuaacaauaacuccagaggagaccuacaaaaggcaaacgaaauguuuuuaccagcaaaacuuguuacacuacuauaucaugcccauaaaauagaaucaucaaaagaauuagaacaugaagcauacauacuagaccauuacaaugacuuauaucaacuucuuucuuauauugaaagguuugccucacuauacguagauguagagaaaaacauuaguaaaguaaaagaauuauucucaaauauugaauccuauucaauauccgaaauaugcucuaguguaauaaaucuauuaaccuuaacggcuagcggagcuccagcggacuucaaauuucuagguacgacaauacccagaaaacguuacggaucaccacaaucgauucuauccucaacguuaauccaccaaaguaucacuggccuauacgaaaccagaauagaccuaucacaacuuggaggagacuga

SEQ ID NO: 8945 - RNA, 4116 nt, Artificial Sequence
  Cas9 variant
auggauaaaaaguauagcauaggucuagacauaggcaccaauucaguagguugggcagucauaaccgacgauuauaaagucccauccaaaaaguucaaaguacuagggaacacagaucggcauagcauaaagaaaaaccuaauaggugcacuccuguuugacagcggagaaacugcagaagcaacaagacuaaaacgcacugccaggcgaagauacaccagaaggaaaaaccgaauacgauaccuacaagaaaucuuuagcucggaaaugucaaaagucgaugauucguucuuucacagacuugaagagagcuuccuaguagaagaagauaaaaagcaugaacgacauccaauauuuggaaacauaguagaugaagucgccuaucaugaaaaguacccaaccauauaccaucuacgaaagaaauuggcugacaguacugauaaagcagaucugcgccuuauuuaucuagcguuagcacauaugauaaaauuuaggggacacuuuuuaaucgaaggagaccugaacccugauaauagcgauauggacaaacuauucauucagcuuguccaaaccuauaaccaacucuucgaagaaaauccaauaaacgcuuccagaguagacgcgaaagcuauacucagugcucgccuaagcaaaucuaggcgauuggaaaaccuaauagcacaauuacccggagaaaagagaaacggcuuauuuggaaaccuaauugcacuaucucuaggccuaacuccuaacuuuaaauccaauuucgauuuagcagaagacgcgaaacuccagcuuucaaaagauacauaugaugacgacuuggacaaccuauuagcacaaauaggcgaccaauacgcagacuuauucuuagcagcgaaaaaccuuucagacgcaauauuacucucagacauccuacgcgucaauucagaaauuacuaaagcaccacuuagugcaucaaugaucaaaagauacgacgaacaccaccaagaucuaacccuucucaaagcccuggugagacaacaauuaccagaaaaauacaaagaaauauucuuugaccaaucuaaaaauggguaugccggauauauagacggaggagcaucacaagaagaauuuuauaaauuuaucaaaccuauuuuagaaaagauggauggcacagaagaauuacucgcaaaacuaaaucgagaagaucuauuacgaaaacaaaggaccuucgauaauggaucaauuccacaccaaauccauuuaggagaacuacaugccaucuuaagaagacaagaagacuucuacccauuuuuaaaagacaaccgagagaaaauugagaaaauacuaacauuccgcauaccauacuacgucgggccauuagccaggggcaauagcagauucgccuggaugacaagaaaauccgaagaaaccauaacaccauggaauuucgaagaagucguagacaaaggagcaucggcucagagcuuuauagaacgcaugacaaauuuugauaaaaaccuaccaaaugaaaaagucuuaccaaaacacagucuccuuuacgaauauuuuacgguuuauaacgaacuaacuaaaguaaaauauguaaccgaaggaaugagaaaaccugaguuccuaucgggaaaacaaaaagaagccaucgucgauuuacucuuuaaaacaaacagaaaaguaacggucaaacaacuuaaagaagauuauuucaagaaaauagaaugcuuugacucagucgaaauaucagguguagaagacagauucaaugcuucgcuagguaccuaccaugaucuccugaaaauaaucaaagacaaagacuuuuuggauaacgaagaaaacgaagacauauuggaagauauuguacugacauuaacacucuucgaagauaaagaaaugauugaagaaagauuaaaaacauacgcacaccuguuugaugacaaaguaaugaagcaacuaaaacgaagacacuauaccggauggggucgcuugucacgaaaacuuaucaacgguauccgagauaaacaaucgggaaaaaccauucucgauuuccuaaaaucagauggcuucgccaaccggaauuucauccaacuaauccaugaugacagcuuaacauuuaaagaagcaauacaaaaagcacaaguuucaggacagggucauucacuacacgaacaaauugcgaauuuagcagguucaccagcuauaaagaaaggcauacuacaaagugucaaagucguugaugagcuaguaaaagugaugggacauaaaccugaaaauauaguaaucgaaauggcacgggaaaaccaaacaacacaaaaaggccagaaaaauucuagagaaagaaugaaaaggauagaagaagggaucaaagaauuagguagucaaauacuuaaagaacauccugucgaaaacacccaacuccaaaaugaaaaacuauauuuauacuacuuacaaaacggaagagacauguauguagaccaagaacuagauauaaacaggcuaagugacuacgacguugaccacauagucccccagagcuuuauuaaagaugauucuauagauaacaaaguacugacacgcucagacaaaaacagagguaaauccgacgacguucccagugaagagguugugaagaaaaugaaaaauuacuggagacaauuacuaaacgccaaacuaauaacucaaagaaaauucgacaaucucacaaaagcagaacgaggagggcuuuccgaacuagacaaagcagguuucaucaaacgacaacuuguagagacccgacaaauuacaaaacacguagcucaaauccuugacucaagaaugaacacaaaauaugacgaaaaugauaaauugaucagagagguaaaaguuauaacucuuaaaucuaaauuaguuucggauuuuagaaaagauuuccaauucuacaaaguuagagaaauuaauaauuaccaucaugcgcacgaugcauaucuaaacgccgucguagguaccgcuuuaaucaagaaauaccccaaacuagagucagaauuugucuacggugauuacaaagucuaugacguuagaaaaaugauagcuaaaagcgagcaagaaauaggcaaagccaccgcgaaaagguucuucuauagcaacaucaugaacuucuucaaaacugaaaucacucuagcaaacggcgagauaagaaagcguccacucauagaaacaaacgaagaaacuggcgaaaucguauggaacaaaggaagagauuuugccacaguucgaaaaguuuuauccaugccccaaguaaacauaguaaagaaaacagaaguucaaacaggcgcacuaacaaacgaaaguaucuaugcacgugguagcuuugacaaauugauaucacggaaacacagguuugaaagcagcaaauacggaggcuucgguucaccaacaguaacauauuccguuuuaguaguagcaaaaaguaaaguacaagauggaaaaguaaagaaaauaaaaaccgguaaagaacuaauagggauuacccuucuagauaaacucgucuuugagaaaaauccccuaaaauuuauugaagauaaaggguacggaaacguacaaauagauaaauguauaaaacuacccaaauauucauuauuugaguucgaaaauggaacaagaagaaugcuagccucaguaauggcgaauaacaauagcagaggugaccuucaaaaagcaaacgaaauguucuuacccgccaaauuaguuaccuuauuauaccacgcgcacaaaauagaaucuucaaaagaacuagaacaugaagcauauauacuagaccauuauaaugaccuauaucaauuauugagcuacauugaacgauuugcaucauuauacguagacguugagaaaaacaucucaaaaguaaaagaacucuucagcaacauagaauccuauucuauaagcgaaauaugcucaagcguaauaaacuuauuaacauuaacagcuagcggugcaccagccgacuucaaauuccuaggcacuacaauacccagaaaaagauacggauccccucaaucuauacuaucauccacacucauucaccaguccauaacaggcuuauacgaaacgcgaauugaccucucacaacuagguggagacuga

SEQ ID NO: 8946 - RNA, 4116 nt, Artificial Sequence
  Cas9 variant
augaauaauaacaauuacagcauaggucuagauauaggaacaaauagcguaggaugggcagugauuacagaugacuauaagguaccaucaaaaaagaugagaguacuggguaauacugauaaaagauuuauaaagaaaaaccucauaggcgcacuucucuucgacgaaggcacaacugcagaagaucguaggcucaagcgaaccgcaagaaggcguuauacaagaagaaaaaaucgauuacguuauuuacaggaaauauucgcugaagaaaugucgaaaguagauuccagcuuuuuucacagacuagacgauuccuuccuaguaccagaagauaaauccggguccaaauaccccaucuuugcaacgcuagcggaagaaaaagaguaucauaaaaaauuuccaacaauauaccaccuaagaaaacaucuagcagauucaaaagaaaaggcagaccuaagauuaauuuacuuagcucuagcacauauaaccaaauaucgaggucacuuucuuuacgaggaagccuucgauauuaagaauaaugacauacaaaaaauauucaaugaauuuauaaauauauaugacaacaccuuugaaggauccagucuaucaggccaaaaugcucaaguagaagcuauauuuacugggaaaauaagcaaaucaguaaaaagagaacacgugcuaaaauuauuuccagaugaaaaaucgaccggacuuuucucugaauuucucaaguugauugucgggaaccaggccgauuuuaaaaaacacuuugacuuagaagaaaaagcaagucuacaauucucuaaagacaccuacgaugaggaucuugaaaaccuacuuggacaaauuggugacgacuuugcagaccuuuucuuaguggcaaagaaacuauaugacgcaauauugcuaucagggauccuuacaguaacugaccccucaacaaaagcuccauuaucagcaucaaugauugaacgauacgagaaucaucaggaagaucucgcagcauuaaagcaauucaucaaaaacaaccuaccagagaaguaugccgaaguuuuuagcgaccaaagcaaagauggauacgccggauauaucgacggcaaaacuacucaggaagcuuuuuauaaauauaucaaaaauuuacuaucuaaguucgaaggagcagacuacuuucuagacaaaaucgaaagagaagauuuuuuaagaaaacaaagaaccuucgauaaugguucaauaccacaucaaauucaccuccaagaaaugaacgcaauacuaagaagacagggggaacacuacccacuccuuaaagagaacaaggaaaaaauagaaaaaauucugaccuuccgaaucccauacuacguaggaccgcuggcuaggggaaauagagauuuugcaugguugacaagaaauuccgaucaagcaauuagaccuuggaacuucgaagaaaucguugacaaggcaucauccgcagagaguuuuauaaauaaaaugaccaacuaugaccuauaccucccagaagaaaaaguacuccccaaacauucccucuuauacgaaacauucgcuguuuacaaugaacuaacaaaagucaaauuuauagcagaaggcuuacgagauuaucaauucuuugacuccgggcaaaaaaaacagauuguaaaccagcuauuuaaggaaaaaagaaaagugacugaaaaggauauaauacauuaccuacauaacguagacggcuaugacggaauagaacuaaaagguauagagaaacaauuuaaugcaagucuaucuacauaucacgaucuacucaaaauaaucaaagauaaagaauuuauggauaaccauaagaaucaagaaauacuugaaaauauuguacacacucuaaccauauucgaagaucgagaaaugauaaagcaaagacucgcgcaauaugauagcauuuucgaugaaaaaguuauaaaagcucucacacgacgacauuauaccggaugggguaaauuaagugcaaaacucauaaacggaauaugcgacaaaaaaacaggcaaaaccauauuagauuaccucauagaugacggcuacaauaauaggaauuucaugcaacucauuaacgacgacggauuaucauucaaagaaaucauacagaaagcacaagucguagguaaaacugaugaccucacacaagugguaagagaguuaucggguuccccugcaaucaaaaaagguauacuacaaucaaucaaaauaguagaugaguuaguaaaaaucaugggauaugccccugaaucaauaguaauugaaauggcccgagaaaaucaaacuacugcaaaagguaaaaaaaacucccaacaaagauauaaacgaauagaagaugcacuaaaaaaucuagccccuggucuagauucaaccauaucaaaagaaaauccaacagauaacauacaauuacaaaacgacagguuauuuuuauacuaucuccaaaauggaaaggacauguauacaggugaagcauuagauauaaaucaacuaaguucauaugacauagaucauauaauaccacaagccuucauaaaagacgauagucuagauaacagggugcuaacgaguucaaaagauaaccgaggaaaaucagacaacguaccaucacucgaagucguaaaaaaaagaaaagccuucuggcaacaacuacucgauuccaaauuaauaagcgaacguaaauucaacaaucuaaccaaagccgaaagggguggauuagaugaacgagauaaagucggcuucauaaaacgacaacuaguagagacacgucaaaucacaaaacacguggccagaauccuagacgcgagauucaacacagagguaucagagaaaaaccaaaaaauacgaucaguaaaaauaauaacacuaaaaucuaaccuaguaagcaauuucagaaaagaauuuaaacuauacaaaguacgagaaauaaaugauuaucaccacgcucaugaugcauacuuaaaugcagucguggcaaaggcaauacuaaaaaaauacccgaaacuagaaccggaauucgucuauggagauuaucaaaaauaugaucuuaaaagauauauaucaaaaucgaaagaccccaaagaaguagaaaaggccacagaaaaauacuucuucuauaguaauuuauuaaacuucuucaaagaagaaguacauuaugcagauggcacaauaguuaaacgagagaacaucgaauacaguaaggacacaggagaaauugcauggaauaaagaaaaggauuuuguuacaauuaaaaaaguacucagcuauccccaaguaaacauaguaaagaaacgagaaguacaaacaggagguuuuagcaaagaaaguauuuuaccaaaaggaaauucggauaaacuuauaccaaggaaaaccaaagacaucuuaugggacacaacgaaauauggagguuuugacucaccgguuauagccuacucaauccucuuaauagcagacaucgaaaaaggcaaagcaaaaaaacucaaaacaguaaaaacucuuguuggaaucacaauuauggaaaaagcagcauucgaaaaaaauccuauaacuuuuuuggaaaauaaaggauaccacaacguucgaaaagaaaacauucugugucuuccaaaauacucacuuuuugaacuggaaaacggcagacgaagacuucuagcuagcgcaaaagaauuacaaaaagggaaugaaaucguuuuaccaguuuauuugacaacgcuccuuuaccauagcaaaaauguacauaaacuagaugagccagagcaccuagaauacauacaaaaacaccgauaugaauucaaagaccuauuaaacuuaguaucagaauuuucacaaaaauacguccucgccgaagcaaacuuagaaaaaauaaaauccuuauacguagauaacgaacaagcugacauugagauauuagcaaacucauucauuaaccucuuaaccuucacagccuuaggcgccccagccgcauucaaauuuuucggcaaagaugucgacagaaaaagauacaccaccguaagcgaaauacuaaacgcaacucuaauacaccaaucaaucacaggccuauacgaaacacgaauagaccucagcaaacuuggagaagauuga

SEQ ID NO: 8947 - RNA, 4116 nt, Artificial Sequence
  Cas9 variant
augacugagaaaaauuauucgauuggucuugauauugguacuaauuccgucggaugggcuguuauaacagaugacuacaaaguaccugccaagaaaaugaaaguauuaggaaauaccgauaagaaauauaucaagaaaaaccuacuaggagcacuacuuuucgacaacggagaaaccgcagaagcaacaagacugaaacgaacagcgcgccgaagauauacucgaaggaaaaauaggcuaagauauuugcaagaaauauuugccgaagaaauggcuaaaguugaugaaaguuucuuuuaccgccuagacgaaucguuuuuaacuacagacgacaaagacuuugaaagacauccaauauuugguaacaaagcugacgaaauaaaauaucaucaagaauuuccgaccauauaccacuugcggaaacaucuagcagacagccaugaaaaagcagauuuacgauuaauuuaucuagcacuagcucauaugaucaaauuccgaggacacuucuuaauagaaggagaauugaacgcagaaaauacugacgugcaaaaacuauucgaagcauuuguagaagucuacgacagaacguuugaugauucuaaucuaucugaaauuacaguagaugcaucaucuauacuaacagaaaaauuuucaaaaucacggagauuagaaaacuuaaucaaacauuaucccaccgaaaagaaaaacacucuauuuggaaaccuuguagcuuuagcuuuagggcuacaaccaaauuuuaaaacaucauucaaacuuagcgaagacgcaaaacuucaguucuccaaagacaccuacgaagaagaucuagaagaauuaaucggaaaaauaggagaugaauacgcugacuuguucacuucagcaaagaaccuuuaugacgcuauauuacuaucagggauucucacagucgcagacaacaccacaaaagccccauuaagugcaucaaugauaaaaagauauaaugaacaccaaguugaucucaagaaacuaaaagaguucauuaaaaacaacgcuagcgauaaauacgacgaaauauuuaacgauaaagacaaaaauggauaugcaggauacauagaaaaugguguaaaacaagaugaauuuuauaaauaccuaaaaacuaccuuaucaaaaauagauggaagcgacuacuuuuuagauaaaauagaaagagaagacuuccuccguaaacaaagaacauucgacaacggaucaauaccccaccaaauucaucuacaagaaaugcaugcuauccuaagacgucaaggagaacauuaugcauuucuaaaagaaaaucaagcaaaaauagagaaaauucucacuuucagaauccccuacuacguugggccauuggcacguaaaaacaguagauucgcaugggcggaauaucauucagacgagaaaauaacucccuggaacuuugaugaaauaauagacaaagagaaaagugcugaaaaauuuauuacaagaaugacccugaaugauuuauaucucccagaagaaaaaguacuccccaaacacagccuaguauaugaaacuuacacagucuacaaugaacucacgaaaguaaaauauguaaaugaacaaggaaaaagcaacuucuuugacgcaaacaugaaacaagaaauuuuugaacacgucuuuaaagaaaauagaaaagucacaaaagauaaauucuuaaacuaucuaaauaaagaauuuccagaauaucgaauccaagaucuaauuggucuugauaaagaaaacaagagcuucaacgcaucccuaggaacguaucacgaccucaagaaaauuuuagauaaaucauuccuagaugauaaaacuaacgaaacgauuauagaagacauuauccagacacuaacacuauucgaagaccgagauaugauacgacaaagauuacaaaaauauagcgacaucuucacuccucaacaacucaagaaauuagaaagacgacauuauaccggaugggguagauugucuuauaaacugauaaauggaauacgaaauaaagaaaacgggaaaucaaucuuggauuaccucauagacgauggauacgcaaaucgaaacuucaugcaacucauaucagacgacacuuuaccauuuaaacaaauaauaaaagaugcacagaucauaggugacauagacgauguuacaucagucguaagagaauuacccggcucccccgcaauaaagaaagguauauuacaaucagugaaaaucguugaugagcuaguaaaaguuauggggcacaacccugauaauauagucauagaaauggcuagagaaaaccaaacaacaaauagaggcagaaaccaaucacaacaaagauugaagaaacuacaagauucacucaaagaauuggguucaaauauccuaaacgaagaaaaaccuuccuauaucgaaggaaaagucgaaaacaaucaccuacaagaugauagacuauuucuauacuauauucaaaauggaaaagacauguacaccggugaugaacuagacauagaccaccuuucagacuaugacaucgaccacauaaucccccaagccuuuauaaaagaugacuccaucgacaaccguguauuaacuucaucagccaaaaacagaggaaaaagugacgacgucccgagccuagacauaguacaugauagaaaagcggacuggauucgacuauauaaaagcggucuaauaagcaaaagaaaauucgauaacuuaaccaaagcugaaagaggcggacuaacugaaaaugauaaagccggauucaucaaacgucaacucguugagacgcgucaaauaacuaaacacguugcgcaaauacuagauaguagauucaacacugaaagagaugaaaaugauaaagucauccgaaauguuaaaguaaucacucuaaaaucgaacuuagucucacaauuucgcaaagacuuuaaauuuuacaaaguccgggaaauaaaugauuaccaucaugcacacgaugcauauuugaaugccgugguuggaaccgcacuacuaaagaaauauccaaaacuagcaccugaauuuguauacggagaguacaagaaauacgauauaagaaaauuuauaacgucuucaggagacaaagcaacagcuaaauacuucuuuuauucuaaucuaaugaacuucuucaaaagagugauucgauauucaaauggaaaagucguuguaagaccaguaauagaauguucuaaagacacuggcgaaauagcauggaauaaacaaacagacuucgaaaaaguacgaagaguguuaucauauccacaaguaaacauaguaaagaaaguagaaacacagacaggaggauucucaaaagagucgauucuuccuaaaggcaauucugauaaacuuaucccaagaaaaaccaagaaauuucgaugggacacaccaaaauacggaggauuugacucaccaaacauagccuacucaguauucguaauagcagauguggaaaaagguaaagccaagaaauuaaaaacaguaaaagagcuaguagggauaagcauuauggaaagaucuagcuuugaagagaacccgguaguauuuuuggagaagaaaggcuaccaaaauguccaagaagauaauuuaauaaaauuaccuaaauauuccuuauucgaauuugaaggaggcagaagacgccucuuagcuucggcuucagaauuacaaaaaggaaaugaagucguacuaagcagacacuuaguugaacuacuauaucacgcgcaccgagugaacucauucaacaauucagaacaccuuaaauaugucuccgaacauaagaaagaguucggagaaguacucagcugcguggagaacuucgcgaagaguuaugucgacguagagaaaaauuuagguaaaauucgagcaguugcagauaaaauugauacauuuagcauagaggauauaucuaucagcuuuguaaaccucuuaacgcucaccgcccuuggugcaccagcggauuucaacuucuuaggagagaaaauacccagaaaacgauauacaaguaccaaggaaugucuaaaugcaacauuaauccaucaaucaauuacgggacuauacgaaacaagaauagaccuaucaaaauugggcgaagaguga

SEQ ID NO: 8948 - RNA, 4116 nt, Artificial Sequence
  Cas9 variant
augaaucuaagaaauguagaaucuuaccaaguaggauuagacauagguacagguaguguuggaugggcuguacuugaugacaacggagaucuauguagauuuaaagggaaaccaacauggggcagcagaguguucccaacagcagaaacagcagcugaagcaagagugcaccgcggacaaagaagaagauaugacagaaggagacaaaggauagauuuguuacaacgcuucuuugccgacgaaguagcaaaaguagacccagaguuuuucauaagauuaaaccaagcaagacuacauccagaaaaucgagaucccgcucaugccgauuacagauggccccuuuucaacggcagcaauuucacagagaaagauuacuaucgucaauucccgacuauauaucaccuucgugcucaucuacugaaaagugacgaaccggcugauauacgauuaguauaucuagcacuacacaauauagugaaacacagagguaacuuuuuacaucaggacaacccuuccuuaucagcucguaaugcaaauguaggggacgcuguagaggcuuuguguuuagcucucgaugaauggugcggagcucaugauguagaaugugcaugugacgaagcagcgcuggcagaagcacucggagaugcuuccuuaagaccaggcgaaaaacgagaaagagccgaagcagcauuagguguugaaaaagcacauaagaaacuugcuaaagcaguuaguucagcaguagugggauacgccgccgaauuuggccauguauuuuucgcagaaucagaaggaagcaaguuugcacuaagcaaugaugaaaaaguugaagcauaugucugcccugaugagggaagagauuuauuugaugcgaugcgagcaguccauucaagcuacguuuugaugggaauauuaagcgaagcacaaggcgaguuauuaagugucuguaagguaggagaauaugaaagauacaaaagagaccuggagacacuaaaaaguuugguaagggcguacggaccagaaagauacgacgaguucuucuguggaccguucuacgaaggcacuagggacuacgacccuggaaaggcacaagguuauacaaaguauaaucucggagcauccaaacucucccaugaagauuuccuaaaggaagugcagaagcuacucaaagauaucggcgcacaagccgaugaaagguaugccgauaucgaacgagcaaucgaggcaggagcauuccuaagaagauuaaaaacaagugacaauggaacaauaccauaucaacuacauuuagaagaaauggacgcuauaauugagagacaagccgcuuuuuacccguuuuuagcacaggagaaagacaaacugaaaucuuugguaaguuucagaauaccauauuaugucggaccacuuacucagaaaaacgcggccagagacggaaaaggagaagcuagauucgccuggaguucacgaaaaccagguauggaagaugcaagaguauaccccuggaacugggaagauguaauagauaaagaucaaagcgccgaagauuuuauuaggagaaugacagggacuugcaccuauuuaaaaggagaaccaguauuagcaagauguaguuuagauuaugaacuauucugcguauuaaaugaauuagcaggcgcaagauggacacaagacggagauaaaaguuaucgcuuugaugcugcugaucgacuaggaauaguagaagaucuuuuuaagaaacguaaaagaguuacguacgaagccgccgaaaaaugguuagcucggacacauggaccagaaucugggaaaagugcggguggagcauaucacguaaguggaggccaaggagaggacgcauuugagucacaacugaguagccacuaugacuuuugcaaaauuuuggguguugaugaauuaucugaugcagacgaagcaauggcggaagacauaauucuauggaacacaguauucgaagaccguucaauuuugaaaaggaaaauaaaacucgcauauggcgaucguuuaggugaugcccaaguuagaaaacuaugccagaaaagauacacaggguggggacgacuaagcggugaacuacugagagggcuaaggucagcaacagauaaugguccuaaaacaauaauggauauauuacuugaaggggauccuaaccacgcgcgucguaugggagcugcuaugaacuuaauggaaauauuacaugaugacuuauuagaauuucaagcaaaaauagacgaacauaauagagaaagagcucuagcagucgggggcaugucaguagaugaagucacuggaagcccugcgcuaaggagagguaucaaccaagcacuacgaguuguugacgaaauagcaggaauugcagggaaacccccagcacauauuuacguagaaguuacacgagaugaaggggcacggaauaaggggagacgcaccacgagcagauacagagcauuagaagcugcacuaucaucaauaaaagcacaaugugcagauguguacgcagaacucaaggaaagagauccaagggcccuagacgaugaaagauuaacguuguauuuuaugcaauguggaaaguguauguacaguggcgacgcauuagauaucaacaaguuacaaacauaucaaguagaucacauacuaccgcaaucauaugugaaggaugacaguuuugaaaauaaaguuuuaguuagaccggacacaaaccaacgaaaaggagauacgcuauugcucgacgaacgacucauagcaaggaugcgaggcuuuuggcgaacacucagggaugcagaauuaauaggugaaaagaaguuuaauaaucuuacacgaacaaguguuucagacgagcagaugaagaaauuuguaucgagacaauuaguagaaacuggccaaaugguaaaacaaguucaacaauuauugcaagcaagauauccagaaucugaaguacaaccuguuaaagcaggagugagucaccaauuaagagucggcugcgcguuagcaaaaaguagggaaauaaacgauuuucaccaugcacaugacgccuauuuagcaugucagguagguagauuuguacaauacagacauucagccguuuauucagaacccgugaaaauggcagcugucguaaaacaauucauaaagaaacaagcagaagauuauagacgaacgagagaauuaccaggaagugacgguuucauagucagcucauuuaugacacccgguuuugacguaaaaacaggcgaaguuuuuagggacgcgugggaugcuggagcagaaauagacagaauuagaagauguuuugauuauaaagacugcuuuauuuccagaaugccagaagaaacgcauggggcauucugggaugcaacaauuuauucaccuagggcagcaggcaaaaccuuaagucuaccgcuaaaaagaggauuagacccaagaaaguauggaaguuacucucgggaacaauucgccuacuucuuuguguaugaagccguuaaaccaaagaagaaacagcgagucuuagaguucgcacccgucccaguuagaguagcaucagcacucgcuaaugauccagaugcccuagaagacuaugcaagggaacuagcggaagcagaaggccuaguuuucgaacgcauuagaagaagaaaaguauauaaauaucaacaaauuauuguaggagauucaagacuauauguuacaggacgggaggaaguacgaaacgcucgucaacuggcuuuuucucaagacgaaacgaaauugauaugcagaauagagcaaggugaagaaugugaagaaggugaauuacuggauuuauuuagguccaugcagcguaaauauuuagcaugcgcaccacgacuggcuagacugaugaaaguugcagaaauggaggaaggauuuauagcugcgacagcauccgggaaaagggaaguauuacuaagucuuacaucuauagcagcagcgcacagaaacagcaucgaucuuaaaccaauuggaagaaaaggaucuaguggucaaaugaaaauaacauucaguaaagaacugaguacaaauggaauauuguuuguugacucaucuguaacagguauguucgagagacguuguagauuagguuuguga

SEQ ID NO: 8949 - RNA, 4116 nt, Artificial Sequence
  Cas9 variant
auggaaaauaaaaauuauaguauaggacucgacauaggaacaaauagcguaggcuggagcguaauaacagaugauuauaaaguaccuagcaagaaaaugaaaguuuuaggaaacacugacaaacgcuucauaaagaaaaauuuaauaggagcauuauuauuugaugaagguacuacagcagaagcccgaaggcuaaaacgaacagcaagaaggagauauacucgaaggaaaaacagacuacgauauuugcaagaaauauuugccgaagaaaugucaaaaguagacucgucauucuuccauagacucgaugacagcuuuuuaauaccggaggacaaaagagguucaaaauauccaauauuugcgacccuagcugaagaaaaagaguaucauaagcaauuuccuacaauauaucacuuacggaagcaauuagccgauuccaaagaaaagacagaccuacgacuuaucuaucuagcauuagcucacaugaucaaauaucgugggcacuuucuguacgaagacaccuuugauauuaaaaacaaugacauacagaaaauauucucagaauuuaucucaauauaugacaacacuuuugaaggaucuucucucucuggacaaaacgcucagguagaagcaauauucaccgacaagauuucaaaauccgcaaaaagagaaagaguacuuaaauuguucccugacgaaaaaucuacuggauuauuuagugaauuucuuaaacuaauaguggguaaucaagcagacuuuaagaaacacuucgauuugggagaaaaagcaccacuucaguucucaaaagauacguacgaugaagaccuagaaaacuuguugggacaaauuggagacgacuuugcagaucuauuccuagucgccaagaaauuauacgacgcaauacuacuuaguggaauacuuacaguaacagauccuucuacuaaagcgccgcuauccgcaucaaugauagaacguuacgaaaaccaccaaaaagaccuagcaguacucaaacaauuuauuaaaaacaauuugcccgaaaaauaugaugagguguuuucugaccagucaaaagacggauacgcgggcuauauagacggaaaaacuacccaagaggcuuuuuauaaauauauuaaaaauuuacucagcaaauuugaaggcaccgauuacuuccuagagaaaaucgaacgggaagauuuccuaagaaaacaaagaaccuucgacaacgggucaauaccccaccagauucacuuacaagaaaugaacgcgauccuaaggcgacaaggagaacacuacccauuuuuaaaagauaacaaagagaaaauagagaaaauucugacuuuccguauacccuauuaugugggaccguuagccagaggaaacagagacuucgcaugguuaacccgaaauucagaugaagcuauaaggccguggaacuuugaagaaauuguggauaaagcaagcucugcggaagacuuuauaaauaaaaugaccaacuacgacuuauauuuaccagaagaaaaaguacuaccaaaacauaguuuacucuacgaaacauucgcggucuauaacgaauugacaaaaguaaaauucauagcugaaggacucagagauuaccaauuccuggauaguggacagaagaaacaaauaguaacacaauuauuuaaagagaaaaggaaagucacagaaaaagacaucauacaauuccuacauaacguagacggauaugaugguaucgaauuaaaaggaauagaaaaacaauucaaugcaagccucucuacuuaucacgauuuacuaaaaauaauaaaagacaaagaauuuauggaugauucuaaaaaugaagaaauauuagaaaauauaguccauacauuaaccauauuugaagauagagaaaugauuaagcaaagauuagcucaauacgauucacuauuugaugaaaaagucauuaaagcccucaucagacgacacuacacggguugggguaaacucucagcaaaacuuaucgauggaauaugugacaaacaaacagguaacaccauuuuagauuaccuaauagaugauggcaaaaauaaccgaaauuuuaugcaacuaauaaacgaugaugguuuaucauucaaagaaauaacacaaaaagcacaaguaguggguaaaaccgacgacguuaaacaaguaguacaagaauugccuggauccccugcaauaaagaaaggcauauuacaaagcauaaaaaucguugacgaauuaguaaaaguaauggggcauacucccgaaucaauuguaauagaaauggcacgggaaaaccagaccacugcacgagguaagaaaaacucacagcaaagauauaaaagaauagaagaugcucugaaaaaucuagcaucaggauuagauucaaacauacugaaagagcaccccacaaauaauauacaauuacaaaacgaucgucuauuucucuauuacuuacaaaauggacgagacauguacacagguaaaccacucgauaucaaucaacucaguagcuacgauaucgaccauauaguaccacaagcauuuauaaaagaugauucacuagauaauagaguucuaaccagcuugaaagauaauagaggaaaaucugauaauguuccaucaauagaaguaguacagaaaaggaaagcauucuggcaacagcucuuagacucaaaauuaauaucagaacgaaaauuuaauaaucuaacaaaagcagaaaggggcgguuuagaugaaagagacaaaguuggcuuuauuaaaagacaacucguagaaacaagacaaauaacuaaacacguagcacaaauucuagacgcuagauucaauaaagaaguuaacgaaaaagauaagaaaaacagaacgguaaaaauaauaacccuaaaaaguaacuuagucagcaauuucagaaaagaguuccgucucuauaaaguaagagaaauaaacgacuaucaccacgcacacgacgcauacuugaaugcuguaguugccaaagcuauuuuaaagaaauauccaaaacuagaaccagaauuuguuuauggagauuaccaaaaauacgacuuaaaacgauacauaucaagaucaagaaauccaaaagaaguugaaaaagcaacagaaaaauacuuuuucuacucaaaccuauuaaacuuuuucaaagaagaaguacauuacgccgacgguacuauaguaaaaagagaaaauauagaauacucuaaagacacaggcgaaauagcauggaacaaagaaaaagacuucgcaacaaucaagaaaguccugagcuacccacaaguuaauauagucaagaaacgagaagugcaaacaggaggauuuagcaaagaauccauauuaccgaaagguaacucugauaaacuaauaccaaggaaaaccaaagauauacuaugggaaacaacaaaauacggagguuucgacucgccaguuauagccuacucaauacuacucaucgccgauauagaaaaagguaaagcaaagaaacuaaaaacagugaaaacauuagugggcauaacgauuauggaaaaagcagccuuugaagaaaaucccauaaccuuuuuagaaaacaaaggauaccauaacguaagaaaagaaaacauccuaugucuucccaaauacucauuauucgaguuagaaaacggacguagaagacuucuagcuagcgcaaaagaauuacaaaaagguaacgaaauaguacuuccaguuuaccuaacaacauuacucuaccacuccaaaaauguacacaaacuugacgaaccagaacauuuagaauauauccaaaaacacagaaacgaauuuaaagaccuacuaaaccuaguaucagaauuuagccaaaaauaugugcuagcagaugcuaaucuagagaaaauacagaacuuguacgcagauaacgaacaagccgauauagaaauauuagcgaacaguuucauuaaucuacucacauuuacagcacuaggagcaccagcagcauuuaaauuuuucggaaaagauauugaucguaaaagauacaccaccguuucggaaauacuuaaugcaacacuaauacaccaaucuauaacgggauuauaugaaacaagaauugaccucucuaaacuuggagaagauuga

SEQ ID NO: 8950 - RNA, 4116 nt, Artificial Sequence
  Cas9 variant
auggauaagaaauacuccauagguuuagauauaggaacuaacaguguaggcugggcgguaauaacugaugacuauaaaguaccaucaaagaaauuuaaaguucuaggcaacacggaccgccauucaauaaagaaaaaccuaauaggggcacucuuauuugacagcggagaaaccgccgaagcaacaaggcuaaaaagaacugcccggagaagauacacacgaagaaagaacaggauucguuaucugcaggagauauucucuagugaaaugaguaaaguagaugauucguucuuucacaggcuagaagagagcuuucuaguagaagaagacaagaaacaugaacgacaccccauauucgguaauaucgucgaugaaguagcauaccaugaaaaauauccaacaauauaccaucuaagaaagaaauuagcagacucaacagacaaagcagaccuuagacuaaucuaccuagcacuagcacauaugauaaaauuuagaggacacuuuuuaauagaaggagacuuaaacccagauaacucagacauggacaaacucuucauccaacuuguucaaacauauaaccaacuauuugaagaaaaucccauaaaugcauccagagucgaugcaaaagcuauacuaucagcgcgacuaagcaaaagucgacgacuagaaaaccuaaucgcacaauuaccaggugaaaaacgcaacggacuuuucggcaacuuaauugcacuuagccucggacuaacaccuaacuucaaaucaaauuucgacuuagcagaagaugcaaaauuacaauugucuaaagauacuuaugaugacgaucuagacaaccuuuuagcucaaauaggagaccaguacgcagacuuauuucuggcugcgaaaaaucucucagacgcuauacuguuaucagacauuuuaagagucaauucagaaaucacaaaagcaccacuuucagcgucaaugaucaaaagauaugacgagcaccaucaagaccuaacacuacuaaaagcacucguacgacaacaacugccagaaaaauauaaagaaauauuuuucgaucaaucuaaaaacgguuacgcaggguauaucgacggcggugccucgcaagaagaguucuauaaguuuauaaaaccgauuuuagaaaagauggaugguaccgaagaauuacuagcuaaacuaaacagggaagauuuacuccguaaacaacgcacuuucgauaauggaaguauaccacaccaaauacaccucggugaauugcacgcaauauuacggcgucaagaagacuucuaccccuuucuuaaagacaacagagagaaaauagagaaaaucuuaacuuuucguauuccauauuauguaggaccacuagcuagaggaaacucaagauucgcauggaugacacgaaaaucagaagaaaccauaacacccuggaacuuugaagaaguagucgacaaaggagcauccgcacagaguuucauagaaagaaugacaaauuucgauaaaaaccuaccaaacgaaaaaguauuaccaaaacauagucuauuauacgaauacuucacaguauauaacgaacuuacgaaaguaaaauauguaacagaaggaaugcgaaaacccgaauuuuuguccgggaaacaaaaagaggcaauagucgaucuacuauuuaaaacaaacaggaaaguaacagucaaacaauuaaaagaagacuacuuuaagaaaauugagugcuuugacagcguagaaaucagcggugucgaggaucgcuuuaaugcuucauuaggaacuuaucacgaccuuuuaaaaauaaucaaagacaaggauuuccucgauaaugaagaaaaugaagauaucuuggaagauaucgucuuaacccuaacucuuuucgaagauaaagaaaugauagaagaacguuuaaagaaauaugcaaacuuauucgacgacaaggucaugaaacaacuaaaacgaagacauuacacuggauggggucgucucucacgaaaauuaauuaauggcauaagagauaaacaaagcggaaaaacaauauuagacuuuuuaaaaucagauggguucgccaauagaaauuucaugcaauuaauaaaugaugauucauuaaccuucaaagaagcuauacaaaaagcucaaguuagcggacaaggacacaguuuacacgaacaaaucgccaaccuagcagguaguccagcaauaaagaaaggcauacuccaauccguaaaaguaguagaugaacuugucaaagucaugggacacaaaccagaaaauauaguuauagaaauggcacgggaaaaucaaacuacucagaaaggacagaaaaauagccgagagagaaugaaacgaauagaagagggaaucaaagaacuggguucacaaauccuuaaagaacauccuguagaaaacacucaacuccaaaacgaaaaguuauaccuauauuacuuacaaaauggaagagauauguauguagaccaagaauuagauaucaaccgccuaucagauuacgacgucgaucauauuguaccccaaucauuuaucaaagacgacucaauagacaacaaaauucuaacccgaagugacaaaaaucgaggcaagagugauaacguaccuagcgaagaaguggucaagaaaaugaaaaauuacuggcgacagcuauuaaacgcaaaacuaauuacucaaagaaaauucgacaauuuaacaaaagccgaaagaggaggauuaucggaauuagacaaagccggcuucaucaaaagacagcuaguggaaacuagacaaauaacuaaacacgucgcccaaauacuagauagccgaaugaacacuaaauacgacgaaaacgauaagcuaauaagagaaguaaaaguaaucacacuaaagaguaaauuaguaagugauuuuaggaaagauuuccaauucuauaaaguacgcgaaauaaauaauuaccaccacgcccaugaugcauaucuaaacgccguaguagguacagcccuaauaaagaaauauacuaaacuugagucggaguucguauauggcgacuauaaaguauacgaugucagaaaaaugauagcaaaaucagaacaagaaaucgguaaagcgacagcgaaacgcuuuuucuauucaaacaucaugaacuucuuuaaaacggaaauuacacuggccaacggugaaauacgaaaaagacccuuaaucgaaacuaacgaggaaacuggagaaauaguaugggacaaaggaagagacuuugcaacaguaagaaaaguauugagcaugccucaaguaaauauagugaagaaaacagaaguacaaaccggugcauuaacuaacgaaaguauauacgcacgaggauccuuugauaaacuaauaucaagaaaacaccgguucgaaucuucuaaauaugggggauuugggagucccacaguaaccuacagcguguuaguggucgccaaauccaaaguacaagauggcaaaguuaagaaaauaaaaacagguaaagaacuuauaggaaugacucuccucgacaaauuaguauuugagaaaaauccacuaaaauuuauagaagacaaaggcuaugguaacguccaaauugauaaaugcaucaaacuaccaaaauauucauuauucgaguucgagaauggaacaaggcguauguuagcauccgugauggccaacaacaauaguagaggagacuuacaaaaagcuaacgaaauguuccuuccagcaaaauuaguaacacuauuauaucaugcccacaaaauagagucaaguaaagagcuagagcacgaagcauacaucuuagaccacuacaacgacuuauaccaacuguuaucauacaucgaaagauucgccagucuauauguugauguagagaaaaauauaagcaaaguaaaagaauuauuuucaaacauagaaaguuacaguaucagugaaauauguucaagcguaaucaaucuauuaacucucaccgcgagcggagcaccagcggacuuuaaauuucuuggaaccacgauaccuagaaaaagauauggauccccucaaucaauacuaucguccacgcugauccaucaaucaauuacaggguuguaugaaaccagaauagaucuaucacaguuagguggagacuga

SEQ ID NO: 8951 - RNA, 4116 nt, Artificial Sequence
  Cas9 variant
auggacaagaaauauaguauuggauuagacauuggaacuaauucagucggaugggcaguaaucacagaugacuauaaagucccaucaaagaaauuuaaaguacuuggcaauaccgacagacauucuaucaagaaaaaucucauaggagcccuucuauuugauucaggagagaccgcagaagcgacacgucuaaaaagaacagcaagacgacgauauacacggaggaaaaauagaaucagauaccuacaagaaauuuuuagcagugaaaugucaaaagucgacgacuccuucuuucacagauuggaagagagcuuccuagucgaagaagacaagaaacaugaaagacacccaaucuuugguaauauaguugaugaaguagcauaccacgaaaaauauccaacaaucuaccaccuucguaagaaacuggccgauaguacugacaaagcugacuugaggcuuauauaucuagcucuagcacauaugauaaaauuuagaggacacuucuuaaucgaaggggaucuaaacccagauaauucagauguagauaaacuauucauccaauuaguucaaacguacaaucagcuauucgaagaaaaccccaucaaugcgagcaggguagacgccaaagcaauucuauccgcccguuuaucgaaaucccgacgacuagaaaaccuaauagcccaacucccaggagaaaaacggaacggacuauucggcaaccucauagcgcuaucacuuggguuaaccccuaauuucaaaucaaauuucgaccuagcagaagacgcgaaacuucaacuaaguaaagauacauacgaugacgacuuagauaaucuucuagcccaaauaggugaccaauaugcagaccuauucuuagcggccaaaaaucuauccgacgcuauccuuuuaagugacaucuuacguguaaauagcgaaaucacaaaagcuccccuaagugcaucuaugauaaaacgauacgacgaacaucaccaagauuuaacacuacucaaagcccucguacgccaacaauugccagaaaaauacaaagaaauuuucuuugaucaaagcaaaaauggauacgcugguuauauagaugggggugcgucacaagaagaauuuuacaaauucauaaaaccuauacuugagaaaauggauggcacugaagaacugcucgcaaaauuaaacagagaagaucuuuuacgaaaacagcgaacuuucgauaacgggucaauuccccaucaaauucaucuaggugaacuucaugcuauauuacgcagacaggaagacuuuuacccuuuccucaaagauaaccgagagaaaaucgagaaaauauuaacauuccgcaucccuuacuauguaggcccucuugcacgagggaacucacgauucgcauggaugacacgaaaaucagaagaaaccauuacaccauggaauuuugaagaagugguagauaaaggagccagugcucaauccuuuaucgaacgaaugacaaacuucgacaaaaaccugccaaaugaaaaaguacucccaaaacacucacuuuuauaugaauauuucacgguuuacaaugaauuaacuaaaguaaaauauguaacagaaggaaugcguaaaccagcauuccuuucuggcgaacaaaagaaagcuaucguggaucuuuuauucaaaacaaacagaaaaguaacgguaaaacaauuaaaagaagacuacuucaaaaagauagaauguuuugacucaguagaaauaucuggaguggaagacagauucaacgccaguuuaggaacauaccaugauuuauuaaaaauuauuaaagauaaagacuuuuuagauaaugaagaaaacgaagauauacuagaagauauaguauuaacgcuuacauuauucgaagacaaagaaaugauagaagaaagacuaaaaacuuacgcacaccuguucgacgacaaaguuaugaaacaacuuaaaaggcgacacuacacugguuggggccgacuuagucgaaaacuuauaaauggaauacgagauaaacaauccggcaaaacaaucuuagacuuucugaaaucggacggauucgcuaacagaaacuucauccaacuuauacacgacgacucccuaacauuuaaagaagcaauacaaaaggcucaaguaaguggacaaggacauagucuucaugaacaaaucgcaaaccuagcagguucacccgcaauaaagaaaggaauauuacaaucagucaaaguaguagacgaacuuguaaaagugaugggacauaaacccgaaaauauaguuaucgaaauggcaagagaaaaucaaacuacccaaaaaggucaaaagaacuccagagaaagaaugaagcgaaucgaagaaggaauaaaagaauuaggaucgcaaauauuaaaagaacacccaguugaaaacacccaacuccaaaacgaaaaauuauaccuuuauuacuuacaaaacggcagagacauguacguggaccaagaacucgauauaaacagauuaucugauuacgacgucgaucacauaguaccgcaaucauuuauaaaagaugauuccauagacaacaaaguauuaacaaggucagauaaaaacagaggaaaaagugauaacgucccaucagaagaaguugugaagaaaaugaaaaauuauuggagacaacuacucaacgcaaaauuaauaacacaaagaaaauuugauaaucugacuaaagcagaacgaggcggauuaagcgaauuagauaaagcuggcuuuauaaaaagacagcuaguugaaacaagacaaauuaccaaacaugucgcgcaaauacuagacucuagaaugaauacuaaauaugaugaaaacgacaaauuaauccgagaaguaaaaguaauuacucugaaaucaaagcuagucucagauuucagaaaagauuuccaauucuauaaagugcgagaaaucaacaauuaccaccacgcucaugaugcauacuuaaacgcgguaguggguacagcucugaucaagaaauacccaaaacucgaaucugaauuuguauacggcgacuauaaagucuaugauguaagaaaaaugauugcgaaaagugaacaagaaaucggaaaagcaacugccaaacguuucuuuuacucgaacauuaugaauuucuucaaaaccgaaaucacuuuagcgaacggugaaauucgaaaaagaccguuaauagaaacuaacgaagaaacaggagaaaucgucugggauaaaggaagagacuucgcaacaguuagaaaagugcuaaguaugccacaaguaaacauaguuaagaaaacagaaguucaaaccggagcucuaacaaaugaauccauauacgccagaggaucuuuugacaaacuuaucucaagaaaacacagguuugaaaguucaaaauacggagguuucgggucuccaacaguaaccuauucagucuuaguaguagcaaaaucaaaaguccaagauggcaaaguaaagaaaauaaaaacagguaaagaguuaaucggaauaacauuauuggacaaauuaguguucgagaaaaacccacuaaaauucauugaagacaaaggauacggaaauguacaaaucgacaaaugcauaaaauugccuaaauauuccuuguucgaguucgaaaacggaacccgacgaauguuagccucaguaauggcaaacaauaauaguagaggagaccuacaaaaagcaaaugaaauguuuuugccagcaaaauuagucacacuacuauaccaugcacacaaaauagaaaguuccaaagaauuagaacacgaagccuauauauuagaucauuacaaugaucucuaccaacuauuaaguuauauugaacgcuucgcaucacuauacguggacguagagaaaaauauauccaaagucaaagaacuauuuucaaacaucgaaucuuacagcaucagugaaauuugcucaucaguaauuaaccuccuaacguuaaccgcuucaggagcgccugccgacuucaaauuucuaggaacaacgauaccccgaaaaagauacgguucaccacaaagcauuuuaagcucuacuuuaauacaccaaucuauaacgggauuauaugaaacuagaauagaccuaagccaacuaggaggagauuga

SEQ ID NO: 8952 - RNA, 4116 nt, Artificial Sequence
  Cas9 variant
auggaaaauaaaaauuacucuauaggacucgacauuggaacaaauucaguaggauggucaguaauaacugacgacuacaaaguaccuucuaagaaaaugaaagucuuaggaaacacagauaaacacuuuauaaagaaaaaccuaauaggagcacuucucuucgaugaaggaacaacagcagaagcaagaagacucaaaagaacggcuaggagacguuauacgcgacguaaaaaccgacuacgauaucuucaagaaauuuucagugaagaaaucggaaaagucgacaguaguuucuuucaucgacuagaugacuccuuuuugauaccugaagacaaacgaggaaguaaauacccuauuuucgccacccuagccgaagaaaagaaauaucauaaacaauucccgacaauuuaucaucuuagaaaacaauuagccgauucuaaagagaaaacugaucuaagauuaauauaccuugcucuugcacacaugaucaaauaccgaggccacuucuuauaugaagaagcauuugauauuaaaaauaacgacauacagaaaauauucaacgaauuuauaagcauauacaacaauacauuugaaggaaauucccuaucaggccaaaacguacaaguugaagcaauuuucacagauaaaauaucuaaauccgccaaaagagaaagaguauuaaaacuauucccugaugaaaaaucaacuggucuuuucagcgaauuucuuaaacugauaguaggcaaccaagccgauuuuaagaaacacuuugaccuagaagaaaaagcaccacuacaauuuagccgagacaccuacgacgaagaccuugaaaaccuucuaggacaaauaggcgacgacuucgcagaccuauuccucguagcaaagaaauuauaugaugcaaucuuacuaucaggaauacuaaccgucacaaacccaucgaccaaagcaccuuuaucagcaucuaugauagaaagguacgaaaaucaccaaaaagaccuugcgucccucaaacaauucaucaaaaauaaccuaccagaaaaauacgaugaaguguuuuccgaccagucagaagaugguuacgccggauacaucgaugguaaaaccacccaagaaacauucuacaaauacaucaaaaaccuauuauccaaauuugaaggagcugauuacuuucuagauaaaaucgaaagagaagacuuucuaaggaaacaaagaacauucgacaauggaucaauuccacaucaaauccaccuacaagaaaugaacgcaauucugagaagacaaggagaacacuauccauuccucaaagagaacaaagagaaaauagagaaaauacucacauuuaggauaccauauuacguaggcccacucgccagaggaaaucgagacuuugcauggcuuacacgcaauucagaccaagcaauaagaccauggaacuuugaagaaaucguagacaaagccucaucugcagaggacuucauuaauaaaaugacaaacuaugaccucuaccuccccgaagaaaaaguuuuaccaaaacauagucuccuauaugaaacuuucgcuguauauaaugaauuaaccaaaguaaaauuuauagccgaaggacuuagagauuaccaguuccuagacuccggccaaaagaaacaaauaguaacccaacuuuuuaaagaaaaacgcaaaguuacagaaaaagauauaauacaguuccuacauaacguggacggcuaugacggaauagaauuaaaaggcaucgaaaaacaguuuaaugcaucucuaaguacguaccaugauuuauuaaaaauaauaaaagauaaagccuucauggacgacgcuaaaaacgaggcaauauuggaaaacauaguacauacccuuaccauauuugaagauagagaaaugauaaaacaaagauuggcccaauaugacagucuauuugaugaaaaaguaauaaaagcacuaacacggcggcacuauacaggaugggggaaacuuucagccaaacuaauuaacggaauaagcgacaaacaaaccggcaacacgauacucgauuauuuaauagacgauggagaaauuaauagaaauuucaugcaauuaauaaaugacgacggcuuaucauuuaaagaaauaauacaaaaagcacaaguagucgguaaaacaaacgacguaaaacagguugugcaagaacuaccaggaucgccagcaaucaagaaagguaucuuacaaagcauaaaaaucguagaugaauuaguaaaaguaaugggacacgccccagaaaguauagucaucgaaauggcaagagagaaccaaacaacagcuagaggcaagaaaaacucccaacagagauacaaacgaauagaagauuccuuaaaaauucucgcaucaggacuaaauagcaaaauccucaaagagcacccuaccgauaacauacaacuacagaaugacagauuguuuuuauauuauuuacaaaacggaaaagacauguauacaggagaagcacuggacauaaaucaacuuaguucuugugauauagaccauauaauaccacaggcuuucauaaaagaugacagccuggauaaucguguacuaacuagcagcaaagacaacagaggaaaaagcgauaauguaccaagccuugaaguggucgacaaaaugaaaguauuuuggcaacaacuauuagacaguaaacuuauaucuuaccgaaaauucaauaaccugacuaaagcagaaagaggaggacugaaugaacucgacaaaguagguuuuaucaaacgccaacugguugaaacacgacaaauaacaaaacauguagcccaaauccuugaugcacgauucaauaaggaaguaacggaaaaagacaagaaaaaccggacugugaaaauaauaacauuaaaaagcaaucucguuaguaacuuuagaaaagaguuugaacuuuacaaagucagagaaauaaaugacuaccaucaugcucaugacgccuaucuaaacgccgucguagcaaaagcgauacugaagaaauauccaaaauuagaaccagaauuuguuuacggugauuaccaaaaguaugaccuaaaaagguacauaucaagaagcaaagacccaaaagaaauagaaaaagcaaccgaaaaauacuucuuuuauucaaaucuacucaacuucuuuaaagaagagguccacuacgcagauggaacaauugucaaacgagaaaacauagaguacucaaaagacacaggagaaauugccuggaauaaagaaaaagacuuugcaacaaucaagaaaguacuaaguuuaccccaagugaacauugucaagaaaagagaaguucaaacugguggauucucgaaggaauccauacuaccaaaaggaaacagugauaaacucauaccaaggaaaacaaaagauauccuuugggacacaacuaaauauggcggauucgacucaccaguaauugcuuauucaauucuacucauagccgauauugaaaagggaaaagcaaagaaacucaaaacaguaaaaacccuaguuggaauaacaauaauggaaaaagacgcauucgagaaaaacccaauagcauuucuagaaaacaaaggauaucauaaugucuguaaagaaaauauauuaugccuuccuaaauauagcuuauucgaauuagaaaacggucgaaggagauuacuagcuagugcuaaagaguugcaaaaauguaaugaaauaguucuaccggucuaccuaacgacacuauuauaccacagcaaaaauguacacaaacuagacgaacccgggcaucuagaguauauacagaaacacaggaaugaauuuaaagaccuguuaaaccucguaucagaguucucucaaaaauacguacuugcagacgcaaaccuggagaaaaucaaaaacuuauacgccgauaaugagcaagcagauauagaaauccuugcuaacuccuuuaucaaccuccuuacauuuacugcccuaggagccccugcagcauucaaauucuuuggaaaagacguagauagaaaaagauacacuaccguaagugaaauacuaaaugcaacacuaauacaccaaucaauaacuggcuuauacgaaacaagaaucgaucuaaguaagcugggagaagacuga

SEQ ID NO: 8953 - RNA, 4116 nt, Artificial Sequence
  Cas9 variant
augaaaguaaauaacuaccauaucgggcuagauaucggaacaucuuccauaggauggguugcaaucggagaagacgguaaaccacuaagaauaaaaggaaaaacagcaauuggagcucgcuuauuucaggaagguaaucccgccgcugauagacgcauguuuagaacaacuagacguagacuaucccgaagaaaauggagacuaaaacucuuagaagagaucuuugaucccuacauaacaccagucgauagcacguucuuugcucgacuaaaacaaucaaauuuaucaccuaaagauaguagaaaagaauuuaaaggcucaauguuauucccagacuuaacugauaugcaauaccacaaagacuacccuacaauauaccaucuccgacacgcauuaaugacacaggaugaaaaauuugacauacgaaugguauaucuggcaauucaucauauaguaaaauacagaggcaacuucuuaaacagcacaccuguagauucauucaaagcaucuaaaguaaacuucguagaucaauucaaaaaauuaaacgaacuguacacugcgaucaaccccgaagaaucauuucagauaaauuuagcaaacagcgaagauaucggacaucaauuccucgacccaucaauacgaaaauucgacaaaaaaaaacaaauuccaaaaauagucccugucucuguagacgacaaagccacagauaaaauuaauggcaagaucgcauccgaaauuaucaacgcaauacucgguuauaaauccaaacucgacguaguagugcagugcacuccuguugacucaaaaaguugggccuuaaaauuugacgaagaagauauagaugcaaaacugcagaagauauuaccagaaauggaugaaaaccaacaaaguauaauagcuauacuccagaaccuauauucucaaguaacucuaaaucagauuguacccaauggcaugucacucagugagucuaugauugagaaauacaacgaucaccaugaccacuuaaaauuauacaaaaaaauaauagaucagcuggccgauccgaaaaaaaaagcagcucuaaaaaaagccuauucgcaauacguuggagacgauggaaaaguuauagaacaggcugacuucuggaguucgguaaaaaaaaacuuagaugacucggaccuuucuaaacaaauuauggacuuaauagaugcagaaaaauuuaugccaaaacaaagaacaagccaaaauggagucauaccucaccaauuacaucaacgugagcucgacgaaauaaucgaacaccaaaguaaauauuauccaugguuagcagagaucaauccgaacaaacacgaccuacacuuagcaaaguauaaaauugaagaacuaguagcauucagaguuccguacuacguaggaccaaugauaacaccagacgaucaagcgaaaucagcagaaacaguauuuucauggauggagaggaaaggaaaagaagcugggcaaauuaccccauggaauuucgaugagaaaguagauagaaacgcguccgcuaaucgauuuauaaagaggaugacuacuaaagauacuuaccuaauuggagaagacguacuacccgacgaaucauuacucuacgagaaauuuaaaguucuaaacgaacucaacaugguacgagucaauggaaaauuauugaaaguagcagauaaacaagcuauauuccaagaccuauucgaaaauuacaaacacauaucaguaaaaaaacuucaaaacuauauaaaaucuaagacuggacuaccgucagauccugaaauuucuggucuaucugauccagaguacuuuaauaauagucuaggaacauauaaugauuuuaaaaaauuauucggcaacaaaguugaugaaccagaccuucaagacgauuucgagaaaaucgucgaauggucgacaguauuugaagacaaacgaaucuuacgagaaaaacuaaaugaaauaacaugguugucugaucaacaaaaagacguucuagaaucuuccagauaccagggauggggaagauuaucuaaaaaauuacucaccggaauaguuaacgaccaaggagagagaauaauugaugaacuauggaauacuaauaagaacuucaugcaaauacaaucagacaacgauuucgcaaaacgaauccaugaggcgaaugcagaucaaaugaaagcaguugacguagaagacgucuuagcagaugcguauacaaguccacaaaacaagaaagcuauaagacaaguaguaaagguaguagaugauauacaaaaggcgauggguggaguagcacccaaauacauaucaauagaauuuacucgaagcgaagacagaaacccucgaagaaccauaucgagacaaagacaauuagaaaauacccuaaaagacacugcgaaaucccuagccaaaaguauaaauccugaguuauuaucagaguuagauaaugcggcuaaaucaaaaaaaggcuuaauagauagacuauaucucuacuucacacaauuagggaaagacaucuacacaggcaaaccaauaaauauagaugaaaucucaaccuaugauauagaccauauacucccucaagcuuucgucaaagacgauaguuuaaauaacagaguacuagucucuaaagcaauuaauaacggaaaaucagacaaugucccaguccaauuauucggcgcaaaaaugggacacuucuggaaacaacucgccgaggccggucuaauauccaaaagaaaacuaaaaaaccuacaaacagaucccgauacaauaagcaaauaugcaaugcauggcuuuauaagaagacaacuaguagaaacuucucaaguaauuaaguuaguagcuaacauucuuggugacaaauaucgcaaugacgacacaaaaaucaucgaaauuaccgcaagaaugaaucaccaaaugagagaugaauucggauucauaaaaaaccgagaaaucaacgacuaccaccacgccuuugaugccuaccuaaccgcuuucuuagggagauacuuguaucauagauacauaaagcuaagaccauauuucguuuacggcgauuucaaaaaauuuaaagaagauaaaguaacaaugcgaaacuucaauuuccuacaugaucucaccgaugauacacaagaaaaaaucgcggacgcagaaacaggagaagugauaugggauagagaaaauuccauucagcaauuaaaagacgucuaccauuacaaauucaugcuuauaucacaugaaguuuacacacuuagaggagcaauguuuaaccaaaccguuuauccagcauccgacgcuggcaaaagaaaauuaaucccaauaaaagcugaucgcccuauuaacguauaugggggauacuccggguccgccgacgcauacauggcaauaguaaggauccacaauaaaaaaggagauaaauauagaguaguaggaguucccaugcgagcaagagauagauuggaugcggcaaagaaagucagcgacgccgacuacgaccgggcccucaaagacguacucacaccucagcuaacaaaaacaaaaaaaagccgcaagacaggagaaauaacacaaguaguagaagacuucgaaauaguucuugguaaaguaauguauagacaacuaaugauagacggagauaaaaaauucaugcuaggcucgucaaccuaucaauauaaugcuaaacaacuuguacuuucagaccagagugucaaaacauuagcgucaaaaggaagacuagacccacuccaagaaagcauggauuauaauaacguauacacagaaauauuggauaaagucaaucaauacuuuuccuuguacgauaugaacaaguuuagacacaaacuaaaucuagguuucucaaaauucauaucauuccccaaccacaauguauucgacgguaauacaaaagcaucaagcggaaaacgagagauauuagaagaaguacuaaacggacuccaugccaacccaacauuuggcaacuuaaaagacauaggaaucacaacaccauucggucaauuacaacaaccaaacggcauccucuugagcgaugaagcaaaaauuagauaccaaucccccacaggacucuucgaaagaacuguaucauuaaaagauuuauga

SEQ ID NO: 8954 - RNA, 4116 nt, Artificial Sequence
  Cas9 variant
augaaggucaauaauuaucauaucggccuagauauagguaccucaucaaucggguggguagcgauuggaaaagacggcaaaccccuacgaguaaaaggaaaaacagcuauaggcgcacgauuguuucaagaagguaacccugccgcggaccgacgaauguucagaacaacacgaagacgucuaucaagaagaaaauggagacuuaaauuacuggaagaaauauuugaucccuacauaaccccagucgauucgaccuucuuugcaagauuaaaacaaaguaaucuuaguccaaaagauagccgaaaagaguucaagggaucaaugcuauuuccggaccuuacagauaugcaauaucacaaaaauuaccccacaauauaucaucuaagacaugcucucaugacacaagacaagaaauucgauauacgcaugguguacuuagcaauccaccacauagucaaauaccgaggaaacuucuuaaacucaacaccaguugacucguuuaaagcaagcaagguagacuucguagaccaauuuaagaaacuuaacgaacucuaugcggcaauaaauccagaagaaucauucaagaucaacuuagcuaacucagaagauauuggacaccaauuucuagauccuagcaucagaaaauucgacaaaaagaaacaaauaccaaaaauugucccagucaugaugaacgacaaaguaacagacagauuaaacgguaaaauagcuagcgaaauuauacaugcuauacucggcuacaaagcgaaacuagauguaguuuuacaaugcacgccaguagacucaaagccuugggcacucaaauuugacgacgaagauauagaugccaaacucgagaaaauauuaccggaaauggacgaaaaccagcaaucaauuguggcaauauuacaaaaucuuuauucucaagugacacugaaccaaaucguuccuaacgguaugagucucagugaaagcaugaucgaaaaauacaaugaucaucacgaccaucuaaaacuuuauaagaaacuaauugaucaacuugcugaucccaaaaagaaagccguacuaaagaaagcauacucacaauauguaggcgacgauggaaaagucaucgaacaagccgaguucuggucaucuguuaagaaaaaccuagacgauagcgaacuaagcaaacaaauaauggaccucauagaugcagaaaaauuuaugccgaaacagagaacaucacaaaacgguguaauaccgcaucaacuccaccaaagagaacuagaugaaauaauagaacaccagaguaaauauuaccccuggcugguagaaaucaauccaaauaaacacgaucuccauuuagcaaaauacaaaauagaacaacucguugcauuuagagucccuuacuacguugguccaaugauaaccccgaaagaccaagcggaaagugcagaaacuguauucaguuggauggaaagaaaaggcacugaaacgggccaaauaacgcccuggaauuucgacgaaaaaguugaccgcaaagcaucugccaacagauucaucaaaaggaugacuacgaaagauacuuauuuaauaggagaagacguacuacccgaugaaucauuacucuacgaaaaauucaaaguacucaaugaacucaauauggucagaguaaacggaaaacuacuaaaaguagcagauaaacaagcaauauuccaagaccucuucgaaaacuauaaacacguuucaguaaagaaacuccaaaauuacauuaaagcaaaaacaggauuaccgagugaucccgaaauaucgggccuaagugaccccgaacacuuuaacaauaguuuaggaacauacaaugauuuuaagaaacuauuugguagcaaaguagaugaacccgaccuucaagacgacuuugagaaaaucgucgaauggucaaccguauucgaagauaagaaaauacuaagagaaaaauuaaaugaaauaacauggcuuuccgaucaacaaaaagacguacuagaauccucgagauaucaaggauggggucgccuuaguaagaaacucuuaacuggaaucguuaaugaccaaggagaaagaauaauugacaaauuauggaauacaaauaaaaacuucaugcaaauacaaagugaugacgacuuugcuaaacgaauacacgaagcaaaugcugaucaaaugcaggcuguagaugucgaagacguguuagcagaugcauacacaucuccacaaaauaagaaagcaauuagacagguaguaaaaguaguugacgauauacaaaaagcaaugggagguguagcaccaaaauacauaaguauagaguucacacgcucugaagacaggaacccaaggcgaacaauuucacgacaacgacagcuagaaaacacacuaaaagauacugcaaaaucacuagcuaaaaguauuaauccagaauuacuguccgaauuagacaaugcagcuaaaucuaagaaaggucuuacagaccgacucuaucuguauuucacucaauuggggaaagacauauacacaggagaaccaauuaacauagacgaacucaauaaauacgacaucgaucacauauuaccacaggcuuucauaaaagauaauagcuuagauaaucgcguauuagucuuaacagcaguaaauaacggaaaaagugacaauguaccacucagaauguucggggcaaaaaugggccacuuuuggaagcaauuagcagaagcagguuuaauuucaaaacgcaaacuuaaaaaucuacaaacagauccagauacaauaagcaaauaugcaaugcacggguucauaagaagacagcuaguggaaacuucacaaguaauaaagcuagucgcuaacauacucggagauaaauaccgcaaugacgacacuaaaauaauugaaauaaccgcaagaaugaaucaucaaaugagagacgaauuuggauuuaucaaaaauagagaaauaaaugauuaccaucaugcuuucgacgccuaucuaaccgcuuuccucggcagauauuuauaccaucguuauauaaaacucagaccguacuuugucuacggagacuuuaagaaauuccgagaagauaaagugacuaugagaaacuuuaauuuccuacacgaucucacagacgacacgcaagagaaaauagcggaugcagaaacaggugaaguaauaugggauagagaaaauucaauacagcaauuaaaagacguauaccauuacaaauucaugcuaauaucacaugaaguauacacucuacggggugcaauguucaaccaaacugucuaucccgcaucggacgcagguaaaagaaagcucauuccuguaaaggcagacaggccagugaacguauaugggggauauagcggaagcgcugaugcauacauggcgauaguacgaauacacaacaagaaaggagacaaauacagaguuguaggagugccuaugagagcucuagauagauuagaugcagcuaaaaauguaagcgaugccgauuuugacagagcucuaaaagacgugcuagcuccacagcucacaaaaaccaagaaaaguagaaaaacaggagaaauuacacaagucauagaagacuucgaaauaguucuaggcaaaguuauguaccggcaacuaaugauagauggugacaagaaauucaugcugggaucaaguacuuaccaauacaacgcaaaacaacucguccucucagaucaaagcguaaaaacacuggcaaguaaagggaggcuagauccacuccaagaaaguauggacuacaacaacguauauacagaaaucuuagauaaaguaaaccaauauuuuaguuuauacgacaugaacaaauuuagacacaaauuaaauuuaggauucaguaaauucauauccuuuccaaaucacaaugucuuagacggaaacacaaaaguaaguucgggaaaaagagaaauacuccaagagauccugaacggacuacacgccaauccuacauucggaaaccuaaaagacguaggaauaaccacaccauuuggacaacuccaacagcccaauggaauacuucuaucagacgaaacgaaaauucguuaucaaaguccgacaggucuuuuugaaaggacugucucacuaaaagaucucuga

SEQ ID NO: 8955 - RNA, 4116 nt, Artificial Sequence
  Cas9 variant
auggauaagaaauacucaaucggauuagacauaggaaccaauucaguagggugggcagucauuaccgaugacuauaaaguaccguccaagaaauucaaaguacuaggaaacacagaccggcauaguaucaagaaaaaccuaauaggagcauuauuauucgacucaggugaaacagcagaagcuaccagacuaaaacguacagcgagaagaagauauacucgaaggaaaaacagaauauguuauuuacaagaaauauuuaguaaugaaauggcuaaaguagaugauagcuucuuucaucgacuagaagaaucguuccuaguugaagaagauaagaaacaugaaaggcauccuauauuuggaaacauaguagaugaaguagccuaucacgaaaaauaccccaccauuuaccaccuuaggaagaaacuagcagauaguaccgacaaagcagacuuacgacugauauacuuagcauuagcacacaugauaaaauuccgaggacacuuccuaauagaaggcgaccuuaacccagacaauucugacguagacaaacuauucauccagcuuguucaaaccuauaaccaacuauucgaagaaaacccaauuaacgcgagucguguagacgcaaaagcaauccuaagugcaagacuaucaaaaucacgccgacucgagaacuuaaucgcucaauuaccaggcgagaagaaaaacggacuauuuggaaaccuuauagcauuaucccuuggauugacaccgaacuucaaaaguaacuuugacuuggcagaagacgcgaaacuucaacuaucaaaagauacauaugacgacgacuuggauaacuugcuugcgcaaauaggcgaccaguaugccgacuuguuuuuggcagccaaaaaucuaucagacgcaacgcuucuaagcgauauauuaagaguaaauagcgaaauaacgaaagcacccuuaucagcaagcaugauaaaaagauacgaugaacaucaucaagacuuaacacugcucaaagcccuaguacgacaacaacuacccgaaaaauacaaagaaaucuucuuugaccaaagcaaaaauggguaugcaggauacauagacgggggagccucucaagaagaguucuacaaauuuauuaaaccaauacuagagaaaauggacggaacagaagaacuauuagcaaaacuaaaccgagaagaucugcuacguaaacaaagaaccuucgacaauggaagcaucccacaucaaauacacuuaggagaacuacacgcuaucuuaaggagacaagaagacuucuauccauuccuaaaagacaauagggagaaaauugagaaaauauuaacauuccgcauaccauauuaugucgguccgcuugcacgugguaauucuagauuugccuggaugacaagaaaaagcgaagaaacaaucacaccuuggaacuuugaagaaguuguagauaaaggagcaagcgcucaaucauuuauagaaagaaugacaaacuuugacaaaaaccugcccaacgaaaaaguacuacccaaacacagccuacuauacgaauauuucacuguauacaaugaacucacaaaagucaaauauguaacagaagguaugagaaaaccggcauucuuaaguggcgaacaaaagaaagcaaucgucgauuuacuguuuaagacaaaucgaaaaguaacaguaaaacaauuaaaagaggauuacuucaagaaaauagaaugcuuugauaguguggaaauaagcgguguagaagacagauuuaaugccucacuaggaacauaccacgauuuacuaaaaauuauuaaagauaaagauuuccuagauaacgaagaaaacgaagauauacucgaagacauaguacuaacccucaccuuauucgaagacaaagaaaugauagaagaaaggcuuaaaacauacgcacauuuauucgaugauaaagucaugaaacaacuaaaacgacgccauuauacaggauggggaagauuaagccgcaaacuaauaaacggcauucgggauaaacaaagugguaaaaccauauuagauuuucuuaaaagugauggauucgcuaaccguaacuucauacaacugauucacgacgauaguuugaccuucaaagaagcaauacaaaaagcacaaguaucuggccaaggacauucauuacacgaacaaaucgccaaccucgcuggaagcccugcuaucaagaaaggaauacuucaaucagucaaaguaguugaugaauuaguaaaaguaaugggacacaaaccugaaaacauaguaauagaaauggcacgcgaaaaucaaacgacucaaaaaggacaaaagaauagucgugaaagaaugaaacgaaucgaagaaggaaucaaagaauuaggaucucaaaucuuaaaagaacacccaguagaaaauacgcaacuacaaaacgaaaaacucuaucuauacuaucuacaaaacgggagagacauguauguagaucaagaacuugacauaaacagauuaucugacuacgauguagaucacauuguaccacaaucauuuauaaaagaugacaguaucgauaauaaaguucuaacaagaagcgauaaaaacagaggaaaaucagacgauguuccauccgaagaaguaguaaagaaaaugaaaaauuacuggcgacaacuacuuaaugccaaacuaauuacucaacguaaauucgacaauuuaaccaaagcagaacgugggggacuuucagaauuagacaaagcgggauuuauuaaacgacaacucguagaaacaagacaaauaaccaaacacguagcacaaauccuagacagcaggaugaauacuaaauacgaugaaaaugacaaacucauccgugaaguaaaagugauaacgcucaaaucaaagcuaguaucggauuuuagaaaagacuuucaauucuacaaaguaagagaaauuaacaacuaucaucacgcucaugaugcauaccugaacgcaguagucggaacagcccucaucaagaaauauccgaaacuagaaagcgaguucguguacggagacuauaaagucuaugauguacgaaaaaugaucgcaaaaagugaacaagaaauagguaaagcaacagcuaaaagauuuuucuauagcaacauaaugaauuucuucaaaacggaaauaacgcuagcuaacggagaaauaagaaaaagaccauuaauagaaacuaacgaagaaaccggcgaaauagugugggacaaaggacgugauuucgcaacaguuagaaaaguucuaucaaugccccaaguaaacauagucaagaaaacagaaguccaaacuggugccuuaacaaaugaaucaauuuacgcuagaggcucuuucgacaagcuaauaaguagaaaacaucgauuugaaagcagcaaauauggaggguuugggucaccuacggucacguacaguguucuugucguugcaaaaaguaaaguacaagacggaaaagucaagaaaauuaagacaggaaaggaauugauaggaauaacacuucucgauaagcuaguauucgaaaagaacccccuaaaauuuaucgaagauaagggguauggaaauguacaaauugauaaauguauaaaacuaccuaaguacucacuauucgaauuugaaaacgguacaagacgaauguuagccaguguuauggcaaauaauaauucaagaggggaccuacaaaaagccaaugaaauguuccuaccagcaaagcuagugacacuauuauaucacgcgcacaagauagaaucaucgaaagaacuugaacacgaggcuuacauauuagaccacuacaacgauuuauaucaauuacuauccuauauagaaagauuugcaaguuuauacguagacgucgagaaaaacauuaguaaagucaaagaacuauucaguaacauagaaagcuauucaauaucagaaaucugcagcuccguaauaaaccugcuaacucuaacagcaucaggagcuccugcagacuuuaaauucuuaggaacaacuauaccaaggaaaagguacggaucaccucaaaguauccuaucaucaacccucauucaccaaaguauaaccgguuuauaugaaacaagaauagauuuaucucaacuaggaagugauuga

SEQ ID NO: 8956 - RNA, 4119 nt, Artificial Sequence
  Cas9 variant
augaacaaugaauacuucguuggauuugauaucggcacaaauucuguaggcgcggcagucacagacgaaaaauaccacgucuuaaaauuuaaaggcaacgcaauguggacaagugcuguuuucgaaagcgcacaacaauccgccgauagaagacucaacagaacagcaaggcgaagacuagauagaucccagcaaagaagagacuuauuacaggaauugauugcuccagccauaaccccaguugacccaagguucuuugauagaaucagggaauccgcacuaugggcagaagacaaaacuacagguuccagauuuacauacuuuucagaugaaggauauaccgauaaacaguaucauaaagaauacccaacaauacaucacuuaauuuguucacuaaugaaugacccagcaccacacgauccgaggcuaguguauauagcauguuccuauauguuaacacauagaggacauuuucuaaacgaagcagauaaagagaaaauugaugaugugcuugacauuagaaggguguuuaaugaauuauguagcugguuuacuagcuaugguauugaaguuccauuuucgugcuuuccagaagaguucggcaauguacucaccgcaaacagaggaguacaagacagaacgcgugcauucuacgaccuauuauucgccggcaagaaaccaaaaccaucugaagacgaucagguagacauagauguauuaaucaaacuaauaucuggaggaaaaauagaauuaucuaaacuauuucuuaacgaagaauacucagaacuagaaaacaacaaaauacaacuguccgaugcagguuucgaugaaaaagaaccagaauuaagaagugaacuaggagaugauuuuggacucguggcagcagcuaaaaacaucuacgacuggagcuuacuaacaggaguacuuggagaaugcaaaucaauaucagaagcaaaaguaaaaacauacgaaaaacacucggaagaucuggcugcucuuagaagaguaguaagaaaauaucacccggauaaauauaaagaaaucuucaagaaauacguaguaggaaauuacacaucauacucaggcaauguaaaaucagcgggaaaaaucucagaaacaaaauuaaagagaugcaaucaagccgaauuuugcgauuauuuaaaaaguaaauuaaaggacguaaaaccagcaccaggagacgaugaaugcgaaagaguauuaaaagaaauaaguaaacauacguucugcccuagacaaguaacuacagauaaccgaguaauacccuaucaacuuuauuauacagaacuaaagaaaguuuuagaaaaugcaaaaagauauaucccucaacuaaacguaacagaugaguacggaagugcagcagacaaaauauuaucauugaugacauuucgaauaccauauuacgugggcccccuaguaaagaaaaaugacagcaguaaugccuggauaguccgaagaggagaggguagaauuuuaccauggaauuucgacgagcuaguggacaaagauaaaugcgaagacgaauuuauacgccgaaugacaugcaaaugcacauacauugcagguaaaaacguccuccccaaaaauucauuguuauauuguaaguucaugguucucaacgaaauuaauaacauaaaaaucaauggagaaagaauuagcgucggagauaaacagaaaauuuauacugaacuuuuugaaaagaaaagaaaagucacugugagagauauucggaaccuucuaacaucagagggaagacuaaaagccggagauacguuuggaggaauagacauaacagugaaaucaucacucaaaccacaacaugaccuuaaacguuuaauggcagccggaguuauaacagaggcagaugcagaagaaauaauagaaagaauaaccugcacaaccgacguuagcagauuaagaaccuggcuggguaaauuuggacuaagcgcugcagacgcuaaauacgugagcggacuaaaauauucugauuucggccgacuaagucgcgaguucuuaacggaagucaaugauguggauccagcaacaggagaaguaauaaacccaaacaucauaacgaugaugugggaaaauaauauaaauuuaauggaacuccuuagucaaaaauacaguuacagaucucaaauagaaucgaugaauagagaauacuaugcagcaaacccauugacacuagacgaaagaauguccgaaauguacauaccaucagcaguuagaagacccguaaaacgaacgauagaaaugaugaaagaauacaugcauauaaugagaaaacccccuaaacgaauuuucauagaaauggcacgugaacuuacagacuuggacaauaaagggaaaagaacuuccuccaggcgaaauacauuauuagaguucuuuaagaaauguccucaagauacuacugaacuaagagcgcaacucgaaaagaaaucagacgaugaauuaagaucagaaaaacuauauuuauauuuugcacaacugggaaaauguauguauuccggugaaucgauagauauugaacgacuagguucuaaauuguaugauguagaucauaucuuuccacaagccagaguaaaagacgauagcaucgaaaauaaaguauuaguguugagcgaucuuaacggugcgaaaagcgaccgauaccccauaaaugcagacauccguaauaaaaugcacaguuuuugggauaaacuacauucuaucgggcucauaggggagaagaaauaugaacgacuuacaagaucaacgggauucacagaugaugaauuggcgggauucauaagccgacaauuaguggagacacgacaaagcacaaaagcuguagccgcauuauuagcagaagaauuucccgaauccgaaauaguuuacgugaaagcaggacuggccucacaauuucgccacgaguucggauuauugaaauguagagaaauuaaugauuugcaccaugcgaaagaugccuauuuaaauauaguaaugggaaauauauaucauguaaaauuuaccaaagacccaaugaauuucgucaaagaauacagacgaaaagaacaaguuuuugauuugaaaauucaaaguaugcuuacacaugacgcaauuagaaacggagaaacagcuuggauaggagacggaacuuggcuagaaacaguuaagaaacaaauggaaaagaacaacauaagauauguaagauauucguucagaagaaaaggagcccuuuuuaauuuaaugccagaacggaaaaacccaucacuacuuccucgcaaaaaugguaaaaauauggucuuaccugcggaaaaauacggaggauauaacaauacagccgcaucauuuuucaguuuagucaaauaucauucagcuaaaggaucuggaguggucaucauaccaguugaauuaauacacgcacaucgauaugaacacgacucaaguuucgcugaagaauacgcuuuacgcguucucgcagacaucgugucacucaagaaaggugauguauugcaaucagucgaguucccgcuaggaucgaggauacuaaaaguaaauacucuacuagauauagacggcuuuagagcuaauaucacaggaaaagauucuggaggaaaauaucuaggcauaucgucugccaguagccuaauuauaagucaaguugauacaacuuacauuaaacgcgucauuucaauaaacgaacgaauauccgcaugugagaaaaacaaacaaucauauaccauucgaccagaauuugaugucauaacaagcgaacguaauauagaaaucuacaauauguuaugugagaaaauaucaucucgaccauuuugcauaaaauuugcaaacacaagcgacacuuuuguuucaggaagagaaaaauuuauagcacuaagucuaaaugaacaaguaaaaacauuaacaaauauguuaucuguuuucaaaacaggcagagcaucaggaugcgauuuaacuaacauagggggaaguaaaaacacggcaauaguaaaacuaaaugcaguuuuaucaaaccuuaaagacuuuaaauccguacgaauaauagaccaaagcccuacgggacuauaugaaaaaguuucaccaaauuuacuuagcuuauga

SEQ ID NO: 8957 - RNA, 4119 nt, Artificial Sequence
  Cas9 variant
augacaaagaaaaauuacaguauaggucuagacauaggcaccaacucaguuggaugggcaguaauaacagaugacuacaaaauacccgcuaagaaaaugaaaguacuaggaaacacagacaaagaauauauaaagaaaaaccuacuaggagcguuguuauucgauagcggagaaaccgcagaagccacacgacuaaaacgcacugcacgaagacgcuacacccgaaggaaaaacagacucagauaccuucaagaaauauuugcagaggaaauagcaaaagcagacaacucauuuuuccaacgacuagaugaaucauuccugaccgaugacgauaaagauuuugacucacauccaauauucggcaacaaagcugaagaagaugccuaccaucaaaaauucaguacgaucuaucauuuaagaaaauaucuagcagacucuccggagaaaagugaucuacgcuuaguauauuuagcacuggcucauaugaucaaauaccgaggacacuuccuaauugaaggcgaacuaaaagcagaaaacacagauguacaaaaauuauuuacugauuuuguagaagucuaugauagaacauucgaugauucacauuuaucugaaguaacaguugacgccucaagcaucuuaacagagaaaauaagcaaaucaagaagauuagagaaccuaauagaaucauaucccaaagaaaagaaaaacacauuauucggaaaccuaauugcguuaucauuaggcuuacaaccgaauuuuaaaacaaauuucaaacuuucagaagaugcaaaauuacaauucucuaaagacacauacgaagaagaccuagaagaaguacuugagaaaauuggugacgauuaugcagacuuauucacaagcgccaaaaaccuauaugaugccauccuacucucagguauccuuacaguagaugauaguucaaccaaagcaccauuaucagcaucaaugauaaaaagauaugcagaacaucaugaagacuuagaaaaacugaaagccuuuauuaaaaccaacaaaccaaaccuuuaccaugacauauucaaagacgaaacccaaaacggauaugcuggauacauagaaaacggcguaaaacaagacgaguucuauaaauacuuaaaaacaauccuaucaaaaaccgaugggucagaauacuuuuuagauaaaauugaacgcgaagauuuucuacgaaaacaaagaacauuugacaaugggucgauaccccaccaaauucaucuccaagaaaugcacgcaauuuugagaagacaaggagauuacuaucccuuccugaaagaaaaucaagacaggauagagaaaauacugacauuucguauucccuauuauguaggacccuuggcaaggaaaaacucuagauucgcaugggcagaauaucauuccgaugagaaaaucacaccauggaacuucaauaaaguaauugacaaagaaaaauccgcugaaaaauucauaacuagaaugaccuugaaugaucuuuaucuaccggaagaaaaaguacuaccaaaacauucacacgucuaugaaacauuugcaguguauaaugaauuaacaaaaauaaaauauguaaacgaacagggaaaagaagcauuuuucgauucaaacaugaaacaagaaauauucgaccacguuuuuaaagaaaacagaaaagucacaaaagaaaaacuacuuaacuaccucgauaaagaauuuccugaauauagaauccaagaccuaauaggacuagauaaagaaaacaaaucauucaacgcaagucuaggaacauaccaugaucucaagaaaaucuuagauaaaucauuuuuagacgauaaagucaaugaagaaguuauagaagacauaaucaaaaccuuaacacuauuugaagauagagaaaugauccaacaaagauuacauaaauacagcgauaucuucucaacucaacaauugaagaaauuagaacgucggcauuacacaggaugggggagauuaaguuauaaacuaauuaacgguauaagaaacaaagaaaauaauaaaacaauauuggaauacuuaauagaugacggauaugcaaaucguaauuuuaugcaacuaauuaaugaugauacacuaccuuuuaaacaaauuauaaaagacgcacagauuaucgggaauauagaugacauagcagcaguaguacaugaauugcccggaucucccgcgauaaagaaaggcaucuuacaaaguauaaaaauaguagacgaacugguaaaagugaugggucauaacccagauaacauaguaauagaaauggcaagggaaaaucaaaccacaaacagaggcagaucucaaucacaacaacgacuaaagaaauuacaagauagcuuaaaagaacuaggaagcaacauauuaaacaaaaagaaaccaucuuauguagaagacaaaguagaaaauguccacuuacaagacgaccgacucuuccuuuacuacauccaaaacggaaaagauauuuacacuggcgaagaauuagacaucgacaggcuauccgacuacgacaucgaucacauuaucccacaggcauucauaaaagacgauucaauugacaauagaguauuaacauccucggccaaaaaucgagguaaaagugacgacguccccaaccuagauaucguaagggcaagaaaagcagacuggguaagauuauacaaaagcgggcucauaaguaaacgaaaauuugauaaccuuacuaaaucagaacguggagguuuaacagaagccgauaaagcagguuuuauaaaaagacaacucguagaaacccgccagauuacuaaacaugucgcacaaauccuugacgcccgauuuaacacagaacacgaugaagacgauaaaguaauccgcaacgucaaaguaauuaccuuaaaauccaacuuaauaucacaauuuagaaaagauuucaaauuuuauaaaguucgagaaauaaaugacuaccaucaugcacaugaugccuaccugaaugcaguaguaggaacugcucucuuacguaaguauccuaaacucgcaccagaauuuguauacggcgaauauaagaaauaugacgucagaaaacuaauaaccucaagcucugauaaggcaacggccaaauacuucuuuuauaguaaccuaaugaacuucuuuaaaagaguaguaagauacucgaacggcaggguaaucguuagacccgucaucgaauacagcaaagacacaggugaaauugucuggaauaaagaaacagauuuucgaacaauaugcaaaguucuaucauauccacaaguaaacauagucaagaaaguagaaucacaaacuggagguuucuccaaagaaagcauacuaccaaaaggugauagugacaaauuaauacccagaaaaaccaagaaaguauauugggacacgaagaaauacggagguuucgacucacccauaauagccuauagcgucuuuguaguggcagauguugaaaagggaaaagccaagaaacuuaagaaagucaaggaauuaguggguaucucaauaauggaaagaccaucuuuugagaaaaauccaauaguauuccuagagaagaaagguuauaggaauguacaagaagacacacuaauaaaacuucccaaguacucuuuguuugaauuugaaggaggacgacgaagacuccuugccuccgcaucagaacuccaaaagggcaacgaggucguacugucagaccggcuaguggaacuccuauaccaugcccauagaguaaauaguuucaauaguacagagcacuuaaaauacguauccgaacacaagaaagaguucggggaaguauuaucaugcguugaaaauuuugccaauuccuacguagacguagagaaaaauuuagacaaaauccgcgcagugaucaauaaaauagauaccuuuagcauagaagaaaucuccacaaguuuugucaauuuauuaacacugaccgcacuaggugccccagcagauuuuaacuuccuaggaaagaaaauaccaagaaagagauacacaaguacgaaagaaugcuuaaacgcgacauuaauucaccaaucaauaacugggcuauacgaaacaagaauagaccuaucaaaguuaggagaggauaaauga

SEQ ID NO: 8958 - RNA, 4119 nt, Artificial Sequence
  Cas9 variant
augacaaagaaaaauuacucaauaggucuagacauaggcacaaauucuguuggcugggcuguaauaaccgacgacuauaaaguaccagccaagaaaaugaaaguacuaggaaacacagacaagaaauauaucaagaaaaaccuauuaggugcauuacuauucgacucaggcgaaaccgcagaagcuacacgccuaaaaagaacagcacgcagacgguauacaagaaggaaaaacagauuacgcuacuuacaagaaauauucgcgaaugagauugcaaaaguugaugagagcuuuuuccaacgauuagacgaaaguuucuuaacugacgacgauaaaaccuuugauagucauccaauauuuggaaauaaagcugaagaagacgcauaccaucaaaaauuuccaacaaucuaucaucuacguaaacauuuagcagacucaucagaaaaagcggaccuacgccuaguuuaccuagcucucgcccacaugaucaaauuuagaggucacuucuuaauagaaggugaacuaaaugcugaaaauaccgauguacagaaaauauucgcagacuuuguaggagucuauaacagaacguucgaugacucgcauuuaagcgaaauaacaguagacguugcuagcauccuaaccgaaaagauauccaaaagucgacgccucgaaaacuuaauaaaauauuauccaacagagaagaaaaauacacuauuugguaauuuaauagcuuuagcucugggacuucaaccaaacuuuaaaacaaacuucaaauuaucagaagaugcaaaauuacaauucucuaaagacacauacgaagaagaucuagaagaacuacuaggaaaaauaggagaugacuaugcagacuuauucaccagcgcgaaaaacuuauaugaugcaaucuuacuaucaggcauccuuacaguugaugauaacucaaccaaagcacccuuauccgccucgaugauaaaaagauauguagaacaucaugaagaccuggaaaaacuuaaagaguucauuaaagcaaacaaaagugaauuauaccacgauauuuuuaaagauaaaaacaaaaacggauacgcagguuauauagaaaauggaguaaaacaagacgaauuuuauaaauaccucaaaaauauacuaagcaaaauaaaaauagauggaucagauuacuuccucgacaaaauugaacgugaagacuuccuuagaaaacaaagaacauucgacaauggaaguauaccgcaucaaauacacuuacaagaaaugcaugcuauucuacgccgacaaggggacuacuacccauucuuaaaagaaaaacaagauagaauagagaaaauacuuaccuucagaaucccuuacuacguagggccacuuguaagaaaagacucacgcuucgcaugggcagaauacagauccgacgagaaaauaacuccguggaacuucgauaaagugauagacaaagaaaaaucugcugaaaaauucauaacaagaaugaccuuaaacgacuuauacuuacccgaagaaaaaguacuaccaaaacacagccacguauaugaaacuuacgcaguguacaacgaacuaacuaaaauaaaauauguaaacgaacaaggaaaagaaucauucuucgacucuaauaugaaacaagaaauuuuugaucauguuuuuaaagaaaauagaaaaguaacaaaagaaaaacuacuuaauuacuuaaacaaagaauuucccgaauauagaaucaaagaccuuauaggauuggauaaagaaaacaagagcuuuaaugccagucuagggacauaucaugaucuaaagaaaauacucgacaaggcauucuuagacgauaaaguaaaugaagaaguaaucgaagauauaauaaaaacccuaacccuauucgaagauaaagauaugauacacgaaagauuacaaaaauauucugauauauuuacggcaaaucaacuaaagaaacuagaacgcagacauuacacaggguggggcagacuaucauacaaacuaauaaacgguauaagaaauaaagaaaacaauaaaacaauauuggauuacuuaauagaugacgggucagcaaauagaaacuucaugcagcucauaaaugacgacacauuaccauuuaaacaaauaauacagaaaagccaaguaguaggugauguagaugacauagaagccguaguccacgaucuccccggaucucccgccaucaaaaagggaauccuucaaucaguaaaaauaguagaugaacucguaaaaguaaugggaggaaauccagacaacauaguaauugaaauggcccgagaaaaucaaaccacaaauagaggaagaagucaaucccaacaaagauuaaagaaacuacaaaacucacuaaaagaacuagguucaaacauccuaaaugaagaaaaaccuagcuauauugaagauaaagucgaaaauucccaucuacaaaacgaccaacuuuuucucuacuacauccaaaacggcaaagauauguacacuggcgaugaacuagacaucgaccaccugucagacuaugacaucgaccauauaauaccacaagcauucauaaaagaugacucuauagacaauagaguguuaacaagcagcgcuaaaaacaggggaaaaagugacgacguucccagccuagacauuguaagagcacgaaaagcagaauggguucgacuauauaagucaggauugaucucuaaacgaaaauuugacaauuuaacuaaggccgaacgaggagguuuaacugaagcugacaaagcaggcuucauaaaaagacaauuaguugaaacacgacagauaacaaagcacguugcacaaauccuagacgcucgauucaauacagaacaugacgagaaugacaaagucauucgagacgugaaaguaaucacauugaaaagcaacuuaguaucccaauuuagaaaagacuuugaauuuuacaaaguacgcgaaauaaacgacuaucaccaugcgcaugacgccuaucugaaugcaguaguaggaacggcauuauuaaagaaauacccuaaauuagcaagugaguucguauacggugaauacaagaaauaugacauuagaaaauucaucaccaacaguagugauaaagcaacggcaaaauauuucuucuacucuaauuuaaugaacuuuuucaaaacaaaaguuaaauacgccgacggaacaguuuucgaaagacccaucaucgaaacaaaugcagacggugaaauagcauggaacaaacagaucgacuuugagaaaguaagaaaaguccuaagcuacccccaaguaaacaucguuaagaaaguagaaacacagacaggcggauuuucgaaggaaagcauccuacccaaaggggacuccgauaaguuaaucccccguaaaaccaagaaaguauauugggacacuaagaaauauggaggcuucgacagcccaaccgucgccuacucaguauucgucguggcugacguagaaaaaggaaaagccaagaaacuaaaaacuguaaaagaauuagugggaauuucuaucauggaacguucauucuuugaagaaaacccaguagaauuuuuagaaaacaaaggcuaucacaauauaagggaagauaaacugauaaaacuaccaaaauacagccuauucgaguucgaaggcggcagaaggagauuacuagcaucugccucagaacuacagaaaggaaacgaaaugguccuaccuggauacuuagucgaguuacuauaccacgcucaccgggcagauaauuuuaacucaacggaguauuugaacuaugucucagagcauaagaaagaguucgaaaagguacuaagcuguguagaagacuucgcaaacuuauacguugacguagagaaaaaccuaagcaaaauacgagcuguagccgacaguauggacaacuucagcauagaagaaauaucgaacagcuucauuaaccuacugacacucacugcccuaggcgcuccagccgacuucaacuuccucggagagaagaucccaagaaaaagauacacuucaacaaaagaaugucuaaacgcaacccucauacaccaaagcauaaccggacuauacgaaaccagaauagaccucucaaaacuuggggaggaauga

SEQ ID NO: 8959 - RNA, 4119 nt, Artificial Sequence
  Cas9 variant
augaauagcgacaaacgagaggacuacuaugugggacuagacaugggcacagguagccuaggaggugcaguaaccgacacacaauaucaccuucucaaaguaaaaggaaaagacuucugguucguacgcgaauaugaaacagccaaaucucagcuugauagaagaacacauagaaucgcuaaaaggaggcuacaaagacacaaggcacgaauaggucuaaucagaagcuacuuugcagaggauauccuuaaacaugacccccuuuucuacauacgucaagauaauaguaaauauuaccacgaagauaaagacguacgcuugacaacuaaggacaguauauuugcagauccaggauacggggacaaggaauaucuagaugacaaagaauaucccacaauuuuccaccuucgacaggcccuucuaagagaccaaauaaaagacgaggaaagauacucuagauuucuuuacuuggcaauuauaaacauguucgagcauaggggacauuuccuuuuaaauacagaaaguagcgacuuaaacgcagauaugauaaaagauguaggggagcuaguaaugaacgcgauauguggcguaucagaauacggcucagucaccuacaaagaaauaauagaaauccuggaagacaaaaauaucucuagaacagcaaaaaaagaucaaauagcaaguaaaauagacauuaaaaaauccgaaaaagcucaaauggaaagaauaaaaugucuuugugggauggaagcagaugcaagaguaauguuugaaaucgaagcagacgaaaaaauaaaaauagccuuucaacaagcagcauuugaagaugaaaaagaagaaauagaagcaguaauaggcgaagacagauauuuaaucauugaaaacaugaaacaacuauaugauuacagccaguuacaaaguguccuaaauggauuugacuauuuaucagacgcaagaguacaaauguaugagaaacauaaagaggacuuacacuugcuaaaaaagguauauaggaaaaauuuagacagagaaaucuacgaucguauguuuagaagcggagaagaaggaagcuauugcgcguauuccaacagcaccaacuccguggauagccuagcagaagcuaaaaaauaccgaaggaacaugaagaaacgaucacaaaaagaucucuacgacagaauaaagaaagaucuuaaagaaguucaugacgcugaugcagaugcgauaagaaaggaaauggaacuugagagauuccuaccaaaacaaaucacaggagcaaacggaauuauaccuaaccaaguacacagaaaagaauuaaaaaaaauacuagaaaaugcagaacaccacuuagauuucuuaaaagaaaaggaugaaucaggauauacuguaucagaacgaauacucaugcuuuuuagcuccaauauaccauauuacgucggacccguagggucaggcucaaaaaccggaugggcaaaaauacaggaaagugggcagguacuaccguggaauauggagcaaaaaauagacauagaacaaacauccgaaagauuuauaacgaauuuaaucagagaaugcacguaucucucaggcgagaaggucuuacccaaacaaagccuauuauacgaaaguuauugcguucuaaacgaaauaaacaauuuaagaauacacgguaaacgaauuguaccagaauuaaaacaagacauauauaaagagguauuccaaggguuuagacucggcaaaaaagugacuaaaaaaaauauauguacauaccuaauaaaccgaggacuaauaacugaagaaagugaagucaguggaauagacaaagaaauaaacgcauaucuacccaguuacggaaagauguacggaguauucggugaaagacuccgugaggaggcaguucaagagauugcugagaagauaauuuauuauggcaccauauauggugacgcaaaaaguauguucagaaaaaaauugaaccaauauguaucagauggauggaugaccgaauaccaagcaaaaagaauaucaggauauaaauucaaagauugggcaagacuuagcagaagcauguuauguuuaucaggaugugauaagagcacaggagaaaaaaucucacucauucgagcaaugugggaauauaaucuuaacuuuauggaacugauauacagagaagauuucacauuccaaaaagaguuggaagaaagacguaaagccuuaggaaaaacguuacaagaauuccaguuugaagaucuagaugaauacuacuacagugcgcccgucaagagaaugaucuggcaagcaguacaagcccuaaaagaaauaacucaaauaaugggacacaacccaaaacgcauuuuuaucgagaugacacgaacagaagaagaaaaaggagaacagggcagaaagaauagcagagaaaaacgucuucucaaaauguacgaaucaaucagggacgaaaggaauugggcagcugaaauaaaaaacgcuaacgcuaguggaaagcuuaacucgaagaaguuauaucuauauuacuuacaaaugggacgugaugucuacacaggcgaaccuauugacauugaagaucuuuuugaugacaguagguacgacauagaucauaucuacccaagaagucucacaaaugacaacaacauagaaaacaacuuaguacuaguaucaaaaacaauaaaccaaaaugaaaaaaaaaaugauuacccgguccccgagaaaauacgacgaaacaaaaaaguaagaaauuuauggcacacacuacauaagaugggauucaugaaugacgagaaauacaaucgacugacauccacagaaagauugucggaagaucaacuggcuggcuuuauagcuagacaacuuguagaaacagcacaaggagcaaaagguaucgcugagcuaaugaaagcaauguugccugguacagacauagucuaugcuaaggcaaggaauguaagcgacuuccguaaagaauacaagaugcuaaaaucacgauuagugaaugacuaccaucacgcccaagaugcauaucuaaacauaguugucgggaacguuuauuuuaugaaauucacaagaaauccaaugaacuucguuaaaacagaagccagaagagacggacgaaauuaugacuacaaucuauacaaaauguauagcaaagacauaaucaggaauggagaaaaagcuuggauagcaacaagugaacaaggaccagguacaauaagacuaguaaaagaaacaauggguagaaauaccccgauuauaacaagacaagcauucgaacaaagaggagaauuauuuaauuuacaaccaguaggaaaauauagugcuaaaaaagacaacuauguuccuuuaaagauuaaugacgaaaaaaugcaggacguaucuaaauauggcggcuauacgagccuuaacccauccuauuuuauuuucaucgaacacggaccagaaaaaaaaagaaagaaaugcuucgaaguaauucacagcuauuaugcugcucaaauaaaaacagaaaaagauuuaauagacuuccuacuccaaaagggauacaaaaauccgcgaguuauuaaugcccggauaaagaagaaugcgcuaauaaaauauaauggauauuuuuuauacauaauagggauggacgcaaggaaaaauauugaguuuucaaaugcuacggcaauguguuuaaagaacaaauauauacaauauguuugcaagcuagaaaaaaugaacaaagcuauauuacuuucggaaaaacagaaaacaaauuuacauugggaugaaaaaauaacaugugaaagcaauuuagaacuauaucgugaauuaacagaaaaacacuuacauagcauauaccaaaggcauccgagaucaauagguaaauguuuggcagauggagaaggagcauucaaacuucuagauauagaagagcaaguaaaaauuauuugugauauuguacaauauacuucguuccaaagagguguuuucagucuaaaaguauuaggaggaccuaaagaaguuggucgaauaagaauaaguggcaauaugacagaggcuaaagaaugcaaauuaguaaauuacagcaucacaggaauguauaaaacggagauggauuuacuaaaaaaauga

SEQ ID NO: 8960 - RNA, 4122 nt, Artificial Sequence
  Cas9 variant
auggaaaaaacauauagcaucggauuagacauaggcacaaauucagucggauggucgguaauaacugacgacuacaaaguuccagcgaaaaaaaugaaaguccuaggaaauacagacaaaaaguacauaaaaaaaaaccuauuaggggcuuuauuauuugauucgggcgaaacugcagaaguaacuagauuaaaacgaaccgcccgaagaagguauacaagaagaaaaaacagacuaagauaucuacaagaaauauucgcgaaagaaauggcuaaaguagacgaaucuuucuuccaaagacuggaagagucuuuucuuacagacgaugauaaaacauucgacucacacccaauauuuggcaacaaagcugaagaagacgcguaccaccaagaauuuccaacaauuuaccaccuucgaaaacacuuagcggauaguucagaaaaagcugaccuaagauuaguuuaucucgcacucgcccacaugaucaaguucagaggacauuuccuaaucgaaggagaacucaacgcagagaacacagacauacaaaaacuauucaacgauuucguggaaacuuacgacaaaauagcagaugaaagucacuuaucagaaguugacgcaucaucaauccuuacaaacaaaauaaguaaaucuagacgccuagaaaaccucauuaaacaauauccaacagaaaaaaaaaauaccuuauucgguaaccuaguagcucuaguccuagggcuacagccaaacuuuaagacgaauuuuaaacuaagugaagacgcaaaauuacaauucucgaaagacacguaugacgaagaccuagaagaauuacuaggaaaaauaggagaugauuaugcugaccuauuuaccgcagccaaaaaccuuuacgacgcaauauuacuuucaggaaucuuaacaguugacgacaacaguacaaaggccccuuuaagcgcgagcaugauaaaacgauacgaagagcaucacgaagaucuggaaaaauugaaaaaauuuaucaaagugaacaauuucgacaaauaucaugaaaucuuuaaggacaaaucgaaaaaugguuaugccggauacauagaaaauggaguaaaacaagacauauucuauaaacacuuaaaaaguauaauauccgaaaaaaacggaggucaguacuuccuagacaaaauagaacgugaagacuuucuaaggaagcaaaggaccuuugauaauggcucgaucccucaccaaauucaucuacaagaaaugagagccauacugcgaagacagggcgaauauuacccauuccuaaaagagaaucaagccaaaauugaaaaaauucugacauuuagaauuccauauuacguagguccauuagcaaggaaagauucaagauuugcuugggcaaacuaccacuccgacgaaccaauaacaccauggaacuucgaugaaguaguugauaaagaaaaaagugcagaaaaauucaucacaagaaugacguuaaacgacuuauauuuacccgaagaaaaaguuuuaccaaaacacagccauguguaugaaacuuuuacaguauauaacgaacuaacuaaaauaaaauaugucaacgaacaaggagaaagcuuuuuuuuugacgcgaauaugaagcaggaaauauuugaccauguauuuaaagaaaacagaaaaguaacaaaagcaaaauuacuaagcuauuuaaacaacgaauuugaagaauuuagaaucaaugaucuaauagguuuagauaaagacuccaaaaguuuuaaugccagucucggcacuuaucaugaucuaaagaaaauauuagacaaaaguuuccuagaugauaagacaaacgaacaaauaaucgaagacauaguacucacucuaacacuauuugaagacagagauaugauucacgagagacuucaaaaauauagcgauuucuucacuagucaacagcuaaagaaacuagaaagaagacauuauacaggaugggguagacuaucauacaaacucauaaacggaaucagaaacaaagaaaauaauaaaacuauccucgauuuucugaucgacgacggacaugcgaaccgcaacuuuaugcaauuaaucaaugaugaaucacuauccuucaaaacaauaauacaagaagcacaagucguaggagacgucgacgacauugaagcuguaguccacgaccuaccuggaagccccgcaauaaagaaaggaauuuuacaauccguaaagauaguagaugaacuugugaaaguaaugggagauaaccccgacaacauaguaauagaaauggcaagagaaaaccaaacaacaaacagagaacgaucacaaucgcaacagagacucaaaaagcuacaaaauaguuuaaaagaacucgggucuaauauauugaacgaagaaaaaccaagcuacaucgaagauaaaguugaaaauucccaccuacaaaaugaucaacuguucuuauauuacauccaaaacggaaaagacauguacacuggagaugaacuugauauagaccaucuuucagauuacgauauagaccauauuaucccacaggccuucauuaaagauaauucuauagauaacagggugcucacuuccuccgcaaaaaacagaggaaaguccgaugacgugccuucucuugacauaguaagagcgcgaaaagcggaauggguacguuuauacaaaagcgggcuaaucucaaaaagaaaauucgauaauuuaaccaaagcagaacgaggaggcuuaacagaagccgauaaagccggauucauaaagagacaacuagucgaaacaaggcagauaaccaaacauguggcacaaauucuugacgcuagguuuaacaccaaacgcgaugaaaacgacaaagucauccgcgaugugaagguuauuaccuuaaaaucuaaccuuguuagucaauuuagaaaagaauuuaaauuuuacaagguuagggaaauaaacgauuaccaucacgcacaugaugccuacuuaaacgccguuguaggcaccgcauuacugaaaaaauauccaaaacuaacuccagaauucgucuacggugaguauaagaaauacgauguaagaaaauuaauugccaaauccagcgaugacuacagugaaaugggaaaagcaacugcaaaauacuuuuuuuacucaaaucuaaugaacuucuucaaaacagaaguaaaauacgccgaugguagaguauucgaacguccagauauugaaacuaaugcugauggugaaguagucuggaauaaacaaaaagacuucgacauaguccgaaaggugcugucguacccacaggugaauauagucaaaaaaguagaagaacaaacuguaggucaaaacggcggauuauuugauaauaacauauuagccaaaccugaaaaagacgacaaaaagaaguuauuuccaauuaaaaaaucauugucaaccacaaguuacgguggauacgcacgagccacaaucgcuuauucuauccucauugucucugaauucggcaaaaacaaggaacuaaagcuauuaggacuaccccuacucgacaaagucaaauacgaaaaaaacccgauagcauaucuaaacucuauaggcaucauaaaugucaaaucgauauuuaaacuccccaaauauugccuauucgaauuccaagaaaagaacacaaacuacagaagguacaugguaaguaaccaagaacuaaaaagagccaaccaacuuuuccuaacaugcaaggaaaccgagcugguauacaaauacauaaaaagcgauaaugacaauacucauuuaguagguaacgaaaaaaccauuuuaucaauuuggaacaaacuaguuaucuucauggaacguacaaaacuuauagauaaaaaacuuuucgcuucacuaaagcaauuaaaagacgaaguagauuuaaucaacauuuuagauaugacugccaaaucgcuagacuuuacaaaaauaagcgcugggcaaaaaaagauaacgauuucggauagucuaucguuaccaauuaaacgauggcaauuuagcuccgacgaaaaaauguugaaacagcuaaaaacggccacacuuauacaucagagcguaacgggacuauacgaaacacggauagauuuaagcaagcuaggagaagaauga

SEQ ID NO: 8961 - RNA, 4122 nt, Artificial Sequence
  Cas9 variant
auggaaaaaacauauagcaucggauuagauauaggaacaaauagcguaggcuggucagugaucaccgaugacuacaaaguacccgccaaaaaaaugaaaguauuaggcaauacagauaaaaaauauauaaaaaaaaacuuauuaggcgcccuccuauucgauucaggugaaacugcagaaguaacacgacucaaaagaacagccaggagacgauauacucgaagaaagaacagacuaagauaucuacaagagauauucgcaaaagaaauggcuaaaguugacgagucauuuuuucaacgauuagaagaaagcuuuuuaacagaugaugacaaaacauucgauagccauccaaucuuuggcaauaaagcugaagaagaugccuaucaccaggaauuccccaccauauaccacuugagaaaacaucuagccgacuccucugagaaggcugacuuacgauuaguauacuuagcgcuagcccacaugauaaaauuuagaggacacuuucugauagaaggcgaguuaaacgcagaaaauacggacauacaaaaacucuuuaacgacuuugucgaaacauaugacaaaauugcagaugagucacacuuaucagaaguagacgcuucuucaauauuaacaaacaaaauaucuaaaucuagaagauuagaaaaccucaucaaacaauaccccacagaaaaaaaaaacacacuauuugguaaccugguagcucuaguucucggccuccaacccaauuuuaaaacuaauuuuaaacugucagaagacgcaaaacuccaauuuaguaaagacacguacgacgaagaucucgaagaacuuuuaggaaaaaucggagacgacuacgcagacuuauucacagcugcgaaaaaucuuuacgaugcaauccuccuaagcggaauauuaacaguagacgauaacagcacuaaggcaccauuaucagcauccaugauaaaaagauacgaagaacaucacgaagaucuagagaaauuaaaaaaauuuaucaaaguuaauaacuucgacaaguaccacgaaauuuuuaaagacaaaaguaaaaacggauacgcuggauacauugagaauggaguuaaacaagauaucuucuauaaacaccuaaaaucaauaauaucagaaaaaaauggaggacaauacuuccuugacaaaauagaaagagaagacuucuuaagaaaacaaagaacguucgacaauggaaguauaccacaucagauccacuuacaagagaugagagccauucucagaagacaaggcgaauacuauccauuuuuaaaagaaaaucagaguaaaaucgaaaaaauccuuaccuucaggauccccuacuauguaggaccacucgcccguaagaacucaagauuugcaugggcaaaguaucacucagacgaacccauuacgcccuggaacuucgaugaaguuguggauaaggaaaaaagcgcagaaaaauuuauuaccagaaugacuuuaaacgaccuuuaccuaccagaagaaaaaguauuaccaaaacauucucauguauaugaaacuuacgcagucuauaacgaauuaacaaaaauaaaauacguuaacgagcaaggaaaagaaucauuuuuugauuccaacaugaaacaggaaauuuucgaccacguauuuaaagaaaaccgaaaaguaacaaaagaaaaacuauuaaacuauuuaaacaaagaauuccccgaauaccgaauaaaagaucuaauuggacuugacaaagaaaauaagucguuuaacgccagccuagguaccuaccaugacuuaaaaaaaauuuuagacaaaucauuccuggaugauaaagucaaugaagaaguaaucgaagauaucauaaaaaccuuaacacucuucgaggacaaagacaugauucacgaaagacuccaaaaauauucugacauauucacagccaaccaauuaaaaaaacuugaaagaagacauuauacuggauggggaagauuguccuauaaacucauaaaugggaucagaaauaaagaaaacaacaagacaauccucgauuaccuaaucgaugauggaagugccaacagaaauuucaugcagcuaauaaaugacgauacauuacccuucaaacaaauaauacaaaagagccagguaguaggagacguagacgacauagaagcaguaguacaugaccuaccuggaucuccagcgauaaaaaagggaauauuacagaguguaaaaauaguagacgaacucguaaaaguaaugggcgggaaucccgauaauauaguuauagaaauggcuagagaaaaucaaaccacgaacaggggcagaagccaaagccaacaaagacugaaaaaacuacaaagcagucuaaaagagcucggaagcaacaucauaaacgaggagaaacccagcuacauagaagauaaagucgaaaauucacaccuccaaaacgaucaauuguuccuauauuauauccaaaaugguaaagauauguacacuggugacgagcuagacauagaucaucugucagacuacgauauugaccauaucauuccacaagcauucauaaaagacgacucaauagauaacagaguacugacaucuuccgcgaaaaauagagguaaaagugaugacguaccaucauuagacaucgucagagcaagaaaggcagaauggguaagacuauauaaauccggccugauaucuaaacgcaaauucgacaaccuaaccaaagcggaaagaggcggacuuacagaagccgacaaagcaggauuuauaaaaaggcaauugguagaaacaagacaaauaacaaagcauguagcacaaauauuagacgcaagauuuaacacagagcaugaugaaaacgauaaaguaauaagagaugugaaagugauaacccuaaaaucaaaccuagugucucaauuuagaaaggauuucgaauucuauaaaguaagagaaaucaaugacuaccaucacgcacaugacgccuacuuaaacgccgucguuggcacugcucuauuaaaaaaauauccuaaacuagcuccagaauucguauauggagaauauaaaaaauaugacguacgaaaacucauagcaaaauccucagacgaucauagcgaaaugggaaaagcuacagcuaaauauuucuucuacuccaaccugaugaacuuuuuuaaaacuaaaguaaaauaugcagacggauccguauaugaaagaccaauaauagaaacuaacgcagauggugaaguagucuggaauaaacaaaaagacuucgaaaucauccgcaaaguacuauccuauccgcaaguaaacaucguuaaaaaaguugaagaacaaacaguaggacaaaacggaggacuuuucgacaacaauauacuagccaaaccagaaaaggacgauaaaaaaaaacuuuuucccauaaaaaaaucgcucucgacaaccucauaugguggauaugcaagagccacgauugcauacucuauccuaaucguuucagaauuuggaaagaauaaagaacuaaagcuccuuggacuaccccuccucgauaagguuaaauacgaaaaaaacccaauugccuaucuuaacucaauaggcauuauaaacgucaaauccauauuuaaacuaccaaaauacuguuuauuugaauuucaggaaaaaaacacaaacuaccgucgauacaugguuucaaaucaggaguugaaaagagcgaaccagcuauuccuuacaugcaaagaaacagaacuggucuauaaauacauaaagucagauaacgacaauacccaccugguuggaaacgaaaaaacuauauuaaguauauggaauaaauuaguuaucuucauggaaagaaccaaauuaauagauaaaaaacuauucgccucacuaaaacaauuaaaagaugaaguaaaccucauaaacauacuagacauagcaagcaaaagcauagacuuuacaaaaauaucagcuggacaaaaaaaaauagucuuaaaugauucauuaucacuaccaaucaaacgauggcaguuuaaaagcgacgaaaaaaugcuuaaacaacuaaaugaugccacuuuaauucaccaaucuauaacaggcuuauaugaaaccagaauagaucuaucaaaacuaggagaagaauga

SEQ ID NO: 8962 - RNA, 4122 nt, Artificial Sequence
  Cas9 variant
augaaucuacguagagcuagggauuauucaaucggacuagauuuaggaacuggcucuguagguugggcuguuacagacgcggaaggaaacuuauacucguuuaagggacgacccgcgaugggcuccaggacuuuuccaaacgcagaaccagccuccguagcuagaauaccacgaggucaacgaagaagguacgagagacgaagacaacgaauuaaauuguugcaacaauuuuuuaugagugacauggaaagagucgauccggauuuuuuuacacgacuaaaucaaaguacacuacucgccgaggacaaagaugaacgaauagcuagcugugcauggcccauauucaauucauccgauuuuacggaaaaagauuauuacaaaaaauuuccaacaauuuaucaccuccgagcauuccuaugugagagugaugaaaaaggugacuugagguuaguauaucuggcgcuacauaacauagugaaacaucgaggcaauuuucuauaucaggacaacccugcuuuauccgcaucagacgccuccguagaugaagcaguaaggcaacuuguugaugcauuagcagaguggugucaaaauaaagagauagaacucucaugugaugccggaagaauaauagaaguuuuuggggaugcgagccuaaggagaacggacaaaagagaucaguuaaaaggauuguuaggauuacccgcagacuuagcuaaaacaaugggaaaggaacuggcaucugcaguuuuagguuaugcagcuaacuuuucaaaaauauuuuuaauaucagaugccgaacauaaauuuuccuuaggaaacgaugagaaaguugaagaauuugagaccauauguccaaacgagugcacgucacuauuuagcgcacuacguacggcauauagugccuaucuacuaucgggaauacuaagagaugcaaaugggaaaacacucaguuuuuguaaaaaaaaagaguacgauagauaucaugaugauuuggcacuauuaaaagcucuaguccgagaguacgcaccggaaagcuaucaaucuuuuuuuggaggcgagagauugguaguuaacggucguaugaccaagagauaugacccuacuaaagcuaaagguuauacgaaauaugacuuaguacauucagcuggaucguaugaugagcuugcuaaagauguaaaaaaauuauuaggcagcuuggcagcugaugauucacgauaucaacgaaugaugcaagccuuugaugaagaacguuuucuaaggcgacuuaaaaccucagacaauggauccaucccauaucaauuacaucuagaagaauuaagagcaauaauagcaaggcagggagaguucuacccuuuccuaaaagaagaaucaaaaaaaaucgaaucuuugguuucguuuagaaucccauacuauguagguccacuaacaacaaaaaaugcagcuguugauguccauggaaacaaacguuuugcauggagugaaaggaagccaggaauggagucagcuaaaguaagaccauggaauugggacgauguuaucgaucguggcaaaagcgcagaaaauuuuauuguaagaaugacagggaccuguacuuauuuacaaaacgagaaaguccuaccaaaaugcucacuauuauaugaagaauucugcguauugaaugaauuaaacggugcucacuggucagcagacggugaccaugaauguccguuugauacaucagauagaagaggaauaguacaagacuuauuuugcggaaaaaggagaguuucauauaaacaagucgaggacuggcuaaggcagcacggaucuagaagagcucgcguuagugguggucaaggagccucaggcuuugaaagcaaaaugucaaguuacauuuuuuucucaaaagacguauuacauguagacagaaucgauccugcagauuuuccuaugauugaagaaauaauacucuggaauacguuauucgaagauagagacauccuuaaagaaaggaucgaagaagcauauggugacagacugaacgcagaacaaaucaagacuauaugcaaaaagagauucacagguugggggagauugagcaggaggcuccuaacaggcaucaaagcccaaacugaucaaggagacuuaagcauaauggacauuuugcgcgaaggugauccuaauaaugaccacagaggaaaagcuaugguuuuuaugggaauucuccauucugaagacuuaggauuccaaaaaaaaauagaucaaauaaaccaagagaaaguaucggcaggaaaaguaucccuugaagacuuaccugggaguccggcacuacgaagauccauaaaccaggccaugaggguaguagaugaaauaguauccauagcuaaaugcccuccaucucauauauauuuagaagucacacgugacgaagauggagcaagaaaaggacgacgcucaacaagaagauaugacgccauaaaagcagcacucgaaaaauuuaaagaagagagcccaacaugguuugaccaagauguguucggagaauuuagacguucaagagcagaagacuuggaugagagacuuagucuauauuuuaugcaaggaggaaaaucgcucuauuccgcaacaccauuaaaacucgaacuauuacauacgaaucaauaccaaguagaucauauuaucccacaaagcuauaucaaagaugacuccuucgaaaauaaagcuuuaguauuagcaggugaaaaucaacgaaagagugacgcccuacucauagauucaucaauaaggaccgccauggcaccuuauuggcgcgcacuccaucaagcaggcuuaaugggugacaaaaaauuuaauuccuuaaugugcuccaguaucagugauaaaagaguaagaggauuuauagcaagacagcugguagaaacaagccaaauaguaaaacuagcgggcaugaugcuacagucaaacuauccagaagcagacguucaaccaguaaaagccagccuaggucaugauuuacgaguucaagccgguuuuauaaaaugcagagaagucaaugauuuucaucaugcacaugaugcacuuauugcaugugaaguaggucgauauauaaaccaaugucaccccggcauauaugauaacccaauaggcuaugcaagagccguaagagaguuaguaagaaaacaaaaugaggaaaugagaaaauauggacgacuaccaggauccgcaggcuuuauagugggaggguucaugagaacacauguugaugucgauacaggagaaguaguaugggaugcugaagaagaacuuagcaggauacgcgcauaccuagacuauucaaacguauuuguaacaagaaugucagaagaaacaaguggagcauuguggaaugcuaccauauacucaccacacuauggaaaaacagcaccaacuuuacacaucaaacaaggucuagacguacagagauauggagguuacucaagcgcaaccuuugcauacuuuacccuuuaugucgcagaaaaagguaaaaaaagaaaagcagaauuauuagggauuccaauauccguugcacgaaaaauagagggugaaccgagcaaauuagaugccuuugucgcucaagaugcagaagcgaaaaaacuaaaacauccauuaauaauaagagcuagaauauuaaaauacgccagauuugaaauggaaggaaaucaguuuuauuucgccgcacaagaugcaguuuauagcgcaagacaauugguacuaaaaggcgauuuguauaguguugcugcaaaagcaugcgacaaacauuuaaacgauaguuguauuucaaaugaagaucuaauaaggcuguaugaugaauuaguacacaaaggagaucuccuuuguaauaaauuugguaacguaacagacguucuacgagcagguagagaaagauacgcaggccuaucuauaucagaaaaacgacaauuagucuguaauguauuagcuuauuacagaagugcaacugcuaggguggauauaucacuaguagguggucccaaacacgcagguaaucuagguauagcauuuguguugaacaacccagaagccauaguauucguagaucaauccguaacagggauguuugaaaagagaaccagaguagaacuauga

SEQ ID NO: 8963 - RNA, 4122 nt, Artificial Sequence
  Cas9 variant
augaaaaaaaucuuaggacuggaccuaggaacuaacucgaucgggugggcccucguaaacgaagcugacaacgaaagagaaaagucaucaauuaucaaaauaggaguuagaguuaacccacuaaccguagacgaacaacagaacuuugaaaaaggcaaaaguauaacaacgaacgcagacagaacacuaaagagaagcaugagacgaaaucuacaaagauuuaaacuacgcaaagaaaaccucauugaaauuuuaaaaaaacaaaaauucauaaaugaugagaccauccucagcgaaaauggaaacaaaucaacauucgagacuuauaauuugcgagccaaaucugcaaccgaagaaauaaccuuagaacaauucgcacgaguauuguugaugauaaauaaaaagcgaggauacaaaucguccaggaaagcuaaaucacaagaugaaggacaauuaauagauggaauggaaauagcaaaaaaacucuauaacgacaaucucacuccaggacaauucguauuucaaauacuaaaagaaggcaaaaaauacauacccgacuucuaccgcagugacuuacaggcugaauucgacaaaauauggagcuuucaaaaacaauucaacccagauauauuaacagaagaauuuaauaaacaaauaauagggaaaggaaaagugaauacaaccaaaauauuucuagccaaauacggaauauacaccauagacaacaaaggagcagacaaaaaaucacaggcauacaauuggagggucgaagcauuaacuaaccaauuaacaaaagaagaauuagcauucgugauuucagacuuaaacggcauaaucaguaauucaucaggauacuuaggaucaaucucugaccgcucaaaagagcuauacuucaacaaacaaacaguaggacaauaccuaauagcacaacuaaaagaaaacccucacacacaauuaaagaaccaaguauucuaucgccaagacuaccuagaugaauucaauaccauuugggaaacucaagcaaaauuccacaaagaacuaaccaacgaacuaaaggaggaaaucagagauauaaucauuuuuuaucaaagaaaacuaaaaagccaaaaaggacuuauaagcuuuugcgaauucgaaagcaaacaaauagagauaaacauugauggaaaaaagaaacuuaaaaccguagggucgaaagucugccccaaaagcaguccauuauuccaaguauucaaaauauggcaaauccuaaauaacauacaaguaaucgaaaaauccacugggaaauccaaauuucuagaacaagacgaaaaagaaauacuauuuaaggaacuaaacuuuaaagauaaaauaagcaaaacagacgcguuaaaaauauuauacaaaaauuacaaggaauuagauuucaauuucaaggagaacauagaaggcaaccgaacacaggccacauuccuaaaagccuuucaauccauaauagaacucucuggacaugaaguuagugacuucucgaaaaucaaaacagacgagauccucgaaauuguuaccccaaucuuugaaggauuugguuucaacaccaaccuguuacaauuuaacucaaaucuaaaaggaaaagacuucgagaaacaagcgguauaccaauuauggcaccuacuuuauuccuucgagggcgacaauucaaacacuggcaacgagaaauuaauacagaagauuucggaauuauauggguucgaacgcgaguacgcaauaauaauagccaauauaucauuccaaccagauuacggaucccucaguacuaaagcaaucagaaaaauacuuccccacuuaaaagaagggauugaauucucacucgcuugugaauaugcgggauacagacacucuaaaaacucacugacaaaagaagaaaaaaauaagaaaauauuaaaagauaaaauugacaucuuaccaaaaaacucacuacgcaauccaguaguugaaaaaauccuaaaccaaaugauaaaugucgugaacgcaacuauagaaaccuacggcaaaccagacgaaaucagaaucgaacuagcccgggaacuaaaaaaaagcgcaaaagaacgggaagacuuaacuaaugcaauaaacaaguccacccuggaucaugaaaaauacaaagcacuacuacaaaaagaauucgggcuuaguaauguaagucgaaaugacauuauacgauauaaauuauacuuagaacuugagcacaacggguuccacacauuauacucaaacacuuauauugaaccaaauaaacucuuuaguaaagaauuugauauagaacacauaaucccacaaucaagacuuuuugaugauucauuuucaaacaagacaauagaaaguagaagcgccaauaucgaaaaaggcaaugaaacagcauuugacuauguaaguaacaaaaacggugaaguaggauuaaaagacuaccuaaaaaacauagaagaccuauuuaauaauggaaagaucucaaaaacaaaauacaauaaauugaaaaugaaaggugacgaaauaccaagcgacuucauagcucgcgaccuaagagacacgcaguacaucuccaaaaaagccaaaaguauacuugaagaccucguuaaggauguaguaucaacaggaggcaguauaacugacagacuaagagaagacuggcaacuaauugauauaaugaaagaacuaaauugggauaaauacgacaaacucggauugacagaaguaauugaaaacaaugauggucauaaaaucaacagaauaaaagauuggacuaaaaggaacgaucaccgucaucacgcaauggacgcacucacaauagccuuuaccaaaagaaguuauauacaauaucuaaauaaccuaaacgcucguuccgacaaaucaggaagcaucuacggaauagaacaaaaagaacuuuaccgagauaagaacaauaaacuaagguucaaaccacccauaccucuagaugacuuucgagcagaagcuaaaaaacaacuagaaaauacacuuguaagcaucaaagcuaaaaauaaagucgcuacaauaaauauuaacaacaccaaaaaacagggaggagaaaacaaaaaaaaacaguuaacaccaagaggccaguuacaccuagaaaccauauauggcucaauccaacaguauguaaccaaagaagaaaaaguaggagccaacuucaauaaagaauuaauugagaaaguugcgaacaaaaagugcagagaagcacuauuaaaacgacuaauagaauuugacaacgacccaaaaaaagcguucacgcgaaaaaauaguuuaaauaaaaauccacuauacaucgacaccauaaagaccuacaaaguuccagaaaaagucaaaacugucacgacagaaacgauuuacacaauacggaaggacauaaauccugaucucaaaauugauaaaguagucgacaaaaaaaucaaaaacauauuagaacuaagacuuaaagaauucaacggagaugcuaaaaaagcguucagcaaucuagaugaaaaaccaauaugguugaacaaagaaaaaggcauuuccauaaaaaggguaacaaucacaggcaucaguaacgccauagcacuccacgacaaaaaagacaaagaaggaaacuucauuuuagacaaccaaggaaaaaaacaagccgucgauuucguuaauacuggaaacaaccaccauguagcuauuuacaaagaugaaaaagguaaccuacaagagaacgugauaacuuuuuaugaagccgucgaacgagucaaccagggaauucccauaauagauaaaacauacaaacaaaaugaaggguggcaguuucucuuuuccaugaaacaaaacgaauauuuuguuuucccaaacgagaaaacaggauucaauucaaacgaaauagacuuacugaacccagaaaauuaucaucuaauaagcccaaaccuuuuucguguacaaaaaauagcaacaaaggacuacuuuuuuagacaucaccucgaaacaaauguagaaaacauaacaacaacaaaagacuugacauggaaaagacuaggaauaaauggaauaauuaacauacuuaaaguaagaauuaaucacauagggcaaaucguaaguguaggggaauacuga

SEQ ID NO: 8964 - RNA, 4122 nt, Artificial Sequence
  Cas9 variant
augacaaagaaaaacuacagcauagguuuagacaucggaacaaauucaguggggugggcaguuauaaccgaugacuacaaaguaccagcaaagaaaaugaaaguauuaggaaauaccgacaagaaauacauaaagaaaaauuuguuaggagccuuauuauuugacagcggcgaaaccgcagaagccacucgauuaaaaagaacagcaagaagaagauauacacgccgcaaaaacagacuccgauaucuacaagaaauuuuugcugaagaaaugaccaaagucgaugaaucauucuuccaaagacucgacgagagcuucuuacgaugggacgacgacaacaagaaacuaggaagauacccaauauucgguaacaaagcggauguugucaaauaucaucaagaguuccccacuauauaucaucuaagaaaacaucucgcagacucaucagaaaaagcagaucuuagauuaguuuaucuagcacuagcacacaugauaaaauuucgaggccauuucuuaaucgaaggagaauuaaaugccgaaaacacagacgugcagaaaaucuucgcugacuucgugggagucuaugaccgaacguucgacgacucgcaccuaucagaaauaacuguagaugccgcgucuauccucaccgagaaaaucucaaaauccagacgacucgaaaaucuuaucaaauauuauccaacagaaaagaaaaauacacuauucggaaaccuuauagcauuagcuuuaggauuacaaccaaacuucaaaaugaauuuuaaacuaucagaagaugccaaauuacaauuuucaaaagacucauacgaagaagaucugggugaacuauuaggcaaaauuggagacgauuacgcagaccuauucacauccgccaaaaacuuauacgacgcaauacuacucucgggaauacuaauagucgacgacaauaguaccaaagcaccacuaucagcaucgaugauaaaaagauaugucgaacaucaagaagauuuggaaaaacugaaagaguucaucaaagcaaauaaaucugaacucuaccaugauauuuucaaagauaaaaauaaaaacgguuacgcaggauacauugaaaaugguguaaaacaagacgaauuuuauaaauaucucaaaaauacauuaaguaaaauugcaggauccgauuacuucuuagauaaaauagaaagagaagauuuccuuagaaaacaaagaacauuugacaacggaucaauaccacaucagauacaccuacaagaaaugcaugcuaucuugagacggcaaggagacuacuaccccuuuuugaaagaaaaucaagaccgaauagagaaaauuuuaacauuucgaauaccuuauuacguaggcccauuagccagaaaagacucaagauuuucgugggcagaauaucacucagacgaaaagaucacuccuuggaacuucgacaaaguuauagacaaagaaaagucugcagaaaaauuuaucacacgaaugacacuaaaugaucuauaccuaccagaagaaaaaguauuaccaaaacacagucacguuuacgaaacuuacgcugucuacaaugaacuaacaaaaauaaaauacgugaacgaacaagggaaggacucauucuuugacucaaauaugaaacaagaaaucuucgaucauguauuuaaggaaaacagaaaaguuacuaaagaaaaacuacuaaacuauuuaaacaaagaguucccagaauaucgaauuaaagacuuaaucggauuagauaaagaaaacaagagcuuuaacgcgagccuagguacauaccacgauuuaaagaaaauacuugauaaagcguuuuuagacgacaaaguaaaugaagaagucauugaagacauaauaaaaacucuaacacuauuugaagauaaagacaugauacacgaacgacuccaaaaauauucggauaucuucacugcagaccaacuaaagaaauuagaacgccggcacuacacaggauggggacgguuaucuuacaaacuuaucaaugguauaagaaauaaagaaaauaauaaaacuauuuuagauuaccugaucgacgauggaucagccaauaggaauuucaugcaauuaauuaaugaugauacguuaccauuuaaacaaauaauccaaaaaucacaaguaguaggugacguugaugauauagaagcaguuguacacgaccuacccggcagcccagcuauuaagaaagggauucuacaaucugugaaaauagucgaugaauuaguaaaaguaaugggagacaacccagauaauaucguaauagaaauggcucgagaaaaucaaacaacuaacagaggaagaucacaaucgcaacagagacugaagaaacuacaaaacagucuaaaagaacuaggaucuaauauacuaaacgaagaaaaacccaguuauauagaagauaaaguagaaaacucacaccuacagaaugaccaacuauuuuuauauuauauccaaaauggaaaagacauguacacaggagacgaacuagacauagaucacuuaucagacuacgacauagaccauauaauaccccaggcauucaucaaagaugauucuauagacaacagaguccuaacauccucagccaaaaacagagguaaaucugaugacguucccucacucgacauugucagagcaagaaaagcagaauggguacgucuauauaaaagcggacucauaucuaaacguaaauucgacaacuugacaaaagcagaaagaggaggauuaacagaagcagacaaagcaggcuuuauaaaacgccaauuaguggaaacuaggcagauaacaaaacauguagcgcaaauauuagaugcgcgauuuaauacagaguccgaugaaaaugacaaaguaauacgugauguaaaaguuauaacacuaaaaucuaacuuaguuucacaauucagaaaagacuucgaguucuauaaaguaagagaaauaaacgacuaucaccacgcccacgaugcauaucuaaacgcuguaguaggcacggcauuacugaaaaaguauccuaagcuagccagugaauuugucuauggcgaauacaagaaauaugacauacgaaaauucauaacaaacaguagugauaaagcaacagccaaauacuucuuuuauuccaaucuaaugaacuuuuucaaaagggucauacgauauucgaacggaaaaguaaucguacgaccagucgucgaauacucuaaagauaccgaagacauugcuugggauaaaaagaguaauuuccguaccauauguaaaguacuaucauacccgcaagucaacauaguaaagaaaguagaaacucaaaccggagguuucuccaaagaauccauacucccaaagggagauagugauaaauuaauaccacguaaaacaaagaaagcguauugggacacaaagaaauacggcggauuugacaguccaacaguagcauacagcguauuugucguggcagauguagaaaaaggaaaagccaaaaagcuaaaaacgguaaaagaauuaguagguauaucaauaauggaacgcaguuucuucgaagaaaacccaguagaauuucuugaaaacaaaggcuaccacaauauacgagaagauaaacugauaaaacucccaaaauauucuuuauuugaguuugaagguggaaagagaagacuauuagccucagcuagcgaauugcagaagggaaaugaaaugguaauuccgggacaccuaguaaaacuccuuuaucacgcucaacguauaaacucauuuaacucuacgaaauaccuugauuacguaagcgcccauaagaaagaguuugaaaaaguuuuaucaugcguagaagacuuugcaaauuuauacgucgacguagagaaaaacuuaaguaaaauuagagcaguagcugacucaauggauaacuuuagcauagaagaaauaucaaacucuuucaucaaucuacucaccuuaacugcacugggagcgccagccgacuucaauuuccucggcgagaaaaucccgagaaaaagauauacaucgaccaaagaaugucucaaugcaacauuaauccaucaaagcauaacagggcuauacgaaacgagaauugauuuaaguaaaauaggcgaagaauga

SEQ ID NO: 8965 - RNA, 4122 nt, Artificial Sequence
  Cas9 variant
auggaaaauaaaaauuacaguauaggucucgacauagguacuaacagcguaggaugggccgucauaaccgaugacuacaaaguaccaucgaagaaaaugaaaguacuaggaaacacugacaaacguuuuauuaagaaaaaccucauaggagcacuacucuuugacgaagguacaacugccgaagcacgaagacuaaaaagaacagcgagacgcagauauacgagacgcaaaaacagauuacgauaccuacaagaaauuuuugcagaagaaaugagcaaaguagacucaucauucuuucaccgacucgacgauucauuucuaauucccgaagacaagaaagguuccaaauacccgauauuugcgaccuuaauagaagaaaaagaauaucacaaacaauuccccaccauauaucaucuaaggaaacaauuagcagacuccaaagagaaaaccgacuuaaggcuuauauaucuagcucuagcacacaugauuaaauauagaggacauuuucucuacgaagacacuuuugauauuaaaaauaacgacauacagaaaauauuuaaugaguucauaaguauauauaacaacacuuucgaaggaaauagccugagcggacaaaacguccaagucgaagcaauauuuacugacaaaauaaguaaaagcgccaaaagagaacgaguccuaaaacucuucccagaugaaaaaucaacaggacuauucagcgaguuccuaaaauuaauaguaggaaaucaagcugauuuuaagaaacauuuugaccucgaagaaaaagcaccucuccaauucucgagagauacguacgacgaagacuuggaaaaucuauuaggacaaauaggagacgacuucgcagaucuuuucguagcagccaagaaacuauaugacgcuauauuauuaagcggaauauugacugucacugacccaucaacuaaagcaccacuaucugcaaguaugaucgaaagauacgaaaaccaucaaaaagaccuugccacucuuaaacaauuuauaaaaaccaacuugccggaaaaauacgacgaaguauuuagugaccaaagcaaagauggcuacgcaggauacauagaugguaaaaccacacaagaaaguuuuuacaaauacauuaaaaaccuacuaaguaaauucgaaggugccgacuacuuucuagagaaaauagaaagagaagauuuucugcgcaaacaacguacauucgacaaugggucaauaccacaucaaauacaucuccaagaaaugaacgcaaucuuacguagacaaggcgaacauuauccauucuuaaaagaaaauaaagagaaaauagagaaaauucuaacguuccgaaucccuuacuacgucgguccacuggcccgcggaaaucgagacuuugcauggcucacccgaaacuccgaucaagcuauuagaccauggaacuuugaagaaauaguugacaaggcuuccagugccgaauccuucauaaacaaaaugaccaacuacgaccuguaccuucccgaagaaaaaguacuaccgaaacauagcuuacuauaugaaacuuucgcuguauauaaugaacuuacaaaaguaaaauuuauagcagaaggccuaagagauuaccaauuucuagauucgagacaaaagaaagauauauuuuacacacuauuuaaagcagaagacaaaagaaaaguuacagaaaaagacauuauacaauaucuacacacaguagauggauacgacgguaucgaacuuaaaggcaucgaaaaacaauuuaaugcuagcuuaucaacauaccacgaucuuuugaaaauaauaaaagauaaagaauuuauggacgacccaaauaaugaagaaauacuugaaaauaucguccauacccuaacaauuuucgaagacagggaaaugauuaaacaacgauuagcccaauaugauucacucuucgacgaaaaaguuaucaaagcacuuacuagaagacacuauacuggcuggggcaaauuaagcaguaaauuaaucaauggcauucgagauaaacaaacaggaaaaacuauacuugacuaccuaauggaugacgguuauaauaauagaaacuucaugcaacuaauaaaugacgaugaacuuucauucaaagaaauaaucaagaaagcucaaguuguaggcaaaacagacgacguaaaacaaguaguacaagaacuacccgguaguccagccaucaagaaaggcauuuuacaaucuauaaaacuuguagacgagcuagugaaagugaugggacacgaaccggaaucaauaguaaucgaaauggcucgggaaaaccaaacuacagcaagaggcaagaaaaacucacaacaacgcuacaaacgcauugaagauagccuaaaaauacuagcaucgggccuaaaugcuaaaauccuaaaagaacacccgacagauaauauccaauuacaaaaugacagauuauuccuuuauuaucuacagaaugguagagacauguauaccgguaaaccauuagacauaaaccaacucagcaguuaugacauagaccacauaguaccucaagccuuuauuaaagacgacagcuuagauaaucguguccuuaccucguuaaaagacaauagagggaaaucagacaauguucccucauuggaaguagucgagaaaaugaaaacauuuuggcaacaguuacucgacucuaaacuaauaucguaccguaaauucaauaacuuaaccaaagcugaaagaggagguuuagacgaaagggacaaaguuggauucauaaaacgacaacuuguagaaacuagacaaauaacuaaacacguagcacaaauacucgaugcuagauacaacacggaaguaaacgaaaaagacaagaaaaacagaacaguaaaaauaauuacacuaaaaaguaaccucguaucaaauuuuagaaaagaauuuagauuauauaaaauaagggaaaucaaugacuaucaccaugcacacgaugcguaccuaaacgcuguaguagccaaagcaauccucaagaaauacccaaaacuggaaccagaauuuguauacggagacuaucaaaaauacgacuuaaaacgauacauaucucgaucaaaagaucccaaagaaauagaaaaagccacugaaaaauacuucuucuauagcaaccuauuaaacuuuuucaaagaagaaguacauuacgcugacgguacuauuguaaaaagagaaaauauagaauacagcaaagacacuggugaaauagcuuggaacaaagaaaaagacuucgcuaccaucaagaaaguacuaucacuaccacaagugaauaucgucaagaaacgugaaguacaaacaggaggauuuucaaaagaaucaauacuaccgaaaggaaauagcgauaaauuaauuccacgaaaaacuaaagauauucugugggacacaacaaaauacggcgguuuugauagucccguaauagccuacucuauccuuuuaauagcagacaucgaaaaaggaaaagcgaaaagauuaaaaacagucaaaacccucguuggaauaacaauuauggaaaaagcgaccuuugaaaagagcccaauagcauuccuugaaaacaaagguuaucacaacguacgaaaggaaaauauacuaugccucccuaaauauucccuguuugaacuuaaaaacggcagacgcagaaugcuagccuccgccaaagaacuacaaaaggguaacgaaauuguacuacccguacacuuaaccacccuuuuauaucacgccaaaaauauacacagacuagacgaaccagaacaucuagaauacauacaaaaacacaggaacgaguucaaaggccuacucaacuuagugagcgaguucagucaaaaauacgugcuggcagacgccaaccuggagaaaauuaaaaaucuuuaugcagacaacgaacaagccgauauagaaauacuagcaaauucauuuauaaaucugcuaacauucacagcauuaggugcgcccgcagccuucaaauucuuugguaaggacguagacaggaaaagguauaccacagugagcgaaauccuaaaugcaacacuaauacaccagucaauaacaggauuauacgaaacucgcaucgaucuuagcaaacuaggagaagauuga

SEQ ID NO: 8966 - RNA, 4125 nt, Artificial Sequence
  Cas9 variant
auggaaacaaaauuuacuuauuaucuaggguuagacaugggaacagacucacugggaugggccgucacagauucaaguuaucacauuuugagggcuaaggguaaagauuuauggggggugagauuguuuccaucugcugaaacuagcguugaacgacgaacauacagagugaaucgaagaagaagacagagagaaguugcaagaauaggugcccuaaaagaacucuuugccgaugaaauagagaaaguugacccuggauuuuucguucgacucgaugaaucgaaauuucauauggaggauagaagugaaaauaauaagcaaaaauauggccucuuugcagauaaacuauucagcgaugcgggauacuauaagaaauaucccacaaucuuucauuuaagaaaagaauuauuagaaagcgaagaaccccacgacguuagauuaguauauuuagccuuauuaaauauguuuaaacacagaggacauuucuuaaauucaagccuucaaauagaaggagaaaauuccaacauagcagaaaguuaccaaauguuuguagauacgcuaacugacgaagaccuagacuuuccugagcaagucucaggcgaaagauuacaggagauuuuucgaagcagugauucgaggaagaaaaaaguagaaaaccuacuagcggaaaugaaucuuucaaaaaaacaaaagagagaaauacaauucgucaaucugaucugcggacuaaaaggaaaacuaagcgaauuauucccagacaaggaauacgaugaagaacaaaagaagauugcauucucauuucaggacagcgacuacgaagauaaggaaaauacaauacaagaauuauuagacgaaagugaaaugaacaugauauaugcagugaaagcgguccaugauuccggaguacuaaguggcauaaugaauggggaaagguauuuaucaguagcuagagucgcuagcuaugaaaaacauaaaaaagacuuacaaauuuuaaaggacauuuuaaaaaaauaugauacuaaggaguauuucgaaauguuucgaaaugaaucagcuaaaucagaaucauauucagcauauguaggaucaguuaaauaucacggaacuuuuagaagaggacuaucagguggcaagcaagaagauuuauacaagcacauaaaaaaaguguuaggaaaguucccucaagacgacgaaggugugacauauauucucgaagaaauagaaacagaaaguuuccuaccaaaacagcucacagcaucaaacggaguuauaccaaaucaaguacacgcaagagaaauguuagcaauuuuaaagcaugccgaacuauauuuacccuuccuucaagaaaaagaugacacaggccuaucuguaagcgaaaagauccugaaauuauucauguuccaaaucccauauuauguaggucccuuagggcaagaauacaaagacaaaaaaggguacaacguuugggcugaacggaaagcaucaggaaaaauauauccauggaauuucgaagauaaaauagaugugaaaaaaagugcagaaaaauuuauuggacgaaugguacggagguguacuuaucuaucaggagaacaagcucuuccaaagcaaagucuauuauaugaaaaauuccaaguacuaaaugaacuaaacaaucuccgaauucgaggcgaaaaaauaccuguauccuuaaaacaagaaaucuaucacgauuuguuuggagauggcaaaaaaguaucuaugacgagacuuacuaauuaucuauuacaaaauggaguuauaucaggagaagaaaaagauaguugcauuucaggaauugauggaggcuuucauaauucuuuaagcaguguagguaaauuuaaggguguauucggugacacuguacauacggaugaacauagaaaaaugauagaagacauuauauucuggggaacuguauuuggugaugguaaaaaacuacuaaaagaaaagguagaagaaguauauggaaaucaacucacugaagcacaaaaaaaaaggauauuuggauucaaauuuagcucuuggggcagacuaaguaaagcguuucuuacaauggaaggggcaucgaaagaugauggugaaauuaaaggucuaauacaagcaaugugggacacaaacuguaaccuaauggaauuauuaagugauagauucacuuauaaagauaaauuaaaugaaaugguaacaaccgcagaaaaaccgcuaugugaauggaaaauagaggacuuagaugaaauguauuuaagcgcaccagugaagcgaaugguauggcaaacaauacgcguaguagacgaagugcaacaaauaaucggauguccaccgaaaagaauauuuguagaaaugacaagaucagauggggaaaaaggaaaaagaacgguaagcagacaaaaaaaacuuguagacuuauauaaagccuuaggaaaagaaggaaaaaccugguccgaagaacuuucagacacaccagaaucgcaauucaggauaaagaaauuauauuuauacuaucuucaaauggggaaaugcauguauacaggcgaggcaauugaacuagaacaauuaaugaacgacaacuuauaugacauagaccauauuuacccaaggcacuuuauaaaggacgauaacauaucgaauaaccuagugcuagucaaaaaggaaaaaaacgcacauaaaucagauucauucccgauagaaccagaaauaagaaauaaaaugaugccuuucuggaaaagucuuagaaaaaaaggauuucuuaccgaagagaaauacaauagacuaacacgaaugucugcuuucacagacgaagaaaaggcugcuuucauaggaagacaacuaguagaaacgucacaagggacuaaagcuauaacacaaauauucgaacaggcauucgcaaauagcgaaaucguauucaguaaagccaguguugucucagcguuccgacaaaaauuugacuguuacaaaguaagauguguaaacaacuaucaccaugcacaugaugcauaccuaaacauaguagcuggaaauacauaccgcguuaaauucacuagcaauccacuaaauuuuauaaaagaagcgaaaaaaaauccuaacagucgugagaacagguacaacauggacaaaauuuuugaaugggacguaacaaggaauggcgagacagcauggguagcacaaacaaaagaacauccgggaacaauacaauuaguaaaaaaauaccucaauaagaacaguccacuuauaaccaaaaugguauaugaaaaacacgggggaauaacacaaaaggcgacaauauggucagcaaagaaagcagaaagugggaacaccgaugccuauauaccagucaaaaugaaugacccaagacuagcagaugucacaaaauacggugggguaaccacgauagcaguagcaggauacacauugcuggaauauaaggccggaggaaaaacaguacgcucacuugaagcucucccuaucuauuuaggugguagcaaaaaacucacagaagaacaaaugguagaguacuucaguaacgugcuacagcaagaaaauaaagaaaaaguaguaucugacguaauuauaaggaaaaaaaugauaccuucagggucuuugauaaaauacaacggauucuauuacuaccuugcgggaaaaacuggagacaggauaauacuaauaagugcaguucaacuaugccucccgauggauacuaugcuuuacaucaaaaagauagaaaaagcaugcucaaccggaaauuuugaagaaaaagauaaaaacggaaaacaaguauuaagcaaacaacagaaugaauuuguuuaugaauugauaauucaaaaauaucagcaaaguauauuuaagaaaaaagugggcgcgauaggagauaccauaauagaaaaaagagagaaguucgcagaaauaucccuagaagaacaauguaaaguacucaugcaaaucuuucuaaacuuucaaucuggaaucggcguugaauuaaaaaucauagaaggaggaaaaaaaagcggaguaacauaucucaacaaaaaaguuaugaacguucaagagcuaaaacuaaucgaccaaucagucacaggaguuuucucuagagaaauagaucuauuaacaaucuga

SEQ ID NO: 8967 - RNA, 4125 nt, Artificial Sequence
  Cas9 variant
augaaaaaaagauacucauauuccauaggcuuagacauugggaccaacagcguggggugggcugucauaaaugaagacuacaaagucccggcaaaaaaaaugaccgucuucggaaacacagaucgaaaaacgauuaagaaaaaucuucuuggcaccguucuauucgacagcggagaaaccgcacaagcgcgaagauuaaaaagaaccaacagaagacgauauacccgacgaagauacagacuaugucagcuccaaaauauuuucgcaacggaaauggugaaaguugacgauaccuuuuuccaacgccuaucggaaaguuucuuuuauuaccaagacaaggcauuugauaaacaucccauauucggaaauuccaaagaagaaagagcauaucauaaaacuuaccccaccauauaccaccuuagaaaagacuuagcugaccgagaucaaaaagcagaucuacgguuaauuuaccuagcccuaucucacauaauaaaauuucgcggacauuuuuuaauagaaggaaaguuaaauucagaaaauaccgacguucagaaacuauuuauagcucuaguaacgguauacaaucuauuauuugaagaagaaccaaucgcaggggaaacuugugacgcgaaagcccuacuaacugccaaaacuagcaaauccaaaagacuagaaucguuaaucucagaauuuccuggacagaagaaaaauggacuauucggcaacuuauuagcgcuggcauuaggacucagaccaaacuucaaaucuaauuuuggacuaucagaagacgcaaagcugcaaauaacgaaagacacauacgaagaagaauuagacaaccuuuuagcagaaaucggagaccacuaugcagaccuauuccucgccgcgaaaaauuuguccgacgcuauauuacuaucagauauauuaacauuaucagaugaaaacacacgcgcaccacuaucagcaucaaugauaaaaagauaugaagagcaccaagaagacuuagcacuauuaaaaaaacucguaaaagaacaaaugccggaaaaguacugggagauauuuagcaaugcaaaaaaaaauggauacgcugguuacauagaaggaaaagugucacaagaggauuuuuaccgcuauauaaaaccuauauuaagucgauuaaagggcggggacgaauuccuagcgaaaauagaucgcgacgauuuucuccgcaaacaaagaaccuuugauaauggaucaauaccccaucaaauacauuuaaaagaacugcaugcaauccuccgccgacaagaaaaauacuacccauuucucgccgagcaaaaagagaaaauagaacaguuacuuugcuuccgaauaccuuauuacguugggccucuugcuaaaggagggaacucaucuuucgcaugguuaaaaagaaggagugaugaaccgauaacaccauggaauuucaaagacguaguagacgaagaagcaagugcacaagcauucauagaaggaaugacaaauuaugacaccuauuuaccagaggaaaaaguacuucccaaacacucaccauuauacgaaauguucacaguuuacaaugaacucaccaaagugaaauacauagcggaaaacaugacaaaaccacuauauuuaucugcagaacaaaaagaagccauuauagaucaccuuuucaaacaaacccggaaaguaaccguaaaagauuuaaaagaaaaauauuuuucccaaauagaaggccuagaaaauguagacguaaccggcguagagggugcauuuaaugcaagcuuaggaaccuauaacgacuuauuaaaaauaauaaaagauaaagcguuccuagaugacgaggcaaacgcagaaauacuugaagaaauaguucuaauccugacacucuuucaagacgaaaaguuaauagaaaaaagacuagccaaauacgcaaaccuauucgaaaaaucaguauuaaaaaagcuucgcaaacgucacuauaggggcugggggcgacuaagcaggcaauuaauagacggaaugaaagauaaagccagcggaaaaacaauacuagauuuuuuaaaagccgacgauuucgcaaacagaaacuuuauacaauuaaucaacgauaguagccuugacuuugaaaaguugauugacgacgcacaaaaaaaagcaauaaaaagagaaagccuaaccgaagcaguagccaaccuagccggcucaccagccaucaaaaaagguaucuuacaaaguuuaaaaguuguagacgagauaguuaaagucaugggucauaauccagacaacauaguuauagaaaugagucgcgaaaaccaaaccaccgcacaaggccuaaaaaacgcaagacaaagauuaaaaaagauaaaagaaguacacaaaaaaacaggcucacgaaucuuagaagacaauucagaacgaauuaccaaucuuacacuccaggacaacagacuguacuuauauuuacugcaagacggaaaagacauguacacgggacaagaccuagacauaaauaauuuaucucaauaugacauagaccauaucauaccacaaucauucauaaaagauaauucaauagauaaucuagucuugacaacgcaaaaggcaaaccgaggaaaaagugauaaugugccaucuauugaagucgugcgagauaugaaagacagaguauggagacgacaacuagcuaauggagcaauuucacgccagaaauucgaucaccucacuaaagccgagcgcgguggacuugcagauucagacaaagccagauuccuaaggagacaacuaguagagacaagacaaaucaccaaacacguggcccaacuccuagauagcagauuuaacucaaagucuaaucaaaacaaaaaauuagcacgaaacgucaaaauaauaacccuaaaaaguaaaauugugucagacuuccgaaaagacuuuggauuauauaaauuaagagaaguaaauaacuaucaucacgcacacgaugcguaccuaaaugcaguaguagggacagcauuauugaaaaaauaccccaaauuggaagcagaauuuguuuauggugacuacaaacacuuugaccuugugaaacuaaucucuaagucugacccaucacuaggaaaagcuacagcaaagguauuuuuuuacucuaacauaaugaacuucuuuaaagaagaacuaagccuugcugacggaacucucaugaaacgacccguaaucgaaacaaacacggaaaccggagaagucguaugggauaaagugaaagacuuuaaaaccauaaggaaaguauuaucauacccucaaguaaauauuguuaaaaaaacugagauucaauccggcgccuuuaguaaagaaucaguauuauccaaaggaaacucggauaagcucauagaacgaaagaaaggaugggacccgaaaaaauacggaggauuugacuccccaaauacagcauauuccauuuucguugucgcaaaaguagccaaaagaaaagcacaaaaacuaaaaacaguaaaagaaauaguaggcauaacaaucauggaacaagcagaauacgaaaaggacaauauagcuuucuuagagaaaaaaggauaccaagacauacaagaaaaacuccucauaaaauugccaaaauacucacuauucgaauuggaaaacggacgaagacgacuacuagccagcgcaaaugaauuucaaaaaggaaacgaacuagcauuaaguggcaaauacaugaaauucuuauaucuagcgucacgauaugacaaacuaucaucaaagaucgaaucagaacaacaaaaaaaauuauucgucgaacaacacuuacauuacuuugacgaaauacuagauaucguagucaagcaugccacauguuauauaaaagcagaaaacaaucuaaaaaaaaucauaucauuauacaaaaaaaaagaagcguauuccauaaacgaacaagcacugaacaugcuaaaccuauuuauauuuacgucgcuaggagcacccagcacauucguauucuuugaugaaacuauagauagaaaacgauauacaacaaguagugacguacucaacgggauucucauccaacaaaguauuacaggauuauacgaaacacgcauugacuuaucaagguucggcggagauuga

SEQ ID NO: 8968 - RNA, 4125 nt, Artificial Sequence
  Cas9 variant
augaaaaaacagaaguuuucagacuacuaccucgguuuugacauaggaacaaacucggucggcuggugcgucacagaccuggacuacaacguacugagauucaauaaaaaagacauguggggaagccgucuauuugaugaagccaaaacggcagcugagcgcagaguacaacgaaauucccgcagacgacuaaaaagaagaaaauggagacugaaucuguuagaagagauauucucugaugaaauaaugaaaauagacaguaauuuuuuuagaaggcuaaaagaaucaucccuauggcuagaagacaaaaacucaaaagaaaaauuuacccuguucaaugacgauaacuauaaagacuaugauuucuauaaacaauacccaacaauauuucacuuacgagaugaguuaauaaaaaacccagaaaaaaaagauauacgacuuaucuaccuggcgcuacacucaauuuuuaaaucaagaggucauuuccuauucgaagggcaaaaucugaaagaaauuaaaaacuucgaaaccuuauacaacaaccuaauuuccuuucuagaggacaauggaauuaacaaaucaauugacaaagacaauauagaaaaacuugaaaaaauuauuugcgacucaggcaaaggauuaaaagauaaagagaaagaauucaaaggcaucuuuaacucggacaaacagcuuguagcaauauuuaaacuguccguagggagcuccguuucccuaaaugauuuauuugacacagaugaguacaaaaaagaagaaguagagaaagaaaaaauaucauuuagagagcagauuuacgaagacgacaagccuauuuacuacagcaucuuaggggaaaaaaucgaacuauuagacauagcaaaaucauucuacgauuucaugguauuaaauaauauacuuucagauucuaauuauauaucugaagccaaagucaagcuuuacgaagaacacaaaaaagaccuaaagaacuuaaaauacauuauacgcaaauacaauaaagagaacuaugauaaacuguucaaagauaaaaaugaaaacaacuaccccgcuuacaucggacucaacaaagaaaaagauaaaaaagaagucguagagaaaucaaggcuuaaaauagacgaucugauaaaaguaauaaaaggguauuugccaaaacccgaacggauagaagagaaggacaagacuauauucaacgaaaucuuaaauaagauagaacuaaaaaccauucuaccaaaacagagaauaagugauaauggaacccucccauaucaaauacaugaaguagaauuagaaaaaauacuagaaaaccaaaguaaauauuacgauuucuuaaacuacgaagaaaauggagucuccacaaaagacaagcuccuaaaaaccuucaaauuccgcaucccauacuacguagggccacuaaacagcuaucacaaagauaaaggcggaaacuccuggauagucagaaaagaagaagguaaaauacuaccauggaacuucgaacaaaaaguagauauagaaaaaagugcugaggaauucaucaaacguaugaccaauaaauguaccuauuuaaacggugaagauguaaucccaaaagauagcuucuuauacucugaguacauuauacuaaaugaacucaacaaaguacaaguaaacgaugaauuccuaaaugaagaaaacaaacguaaaauuauagacgaacuuuuuaaagagaauaaaaaaguaucugaaaagaaguuuaaggaauaucuacuuguuaaccaaauagcaaaccgaacagucgagcuaaaaggaaucaaagauucauucaacucaaauuacgucucguacauuaaauucaaagacauuuucggagaaaaauuaaauuuagacauauacaaggaaauaucugaaaaaaguauauuauggaaaugccuauauggcgacgauaaaaaaauuuucgaaaagaaaauaaaaaaugaauauggagacauacuaaauaaagacgaaauaaaaaaaauaaauagcuucaaguuuaacacauggggucgauuaagcgaaaagcuacuaacuggaauagaauuuauaaaccucgaaacaggagagugcuauagcucugucauggaagcauuaagacgaacaaacuauaaucucauggaacuuuuaagcucaaaauucacucugcaagaaagcauagacaacgaaaacaaagaaaugaacgaaguaucuuauagagaccuuauagaggaaagcuauguauccccaagccuaaagcgagcuauccuacaaacacuaaaaauauacgaagaaauaaaaaagaucaccggcagaguacccaaaaaaguuuucauagaaauggcaagaggcggggaugaaucaaugaaaaacaaaaaaauaccugcacgccaagaacaauuaaaaaaacuauacgauaguuguggaaaugacauagcaaauuucaguauagauaucaaagaaaugaaaaacucucucaguaguuacgacaacaacucauuaaggcaaaaaaaacuauaccuauauuaucuucaauuuggaaaaugcauguacaccggaagagaaauagauuuagacagacuacuacagaauaaugauacauaugacauugaccauauauauccacgaucaaaaguaauaaaagaugauucauuugacaauuugguccuaguguuaaaaaacgaaaaugccgaaaagagcaacgaguacccagucaaaaaagaaauccaagaaaaaaugaaaucauucuggagauuucuaaaagaaaagaauuucaucucagacgaaaaauauaaacgacucaccggaaaagacgauuucgaacuacgagguuucauggcaagacaacucguaaacguuagacaaacaacaaaagaaguaggaaaaauccuacaacaaauagagccagaaauaaaaaucgucuacucaaaagcggaaauagcauccagcuucagagaaauguucgacuucauaaaaguaagagaguugaacgacacccaccacgcaaaagacgcauaccuaaauauaguggcuggcaauguuuauaacacaaaauucacagaaaaaccguauagauacuuacaagaaaucaaagagaauuacgauguaaaaaaaauauacaacuacgacauaaaaaaugcuugggacaaagaaaacucucuagaaauaguaaagaaaaauauggagaaaaacacaguuaauauaaccagauucauaaaagaagaaaaaggcgagcucuucaacuuaaacccaaucaaaaaaggggaaacgaguaacgaaauaauaucuauaaaacccaaauuauacgauggaaaagacaacaaauuaaaugaaaaauacggcuauuacaccucguugaaagccgccuacuuuauauauguggaacacgaaaaaaagaacaaaaaaguaaaaaccuucgaaaggaucacccguauagacuccacauuaaucaaaaacgagaaaaaccucauaaaauacuuagucucucaaaaaaaacuacucaaccccaaaauaaucaaaaaaauauacaaagaacaaaccuuaaucauagacucauacccauacacauucaccggaguugacagcaauaagaaagucgaacuaaaaaauaaaaaacaacucuaccuugaaaaaaaauaugaacaaaucuuaaaaaaugcacuaaaauuuguagaggacaaccagggcgagacagaagaaaauuauaaauucauauaccuaaagaaaagaaauaauaacgagaaaaacgaaacgauugaugcuguuaaagaacgauacaauaucgaauucaaugaaauguacgacaaauuccuagaaaaauuaucaaguaaagacuacaaaaauuauauaaauaacaaacuuuacacuaacuuccuaaauucaaaagaaaaguuuaaaaaacuaaaauuaugggaaaaaucacugauauuaagagaauuucuaaagauuuucaacaagaauacauacggaaaauacgaaauuaaagacucacagacaaaagaaaagcuuuuuucuuucccggaagauacaggaaggauaagacucggacaaaguucauuagguaacaacaaagaauuacucgaagaaucagucacaggguuauucgucaaaaaaauaaaacucuga

SEQ ID NO: 8969 - RNA, 4128 nt, Artificial Sequence
  Cas9 variant
augagcaacaaaccauauagcauaggauuagacauaggaacaaacaguguaggcugggcaguuauaaccgaugacuacaaaguaccgaguaagaaaaugaaaguacuggguaauacagauaaacacuuuaucaagaaaaaucucauaggagccuuauuguuugacgaaggaacaacggccgaagaucgacggcuuaaacgaacagcccgccggagauauacuagacguaaaaacagacuaagauaccuucaagaaauauuuuucgaagaaaugucaaaacuugacucuggauuuuuccauagacuugacgauuucuuccuaauacccgaagauaaacggggauccaaauauccuauuuuugccacacuagcagaagaaaaagaguaucacaaacaauuccccaccaucuaucacuuacgaaaacaauuagcagauaguaaagaaaaagccgaccuacgacuaauauacuuaacauuagcccauaugauaaaauaccgagggcacuuccuuuacgaagagagcuuugacauuaaaaacaaugacauacagaaaauauucaaugaauuuauaaguauauacgauaauacauuugaaggaaguucacuaucagggcaaaacgcacaaauagaagcaauauuuacagacaaaauaagcaaaagugcaaaaagggaacgcguacuuaaacuauuuccagaugaaaaauccacaggccuuuuuagcgaauuuuuaaaacuaaucguaggaaaucaagcagacuucaagaaacacuuugaacuagaagaaaaagcgccacugcaauuucccaaagacacauaugacgaagaucuugaaaacgugcuuggacaaauaggagaugauuucgcugaccucuuuguagcugccaagaaacuauaugacgcaauacuacucuccggcauacuuacuguaacagauccgucuacaaaagcgccacugucggcgagcaugauugaaagauaugaaaaccaccaaaaagaucucgcugcuuuaaaacaauucauuaaaacaaaucuaccggaaaaauacguagaaguauuuucagaucaaagcaaagacgguuacgcugguuacaucgacggaaaaacaacucaagaagccuucuacaaauacaucaaaaaucuacuauccaaauucgaaggcacagacuacuuccuagacaaaauagaaagagaagacuuuuuacguaaacaaaggacauucgacaacgguucaauaccccaccaaauccaccuucaagaaaugaaugcgauuuuaagacgccaaggagaacauuacccauuccuaaaagaaaauaaagagaaaauugagaaaauacugacauucagaauaccauacuauguaggaccacuugcaaggggaaaccgagauuuugcauggcuaacacgaaauucugaccaagcuauucgacccuggaacuuugagaaaauuguagauaaagccagcucagcggaagauuuuauaaacaaaaugacaaacuacgaucuauaucuaccugaagaaaaaguacuacccaaacauucucuacuauacgaaacauucgcaguguacaaugaguuaacgaaaguaaaauucauagcagaaggucuccgugacuaucaauuuuuagacagcggucagaagaaacaaauaguaaaccagcuauuuaaagagaaaagaaaaguaaccaagaaagauaucauccacuaccuucauacuguagauggauacgaugggauagaacucaaagggauugaaaaacaauucaaugcaucacuuucaacauaucaugaccuccucaaaaucaucaaagauaagaaauucauggacgauuccaaaaaugaagcaauccuagaaaauaucguccacacacuuacaauauucgaagaccgcgaaaugaucaaacaaagauuagcacaguaugauucacuauucgacgaaaaagucauuaaagccuuaacaagaagacacuacacaggcuggggaaaauuaagcgcaaaauugaucaacggaauaugugacaaacaaacaggaaauacaauccuagacuauuuaaucgaugacggcgaaauaaacagaaacuuuaugcaauuaaucaacgacgauggccuauccuucaagaaaauaauucaaaaaucccaaguugucggcgaaacagacgacguuaaacaaguagugagagaacuuccgggauccccggcaaucaagaaaggcauucuacaaucaauaaaaauaguagaugaauuaguaaaaguaauggaccacgcaccagaaaguaucguaauagaaauggccagagaaaaucaaacaacggcacggggaaagaaaaacucgcagcaaagguacaaacgcauagaagauucauugaaaaaccuagcaucgggacucgacucaaacauacugaaagaaaauccuacagauaauauucaacuuaaaaacgaccguuuauucuuauauuaccuacaaaauggaaaagacauguacacaggggaagcacuagacauaaaucaauugucaagcuacgauaucgaucacauaauaccucaagcauucaucaaagacgacucacuagauaacagaguacugacgaguucaaaagauaacaggggaaaaucagacaacguacccuccuuagaaguuguucaaaaacgaaaagcauuuuggcaacaacuacuagauucaaaauuaauaucagaacgaaaauuuaacaaucuaacaaaagcugaacgcgguggacucaaugaaagagacaaagucggcuucauaaaacgccagcuaguagaaaccagacaaauaacaaaacauguagcucagauucuugacgcaagauauaacacagaagucaacgaaaaagacaagaaaaaucgaacaguaaaaauaauaacucuaaaaucuaaucuaguaagcaauuuuagaaaagaguuuaggcuauauaaaguuagagaaauaaaugauuaucaucaugcacacgacgccuaucuaaacgccguggucgcuaaagcaauacucaagaaauaccccaaacucgaaccggaguucguauauggagaauaccaaaaauacgauuuaaaaagauauaucucuagaucacgcaaccccaaagaaguagaaaaagcaacagaaaaauacuuuuucuauucaaauuuacucaauuucuucaaagaggaaguccacuaugcagacggaacaauagucaaacgcgaaaacaucgaauauucgaaagacacuggagagauagccuggaacaccgaaaaagauuucgcaaccaucaagaaaauauuaagcuauccgcaaguuaauaucgucaagaaaacugaagaacaaaccgugggacaaaacgggggucuauucgauaacaacauaguuucaaaagaaaaaguaguagaugcaucaaaacuaauccccauaaaaagcggacuauccccaaagaaauauggaggcuaugcacgaccaacaauagccuacuccguccuaguaacauauaaacaaaacaauaagauuaaaaacacaaugguagguaucccaguacuuacaaaacucgaguuugaaagagauccuaaccuauaucuacgaaaucuuggaaucaauaacguaucacaugucauaaaacucgugaaauauacaguccuugaguuuaaacauaaauauggcacauacagaagauuuauaguauccaaccaagaauuaaaaagagcaaaccaaaucuuuguaaccaccaaacaaaugaaacuaauaagccaauacaccaccuuagacaaaaacgaacaugauaguuuacuuaaaaacaaccaacaacucauucaaucaaucuggaaccaguuccuagaauuuauguuagcaacggaccuaguaaacaagaaacaauacgaugaacuaauauuaacaaacaaccaaacaauagaagaauguaggaauaucaugaaccgagucaucacaacauuguccuuuacuaacaucaaugcaggacaaaagaaaauaauuuuugacgacaccuugagccugcccauaaaaagguggcaauuuacagacagcgacaaaauggucaagaaaauaauagagagcacgcugauacaccaaucuauaacagguuuauacgagacccgaauagaucuauccaaacuaggcgaagauuga

SEQ ID NO: 8970 - RNA, 4128 nt, Artificial Sequence
  Cas9 variant
augaaagaauaucacaucggauuagacauugguacuucaucaauaggcugggcagucaccgauucacaauuuaaauuaaugagaaucaaagguaaaacagcaauaggaguaagauuauuugaagagggaaaaacggcagcagaaagaaggaccuuucgcacaaccagacgucgacuuaaaagaagaaaauggagacuccacuaccuagacgaaauauuugcaccccaucuacaagaaguagacgaaaacuuuuuacgaagacuuaaacaaucaaauauacauccugaagacccugcuaaaaaucaagccuucauaggcaaacugcuauuuccagaucuccuaaagaaaaaugaacgaggauaucccacccuaauaaaaaugagggaugaacuucccgucgagcaaagagcccacuacccuguaaccaacaucuauaaacugcgugaagccaugauaaaugaagauagacaauuugauuugagagaaguauaccuggcaguucaucacauuguaaaauacagaggccacuuuuuaaacaaugcaucaguagacaaauucaaaguuggcagaauugauuucgacaaaaguuuuaauguucuaaacgaagccuaugaagaacuacaaaacggcgaagguaguuuuacuauagagccaagcaaagucgagaaaauaggccaacuacuacuugacacaaaaaugagaaaacuagacagacaaaaagcuguugcaaaauuauuagaaguuaaagucgcagauaaagaagagaccaaaagaaauaaacagauagcgacagccaugagcaaauugguacuaggauacaaggccgacuuugccacagucgccauggucaacggaaaugaauggaagauagaucucucuucagagaccagugaagaugaaauugaaaaauuucgagaagaacuaagugaugcacaaaacgacauuuuaacugaaauaacaagccuauucucacaaauaauguuaaaugaaauagucccuaacggaaugucaauuucagaaucaaugauggauagauacuggacucaugaaagacaacucgccgaaguaaaagaauaccuagcuacgcaaccagcaucagcaagaaaagaauuugaccaaguauacaacaaauacauaggacaagcacccaaggaaaaaggauucgaccuugaaaaaggauuaaagaaaaucuuaaguaagaaagaaaacuggaaagagauagaugaguugcuaaaagcuggagacuucuuaccgaaacaacgaauaucugcuaacggaguaauaccccaucaaaugcaccagcaagaacuugacagaauuaucgaaaaacaagcaaaauacuacccauggcuggcaacugaaaacccugcaacaggagaaagagauagacaucaagcuaaauaugaauuagaccagcuaguauccuucagaauacccuacuauguaggaccccuaguaacccccgaaguucaaaaagcaacaucaggggccaaauuugcuugggcaaaaagaaaagaagacggugaaauuacaccauggaaucucugggacaaaauagacagagcagaaucugcagaagcauuuauuaaaagaaugacagugaaagacacauaccuacuaaacgaagauguacuaccagcaaauucacuuuuauaucaaaaauacaacguacuuaacgagcuaaacaauguucguguuaaugggcgucgacuuagcguaggaauaaaacaggacauauacaccgaguuauuuaaaaagaagaaaacuguaaaagcuagugaugucgcuucucuaguuauggcuaaaacuagaggaguaaacaaaccuuccgucgagggguuaucugauccaaagaaauucaauucaaacuuagcuacauaccuagaccuaaaaucaaucguuggagauaaaguagacgauaacagguaucaaauggauuuagaaaacauaauagaauggagaucagucuucgaagauggagaaauuuucgcagauaaacugacugaaguugaauggcuuacagacgaacaacgcagcgcccuagugaagaaacguuacaaagguuggggccgucuuucaaagaaauuauuaaccgguauuguagaugaaaacggacaacgcauuauagaccuaauguggaauacugaccagaauuuuaugcaaaucguaaaucagccaguauucaaagaacagauugaucaauugaaccaaaaagcaauaacuaacgauggaaugacuuuacgagaaaggguugagaguguucuagacgaugcauacaccucaccucagaacaagaaagcaauauggcaaguagucagagucguggaagacauaguaaaagcgguaggaaacgcuccaaaaaguauuucaauugaguucgcuaggaacgaaggcaacaaaggggaaauaacaaggucaaggagaacacaacuacaaaaacuguuugaagaucaagcacacgaauuaguaaaagacacaagccucacagaagaacuggaaaaaguaccugacuugucagaccgauauuacuucuacuucacgcaaggcggaaaagacauguauacgggggauccaauuaauuucgacgaaauuucaacaaaauaugauauagaucacauucugccucaaucauuuguaaaagacgacagccuagacaauagaguguuaacaucacgaaaagaaaauaauaagaaaucagaucaagucccggccaaacuguacgcggcaaaaaugaaaccauacuggaaucaacuuuuaaaacaaggccucauaacacaaaggaaauuugaaaaucuaacuauggacguagaccaaaccauaaaauauagaucacuuggguuugugaaaagacaauugguagaaacgagacaaguaauaaaauuaacugcaaauauauuaggaucgauguaccaagaggccggaacugacaucauugaaacaagagccggacuaacuaaacaacuacgagaagaguucgauuuaccgaaaguacgagaagucaaugauuaucaccaugcuguagacgccuaucugacaaccuucgccggacaauaucucaacagaagguaucccaaauuacgcucuuucuuugucuauggugaauacaugaaauuuaaacacggcagcgauuuaaaauuacgcaauuuuaacuucuuucacgaguuaauggagggugacaaaucacaagguaaaguaguggaccaacaaaccggagagcuaaucacgacaagagacgaaguagcugacuauuuugauuggguacaagaccugaaacuaaugcuagucacaaaagaacuaaaacggucuaacggaaaacucuuugacgccacaauacaaaacgcgaauuauacaaaauuaaaugaaaggaaaaagguuuuuguaccacuaaagaaagaacuagauaaaacgcuauauggaucauacagcggaauacagucaaguuacaugacaauaguaaagaaauuugauaagaaagguuccacuuaugcuguacaaagaauaccaguuauguacucgaaauuguuagagcuagaaaaagaacaaucaaaacuaaauagacucguacaaagcauaguaacuuccgacccccaagcuccaaacaauuuugaggugcugaugcccuguguccucucgggacagcuaguaauagacaacgguagaaaauuuacacuaacgucauacagauaccaauguagcacagcccaauuauucuuacccaagaaagaccuaaaauauauacaaaacaauuucaaagaacuuaagaaaaccccugacaaacaagauaaaauauucgaaacaauuuacgaugacauauuaaaacaaguagacaaauauuucucgcuauaugauauaaauaaauuccguuccaaauuacaugacggcaaagacaaauuuuuggcccuggaaaacuucggagaaaaagaaaguaaagauaaagucauuacaaaaauuuuacgcggacuacaugcaaaugcagagagaacaucauuaaaagaaauuggauuaucaacaccgcucggacaauuccaauccggggaaggagguauuacucucucagacaacacaaaaaucauauaccaaagccccacagggcuuuucgaacgacacguauaucuuaaagauuuauga

SEQ ID NO: 8971 - RNA, 4128 nt, Artificial Sequence
  Cas9 variant
augaggaagaaucaagaaccauacaauauaggacucgauauagguacuucuaguauaggguggaguauaaugaaugauaacuucgauuuaaugagagugaaagggaaaaaaggaauaggaguaagacuauacaaugaaggucaaucugcagcagaacgaaggaugcacagaacugcccgcagaagauaugggagacgaaaauggagauuacgacuauuggaggauuucuucgaugaacacauggcugaagucgacgacacuuucuuugcaagacucaaagauaguaauauaucaccaaaagaugauaaaaaauaucgcaaaagccuacuauuuccaaaaaguaaaggcgucacauaccaagacgacggugaauucuauaaaaaauaucccacuauguaccaccucagauacgcauuaaugaccgaacaccgaaaauucgauuuaagagaaaucuacuuagcuuuucaucauaugguaaaguacaggggaaauuuuuuauaugauaccucaguugacuccuuugaagcuaaaaaccuagauauaaagggaaaauucgacgaaauaaaugaucuccuaucaucauauacagacuuuuauguagacaacucaaaugcagcccuaguugaaucaaucuuauuggaaaaaaauacaacacguaaagacaaaagcaagaaaauagcaaaacuccuacacguugaggauaaagaaaaaggcaaaaacaaaaaagcuaaagauuuagcaacccaaaucucgaaugcaguauuaggccuuaaaugcaauuuccaccucaucuucgaacuacaacaaaaauauuccuucgaucuauguuccgaaaagaccgaagaaaacauagcaaaacucagcgaaguacuggacgaaaaccagaaaaugcuacuaaugauucuaaaagaaguacaggaccaaguuauguuaaacgcauucguaccuucugguaugaguuuaucagaagcuaugaugcaaaaauaugaugacuacggagaacaauuaaaaauauaccacgagcucgaacacucaguuagcgacgauucagcggcaaaacuaagaggagcauaccgagacuauaaugauaauauuauuaaaagaauugauggugauaacaagaaagacacuuuuuauaaaagaguaaaaaacauacugacaaaaauaucaaaagaauauguagaucaagauguacuagaauccugcggaaagcuaaaaaaauuaaucgacgaaaacaaacuauuuauucgacaacgaacugcagcuaacggaguccuuccacaccaauuacaccaaauagagaugagaaaaauaaucgacaaccaaaaagaauacuacccauggcuugcagaaccaaauccuaacgaaaaaagacgagucuauaguaaauacaaaguagaggaacuaauagcguucagaauaccguacuaugucgggccguuaguugacccaaauaaugcagacaaaaauaaagaagcaagguuuuccuggaugguacggaaaaaggauggagaaaucacgcccuggaauuucuaugacaaaguugauugggcagaaagcgcaaacaauuucauugaaagaaugaaaucaaaagacacuuaucuacuaggagaagauguaguacccaaggaaucuaugcuuuaucaaaaguaugaaguacuaaaugaauuaaacaacuuacggauaaaugauagcgggcugagcgacucuuucgaagauguaaaauuaaaacaagcaauauauaacgaccuauucaaaaaacaaaaaauaguaaaaaucacggaccuccaaaacuaucucguccaaaaucacaaauauuuagucaagccaaagauaucuggcuuagcagacgaaaacagauuucuaucuucacuaucaacauauuccgacuuaaaaaccauauucggagauaaaguagaugacagaacauacuucaacgacuucgaaaaaaugguagaauacucaaccguuuucgaagacggucacgauuauaaucaaaaacucgacgaauauacauggcugaccaaagaagaaaaauacaaaauaggcaaaaaaagauacagaggcuggggaaaauuaucgaaaaaacuacuaacaggacucagagacaaaaauaaucacacaauaauggauaaucuaugggaaacaaauagaaauuuuaugcaaauucagacugcagaugaauucucaaaacaaauagccgaagaaaacgaaaggcaucucaaggguucaguuagcgaugccauaaaugacauguacacuuccccagcgaacaaaaaagcuauaagacagguacuuagagucguugaugacauccaaaaggccaugggauacgccccaucuaguauaagucuggaauuugccagagaagacggaccaucugucagaacagucucuagggcgaaccgaaugaaauccaucuacgaaaaguacgcuuccgagguaucugaagaagugaugaaagaccuggauggaguaaucaaagacaaaaaaggauuaaacgaucguuuauaccuauacuuugaacaacaaggcaaagacauguacucaggacauccauuagauuuugauaaaguuauaucaggacaagaauacgacauagaccauauacuaccacaggcaguaauuaaagaugauucccuagacaaucgaguacuaacaacuaaggcucucaacaacgauguaaaaagcaaaggaguaccguguagaauguucaacggaaugcauagcuucuggaaaaacuuauaugacaaaggauucauauccagaagaaaauucaauaaccugacaaccaaccccgaaaacauugauaaauacaaaaugaaaggauucgucaacaggcaauugguagaaacaagacaaauaauuaaacuuguagcaaacguacuaaacgauaaauaccaaaacgaugauguagacauaauagaagucagagccgaacuuacacacgacguuaggaaacacuucaaauucuacaaaaacagaaaugugaacgauuaucaucaugcauuugaugcuuaccuaacaaguuucauaggccacuaccuauucaagaaauauccuaauuuaaggccacuauuugacuauaaugauuucaugaaaguuagcgacaacguauuuaaacaacuacgaggaaacaacuucuuaggcgaauuccucaacaaaacgggagacaucauaucaacagaugguaauuucguauugaauaaagaagaaaugauaaacaaacuaaacaaagcauacgcauucaagaaaauauuggucaccaaagaaguuggacagagaaccggcgcaauguucaaugaaacacguuacccggcaccgaauaguagaaaagcagcauugaaauacagaagaaugccuaaaccugacucgcuaaucagcguaaaagacuacaaaaauacagacauuuacggaggauacagugguaaaaaugacgcauauaugguaauagucgauauggggaaacaauauauggucgugggaguuccuguaagguauacagaaaaauuagacaaacuaaggauaaaacauucagaacuuuauagagacgaauugcgaaagguauugaguagagauaaaacacuccucgauucaaaaggcaacgugaaacgguucgacauaguacuugacagaguauuauauggacaacuaauagaagauggaaaugaauuauuuacacuaggaaguucuaaguauaaacguaauuuuagacaauuauuccuagacaaacaauguauagaaauuuuagauagcuccgcuacaccacaaccgacagacgaagaauuaaucuggguauacgaucaaauauuagauaaaguagacaaauacuucgagcuguacgauauaaacagacaaagggaaacucuaagaaaaggacgagcagcauucuguucuuuaccgaacauaucaaugaaaaaagaugaugugacaaaaaaaaaaauauuaaacgagauauugguugcacuacacgcaaacgaaagugaaaguaauugugaaaaaauaggcaaaaaggucuucggcagauuacaaguucccggaggcauuaaacuaagcaaagaagcaaaacuaauauaccaaucaccaacaggacuauuugagcgagucguauaccucaaagaucuauga

SEQ ID NO: 8972 - RNA, 4128 nt, Artificial Sequence
  Cas9 variant
auggaaaacaagaaauauagcauuggucuugauauaggcacuucaagcaucggauuugccguuguagacgaaaauaauagagucaugcgagugaaagguaaaaacgccauaggagucaggcuguuuagcgaaggacaaccagcugcagacagaagaaguuucagaacaaccagacgaaggcuaucgagaagacguuggagacuacgacuacuaagagaaauauuugaacccuacauaaacccuguagaugaagcauucuucaugcguuuaaaagaaaguaacuuaaguccaaaagaugcaaauaaacacuauagcggagauauucuauuuaacaaucaaaccgaucaagauuucuaugaaaaauaccccacaauauaucaccuaaggcacgcguuaaugacagaacaccgcaaguucgacgucagagaaauauaucuggcaauccaccauauaguaaaauuccggggacacuuuuuaaaugcagccuccgcaucaaauuucacaguaggaaaacuaaaucuggaaggaaaauucgacgcccuuaaugagauauaucaacgggugcucacugaugacccguuugcuuugcgcacagacaaucuagaucauauaaaagaaauuuugaucgauaacaagagaagccaggccgaucgacaacgaacauuaacaggagauguauaucaaucuagugaagagaaagaaauagagaaaagaaauaaagcuauagcgacagaaauacuuaaagcagcaguaggaaauaaagccaaacuaaacguuaucacuaacgucgaaguugauaaggaagccgcuaaagauuggagucugacauucgauucagaaacuauugacgaugaauuagcaaaaguagauggacaaaugacggaugauggaagagaaauaauagaaauacuaaggucauuauacagcggaauaacauuagccgccauuguucccgaaaaccauacacuaagccaaaguaugguugaaaaauacaauucccacaaagcccauuuaaaauuacucaaagaccuaauuaauaauaugacagacacuaagaaagccaaaaacuuaagagcugcuuaugacgguuauauagacggcguaaaagguaaaguacuuacccgagaugauuuuuauaaacaaauucaggguaacuuagacgauucagcugaagcacagaaaauucaagacguuauggaucaagaugaguucaugccaaaacaacgaacaaaagcaaauggaucaauuccgcaucaacuccagcaacaagaauuagaucaaauaguagaaaaccagaaagaauacuauccgugguuagcagaagaaaauccaaacgaaacacgcagaggcgucgcuaaauauaaacuugacgagcuagucacauuccgcguaccuuauuacguagggccaaugauaacagccgaagaccaagaaaaacaaaguggugcauccuucgcauggaugaagagaaaggaaccagguaauauaacaccauggaauuuugaccaaaaagucgaucgaauggcaucagcaaaccaguucauaaaacguaugacuaccacagauaccuaucuccuaggagaagacguauuaccagcucaaucccuccuuuaccaaagauuugaaguuuuaaacgaacucaacaaaauaagaauagaucgaaaaccuauaaguauagaacuaaaacaacaaauuuuuaaugauuuauuuaaaaaguucaaaaaugugacaauuaaacaccuucaggaauacuuggucgcaacgggaggguacgauaaacggcccagaauagauggauuagcugaugaaaaacgauuuaauagcggacucucagcauaucacgauuuacacgguauucuaggagcugaaguagucgacgcuaaugacaaacaagaugaccuagagaaaauaauagaauggucaacaauauuugaagacaagaaaauauauagagccaaacuugacgaacuuacuuggcuuacugacagccaaaaagaaaaacuagcaacaaaaagauaucagggauggggaagacuaucgaaaaagcuacuaucaggcuuaagaaacuccgaucauagaucaauccuagauauauuauggauaacaaacgagaacuuuaugcaaauacaagcagauccagauuucgcugagcuagucaaaaaugccaaucaaggcaugcugggcaaaaacaauagucaagauguaauuaacgaucuuuauacaucgccacaaaacaagaaagcuauaagacagauauuacuuguaguacacgauauacaaaacgcaaugcauggacaagcccccgccaagauccacguagaguucgcaagaggcgaagaacgaaauccucgaaggaguauacaacgacaacaccaaauagaagcagcauacgauaaaguuacaagugacuuacuuguugaugcaggaguaagacaagaacuaaaagacgcuauaaaugacaaaagagauuuuaaagauagacuuuucuuauacuuuaugcaagguggaagggauaucuauaacggagaaccaauaaauauugauagacuuagcaguuacgauauagaccacauccucccacaggcuuucgugaaagacgauagccuaaauaauagagugcuaacugacgcagaaggaaaccgacgcaaaagugaugcaguuccaagugaacucuuuggagcaaaaaugcgcagcacaugggaacucaugagggaacaaggauugaucucuaaagcaaaauaucgaaacuuaaccaugaauccugagaacauaaacgcucauacugaaaauggauuuauaaauaggcaauuaguagaaacacgacaaguaaucaaacuugcgguuaauauacuagcagacgaauauacggaagacacacaaauaguaucaguuaaagcagaccuaucacaccaaaugagagaagacuuugaacucuugaaaaauagagacguaaaugacuaccaucacgcauucgacgcauaccuagcugcuuuuauaggcaacuaccuccuagaaagauacccaaaauuacaaucauacuucguauauggagacuuuaagaaauuuucacaaaaagauacgaagaugagaagauucaacuuuaucuaugaccuaaaacauucagaucaaaucgccgauaaaaacggcaaaaagauuuggcauaaaacuaaugacuuagauuacauaagacaucuauuugcauauaagaaaauauuaauaucacacgaaguaagcgaaagaaggggcgcucucuacaaucaaacaguauauaaagcgucagacgauaaagcguccgggcaaggaucuaagaaacuaauacccauaaaagccaauaaaccaacagaaaucuauggaggcuauacgggaaaaacgcuagcuuauauggcaauaguaaaaguaauuaaagggaagaaaauagcuuacaaagugguuggaguccccacuucagcacucguacaacuugcagguauagaacauggcagccaagaggaacuaaacagauuguacgaugucuuaaaaccccaauuuacgcaauuaaagaaaaacaauaaaacaggagaaauaucugaaaccguaucaaaauuugaaauagucaucccuagaguaaaauaucaacagcuaguagaagacgacgauaaauuguucaugauaggcagugauaccuaccccuauaaugcacaacaacuggugcuuucagaaggagcccuaaaaguaauuaauaacguauaccgcaaaggagaaaacagcgacaaacaagagaguuacaaauuagacgacguuuaugaugaaaucauaauagcuaugaagaaauauuuuccacucuaugacaacagaggauuuagagaaaaaguugcagaaggaaaaucgacauuugaaaaccuaccaauaagcaacgaauuuaaaaauggaaaacucacaaaaauagguaagaaagaaguuauuaaucguaugcuacaaggacuacaugccaacgcaacaaugacggaccuaaaaauacuaggcaucaaaaguccguucggcuucaugcaacaaccaacuggaauugcauuaagugaaaacgcacaacuaauauaucaaucucccacagauuuauuugagagaagaguccaacuaaacaaaauaaaauga

SEQ ID NO: 8973 - RNA, 4128 nt, Artificial Sequence
  Cas9 variant
augaagaaaauacuuggacuggauuugggaaccacaucuaucgguugggcucuagucuaugaaagugaaaauacagacgagaaaaguucaauuguacgauuaggcguaaggguaaacccacuaagcguagacgaaaaaggaaauuuugaaaaaggaaaagcaauaacgacaaacgcagaucgacaacaaacacacggcgcaagaaucaauuuacaacguuacaaauuaagacgagaaaaucuuaaggacugucuacaaaaacaaggcuggauagggaccgaagcacuaugcgaagaagguaagaccaguaccuucgaaacauauaugcuuagagccaaagcagccgaggaagaaaucucacuccacgaauugugucgcguccuuuuuaugaugaauaagaaaagaggauauaaaucaaaucgcaaagcaaacaacaaagaagacggaaaacucuuugacggaaugacagucgcuaagaaacuuuaugaagaacaccuuacaccagcugaauacaguuuucaacuauuaucaucaggaaagaaauuuaaacaagaauauuaccggagcgauuugaaagaagaauuugauagaauauggaaugaacaacaaaaauacuauccagaaauccuaacagacgauuuuaaacaacaacuucaaggaaaaucaaaaggaaauaccagcaaaauauucuuagguaaauauggaauuuacuccgcggaccuaaaaggucuagacagaaaauugcagccacugaaauggcgaguugaagcauuaaaacaacaagucgauaaagaaguuuuagcuuucguaauuagcgaccuuaauggacaaaucgcuucaacaaguggucuuuuaggcgcaauaucugauagaucaaaagaauuauauuuuaauaaacaaacaguaggucaauauuuauggacaucauuaaaagaaacuccccauguuagcaucaaaaauaaacccuuuuauaggcaagauuauuuggacgaguucgagaaaauaugggaaacacaagcaacauaccacaaagaauuaacaccagaacugaaacaagaaauaagagacauaaucauuuucuaccagagaccucuaaaaaguaagaaaggacucauuucaguaugugaacucgaacaaagaaaaguaaaaguuaccaucgaugggaaagaaaaagaaauuucaauaggaccaaaaguugcaccgaaaaguucaccaauguuucaagaauuucgcauauggcaaaauuuaaacaauauauuauuaauagacaaagguaauaacucuauucauccuuuauaugaagaagagaaaaaccuacucuacgaagaauuaaguguaaaagaaaaauuaagcaaagcagaagcacuaaaaguauuaaacaaaaacucaaaacaaugggacuuaaauuauaaagaaauagaaggaaauagaacacaagcaguccuauacgacugcuacaaccggauaauagucaugaccggacaugaagaauacaacuucaagaaacuaaaagcuagcgaaauacgcucauauguuaaaacgacauuuacagggcuaggguucaauaccgacauacuugaguucgauucgucguuaaccggacaugaacuugaaaaacaaccaauguaccaauuauggcaccuacucuacagcuaugaaagugauaacagcaggacaggaaaugacgcacuauuaagaaaauuagaaaccgcauucggauucccuaaagaauaugcugcgguauuaucagacguaguguucgaagacuccuacggaaauuuaucaguaaaagcgaugaggaaaauauuaccucauuuacaagcaggccuuaauuacagccaggcgugugaagaagcaggauacaaacacagucgccguagucuaacuaaaaacgaacuugaccaaaaagaauacaaagaaaagcucgaauuauuaccgaaaaauagucuacacaauccaguaguagagaaaauuuugaaucaaaugauaaauguaauaaacgcgguaauagacgaauauggcaaaccagacgaaauaaggaucgaacuggcgcgagaacuaaaaauaggagcugcagagcgcgaaaauaugacucgauccauaaaucaaggaaaugcagaaaauaaaagaauaagagaaauauuggagaaagaguucgcauuaaguuauauaucacgcaacgacauuauuaaauacaaguuauacgaagaauugaaaucaaacgguuucaaaacauuauauucugauaccuacauaaguaaagacaaacuuuucuccaaggacuucgauauagaacauauaaucccaaaagcacgacuauucgaugacagucugucaaauaagacaauagaagcccgagauguaaauauagcgaaaaguaacaaaacagcuuuugauuucauaucagaaaaguaugaccagcaaggaauagaagccuacaagaagaaauuggauauuuuacuucaggauggaucaauuagcaaagccaaauauaacagacugcucaugaaagaagcagacauaccgagcggauucauugacagagaccuuagagacacacaauauauagcgaagaaagcauacgaaauauuaagugaucuagugagaaacguuacuccaacaacaggagccgugaccaguagacugagagaagauuggcaauugguagacgucaugaaagaacuaaauuuugaaaaauaucaaaaacucggccucguagaaguuauagaagacagagacggccguaaaauaaaaagaauuaaagacuggacaaaacggaaugaccacaggcaucaugcuauggacgcucugacaaucgcauuuacaaaaccuaguuauauucaauauuugaacaauuuaaacgcacgaucugauaaaaauucuagcauauacggaauagaaaacaaagaguuacauagagaggauaauaaauuaagauuuaacgcaccguuacccauaaacgaauuucgagcagaagcaagacgacauuuaaaaucgauauuagugaguguuaaggcuaagaacaaaguaaugacacaaaacgucaacguaaucaaaacgaagcacggaguaauaaagaaaguacaacugacuccccgaggagaguuacacaaugcaacauucuauggaacaaagaaacgaccgauuaucaaaauggucaaaguuggagcugcauuggaugaaguaacaauaaagaaagucucaucaaguuucauaagagaggccuuacuagaccgacuacacgaauacaauggagacgcaaagaaagcauucaccggcagaaauaguauagauaaaaaucccauauacauagaugaagaacacaagaaaacuguuccggcucucguaaaaacgaucgaaugggaaauguaccacccgacgagaaaauuaauaagcccagaucuaaaaauugauaaaguaauagauaaagguauaagagaaauacuuaaaaccagacuagcuaaauucaacggagacgcacaaaaagcauucaguaaucuagacgaaaaucccauauacaaagaugaagccaagaaaauaacacuuaaaagaguuucacucgagggaguuucaagugucauaccacuacauacccugaaagaucgugaaggaaaauuagucgugggcaaagauggaaaacccguauuaggggacuauguucaaacuucaaacaaccaccacauagccuucuauauggaugaaaaugguaaccugcaagacaauguaguauccuuuuucgaagcugcagagcgcaaaagucaagguguucccguaauagauaaaaauuacaaucacgauaaaggauggaacuuccucuucacuaugaaacaaaaugaauacuuuguuuucccuaaugaagucacaggcuucaacccgagcgaagucgaucuaauggacgaagcuaauuauaguauuauaucgccaaacuuauauagaguacagaaaaugucuaaagcgucaggcagagacuacugguucagacaucaucucgaagcuauguuaaaugacgaucccaaacuaagaaacucaauguuuaaacgaaucacaucguuaaaagcauuagaaggaauugucaaaguacgaauaaacugcauaggaaaaauagucgcaguaggagaauaugacuga

SEQ ID NO: 8974 - RNA, 4128 nt, Artificial Sequence
  Cas9 variant
augucgaauaaaaguuacagcauaggacucgacaucgguacaaacuccguaggaugggcagucauuaccgaugauuauaaagucccaagcaaaaagaugaaaguacuaggaaauacagacaaacauuucauaaaaaaaaaucuuauaggcgccuugcucuucgaugaaggaacuacagcagaagauagacgcuuaaaacguacggcuaggcgaagauauacucgacgcaaaaacagacuccgcuaucuccaagagauauucucacaagagauaucgaaaguagauucaagcuucuuucacagacuagaugauuucuucuuaguucccgaagauaaacgaggaucaaaauacccuauuuuugccacucuuguggaagaaaaagaauaccacaaaaaauuucccaccauauaccaucuacgaaaacaucuagccgauucgaaagaaaaaacggaccucagacuuaucuaucucgcuuuagcucauaugaucaaauauagagggcauuuuuuauacgaagaaucauuugauauaaaaaacaacgauauacaaaagauauuuucugaauuuaucuccauuuacgacaacacuuucgaagguaaaucacucucuggacaaaacgcccaaguagaagcaauauuuacagauaaaauaucaaagucuacuaaaagagaacggguacuaaaacuauucccagacgaaaaaucaacaggucuauucagugaauuucuaaaacuuaucguaggaaaccaagcagacuuuaaaaaacacuucgacuuagaagaaaaggcaccucuacaauuuagcaaagacacauacgaugaagaccucgaaaauuuauugggacaaauuggagacgauuuugcagauuuauuccuaguagcaaaaaaacucuacgacgcaauucuacuaucaggaauauuaacaguaaaagaucucaguacaaaagcuccuuugucagcaaguaugauagaacgcuacgaaaaucaucagaaggacuuagccgcauuaaaacaauucauacagaacaaucuacaagagaaauacgacgaaguguuuuccgaccaaucuaaagacggcuaugcagguuacauagauggaaaaaccacacaggaggcuuucuauaaauauaucaagaauuuacuauccaaauucgaaggagcggacuauuuucucgacaaaaucgaacgggaagauuuucuuaaaaaacagagaaccuucgacaauggcucaauaccucaccaaauacaccuucaagaaaugaacgcaauaaucagaagacaaggcgaacauuauccauuuuuacaagaaaauaaagaaaaaaucgaaaaaauauuaacauuuagaaucccauacuacguugguccacuugccagaggaaauggcgacuucgcguggcuaaccagaaacucagaccaagcaauuagaccuuggaacuucgaagaaaucguagaccaagcaaguuccgcugaagacuuuauaaauaaaaugacaaauuaugaucucuaucuuccugaagaaaaaguacuaccaaaacacucacuacucuacgaaacguuugcgguauauaacgaacucacaaaaguuaaauuuauagccgaagguuuaacacgcuaccaauuuuuagauaaaaagcaaaaaaaagacauauucgauaccuucuuuaaagcagaaaauaaacgaaaagugacugaaaaagauaucauucauuaccuacacaacgucgauggcuaugacgguauagaauugaaaggaauugaaaaacaauucaacgccagucucucaacauaucacgaccuacuaaaaauaauaaaagauaaagccuucauggacgauucuaaaaaugaagagauauuagagaacauaauccacacacucacgauauucgaagauagagagaugauuaagcaaaggcuugcacaauacgacucacuauuugaugaaaaaguuauaaaggcauuaacaaggcgacauuauaccggauggggaaaacuaucagccaaacuaauaaaugggauaagagauaagaaaucugguaaaacaauccuagacuaucuaauagacgauggagaaauaaacagaaauuuuaugcaacuaauacacgaugacggccuuucauuuaaagaaauaauccaaaaagcgcaaguuuuuggcaaaacgaacgaugucaaacagguaguacaagaauuaccaggaucaccagcaauaaaaaaaggaauacuacaaagcauaaaaauuguagacgaacucguaaaggucauggggcaugcuccugaaucaauaguaaucgaaauggcacgugaaaaccaaaccacugcacgaggaaaaaaaaauagucaacaaagguauaaaaggauugaagauucauuaaaaaaucucgccucaggucuagauucaaacauauugaaagaaaacccuacagauaacauacaacugcaaaaugaccgacuauucuuauacuacuuacaaaauggaagagauauguauacaggcaaaccgcucgaaauuaaccaauuaaguaacuacgacauagaccacauuaucccacaagccuucauaaaagacgacucuuuagacaaucgaguuuuaacaucaaguaaagauaacagaggaaaaucugacaauguuccaucacuagaagucguugaaaagaugaaagccuucuggcaacaauuacuugacucaaaacucaucucggaacgcaaauucaauaaccuaacaaaagcagagagagaaagaggaggacuuaaugaauuggacaaagucggcuucauaaaaagacaguugguagaaaccagacaaauaaccaaacacguagcacaauucuuagaugcccgauuuaacaaggaaguaacggaaaaagauaaaaaaaauaggaauguaaaaauuauaacacuaaaaaguaaucuaguaucuaauuucagaaaagaauucggacuguacaaaguccgugagauaaacgauuaccaccacgcgcaugacgccuaccucaaugccguacuggcaaaagccauacuuaaaaaauauccaaaauuagagcccgaauucguuuauggagauuaucaaaaauaugaucuacaaagauacauuagcaagucacgagaaccaaaagaaguugaaaaagcaacacaaaaauauuuuuuuuacaguaaucucuuaaauuuuuuuaaagaagaaguacauuaugccgaugguaccaucguaaaacgagaaaacauugaauauucaaaagacaccggagaaauugccuggaacaaagaaaaagacuuugcaacuguaaaaaaaguuuuaucucuaccacaagucaacauagucaaaaaaacugaaguacaaaccggaggauucuccaaagaaucgauccuuccaaaaggaaauuccgauaaauuaauaccacgaaaaacaaaagaaauccucugggacacaacuaaauauggaggcuucgauucacccguaauagccuauaguauuuuguugauagcugacauagaaaagggaaaagccaagaaauuaaaaaccguaaaaacccuaguaggaauuaccauaauggaaaaggcaacauucgaaaaaaacccuauaaccuuucuagaaaauaaaggauaccacaacguaagaaaagaaaacauccuaugccuaccgaaauacagucuauucgaauuagagagugggaggagaagaaugcuagcaucugccaaggaauuacaaaaagguaaugagauuguccuucccguauaucuaacaacuuuauuauaucacagcaaaaauguacauaaacucgacgaaccggaacaccuugaauacauacaaaaacaccgcuacgaauuuaaagacuuauugaaccuuguauccgaauuuagccaaaaauacguccucgccgaugcaaacuuagaaaaaauuaaaaaucuuuacgccgauaacgagcaagcugauauagaaauucuagccaauagcuucauuaacuuacuaacguucacagcacucggagcaccagcagccuuuaaauuuuuaggcaaagauguagaucgaaagagauauaccacagugagcgaaaucuuaaacgccacuuuaauucaccaaucaauaacuggauuauaugaaaccaggauagaccuauccaagcuaggagaagacuga

SEQ ID NO: 8975 - RNA, 4128 nt, Artificial Sequence
  Cas9 variant
auggaaaagaaauauuccauagguuuagacauuggcacgaacucaguggguugggcugugauaacagacgauuauaaaguaccuucaaagaaauucaaaguacuugguaauacgaauagaaaaaguaucaagaaaaauuuaaugggggcucuacuguuugacuccggagaaacugcugaagcaacucgauuaaaacguacagcucgacgaagauauacucgaaggaaaaaucgaauaagauaccuucaagaaaucuuugcuaaugaaauggccaaauuagacgauuccuuuuuccaaagacucgaagaauccuuucugguugaagaagacaagaaaaaugaaagacacccuauauucggaaaccuugcagacgaagucgcauaccaccgaaacuacccgacuaucuaucaccuaaggaagaaauuagccgacucacccgaaaaagccgaccucagacucauauacuuagcccuagcgcauauaauaaaauuuagaggacauuucuuaauugaagggaaauuaaacgcagaaaauucagauguugcuaaacuauucuaccaguuaauacagacauacaaccaauuauuugaagaaucaccacuagacgaaauugaaguagacgcaaaagguauucuaucagcuagauuaucaaaaucgaaacgacuagaaaaauuaaucgcuguuuucccuaacgagaagaaaaacggacucuuugguaauaucaucgcauuagccuuaggauuaacaccaaacuucaaaucaaacuucgaucuaaccgaagacgcaaaacuacaauuaaguaaagauacauacgacgacgacuuagacgaacuucucggacaaaucggagaccaauaugcggaccuauuuucagcagcgaaaaaccuuucugacgccauacucuuguccgauauuuugcgaucaaacagugaaguuacuaaagcaccucuuagcgcuucaaugguaaaaagauacgacgaacaccaccaagaccuugcacuacucaaaacacuggucagacaacaauuucccgaaaaauacgcugaaauauuuaaagacgacaccaaaaacgguuaugccggcuacguaggaauuggaauaaaacacagaaaaagaacaacaaaacuagcuacccaagaagaauuuuauaaauuuaucaaaccaauucuagagaaaauggauggagcugaagaauuacuugcuaaauugaaucgagacgaccuacuaaggaaacaaagaaccuucgauaauggaagcaucccacaucaaauacaccugaaagaacuucacgcaauuuuaaggagacaagaagaguucuauccguuuuuaaaagaaaauagggagaaaauagagaaaauucuaacuuucagaaucccauauuaugugggaccacuagcaagaggaaacucuagauucgcauggcuaacacgaaaaagugaagaagccauaacaccauggaacuuugaagaaguaguagauaaaggagcauccgcacagagcuucauagaacguaugacaaacuuugacgaacaacuaccaaauaagaaagucuuaccgaaacauucgcucuuauacgaauauuuuacagucuauaaugaauuaacaaaaguaaaauauguaacagagagaaugagaaaacccgaauuucuaucuggcgaacagaagaaagcuauugucgacuuauuauucaaaacgaacaggaaaguuacaguaaaacaauuaaaagaagauuauuuuaagaaaauagaauguuucgauucaguagagauaauuggaguagaagaucgauucaacgcaagucuugguacuuaucacgaucuauuaaaaauaauaaaagauaaagacuuucuugacaacgaggaaaacgaagacauauuagaagauauaguacucacacuaacauuauucgaagauagggaaaugauagaagaacgucuuaaaacauaugcacaccuguucgacgacaaaguaaugaaacaauuaaaacguagacauuauacuggauggggaagauuaagccgcaaaaugauaaacggaauaagagacaaacaaucgggaaaaacgauacucgacuucuuaaaauccgacggcuucaguaaccguaacuucaugcagcugauacaugacgacagcuuaacauucaaagaagaaauagagaaagcacaaguaucgggccaaggggauucauuacaugaacaaauagcugauuuagcaggaucacccgcaauaaagaaaggaauccuacaaacuguuaaaauaguagacgaacuuguaaaaguaaugggacacaaacccgaaaacauaguaauugaaauggcucgggaaaaccagacaacaacaaaaggauuacaacagucgagagaaagaaagaaacgaauagaagaaggaauuaaagaacuagaaucacaaauauugaaagagaaccccguugagaauacacaacugcaaaacgaaaaauuauauuuauacuacuuacagaacggaagggauauguauguagaucaagaauuagauauaaacagauugucugauuacgacguagaccauauaguaccccagucauucauaaaagaugacaguaucgacaacaaaguauuaacacgaucaguagaaaaccgggggaaaagcgauaacguaccaucagaggaaguaguaaagaaaaugaaaaauuacuggcgacaauuguuaaaugccaaauuaaucacucaacgaaaauucgauaacuugacaaaagcagagagaggcggauugagugaggcagauaaagcaggauucauaaaacgacaauuaguugaaacccgacaaauuacgaaacacguagcacgcauauuggacucucguaugaacacaaagagggauaaaaacgauaagccuauaagagaaguaaaaguaauaacauuaaaaaguaagcuaguaucagacuucagaaaagacuuccaacuuuauaaaguucgagauauaaacaauuaccaccacgcacaugacgcuuacuuaaaugcugucguagggacagcuuuaauaaagaaauacccaaaauuagaaucagaguucguauacggugacuacaaaguauacgaugucagaaaaaugauugcaaaaagcgaacaagaaaucggcaaagcaacugccaagcgauuuuucuauaguaacauaaugaacuucuuuaaaacugaagucaaacucgcuaacggagaaauuagaaaaagaccuuuaauagaaacgaacggggaaacaggcgaaguaguauggaacaaagaaaaagauuuugccacuguaagaaaaguacucgcaaugccacagguuaauauagucaagaaaacagaaguccaaacuggaggauucuccaaagagagcauauuaaguaaacgggaaucagccaaacugaucccacgcaagaaaggaugggauaccaggaaauauggagguuuuggcucaccaacaguagccuauucaauauuaguaguagcaaaaguggagaaagguaaagcuaagaaauuaaaaagugucaaaguacucguaggcauaacaauaauggagaaaggaaguuaugaaaaagacccaauaggauuccuggaagcuaaagguuauaaagacauaaagaaggaauuaauauucaaacuaccaaaauacucauuauuugaacuagagaauggacgucgaagaaugcuagcaagcgcaacagaacuacaaaaagcaaacgaauugguauuaccacagcauuuaguaagacuuuuauacuacacucagaacauauccgcaacaaccggaucaaauaaccuaggauacaucgaacaacaucgagaagaguuuaaggaaauauucgagaaaauaauugauuucagcgagaaguacauacucaaaaauaaagugaacucaaauuuaaaauccucauuugacgaacaguucgcaguaucugacuccauccuacuaagcaacucguucgugucacuucuaaaauauaccucauucggagcauccgguggguucacuuuccuagaucuagauguaaaacaaggccgacuaagauaucaaacagucaccgaaguucucgacgcaacccuaauuuaucaaucaauaacaggcuuauacgagacaagaacagacuuaucacaacuaggcggagauuga

SEQ ID NO: 8976 - RNA, 4128 nt, Artificial Sequence
  Cas9 variant
augaagaagaucuuaggucucgacuuaggcacgacguccaucgggugggcccuagugaacgaauccgaaaacaaagacgaacaaagcucaauaguaagacuaggcguacgaguaauuccucuaacuguagacgaaaaaggcaacuucgaaaaaggaaaagcaauuacaacaaaugcagacagacagcaaguacacgcggcuagaauuaaccugcaacguuauaaacugagaagagaaaacuuacgagauugcuugcaaaaacaaggguggauuggaagcgaaccgaugugugaagauggaaaaucaucaacguucgaaacuuacaaauuaagagcaaaagccgcaguugaagaaguuagucuccacgaauucgcuagaguauuauuuaugcuaaauaaaaaaagaggauacaaaucaaacagaaaagccaaugacaaagaggagggaaaauuauuugaugguaugacaauagcaaaaaaacuauaugaagagcaucugacaccagccgaauacagccuccaauugcuuaacacgggcagaaaauuuacuccggaauauuauagaagcgaccuaauugaagaauucgaaaaaauauggaaugagcaacagaaauauuauccagaaauacucacugaugaauuuaaacaacagcuagaagggaaagcgaaaagcaauacaucaaaacucuuucuaggaaaauauggaauuuauucugcggacacgaaaggucuagaucgccgucuacaaccauugaaauggagaguagaagcaaugaagcaacaaguugacaaagacguccuagcguucguaauaucugauuuaaaaggccaaauugcaaacacaucuggacuguuaggugccauaucagaccgaaguaaagagcuauacuucucaaaacaaacuauugggcaauacuuaugggcaucacuccaagagaauccacacauaucaauuaagaaccaaccauucuaccgccaagacuaccucgaugaauucgagaagaucugggaaacacaggcaacauaucacaaagaacucacaagcgaauuaaaacaagaaauaagagacauaauaauauucuaucaacgaccguuaaaaaguaaaaaaaaccugaucgcaguaugcgaauuagaacagaggaaagugaaaguaaccguagacgguaaagaaaaagaaauaacuaucggaccaaaaauagccccaaaaaguucaccaauguuucaagaauuucguauuuggcaaaacuuaaacaacauauuacuauuagaucacgaaacaaauagcaagcgaccacuauacgaagaagaaagaaauuuauuauacgaagaauugagcguuaaggagaaacucuccaaaacggaagcauuaaaggugcugggaaaaaaaucaaagcaaugggauuuaaauuauaaggaacuagaagguaacagaacacaagcaguauuguaugauugcuauaacagaauaauaguaauguccggacacgaagaaugcaacuuuaaaaaacucaaagcaagugacauacggcacuauguaaagaugauuuuuaaaaaccuagcauuuaacacagauauacuaugcuucgacucaucgcuaaaaggacacgaauuagaacggcaaccuaugugccagcuauggcauuugcuuuauagcuacgaaggcgauaacagcagaacuggaaaugaugcacuuuuacgaaaacuagaaacaaguuucggauuuccgaaagaguaugcagccguacuggcugacgucaucuuugaagauucuuacggaaacuuaagcgucaaagcaaugcggaauauucuaccacauuuacaagccgggaaagacuauucacaagcaugugaagaagcuggauauaaacacucccgaagaucauuaacaaaagaagaacuaaaccaaaaagucuacaaagaaaaacuagaacuauuaccgaaaaauagucugcauaacccuguagucgagaaaauucuaaaucaaaugguaaauguaauaaacgcgguuauagaagaauacgggaaaccggaugagauaagaauagaauuagcaagggauuuaaaaauaggagcagcagaacgggaaaacaugacaagaagcauaaaucagggcaaugcagaaaacaaacgaauucgcgaaaucuuagaaaaggaauucgcucuuaguuacuuaagcagaaacgacauaauaaaguacaaauuauacgaagaauugaaaucaaauggcuuuaaaacgcuauauucagauacuuauauaagcaaagacaaacucuucucaaaagacuuugauauagaacacauuauaccgaaagcacgauuauuugacgacucacuuagcaauaaaacaauagaggcccgagacgucaacauagcgaaaucaaauaagacagcauucgacuucaucuuagaaagguauggcgaacaaggaguaaaaacauauaaaacuaagcucuuacgacuacuagaagauggagccauauccaauaaaaaauacaauaauuuauuaaaaaccgaagcggacauacccucuggauuuauagacagggauuugaggaacacccaauacauagcaaagaaagcuuaugaaauacucuccgaacugguaaaaauaguaacucccacgacaggaaguguaacaaaccgucuaagagaggacuggcaauuaguugacguaaugaaagaauuaaauuucgaaaaauaccaaaaguuaggauuagcagauguaauagaggacagagauggacgaaaagucaaaagaaucaaagauuggacaaaacgcaacgaucaccgacaccacgccauggacgcccuaacaauagcauuuacaaaaccaaguuauauccaauacuuaaauaaccuaaacgcaagauccgauaaauccucaucaauuuacggaauugaaguaaaggaauuacacagagaagagggaaaauuucgcuucaaugcaccacuacccauaaacgaauuucgugcagaagcaaaacgacacuuaaaaucuguauuaguuucaaucaaagcaaaaaaaaaaguaaugacacaaaauguaaauaaaauaaaaacaaagcacgguauuauaaaaaaaguucaacuuacaccuagaggagaguuacacaacgcaacauacuauggcaccaaaaaacguccacugguucgcaugguaaaaguuggcgcagcccuugacgaagccacaauuaaaagaguauguucaccagcaauuagagcagcuuuauuaaaaaggcuaaacgcauacaacggcgacgcaaaggaagccuucacuggcagaaacucaauugacaaaaacccgauauauuuagacauugaacaaacuaaacuaguaccaguauuagucaaaaccauagagugggguauguaucauccaauccguaaaagaaucacaccugaucuaaaaaucgauaaaguaaucgacaaaggcauuagagagaaacuaaaagcccgucuagcagaguuuaauggagaugcacaaaaagcauuuagcaauuuagacgaaaacccuauauacauggaugaagcaaaaagaauuacuuugaaacgaguaucuauagaaggcguccuaagugcaauaccauuacacacacuuaaagacaaagcaggcaaaccagugauaggaucugauggaaaaccgguguucggagauuacguacaaacaaguaauaaccaucauauugccuucuauauugacgacaagggaaaccuacaagauaacccagucucauucuuugaagcugcagaaaggaaaagucaggguguaccuguuauagacaggagauacaauugcgacaaaggauggcacuucguauuuacuaugaaacaaaaugaguacuuugucuucccuaaugaagcaacaggguucauacccagugaaguagaccuacuagacgaagcaaacuacuguauaauaucaccaaaucuauauaggguucaaaaauuaaguaaagccucgggccgcgacuauugguucagacaccaccuagaaacuaugcuaaaugaugaucucagacuaaaaaacucuacuuucaaacgaauacaaaguuuaaagggacuggaagauauaguaaaaguaaggauaaauaguaucggaaaaauagucgccguugggaaauaugauuga

SEQ ID NO: 8977 - RNA, 4128 nt, Artificial Sequence
  Cas9 variant
auggaaacuaaauucacguacuaccuuggccucgauaugggaacagauucgcuaggaugggcaguaacagauucaaguuaucauauauugagagcaaaaggaaaggaccuuuggggagugagauuguucccagcugcugaaacuaguguagaccgaagaaccuacagagucaaccgcagacgacgacaaagagagguagcuagaauaggagccuuaaaagagcuauucgcugaugaaauugaaaaaguagauccugguuucuuuguaagacuagaugaauccaaauuucauauggaagauaggucagaaaacaauaaacaaaaauacgggcuuuucgcggauaaacuauuuagcgaugcagaauacuauaaaaaauaccccacaauauuccaccugcguaaagaacuacuagaaagcgaggaaccacacgauguaagacuagucuauuuagcccuucuaaauauguuuaaacaucguggacauuuuuuaaacucaaguuuacaaauagaaggugagaauucaaacauugcagaaucauaucaaauguuuguggauacacuaaaagacgaagaacuugauuuuccagaacagguuaguggagaaagacugcaagaaauuuuuagaaguucugauucacgaaagaagaaaguugagaaucuauuagccgaaaugaaccucaguaaaaaacagaaaagggaaauucaauuugugaacuuaauaugcggacuuaaaggaaaauugucugaacuauucccagauaaagaauacgaugaggaacaaaaaaaaaucgcauuuaguuuccaggacagcgauuacgaagacaaagaaaacaccauucaagaauuauuagaugaaucugaaaugaauaugauauacgcaguaaaagccgugcaugauaguggaguccuaucaggaauaaugaacggcgaaagauaccuuuccguagcacgaguagcaaguuaugaaaaacacaaaaaagaccuacaaauccuuaaagauauauuaaagaaauaugacacuaaagaauacuuugaaauguuuagaaacgaaucagagaaaucggaaaauuauucagccuauguagguuccguaaaauaccacgggacuuuuagaaggggcuuaucaggaggaaaacaagaagaccuuuacaaacacauaaaaaaaguacuagguaaauuuccacaagaugacgaaggagugacauacguacuugaagaaauagaaacugaauccuuuuugccuaaacaacucacagcaagcaauggagugauacccaaucaaguacacgcuagagagaugcucgcaauucuaaaacaugcagaauuguauuuaccauuccuacaagaaaaggaugacaccggacuauccgucagcgaaaaaauacuaaagcuuuuuauguuccaaauuccauauuauguugguccccucggucaagaauacaaggauaaaaaaggauauaauguaugggcagaaaggaaagaacccggaaaaauauauccauggaauuucgaagaaaaaauugaugugaagaaaagugcggaaaaauuuauugggagaauggugcguagauguaccuaucuaaguggcgaacaagcucuacccaagcaaaguuuacuauaugaaaaauuucaaguuuuaaaugaauuaaauaaucuacgcauaagaggagagaaaauacccguaucccucaaacaagagauauaucaugacuuauuuggagacggaaagaaaguauccaugacacguuuaacaaauuaccuucuucaaaauggugucauauccucugaagaaaaagauagcuguauaucuggaauagauggaggcuuccauaauucacuaaguagugucggaaaauuuaaggggguguucggagacacagugcacacggacgaacacaggaaaaugauagaagauaucauauuuuggggaacuguguucggcgauggcaaaaaacuacuuaaagaaaaagucgaagaggucuauggaaaccaguuaacugaagcucaaaaaaaaaggauauuuggauuuaaauuuuccggcugggggagacuaaguaaagccuuucuuacgauggagggcgcuagcaaagacaauggagagauaaaaggcuuaauacaagcaaugugggacacaaacuguaauuugauggaacuauuaucagaaagauuuacauacaaagacaaacuaaaugaaaugguaacaacagcagaaaaaccauuaugugaauggaaaauugaagaucuggacgaaauguaucuaucagcaccagucaaaagaaugguuuggcaaacaauaagaguuguugacgaaguacaacagaucaugggaugcccuccuaaaagaaucuuugucgaaaugacaagaagcgauggugaaaaaggaaagcgcacgguaaguagacaaaaaaaacucgucgacuuauacaaagcacuagggaaagaagguaaaauauggagugaagaacuuaauaacacaccagaaggacaauuccggauaaaaaaauuauaccuuuauuaccuacagaugggaaagugcauguauaccggagagaguauagaacuagaacccuuaaugaaugacaaucaucuauaugacauagaucacauauauccacggcauuuuauuaaagacgacaacauuucgaacaaucuaguuuuagugaaaaaagaaagaaaugcgcauaaaucagauagcuuuccaaucgaaccagaaauaagaaacaaaaugaugccuuucuggaaaagucuaaggaagaagggauuuuuaacggaagagaaauauaaucgauuaacacgaaugucagcauucacagacgaagaaaaagcagcauucaucagucgacaacuuguugaaacuagccaaggaacaaaagcaauaacucaaauauuuaaacaggccuucgcagacucagagauaguauucucgaaagcaucgguaguaagugcauuccgacaaaaauucgacuguuauaaagugagauguguaaaugacuaccaucacgcacacgaugcauacuuaaauauaguggcagguaacacauacagaguaaaauucaccucaaauccucuuaacuucauaaaagaagccaaaaaaaauccaaauucucgcgaaaauagguauaauauggauaaaacguuugaaugggacguaacaagaaacggggagaccgcuuggguagcccaaaguaacgaaaacccggguacgauacagcuaguaaaaaaauauuuaaauaaaaauucaccauugauaacaaaaaugguguaugaaaaacauggugguauaacacaaaaagcuacaauauggagcgcuaaaaaagcugagaguggaaacacggaugccuauauaccaguuaagaugaacgacccacgauuagcggaugucacaaaauacggaggaguuacaacaauagcaguagcaggauauacauuauuagaguauaaggcaggaggcaaaaccguaagaucauuagaagcacuaccgaucuaucuuggaggaagcaaaaacuuaacggaagaacaaaugguugaauauuuuucuaacauauuacagcaagaaaauaaagaaaagguaguuuccgacgugauaauacgaaaaaagaugauaccuaguggaucucuaauaaaauacaacggguucuauuauuacuuagcagguaagacuggcaauagaauaguccugauaucagcaguacaauuaugucuuccaauggacacaauguuauacauaaagaagauagaaaaagccugcaguacaggaaauuuugaagaaaaagacaaaaacggaaaacaaguacuaaguaaacaacaaaaugaauucgucuaugaacuaauaauugaaaaauaccagcaaucaaucuucaaaaaaaaagugggugcaauuggagacaccauuauugaaaagagagaaaaauuugcggaaauaucacuagaagagcaauguaagguacugaugcaaaucuuuuuaaacuuucagucuggcauuggcguagauuugacgagugucgauggaucuaacaaaucagggguaaccuacuuaaauaaaaaaauaaugaaugcucaagaacuaaaacuuauagaucagucaguuacaggaguauuuucacgggaaauugauuuacuuaccauauga

SEQ ID NO: 8978 - RNA, 4128 nt, Artificial Sequence
  Cas9 variant
augucaaacaaaucauauucuauaggacuagauauuggcacaaauuccguagguugggcuguaauaacagaugacuauaaaguaccgagcaagaaaaugaaaguacuuggcaacacagauaaacacuucauuaagaaaaaccuuauaggagcauuauuauuugaugaaggcacgaccgccgaagauagaagacuuaaaaggacagcccgacguagauauacccggaggaaaaauagguugagauaccuacaagaaauauuuucagaagaaauguccaaaguggauucuagcuucuuucauagauuagacgacagcuuuuuaguaccagaagauaaacgagguucaaaauacccaauauucgcuacccuagccgaagaaaaagaauaucacaagaaauucccaaccauuuaccaccuccgaaaacacuuagcugacucgaaagagaaaacagaccuacgacuaauauaccuagcacuagcccacaugauaaaauauagaggccauuuccuauacgaagaaucauuugauauuaaaaauaaugacauucagaaaauauucucagaguucauaaguaucuaugacaauaccuucgaagaaaguucuuuaauaggccaaaacgcacaaguagaagcaauuuucacugauaaaauaucaaaaucagcuaaaagggaaagaguacuuaaacuauucccagaucaaaaaucaacuggcuuauucuccgaauuuuuaaaacuaauccucgggaaucaagcagauuucaagaaacauuucgaucuagaagaaaaagcaccacuccaauuuuccaaagacacauaugacgaagaucuagaaaaucuacugggccaaauaagagacgacuucgcagaccuauuucuaguagcaaagaaacuauacgaugcgauauugcucucuggcauauuaacagucaaagaccuaucuacaaaagcuccacuaucagcuagcaugaucgaacauuacgaaaaucaccaaaaagacuuagcugcucuaaaacaauuuauccaaaauaaucuccaagaaaaauaugaugaaguguuuucugaucaauccaaagacggcuaugcagguuauauuaacgguaaaaccacacaagaagcauucuauaaauacaucaaaaauuugcugucaaaauuugaaggagcugauuauuuucuagauaaaauagaacgagaagauuuucuacggaaacaaagaacauuugauaauggcucaaucccccaccaaauacaccuccaggaaaugaaugccauauuacacagacaaggcgaacacuauccauuucucaaagagaauaaagagaaaauugagaaaauucuaauuuucagaauaccguacuauguagguccauuagcaagaggaaacagagauuuugcgugguuaacacgcaauagcgaugaagcuauucgaccguggaacuucgaagaaaucguagacaaagcauccagcgcugaagacuuuauaaacaaaaugacaaauuacgauuuauauuuaccugaagaaaaaguucucccaaaacacuccuuacucuacgaaaccuuugcggucuacaacgaauuaaccaaaguuaaauucaucgccgaaggacuaacucgauaucaauuccucgacaagaaacaaaagaaagauauauuuuauacauucuucaaagcugaagacaaacgaaaaguaacagaaaaagauaucauacacuaccuacacaccgucgacgguuacgauggaaucgaauuagaaggaauagaaaaacaauuuaacgccucucucucuacuuaccaugacuuacuaaaaauaauaaaagacaaagaauuuauggacgacgauaaaaaugaagcaauauuagaaaacauaguacacacauuaacuauauucgaagaccgagaaaugauaaaacaacgacucgcacaauacaauucacuauuugacgaaaaaguaauaaaagcauugacacguagacauuacaccgguugggggaaauuaucagcaaaauuaaucaacgguauccgagacaagaaaucaggaaaaacaauacuagacuaucuaauagaugacggagaaauuaaccgaaacuuuaugcaauuaauacacgaugauggauuauccuucaaagaaauaauccagaaagcccaaguauucgguaaaacaaaugauguuaaacaaguaguacacgaacuaccaggaucuccugccaucaagaaaggaauacuccagucaaucaaaauaguagacgaauuaguaaaagugaugggucacgcaccagagucaauagucauagaaauggcuagggaaaaccaaaccacagcgcgcgguaagaaaaacagccaacaacgauacaaacgaauagaagauucacucaaaaaccuagcauccggauuagauucuaacauauuaaaagaaaaucccacggacaacguccaacuucaaaacgaucgacuauuucucuacuacuugcaaaaugguagagauauguauaccggcaaaccgcuagaaauaaaucaauuaucgaacuacgauauagaccauauaauaccacaagcauuuaucaaagaugacagcuuagacaaccgaguccuaaccaguagcaaagauaacaggggaaaauccgacaauguacccucauuagaaguaguugagaaaaugaaagcguucuggcaacaacugcucgauucuaaauuaaucuccgaacgcaaauuuaauaaccucacaaaagcugaaagagaacgaggaggucucaacgaauuagacaaaguuggauucaucaaacgacaguuagucgagacucgccaaauaacuaaacauguugcacaaauccuagacacgcgauucaacaaagaaguaacagaaaaagacaagaaaaaucgaaacguaaaaauaaucacccugaaaucgaaccuaguuucuaauuucagaaaagaguucgguuuauacaaagugcgagaaauaaaugacuaucaucacgcccacgacgcuuaucucaaugccguagucgcaaaagcuauucuaaagaaauacccuaaacuagaaccagaauuuguauauggugaauaccaaaaauaugaucuaaaaagauauauuagcagaucaaaagacccaaaagauauugaaaaagcaaccgaaaaauacuuuuucuacaguaaccuauuaaacuucuuuaaagaagaaguacaauacgcagacggaacuaucgcaaaaagagaaaauaucgaauacaguaaagacacaggcgaaauagccuggaacaaagaaaaagauuucgcaacagucaagaaaguacucucauuaccacaggucaauauagucaagaaaagagaaguacaaaccggugguuucuccaaagaaagcauccuaccuaaaggcaauagugacaaauuaaucccuagaaaaacgaaagacauacuaugggaaacaacuaaauaugguggcuuugacuccccaguuauagccuacucaaucuuacucauagcugauauagaaaaagguaaaucuaaagaacuaaaaacagucaaaacacucguagguauaacaauaauggagaaagcaacauuugaggaaaacccgauaacauuccuagaaaacaaaggauaccacaacguaagaaaagaaaacauacuaugucuaccuaaauacucauuauuugaacuagaaaacgggagacgaagauuacuugcaagugcuaaagaauuacagaaagggaacgaaauaguuuuaccaguuuacuuaaccacacuccuauaucauagcaaaaaccugcauaaacuagacgaaccuggacacuuagaauacauacaaaaacaucggaacgaguucaaagaccuucuaaaccuaguaucugaguucucucaaaaauacauccuagcagacgcaaaccuggaaaagauacaaaaccuguacgcagauaaugaacaagcagauauugaaauucuugcaaacagcuuuauaaaucuacuaacguuuacuacccuaggcgcuccugcagcauuuaaauuuuucggaaaagacauagauagaaaaagauacacaaccgucuccgaaauacuaaacgcuacacuaauccaccaaucaauuacaggacuguacgaaacaagaauagacuuaucaaaacuaggugaagacuga

SEQ ID NO: 8979 - RNA, 4128 nt, Artificial Sequence
  Cas9 variant
auggaaaaaaguuacaguauagggcuagacauaggaacgaacagcguaggaugggcgguaauaacugacgacuauaaagugcccgcaaaaaaaaugaaaguccuaggaaacacugacaaaaaauacauaaaaaaaaauuuacuaggagccuuacuauucgacagcggggaaacagccgaaguaacgcgacuuaaaagaacagcuagacgcagauacacaagaagaaaaaaucgauuaagauaucuacaagaaauauucgcaaaagagaugaccaaagucgaugaaucauuuuuccaaagguuagaagaauccuuccuaacagaugacgacaaaacuuucgauucccaccccauauucggaaauaaagccgaggaagacgcauaccaccaaaaauucccgacaauauaucaucuaagaaaauacuuagcagacucgcaagaaaaagcugauuugcgauuaguauauuuggcauuggcacacaugaucaaguauagaggacauuuucuuaucgaaggcgaacuaaaugcagaaaacacagauguacaaaaacuauucaauguuuuuguagaaacguaugacaaaauuguugacgaaucucaccuuagcgagaucgaaguagacgcauccuccauauugaccgagaagguaucaaaaucccgcagacucgaaaaucuaauuaaacaauacccaacagaaaagaaaaauacacuauucggaaaccuaauugcacuagccuuaggacugcaaccaaauuucaaaacaaacuuuaaguuaagugaagacgccaaauuacaauuuuccaaagauacuuacgaagaagaucuagaggaauuacuuggaaaagucggugaugauuacgcugacuuauuuaucagugcuaaaaaucucuacgacgcaauacuauuaagcggaauauuaacagucgaugacaacucaacuaaagcucccuuaucagcuucaaugauaaaaagauauguagaacaucaugaagacuuagagaaacuaaaagaauuuauaaaaauuaauaaacuaaaacuauaucacgacauuuuuaaagauaagacgaagaacggauaugcaggauacauugauaauggcguuaaacaagaugaauucuacaaauacuuaaaaaccauccucacaaaaauagaugacucagauuacuucuuagauaaaauagaaagggaugauuuuuuacguaagcaaagaaccuucgacaauggaaguauaccacaucaaauacaucuacaagaaaugcacuccauauuaagaagacaaggugacuauuacccguuccuaaaagaaaaccaagcaaaaaucgaaaaaauacuaacauucagaauacccuauuauguuggaccucucgcaagaaaggacucaagauucgcgugggcgaacuaccauagugacgaacccauaacaccguggaacuucgacgaaguugucgacaaagaaaaaagugcggagaaauuuauaacccgcaugacguuaaacgaccucuacuuaccugaagaaaaaguccuaccuaaacauucacauguauacgagacguuuacaguauauaacgaacuaacuaagauaaaauauguaaaugaacaaggcgaaagcuucuucuucgacgcaaauaugaaacaggaaauauucgaccauguuuucaaggagaauaggaaaguaacaaaggccaaguugcuauccuaucuaaauaacgaauucgaagaauuuagaauaaacgacuugauuggacuugauaaagacaguaaaaguuucaaugccucucugggcacauaccaugaccuuaaaaaaauauuagacaaaucauuccuugacgauaagacuaauggacaaauaauugaagauaucguccuuacccuaacccuauucgaagauagagauaugauccacgaacgucuacaaaaauauucagacuuuuucacuucccaacaacuaaaaaaacuagaacgacgacacuauacaggguggggcagauuaagcuauaaacugaucaauggaauacgaaacaaagaaaauaauaaaacaauucuagauuuucuuauagacgauggucaugcuaacagaaacuucaugcagcucauuaacgaugaaagucuuuccuucaaaacaauaauacaggaggcacaaguaguuggcgacguagaugacauagaagcaguaguacaugacuuaccaggcucaccagccauaaaaaaagguauacuccaaucugugaaaauaguagaugaacuagucaaaguaaugggggauaacccagacaacauaguaauagagauggcccgugaaaaccaaacaacggguuacggacgcaauaaaucuaaccaaagacuuaaacgauuacaggauucacuuaaagaauucggaagcgacauauuaaguaaaaaaaaaccuucauacguagacucaaaaguagaaaacagccaccuacaaaacgaccgucuuuuccuauacuauauacaaaacggaaaagacauguauacaggagaagaauuagauauagaccgucuaucagacuacgacauagaucauaucauaccacaagcauuuauaaaagacaauaguaucgacaauaaaguacuuacuuccucagcaaagaaccgcggaaaaucagaugacguaccuaguaucgaaauaguaagaaaccgacgaucauauugguacaaacuauauaagucuggucucauuucaaagcgaaaguucgauaaccucacgaaagcagaaagggguggauugacagaagcagacaaagcgggauucauaaagcgccaacuaguagaaacacgacaaauaacaaaacauguagcccaaauauuagaugcacgauucaacacaaaacgcgaugaaaacgauaaaguaauuagagauguaaaagugaucaccuuaaaaagcaaccugguaucacaauuuagaaaagaauucaaguucuacaagguuagagaaauaaaugauuaccaccaugcccacgaugcauaucuuaacgcaguaguaggaaccgcacuguuaaaaaaauacccaaaacuaaccccugaauucguuuauggggaauacaaaaaguacgacgugcggaaacuaauugcaaaaucaucagaugauuauuccgaaaugggcaaagccaccgcuaaauacuucuuuuauagcaacuuaaugaauuucuucaagacagagguaaaauacgcagauggacgaguauuugaaagaccagauauugaaaccaacgcugauggagaaguaguauggaacaaacaaaaagacuucgacauuguaagaaaagugcuuuccuauccccaagucaacauaguuaaaaaaguggaagcacagacaggaggauuuucaaaagaaaguaucuuaaguaaaggggacucagacaaauugauaccacgaaaaacaaaaaaagucuacuggaacacuaaaaaauauggaggcuucgauuccccuacagucgccuauucaguacuuguaguugccgauauugaaaaaggcaaagcaaagaaauuaaaaacggucaaagaacucguugguauaucuauaauggaaagaagcuuuuuugaagaaaauccaguuucauuccuagaaaaaaaaggcuaccacaacguccaagaagacaagcuuauaaaauuaccaaaauacagccuuuuugaauuugaaggcgggagaagaagacuacuugccagcgcaacagaacuacaaaaaggaaacgaaguaaugcuaccagcacacuuaguugaacuacuauaucaugcacacagaauagacucuuuuaacucaacugaacaccuaaaauauguguccgaacacaaaaaagaguucgagaaagucuuaagcuguguagaaaacuucucaaaucuauacguugacguggagaaaaauuuaucaaaaguccgagcugcugcagaaagcaugacuaacuuuagucucgaagaaauuucagccagcuuuauaaacuuauuaacauuaacugcccuaggagcucccgccgauuucaacuuucucggcgaaaaaauucccagaaaacgcuacacaucgacaaaagaguguuuaucugccacauuaauacaccaaagcguaacaggccucuaugaaacaagaauagacuuaucaaaauuaggugaagaauga

SEQ ID NO: 8980 - RNA, 4128 nt, Artificial Sequence
  Cas9 variant
augacuaaaauaaaagacgauuauauaguaggccucgacaucgguaccgacucauguggaugggucgcuaugaacucuaacaaugacauauuaaaauuacaaggcaaaacugcuauagggaguagacuguuugaaggagguaaaucagccgcagaaagacgacucuuccggacgacccauagaaggauuaaaaggaggcgcuggaggcuaaaacuccuugaagaguucuuugacccauacauggcagaaguagauccauacuuuuucgcgcgacuaaaagaaagcggacuaucgccacuugauaaaagaaaaacaguaaguucgauaguauucccaaccuccgcugaagauaagaaauuuuaugacgacuauccaaccaucuaucaucuaagauacaaauugaugacagaagaugaaaaauuugaccugagagaaguuuaccuagcuauccaucacaucauuaaauauagagguaacuuucuauauaacacaagugucaaagauuucaaagccucaaaaauugauguaaaaagcaguaucgaaaaauuaaacgaacuauaugaaaauuuaggccuggaccuaaacguagaauuuaacauaucuaauacagcagaaauagaaaagguccuaaaagauaaacagaucuucaaacgcgacaaaguaaagaaaauagcugaauuauucgcuauaaaaacggacaauaaagaacagaguaaaagaauuaaagacauuucuaaacaaguagcuaacgccgugcuagguuacaaaacaagauuugacaccauagcuuuaaaagaaaucucaaaagaugaacucucagauuggaacuucaaauuaagcgauauagacgcagauuccaaauuugaagcucucaugggcaauuuagaugaaaaugaacaagcaauacuauuaaccauaaaagaauuauuuaacgaaguaacucuaaauggcauuguagaagacggaaacacucucucggaaagcaugaucaacaaguauaaugaccacagagacgacuugaagcuauuaaaagaaguuauagaaaaccacaucgaccgaaagaaagcgaaagaacuagcacuagcuuaugacuuauauguaaacaauagacacggccagcuacuucaagcgaaaaagaaacucggcaaaauaaaaccaagaucaaaagaagacuucuacaaaguagucaacaaaaaccucgaugauaguagagcaaguaaagaaaucaaaaagaaaauagaacuagauucguuuaugccaaaacaacgaaccaaugcaaacggcgugauaccuuaucaauuacaacaauuagaacuagacaaaauaauagagaaucagucaaaauacuacccauucuuaaaagaaauaaacccuguaucuagucaucuaaaagaagccccauacaaauuagaugagcuuauacgcuuccgugugccguauuauguuggaccacuaauaucuccaaaugagaguacaaaagauauucaaacgaagaaaaaccaaaacuuugcauggaugauaagaaaagaagaagggcguauaacaccauggaauuuugaccaaaaaguagaccguauugaaucugccaauaaauuuauuaaaaggaugaccacaaaagauaccuaccuauuuggcgaagauguacuuccggccaauaguuuacuuuaccaaaaauucacagucuuaaacgaacuaaacaacauccgaauaaacgggaaaaggauaagcgucgaccuaaaacaagaaauauaugaaaaccuguucaagaaacauacaacagucacaguuaagaaauuagaaaacuauuuaaaagaaaaccauaacuuagucaaaguggaaauuaagggccuagcagaugaaaagaaauucaacaguggacucacaaccuacaaucguuucaaaaauuuaaauauauucgauaaccaaauagaugaccugaaauauagaaacgauuuugagaaaaucaucgaauggagcacgauauuugaagauaaauccauuuauaaagaaaaacuacgcaguaucgauugguuaaacgaaaaacaaauuaaugcacuuaguaacauacgacuccagggauggggcagacucucuaagaaacuacuugcacaacuacaugaccauaauggacaaacaauuauagaacaacucugggacucacaaaacaacuuuaugcaaauuguaacccaagcugauuuuaaagaugcaaucgcuaaagccaaucaaaaucuacucguagcuacuucagucgaagauauauuaaauaacgcauacacgucuccugccaauaagaaagcaaucagacagguuauaaaaguagucgacgacauagucaaagcagcaucuggcaaaguaccuaaacaaauagcaauagaauuuacccgagacgcggaugaaaacccaaaaagaucccaaacaaggggcaguaaacuacaaaaaguuuauaaagacuuaagcacagaauuagcuucuaaaacuauugccgaagaguuaaacgaagcaauuaaagacaaaaagcuaguacaggauaaauauuaucuauacuucaugcaacuaggcagggacgcauacacuggugaaccuaucaacauagacgaaauacaaaaauacgauauugaccacauauuaccacaaucuuuuauaaaagaugaugcacuugauaacagaguauuaguaagucgagcagucaauaacggcaaaucugacaauguucccgugaaauuauuuggaaacgagauggcagcaaaccuaggaaugaccauaaggaaaaugugggaagaauggaaaaauauuggauugauuucaaaaacaaaauacaauaauuuacuaacugacccugaucacauuaacaaauacaaaagcgcuggauucauaaggagacaacuuguagaaacgucacaaauaauaaagcuaguaaguacgauauuacaaucacgauauccgaauacugaaaucaucacagucaaagcuaaauauaaccacuauuuacgugaaaaauuugaccuuuauaaaucacgagaaguaaacgacuaccaccacgcaauagacgcauauuuauccgccauuugugggaaccuccuauaucaaaacuaucccaacuugagacccuuuuucgucuacgggcaauauaagaaauucucaagugauccugauaaagaaaaagcaauauucaauaaaaccaggaaauucucauucaucagucaacuacuuaaaaacaaauccgaaaauucaaaagaaauagccaagaaauuaaaaagagcauaccaguucaaguauaugcuuguaucaagagaaacagaaaccagagaccaagagauguuuaaaaugacagucuauccuagauucucacacgauacaguaaaagcuccaaggaauuuaauaccgaagaaaaugggaaugucucccgacauauauggagguuacaccaacaauagugacgcauacaugguuaucgugaggauagauaaaaagaaagguaccgaauauaagauacuagguauuccaacucgagaacuuguaaaucucaagaaagcagaaaaagaagaccacuacaaaucauaccuuaaagaaauacuaacaccacgaauccuauacaauaaaaauggaaaacgagacaagaaaauaaccagcuucgaaauuguaaaaucaaaaauaccguauaaacaggucauccaagauggagauaagaaauucaugcuuggaagcagcacauacgucuauaacgcaaaacaacuaacacuaagcacagaaaguaugaaagcgauaacaaauaacuuugacaaagauucagacgaaaacgacgcucucauaaaggcuuacgacgaaauacucgacaaaguagauaaauaccucccucuauucgacauuaacaaauuuagagaaaaacugcacucaggacgugaaaaauucauaaaacucucauuagaggacaagaaagauacaauauuaaaaguacuagaaggauuacaugacaacgcagucaugacuaaaauaccaaccaucggacucaguacaccauuaggauucaugcaauuccccaaugguguaauauugagugaaaacgccaaauugauauaccaaucacccacuggacuauucaagaaauccgugaaaauuagugaccuuuga

SEQ ID NO: 8981 - RNA, 4131 nt, Artificial Sequence
  Cas9 variant
auguccaauuucgauaaccacaaagauaguauaugcaaacacaaaggacuaaaaaaagggaacuauuauauaggacuugauaucggaaccaauucgguagggugggcagcuaccaaugaacaauacgaacucuugaaauucaaaagucauaaaauguggggaaguagacuauuugcagaagcacagacagcgguagacacuagaaugaaaagaucagcaagacgacggcuacaaagaaggaaauuuagacuaauucuucuagaaucguuguuuuccaaagaaauaaaugcagucgaugaaacguucuuuaugcgucuacacgaaucaaacuaucauguugaagauaaaaccaaccucguuaaauacacacuauuuauagauaaaaauuauacagacguugauuacuacaaagaauuuccaaccauuuaucaccuaagacaucaucugaugacagaaggaaccaaagauauaagacuucuguuuuuagccauacaccauaucuuaaaauaccgggguaauuuucuuuacggaaaaaaagaauuuagcguugauggagaaauguacagcguauugcgcucgacgcuugaagaacucggauucggaucauacguagaagacgaaaacguuuuacaaucaauagcaaaccuagucuuagaucgagggauugccagaucagaaaaaguaaaacaaaucgaaccauuaauugcacaaggcaaaaaauuaucgucaguagaaaaaaacagauuaaaagcuugggcauaccuaauaaugggguuaaaagcuaaucucgugaauuuauucacagacgaagacgucgaaguaguacucccugaagaaaaagaauucaaauccauuaaucuucacgaaggcauauaugaggacguaagagaugcauaugaagaugcauggggugacagauucgccauuguagaccaaugcaaaguauuacacgacaucauaguuauaagcagcaucauaaaaccaggacaaagccugagcgaggccaaaauagaaagcuauaaucaacauaaagaagaccugguucuauugaaaagcguucuaaaagaagacaaaaaacuuuaugacgacauguucguaguugauauugauaagggaacaaauuauguaaaauauaucaaacaaggaguuaacggcaauacgagcacaacucaagaagccuucuacaaguacgugcgaaaagugguaagcguacuaccagaaacugaaaacacgagaugcauaguacaaaaacuagaagaagggacauuucuuccuuuacaacgaaucucuaaaaacgggguagugccuuaucaacuucacaaagaagagcucguuagaauuuuagaaaaagcgaaacuaaauuucccauuuuuaaaugaaguugaagacggauuaacaguagcagauaaaauaauaaguauauuagaauucaaaauaccuuacuaugucggcccuuugaacccuacacauucgaucgaaaauggaggcuuugcuuggguaguuaggaaagaagcaggccaaguuuuacccuggaauuuugaacaaaaagucgacguucaagcaagugcaguaaaauucauagaaaaucucacaaauaaguguacuuacuuaauagaccaagauguacuaccuaaauacucacuacuauacgcagaauuuucccuacucaaugaauuaaauaacauaagaguuaacgacaaaccccucccagcggauguuaaacaagccuucauaagagaccauuucaucucauuacaagauucaaaaacagcaacuaaaaaagucgucgcaaaauauuuaguagacaauaacuaugucucucaacccccaauuauaacaggaauggaccaacaaauugcaaccaaacucacuagccacagggauaugacucgcauauuaggagaacauuuugacuacgcuauggcggaagauauaauaagauauauuacgauauucggugaauccaaagauaugcugcgacaaguucuaaaaaauuauuacggggauagacucacaaccgaacaaauaaaaaaacucggaaaguugacguauacaggaugggggagacuaaguaaaaaauuucuuagcgauauauggggaaugaagaaaaacgacgaugaugccgaagcugguacaaucauugaacacaugcgugaaggccaagagaauuugaugcagcuacuaucgagcucauauagcuuuauugauguaguacaagaauaugucacaaauguauugggagcaaaagaaaaaacagcuuuugaaaugcuggaagaccuaucacucucgcccaugguaaaaagaucuguauggcagacucuaagaaucuuagacgaaauagucagcauuagaaaagaauuaccaaaaaaaaucuucgucgaaguagccagaacaaacaaagccgauaagaagagaacacaaucacgaaaagcacuuuuagaagaauuguacgaacaaauaaaagacgaagacguucacguacugcaacaagaguuggaaucaaaagaggacagcgcucuaaacucaaaaaaacuuuaccuguacuuuacacaaauggggagguguauguacagcggacgaagaauagauauacaugaauuauucacagacacuuacgauauugaucauauauacccuagauccuuaacgaaagaugauagcuggcacaauauagucuuaguagaaaaacaacuuaacgcagaaaaaacugauagguucccaauauugagugcaauucaaucaaaacaaaaaggauucuggaaauuauuaugggauagaggauucauuucugagaaaaaauacgaccggcuaguaagaacgacugaucuaacagacgaagaauugaaccaauucauaaauagacaaaucgucucaacaaaccaaucaguuaaagcaguaaccacacuacuacaucagcuauacccagaaacagaagucgucuuuucaaaggccgaaaacauaagcgacuuccgaagagacuacggcuuuguaaaagucagaaguauaaaccaccaccaccaugcaaaagacgcguauuuaaauaucgucguaggaaacguuuaucaugaaaaauucacaaaaaacuucuuaagcuucgcuaaacaaaaaggaacacacagaacguauaaucuaacaaaaauguucgaauacgagauaaaguugacugaagaaagcaagaaaguaauuugggaccccaauauccauauggauauaguaaaaaaaaugaugaagucaaacgauguuagggugacgcagagagccguuccacaaaaaggaggacuaucagaugaaacaauauacaagaaaggaauagcaaaaaggggaguauaccuaccacucaaguccagugacgaaagaguccgagauguugaaaaauacgggggcagaacaagcauaacaauaucagaauauauaauacuaaacaucagagauaccucagaccaagaccguauagaaauauucucacucccccucuacauagcaggcaaaaaagauauacacaaagcaauugaggaagcguaucuuuccacaugcaaaaagccagccagcguaguugauauccaaauccuauacagaggacucuauauaggaaguaaaguaaacauaaacggauucacguacuacaugggaggaaaaacaggaagcaauguaagcguagacagcgcaguagaugucgucauggacauaacaucaucuguauacauaaaacucuuagaaaaagucgcaauaaaaaaaauagagaauucaaaaacauuccgaaucgaaaauauuaaaacaucuuacaaucacaaagaaguaaccgugucuaaagaacagaacaucgcauuauaucaagaauuauugaaaaaacuugauacaccacuauucucaaaaaugaaaggcaacaaauuagaagaguuuagaaccguagguuuugauacauucauagcauuaagcuuagaagaccaagcuuccguauuacuagaaguauuaaacguccucacaaauuuuaagaccaaaagagauauaacuaaaauaggaaugaccucgagcagaucuacacuagguauaaacaucuccaacacagaacaauucagcguaauuacaacaucgaucacaggacucuaugaacaagaaauaaaaauaaaauga

SEQ ID NO: 8982 - RNA, 4131 nt, Artificial Sequence
  Cas9 variant
augacuacuaaaaaccgcgagaaaaauaauaaauuccauaaagcuaguccauuauacacauugggacuggauauuggaacaacauccguagguuuuacagcuaucgacgaagcacaaagaccaaugagggcaaaaggaaagacaguaaucggaguuagacucuuccaagaaggacaguccgccguaggcaggaaaaauuuuagaaccacaagacgaaggcuaaaaagacgacgucgaagacucaacuugcucaaacaauuuuucucugcaccucuaagaaaaaucgaucccacguucuucaaacguuuaaaagcguccucacuaucuccagcagacaaacgcagguaccuugcacccgggcuguuuccaaaugguggagauauaaaauucuaccaaaaauaccccacaaucuaucaccuucgucucgcacuuaugacagaaaaacgucccuuugaccuaagagaagucuacuuagcaauccaucauauugugaaauauagagguaauuuccuaaauccacuaccaguaucagcauuuagaggaagaaaccaaagauuugaagaccaauuuucugaauuaaaucaauuauauaagucacuagaaggcgaaucaccauuucaauucgaugaaaagauuuucucagaauuagacaaacaacuauuagucaaugaugggagaaaaaucgaucgucaaaaacaacuagcaaaacgaguauucaucaaaacuaaugaaaagcgaauagauucacaccaucagaaaauagcgagugcauucagcaaggccguuuucggcuauaaauucagaccagacgucuuacuaaauagcgauccaaaugaaaguauugacgaauuuaucaaauucggagacgaagacuucgaugacaaacuuguaauccucagagaaagccugaaugccacucaaaaagaaaucuuagcaguuacacaaaggauauacagccaaaucauuuuaaaugaaaucguacccagccgcgaaacacuuagugaagccaugguuuccagguaccaaaaacaccauucugauuuacaacucuuaacagaagcaugcaaaaagaugaccaaagcaaaagcagcucgcauucaagcagcuuacacagacuauauaggaaaaggugacggacacaagcuaguccaugaucaauucguggcuuuaaucaagaaaaaccucgacccuucagaagaaggcagagacuuagcagagcgacuugcucaagacgauuuuaugcccuuacaacgcacuccauugaacagaguuaucccacaccagcuacaacaggaggaacuagaccgaauaauagaaaaccaaggagaauauuaccccuuuuuaaaaacauuaaacccaaauaggucacgcgccgguguugcaaauuaucaauuagaugaauuaguuuccuuuagaauaccauauuacguaggaccacucauaacagcaacugaucaauuacacacaucaggagccaaauucgcauggaugacuagacgcgcagcuggugaaauuaccccauggaauuucgaucaaaaagucgacagauuagcaucugcgaaccaauucauacgacaaaauaugccaaaagacaaucauuuauuagaagcagacguucuuccugcaaacucucucacauaucaacgauauuuaguuuuagacgaacuaaacgccguaaaaguuaaccacaaaagucucacaguaucccaaaaacaaagaaucuucaaugauuuauucaaaagacaacgcacuguaacaguacuaaaucuacaaaauuaccuaaaauccauagaaaaacugccgacacuaccugucauaacuggaguuagcgauagcgaaagauucaagacuacguuaucaaccuaccuagauuuuaagaauauauucggaggcaagguagacgauaguucccaaaaagaaaaauucgagaaaaucauuuuauacgcuacaaucuucgaagaucaugcaguauacaaagccaaauuggaccaaauagauuggcuuggucaacaacagaaaaccgaucuccucuccaaaaacuaucaagguuggggacaacugucagaaaaacuucuuuuaggccuuaaaaaccaagcuggccaaagcauuuuagaugaacuauggcaaacaaacaaaagauucagggaaaucaugaaugaagcacacuucgcuaaacaaauaauggccucaaacgcagcauuauuaaggaagaaagguuuagacgacguuuuaucaaccgcauuuuuaucaccccagaacaagaaagcaauaagacaaacuguagaaguaguagacgacaucguuaaagcgauaggaugcccaccucagaaaauaucacuucauuuuucaaaagcaccagcugacgccauaagacaugaacgcgacaacgccaauaucauacuacgaacauacagaaauuuaccggcuaaaaugguugaugaucaauugaaagcggaacuacaagcaacagcugaaaaacaccaaguuuuaucugacaaacucuaccuguacuucacacaauuaggccgcgacuuauacacaggugaaauguuaaaaaugagugaguuagaaaaugacaugauagaucauauaaugccacaaaccuucgcguaugaugacagcgugaacaaccgagugcuuguuucgcaaaaucacucuucacaguuaggaaaaacaucaggagaaaaaucagacgcuaaaaugauacguuucuggcaaguacuucgagauaauaaauugauaucagaacaaaaauaccaaaacuuaacucuugauucagaccacuuaucaaaauccacuagggaacaacuacucaauagguaccuuguggagaaaaacccuaucacucaauggguagcaucuguacuuaccgaaaaauacggugauaauggaacaagaguucuuacaauaaacccacgaaugguauaccaaaugaggcgacaauuuaauuuaguuaaccuaccugaaguaaaugauuaugaucacgguuuagacgcauacuuagccgcauucauagguaauuacguugaccgccgauauccaagauuaagauccuauuucguauauggcgacuuuaguucuaguaaagaaauaguauuuagacuaaacagauucaauuuucuguucgaccuuggacaagccgaaccaaacgaauuaacagacugggaaaccggagaaaugauaugggacaaagcagcagcaaauucaguacuacgagacguauaccaauacaaauucauguuaaucucucaagcgguauauaguagacaaggagcuauguucaaucaaacaauauacccugcgagucaagcagcaggacgacaacuaauccccguaaagaaaaaccgcgccaccaaauuauauggaggcuacucggguaacguugacgccuaccuagccauuguccgcuugggcgguccaaaaucagaccaauacagaguuguagguauuccaacaagaaugguaggacgccuccaaucugcaaugaaacaaggagcggauacuuacgccaauacacuacauaaaauucuucaaccccaauucacaaaacguaagaaaaauagacaaacaggauacuaugaagaaacgacagaaccauuugcagucauacucgauaaaguuuauuaucgacaacuaauuauugauggacaacaaaaauucaugcuaggaucaucaacauaucaauucaaugcaaaacagcuaguacucucuagucgugccagacaaauuuuaucuggagaagaacgcuuaaccgacgaaaauggaucucaagaucuaauagauguauaugacgaaauauugacaaaaauagauagauacuucgaacuuuaugaucaaaggcauuucagacaaucucuccaugacggucgaaaacaauuuauaucuuuaccgauacauaacguauaccgagcaaauagauuaauagaacaugguaaauaugaaacucucagucaaaucuuaaauggucuacaugcaaauacuaugaugacaaaccucagguauuuagguauaucaagccccuuugguaaauuccaaucacccaauggcauuaaacuauccaaagacgcuguuuuaguguaccaaucaccaaguggucuauuugaaagacgugucagauuacgcgaucuauga

SEQ ID NO: 8983 - RNA, 4131 nt, Artificial Sequence
  Cas9 variant
augaauaacaaaccauauucaauaggacuagauauuggaaccaauucuguugguugggcgguuaucacagacgauuauaaaguaccuucuaagaaaaugaaaguucuaggcaauacagacaaacauuucauuaagaaaaaccucuugggagcuuuacuguuugacgaagguacaaccgccgaagacagacgucugaaacggacagccagacgccgcuacacaagacgcaaaaaccgauuacguuaccuacaagaaauuuucacagaagaaaugucuaaagucgauauaucauucuuucauagauuagacgacaguuuucuagucccagaagauaaaagaggauccaaauauccuaucuuugcaacguuagaagaagaaaaagaauaccauaaaaauuuuccuacaaucuaccacuuaaggaaacaccucgcagacucaaaagaaaaagcagacuuuagacuaauauauuuagcacuggcacauauuauuaaauacagaggacauuuccuauaugaagaaucauucgacauuaaaaauaacgauauacagaaaauauuuaacgaguucauaaguauauaugacaauacauucgaaggaucgagucuaaacggacaaaaugcucaaguagaggcuauauucaccgacaaaaucucaaaaagcgcuaaacgagaacgaguucuaaaacuuuucccagaugaaaaaucaacgggacuauuuuccgaguuccuaaaacuaauaguaggcaaccaagcugauuucaagaaacauuucgaucuagaagaaaaagcaccauuacaauuuucuaaagacacauacgacgaagaccucgagaaccuuuuaguacaaauaggcgaugauuucgcagaccuuuuccuugucgccaagaaauuauacgacgcaauacuacuaucaggaauauuaacaguaacggaccccuccacaaaagcuccacuaagcgccaguaugauagaccgcuaugaaaaccaccaaaaagacuuagcugcacuuaaacaauucauaaaaacuaacuuaccagaaaaauacgaugaaguauucucugaccaaucaaaagaugguuacgcaggauauaucgacggaaaaacaacacaagaagcauuuuacaaauauaucaaaaacuuauuaucaaaacuugaaggcgcugauuacuuccuagacaaaauagaaagagaagauuuucuacggaaacaaagaacuuuugauaacgggucaauaccacaccaaauacaccuucaagaaaugaacgcaauaauaaggagacaaggugaacacuauccauuccuacaagaaaauaaagagaaaauagagaaaauacuaacauuccguauaccauauuacguaggaccacucgcaagaggaaaccgagauuuugcuugguuaacacgaaauagcgaccaagcaaucagaccauggaacuucgaagaaauuguagauaaagcgcgcagcgcagaagacuuuauaaauaaaaugacaaacuaugacuuauaucuaccggaagaaaaaguacuuccuaaacacagccuccuuuaugaaacauuugcaguguacaacgaacuaacaaaagucaaguucauagcugaaggccuucgagauuaccaauuccucgacagcggucagaaacaacaaauaguuacacaacucuuuaaagaaaaacgaaagguaaccgaaaaagauauuauacaauaucuccacaauguugauucauacgauggaauugaauugaaggguauagaaaaacaauucaacgcgucacuuagcacauaccaugaccugcuuaaaauuauaaaagacaaagaguucauggaugacucgaaaaacgaagcaauacuugaaaauauuguucacacgcugacaauauuugaagauagagaaaugauuaaacaacgccuggcucacuacgcaucuauuuuugaugaaaaaguaauaaaagcgcuaaccaggagacacuacacaggauggggcaaauuguccgcuaaacuaauaaauggaauauaugauaaacaaucuaagaaaacaauccucgauuaccuuauagacgacggagaaaucaacagaaauuucaugcaacuaaucaacgacgauggacuaaguuuuaaagaaauuauacaaaaagcacaaguaguagguaaaacaaaugauguaaaacaagucguccaagaacugccggggucuccagcuauaaagaaaggaaucuuacaaagcauaaagcuagucgacgagcuaguaaaaguaaugggacacgcaccagaaucaauaguaaucgaaauggccagagaaaaccaaacaacagccagaggcaagaaaaacucacaacaaagauacaaaagaauagaagaugcauugaaaaauuuagcucacggauuagauucgaauauacugaaagaacaucccacagacaauauacagcuacaaaaugacagacuauuuuuguauuaucuacaaaacggaaaagauauguauacaggaaaaagucuagauauaaaccaguuaucuagcugugacauugaccacauaauuccucaggcauucauaaaagacgacucacuagacaauagaguucuuacauccucaaaagacaacagaggaaaaucugacaacguaccaucacuggaaauaguccagaaaagaaaagcauucuggcaacaacucuuagauucuaaauuaauaucugaaagaaaauucaacaaucuaaccaaggccgaaagagguggcuuagacgaacgagauaaggugggauucauaaaaaggcaacugguagaaacacgacaaauuacuaaacacgucgcucaaauccuagaugcacgauuuaauacggaagucaccgaaaaagacaagaaagaccguagcguaaaaaucaucacucucaaaucuaacuuaguaaguaacuuucgaaaagaauuuagacuauacaaagugagggaaauaaaugacuaccaccaugcgcacgacccauaucugaacgcagucgucgcuaaagcaauuuuaaagaaauauccuaaacuagaaccugaguucgucuauggcgacuaccaaaaauacgaucuuaaacgauacaucagucgaaccaaagacccaaaagaagucgaaaaagcaacugaaaaauacuucuucuauagcaaccuacuaaacuuuuucaaagaagaaguccacuaugccgauggaacaauagucaaacgagaaaacauagaauacagcaaagacacaggagaaauagcuuggaauaaagaaaaagauuuugcaacaauaaagaaagucuuaaguuuaccccaaguaaauauagucaagaaaacagaagaacagacaguaggucagaacgguggccuuuuugacaauaacauaguauccaaaaagaaaguaguggacgcguccaaacuaacaccaauaaaaucaggauugagcccagaaaaauauggaggauaugcgcgaccaacaauagccuacucuguccuuguaauagcugacaucgaaaaaggaaaagccaagaaacuaaaaagaauuaaagagaugguaggaauaacaguacaagauaaaaagaaauucgaagcuaacccgauagccuaccuugaagaaugcgguuacaaaaacauaaaccccaaucuuaucauaaaacuucccaaauacucccuauucgaguuuaauaacggacaacggaggcugcucgcaaguagcauagaguugcaaaaagguaaugaauuaauagucccuuaccacuuuacggcccucuuauaucacgcacaaagaauaaacaaaauuucagaaccaauucacaaacaauauguagaaacacaucaaagcgaauuuaaagaguuacuaacagcuauaauuagucuaucaaagaaauacauacaaaaaccaaauguagagagcuuacuucaacaagcauuugaucaaagugacaaagacauauaucaacuuagcgaaaguuuuauaucauuauugaaauuaaucucuuuuggagccccugguacuuuuaaauuucucggcguagaaauaagucaaucgaacguaagauaccaauccgucucauccugcuucaaugcaacauuaauacaucaaaguaucacaggccuguacgaaacaagaauugaccuauccaaacucggagaagacuga

SEQ ID NO: 8984 - RNA, 4131 nt, Artificial Sequence
  Cas9 variant
auggacaagaaauauggcauaggccuugacauaggaacaaguagcauagguuggacugucguagacaaauacggacacauaauucgaguuaaaggccagacuggaauuggcguuagacuauucagagaaggacaaacagccgcugaaagacgaaccuuucggacaacuagaagaagauuaagcagaagacgauggcgguugagacuauuaagagaaauauucgacgaaccaauaucagcaauugaugaaaacuuuuucgcaagacaaaaagccagcagucuggcaccuggagacgcacgauaccaacaggcuuuccaacuauucaaugaccgaaccgaucaagcguuuuacugcaaauauccuacuauauaccaccuaagacaagcucuuaugaccgagucaaggcaauuugacauacgagaaaucuaccuagcacuacaucagauaauaaaauaucgaggucacuuuuuacugggaggagcagcaaaagacuuccaaagcgacaaacuagaccuagaggcuuacuucaccacaaucaaugcacaacuagcaggaaucuacucagacggcucuguucaauuacccacccuugauuggaaucaagccugucaggaacucacagauacaucaagaacucaauccgaucgcaaaaauuggcuaguaaaagaacuaaaaucauacggagacagucaacuaaaaccaauauauacacaaauagcaaaugcuauucuaggauuuaaaacagauuuagcaaaaauuaugggcauaaaugaucccgaaaaagcacuaucauucaaucuagacgcacuagacgaucacagagacgaugucgcagaauugcucacagacgaacagauaccauuagugaaucuacucgcaaaacuacauacagcauuagaauuagcggcaauccuaccagacggacaaacucuaaguggaaaaaugguagaaauuuaugaaacacaucgaaaacaacucaaaacauauaaggcuuucauaagacaauuaccagaccgacaacaacgguuagcgcuaaaacaggccuaugaccauuauauugaccaagguuuaaauagagaagcauucuauucugaaguuaaagcuauccuggaaaaacaaaaaccacugacugcaacuggucaggccaugaagaaagccauggaccaaaacgccuuucuacuuaaacaaaggacaaaaacaaacauagcaaucccauaucaaguccagcaacaagaaauggaucaaauaaucgcaaaucaauccaaauauuauccauggcuagcgacaccuaauccaguaaaaucaaggcggguaauagcacccuauaaacuagacgagcuaguauguuucagaguaaacuacuauguaggaccgcucguacaaucaaaaccaggagaagcaacuaaagaagccaaauucgcauggaugacaagaaaagauccucagucuacgguggcgauuacaccauggaacuucgaccaacaaguagacagacaagcaagugcaaaugcauuuauucaacgaaugaaaacaacagauacauaucugcuaggagaagauguuauaccgaaaaacucucucuuguaucagaaauacgaaguacugaaugaauugaacaacguaagaguaaauggagacuggcuggacccacaacgaaaacaauacuuauuuaagaaauuauucauggaucaaccacagucaguaguaacagucaaagcacuacaaaagacacucguagucauuggagcauguccaacguuaccaacuguugaaggauuggcaaacccaaaaagauuccuaucccaacugacaacauaucacgacuucuguaaauuacuacccgacgacauucaaagagcugacaggcaagcggacauagagaaaauaauaaacugguccacaauauucgaagauacagccauauuuaaagaaaaauuaagagauauaaaauggcuuucagccgaucaaaucagaagacuaucaucuagaccaagauaccguggauggggaagauuuucagcaaaacuacuaugcggacuacacgaccgucaaggaaacacugugauggaugaacucuggcagacguccagaaauuuuaugcaaauaauuagacaaucugacuuucaaaccgcaauugccgcaguaaaucagcaagaccuagggcggcaagacuugcaacguguaauagacgacuuauauacguccccucaaaauaagaaagcuauaagacagguauuagcuguaguuacagauauccaaaaagccaugcacggcaaagcacccaguuggcuauuuguagaaguggcgaagggugcacagaaaaauccacaacgaacacaaucuaggcaaucuaaauuagcggaggcuuauagagaauccgcacgggaauuagucgacgaagcugucaaagaacaacucuuaacgcuaccagacgacaggcaaacauucagugauagauuaguccuauauuuucaacaaaacggaagagauauuuacacuggagaaccacuugauuuugaacgacuaagcaauuaucacaucgaucauauuauuccacaagcaguaguaaaagacgauagcuuagauaauagaguauuaacaucuaaccaagccaaucucgaaaaaggagcgcaugucccaacuauauuccgagacaagcaagaaccaguuuggcaagaauuauacaggguuggauugauaagucaucgcaaacuacguaauuuacucacaacuccugacgaccucgaugacagaggcagagcaaccggauuuauagcuagacagcuaguggaaacaagacaaguaauaaaauuagucauggaaguuuuaagccaauacuaugacacaacugaaacugaguuaaucucaaucaaagcaggguugucccaccaauucagacaagagcucaaccuaccaaaacugagagcacuaaaugacuaucaucacgcacaagacgcauacuuagccgcacguaucggcacauaucuauuacaacgauacccaaaucuaaagagauucuuuguauacggcgacuucaaaaagacucauuuugaucuacaacgaagguuuaacuuuaucggcgguaugauuucaagagaaaagcaaccauacaaucucauuaaaaacccaguaacacaccaaguuauaugggacgaagaaauggaaauaggagacugucaaaagaaaaacccugaacaaccuaaacaugaugcaacagucaaaaugaugaaccuaacuaaaaucaugaaccugaaacacauucuaguaacacacgaaguuuaugaaaaucauggggcacuauuuaaucaaacaauauacccagcaucccaagcccacaaaaagaaauuaauaccgcagaaaacugaaaaaccgauagaacuauauggcggacacucaagcgaacaagccggauacauggcaauaauaaggcugcuagguaaaagaccgggauacaagguaaugagaguaccaguacgcuauguaucacaacuacaacaucaagacguugcugaacaaaagaaacuacuauauaaaauauuuguaagugaauuaacaucacgcaauaaagugaaaccguuugaagucguagugccacacguuuguuuaaaucaaccuguugaagauaugauaaaaggucaauggcacagauucgcacucagaaccaauggcuauuaccaaaaccaacaacaacugaucuuaagccuuguagcccaacgaacccucgcggguuauaaaccaaaagaugaugaacucauggcaguauaccaugaaauauguaagcaaguaaaauauuauuuuccacuauacaagaugaauaaauuucaaagccguuuauucgcagcagaagaacuacuacaaaagcgaagcacaguaaacuccuucucaauaaccauaggcaaaaauggaaaggaaaauaaaacauuaaaccucggcaagcgagaauuacuauuacgccuccuuggcggucuccacgcaaacgcaacgagggucgaucuaaaagacauaggauguacuggacaauuuggccagcuucaggucaaaaauggaauaaaauuaacugaacaagcaguacuuauucaugaaucgccaacuggguuauuccacagacgaguaagacuaaaugaucuauga

SEQ ID NO: 8985 - RNA, 4134 nt, Artificial Sequence
  Cas9 variant
augacaaagaaaaacuacucaauaggguuagauauuggcacuaacuccguaggcugggcaguaauuacagaugacuauaaaguaccagcuaaaaagaugaaaguacuagguaauacugacaagaaauauaucaagaaaaauuuacuaggagcauugcuauucgauucuggcgaaaccgcagaagcaacaagacugaaaagaacugcaagaagaagauauacuagaaggaaaaaccgauuaagauaucuacaagaaauauuugcagaagaaaugacaaaaguagaugaaaguuucuuuuacagacuagaugaaucauuucuaacaaccgaugaaaaagacuuugaacggcaucccauauuuggaaacaaggcugacgaaauaaaauaucaccaagaguucccaacgaucuaccaucuaagaaaacaccuugcggacuccucagaaaaagcagacuuaagauuaguauaucucgcgcuugcccauaugauaaaauuccgaggucacuuuuuaauagaaggugaacuaaaugcugaaaauacugauguucagaaaauauuugcagacuuuguagggguauacgaucgcaccuucgaugacucgcaucuuucagaaauuacaguagacgcggcgucaauucuaacugagaaaauauccaaaucacgcagauuagaaaaucucauuaaauauuacccaacagaaaagaaaaacacguuguucgguaacuuaauagcccuagcgcucggacuucaacccaacuucaaaaugaauuucaaacuaucagaagacgcaaaacuacaauucaguaaagacaguuacaaugaagacuuagaagaacuacucggaaaaauaggggacgacuacgcagauuuauucacgucagcuaaaaaucucuacgacgcaauuuuacuaucaggaauccucaccguagacgacaacucaacaaaagcaccauuauccgcauccaugauaaaacgauaugcagaacaccacgaagauuuagaaaaacucaaagaauuuauaaaagcaaacaaaucagaacuuuaccaugauauuuucaaagaugaaaccaaaaaugguuacgcaggcuacaucgaaaacggaguaaaacaagaugaauuuuauaaauaucugaaaaacacacuuucaaaaauagcagggagcgacuauuuccuagacaaaaucgaaagagaagacuucuuacgaaaacaacgaacauucgacaacgggaguaucccacaccaaauacaucuccaagaaaugcaugccauccuacgcagacaaggcgacuauuaccccuuccuaaaagaaaaccaagaccgaauagagaaaauacucacauuuagaauaccauacuacguaggcccacuggcccgaaaagacaguagauucagcugggccgaauaucacuccgacgagaaaauaacacccuggaacuucgauaaaguuauugacaaagaaaaaucggcugaaaaauuuaucacgagaaugacacuuaacgaccucuacuuaccagaagaaaaaguucugccaaaacacagccacguauacgaaacauacgcuguauauaacgaacuaacgaaaaucaaauauguuaaugaacaaggaaaagauuccuuuuucgauucuaauaugaaacaagaaauauuugaucacguuuucaaagaaaacagaaaaguaacaaaggaaaaauuacuuaauuauuuaaacaaagaauuuccagaauaccgaaucaaagaucuuauaggccuagacaaagaaaacaaaucauucaacgcuucacucggaacauaucaugacuuaaagaaaauacucgauaaagcauuccuagaugauaaagugaaugaagaaguaauagaagauaucauaaaaaccuuaacacucuuugaagauaaagauaugauacaugaaagauuacaaaaauacucagauauauuuacugcugaucaguuaaagaaauuagaacgaagacacuacacuggcuggggccgcuuaucauacaaauugauaaauggcauacgaaauaaggaaaacaacaagacaauacuagacuaccucaucgacgauggcucugcuaaucgaaacuuuaugcaguugauuaacgaugauacccuaccauuuaaacaaauaauucaaaaaucacaagucguuggugaugucgaugauauagaagccguuguucaugaucuucccggcucgccagccaucaagaaaggcauauuacaaagcgucaaaauuguugacgaacuugugaaagucaugggggauaacccugauaauauagucauugaaauggcacgcgaaaaccaaacaacaaaccgaggaaggucacaaucacaacaaaggcuuaagaaacuccaaaauucacuaaaagaauugggaucaaacaucuuaaacgaagaaaagccaucuuauauagaagauaaaguagaaaacucucacuuacagaaugaucaguuauuucuauacuacauucaaaacggaaaagacauguacacuggggaugaauuagauaucgaucacuuaagugacuacgauauagaccauauuauuccacaggcuuucauaaaggacgacagcauagauaauagaguccuuaccaguucagccaaaaaccgaggaaaaagcgacgacguaccaucauuagauauagucagagccagaaaagcagaaugggucagacucuauaagucaggauuaauaucuaaaagaaaauucgacaaccuaacaaaagcagaaagagguggauuaaccgaagcugacaaagccggauucauaaaaagacaauuaguagaaacaagacaaaucacuaaacauguagcccaaauauuagacgcaagauucaacacagaaagcgacgaaaaugauaaaguuauacgcgauguaaaaguaauaacccuaaaaaguaaccuaguuucacaauuucgcaaagacuucgaguucuacaaaguaagggaaauaaacgacuaccaccaugcacaugacgcauaccuuaaugccguaguaggaacagcuuuacuaaagaaauacccgaagcuagcuucagaguucguauacggcgaauauaagaaauacgacguucacaaauuaauagcgaaaucuucugacgaccacuccgaaaugggaaaagcaaccgcaaaauacuucuuuuauuccaacuuaaugaauuucuucaaacgagucauaagauauucgaauggcaaagucauuguuagaccagucguagaauauuccaaagacacagaagauauagcaugggauaagaaaagcaacuucagaacgaucugcaaaguacugaguuauccacaaguuaacauaguaaagaaaguugagacccaaacaggagguuucaguaaagaaucgauacuaccuaaaggagauucugacaaauuaauaccaagaaaaaccaagaaagcauauugggauacaaagaaauauggaggcuuugacuccccaacaguugccuacucuguauuugucguagccgaugucgaaaaagggaaagccaagaaauuaaaaaccgucaaagaguuaguugggauaaguauaauggaaagaaguuucuucgaagaaaacccagucgaguuccucgaaaacaaaggauaccauaacauacgagaagacaaacuuauaaaacuaccaaaauauucauuauucgaguucgaaggggguaaacguagauuauuagcgucagcaucggaacuacaaaaaggaaacgaaaugguaauaccuggucauuuaguaaaacuccuauaccacgcccaaagaaucaacucauucaacucaaccaaauacuuagauuauguaagugcucacaagaaagaauuugaaaaaguccuauccugcguagaagauuucgccaaccucuauguggacguggagaaaaauuuaaguaaaauucgugcugucgcagauucuauggauaacuuuucaauugaagaaaucagcaauuccuucaucaacuugcuaacauuaacagcacucggagcacccgcagacuuuaacuuccuaggcgagaaaauaccaaggaaaagauauaccuccacaaaagaaugucucaaugccacauugauacaccaaucaaucaccggccuauaugaaacaagaauagauuuaucaaaaaucggagaagaauga

SEQ ID NO: 8986 - RNA, 4134 nt, Artificial Sequence
  Cas9 variant
augaagaaaccauauucaauaggacucgacauaggaacaaauucuguaggcugggcaguaauaacagacgacuauaaaguaccaagcaagaaaaugaaaguauuaggaaacacagacaaacacuucauuaagaaaaaccuuauaggagcucuauuauuugaugaaggcacaaccgcagaagauaggagacuaaaaagaacaaguagaagacgauauacaagaaggaaaaaccgacuaagauaccuacaagaaauauucucggaagaaauaucaaaacuagauucaucauucuuccacagacuagaugauagcuuuuuagugcccgaagacaaaagaggaucaaaauaucccauuuuugcaacauuagaagaggagaaagaauaucauaagaaauuuccaacaauauaucauuugagaaaacaccuagcggacuccaaagagaaaaccgacuuaagacuuauauaccuagcacuggcacacaugauuaaauauagaggacacuuuuuauacgaagaaucauuugacaucaaaaacaacgauauacagaaaauuuuuaacgaauuuauaaguauauaugauaauaccuucgaagguucgagucuaucuggacaaaaugcacaaguugaagcaaucuucacagacaaaauaagcaaaucaaccaaaagagaaagaguauuaaaacucuucagugacgaaaaaucuacaggacuguucucugaguuccuuaaacuaauaguagggaaccaagccgauuuuaagaaacauuucgauuuggaagaaaaagcgccacugcaauuuucaaaagacaccuaugacgaagaucuagaaaaucugcuagggcaaauaggcgacgguuuugcugaccucuuucuuguugcaaagaaauuguacgaugccauuuuacuaucaggaauacuaacgguuacagacccaaguacaaaagcaccccugucagcaucuaugauagagagauacgaaaaccaucaagaagaccuagcagcccuaaaacaauuuaucaaaaauaaccuaucugaaaaauaugccgaaguauuuagugaccaaucaaaagauggauaugcaggcuuuauagauggaaaaacaacccaagaagcauucuacaaauacaucaaaaacuuacuaucuaaacuugaaggagcggacuacuuucuaaauaaaauugaaagagaggacuuccuacguaaacaacgaacguuugauaacggaucaauaccacaccaaauacauuuacaagaaaugaacgcuauauuaagaagacaaggagaacauuaucucuuccuuaaagaaaaccgagagaaaauugaaaagauacuagcauucagaauacccuacuacguaggaccacuagccagaggaaacagagacuuugcaugguuaaccagaaauucagaucaagcaauacgucccuggaacuuugaagaaguaguagauaaagcaaguucugccgaagacuucauaaauaaaaugacaaauuaugaccuauauuuacccgaagaaaaaguccucccaaaacauaguuuacuuuaugaaacguucgcaguauacaacgaacuaacuaaaguuaaauucaucgcagaaggccugcgagacuaucaauuccuagauagcggccagaagaaacaaauaguuaaucaauuauuuaaggauaaaagaaaaguuacugaaaaagacauaauacacuaucuacauaacguugauggcuacgauggaauugaacuaaaagguauagaaaaacaauuuaacgcauccuuguccacauaccaugaccuuuuaaaaauaauaaaggauaaagaauuuauggauaaccccaaaaacggcgagauuuuagagaauaucauacacacccuuacaauuuucgaagacagagaaaugauaaaacaaagacuagcacaauaugacacacuauucgaugaaaaaguaauaaaggcgcuaacuaggagacacuauaccgguugggguaaacucuccgcuaaauuaauaaacggaaucagagacaaacaaaccggaaaaaccauacuagaauaucuuauugaugacggcgacugcaauagaaauuuuaugcaacuaauaaaugaugauggacuuuccuuuaaagaaauaauacaaaaagcccaaguaguugggaaaacggaugauguaaaacaagucguucaagagauacccggcucacccgcaauaaagaaaggaauauugcaaucuauaaaaaucguagacgaauuagucaaggucaugggccacaacccagaaagcauuguaauagaaauggccagagaaaaccaaacaacagcuaagggcaagaaaaacucgcaacaacgcuacaaaagaaucgaggacgcacugaaaaaccuagcaccagggcuggauagcaacauucuuaaagaaaaccccacggacaauauacaacuucagaacgauagacuauuccuauacuaccuucaaaauggaaaagauauguauacaggcaaagcaauagauauaaaccaauuaaguaauuaugauaucgaucacauaauaccacaagcauuuauaaaagacgauucguuagauaacagaguacuuacaucaaguaaagacaaucggggaaaaucagauaacguuccgucuauagaaguaguccaaaaacguaaagcauuuuggcaacaacuauuggauucgaaauuaauaagugagagaaaauucaacaaucuaacgaaagcuaaaagaggaggacuagacgaacgagauaaagugggcuuuaucaaaagacaacuugucgaaacccgacaaauaacgaagcacguugcacaauuacuggauacccgcuuuaacacagaaguaaaugaagaaaaucagaaaauaagaacaguaaaaauaaucacguugaagucuaaccucguuucuaauuuuagaaaagaguucggauuguauaaaguaagagagaucaacgauuaucaucaugcacaugacgcauaucuaaacgccguaguagccaaagcuauauuaaagaaauauccaaaacuugaaccagaguucguauauggggacuaucaaaaauaugaccuuaagagauacauucuaaaaaguaaagcaucaaauaccauagacaaagcaacagagaaauacuucuuuuauagcaaccuacugaacuucuuuaaagaaaagguuagauaugcagacggaacaaucaagaaaagagaaaacauagaguacucgaaugauacgggcgaaaucgcauggaauaaagaaaaagacuuugcuaccauaaagaaaguccuaucccuaccccaaguaaauaucgucaagaaaaccgaagaacaaacaguaggacagaacggaggucuauucgacaacaauauaguauccaaaaagaaaguaguagaugcuagcaaauuaauaccaaucaaaucgucccucagcccggaaaaauacggagguuacgcgcgaccaacaauagcuuauucaguccuaguuauugcggauauagaaaaaggcaaaggaaaagcaaagaaauuaaaaagaauaaaagaaauaguaggaauaacaauccaagauaaaaagaaauucgaaucaaauccagucacuuaucuagaagaaugcggauacaaaaauaucaauaguaaucuaauaauaaaauuaccaaaauacucacuauucgaguucaaugauggccagagacgauuacuagcaucuagcauagaauuacaaaaaggaaacgaacuaauacugccguaccacuuaaccgcacuccuuuaccacgcacaacgaauaaacaagaucucagaacccauacauaaacaauauguugaggcccaucaaaacgaguucaaggaacuacuaacgaccauaaucucauuaagcaagaaauauauacaaaaaccuaacgucgaauuauuacuacagcaagcauuugaccaagccgauaaggauaucuaccaauuaagcgaauccuucauaagucuauuaaaacuaacaucauuuggcgcaccaggagccuucaaauucuuaggaguagagauaucucaaagcagcguucgcuauaaaccuaacagucaauuccucgacaccacacucauucaucaaaguauaacgggucuauacgaaacacguauagaccucucuaaacuaggggaagauuga

SEQ ID NO: 8987 - RNA, 4134 nt, Artificial Sequence
  Cas9 variant
augaauaauaaaccauauucuauaggacuagauauaggaacgaauaguguugguuggaguguaauaacggacgauuacaaagucccaagcaagaaaaugaaaguccuaggaaauacagauaaacgauucauaaagaaaaaucucaucggggcgcuuuuauuugacgaaggaacuacagcagaagcuaggagauuaaaaagaacagcaagacgccgcuauacgcgaaggaaaaauagauuacgcuaccuccaagaaauauuugcagaagaaaugagcaaaguagacaguagcuucuuccauagacuagacgacucauuucugauaccagaagacaaaagagguagcaaauauccaauauucgcaacacucguagaagaaaaagaauaccacaaacaauucccaacaauauaucaccuaagaaaacaauuagccgacucuaaagaaaaagcagaccuuagacucauauaccucguucuugcacauaugauaaaauacagaggacauuucuuauacgaagaagcauuugauauuaaaaauaacgacauucagaaaaucuucaaugaguucaucucaauauaugauaauacguucgaagguaguagccucucuggacaaaaugcccaaguagaaacaauauucacagacaaaauauccaaauccgccaaaagagaaagaguacucaaauuauucccagaugaaaaaucaacuggacuauucagugaguuccuaaaacuaauaguaggaaaccaagcagacuuuaagaaacacuucgaccuagaagaaaaagcaccccuacaauuuucuaaagauaccuaugacgaagaucuugaaaaccuacuagaacaaaucggagaugauuucgcugaccuguucguggcagcaaagaaacuauacgaugccauucuacucagugguauucuuacaguaacugauccaucaacaaaagcacccuuaucagcaaguaugauugaacgauaugaaaaucaccaaaaagaccuagcagucuuaaaacaauucauuaaaacaaaccuuccagaaaaauacguugaaguauucagugaucaaagcaaagauggcuacgcgggcuacauagacggcaaaacaacgcaagaagcauucuauaaauauaucaaaaaccuucuaucaaaauucgauggugcagacuacuuucuagacaaaaucgaaagagaaguauuucucagaaaacaaagaacauuugauaacggaagcauaccacaccaaauacacuuacaagaaaugaauacaauacuaagaagacaaggagaacauuauccuuuucuuaaagaaaacaaagagaaaauagagaaaauauuaacauuuagaauaccauaccacgucggaccauuagcacgaggaaaccgagauuuugcuuggcuuacaagaaacucagaccaggcgauuagacccuggaacuuugaagaaaucguagacaaagcauccagcgcugaagacuuuauaaacaaaaugaccaacuacgacuuauaccuaccagaagaaaaaguccuaccaaaacacucacuacuauacgaaacauuugcuguauacaacgaauuaacaaaaguaaaauucauagcagaagggaugcgggacuaccaguuuuuagacucaggucagaaaaagaaaauaauaaaccaacucuuuaaaaagaaacgaaaaguuacagaagacgauauaaucgacugucuacagaaaauagacaacuacgauggaauagaauuaaaaggaaucgaaaaacaauucaacgcauccuuauccacuuaucacgacauucuaaaaauaauuagagacaaagaguucauggaugaucccaaaaacggagauauacuagaaaacgucauucauacccuuaccauauuugaagaccgagaaaugauaaaacaacgauuagcccaauacaauucuaucuuugacgaaaaaguaauaaaagcgcuauccagaaaacauuacacaggauggggaaaacuaagugcaaaauuaauugacggaauccgugauaaacagacuggaaaaacaauccuagauuauuuaauggaugauggaaaaagcaauagaaacuucaugcaacuaauaaaagacgaugaacuaucauucacugaaauuauacaaaaagcucaggucgucggugacaccgauaaccucagacaaguuguacagaaccuaccuggaagcccagcaauuaagaaaggaauacuccaaagcauuaaaauaguugacgaacuuguuaaaguuaugggacacgcgccagaaagcauaguaaucgaaauggcuagggaaaaucaaaccaccgcgcgcggcaagaaaaauucacaacaaagauauaaaaggauagaagacagucucaaaaacuuagccucaggauuagauaguaauauuuuaaaagaaaaccccaccgacaacauucaauuacaaaacgacaggcuauuccuuuauuaccuucaaaacggaaaagacauguacaccggggaagcacugaauauaaaccaauuauccucuuaugacauagaucauauaaucccacaagcauuuauuaaagacgacucuuuagauaaccgaguucuaaccucaaguaaagacaaccgaggcaaaucagauaauguacccagccuagaagucguagagaaaaugaaagcauucuggcaacaacuacuagacagcaaacucaucucggaaagaaaauauaacaaccuuacuaaagccgagagggaaagagggggacuaaaugaauuagacaaagucggauuuaucaaacgucaguuagucgaaacccgacaaauaacuaaacacguagcccaaauacuagaugcucgauuuaauaaagaagugacagagaaaaacaagaaaaaccgcaauguaaaaaucauuacauuaaaauccaauaugguuagcaacuuuagaaaagaguucggacucuacaaagugagagaaauaaaugacuaccaucacgcccaugaugcauaucuaaaugcaguaguagccaaagccauauuaaagaaauauccgaaacuagaacccgaauuuguuuacggggacuaucaaaaauaugaccuaaaaagauauauuagucgaucuaaagaccccaaagaaguagagaaagcaacugaaaaauauuucuucuauagcaaccuuuuaaacuuuuucaaagaagaaguccacuaugccgaugguacaauaguuaaaagagaaaacauagaauauucaaaagauacaggugaaauugccuggaacaaagaaaaagacuuugcaacaaucaagaaagugcuuucacucccgcaaguaaauauagucaagaaaacagaagaacagacaguaggacaaaacggagguuuauuugacaacaauaucgucaguaaaaagaaaguaguugaugcaaguaaacuuauucccauaaaauccgguuuguccccagaaaaauacggggguuacgcuagacccaccauugccuauagugucuuggugacauauaaacaaaacaauaaaauaaagaacacaaugguuggaauacccgugcucacgaaacuagaauuugaaagagaccccaaccucuaucuaagaaauuuaggaauaaacaacguaagucacguuaucaaauuaguuaaauacaccguccuugaguucaaacauaaguauggcacauaccgaagauuuauuguuucaaaccaagaacuaaaaagggcaaaucaaauuuucguaaccacaaaacaaaugaaauuaaucucucaguacacaacauuagacaaaaaugaacacgauagcuuacuuaaaaauaaccagcaauuaauccagagcauuuggaaccaauucuuagaguucauguuagcaacugaccuaguaaacaaaaagcaguacgaugaauuaauacuaacuaacaaucaaacuauugaagaaugucgcaacauaaugaacagaguuauaacaacauuaucuuucacaaauauaaacgcgggccagaaaaagauaauauucgaugacacacugucauuaccaaucaaacgauggcaauucacagacuccgauaaaauggugaagaaaauuauagaaucaacgcuaauucaccaauccauaacugggcucuacgaaacgcgaauagauuuaucaaaacuuggugaagacuga

SEQ ID NO: 8988 - RNA, 4134 nt, Artificial Sequence
  Cas9 variant
auggaaaguaaucaugauggagaacaagugaaauauacacuaggccuugacauuggaacaucaucaauaggcuacgcagccauagacaaacaucaaaagccuauuagagccaaaggaaaacaugucauaggaguucgauuguuccaagaaggccaaaccgcugcagacagaagagcauuccgaaccacaagaagaagauuaaaaagaagaaaauggcgauuaaaucuacuuaauagacucuuugauccauaucuuagcgaaguagaucccaacuuuuuaccccgacuuagacaaaguaaucuaagcccaaaagaugauaauaaacacuuuaacgggucgacauuauucccagacaaaacagaugcagcuuucuacagacaauaccccacaauguaucaucuuagauacgcauugaugacagaaaaaagaaaauuugacauacgagaagucuaucucgcuauacaucauauagucaaauaucguggcaacuuuuuaaacucugccacaguagauucauucaaaacauccaacauagacuuuacuucucaauuugacagacuaaacgaauuauauagacaaguuaucuuagacgaaccguuucaaauuaacauggaucaaguagaugagaugacaaauaagcuacucgauaacgaugcauugaaauuagauacacaaaaacaaguagcaaaacucuuaccaguuauauauaacgauaaacccaucgacaaacaauacacacgaauagcuaccgaguucagcaaagcuauacuggguuauaaaacgaaauuagacgucauauuaaauuuagacacacagaaugcaaaagacugggucauuagauuagaugacgaagauauagaugauaaacuaccugcacuuguagaaaaucuagacgaaucgcggcaagaaaucguaaccauaaucagagaucuuuacgcgcaaaucacacucaacgcaauaguaccaaaaggaaagucacucucagaauccaugguggauaaauacaacgaucacaaagaucaccucgauuuacuaaugggacuuauacaugaacuaggagaugacucagcuaaaggaauaaaacuccgugaggcuuacacucaauauguagguaagucugaugacaaaacccuaaaucaggacgauuuuuaugcagcaauaaaaaaaaaucuagacgaagacucuaagagaagccccaaaauucaacgccuuauagaacaagccucuuucaugcccaaacaaaggacaucugcaaaugggguuauaccacaucaacuacaccaacuagaauuagauagaauaauugaaaaucaaggcagguauuauccauucuuaaaaaaaccaaacccaaacacacauaaaccgaauggaggaaaauacaaacuagacgaacuaguugcauucaggauuccauauuacgucggcccacuuaucacuaaaagagaucaagaaaaaacuagcggagcugauuucgcauggaugauacgaaaaccagggcaagaaggagagauaacuccauggaauuucgaccaaaagguugauagaauggccucugcaaauagauucauaagaaggaugacaacaaaagauucauaucugguagccgaagauguccuuccagacgcuagccuaauauaugaaaaguucaaagcucucaaugaacuuaacaugcucaaaguuaacgauucaagacuaucucccucacaaaaacaggaucuauuuaacaauuuguucaaaaaacaaaaaacaauaaggaccaaaaaacuucaaacauacauucgaaccaacugggaacuaccaagcguuaugauaagcggauuggcagaccccgauaaauuuaacucuucuuuaucaacauauauagauuucagagauaucuucggugaaaaaguugaugacccaaaccgacaagcagacuaugaagaaaucauagaauggagcacagucuucgaagacaggaaaauauaccaagcgaaacuaaaccaauuagacuggcuaacagaaccacagagaaaagcccucuuaaccaaaagauauacagguugggguagacugucaaagaaauuguugacaggcuuaaaggaucaaaacggagacagcauauuagaccaacucuggaaaacaaaugacaacuucaugcaaauacaaucacgggaugaauucgccaaacaaauacaugaugaaaacgcaaaacaauuucaugaagcgaacaauguagaugauauauuagacgacgccuucacauccccccaaaauaaaaaagcaauccgacaagucgauaaagugguacaagaugucguaaaagcaguagguuaugcuccugacaaaauagcaauagaauuuacacguucacucgaaaacaauccucaaagaacuguaucuagacaaagacaauuacaagccgccuacaaaaauaucccacgcgaaauuaugaaguccggacugauggcugagcuagguaguguggcagacuccaaaaaaguccugagcgauaaacuauaccucuacuuuacacaaaugggaaaagauauguacgaggauaaaacaauaaacauugacaaucuaccaaauuacgacaucgaucauauuuuaccacaagcguucauuaaagaugauuccauagacaauagaguacuaaucagcaaagaagaaaacgcccguaaaaguaaucgagucccccugaaauucuucggagcuaaacgaaugggauucuggaaagauuugcuaaacaacggauugauaucaaaucgaaaauuccaaaaccuaacaacugauccagaaaaaauuagcaaauauucugcaaagggcuuuauacauagacaacuaguugaaacaucacaagugauaaggcuagucgcaaauauacuaggaaaugaauacucucaagcuggaaccacaauaauagagguuuccgcaaaaaugaacagacaacugagggaagacuuccaccucaucaagaacagaaaugucaaugacuaccaccaugcgauggaugcuuaccuaaccgcauacguaggagacuauuuauaucuacgauaccccaaacuccggccauacuuuguauacggagacuucaaaaaagcugaagaucaagauuuaaauauaagaaauuucaacuuucuucacgacuuaaaagauaaugaaaguuuggacaaaaucguggauucugaaacaggagaaaucgucugggaaaaacauggaucggucaaacaacuaaaaaaaguauaccauuauaaauuuaugcuaguuucucaagaaguauacacacgacaagaugcacuuuucaaccaaacuauauauccugccagugacgcagacaaaagaaaacuaauuccaauaaaaaacaguaaaccgguugacguauacggaggcuacagcggcaacauagaugcauacauggcuauaguucguguacacgggaaaaaggaagacaauuauaaagucguaggaauaccaaugagagccgucacaaaacuaaaaaaagcagaaaaagaaggccaugauaguuaccucaaugcuguucaugaaguauuaaaaccccaauucacaaaaaaaaaaaaaaaucgaaaaacaggagaaauuacagaaacaguagacgaauucgauguacuauuaggaaaaguguacuacagacaacugaucguggauggcaauaaaaaauucaugcuaggcucguccuccuaucaauacaacgcgaaacaacuaguucuaagugacaaagccaugcaaguacucucaaaaaauggaaaaguaaaaucccaagacgaaaaccaaaauuuaauagacgucuacgaugaaauacuagaaaaaguagaccaauacuucgaacucuacgaucagcgacacuaucgagaaagcuuacacaaaggacgugggauauucguaaauuuaccguuaucaaaccaauaugauggaucaaaacuuacaucguaugggaaauaugaaacaauagaugccauccuaaauggacuacacgcuaaugcaaccaugucaaaccuucguuauuuagguauaucuaguccuuuuggcaaaaugcaagccucaaauggacuaacaauagaccccgacagcauaauauguuaucaaaguccaacaggauuauuugaaagacagauuaaauuauccgauuuauga

SEQ ID NO: 8989 - RNA, 4134 nt, Artificial Sequence
  Cas9 variant
augaauaaaccuuauaguauaggucuagauauaggcacaaacuccguuggcuggucuauuauaacagaugacuauaaaguaccagcgaagaaaaugagaguacugggaaauaccgauaaagaauacaucaagaaaaaccuaauuggagcacuacuauucgauggaggcaacacagcagccgacagacgauugaaacgaacugcaagacggagguacacaaggcgaagaaauagaauauuauaucuucaagaaauauucgcagaagaaaugucaaaaguagaugacuccuucuuucacagacuagaagacagcuuucuagucgaagaagauaaacgaggcucaaaauacccuauauucgccaccaugcaagaggaaaaauacuaucaugaaaaguucccaacuauauaccaccuacgaaaagaauuagcagauaagaaagaaaaagcagauuuaagauuaguauaccuagcauuagcccauauaauaaaauucagagggcauuuccuaauagaagaugaccgauucgacguaagaaauacagacauucaaaaacaauaccaagcauuccuagaaauauucgacaccacuuuugaaaacaaucaucuacuaucacaaaauguagauguagaagccauucuuacagauaaaauaagcaaaucagcgaagaaagacagaauauuagcccaauacccuaaccagaaaaguacaggaauuuuugcagaauuucuaaaauuaauaguaggaaaccaagcugauuucaagaaacacuucaaccucgaagacaaaaccccacuacaauuugcaaaagauucguaugaugaagaucuugaaaacuuacuuggucaaaucggagaugaguucgcugaucuauucagcgucgcuaagaaacuuuacgacucuguucuucuaucaggaauauuaacuguaacugauuuaucaaccaaagcaccacuaagcgcaucaaugauacaacgcuaugaugaacaccacgaagaccuaaaacaccucaaacaauucgugaaagcauccuuacccgaaaacuaccgagaaguuuuugcagacaguuccaaagacggauaugcuggcuacauagaaggcaaaacaaaucaagaggcuuuuuacaaauauuuacucaaauuacuaacuaaacaggaaggcucagaauacuuccuagagaaaaucaaaaacgaagacuuuuuacggaaacaaagaacauucgacaacggaagcauuccacaccagguacaucugacagaacuaagggcaauaauaagacgucaaucugaauacuauccguuuuuaaaagaaaaccaagauagaauagaaaagauauuaacauuccgcauacccuacuauguagggccccuagccagagaaaaaucggacuucgcuuggaugacgcgaaaaaccgaugacuccauaagaccauggaauuuugaagacuugguagauaaagagaaaagugcagaggcuuucauacauagaaugaccaacaaugaccuuuaccuaccggaagaaaaaguauuaccaaaacacagucuaauuuacgaaaaauucacuguauauaaugaacuaacaaaagugagauucuuggcggaaggauuuaaagacuuccaauuucuaaauagaaaacaaaaagaaacaauauuuaacucacucuuuaaagaaaaacgaaaagugacagaaaaagacauaauauccuuccuaaacaaaguagacggguaugaaggcauagcuauaaaaggaauagaaaaacaauucaacgcuagccuaucuacguaccaugaucucaagaaaauacucggcaaagacuuucuagacaauacagacaaugaacuaauauuggaagauauuguacagacuuuaacacuauuugaagauagagaaaugauaaagaaaugccuagauauuuauaaagacuucuuuacugaaucucaacucaagaaauuauacagaagacacuacaccggguggggcagauuaagugcaaaacuaauaaacgguauucggaauaaagaaaaucagaaaacaauauuagauuaucucauagaugaugguuccgcaaaucgcaacuucaugcaauuaauaaaugacgacgaccuaucuuuuaaaccaauaauagacaaagcaagaacaggaucacauagcgacaaccuaaaagaaguaguaggugagcuggcaggaucuccagcaaucaagaaaggaauauuacaaucauuaaaaauaguugaugaacucgucaaaguaaugggcuaugaaccagagcaaauaguaguugaaauggcucgagaaaaccagacaaccgccaaaggacuuaguagaucccgacaacggcuuacgacccuacgagaauccuuagcgaauuuaaaauccaauauauuagaagagaagaaacccaaauaugugaaagaccagguagaaaaucaucaucucagcgaugacagacuauuuuuauacuauuuacaaaaugguagagauauguacaccaagaaagcacuagauauagacaaccuaucacaauacgauauagaucacauuauaccucaagcauucauaaaagaugauucuauagacaacagaguucuugucagcucagccaaaaauagaggaaaaagugacgacgugccaucaaucgaaaucguaaaagcccgcaaaauguuuuggaaaaaucuauuagacgccaaacuuaugucucaaagaaaauacgauaacuuaacuaaggcugaaagaggaggacucacaucagacgauaaagcuagauuuauacaacgacaguuaguugaaacccgacaaauaacuaagcacgucgcaagaaucuuagaugaaagauuuaacaaugaagucgacaaugguaagaaaauuuguaagguaaaaauagucacucucaaaucaaauuuaguuucaaacuucagaaaagaauuuggcuuuuauaaaaucagagaagucaacgauuaccaucaugcucacgacgcauacuuaaacgcaguaguagcaaaagcuauacuaacaaaauacccacaacuagaaccagaguucguuuacggaauguacagacaaaagaaauuaagcaaaauaguccacgaagauaaagaagaaaaauacucagaagcaacuagaaaaauguucuucuacucaaaccuaaugaauauguucaaacgagucguaagauuagccgauggguccaucguaguaagaccagucauugaaacaggccgauacaugcgaaaaacugcaugggauaagaagaaacauuucgcaacaguaagaaaaguacuaucauacccccaaaacaauauagucaagaaaacagaaauacaaaccggaggcuucuccaaggaaagcauucuagcacacggaaacucugacaaauugauaccaagaaaaacgaaagauauauaccuugaccccaagaaauacggcggcuuugacaguccaauaguagccuacucaguucuaguuguagcagauaucaagaaaggcaaagcucaaaaacuaaaaaccguaacagagcuauugggaauaacuaucauggaaaggagccgguucgaaaagaaucccucagcguuccuagaaucaaaaggauaccuaaacauaagggaugacaaauuaaugauucuacccaaauacagcuuauucgaacuagaaaauggacguagaagacuauuagcuucugcgggagaacuccagaaagggaacgaacuagcucuaccgacacaauuuaugaaauuuuuauaccuggcuucucgcuacaaugaaaguaaaggcaaaccagaagaaauagaaaagaaacaagaguucguaaaucaacacguaucguacuuugaugacaucuuacaacuaauaaacgacuucucuaaacguguuauucuugccgacgcaaaccuagagaaaauaaacaaacuauaucaagacaacaaagaaaauauuccgguagaugaacuagcaaauaauauaauaaacuuauuuacuuuuacuucauuaggagcuccagcagcauucaaauuuuucgauaaaauuguagacagaaagagauauacaagcacuaaggaaguauuaaacucaacccuaauacaccaaucaaucaccggauuauacgaaacgagaaucgacuuagguaaacuuggugaagacuga

SEQ ID NO: 8990 - RNA, 4134 nt, Artificial Sequence
  Cas9 variant
auggagaaaacauauagcaucggauuagauauagguacuaacagcguaggaugggcagucauaacagaugacuauaaaguuccugcgaagaaaaugaaaguauuggggaauacagacaagaaauacauaaagaaaaacuuacuaggugcauuguuauucgacucaggagaaaccgcagaagcaacuagacucaaaagagccgcacgaagacguuacacacgacgaaagaacagacuucgauaucuacaagagauuuucgcaaaagagauggcaaaaguagaugagaguuucuuccaacgacuagaagagagcuuccucacugaugaugacaaaacuuucgacagccacccaauauucggaaauaaagccgaagaagauacauaucaucaagaauuuccaacaauauaucaucuacgaaaacacuuagcagauagccccgaaaaaguggaucuccguuugguauacuuagcuuuagcccauaugauaaaauuucguggacauuucuuaauagaaggacaguuaaacgcugaaaacacagacguacagaaaaucuucgcagacuucguuggaguuuaugaucguacuuucgacgacagccaucuuucagaaauaaccguagaugcugccagcauccucacagagaaaauaucuaaauccagaagauuagaaaaccuaauaaaacaauauccuacagaaaagaagaauacacuguuugguaaucuuguugcucuagcacuaggcuuacaacccaacuucaaaacaaauuucaaacuuagugaagacgcuaaacuacaauucagcaaagacacauaugacgaggaucuagaagaacuuuuaggaaaaaucggagacgacuacgccgaccuauucacugccgcuaaaaaccucuaugaugcuauccuacuuaguggcauacuaacagucgacgacaacaguacaaaggcaccacuauccgcauccaugauuaagagauaugaagaacaucacgaagaccuggaaaaacuaaaaacauuuauaaagguuaacaacuucgacaaauaccacgaaauauuuaaggacaaauccaaaaacggauaugccgguuauauagaaaacggaguaaaacaagauauauuuuacaaacaucucaagagcauaauaucggagaaaaacggaggccaauacuuccuagauaaaauugaacgagaagacuuuuuacguaaacaaagaacauuugauaauggcagcaucccguaucagauacaccuucaagaaaugagaaccauacucagaagacaaggcgaauauuauccauuucuaaaagagaaccaagcaaaaauagaaaagauccuuacauuucggauaccauacuaugugggaccucucgccagaaagaauagucgauucgcgugggccaaauaccauucagaugaaccaauaacaccuuggaacuuugacgaagucguagauaaagaaaaaucagcggaaaaauucauaacaagaaugaccuuaaacgacuuauacuuaccugaagaaaaaguacuaccuaaacauucauauguuuacgaaacguuugcaguauauaacgaauuaacaaaaauaaaauauguaaaugagcaagguaagagcuuuuucuuugaugccaacaugaaacaagaaauauucgaucacguauucaaagagaaucgaaaaguaacaaaagcgaaacuacuauccuacuuaaacaaugaguucgaagaguucaggauuaaugaucuaaucggccuagauaaagauucuaagagcuucaacgcaucauuaggaacguaucaugaucuaaagaaaauacuugacaaaucauucuuagacgauaaaaccaacgaacagaucauagaagacauaguacuuacacuaacccucuucgaagaucgcgacaugauccacgaaagacuacagaaauacucagacauuuuuacaucacagcaacucaagaaauuagaaaggagacacuacaccggauggggacgauuaaguuacaaacuaauaaacggaauacgcaacaaagaaaauaauaaaacaauccuugacuuccugauugaugauggagacgcaaacagaaacuucaugcaacucauuaacgacgacucauugaguuuuaaaacaacuauacaagaagcacagguaguaggagauguagaugacaucgaagcaguaguacaugaccugccaggaucaccagcaauaaagaaagguauucuccaaucaguaaaaauaguagaugagcuaguaaaaguuaugggacauaauccacaaaacauaguaauagaaauggcaagagaaaaucaaaucacgggguacggacgcaacagaagcaaccaacgccucaaaagacuacaagacagucuaaaagaauuuggcucagacauauuaaguaaaaagaaaccaagcuacgucgacagcaaaguagaaaauucccacuuacaaaaugacagacuauuucuauacuauauacagaacggcaaagacauguacacuggcgaagaacuagacauagaccaucucagcgauuaugacauagaucacauaauuccgcaggcuuuuaucaaagauaauucaaucgauaaucguguuuuaacgucgucagcuaaaaauagaggaaaaucagacgacgucccaucaauagaaauuguucgaaauagaaaauccuauugguacaaauuauauaaauccggacuaauuucaaaacgcaaauucgacaaucuaaccaaagcagaacgaggaggucuaacugaaacagacaaagcaggauucauaaaacgucaauuaguugaaaccagacaaaucacuaaacacguggcacaaauuuuagaugcacgguuuaauacaaaaugugacgaaaaugacaaagugaucagagauguaaaaguuauuacacuaaaauccucccuagucucacaauuccguaaagaguucaaauuuuauaaaguuagagaaauaaacgacuaccaucaugcacacgacgcguaccucaaugcuguggucggaacugcacuacugaagaaauacccaaaacuggcaccagaauuugucuacggagaauauaagaaauaugacguaagaaaacuuguagccaaaucaucggacaaccacagcgaacugggaaaagcaacagcgaaauauuucuuuuacuccaacuuaaugaacuucuuuaaaacugaaguuaaauaugcagauggacguguauuugaaagaccagacaucgaaacaaacgcagauggggaagugguuuggaauaaacaacgcgacuuuaacauuguaagaaaaguccucaguuacccucagguaaacauuguaaagaaaguagaaguacaaaccgguggauuuucgaaagaaucaauacuacccaaaggcgacagcgacaaacuuauuccaagaaaaacaaagaaauuacaaugggaaacacaaaaauauggcggcuuugacucaccaacugucgcauacucuguauuagugguugcagaugucgagaaaggcaaaacuagaaaauugaaaacaguaaaagaauuggucggcaucuccauaauggagcgaagcucauuugaagaaaacccagucucuuuccucgaaaagaaaggauaccacaacguacaagaagacaaacuaauaaaacucccuaaauauucccuuuucgaguucgaaggcggccgcagaagacucuuagccagcgccacugaacuccagaaaggcaaugaaguaguauuaccgcaauacaugguaaacuuacuauaucauucacaacacguaaacaauucgcacaaaccagaacaccugaacuauguaaaacaacacaaagaugaauuuaaagacauauuuaauuuaaucauaagcauugcacgaaucaacauacuaaaaccaaaaguuguagacaauuuaauaaacgaguucacugaauacggacaagaagauauaagcagccuuucagaaaguuuuauaaaucuacuaaaauuuauaucuuuuggcgccccaggcgcauuuaaauuucuuaaauuggauguaaaacaaucaaaccuacgcuacaaaucaacaacagaagccuuaagcgccacacucauucaccaaagcgucaccggguuauaugaaaccagaauugacuuaaguaaacucggagaagaauga

SEQ ID NO: 8991 - RNA, 4137 nt, Artificial Sequence
  Cas9 variant
augaaaaccuuugcagaagaguauguaauggauaaaucaaaacccuacggaauaggccucgacauagguaccaauucaguaggguuuguagcaacggacgcagaaggacaccuuauacgucuaaaaggaaaaaccguaaucggagcguaucuauuuaaugcaggcauaucagcugcggaaagacgcggauuuaggacgacaagacggcgauuaucacgaguaaaauggcgucuuggccuucuaagagaaauauuugaaacacauuuccaagaaagcaugggugaaaacgaggauaacgacuucuuucugagauuuaaauauaguaacauaucaccaaaagauccacaauuuagcacagcaaaaggacuuuuuaacgauaggacagacaaagaguuuuaugaucaauacccuacaauauaucauuuacgccgagcgcuaaugacagaagaucaccaguucgauauaagagaaauauauauugcaaugcaucacauagugaaauacagaggacauuuccuaaaagaagggagagcuaaagauuuuaaaguaggagaucuuagauuauuagauaauuuuaaaaugaugaaugaacaaauagaagaaauaaauccacucuggcaauuaaaacuaccaacagacgacgcgaguaucaaaagcauaaccgcuauuuugcuagacaacacgcaaagucaaaacgauagacaaaaagccguuacuaaaguuauauuagcuacuuuagucaaagcaucagacaaagacauuaacgcagcccgaaaaagauucgucggagaacuuaguaaagcgaugguaggauuaaaaacgaaacuuuggguauuagcugacgugucccaaaauggagauugggaaauaaaauacgaaaauuacgccgauuuugcugaaacaauaggaucgggagaguccgacaccauacaaucuuuauuuaacgaaaucaacgaccuauauggaguaauaacccuugcugguauaauuccaaaagaagcugaaucauuuagugaugguaugguccgaaaauaugagcaucacagaaagaaucuugaauuacuuaaaguauacugcgcggaacaaagugacgggaaaagaggaagacaaauacgacaaaccuacgacaaauacauagauggaguggauagcaaacaauuuacacaagaagauuuuuacaaagcacuuagcaaguucacagcgaaagacgaagcaacaagugaaaacgcaaaacucauagcacaagaaaucgccguugggacguuuaugcccaaacugcguacaaaagcaaauggaacaauaccacaucaacuucaucaaaaggaacuagacgccauaauugaaaaucaaaagaaauauuaccccugguuaggcgaaguaaacccaguagaaucccacagacgagcacuuccauauaaacuagaugaacucguuagcuuuagaaucccuuacuacguagguccaaugguaacuccuacuaaaggagaccccgaaaaauccaaauuugccuggauggucagaaaagaaccaggaacuauaacgcccuggaacuuugaccaaaaaguagauagaagcgcgucgggagaagcauuuauucaacgcaugaaaacuacagacacauuccuaauuggugaagacgucuuaccccaacaaagucuucuuuaccaaaaauuugaaguacuaaacgaacuuaauaaaauaaugauaaacggaaaaccgauauguagagaacaaaaacaaagguuauuuaagcaacucuucaugcaauauaaaacaguaaccguuaagaaagugcagcaaaaccuaauugcaaauggagaagaaucggaaaacgucccaaucacaggccuaagugauccgcuacguuuuaacucaucuuuuagcacauauauagauuacaaagacauacuuggaacggcugcaguaaaugauaaugcgaaacaaagugacauagaacaaauuauagcuuggucaaccaucuucgaagacgcggcaaucuuucgagaaaaauuaaaugacauaacauggcuaaacgaugaucaaagaaacaaacuaagucacaaaagauaucgcggauggggcagacacucaagaaaauuacuugcuggucuucgagacggggaaggacaaacuauaaucgaacgacuuuggaacacaaacgacaauuuuaugcaaauucaaaacgacagcgaaauagcgagacaaauuacugaagccaacuccucgaaaauggcaacugcagaaggaaccgaugaaauaauagauggauuuuacacaagcccagaaaacaagaaagcccugagggaggucaugaaagucguuaaagacauacaacgagcccaucacggacaggcuccagcuuggguuuacauagaaucaccccgagaaacaccccgacccggucaaagaacugugucuagagaacaacaacuaaccgaucucuaugaaggagcugcuaaagagauuguugacgacgcugucuuaaaugagcuuaaagauaagguaaaaagcaaagaaaacuuuacagacaaacuugucuuauacuuccuccaaaauggucacgauauauacgcaaacgauaguauaaacauagauaaucuaaacgccuaugacauagaccacguacuaccacaaucauuaauuaaggaugauagccuagauaaucgaguuuuaaccacccacgaacguaaccuaaagaaaucaaaccgcuuugcaacagaacuauucgcagaccaacgaaagaaaugggaaaaauggcacagacuaggccuaauuuccagccgaaaacucaaacaccuaacaaugcaacccaauagcgucgaaaaauuugcacacgguuuuaucgcucgucaacuuacggaaacuaggcagauuauacacuugacagcaaacgucuuaaguaacuuauaccaagaaaacgauacuaaaauugucaugauaaaagcaggacucaauuccgaguucagaagaacguuugauuuuccuaaaaacagauccguaaaugacuaucaccacgccuuugaugcuuuccuaaccgccaaaaucggacgauaucuacuggccagauauccaaaacuagaaccauucuuugucuauggcaauuuugucaaaaacccaaaagcgaugaagagauuaucaucauucgauuucauugcacaauuagcagcaaaaaccgaugacaccucacauauagaccaaagaucauuaaaacaaguaccaguaguaaaugaagaaacaggagaaauaguaugggauaaagacauagaauuggcagaauuagacaaaacuuauaauuacaaaacaaugcuuguaaaaagagcucaaacagaaaacaaugcccaaauguuuaagcaaacaguuuuuaaagcaagagauaaucaaaacaaaacacugauaccuguuaaaaauggacuauccacagauguauaugguggucacagucaacaagcaauauccuaucucugcauaguauggguaggacaaaagaagaaauacagaguccuuggaauaaguacugcccacgccgguauauuaaacaacuuugagaaaaacuacggaagauucgaagcuaaaaagaaacuacaggaaauaguuucgaauaccuuggacaaugcugauagaaaugauuucaaaauagucgcuccaaaaguguuauucgaacaaguaguggaagacgacaacaugaaauuuggauuaggauccgcgagugauuacagaaauguacaacaacuauuucuaagucgcaaaaaccaacuucuauuagcaaacaugaugacagaccaaauucacgaccaagauuuagugcaccuauucgaugaaauagucggucagaugaaugcacauuucccuaucuucgacagaggaggguauagaucgucauuaacucaaagucgagauaaauuucuaaaacuaccauuuaagaaaaaugaagaccucaucacaaaacaggaaguaauccgacgaauacuagacggucuucaugcaaacgcaaaccggaaagaccuaaaaauuauagguagcaaaggagacuuugggcgccuugguacuaagaaaauauaucuuaguaaagaugcgaaacuaauauauaccagcccuaccuguuuauuuacacgaacaguuccauugucaucuuuauga

SEQ ID NO: 8992 - RNA, 4137 nt, Artificial Sequence
  Cas9 variant
augacaaaugaaaaauacucaauaggccuugacauuggaacaucaaguauaggcuucgccguagucaacgauaacaauagagucauacgugucaaaggaaaaaaugcuaucggcgucagauuauucgaugaaggaaaagcugccgcggaucgaagauccuuuagaacaacuagaagacguuuaucaagaagaagguggagacucaaacuuuuacgagaaauuuucgacgcauauauaaccccgguagacgaagcauucuucauuagguuaaaagaaaguaaucucagcccaaaagacucaaaaaaacaguacucuggagacauacuuuuuaacgacagauccgacaaagauuuuuaugaaaaauauccuacuauauaucacuuaagaaaugcauuaaugaccgaacacagaaaauucgacguacgagaaauauaccucgccauucaucacauaaugaaauuuagaggacauuuucuaaacgcaacuccugcaaacaacuucaaaguaggaagacuaaaccuugaagaaaaauuugaagaauuaaaugacauuuaccaaagaguuuuuccagacgaaaguauagaauuccggacggauaaccucgaacaaauuaaagaaguacuacuagauaauaaacgaucgcgagcggauagacaaagaacauuagucucagacauauaccaaaguuccgaagauaaggauaucgaaaagagaaacaaagcagucgcaaccgaaauacuaaaagccucauuagguaauaaagcaaaacuaaauguaauaaccaacguagagguggauaaggaagcugcaaaagaauggucuauaacauuugauuccgaaaguaucgacgacgaucuagccaagauugaaggacaaaugacagacgauggccacgaaauaauugaaguucugagaucacuauacucagguauaacccuuucagcuauagucccagaaaaucacacucuaagccagucuaugguugccaaguacgaccuacauaaagaccaucucaaacuguucaaaaagcuuauuaacgguaugacugacacaaaaaaagcuaagaaccucagagccgccuacgaugguuacauagauggcguaaaaggaaaaguacuaccacaggaggacuucuauaaacaaguacaaguuaaccuagaugacuccgcagaagcaaaugaaauacagacauacaucgaucaagacaucuucaugccaaaacaacgaacaaaagcuaauggaucuauaccacaccaguuacaacaacaagaacuagaucaaauaauagaaaaccaaaaagcauacuauccuuggcucgcagaacuaaacccaaauccugacaaaaaaagacaacaauuagccaaauauaaacuagacgaacuagucacuuuuagaguaccguauuacguaggcccaaugaucacugcaaaagaccaaaaaaaucaaucaggagcagaauucgcuuggaugauaagaaaagaaccugguaacauaacaccauggaauuucgaccagaaaguagauagaauggcaacugcaaaucaguuuauaaaaagaaugaccacaacagauacauaccuacugggagaggacguacugcccgcucaaucauuauuguaucaaaaauuugaaguuuuaaaugagcucaauaaaauccgaaucgaccacaaaccuaucuccauagaacaaaaacaacagauauuuaaugauuuauuuaaacaauuuaaaaauguaacgauuaaacauuugcaagacuauuuaguaagucaaggacaauauaguaaaagaccacuaauugaaggauuagcggacgaaaaaagauuuaacucuucacuguccaccuauucagauuuauguggaaucuucggugcuaaacugguagaagaaaacgaccggcaagaagaccuagaaaaaaucauagaauggucaacuauauucgaagacaaaaaaauauauagagcaaaacuaaacgaucuaacaugguuaacagaugaucaaaaagaaaaauuagcaacaaaacgauaccaaggcuggggaagauuaucuagaaaauuacuaguaggucuaaaaaacagugaacaucgcaacauuauggacauacuauggauuacgaacgaaaacuuuaugcaaauccaagcagaacccgauuuugcaaaacugguuacggacgcaaauaaaggaaugcuagaaaaaaccgauucacaggaugucaucaacgaccuuuacacgagcccacaaaauaaaaaagcuauacgacaaauacuacugguuguccacgacauacaaaaugccaugcacggccaggcccccgcaaaaauccaugucgaauucgcaagaggagaggagcgaaacccaagaagaucaguucaaagacagcgacaaguagaagccgcauaugagaaaguaagcaacgaacucguaucggcuaaaguuagacaagaauucaaagaagcaauaaauaacaaacgcgauuucaaagaccgacuacuacuauauuuuaugcaagguggcauagauauuuacaccgguaaacaauugaacauagaucaacucucuagcuaccaaauagaucacauacuaccacaagcauuuguuaaggacgacuccuuaacgaaucgcguucuaacuaaugaaaaucaaguaaaggcagauagcgugccuauagauauuuucggaaagaaaaugcugucuguauggggacgaaugaaagaccagggauuaaucucaaaaggcaaauauaggaaccuaaccaugaaccccgaaaauauauccgcucauacagaaaacgguuucauuaaucgacaacucguggaaacucgacaagucauuaaacucgccguuaacaucuuagcggacgaauacggagacuccacucaaauaaucucagucaaagccgacuuaucacaucaaaugagagaagacuucgaacuacugaaaaacagggacguuaacgacuaucaccacgcauucgaugcauaccuagcagcguuuauagguaacuaccuauuaaaacguuacccaaagcuugaaagcuauuucguuuacggugauuucaaaaaauuuacacagaaagaaacaaaaaugcgccgcuucaacuucaucuacgaucuaaaacauugugaucaaguaguuaauaaggagacuggcgaaauacuauggacaaaagacgaggauauaaaauacaucagacacuuauucgcuuauaaaaaaauuuuaguaucacacgaaguucgagaaaaaagaggagcguuauacaaucaaacaauuuauaaggcaaaagacgauaaaggcuccggacaaggauccaaaaaauuaauuagaauaaaagaugauaaagaaacuaagauuuacggaggauacagcggcaaaucucuagccuacaugaccauuguccaaauuaccaaaaaaaacaaagugucguauaggguaauaggcauaccaacacuugcacuagccagacuaaauaaauuagagaaugauucuacugaaaacaacggggaacuauauaaaauaauuaagccacaauucacacacuauaaaguggacaagaagaacggcgaaauaauagagacuaccgacgauuucaaaaucguagugucgaaaguacgauuccaacaacucaucgacgaugcgggacaauuuuucaugcuagcauccgacacguauaaaaauaaugcacaacagcuaguaauaucaaauaaugcauuaaaagccaucaacaauacuaacauuacagauuguccgcgagacgauuuagaaagacuagacaaccuaagacuggacucagcauucgacgaaauuguaaaaaaaauggacaaauauuucucugccuaugaugcaaacaauuuccgugagaaaauuagaaacucgaacuuaaucuucuaccaacuaccaguagaagaccaaugggaaaauaacaaaaucacagaauuaggaaaaagaacaguacucaccagaauacuccaaggcuuacaugccaacgcaacuacaacugacaugagcauauucaaaauaaaaacuccuuuuggacaacuacgccaacgaagcggcauaucauuaucagaaaacgcccaauuaaucuaccagucccccacaggauuguucgagcggagaguacaacuaaauaaaauuaaauga

SEQ ID NO: 8993 - RNA, 4137 nt, Artificial Sequence
  Cas9 variant
augaaaaacaaggauuauucaauaggacuagacauuggcacuuccagcauaggcuuugccgucguagacgaaaauaaccauguaaugcgaguaaaaggaaaaaacgcgauaggcguaagacuuuucgacgaaggaaaaccagcagccgacagacgagcuuucaggacaacaagaagaagacuaucgcgacgccgguggagacuaaaacuauuaagagaaauuuuugacagcuacauaacaccagucgaugaagcauucuucauaagacuuaaggagucgaauuuaucacccaaggacucuaaaaaacaguauaguggagacauccuauucaacgauagaucagacaaagauuucuacacaaaauacccuacgauauaccaucucaggaaugcccuuaugacugagcaccaaagauucgauauccgggaaaucuaccuagccauucaccauauaguuaaauuccgcggccauuuccugaaugcaacacccgcuaacaacuuccagguaggaaaacuagauuuagaccaaaaauuugaagauuuaaaugacauuuaucaaagggucuuccccgaugauucaaucgaauucagaauagauaaucuugaacaaaucaaagcaguacuccuagacagcaaaagaucucggagcgaccgacaaagaucgcuuguagacgacguguaccaaacaagcgaagacaaagagguugaaaaacaaaauaaagcgguugcaacggaaguacucaaagccauucuaggcaauaaagcaaaacuaaacaucaucgcaaacgucgaaguagacaaagaagcugcuaaagaauggacaaucaccuuugacagcgaaagcauagaugaugauuuagccaaaauagauggacaaaugaccgacgauggacgagcuauuguagaaauacuucguucauuauacucuggaaucacacuaagcgcuauaguaccagaaaaccacacccugucacaagccaugguagcaaaauaugaucuacacaagaaacaccucacauuacuaaagaagcuaaucaacucgaugacagauacaaaaaaagcaaaaaacuuaagggcagcauacgacggcuauguagauggagucaagggcaagguacucacgcaagaugaguucuacaaacaaauacaaucaaaucuagacgaaucaguugaagccagugaaauacaaacauacauugaccaagauaucuucaugccgaaacagcgcacaaaagcuaacgguucaaucccacaccaauuacaacaacaagagcuagaucaaaucauagagaaccagaaagaauauuauccauggcuagcagaauuaaauccaaacccagauaaaaaaagacaacaacuagcuaaguauaagcucgacgaacuaguaaccuucagaguaccauacuauguuggaccaaugaucaccgcagaagcucaaaaaaaacagaguggagcagaauucgccuggaugauacgaaaagaaucuggcaacauaacaccauggaacuucgaucaaaaaguagaccggauggcaacugcaaaccaauuuauaaaaagaaugaccacuacagacacguauuuauuaggugaagauguauuaccaucccaaucacuauuguaccaaagauuugaaguuuuaaacgaacuaaauaaaauacgaauagacaggaaaccgauaucgguugaacuuaaacagcagauuuucaacgaucuuuucaaaaaauuuaaaaaugucacgauaaaacaucuacaagacuaccuaguugcccagggacaauacucgaaaagaccacuuauagaaggacuugcagacgaaaaaagguuuaacucagggcuaucaacauacaacgauuucugcggaauauucggcgcgaaauuaguugacgagaaugacagacaggcagaccuagaaaaaauaaucgaauggucuacaauauuugaagauaaaaagaucuacagggcaaaauugaacgauuuagcuuggcuuacagaugaacaaaaagauaaauuagccaccaaaagauaucagggauggggaagacucuccaguaaacuacuuauuggacuccaaaacucagagcaucgaaacauaauggaucuuuuauggauuggcaacgaaaacuucaugcaaauucaagcagauagcgauuucgccaaauuaauaaaagacgccaaccaaaacgcacuacaaaacaacgauucucaagaugucauuaaugauuuauauacaagcccccaaaacaaaaaggcaauuagacaaaucuuacuaguaguccaugacauucaaaaugcaaugcauggucaagcacccacuaaaauacauguagaauuugccaagggugaagaaagaaacccaagacgaucaguacaaagacaacgacaagucgaagccgcuuacgagaaagcaaguaacgaauugguaggagcaaacguaagagaagaauuaaaagacgcaauuacuaauaaacgcgauuucaaggaucguuuauuucuauauuucaugcaaggaggugucgauauguauucuggcgaaccaauaaacauagauaacuuaucacgauacgauauagaccacauauuaccucaagccuucgucaaagacgacucauuaaacaaccgaguguuaaccgacgcagaaaaaaaucguagaaaaucugacgcaguaccuaaugaacucuucggagcgaaaaugcgagucacaugggaaagaaugaaagaacaaggacuaauaagcaaaggaaaauacagaaaccuuaccaugaauccagaaaauauaaacaaauauacagaaaacggguucaucaaccgacaacucguagaaacaagacaagucauaaaacuggccguuaauauauuagcagacgaguauaaagaaaauacgcaaauaaucucaguaaaagcagaucuaucccaccaaaugagagaagauuuugaacuccuaaaaaaucgugacguaaacgauuaucaucacgcuuuugacgcuuauuuagcagcguuuauggguaauuacuuauuaaaaagauacccuaaauuaaggagcuacuucguauacggagauuuuaaaaaauuuacacaaaaagagauuaaauuacgacgauuuaauuucauauacgaucuaaaacaugaagaucaaguaaucgauaaagaaacaggugagauacucuggaacaaaaaugaagacauagcauacauuagacaucuauuugcguacaagaagauauuaauaucacacgaagucucagaaagacgaggagcacuauauaaucaaacaguguacaaagcuuccgacgauaaagccaguggccaaggcaguaaaaaauuaauccccauaaaaucugauaaacccacagaaauauaugguggcuacacaggaagaacccuugcuuacaugacaaucgucaaaguaaccaaaggcaaaaaaauaucauacaaaguaguuggagucccuaccgcgguccuagcaaaaauggcugguguuagacaaggaucccaagaagaacaagauaaacucuauggcguacuuaaaccucaauucacacaccaaaaagaaaacaaaaaaacaggagaaauaacugaaacgguagacaaauucgacaucauaguuccaaaaguaaaauaucaacaauuagucaacgauaauggccaacuuuucaugaucggaucagacacucugccauacaaugcugaacaauuaguccucaguaaggaaucaguucaaacaauaaacaaucccggaaucaaagacgaaggcucggacgaagaaucagaaaacaaaaaacuagacaacguauacgacgaaauugugcuauguaugaacaaauauuucccccuauacgauaauagaggcuucagaaauucaauaacgaacggaaaaaauaaauuuuuaaaacuucccauaaaaaacauuuauaagaacggaaaacucaucaauguaggaaaaagggaaguaauaaacagaauacuucaaggcuuacaugcaaaugcgucagugacagaccuuucgaaucuuggcaucaaaagcccauuugguuuucuacaaaaaggagccggauuaagucuuucaggagaagcacaguuaauccaucaaagugcaacagguuuauucgaacauagaguucagcuaaauaaaaucaaauga

SEQ ID NO: 8994 - RNA, 4137 nt, Artificial Sequence
  Cas9 variant
augagcaauaaaccauacucaauaggacuggacauagggacaaacuccguagguugggcuguuauuaccgaugacuauaaaguaccaucuaagaaaaugaaaguacugggaaauacagauaaacauuuuauuaagaaaaaucugauaggagcacuauuguucgacgaagggaccaccgcagaagggagaagacugaaaagaacugcaagaagaagauacacaagaaggaaaaacagauuacgauaccuacaagaaauauucucugaagaaauaagcaaaguggacucaucauuuuuccaucgucuagacgauagcuuuuuaguaccagaagauaaaagaggguccaaauauccaauauucgcaacccuagcagaagaaaaagaauaccauaaaaacuuucccacgauauaccaucuaagaaaacaacuagcugauucgaaagaaaaagcugaccuucgccuaauauaccuugcauuagcucauaugaugaaauauagaggucacuuucuauaugaagaaaguuucgauauuaaaaauaaugacauacagaaaauauucaaugaauuuauuuccauauacgacaacacuuuugaaggauccucacugucagaacaaaacguacaaguagaagccauauuuacugauaaaauuaguaaaucggcaaaacgagaaagagugcuaaaauuguucccagacgaaaagucuacaggauuauucagcgaguucuuaaaacucauuguaggcaaucaagcagaauuuaagaaacacuuugauuuagaagaaaaagccccacuacaauuuucuaaagacacauaugacgaagaucucgaaaacuuacuaggacaaauaggcgauggauucgccgaccuauuuuuaguagcaaagaaauuauaugacgcaauacugcuaucaggaauacuaaccguaacagacccaucuaccaaagcacccuuaucugcaagcaugauagaacgguaugaaaaccaccaaaaagauuuagcuagucucaaacaauuuaucaaaaacaaucuaccagcggaaaaaugcguagaaguauuuagugaccaaaguaaagacggauaugcagguuacauagacggaaaaacaacucaagaagcauuuuauaaauacauuaaaaaucuucuaucuaaacuggagggcgcguauuacuuuuuagauaaaauugaaagagaggacuucuuaagaaaacagagaacuuuugauaauggcucgaucccacaucaaauacaccuacaagaaaugaacgcuauacuccgacgacaaggagaacauuaccccuuccuaaaagaaaauagagagaaaauagagaaaauucuaacauuuaggauaccauaucauguugggcccuuagcaagaggaaaccgagacuuugcauggcuuacaagaaauucagaugaagcuaucagaccauggaacuucgaagaaauugucgaccaagcaagcuccgccgaagacuuuauaaacaaaaugacaaacuacgacuuauacuuacccgaagaaaaaguacuacccaaacauucacuuuuauaugaaaccuucgcaguauauaacgaacugaccaaagucaaauucauagcagaaggucuuacccgauaccaauuccuagauaagaaacaaaagaaagacauuuucuauaccuuuuucaaagcagaagacaaaaggaaagucaccgaaaaagacauaauacacuauuuacacaacguagacggauacgacgggauagaacugaaagguauagaaaaacaauucaaugcaagccucucaacauaccacgauuuacuaaaaauaauaaaagauaaagaguucauggaugaccccaaaaaugaagaaauacuagaaaacauaguacacacccucaccauuuucgaagacagagaaaugauaaaacaaagacuggcgcaauacgauucauuguucgacgagaaaguuauaaaagcguuaacccgacgccacuacacaggauggggaaaacuaucggcuaaacuaauaaaugguaucugcgacaaacaaacaggaaaaacaauccuagauuauuuaauagacgauggcaaaauaaacagaaacuucaugcaauuaauuaaugacgauggacucucauuuaaagaaaucauacaaaaagcucaaguaguagguaaaaccuaugacguaaaacaaguaguacaggaacuaccaggaucgccggcuauuaagaaaggcaucuuacaguccguaaaacuugucgaugaacuuguuaaagucauggggcacgcaccggaaucaauugucauagaaauggcgagggaaaaccagaccacagcaaaaggcaagaaaaacucacaacaaagauauaaacgaauagaggaugccaucaaaaaccuagcuccuggucucgacucuacaauacugaaagaacauccaacagacaauauucaauuacaaaacgaucguuuauucuuauacuauuuacaaaacgggagggauauguacacuggaaaaccacuugaaauaaaccagcuaucgaacuaugacauugaccacauaaucccacaagcauucauuaaagaugacucgcuagacaauagaguacuaacaaguaguaaagaaaacagaggaaaaucagacaacguccccucgcuagaaguugucgagaaaaugaaagccuuuuggcaacaacuacuugauagcaaacugaucagugaaagaaaauucaacaaucuaacaaaagcagagcgaggaggacucgacgaacucgauaaaguuggauucauuaaacgucaacugguggaaacuagacaaauaacgaaacaugucgcacagauauuagaugcccgauuuaacaaagaagucacggagaaaaacaagaaaaaccgaaacgucaaaauaauuacacugaaaaguaacauggucagcaauuuucguaaagaguucggcuuauacaaaguccgagagauaaaugacuaccaucaugcacacgaugccuacuuaaaugcaguaguagcaaaagcuauccucaagaaauacccaaaacuagaaccugaguucgucuacggagauuaucaaaaauacgauuuaaaacguuacauaucuaaaucaaaagaucccaaagaaguagagaaagccacugagaaauacuuuuucuauucgaauuuacucaauuucuucaaagaagaaguacauuaugccgaugggacaauagugaaaagagaaaacauagaauacaguaaagacacaggugaaauagcguggaacaaagagaaagacuuugcuacaaucaagaaaguuuuaucauucccacaaguaaacauagucaagaaaacugaagaacaaacaguaggacagaacggaggcuuauucgauaacaauauuguaaguaaagaaaaaguaguugacgcaagcaaauuaauaccuauaaaaagcggguuaucaccggaaaaauaugggggcuaugcaagaccgaccauagcguacucuguccuaguaacauacaaacaaaacaacaaaaucaaaaauaccaugguaggaauacccgugcuaacuaaacucgaguucgaaagagacccaaaucuauacuuacgcaauuuaggaauaaauaacguaucccauguuauaaaacucguaaaacauacaguauuagaauuuaaacauaaauauggaacauacagaagauucaucguaucaaaccaagaacuuaaacgggcuaaccaaauauuugugaccaccaaacagaugaaauuaauaucacaauauaccacauuagauaaaaaugagcaugacuccuuacuuaaaaauaaccaacaacuaauucaaaguaucuggaaucaauuccuagaauuuaugcuagcaaccgaucuagucaacaagaaacaauacgacgaacuaauacuaacaaacaaucaaaccauagaagaauguaggaauauaaugaacagggucauaacuacucuaucauuuacuaacauuaaugccggacagaaaaagauuauauuugacgauacccuaagccuaccaauaaaaagauggcaauucaccgauagcgacaaaauggucaagaaaauaauagaaucuacuuuaauacaucaaucuauaacugguuuauaugaaacacggauagacuuaaacaaacuuggagaagacuga

SEQ ID NO: 8995 - RNA, 4137 nt, Artificial Sequence
  Cas9 variant
augaacaagccguauuccauuggcuuagauauaggaacaaacaguguaggauggucgauaauaacagaugacuauaaaguaccagccaaaaaaaugagagugcuaggcaacacagauaaagaauacauuaaaaagaaucugauaggagcucuccuauucgacgggggaaauacugccgccgauagaagacuuaaaaggacggcuagaagacgcuacacacgaaggcgaaauaggauauuauaccuccaagaaauuuucgcagaagaaaugagcaaaguagacgacagcuuuuuccaucgacuggaagauaguuuucuaguagaagaagauaaacgaggaagcaaauacccuaucuucgcaacgaugcaagaagaaaaauauuaccaugaaaaauucccaacgaucuaucaucuaagaaaggaauuagcagacaaaaaagagaaagcagauuuaaggcuaauauaucucgcauuagcccauaucauaaaauucagaggccauuucuugauugaagaugacagguuugauguacgaaacacagacauucaaaagcaauaccaagcuuucuuagaaauauuugauacaacauuugaaaauaacgacuuauuaagucaaaacguagauguugaggccauacuaacagacaaaauaucgaaaucugcaaagaaagacagaauacuagcgagauauccaaaucaaaaaagcacggguauauuugcagaauucuuaaaguuaauaguaggcaaucaagcagauuuuaaaaaacacuucaaccuagaagacaaaacaccacuccaguucgccaaggacaguuaugaugaagacuuggaaaacuuacuaggacaaauaggcgaugaauuugcagauuuauuuagcgcugcuaaaaaguuguacgauagcguguuacuaucaggcauauuaacaguaauagaccucucaaccaaagccccuuuaagcgccagcaugauucagagauaugacgaacaucaugaagaccuaaaacacuuaaaacaauuugugaaagcaagucuacccgaaaauuacagagaaguuuuugcagauucaagcaaagauggauaugcagguuacauagaaggaaaaacaucacaggaggcauucuacaaauaucuauuaaaguuacuaaccaaacaagaaggaucagaauacuuacuggaaaaaauuaaaaacgaagacuuccuacguaagcaacgaacuuucgauaacggcagcauaccgcaccaaguacaccuaacggaauuaagagcuauaauacgcagacaaucagaauacuauccauuucuaaaagaaaauuuggaucgaaucgaaaaaauauuaacauuccgaauaccauauuacguaggaccccuagccagggaaaagagcgauuucgcguggaugacaagaaaaacggacgauagcaucagaccauggaauuuugaggaccuaguugauaaagaaaaaucggcggaagcauuuauccacaggaugacaaauaaugaccucuacuuaccagaagaaaaaguucucccaaaacauucauuaauauacgagaaauuuaccguauacaacgaacuaacaaaaguaagauuccuagcggaaggcuucaaagacuuccaguuccuuaacagaaaacaaaaagaaacaauauuuaacagucucuuuaaagagaagagaaaaguaacagagaaagauaucaucucuuuccuaaauaaaguagauggauaugaggguauagcgauaaaaggaauagaaaagcaauucaaugcgucacuuucaacauaucaugaccucaaaaaaauacucgggaaagacuuccucgacaacaccgacaaugaacuuauacuagaagauauaauucaaacauugacuuuauucgaggaccgagaaaugaucaaaaaacgauuagauauuuacaaagacuuuuuuacagaaucucaacuaaaaaaauuauacaggagacacuacaccggauggggaagauuauccgcaaaauuaauuaauggaauaagaaacaaagaaaaccaaaaaacuauauuagacuaccucauagaugauggauccgcaaacaggaacuuuaugcaauuaauaaaagaugccggcuuaucguucaaaccgaucauagauaaagcgagaacaggaucccacucugacaacuugaaagaagucguaggagaauuagccggaaguccagccauaaaaaaaggaauucuucaaucacugaaaauaguagacgaauuggucaaaguaauggguuacgaaccagaacaaauagugguagaaauggcucgcgaaaaccaaacaacagcaaaaggacuaucaagaucacgacaacgacugaccacccuaagagaaagcuuagguaaccuaaagaguaauauauuagaagaaaagaaaccaaaauaugucaaggaucaaguggaaaaucaccaccugucagacgaccgauuguuccuguacuaccugcaaaacggaaaagauauguacacggacgaugaacuagauauagacaacuuaucacaguaugauauagaccauauaauaccacaagccuucaucaaagacgauucuaucgauaauagaguucuaguaagcagcgcaaaaaacagaggaaaaucagaugacguacccucaauagaaauaguaaaagcaaggaaaauguuuuggaagaaucuccucgacgccaaguuaaugucacagaggaaauaugacaauuuaacaaaagcggaacgaggaggccuaacuagugaugauaaagcacgauucauacaaagacaacuugucgaaacaaggcagauaacgaaacaugucgcacgcauacuugaugaaagauuuaacaaugaauuggacucaaaaggcaggagaauuagaaaaguaaaaauuguaacauuaaaaaguaacuuaguuucaaacuuucgaaaagaauuugguuuuuacaaaauaagagaaguaaacaauuaucaccacgcacaugacgcauauuuaaaugcgguaguagcaaaggccauucugacaaaauauccacagcucgaaccugaauuuguauacggauuauaucgaagaaaaaaacuuucaaaaauaguccgagaagacaaagaagaaaaauacuccgaagcaacacguaaaauguuuuuuuauagcaaucuuaugaacauguucaaaagagugguaagacuagcugaugguagcauagucguaagaccugucauagaaacaggacguuacaugggcaaaacagcaugggacaaaaaaaaacauuucgcuacaguuagaaaaguacuaucauacccucaaaauaacauaguuaaaaaaacugaaauacaaacaggagguuuuucaaaagagucaauauuggcgcacggaaauagugauaaauuaaucccaagaaagacaaaagacauauauuuagaucccaaaaaauacggaggcuucgauagcccaaucguagcauacuccguucuaguaguagccgacauaaaaaaggguaaagcccaaaaauuaaaaacaguaacagaauuacuaggaauaacuaucauggaaagaagccgauuugagaaaaacacaucagcuuucuuagaaagcaagggauacuuaaacauucgugaugauaaacuaaugauucuccccaaauacuccuuauucgaacuugaaaacggacgcaggcgccuacuggccagugcaggugaacuacaaaaagguaacgaauuagcccucccaacacaauuuaugaaauuucuguaccuagcaaguagauauaacgaaucaaagggaaagcccgaggaaauagaaaaaaaacaagaauuuguaaaccagcaugugucuuauuucgaugacauauuacaauuaaucaaugacuuuaguaaucgcgugauccuagcagacgcaaacuuggaaaaaauaaacaagcuauaucaagacaauaaagaaaacauaccaguagacgaauuagcaaacaauauaauaaauuuauucacuuucacuagcuuaggagcaccagcagcauucaaauuuuuugacaaaauaguagaccgaaaaagauauacuagcacaaaagaaguauugaauagcacgcuaauccaccagucaauaacagggcuauaugaaacccgcauugaucuaggaaaauuaggggaagguuga

SEQ ID NO: 8996 - RNA, 4137 nt, Artificial Sequence
  Cas9 variant
augacaaacgaaaaauauagcaucggucucgauauaggaacaaguucuauuggcuucgcgguaguaaacgacaacaaccgcgucauaagggucaaaggcaaaaaugcgauaggaguucgccuauuugaugaaggaaaagcugccgcagauagaagaaguuuucguacuacuagaaggagacucagccgaagaagauggagacucaaacuauuacgagaaaucuucgaugcauacauaacuccuguagacgaagcauuuuucauucgccuaaaagaaucaaacuuaucaccaaaagauucgaaaaagcaauauucaggagacauccuauucaaugacagaucagauaaagacuucuacgaaaaauauccuacaaucuaucaucuacgaaaugcacuaaugacagaacacagaaaauucgacguaagggaaauauaccuagcgauccaccauaucaugaaauuuagggggcauuuccuaaacgcaacgccggcgaauaauuuuaagguagggagauuaaaccuagaagaaaaauuugaagaacugaaugauauauaccaacgaguauuuccagaugaaucaauagaauuuagaacagacaauuuagaacaaauaaaagaaguauuacuagauaacaaaagaagucgagccgaucgucaaagaacguuaguaucugacauauaccaaagcagcgaagauaaagauaucgagaaaagaaacaaagcuguugcaacagaaauacuaaaggcaucccuuggaaacaaagccaaacuuaacguuauaaccaacguagaaguugauaaagaagcagcaaaagaauggucuauuacauucgacagugaaagcauagacgacgaccucgccaaaaucgaaggacaaaugaccgaugacggacaugaaauaauagaagucuugcgaucucuuuauaguggcauaacacuaucagcaauaguaccugaaaaccauacuuuaucacagucuaugguagcuaaauacgauuuacacaaagaucaccuaaaguuguucaagaaacuaauaaacgguaugacugauacaaagaaagcuaaaaacuuacgagcggcuuacgacggauauauagacggcgugaaaggaaaaguacuaccacaagaagacuucuauaaacaaguucaagucaaccucgacgacagugcagaggcgaacgaaauccaaacauauauugaccaagauauauucaugccgaaacaacguacuaaggccaacggcagcauaccucaccaacuacagcaacaggaacuagaccaaauaauagaaaaccaaaaagcauauuauccuuggcuagcagaacuuaaucccaauccagauaagaaaaggcagcaguuagcuaaauacaaauuagaugaacucguaaccuuuagaguaccuuacuacguugggccaaugauaaccgcuaaagaucagaaaaaucaauccggcgcggaguucgcuuggaugauuagaaaggaaccaggaaauaucacaccauggaauuucgaucaaaaagucgaucgaauggcaacggcuaaucaauucauaaaaagaaugacuacaacagacacauaucuccucggugaagacgugcucccagcacaaagccuauuauaucaaaaauucgaaguguuaaaugaacuaaacaaaaucagaauagaucacaaacccaucagcauagaacaaaaacaacaaauauuuaacgaccuauucaaacaauucaaaaauguaaccauaaaacaucuacaagauuaucuagucagccaaggccaauacucaaaacguccgcucaucgaaggguuggcagaugagaaaagauuuaauuccaguuuauccacauacucagaucuauguggaauauuuggggcgaagcuagucgaagaaaacgaucggcaagaagauuuagagaaaauaauugaauggucaacaaucuuugaagauaagaaaauauauagagcuaaauuaaaugaccuaacuuggcucacggaugaccaaaaagaaaaauuagcuaccaaacgauaucagggguggggacgauuaucaaggaaauuauuagugggacucaaaaacuccgaacacagaaacauaauggacauacuauggauaacaaaugaaaacuuuaugcaaauccaagcagaaccugacuucgcuaagcuaguaaccgaugcuaauaaagguaugcuagagaaaacggacucacaagauguaauaaacgaucuauacacaucuccucaaaauaagaaagccauacgucaaauauugcuuguuguucacgauauacaaaaugcaaugcacggacaagcucccgccaaaauacauguugaauuugccagaggagaagaaagaaacccacgaagaaguguucaaagacaacgacaaguagaagcggccuacgaaaaaguaucgaacgaacugguaucugcuaaaguaagacaagaguucaaagaagcaauuaauaacaaaagagauuucaaagacagauuguuccucuauuucaugcaagguggaauagacauuuacacaggaaaacaauuaaacauagaccaacuauccagcuaucaaauagaccacauccugccacaagccuucguaaaagacgauucuuugacaaaccgcguauuaacaaacgaaaaucaaguuaaagcugauucuguaccaauagauauuuuugggaagaaaauguuaaguguuuggggaagaaugaaagaucaaggacuaaucucuaaaggaaaauaccgaaaccuaaccaugaacccggaaaacauuucagcacacacagaaaauggauucauaaacagacaauuaguugaaacuaggcaaguaauuaaacucgcagucaacauauuagccgaugaauacggagauuccacacaaauuauuucaguaaaagcugaccuaucacaucaaaugcgagaagauuucgagcuccuuaaaaauagggacgucaaugacuaccaccacgcauucgacgccuaucuagcagcauuuauaggaaauuauuuauuaaaaagguacccaaaauuagaaucauauuuuguuuauggcgacuucaagaaauucacacagaaagagacgaaaaugcgucgauucaacuucaucuacgaucuaaaacacugcgaucaaguuguaaacaaagaaacaggugaaauacuauggacgaaagacgaggacauaaaauauauaagacauaguuucgcauauaagaaaaucuuagucucucacgaaguccgagaaaaacgaggagcauuauacaaccaaacuauuuauaaagcuaaagaugauaaaggaucuggucaaggcuccaagaaauuaauaagaauaaaagaugauaaagaaacaaaaauuuacggcggcuacagugguaaaucacucgcuuacaugaccaucguacagauuacaaagaaaaacaaagucuccuacagaguaaucgguauaccaacacucgcccuagcaagacucaauaaacuagaaaacgacagcacagaaaacaauggagaacucuacaaaauuauaaaaccacaauuuacacauuacaaaguagauaagaaaaauggagaaaucauagaaacaaccgacgauuucaaaauaguaguuaguaaaguaagauuucaacaauuaauagacgacgcuggacaauuuuucaugcuagcaucagauacauacaaaaacaacgcccaacaauuaguuauauccaauaacgcacuaaaagcgauaaacaauacaaacauaacugauugcccgagagaugacuuagaacguuuagauaaucuaagacucgacucagcauucgacgaaauagucaagaaaauggauaaauauuuuucagcauacgacgcaaacaacuuccgagagaaaauuagaaauucaaaccuaauauuuuaucaacuaccaguagaagaccaaugggaaaauaauaaaauaacugaauuggggaaaagaacaguacuaacuagaauacuacaagguuuacacgcaaacgcgaccacuacagacaugucgauauuuaaaauuaaaacaccauuuggucaauuaagacagcggagugguauuucacuaagcgaaaacgcccaacuuauuuaucaaaguccaacaggauuauuugagaggaggguacaauuaaauaagauaaaauga

SEQ ID NO: 8997 - RNA, 4137 nt, Artificial Sequence
  Cas9 variant
augacuaacgaaaaauacucaauuggauuggauaucggaacaaguucaauuggauuugcaguaguaaaugacaauaaucgcguuauacgggucaaaggcaaaaacgcuaucggaguuaggcuauucgacgaaggaaaagcagcagcagaccgaagaucguucaggacaacaaggagaagauuaucccgccgacgcuggagacuuaaauuauugcgagaaauauucgaugcauacaucacccccgucgacgaggcuuucuuuauaagacuaaaagaaaguaauuuaucucccaaagauucaaagaaacaauauucaggagauauacuauuuaacgauagauccgauaaagacuuuuaugaaaaauauccaacaaucuaucaccuacgaaacgcucuaaugaccgaacaucgcaaauuugauguaagagaaaucuauuuagcaauacaucauauaaugaaauucagaggucauuuccuaaaugcaacaccagcaaauaacuuuaaaguuggacgauugaacuuagaagaaaaauuugaagaacuaaacgacauauaccaacguguuuuuccagacgaaagcauagaauuuagaacagauaaccuagaacaaauaaaagaaguccuacuagacaauaaacgaucgcgcgccgacagacaaagaaccuuagucucagauauauaucaaaguucagaagacaaagacauugagaaaaggaacaaagcaguagccacagaaaucuuaaaagcgucccuggggaacaaagcaaaacuaaaugugauaacaaacguagaagucgacaaagaagcugcaaaagaauggagcauaaccuucgacagcgaaucaauagaugaugaucuugcaaaaauagaaggacagaugaccgacgacggacaugaaaucauagaaguauugcguagcuuauauuccgguauaacguuauccgcaauagugccagaaaaucacacgcuaagucaauccaugguagcuaaauaugacuugcacaaagaucauuuaaaauuauucaagaaauuaauaaacggaaugaccgacacuaagaaagccaaaaaccuacgagcagcguaugaugguuacauagauggagugaaaggaaaaguacuaccccaggaagauuuuuacaaacaaguucaagugaauuuagacgauuccgcugaagcgaacgaaauccaaacauauauagaccaagauauuuuuaugccaaaacaacguacaaaagcaaauggcucaauuccacaccaacuacaacaacaggaauuagaucaaaucauugaaaaccaaaaagcguacuacccaugguuagcugaacuaaauccaaauccagacaagaaaagacaacaacuagcuaaauacaaauuagaugaguuaguaaccuuuagaguaccauacuacguaggcccaaugaucaccgcaaaagaccagaaaaaucaaaguggagcagaguucgcauggaugauaagaaaagaacccggcaacauaaccccauggaauuucgaccaaaaaguagacagaauggcuacagcaaaccaauucaucaaacgcaugacaacaacagauacuuaucuacucggugaagauguacuuccggcacaaucccuucucuaccaaaaauucgaaguacuaaacgaauuaaacaaaauacgaaucgaccacaaaccuaucucgauugagcaaaaacagcagauauucaacgauuuauuuaaacaauucaaaaacguaacaauaaaacaucuucaagauuaucuaguaucacagggucaauacuccaaaaggccauuaauagaagggcuagcagaugagaaaagauucaacucaucacuaagcaccuauucagaccucuguggaauuuuuggagcaaaauuaguagaggaaaacgaucgucaagaagaccuagagaaaauaauagaauggaguaccauuuuugaagauaagaaaauauauagagcaaaacucaacgaucucacuuggcuuacagacgaccaaaaagaaaaauuagcaacaaaacgcuaccaaggcuggggaaggcuaucgagaaaauuauuaguaggacucaaaaacucagaacacagaaauauaauggacauucuauggauaacuaaugaaaacuucaugcagauccaagcugagccagauuucgcaaaauuagugacagaugcaaacaaaggaaugcucgagaaaacagacucacaagacguuaucaaugaccuauacaccaguccccagaacaagaaagcuauaaggcaaauacuuuuaguaguacaugauauucaaaacgcaaugcauggucaagccccagcaaaaauucacguagaguucgccaggggagaggaaagaaauccuagaagaucugugcaaagacaaagacaaguagaagcagcguaugaaaaaguaagcaaugaauugguaucagcuaaaguuagacaagaauuuaaagaagcaauaaacaauaaaagagacuuuaaagauagacuauuccuauacuuuaugcaaggcgggauagacauauacacaggcaagcaacucaauauugaucaacuguccagcuaucagauagaccacauacucccacaggcauuugucaaagaugacagccuaacuaaccgcguuuuaacaaaugaaaaucaagucaaagcagacagcguucccauagacauauucgguaagaaaauguuaucuguauggggaagaaugaaagaucagggacucauaucaaaaggcaaguacagaaacuuaacaaugaacccagaaaacaucagcgcacauacagagaacgguuucauaaaucgacaauuaguagagacaagacaaguaaucaagcuagcuguaaacauacucgccgaugaauacggagauaguacgcaaaucauaucuguaaaagcugauuugucacaccagaugagagaagauuucgaacuccugaaaaaucgagacguaaaugauuaucaucaugcuuucgaugcauaucuagcugcuuucauuggaaauuauuuguuaaaacguuauccuaaacucgaauccuauuuuguuuacggagauuucaagaaauuuacgcaaaaagaaacaaaaaugaggagguucaauuucauuuacgaucuaaaacacugugaucaagugguuaauaaagagacaggggaaauacucuggacaaaagacgaagauaucaaauauauuagacaccucuucgcguauaagaaaaucuuaguaucucacgaagucagagaaaagcgaggggcuuuguacaaccaaacaauauauaaagccaaagaugacaaaggaagcggucaaggcagcaagaaauuaauaagaauuaaagacgacaaagaaacaaaaauuuacggagguuacucuggaaaaagccuagcauacaugacaauaguucaaauaaccaagaaaaacaaaguaucuuauaggguaauaggcauaccaacucuagcauuagcaaggcuaaauaaacuugaaaaugacaguacagaaaauaacggcgaauuauauaaaauaaucaaaccacaguucacucauuacaaaguugacaagaaaaauggugaaauaaucgaaacuacugacgacuucaaaauuguaguauccaaaguuagauuccaacaacuaauagacgaugcaggccaauuuuucauguuagcaagugacacguacaaaaauaaugcucaacagcuaguaauauccaauaacgcccucaaagcaauaaauaacacuaauauaacagauugcccaagagacgaccuagaaagauuagacaaucuacgauuggacuccgcauucgaugaaauagucaagaaaauggauaaauacuuuucugcauacgaugccaauaauuuccgagagaaaauaagaaauucaaaccuaauauucuaccaauuaccaguagaagaccagugggagaauaauaaaauaaccgaacucggaaaaaggacaguauuaacccgcauacuacaaggacuacacgcaaacgcaacaacuacagauaugucaaucuuuaagauaaagacuccauucggacaauuaagacaaaggucaggaauaagucuaucagaaaacgcacaauuaaucuaccaaucgcccaccggccucuucgagcggcgcguacagcucaacaaaaucaaauga

SEQ ID NO: 8998 - RNA, 4140 nt, Artificial Sequence
  Cas9 variant
augaaacaaauauuaggucucgaccuagggacaaccagcauaggaugggcauuaguuagagaagcagaaaacaaagacgaacagagcucaauagucaggaucggagucagagucaauccucuuacaagcgacgaacagaaaaacuuugaacaaggaaaauccauuacaacaaaugcagaccguacacucaaaaggaguaugaggcgaaacuuacaaagauacaaauuaaggcgggaccaccuaaaagacugcuuacagaaaaacgguauaauaacagacaaagcuguacuauccgaaaaugggaauuacaccacauuucaaacauacuacuugagagcgaaagcaguaaaugagaaaauuuccuuagaagaguucgccaggguacuauuaaugcuaaauaagaaaagaggguacaaaucaucaagaaaaaugaaaucagcagaugaaggucaacugauagacggaaugucaguagcgaaacgacuauauaaugauaacauuacucccggacaauacguauuaagucucuuagaagaaggcagaaaauacauaccagauuuuuaucgaagugaccuacuagaugaacuagacaaaauauggaccuuucaacaauguuucuacccagaaauacuuacgccagaaugccggaaauuaauagcaggcaaaggaaaacaggcaacagcgaaaauuuucuuagguaaauacaaaauauacaccgcugacaauaaaucaaaagauaaaagacuacaagcauaucaauggagagucgaagcauugucaggucaauuaccuaucgaaguaguagcauuugucgucugcgaaauuaauggcgcaauacaagcauccagugguuaucuaggugccaucagcgauagaaguaaagaauuauacuucgaaggucuaacuguaggacaauaccuagucaaacaauuagagaaaaauccagauacuagccucaaaaauaaaguauucuaccgacaagacuaccuaaaugaauuugagaaaauuugggaaaaacaagcagaauaccauacugaacuaacaccucaauuaaagaaagaaguuagagacauaauaauauucuaucaaaggacacuuaaaucacaaaaagguuuaguaggauucugugaauuugaaucaaggcaaauugaagugaugauagacggaaaacucaaaaagaaaacgguugguuguagaguauguccaaaaucgucgccccucuuccaagaauauaaaaucuggcacaaccuaaacaaucuaaaaauaguagaaaaagaacuaggaaaaucaagauuccucaaucaagacgaaaaagaaucacuauuccaagaauuaaauaucaaagaaaaauuaagcaagacugacauccuuaagcuccuaugcuuaaaggcaaaagaauuugaccuaaacuucgaaaaaguagaaggaaaccgaacccaagcugaacucuuuagggcauaccaagcaauaauagaaaugucuggcaauggcgacuaugacuuuucuaaaaugacauccagugaaauacaagacacggucacugguguauuuaggggauuaggauacaauacggacauacucaguuucgaugcagaaaaagaagaaaagaccuucgauaaacaaccaauguaucucuuauggcauuuauuauauuccuacgaaggagacucaucggacacggguaacaaggcuuuaauaacaaaaauaaagaaauuguguggcuucgaaagugaagaauaugcuagaaucuuaacagacguaacuuuucaguccgaauauggaaacuuaucaacaaaagcuaucagacgaauacuaccuuucaugaagaaaggaagugaauauucggaggcuugcagacaugcaggguacagacacucagaaagaucacuaacaaaagaagaacuagacaagaaaguguacaaagaucaucuggaacuauuaccaagaaacagucuaagaaauccugugguagagaaaauauugaaccaaaugauccaugucguaaacacaguagucgacacauacggaaaacccgacgaaauacgaauagaauuagcgagagaacuaaagaaaucagcaaaagaaagagaugaaaugaccgcuucaaucaacaaaaccgcagcagaacauaagaaauauugugaaguacuacaaaaagaauuuggcuuuacucacguuucacguaacgauauuauacgauauaaacuguacuuagaacuggaaaacaauggauacaaaacgcuuuacucagauacuuauauaccaagagaaaaacuuuucucaaaagaguucgacauagaacauauaaucccacaaucaaaacuauuugaugauuccuuuagcaacaaaacucuggaaugucguagcgucaacauagaaaaauccaacgacacugcguaugauuauguccuaaacaaauacggggaacaagguauucuagauuauaaaaauagaaucgaaaauuuauauaaagacucaaaaaucucuagaaccaaauaccaaaaauuaaugaugaaaaacagugacauaucgggaaacuuuauagaaagagaauuacgagauucacaauauauagcaaagaaagcgagggaaauucucgaagaauuggugaaauucguuguaccuacaacaggauccgugacugccagacuacgagaagacuggcaauuaguagauguaaugcaagaauuaaacuggaagaaauacgauaaacuaggacuuacagacguaagauaugacaaagauggacgagaaauuagauauauaaaagacuggucuaaaaggaaugaucaccgucaccacgcaauggaugcacucacuauagccuucaccaaaagaaguauuauacaauacuuaaauaauuuaaaugcgaaaagcgauaaauccggaucuauauaugccauagaacaaaaagaacuauuuagagauaaaagaggaaaacuaaaauucauuccuccaaugccauguaauauauucagagcggaagcaaaaagacacuuagaaaacguccuaguaagcguaaaagcuaaaaauaaaguaguaacgcccaacauaaauaggucuaaagguaaaaacgguauuaacaagaaaauacaauuaacgccccgaggccaacugcauaacgagaccauauaugggucgaugaaacgauacgaaacaaaaugggagaaaauugggagcggauuugaugaaagacagauagcuaaagucgcaaacaagaaauuccgagaagcucuacuaucaagauuagcugaguucggcaacgacccacaaaaagccuuuacgggcaaaaacucauuagagaaaaauccauuauacguugacgaauugcauacccaaaaaguuccagaaaaaguuaaaaucguuaccuuagaaaaucuauauacuaucagaaaagaaauaaccccugaccuaaaaauagacaaaguagucgacgcaggaguuagacgaguucuacaagaaagauuagaugaauuugaugaugauucaaagaaagcguucaguaaccuagaugaaaacccaauaugguuaaaugguaagaaaaugaaaagaguaacaaucaugggagugaguaaugcuguuccacuccacgauaagaaagauuacaaaggaaaucuaguauucgauaguaaaggaagaaaacaacccguagauuuuguaaacacaggaucaaaccaucaugucgcaauauacagagaugaaaguggagaauuacaagauaucgucguguccuuuuaugaagcaacuacgagaucaaccuuaggaauaccaguaaucgacaaagaguauaagaaagcagaaggauggaacuuuuuauuuaguaugaaacagaacgaauauuucguauucccuaacgaagaaacuggcuuuaacccaaaagaaauagaccuuaugaauccagauaauuacacuacaauaaguccuaaccuguaccgaguucaaaaauuuucaaaauguauguauggcaauucgucaguaagggaauauguauuuagacaccaccuagagacaucuguaaaugacaguaaaggcuugaaaaacauagcauauaaaaacgucaaaagccucguuuacuuagagggcauaguuaaaguccgaauaaaucacauaggacaaauagugagcguaggagaauauuga

SEQ ID NO: 8999 - RNA, 4140 nt, Artificial Sequence
  Cas9 variant
augcguauugauaauggucucgaagaauuaaaaguaaauaauagaauuuacaauauaggacuugauaucggaacuuccucaguuggcuucgccguaacagacgcacaagauaaauuagucagaguaaaaggaaaaacugcaauaggcguucgcuuauuugaggaaggucauaccgcggcagaaagaagaggcuuuagaacaacaaggagaagacuaagcaggagaaaauggcggauaaaccuauuaaaucaaauuuucgaaccauauaucagugaaauagaucccacauucuucgcacgacuaaaaaauucgagccuugcaggaaaagacaaaaaauucgaagguagucuuuuguuuccagauagaaccgacuaccaauuuuauaaagauaauccuacaauguaucacuuaagaaaacaccugauggaaaaagaucgacaauucgaucuccgagagauauaccuagcaaugcaccacaucauuaaauacagagguaacuuucucaauacaaccccuaugaaucauuuuaaaaacgaagaaauagauuuuucagcucuguuuucaagacuaaaugaacucuaccaagaaauugacgacgaaaauauuuuugaauugaacauugaaaacguagacgaaauaaaaaaaauucuucucaaccaugaucucuuuaaaauggaaaaacaaaaacaaguagcaaaauuacuaaaugucgacacugaugacaaacaauuaaagaaagaaaacaccgcgcuagcuuccaauuuuucgaaagcaauacugggcuauaaauucaacuuagcguuagucacuaaaauaccagaucaagacaagaaggaauggacuauaucuuuaggcgaugaggacuucgaugauagacuagauaacguccccguagcacuaacagaaucacaacucgaaguaguugaagucuuacacucgauauuuaauagcauaucacuaaaugaaaucguagaaaauggagagacucuuagcucagcuaugguaagaaaguauaacgaccacaagcacgauuuaaaacuacugaaaaacguuaugacaacacuagaagacagaaaaaaagcgaaaaagauacaagggaucuacaauguauuuguugguaaagauaccgaucuuaucagcgauaaagacaagaacaaauacaaagauaaagacgaauucuauaaggaaauccaaaaaaaccuugauaacucuucagaugcggaagagauuauaaaacggauuaagcaagaccaauucuuaccaaagcaacgcacaucgaaaaauggaguaauuccacaucaacuacaucaaagagaacuagaccuaauaaucgaaaaccaagccaaauacuaccccuuuuuaaaagaagcaaauccaaauaaaaagagacuuaaacaagcgaaauauaaacuagacgaacuaauagcuuucaaaauucccuauuauauuggcccaacuagcggggcagaaaacagcgacuucuccuggcuuaaaaggaaaaaagauggacaaauaacacccuggaacuucgacgaaaaaguagacagaaucgaauccgcaaacagauucauacgcagaaugacaacaaaagauacguaucuacuagcagaagacguacugccacuagaaagccugauuuacgaaaaauacaguguguuaaacgaacucaacaauguaagaauuaaccgacaaaaacucucaguuaacgauaaacaagacauuuacaaugaauuauuuaaaaacaguaaaacaguuacacuaaaacaauuacaaaaguacuuugaagucaccaaaaaauugaaaacgguuguaguagaaggucuagccgacccaaaaaaauuucuaagcaacuuaggcacauaucaugacuucaaacuaauauuuggugauauaguagaugacccugaauaucaaacagacuuagaaaauauaauagaaugguccacaaucuucgaggaucgaggaauuuuuaacucaaagcucaaugaaauuacauggcuaacugacgaacaaagaaaaaaaguauuaagcaaaagauaccagggauggggaagauucucuaaaaaacuuuugguuggauuaaaaaauucacaaggaaauucaauauuagacgaauuauggaauaccaaccuaaauuuuaugcagcuacaaagucaggacgacuuugccgagcucauacacgcagaaaacgcuaagcaguucaaagcuaaugacccagacaauccauggaacgggauugacgcaauacuaaaugacgcauacacaucuccacaaaacaaaaaggcgauacggcaaguaguaaaaguagugcaggauaucgaaaaagcuauggggaacaaaccacaaaaaauagcuauugaauucaccagaagcgcagauaaaaacccccggagaacugacagccgaauaaaacguuuaucagacaucuacaaagaagcugcagaaaaaguaguuggagaaucacuaaaauuagaacucaacgaauacuuaaccaguaaaaaaaaaaugacagacaaaauguaccuauauuuuacacaauuaggaacagauauauauacaggcaaaaaaauagacauagaccaacuaaauaauuaugauaucgaccacguacuaccccaauccuuucucaaagacgacucgcuagauaacagaguuuuaaccaaccgaagcgauaacagcgaaaaaucagauaccguaccauugcauaaauucggagcuaaaaugggcaauuucuggagacaguuagcagacgaaggacuaauaaccaaaagaaaauacaaaaaucuuacgacagacccagcgacaauagacaaauacacaauacaaggauuuauaagaaggcaauuagucgaaacaagucaaguaauaaaauuaacugcaaauauacuuggaggucuauacccagaagaaaccgaaauauuagaaaucccagcuaagcucaaucaucaauuuagagacauguucgacuuaguuaaaguuagagaaguaaacgacuaucaucacgccuuugaugccuacauaaccguauucgugggcaauuuccucuauagacguuacccaaaauuacggucauauuuuguauacggcgauuucaaaaaacuaaacaaaaccgaugacgacauaagaaaguucaauuucuuaaauuuauuuaauaaagauaagguagaagacaaugaaacugaugaaauccuauggaguaaagccgagagcaucagagauauaaaaaacauuuacaauuacaaauuuaugcuaguaucaagagaaguguauacaagacauggugcaauguuuaaccaaaccaucuauccagcauccaaaaaugacuccaaaaaacuaauaccaauuaaaaaaggcaaagacacagccaucuacggaggauauucagggaacacugacgccuacauggcaauagucgcaguagaagacaaaaaaggugaaaaauucaaaguaguaggagucccaacucgagcaguaagucgguuggaacaauuagccgcagacgaccaugaccaguacuugacagcauugcaugaugucuuaaaaccaaacuuuacgaagaucaaaacaaacagaaaaacaaaagcaaaggaggaaguaacaaccccauuuagaauacuuguaggaaaggucggauaccgacaacuaauccaagacggacaggucaaaaugaugcuaggcucaagcgcauauaaauauaaugcaaaacaacuaguccuaucagaaaaaaguuuaaaaguaaucaagaacaacaaaaaauauaauccagaugacgaaaaccaagauuuaaucgaugucuacgacgaaauacuugggguuguaaacagagccuuuaaucuguacgauacaaauggauuucgaaaaaaacugaaugacaacagagugaaauuuguugaacuaccaauaaauaacauauucgaugguacaaaacuaguacaaaugggaaaacgggcaguacuaacgcaaauccuaaacggacuacacgccaacgcggcacucggagaccucaaagcucuaggaauaucuacacccuucggaaaaaugcaaagcaaaucaggaaucccucuauccauggaugcuucacuaguauaucaaucuccaaccggacuauuugagcggaaauugaacuuaagcgaucuauga

SEQ ID NO: 9000 - RNA, 4140 nt, Artificial Sequence
  Cas9 variant
augacaaagaagaacuauagcauaggacuugacaucgguacaaacucaguaggcugggcagucauuaccgaugauuauaaagucccugcaaaaaaaaugaaaguucugggaaacacagauaaaaaauauauuaaaaagaaccuucuaggcgcauuacuauuugauucaggagaaaccgcugaagcuacacgacucaaaagaacagccagaagacgguacacuaggaggaaaaaucgauuaagauaucuacaagaaauauucgcagaugaaauggcaaaaguagaugaaucauucuuucagcgacuagaugaaaguuuuuugagaugggaugaugacaauaaaaaacuagggagauauccaauauuugggaauaaagccgacguaguaaaauaucaucaagaguuuccuacaauauaucaccuccgaaaacaucuagccgacaguuccgaaaaagcagaccuuagauuaguauaccuagcgcuagcucacaugaucaaauucagaggucauuuucucauugaaggcgaacucaaugcagaaaacacagauguacaaaaaauuuucuccgauuuuguaaggguauaugacagaacauuugaugauucccaccuaucugaaauuacgguagacgcugcaaguauacucacagagaaaauuucaaaaagucgacgauuagaaaaccucauuaaauacuaccccacagaaaaaaaaaacacuuuauuuggaaauuugauagcuuuagcacugggccuacagccaaacuuuaaaaugaauuucaagcugucagaagacgccaaacuacaauuuucaaaagauaguuacaaugaagaccuagaggaauuacuuggaaaaauaggcgacgacuacgcagacuuauucacaucagcaaaaaauuuauacgaugcuauucuucuaucaggaauacuaacuguagaugauaauucaacaaaagcuccacucucagcaucgaugauaaaacgauaugcagaacaccaugaagaucuagagaaacuaaaggaauucauaaaagcaaacaaaucagaguuauaccaugacaucuuuaaagaugaaacaaaaaacgguuaugcaggauacauagaaaacgguguaaaacaagacgaauuuuacaaauaccuaaaaaacacccucuccaaaauagccgguucagauuacuuccuagauaaaaucgaaagagaagacuucuugagaaaacaacgaacauucgauaacgguucaauaccgcaucaaauacauuuacaagaaaugcaugcuauacuucgaagacaaggcgauuacuaccccuuucuaaaagaaaaccaagauagaauagaaaaaauacucacauucagaaucccauacuacguagggccauuagcuagaaaagauagcagauuuaguugggcagaauaccacucagaugaaaaaauaacaccauggaacuucgauaaggucauagacaaagaaaagucagcagaaaaauucauaacacgaaugaccuuaaaugauuuauaucuuccugaagaaaaagucuuaccaaaacauagccacguauacgaaacuuacgccguuuacaacgaauuaacuaaaauaaaauacgucaacgaacagggaaaagacucguuuuuugauucaaacaugaaacaagaaauauuugaucauguauucaaagaaaacagaaaagucacuaaagaaaaacuacuaaacuaucucaacaaagaauuuccggaauaucggauuaaagaucuuauaggucuagacaaagaaaauaaauccuucaaugccucucuaggaacauaccacgaucugaaaaaaauacuagacaaagcauuccucgaugacaagguaaacgaagaaguaauagaggauauuauuaaaacacuuacauuauucgaagacaaagauaugauucacgaaagacuacaaaaauacucagacaucuucacagcagaucaauuaaaaaaacuagaaaggagacacuacacuggcuggggacgcuuaucauacaaacugauaaacggaauacgaaauaaagaaaacaacaaaacaauacuagacuaucuuaucgaugacggcucagcaaauagaaauuucaugcaacuaauaaacgaugacacgcuaccauuuaagcaaauaauacaaaaaagccaagucguaggcgaugucgacgacauagaagccguagugcacgacuuacccgguucuccagcaauaaaaaaaggaauucuacaaucaguaaaaaucgucgaugaacuggucaagguuaugggcgacaauccagauaacauaguaauagaaauggcacgagagaaccaaaccaccaaucggggaagaucacaaucacaacaaagauugaaaaaacuacaaaauucauuaaaagaauuaggaucuaacauacuaaacgaagagaaaccaaguuacauagaagacaaaguagagaacagucaucugcaaaacgaccaauuauuccuauacuacauccaaaauggcaaagauauguacacaggagaugaacuagauauagaccaccugagcgacuacgacauagaccacauuauaccucaagcguuuaucaaagaugacaguauagacaauaggguucuuacaucuagcgcaaaaaaccgugguaaaagcgacgacguuccaucuuuagauauuguccgagcaagaaaagcagaguggguucgauuguacaaauccggcuuaauaucaaaaagaaaguucgacaaucuaacaaaagcugaacggggaggauuaaccgaagcagauaaagcaggauucauaaaacgucaacuuguagaaacacgacaaaucacaaaacacguagcucaaauucucgacgcaagauuuaauacggaaagcgaugaaaaugacaaaguaauaagagacgucaaaguuauuacuuuaaaaucaaaucuuguaucgcaauuucgcaaagacuuugaauuuuacaaaguaagggaaauaaacgacuaccaucacgcccaugacgcauaucuaaacgcaguaguagguacugcucuccuaaaaaaauacccaaaacucgcuagugaauuuguguauggagaauacaaaaaguaugauguccacaaauuaaucgcaaaaucuucagacgaucauagcgaaauggguaaagccacugcuaaauauuuuuucuacucaaaccuuaugaacuucuucaaacggguaauacgauauucuaacgggaaaguaauaguaagaccaguaguggaguauaguaaggauaccgaagacauagcaugggacaaaaaaucaaauuucagaaccauaugcaaaguacuauccuauccucaaguuaacaucguaaaaaagguagaaacacagacgggaggguucucaaaagaaucaauccuaccgaaaggugacagugauaaacuuauaccuagaaaaacuaaaaaagcguacugggauacaaaaaaguauggagguuuugacaguccaacaguugcauacaguguauuugugguagccgacguagaaaaaggcaaagcuaaaaaauuaaaaacuguaaaagaacuagucggcaucucuauaauggaacgaucauucuucgaagaaaacccagucgaauuucucgaaaauaaaggauaucacaauauacgagaagacaaacuaaucaagcuaccuaaauacucguuauuugaauucgaaggcggaaaacgcagguuacuugcaagcgcauccgaauuacagaaaggaaacgaaaugguaaucccuggacauuuggugaaacuuuuauaccacgcucaaagaauuaauagcuuuaauucuacaaaauaucuugauuacgucagcgcccauaaaaaagaauuugaaaaaguccucagcugcguggaagacuucgcuaaccuauacguugauguagaaaaaaaucuaucaaagauucgagccguagccgauuccauggacaacuucucuaucgaggaaauuucaaacagcuuuauuaacuuacuaacacuaacagcucuuggggccccugcggauuuuaauuuuuuaggagaaaaaaucccuaggaaaagauauacaagcacaaaagaaugccuaaacgcaacccuaauacaccaaucgauaacaggcuuauacgagacaaggauagaucucucaaaaauuggagaagaauga

SEQ ID NO: 9001 - RNA, 4143 nt, Artificial Sequence
  Cas9 variant
augggaaaauauaaucucggccuagauauagguaccaacagcguuggcugggcgguaguggacgaaaauaaucagauugucaaaaaaggcggcaaagcccucuggggaguacguauguuugaugaagcacaauccgcuaaagaaacacgcauauauagaaacucuagacgaagaaucguaagacgcaaccaaagacuucuccuccuccaaaaagaauucuaugacgaaauaauuaaaguagaccaaaccuuuuuccaacgcuugaaggauucauucuucaaaaaagaagauaaauuaaauaaaaacaacuauacauucuucgacgacgauauaacagacagagaguauuuuaaaaaauucccuacaauauaccaccuacguucccauuuacuuuacaaugaugaaaaaaucgauauucguaugcucuaccuagcuuuacaucauaucgucaaauauaggggccacuuccucgacucuggugaggucaacgaaucaaacuucucaaaaauuaaggaugucuuggauacauucaacaacaaaaugucagaaaugagccucgaauuugaagauaaugaagacuauuucugcaaaauagaauucgaugaaaauuucgaaaacaaacuaaaagacauaaugcuaucccaacucuccaaaaaagagaaaagacaagaacuaauagacuuauuuaaaguagauaaaaaaagcuuaguaaacgaacuucugaucgaauuacuagucaacaaaaaaguaaaacuaaacagccuaucuauaaccaacggaaagaaguacgaagucugugaaauagacuucgaaaaagaagaacuuuuugaaaaacuugaagaugcaaaaaagauuauaacagaacuauuugacauacuagaugaaauaguaaauauaaaaaaaauugucgauuauuacuauguccuaaaaauaauuggagacaacgaauaucuuuccgaagccauggucaaaaaauaugauaaacaugacaaagaccugcgcgagcucaaaagcuucauaaaaaccuauugcccaaacaaauauuacgaauguuuuaggaaaaccucuaauccuaaucuauguaacuauccuaaauacguuggcauaaauuccguaaauaaaaaaauagaaagguucgcucacugcaaaaaagaagaauuuuacaaauaccuaaaaucauuauucaacacuauaaaagacgaaaacgcaaaauuaaaaauagaccucuuucagaaagacauggaaaaugacgacuuucuuaaccgccaaaauucaaaccacaacucuucuauuccuaugcaacuuaacuuuugugaauuaaaaaaaauucuugaaaaccaaagcaaauacuacccauuccuuaugcucaaaaacucggacggauacagcacaagcgacagaaucauagcuauuuucaaauacaaaauucccuauuauguaggaccucuaaacaaaaacucuaaauauaguuggcuagucaaaaaaucaaacgaaaauauaacaccauggaacuacgaaaaagucauagaccucgaugcaagcgccaaagaguucauccagcguaugcaaaauaaauguacauaccugaaaggagaaaacgauuauugcuugccaaagaaaaguauccucuuuagugaauacaacugccuacaauaccuaaacagacuuauuaucaacggugcccuaauagaaaauaagcuaaaaaaugaaauauaugagaacauauuuuuaugcuacaaaaagcccacaaaaaaaaguaucgucgaauaccuuaaaacaaauuauaacuacgaugaaacuacacucaaauccaacauccuagagguuaauugugauaugucaagcuacauucaauuuaaagaaaucuauggagaagauuuugagcaaaacuuaaauauaguagaagacauaaucaaagacaucacaaucuucgaagacaaaaaaauacuagaaaaaagacuaagagagauauaccaccugucagaagauaaaguacagaaaauaaaaggacuaaacuacaaaggauacgcaacucugucaaaacacuuucuaaacaauuuuuauagcguuaaugaagaaacgggagagauauauggaccaaucauucaaauaaugagggacaccaauuauaacuuacaacaaguaauauacaaugacagguauaacuuuaugaaagccaucgacaaauacaauaaaaaaaaucucgacacagaaaaaaaauuaaauguuuccgacuucaucgacgaauacauauacguaagcccaauaaugaaaagaucacuaauacaaaguuauaacauuauccaagaacuagaaaaaauccuaggagaaagcauauccaaauauuacaucgaaugcgcgcgagucagaucaaacucaaaagaugucauaaacucgcgcuaucggcaacuaucagaauuauacaaagacugcgaacaccaaguaagcgacauuagcaagaauuacauaaacauaaacaagcuaaagaaacaacuagaagacaacaaaaacgaacugcgagcagacaaacuauauuuauauuuuacucaauuuggaaaaugcauguauacacugaaagacauugacuuagacgacguauuucuaggaaaauaugacauugaccacauauacccacaaucucuuaucaaagaugacucgcucaauaauagagugcuagcaucuaaagaaaaaaacggcaaaaaagacaaucaauucauuuucaauauuccagaauuccuaccaaaaaaugcugaacucuucuacaaaaaacuuuuagaaugcaaacuaauaacuaaagaaaaauacagaagacuuaccaugaaaaaaauagacgacgaugaauuagacauauuugucaacagacaacuagucgccacaaaccaaucgguaaaaggauuaguagauguacuaaaaauauauaaaggcgucaagcccacuaauauaguauauagcaaagcugucaacauaucugacuuuagaaacaacuauaaucuauacaaaucgcgaacugcuaauaauuaccaccacgcgcaugacgcauaccuaaauguaguaauaggcaaagcgcuugacgucuacuaccaaugcaacuacuuucaaaacuauaaagacguaauaaaacucaaagaccgcaacauaacuauaaaccccgaaaucauccugaguaaaaaccguuacgugaacaggaauggugaaaaaaagguaauuugggauuuagauaacacacucaaacucauuaaaaauaaucuauauaacagauuugauauaacugaaacuauaaugacacguaaguccaauaaaauguuuagcaaaucaucaauaaguccagcuaaaaacucuaaaaacuuaauacccauaaaaacauccgauccacgauguaauguccuaaaguacggaggaauuaaaucaaauagcuacaauuucuauugcauuguugaacuauacgacaaaaaaggcaagaaaucuuauauacucgaagcaauaccaaaaacacauucagauaaauuagaagaauacauuaaaaacagcauagaugaaaagaacguaucaaacuucaaaauaaucaacaaaaacauaaaaaguaacauaauaauagaauauaaaaaacuacgcuauguuauaacuggcaaaucaggcaaauacuaucuaauaaagaacuuuaaggaccgcaacuuuucguacaacgccauaaaaacuaucaaauauaucgaaaaauauaacuaccaaaaaaaauacgaaaucccauuugaagaaacaaaagaaaagaucauucuagcaccuaaaaaaaaagauacaaaagaaauaucccucacccuagacaacugccaagcccuacuagacgaaaucauauccuuauucaaaaaagacauauacaauuaugacaucauuuauaaaauuacaucaaaguuagaagaaaauaaacaaaaccuaacccugacaaaucucaucaaaguccuuaccgaaauccuuauuuugcucaaaaccaacgaacgagguacagcagaccuaacucuaaucgacaugucaaaagauacaggaacucucugcaucagcaaaacauuaaaaccuggaaugaaauucauaucagaaucaccaaccggauauuacagaaaaaucauuuuugaaguaccuaacggcaucuga

SEQ ID NO: 9002 - RNA, 4143 nt, Artificial Sequence
  Cas9 variant
augaaaaggauauugggacucgaucuaggaacaacaaguauugggugggcauuagucaacgaagcagaaaauaauaacgaagccaguaguauagucagacugggggugagagucaauccccuuacuguugacgaaaagagcaauuuugaaaaggguaaagcuauuaccacaaacgcagacagacaauuacgacacggugccagaaucaaccuacaaagauacaagcuacguaggcaaaaccuacacgauugucuccagaaacagggauggcuaggaacagaagcaauguacgaagaaggaaaagcaagcacauucgaaacauacaaacuccgcgcgaaagcagccgaagaagaaauuucucuccaugaauuugcaagaguacuauuuaugcuaaacaagaaaagaggcuauaaaucgaauagaaaagcaaacaauaaagaggauggccagcuuuuugacggcaugacaaucgcgaagaaacuuuaugaagaacaucucacuccggcagaauauagcuuacaacuacugaacaaaggcaagaaauuuacacagggauacuaccgcagugacuuaaaugcagaacucgaacguauaugggaugaacaaaagaaauacuauccagaaauucugacagaugaguucaaacaacaauuagaaggaaaaacuaaaacuaauacaucaaaaaucuuucuagcgaaauaugguaucuacagugcagaucuuaaaggucuugacagaaaauuucaaccccuaaaauggagaguagaagcccuacaacaacaaguagauaaagaaguuuuggcauuugugaucucagaccuaaaaggacaaauagcaaacacaagcggauuacuaggagcgauuuccgauagauccaaagaauuguacuuuaauaaacaaacaguuggccaauacuuaugggcaucucuagaagaaaacccacacaucucaaucaaaaauaaaccuuuuuacagacaagauuaccuagaugaguucgagaaaauaugggaaacccaagccgcuuuccacaaacaacugacaccagaacuuaaacaggaaauaagggauauaauuauauucuaccaaaggcccuugaaaucuaaaaagucauuaauaucagucugugaacuagaacaaagaaaagugaaagcaacaauagacggcaaagaaaaagaaauuacgauuggcccuaaaguagcacccaaauccaguccaguguuccaagaauuuagaauauggcaaaauuuaaauaauguccuacuaauugauaacgacacaaacgagaaaaggccccucgaugaaguugaacgaaacuuacuguacaaagaauuaucaauaaaagcaaaauuaagcaaaacagaagcauuaaagauauuaaacaaaaagggaaaacaaugggaccugaauuaucgcgaacuggaaggaaauagaacccaggcgauacucuucgacugcuauaaccguauaauaacuuuaacaggacacgaagaaugcgauuucaaaaagauuaaagcaagcgaaaucagacauuacguaagcacaauuuucaaaaaucuuggauucaguacagaaauacuagacuucgacccuagucucaaaaagcaugaacuagaaaaacaaccaauguaucaacuguggcacuuacucuauucuuaugaauccgauaauucaagaacaggaaaugaaagccugcuaagaaaacuugaaacaaccuucggauucccugaagaauaugcaacaguacuuugugacguaguauucgaagaagacuacggaaaccuaucuguaaaggcaaugagagaaauccucccuuauuuacaagcggguaaugacuacucucaagcaugcgcauacgcuggauacaaccacagccgacauucauuaacaaaagaagaguuagaccaaaaaguauacaaagaaagacuagaacucuugcccaaaaauuccuuaagaaauccaguaguagaaaagauccuaaaccaaaugauaaauguaauaaacgcaauaauagacgaauacggaaaaccagaugaaauacgaauagaaauggccagagaauuaaaaucaagugcagccgauagaaagaaaaccacacacgcuauaucucaaggaaaugcugaaaaccagcguauacgugaaauauuagaaaaagaauuuagucuuucauauauaucacgcaacgauauuauaaaauauaaacuauaugaagaauuagaaccaaauuauuacaaaacauuguauucagacacauauaucaccaaagauaaacuauuuucaaaagauuucgauauagaacauauaauaccuaaagcccguuuauucgacgacaguuuuucaaauaaaacccuagaggccagaaauauaaaccuagaaaaaucaaauaaaacagcauuugauuuuauaaaagaaaaauacggagaagacggagcagaagcauacaaaaagaaacucgacauguuacuagaaaacgacgcaauuucacguccaaaauacaacaaccugcuaagagcugaagcagacauaccuucagauuucauaaacagagacuuaagaaauacccaauauauagcaaagaaagccugugaaauacugggagaauuaguaaaaacuguaacaccaaccacgggaaaaauaacaaacagacuacgugaagacuggcagcuaguagaugugaugaaagaacuuaauuuugaaaaauacgaaaaacuaggccucacagaaaucguagaagaucgugacggaagaaaaaucaaacgaauuaaagacuggacuaaaagaaaugaucaucgccaccacgccauggacgcucuagcaauagcuuuuacaaaaccguccuuuauucaauaccucaauaacuuaaacgcacgcucgaauaaaggugacaguauauacgcuauagaaaauaaagaacuacauuacgaagaagguaaauugagauucaacgccccaaucccaguaaaugaauuucgagcugaagccaaacgacaucuguccgcuaucuuaguaagcauaaaagcuaaaaauaaaguaaugacacaaaauguuaacaaaauuaaaacaaaacauggaauaauuaaaaagauacaacuuacaccaagaggcccacuacacaacgaaacaauauauggaacuaaaaugaggccaauaaucaaaaugguaaaaguaggcgcagcauuagacgaggcuacgaucaauaaaguaaguagccccgcuauucgugaagcauuauuaaaaagauuaaacgaauacagugggaacgcaaagaaagcauuuacagguaaaaauacuuuggagaaaaauccgaucuacuuaaacgcaggacguacaaaaacugucccaucacuuguuaaaacaguggagugggagucguuucacccaacgagaaaauuaauagacaaagaccucaacguagacaaaguagucgauaagggaauaagagaaauauuaaaggccagauuagaagaguucaacggagaugcaaagaaagcauucaguaaccuagaagaaaauccuauauauuuagacgaagcaaagaaaaucgcuuuaaaaagaguaaguauagaagguguuuuaucagcaauaccacuccacacccuaaagaaccaagcaggcaaaccaauaacagguaaagacggcaaaccgguauuaggaaauuauguccaaacaucaaacaaccaccauauagcauucuacuacgaugaagacggaaaccuccaagauaacgcagugagcuucuuugaagcagcagaaagaaaaucccaagggauaccaguaauugauaaagauuacaaucgagauaaagguuggagauuccuuuucacaaugaaacaaaaugaauauuucguauuucccaaugaagcgacaggauucauaccaucagagguggaccuaacggacgaagcaaacuacggcauaauaagucccaaucuauauagaguacagaaaguaaguagaaucgauaaaggaacaucagcaagucgugauuauugguuuagacaccaccucgagaccauacuaaacgaugaugccaaacucaaaaauuuagcauuuaaaagaauaagagguuuauuagaauuaaaagauauuaucaaagugagaauaaacucuacaggaaaaaucguagcaguaggagaauaugauuga

SEQ ID NO: 9003 - RNA, 4143 nt, Artificial Sequence
  Cas9 variant
augaaaaagauacuaggauuagauuuaggaaccacaaguauaggaugggcuuuaguaaaugaagcagaaacugaauccgaaaaaucaucaauaauaagauuaggaguaaggguaaacccuuuaacgaucgacgaaaaaggcaauuucgaaaaaggcaaagcaauuaccacaaacucagacagacaacagagacauagugcacgcauaaaccuacaacgcuauaaauuaagaagacaaaauuuaugcgauugccuacaaauagguggacuauuaggcagcgaaaguauguacgaagaaggaaaagaaucuacauuugaaacauacaaauuacgagccaaagcagcuacugagaaaguugcauuacaugaauucgcaagaaucuuauucauguuaaauaaaaaacgaggauauaagucaaaucgaaaagccaauaguaaagaagauggacaggcauucgacggcaugacaaucgcuaaaaaauuauaugaagaaaaccuaacgccagcagaauacagcuuacaauuauuaaacaaagguaagaaauucagucccuccuauuaccgauccgaucuggaaucagaacuaaauagaauaugggaagaacagaaaaaauacuauccugagauacuaacagacgacuuuuaccaacaguuagaaggaaaaacuaaaguaaauacuacaaaaauauuucuugccaaauacgggauauauacagcagauuugaaaggacuagacaaaaaaaugcaaccauuaaaauggagaauagaagcacucaauaaacaaguagauaaagaaguacuuaccuuuguugugagugauuuaaaaggacaaauagaaaaaaccucaggccucuuaggagaaauaucggaucgaucuaaagaacuauacuucaacaagcagacgguaggacaauauguaugggcuucacugaaggaaaacccacacgucuccauaaaaaauaagccauuuuacagacaggauuacuuggacgaguuugaaaaaaucugggagacacaagcugcauuccacaaagaacuuacuccagaacuaaaaaaagagauuagagauauaauaauuuucuaccagaggccacuaaaaucaaaaaaaggucucaucuccauaugcgaacuagaacaaaaaaaagaaaaaguuaucauagaagggaaagaaaaagaaauccuaauaggcucuaaaguagccccaaaaucuucgcccauguaccaagaauuuaggauuuggcagaaucuuaacaacguacugcuaauagacaccgaaauuaacgagucaagaccucuugaugaagaagaaaaagcacuccuuuauaaugaacucucuguacgagcaaaguuguccgaaacagaggcauuaaaaaccaucaauaaaaaagguaagcauugggaucuaaacuucaaagaacuagaaggaaaccggacacaagcuguauuauuugaaugcuauaacagaauaauaacgcaaaccgggcaugaagaauguaauuuuaaaaaaauaucagcugaggacauacgacauuacguugcaaccaucuuuaaaaaucuagguuuuaauacagauaucuuagacuucaaccccagccucgaaaaacaugaacuagaaaagcaaccaauguaucaauuauggcauuuguuauauaguuaugaaucggauaagucuagaacagguaacgaaagccuauugaacaaacuagaagcaaacuuuggauucccccaagaauacgcauccguauuagcggacgcuacauucgaagacgacuacggcaauaucaguguaaaagcuauccgcaagauacugccacaccuacacgacggauacgacuacagcgaagcaugcgaaagggccggauacaaccacagcguuagaagcuuaacaaaggaggaacuagcacaaaaaguuuacaaagacagauuagaucuuuuaccaaaaaauucauuacgaaacccugugguagaaaaaauucucaaucaaaugauaaaugucauaaaugcuauaauuguagaauacgguaaaccugacgagauacggauugaaauggcgcgagaacuaaaaaguucggcagcaaaacgagaagaaagaacaaaaagcauaaaucaaaacgcugcagaaaauaaacgcauuaccgaaauacuacaaacagaauucggacuaaguuauauaagcaggaacgauaucguaaaauacaaacuauaucaagaauuagaagcgaacggauuuaaaacccuauauuccaacaccuacauaccuaaagaaaaacuauucuccaaagacuucgacauagaacauaucguccccaaagcacgacuauucgaugacuccuucggcaauaaaacaaucgaagcaagggacgucaauuuagcuaaguccaacaaaacagcauuugacuucguaaaagaaaaauauggcgaacaaggaauugaagaauauaaaaaaaaauuagauacacuccuuaaagaaaaugcaauuucuucaggaaaguauaaaaaauuaaugaugucugaagcagauauuccaucagauuucauaaaccgugaucucagaaacacacaauacauugccaggaaagcauacgaaauacuuggagagcuaguaaaaacuaucacgccuacaacaggaaaaauaaccgauagacucagagaagauuggcagcuuauagacgucaugaaagaacuaaacuucgaaaaguaugaccgucucggauuaacagaaguaaucgaagacagagauggacgaaaaauuaagcgcauaaaagauuggaccaaaagaaacgaccaccgacaucaugcuauggacgcccucaccauagcauucacaaaaccaaguuacauccaauaucuuaacaacuuaaacgccagaucagauaaaagugguucaaucuacgcaauugagaccaaagaauuacaccgcgagaauaauacacucagauucaaugcaccaaugccucugaaugaauuuagaaaagaagccaaaagacaccugagugccauacuuguaaguauaaaagcuaaaaacaaaguaaugacgcagaacgucaauaagaucaaaacuaaaaauggaauuauaaaaaaaguccaacucacaccacggggagcacuacauaaugaaaccaucuacggaaccaaaaugagaccaauuauaaaaaugguaaagauuggcgcagcacuagaugaagcaacuauaaacaaagucucaucuccaacaauuagagaagcguuacuaaaaagauuaaacgaauacucuggcgaugcaaagaaagcauucgcaggcaaaaacgcaauaacaaaaaauccaauauauuuaaaugcagaacauacaaaaacagcaccagcuauggucaaaauaguugagugggaaauguauuacccgauucgaaaguuaauaacucccgaucuuaaaauagaaaaaguaauugauaauggaauaaaggaaauuuugaaaaaaagauuaaaagaauuuggcggugacgcgaaaaaagcauuuucaaaccuagacgagugcccaauauauuuagacgaggaaaaaaauaucacucuaaaaaggguuucaauagaaggcguacuuagugcgaucccuguacauacacuaaaaaaucaugcuggcaaggaaauaaaagaugaagacggaaaagcaguccugggagauuauguucaaacauccaauaaucaucaugucgcuauauaucaagacgcaaaaggaaaccuacaggauaauguaauaucuuuuuucgaagcugcggagcgaaaaucacaaaauguacccauagucgacaaaaaucuaaaccgcgacaaaggauggcacuuccuauacaccaugaagcagaacgaauauuuuguauucccaaaugaggaaacagguuuuguaccaucggaaauagacuuaauggacgaaaacaacuacgaaaugauaagcccaaacuuauuuagaguacaaaccaugucaagaguugacuacggaaaaacaauaauaagagaauauguuuuuagaaaucaucuagaaaccauauugaacgauaaucucaaauugaaaggacuagucuucaaaaaaauaaaaucguuaaaagcauuagaaggaauuguaaaaguaagggucaacgccaucgguaaaauuguugcaguaggugaauacgauuga

SEQ ID NO: 9004 - RNA, 4143 nt, Artificial Sequence
  Cas9 variant
augaaaaagaaauaugcuauagggauagacauagguacaaauuccgucggguggucaguagugacggaugacuauaaaguaccauccaagaaaaugaaagucuuuggaaauaccgagaaaagauauauuaagaaaaaccuucuaggaaccuuacucuucgacgaaggcaauacugccgaaaaucgacgacucaaacgcacggcuagacgcagauacacuagacgaagaaacagaauacucuacuuacaagaaauuuuugcagaagaaauuaacaaaaucgacgacucauucuuucaaaggcuagacgauuccuuccuaauuguugaagacaaacaaggauccaaacaucccauauucgguacccuucaagaagaaaaagaauaccauaaacaauuuccaacaaucuaccacuugagaaaacaacuugcagacucuagccaaaaagcugacauuagacuuauauaccucgcucuagcacacauuauaaaauacagaggucacuucuuauuugaaggggaucuaaaauccgagaacaaagacguucaacaccuuuuuaaugauuuugucgaaauguucgacaaaaccguagaaggaaguuauuuaagugagaaucugccaaacguagcagacguccuaguagaaaaaguaucaaaaagccgacaccucgagaacauauugcacuauuucccaaacgagaaaaagaacggcuuauucggaaauuucuuggcccucgcuuuaggacuccaaccaaauuuuaagacuaacuucgaacuugccgaagaugcuaagauacaauucaguaaagaaacguaugaagaagaccuagaagaauuauuaggaaaaaucggcgaugauuaugcagauuuauucauagcaacaaaaucacuauacgacggaaucuuacuagccggcauccucuccacaaccaacaguacaacaaaagcuccacuuucauccucaaugguaaauagauaugaagaacaccaaaaagaccuggcuuuacugaaaaacuucauacaccagaacuugagcgacucauauaaagaaguauucaacgauaaacucaaggacggauaugcuggcuauauagagggcaaaaccacacaagaaaauuucuauagauucauaaagaaagcaauugagaaaaucgacggaucaaauuacuucauagagaaaaucgaaagagaagacuucuuaagaaaacaaagaacguuugauaacggauccauaccacaccaaauccacuuaagggaaaugcaagcgauaauacgacgucaagcuaaauucuauccauuccuagaagaaaaucaggauaaaauagaaaagauacuuaccuucaggauacccuauuacguaggacccuuagcacgcggaaaaucggaauuugcguggcuuaaucgaaaaucagaugagaaaauaagaccguggaauuuugacgaaaugguugacaaagaaacaucagcagaaaacuuuauaacaagaaugacuaacuacgaucaauacuuaccagaccaaaaaguauuaccaaaacacagccuguuauacgaaaaauuugccguguacaacgaacucacaaaaguucgauauguaacggaacaaggcaaaucauucuucuuugaugcaaacaugaaacaagaaauauucgauagaacuuucaaaguauauagaaaaguaacaaaagaaaaauuaauggacuuucuaagcaaagaauuugacgaguucagaauagucgacuuacugggucuagauaaagauaauaaaucauucaacgcuagcuuaggcacuuaccacgaccucaagaaaauugucucagaagauuuccuggacaauucugaaaacgaagauauuuuagaaaauguugugcucacuuuaacauuguucgaagaccgcgaaaugaucagaaaaagacucgaaaaauauaaagacguacuaacugaagaacaacguaaaaagcucgaaagaagacacuacacaggauggggaaggcucuccgccaaauuaauaaacggaauuagagacaaaguaacacgaaaaaccaucuuagacuauuuaauugaugacgguacaucuaacagaaacuuuaugcaauuaauaaaugacgacacacuaucauuugucgacgaaauucgacucgcucaaggaaguggaaaagccgaagauuaccgagcugaaguacaaaacuuagcgggaagccccgcaauuaagaaagguauacuucaaagucucaaaauuguagacgaacuaauagaaguaaugggauaugauccagaacauauaguagucgaaauggcaagagaaaaccaauuuacaaaucaaggaagaagaaacagucaacagagauacaagaaaauagaaaaugcaaucaaaaaucuagacucaaacuuaaacagcaaaauucuaaaagaauaucccacaaacaaccaagccuuacaaaaugauagacuuuuccuauacuaccuucagaaugggaaagacauguauacugacgaagaauuagauauagaucaacuuucucaauacgauaucgaccacauaauaccacaagcauuuauuaaagacgauagucuagacaacaaaguccucaccaaaagcgcuaaaaaccguggaaaaagcgacgacguuccaucacuagaaauuguuuauaaaaagaaaaacuucuggaaacagcuucuagauucacaacuaauaucacaaagaaaauuugauaaucuaacuaaagcagaacgaggaggacucaccaaugaagacaaagcaagguuuauucagagacaacuggucgaaaccagacaaauaacaaaacacgucgcacgaauauuagacacaagauuuaauacaaaacuagaugaagcuggcaaucgaauaagagaccccaaaguaaauauaaugacacuaaaaagcagccuaguaucacaauuccgaaaagacuaccaacuauauaaagucagagaaauaaacaauuaccaccaugcccaugaugcauacuuaaacgcuguaguggcuacagccuuacucaagaaauauccucagcuugcgccagaguucgucuacggugauuacccaaaauauaauucauauaaaagcagaaaaucagccacugaaaaaguauuauucuacaguaacauuaugaauuucuuuaaacgaguccucguuuauucaaaaacaggcgaagucagaauaagaccugugauagaaguaaauaaagaaacuggagaaaucguaugggacaagaaauccgauuucaggacaguaagaaaaguacuaucauacccgcaaguaaacgucguaaagaaaacggaaguacagaaucacggccuggaccgcggaaaaccuaaagguuuuuacaacgccaaucuaucuccaagaccuaaagaagggucaguugaaaaccuaguacccgcaaaacaaucauuugauaccaaacgauauggcggcuacgcaggcauaucaaauaguuacgccguucuaguaaauggcauuauagaaaaaggcaaaaagaaauccaaagcagaaguaacagaguuccaagggauuuccauacuagcucgaaaagacuuugacaaaaauccaaaacaauaucuacuuaacuuaggauauaaagacauaaaaagcauaauaaaacugccaaaguauucuuuauuugaauuagaaaacggaagcagaagaaugcuagcaucuauucuaaguacaaacaauaaaagaggugaaauacacaaaggaaacgaaauguaccuaccagacaaauucgucacauuacuauaucacgcaaugcgagucaaccgaacucucgaacccggucacaagaaauaugucgaagcacaccgccauguauucgaugaacuauuaacauauauuuuagaauacaacgagaaaauaguuggagcaaaagccaacgggaaaagaauuguagaagcauacuccgcaagaaaagauaccgauaauuuagaagaauuaugcaacagcuuuauaaacuuacuuaaucucacagcacuagguuccgccguggauuuugaauuucuaggaacaaaaaucccucgauaccgagacuauacuccuuccaguuuguugaaagcaacacugauccaccaauccguaacaggauuauaugagaccagaauagaccuuucuaaacuaggaggagacuga

SEQ ID NO: 9005 - RNA, 4143 nt, Artificial Sequence
  Cas9 variant
augaagaaaauccugggccuugacuuaggaacaacaaguauaggcugggccuuaguuuacgagucagagaaugccgaugaaaaaucgucaauaguaagacuagguguacgagucaauccucuuucaguagaugaaaaaggaaacuuugaaaaagguaaaucaaucacaaccaacgcugauagacaacaaacccacggugcucgaauaaauuuacaaagauauaaauuaaggcgagagaauuugaaagauugcuuacagaaacaaggcuggauuggcacugaagcacuguacgaagaaggaaaaacuucgacauuugaaaccuacauguuaagagcaaaagcagccgaagaggaaaucuccuuacacgaauuaugucguguauuguucauguugaacaagaaaagaggauacaaaaguaauagaaaagcuaacaacaaagaagacgguaaacuauuugacggaaugacgguagcuaagaaauuguaugaggaacaccucacacccgcagaauauaguuuaaaauuacugucuucagguaagaaauucaaacaggaauacuacagaucggacuuaaaagaagaguucgaucgcauauggaacgaacaacaaaaauacuacccagaaauauugacggaugauuuuaagcaacagcuacaagggaaaucgaaagguaauacaaguaaaauauuccuaggaaaguauggcaucuauagcgcugaccuaaaaggucuagaucgaaaauugcaaccacucaaauggcgagucgaagcacucaagcaaaaagucgacaaagaaguccuagcauucguaauuagugacuuaaacggacaaauagcaaguacuucaggucuauuaggagcuaucucggacagaucuaaggaacucuauuuuaauaaacagaccguuggacaauaucucuggacaucacugaaggaaucuccacauguaucaaucaaaaauaagccauucuaucgacaagacuacuuggacgaguucgagaaaauaugggaaacccaagcaacguaccauaaagaacuaacucccgaacuaaagcaagaaauaagagauauaauuauuuucuaccagagaccacuaaaaagcaaaaagggacugaucagcguaugcgaacuggaacaacgaaaaguaaaaguuacaauagacggaaaagaaaaagaaauaucaauagggccaaaagucgcaccaaaaucaucaccaauguuccaagaauuucggaucuggcaaaaucuaaauaauauacuacuuauagauaaaggaaacaacagcaacagaccuuuauaugaagaggaacgaaaucuauuauaugaagaacuaucagugaaagagaaacucucaaaagccgaagcacuaaaaguauuaaacaaaaauggaaaacaaugggauuuaaauuauaaagaaauagaagggaacagaacacaagcaguauuauacgauuguuacaaucgaauaauagguaugacuggacaugaagaaugcaacuuuaagaaacuaaaagcgucugauauacgauauaaugugaaaaccauuuucaaaaacuuaggcuuuucgaccgacauacuagacuucgacaguucgcuucaaggacacgaacuugaacgucaaccaucauaccaguuauggcauuuacuuuauucauacgaauccgacaacucaagaaccggaaaugacgcacuacuaagaaaauuagaaacagcauucucuauaccaaaagaauacgcugcaguguuaucagacguaguauucgaagacaguuaugguaacuuaucgguaaaagccaugcgcaacauucugccucaccuacaggcaggccucgauuauagccaagccugugaaaaagcgggguacaaacacucacgaaggagcuuaacuaaaaacgaauuagauaagaaagaauauaaagaaaaacuagaacugcuaccuaaaucguccuuacacaaucccguaguugagaaaauauuaaaucaaaugaucaauguaauaaaugcugugauagacgaauacggaaaaccagaugaaaucagaauagagcuagcccgcgaauuaaaaauuggcgccgcagaaagagaaaauaugacacgcucaauaaaccaaggaaaugcggaaaacaaaagaaucagagaaaucuuagaaaaagaguucgcauuaucauauaucucaagaaacgacauaauaaaauauaaauuauacgaagaauuaaaauccaacggauucaaaacacuauauagcgauacauacauaaguaaagauaaacuuuucucaaaagacuucgacauagaacauaucauaccaaaagcgcgauuauuugaugacucacuuucuaacaaaacaauugaagcaagagauguuaauauagcaaaaucaaacaaaacagcauucgacuucauaagcgaaaaauacgaucaacaaggcauugaagcauauaaaaagaaacucgacauccuacuacaagacggaucuauaucaaaagcaaaauauaauaggcuauuaaugaaagaagcugauauaccaucuggcuucaucgaucgagaccuacgagacacccaauacauagccaagaaagcauaugaaauauugagugaucucgucaggaauguaacaccaacaacaggagcagucacuucaagacuacgugaagauuggcagcuaguggacgucaugaaagaacuaaacuucgaaaaauaccagaaacucgggcuaguagaaguaaucgaagacagggacggaagaaaaauuaaaagaauaaaagacuggacgaaaagaaacgaccaccgccaucacgccauggaugcucuaacaauagcauuuacaaagccaucuuauauacaguacuuaaacaacuugaaugcaagaucagacaaaaacucaagcauauacggaaucgaaaacaaagaauuacaccgcgaagacaacaaacuacguuucaacgcacccuugccaauaaacgaguucagggcagaagcaagaagacaucuuaaaagcauauuaguaucuguuaaagcuaaaaacaaaguaaugacacaaaacguaaacguuaucaaaacaaaacauggagucauaaagaaaguccaguuaacaccacgaggagaauuacauaacgcaacauucuaugggaccaagaaacgaccaauuauaaaaaugguaaaaguuggagcagcacuggacgaaguuacaauuaagaaaguaaguucuagcuuuauaagagaagcacuacuugauagacuucaugaauauaacggagacgcgaagaaagccuuuacaggacgaaauaguauagacaaaaaccccauauacauagaugaagaacauaagaaaacaguaccugcacucguuaaaacgauagaaugggaaauguaccacccaacgagaaaaaugaucagcccggacuuaaaaauagauaaaguaauagacaaagggaucagagaaauacuaagaacacgauuggcaaaauucaacggagaugcacaaaaagccuucagcaacuuagaugaaaacccaauauacaaagacgaagcuaagaaaauaacccuaaaaaggguaagucuagaaggcgugaguucaguaauuccccuccauaaacuaaaagacaugggaggcaaaccaguugucgguaaagacgggaaacccgucuggggcgacuauguccaaacaagcaauaaucaccauaucgccuucuauauggaugaaaacggaaaucuacaagaugauguuguuaccuucuucaaagcagcaaggagaaaaucacaaggaguaccuguaaucgacaaaaacuauaaucacgacaaaggcuggcacuuucucuucacaaugaaacaaaacgaauacuuuguauucccgaaugaagccacaggcuucaucccaacugaaguagacuuaauggaugaagccaauuaugauaugauaagcccaaaucuauauagaguacaaaagaugagcaaaacaaaacagggcauaaccgacaaaagagauuacugguuuagacaccaucuagaaacagugcuuaauaacgaccuaaaagugcgaaauucgauauuuaaacaaauaaacaguuuaaaaccucuagagggcaucguaaagguaagaauaaacgcaauaggaaaaauaguugccaucggagaauacgauuga

SEQ ID NO: 9006 - RNA, 4143 nt, Artificial Sequence
  Cas9 variant
augaagcgaauacuaggauuagaucucggaacgacaucaauaggcugggcccuugugaacgaagccgaaucuaacaacgaagcgucaaguauaguaagacuaggaguacgaguaaauccauuaacaguugaugagaaaagcaacuuugaaaaaggaaaagcaaucacaaccaaugcagauaggcaauugagacacggagcaagaauaaauuugcaaagauauaaacuaagacgacaaaauuuacaugacugucuacaaaaacaaggaugguuaggcacagaggcaauguaugaagaaggaaaggccagcacguuugaaacauauaaauuacgggcuaaagccgccgaagaagagauaucgcuucaugaguucgccagaguauuguuuauguuaaauaagaaaagaggauauaaaucaaacaggaaagcaaauaauaaggaagacgggcaauuauuugaugguaugacuauugccaagaaacuauacgaagaacaccucacgcccgcugaauauagucuacaacuauuaaauaaaggaaagaaauucacccaagguuauuacagaucagaccuaaacgcagaacuagaacgcauaugggaugaacaaaagaaauauuauccagaaauauugacagaugaauuuaaacaacaacuugaagguaaaacaaaaaccaauacaucaaaaauuuuucuagcuaaauauggaauuuacagcgccgauuuaaaaggccuagaucgaaaauuacaaccucuaaaauggagaguagaagcacuuaaacagcaaguagauaaagagguacuagcauuugugauaagcgaccuuaaaggacaaauagccaacaccucgggucucuugggagcaauauccgacagaucuaaggaacuuuauuucaacaaacagacaguaggacaauaucuaugggccucgcucgaagagaauccacauaucaguaucaaaaacaaaccauucuacagacaagauuauuuagacgaauuugagaaaaucugggaaacacaagcaacauuucauaaacaacuaaccccagaacuaaaacaggaaauccgagacauaauaauauuuuaucaaagaccgcuuaaaaguaagaaaucauuaauauccguaugugaauuggaacaaaggaaaguaaaagcaacaauugauggaaaagaaaaggaaaucacaauaggaccuaaaguagcaccuaaaucuagucccguauuccaagaguucagaaucuggcagaaccuaaacaauguacuacuaauagacaacgacacaaacgaaaagagaccucuagacgaagaugagagauaccugcuuuacaaagaacuaaguauaaaagcaaaacuuagcaagacugaggcuuuaaaaauucucaauaagaagggaaaacagugggacuuaaauuauaaagaauuagaagggaaccgaacucaagcuaucuuauuugacugcuauaaccguauuaucacacuaaccggccacgaagaaugcgacuuuaagaaaauaaaagcgucagaaauaagacauuauguuucaacaauauuuaaaaauuuaggauuuagcacagaaauucuagacuuugauccaagccucgaaaaacaugaacuagaaaaacaaccaauguaucagcuguggcaucuacuauacuccuaugaaagcgauaacucccgaacuggcaacgaaagucuauuaagaaaacuagaaacaacauuuggauuuccugaagaauacgccacaguacuaugcgacguaguuuuugaagaagacuacggaaaucucagcguuaaagcaaugcgaaaaauccuaccuuaucuacaggcagguaacgauuauucccaagccugcgcauaugcaggauauaaccacucgagacacaguuuaacaaaagaagaacucgaccagaaaguauauaaggagagacuagaacuauuacccaaaaacucauuaagaaacccaguaguagagaaaauacuaaaucaaaugauaaauguaauaaaugcaaucaucgacgaauacggcaaaccagacgaaauucgcauagaaauggcaagggaacuaaaaaguucagcagcagacagaaagaaaacaacccacgcaauaaaccaagguaaugacgaaaaucaauguauaagagaaauauuagaaaaagaguucgcacuaagcuacaucucaagaaacgacauaaucaaauauaagcuauaugaagaacuaaaaccaaacggauucaaaacauuguacucagacaccuacauaccaaaagacaaacuguucaguaaagauuucgacaucgaacacauuaucccaaaagcaaggcuauuugacgauagcuacucuaauaagacacuagaagcaagagacauuaaucuagcaaaaaguaacaaaacagcauuugacuucguaaaagaaaaauacggggaacaaggugccgaagcauauaaaaagaaacuagacaugcucuuagguaauaacgugauaucuaaaccaaaauacaauaaacuacuaaugaccgaagcagacaucccaucagacuuuaucaauagggaccuuagaaacacacaauauauugccagaaaagcaugugaaauacuuggggagcuagugagaacaguaacacccacaacaggaaaaauaacaaaccgacuuagagaagacuggcaguuagucgauguuaugaaagaacuaaacuuugaaaaauaugaaaaacuaggauugacagaaauaguagaagaucgagaugguagaaagauaaaacgcaucaaagauuggacuaagcggaacgaucacagacaucacgcuauggaugcacuagcuauagcauuuacaaaaccaagcuauauucaauaccuaaacaauuuaaaugcaagaagcaacaaaggcgacucaauuuacgcuaucgaaaacaaagaacuucacuaugaagaaggcaaacuacgguuuaacgcacccauaccaguaaacguauuucgugccgaagccaaacgucacuuaucagcuauacucgucucaaucaaagcgaagaacaaaguuaugacucagaacguuaauaaaauaaaaacaaaacauggcauaauuaagaaaauucaacuuacuccccgcggcccuuuacacaaugagacgauauauggaacaaaaaugcgaccaauaauuaagaaaguaaaaguaggagcagcauuggacgaagccacuauaaacaaaguauccucgcccgccauacgcgaagucuuacucaaacgacuaaacgaguauucaggaaacgcuaaaaaggcauucaccgguaaaaacacacuggauaaaaaucccaucuaccugaacgcagaaagaacuaaaacaguacccgcaagcguaaaaacaguagaaugggaaaacuaucacccaauuagaaaaccaauuacgccagaucuaaaaguugauaaaguaauugacaaaggaauaggagaaauauuaaaagcuagauuagaagaguucaauggcgacgccaagaaagccuucaguaaccucgaagaaaauccgauauaccuugaccaaaccaagaaaauagcauuaaaaagagugucuauugaaggaguacuauccaccauaccauugcacacauugaaaaaucaagcaggaaaaccuauuaugggaaaagauggaaaaccuguacugggcaacuauguacaaaccucuaauaaucaucauauagcuuuuuacuaugaugaagacggaaauuuacaagacaacgcuguuucuuucuucgaagcagcagaaaggaaaucacaaggcauuucaguuauugauaaagacuacaaucgagacaaaggauggagauucuuauucaccaugaaacaaaacgaauauuucgucuuuccaaaugaagcaacagguuucauaccaucugaaguagaucuaacggacgaagcuaacuacggaauuauauccccgaaccucuacagagugcagaaaaugagcagaauugaaaaagggacauccguaagcagagauuauugguuuaggcaccaucuagaaacuauucuuaaugacgacagccgccucaaaaauucagcguucaaacgcaucaauaguuuaaaacccuuagaaggcauuauaaaaguacgcauaaacucaauuggaaaaaucgucgcagucggugaauaugacuga

SEQ ID NO: 9007 - RNA, 4143 nt, Artificial Sequence
  Cas9 variant
augaagaaagguuauucaaucggauuagauauagguacaaauucaguuggcuucgcaguaauuacggacgacuacaaagugccgagcaagaaaaugaaaguauuaggcaacaccgauaaaagauucauaaagaaaaaucuaauaggugcacuccuauuugaugaagggacaacagccgaagcaagaagacuaaaacgcacagcacguagacguuauacaagacguaaaaacagacucagauacuuacaagaaauuuuuagugaagaaaugagcaaaguugauucaucguucuuucaccguuuagacgacucauuuuuaauacccgaagacaaaagagaaucuaaauacccuauauuugcaacacuagaggaagaaaaagaguaucacaagaaauucccaaccauauaccaccuaaggaaacaucuggcagauaguaaagaaaaagcagaucuacgacuaauauauuuagcccucgcacacaugaucaaauaucgcggacacuuccuauacgaagacacuuucgacaucaaaaacaaugauauacagaaaauauuuaacgaguucauaucuauauacgauaaugcuuuugaaggaucaagccucucuggucaaaacgcgcaaguagaagcaaucuuuacagacaaaauuucuaaaagcgccaaacgugaaagaguuuuaaaacuauuuccagacgagaaaaguacaggauuauucagcgaauuuuuaaaauuaauagugggaaaccaagcagauuuuaagaaacauuuugauuuagaagauaaagccccacugcaauuuaguaaagauacguacgacgaggacuuagaaaauuuauuaggccaaauaggcgacgauuuugcagauuuauucguugccgcgaagaaauuauacgaugcaauccuccuauccggaauauuaacuguaacagauccaucaacaaaagcaccacucagugccucaaugauagaacgcuaugaaaaucaccaaaaugaucuugucgugcuaaaacaauucauuaaaaauaaccuaccagaaaacuacgucgaagucuuuagugacgacuccaaaaacggcuacgcaggauacguaggcguagauucaaaaauaagaaaaaggaaugcaaaacuagcaacagaagaagaguucuacaaauaccucaaaaacauacuaaacaacguaaaaggggcagauuauuuccuagacaaaauagaaagagaagauuuccugagaaaacaaaggacauucgauaacgguucuaucccgcaucaaauacaccuacaagaaaugaacgcuauacucagaaggcaaggcgaacacuauccauuuuuaaaagaaaaccgcgagaaaauagaaaagauauuaaccuuccggaucccauacuauguuggaccguuagcuagaggaaauagagacuucgcuugguuaacaagaaauagugaucaagccaucagaccauggaauuuugaagaaauuguggauaaagccuccucugccgaggacuucauaaauaaaaugacaaauuacgacuuauauuuaccggaagaaaaaguacuaccaaaacacucacuacucuacgaaaaguucgcgguauauaacgagcugacaaaaguaaaauucauagcagaaggucuuagagauuaucaauuccucgauucuggccagaagaaacagauugugaaccaacuguucaaagagaaaagaaaaguaacagaaaaagauauaauucacuaccuacauacagucgauggauacgaugguauagaacucaaagguaucgaaaaacaauucaacgccagccuuuccacuuaucacgaccuauuaaaaauaaucaaagacaaagaguucauggaugauccgaaaaaugaagaaauccuagaaaacauaguccacacacuaaccauauuugaagauagagaaaugaucaaacaacgauuagcacaguaugacucuuuauuugacgaaaaagugauaaaaagucuaacaaggagacauuauacaggauggggaaaauuaucggccaugcucaucaacgggauacgugacaagcaaacuggaaaaaccauauuggauuaucuaauagacgacgcauacuacaaucgcaacuucaugcaacuaauaaaugacgacgggcuaucuuuuaaagaaauaauccaaaaagcacaagucgucgguaaaacagaugacguuaaacaagucguacaagaacucccagguucuccagcaaucaagaaaggaauauuacaaaguauuaaaaucgucgaugagcuagucaaaauaaugagacacaacccagaaucaauagugauagaaauggcacgagaaaaucaaacaacggcaagaggaaagaaaaauucccaacaacgcuacaaacggauagaagacgcgcuaaagaacuuagcaccaggacuugauuccaacauacuaaaagaacacccgaccgauaacguacaauuacagaaugacagauuauucuuauauuauuuacaaaauggaaaagauauguauaccggagaagcacuagacaucaaucaauugaguucuuacgacauagaccacauaauaccacaagcauucauaaaagacgacucauucgacaauagaguucuaacaucaagcaaagauaauaggggaaaaagcgauaacguucccucaauagaaguaguacagaaaaggaaagcguuuuggcaacaacuauuagauaguaaacucauaucagaaagaaaauuuaacaaucugacaaaagcggaaaggggaggacuagacgaacgagauaaaguaggcuuuauaaaaagacaauuaguagaaacgagacaaauaacaaaacacguugcccagauacuugaugcgagauauaacacagaaguaaacgaaaaagauaagaaaaauagaacaguaaaaaucauaacacuaaaaagcaaccuuguuaguaacuucagaaaagaauuuagauuauauaaaguuagagaaauaaaugacuaucaccacgcucaugacgccuaucucaacgcaguagucgcuaaagccauauuaaagaaauauccuaaauuggaaccagaguucguauacggagaauaccaaaaauacgaccuaaaaagauacauaagcagaucaaaagacccaaaagaagucgaaaaagccacugaaaaauauuucuuuuacucaaacuuacuaaacuuuuucaaagaagaagugcauuacgcugauggaaccauaguaaagagggaaaauauugaauauucaaaagauacaggcgagauugccuggaauaaagaaaaagauuuugcgauaauaaagaaaguacuaagucuaccccagguaaacauaguuaagaaaagagagguacaaacugguggauucuccaaagagucaauuuuaccaaaaggaaauagcgauaaacuaauuccuagaaaaacaaaagauauacuaugggacacuaccaaauacgguggauuugacaguccaguuauagcguacucgauccuacucauugcagacauagaaaaggggaaagcaaagaaacugaaaacagugaaaacacucgucggaauuacaauaauggaaaaagccgcuuuugaggacaacccaauaacauuccuagaaaauaaaggguaucauaacguucgaaaagaaaauauccuaugccuaccaaaguauucccuauuugagcuagaaaacgguagacgaagauuacuagcuucugccaaagaauugcaaaaaggcaacgaaauaguccuaccaguauaucugacuacucugcuguaccacagcaagaacguacacaaacuagaugaaccaggacaccuagaguacauacaaaaacaccgaaacgaguucaaggaucuucucaaccuuguaagcgaauuuucccaaaaauacguauuagcagacgcgaacuuagaaaagaucaaaucauuauacgcagauaaugaacaagcggauaucgaaauucuagcuaauucauuuauuaaucucuugacauuuacagcucugggggcaccagcagcuuuuaaauucuucgguaaagacauagauaggaaaagauauaccacuguaucagaaauuuuaaaugcaaccuuaauacaccagucaaucacagggcuauacgaaacaagaauagaccuaucaaaauuaggugaagacuga

SEQ ID NO: 9008 - RNA, 4143 nt, Artificial Sequence
  Cas9 variant
augaauuuaaggcacguaggaaacuacaacauaggccuagauaugggcacagcaaguguaggaugggcugcaauagaugaacaaggagaauuacuacauuuuaaaggcaaaccaacauggggauccagguuauucgauucugcaaauacggcagcuacagcuagaaugccuaggggucaaagaagaagauauauaagaagaagauggagacuugauuuauuacaaaaauuuuucagugaggagauggcagaaaaagauccugaguucuucauaagauugaggcaaagcucauuauggcccgaagacagagaaggaggucacacagccuaccacuggccucuuuuuaacgauucugauuucaaugaaaaagaauacuaugaaaaguuccccacaauuuuucauuuacggcaauggcucauggaaacagaugaaaaagccgauauuagauugauuuaccuugcauuccauaacauaguaaagcaccgagguaacuuucuucaagaaaacaacgauagucuaucagcucaaaacgccaauaugagagaaagucuagaaucauucugcauagcuuuagaagaauggugugaugaaaaggaacuuacaugcagcugugacccgcaaaagcuagaacauuuauucaaagaagugaaauauagauccgauaucagagacggcuuugcugcauuguuaggguuggcuuguucuggagaaaaugaaguagacgugaaagcaauggcaaaagagauggguaaagcuauuguuggauacaaagcugauuucaguaaaauauuuacagaaugcgacaaagaagguucaucuuuuagauuaucggaugacgaaggaccugaggcuuuucuggauauauguccagaugauggcaucgcauuguuugaagcgauacaaauggucuauagcucauucauccuaacaggaaugcucacagagaagggccuaucacuuagcaaaaucucagcguacaaccaauaugggcaagaucuagaaucauugaaagcgcuuguaaaagaauaugugccaaaugaauacucgaguuucuuucgugggcccacauauucaggaaguacugaauacgacccuaguaaagcccaggguuacacacguuauaauuugggaccuucaaagaaaggaucaggagcaaaaccaauggccuaugaagauuuuaagaaaucaguagaacaauuauucgcgaacaccaaugcgauaaaugacgaaagauauaaagaaaugaugggcagguuugcagaagagaaauuucucagaagauuaagaacaucggauaacggaaggauccccuuucaacuaaauuuagaagagaugacagcaauaauaauaaaucaaggcaaguauuaucccuuuuuauuagaacagcaagaaaaauuggagaguuuggugagauucagaauaccauauuacgugggaccuuuaacacgaauaaacgcaagauuggacaguaagggcaacgcguguuuugcauggaguaaacgaaaagaugggauggauagugccaguauaaaaccauggaauugggaugaaguaauugauaaacacgccucggcccaggcuuucauagaacgaaugacuggaacuuguacauaucugagaggagagccaguauuaccgagguguucauuacuguaugaggaguauuguguacuaaaugaauuaaauggugcuagauggacacaagacggggauaaguuuauacgcuuugacuacaaagauagaagugauauaauagaagaauuauuuaagaaaagaagagggaggauacaauacgcagcaguugcggacuggaugaaacaagaaagaucucacgcaaacguucacguaagugggggacaaggugaaaacgcauuugagucucgguugucaucauaccacuuuuucuguaacgacgucuucggagucgacgaguuacccggaagcuauguggauaugguagaagaaauaauacuauggagcacauuauucgaggacagaucuauccuaagagaagagauacaaagaaaauauggugauguguugaacgaagaacaaauaaagacuaucugcaagaaaagauucagcggauggggacgauuaagccggaaauuacuuugcucucuuaaagcucaaacggacaauggaccaaaauccauuauggauauacugcaggaaggugaccagaauaacggaagagugggcagagcaaugguauuucaagaaauccuacacgacgaacaauuaggauucgaacagaaaauugaagaggaaaauacccaaagcaugcuagaaggagaaaacuuacuaauugaagaccuuccagguucacccgcuauaagacgcaguauaaaucaagcaguaagaauaguagacgaaaucguagguauagcuggacaugcacccgacaauauuuuuauagaaguaacgcgagaagaugauacaaagaagaaaggaaaaaggacaacgacccgguacucaaauauucaaaaagcacuagaagcacugaaagaagaaggugcugaagcauuaagagaguuaaaaacauauaaacacaaugaauuagacaaacgacuuucacuauauuuuaugcaaaacgguaaaaguuuauacuccgguauaccccuggauauucggcgacugagcgaauaccaaauagaucauaucauuccacaaucauauauuaaggacgauaguuacgaaaauauggcguuggucuugcccggggaaaaucaaucaaaagcagauaaccuccuuauaucacaagauauaagaauaaagaugaaagcaacauggacagcguuacauaaagcagguuugaugggagauaagaaauauaauaauuugaugaacucaucuauaucagaugcgaaaaugaaagguuuuauaaaucgacaauuaguagaaacaucgcaaagcgugaaauuaacucaaaugauguugagucaaaaauacccuggggcaaaagucagaccaauaaaagcaagcauaagcucacaauuaagagaugcaugugacuuaguaaaauguagggaggcaaacgacuaucaucacgcacaugaugcguauuuagcaugccaaguagggagguuuguuuuaaaaagacacuccaguauguuugacaacccaauuggaaugacgaaaguaaucagagauuuuguaaaaagacaaggccaagaguucaaaagaaaugguaaacugccagcguaugccaguagaucaggauuuauaguccaaucauucaugagaucaggauuugacgcggaaaccggggaauuauuacgagacgacuggaacgcaccuuuugaaaucgcaagaaucaaaagaugccuaaacuauagagauugcuauauuucaagaaugccaauggaagauucaggagcguuuugggaugcuacuaucuauagcccuaaagcagguaagaaaggagcauugccugugaaacaaggauugccaguugaaaaauaugggucauauaguagagaacaguucgcauauuucuuuguauauaaagcauacaauccgaaaaagaaagccuacagguuagaauuugaagcagucccugugaggguagcaagugcaguggagaccagggaaaacgcccucgaagaauacgcgaagaguguagcuaaacaggcgggacuagaauuuguagaaguagcgcgaccuaaaguguauaaauaucaauugauagaacucggagaagauagacuauauauaacaggcaaacgggagguacggaaugcaagucaacuugccuuuagucuagaugaaauagacuuacuaaaacgacuagcagaaggagaagaaacaagcagcgaagaaagagaaagguuauucgauguguuaauagagaaauacgcuagguacgcgccaagauuagcucgccaacuaucagucgauucaaugagcgcgacauucgagacacucaaugcagaagaacaauugggcaucuuacuuagucucguggaaauagcgaacggcaaacgaaauaugauugaucuauccagcgcaggcggaaguaaaaaugcaggauguaugaacccaacauuuagcagcgaacucuccaguccuggaucaaauuucacauuuauugaucaauccguaacgggaauguuugagcgacgucaaagacuagaacucuga

SEQ ID NO: 9009 - RNA, 4146 nt, Artificial Sequence
  Cas9 variant
augguaaagaagaaauacgccaucgguauagacaucggaaccaacagcgucgguuggagcauaguaacagacgacuacaaaguuccaaguaagaaaaugaaaguauuuggaaacacagaaaaacgauauauuaagaaaaaucuucuaggaacauuacuauucgaugaagguaauacagccgaaaacagaagguuaaaaaggacagcucgccggagauacacacgaagacguaaccgaauacuauaccugcaagaaauauucgccgaagagaucaacaaaauagacgacaguuucuuucaaagacuugacgacaguuuucuaaucguagaggauaaacaagggucuaaacaucccauauuuggaacccuacaagaagaaaaagaauaccacaaacaauuccccacaaucuaccaccuucgaaaacaacuugccgauagcucccagaaagccgauauacgcuuaauauacuuagcuuuagcccacaucaucaaauacagaggacacuuucuauuugaaggcgacuuaaaaucagaaaauaaagacguucaacaccuauucaacgauuucgucgaaauguucgacaaaacaguugaaggaagcuauuuaucugaaaacuuaccaaauguagcugacguccuaguugaaaaaguuagcaaaagcaggagauuagaaaauauacugcacuacuucccaaacgaaaagaaaaacggccuguucggaaacuuucuagcauuagcguuaggccuccaaccaaauuuuaaaacaaauuucgaacuagccgaagacgcaaaaauccaauucuccaaagaaaccuacgaagaagaucuagaggaacuacucggaaaaauuggagaugacuacgccgaccuuuucauagcuacgaaaagucuauacgauggaauauuacuugccggaauacuaucaacaacagacucaacaacaaaggcgccuuuaucgucauccaugguuaaucgcuaugaagaacaccaaaaggauuuagcacuucugaaaaacuucauacaucaaaaccuaucagacucauacaaagaaguauucaaugacaaacuaaaagaugguuaugcuggauacaucgaaggaaagacaacucaagaaaacuucuaucgauuuauuaaaaaggcuauagagaaaauagaaggcucuaauuacuucauagauaagauagauagagaagacuuccuacgaaaacaaaggacuuuugacaacggaagcauaccacaucaaauacaccuacaagaaaugcacgcaaucauaagaagacaagcagaauuuuacccauuucuagucgaaaaucaggauaaaauagagaaaauacuaacauuccguauuccguauuacguaggaccauuagcaagaggaaaaagcgaauuugcguggcuaaacaggaaguccgacgagaaaauaagaccauggaacuuugacgaaauggucgacaaagaaacgucggcagaaaauuucauaacacgcaugacaaauuacgacagauaucuuccagaccaaaaaguauugccaaaacacucauuauuauacgaaaaauuugcuguauauaaugaacuaacaaaaguaaaauuuaucgcggaaggaaugagagauuaccaauuucuugauucaggacaaaagaaagacauaguuaaaacgcuauucaaaaccaaaagaaaaguuaccgcuaaagauauaaaagcauacuuagaaaauucaaacggauacgcaggaguugaacuaaaaggacuugaagaacaauucaacgcaucacuuccuacauaucaugaccucuuaaaaauacuuagagacaaagcauucauugacgcugaagaaaaccaagaaauacuagaagacaucgucuuaacacucacguuauucgaagacagagaaaugaucagaaagcgauuagaaaaauacaaagauaucuuaacugaggaacaacgaaagaagcuagagaggcgacauuacacuggguggggaagauuaagugccaaacuaauaaacgggauucucgacaaaguaaccagaaagacaauacuuggguaucuaaucgaugauggaacaucaaaccgaaacuuuaugcaacuaaucaacgaugauacauuaucauuuguugaugagauucgacuagcucaaggauccggagaggcagaagacuaccgcgcagaaguacaaaauuuagcaggaucacccgcaauuaagaaaggaauauuacagucacucaaaauaguagaugaacuaauagaaguaaugggcuacgaaccagaacacauugucguagaaauggcgagagaaaaccaauuuaccaaccaaggacgccggaacucgcaacaacgaauuaacaggcuagagaacgcccuaaaagauuuugguaguaaaauccuagaagaacaaaagccauauggcguauccaaaguaaacaauauacacuuacaauccgacagacuauuccuuuacuaccuacaaaauggaaaagacauguacaccgaugaagaacuagauauagaccauuuaagugaauacgacauagaucacauuaucccgcaagccuucauaaaagacgauucacuagacaauaagguacuaaccaaaucagcgaaaaauaggggcaagucagacgauguaccgagcauggaaauuguacacaauaggaaaaauuucuggcgacaacuccucaaaaguaaacuaauuucacaaagaaaguuugacaacuuaaccaaagcagaacgcggaggcuuaacuaacgaggacaaagcuagauucauccaacgucagcuagucgagacaaggcaaauaaccaaacauguugcacgaauguuagacacaagauucaauacaaaauuagacgaggcagguaaccguauaagagacccaaaaguaaauauuauuacauuaaaaucgaaccucguaucccaauuuagaaaagacuaucaacuuuauaaaauucgagaaaucaacaauuaccaucacgcccacgacgcauauauaaacgcugucgucgcaaccgcuuugcuaaagaaauacccucaacuagcacccgaauuuguauauggagaauauccaacuuauaacagcuacaacagcagaaaauccgcaacagaaaaaguauuauucuacucaaauauaaugaacuucuucaaaagaaucguaguacacagcaaaacuggggaaguaagaauacgcccagucaucgaaguaaauaaagaaacaggcgaaauaguaugggacaagaaaucagacuuccgaacaguaagaaaaguacuaucuuauccgcaagucaacguaguaaagaaaacagaaguccaaaaucauggacuagaccgaggaaaacccaaaggcuuuuauaacgcaaacuugucaccacguccaaaagaagggucagucgaaaaccucguaccagcuaaacaaaguuuugauaccaaaagauacgguggauaugcuggaauaaguaacucuuaugcugucuuaguaaacggcauaaucgagaaagguaaaaagaaaagcaaagcagaagugacagaauuucaaggaaucucaauacucgcuagaaaagacuucgacaaaaauccuaaacaauauuuguuaaaucuagguuacaaagauaucaaaucaaucauaaaauuaccuaaauacucguuauucgaacuagaaaacgguucgagacgaauguuggcauccauauuaaguacaaacaauaaacgaggcgaaauucacaaagguaacgaaauguaucuacccgauaaauucguaacuuuauuauaccacgccaugagagucaauagaacacuggaaccaggacacaagaaauauguugaaacccacagacacgucuucgacgaacuacuuauauauauccucgaauacaaugagaaaaucguuggagccaaagcaaauggaaaacgaauuguagaagcauacucagcaagaaaagauaccgacaaucuugaagaauuaugcaacucauucauaaaucugcucaaccuaacagcgcuugguagcgcaguugauuucgaguucuuagggacaaaaauaccaagauacagagacuauacaccaaguucuuuauuaaaagcaacauuaauacaccagagugucacaggguuguacgaaacuagaaucgauuuaaguaaacucggaggugacuga

SEQ ID NO: 9010 - RNA, 4146 nt, Artificial Sequence
  Cas9 variant
augaauuacgugaaagaguaccacaucggacuggacauaggaacaucaaguauagguugggcaguaacagacucacaauuuaaacuaaugcgaauaaaagggaaaaccgccauaggaguccgccuauuugaagaaggaaaaaccgccgcugaaagacgaacauuucggacaacaagaagaagacuaaaaagaaggaaauggcgacuacauuacuuagaugaaauauuugcaccacaccuacaagaaguagacgaaaacuuuuuaagaaggcuuaaacaaaguaauauucauccggaagacccagccaaaaaucaagcauuuauaggaaaauuauuauuccccgacuugcuuaagaaaaaugaaagaggauauccaacacuaauaaaaaugagagacgaacugcccgucgaacaaagagcacacuauccagucaccaauauauauaaacuaagagaagcaaugaucaacgaagaucgacaauucgaucugcgugagguguaucuugcagugcaccacauuguaaaauauagaggacacuuucuaaacaacgcuagcguggauaaauuuaaagucggucgaaucgacuuugacaaauccuucaaugucuugaacgaagcauacgaagaauuacaaaacggggagggcucauucacaauugaaccuuccaaaguagagaaaauuggacaauuauuacuagauacaaaaaugaggaaacuagauaggcaaaaagcagucgcaaaauucuuagaagucaaaguagcagacaaagaagagacuaaaagaaacaaacaaauugcuacagcaauuaguaaauuaguacuaggcuacaaagcggacuucgcaacaguugcaauggcuaacggaaaugaauggaaaauagaucuaucgucagaaaccucagaggaugaaaucgaaaaauuuagagaagaauuaagugacgcacaaaaugacauauuaacagaaauaacuucacucuucucacaaauaaugcuaaacgaaauaguaccaaacggaaugagcauaagugaaucaaugauggauagauacuggacacacgagagacaacuggcagaaguuaaagaauaccuagccacacaaccagcauccgcuagaaaagaauuugaccaaguguacaauaaauauauaggacaagcacccaaagaaaaaggcuuugauuuagaaaaaggcuuaaagaaaauucuaucuaagaaagaaaauuggaaagaaauugacgaguuguuaaaagccggagauuuccuucccaaacaacguacaagcgccaauguaguuauaccucaccaaaugcaucaacaagaauuagacagaauaauagaaaaacaagcaaaauauuauccauggcucgccacagaaaacccugcaacaggugaacgagauagacaucaagccaaguacgagcuagaccaauuagucucauuucggauucccuauuacguaggaccccucguaaccccagaaguacagaaagcuaccagcggagcgaaauuugcaugggcaaaacgcaaggaagacggggaaauaaccccuuggaaucuaugggacaaaauagauagagccgaaucagcugaggcuuucaucaaaagaaugaccguaaaagauacuuaccuuuuaaaugaagaugugcugccggcaaauuccuuguuauaccaaaaauauaauguacuaaaugaacugaauaacguccgagucaacgggagacggcucagcguaggaauuaaacaagacaucuacagugaauuauuuaaaaagaagaaaacaguaaaagccucugauguggccucgcuggugauggcaaaaacgcgcgggguuaacaaacccaguguagaaggacuaagugacccuaagaaauuuaacagcaauuuggccacauaccuagaucucaaaucaauaguaggagauaaagucgaugauaauugcuaccaaaccgauuuagaaaauauaauagaauggcgaucuguauuugaagacggagaaauauucgcagacaaacugacugaagucgaguggcuaacagacgaacaaagaucagcccuagugaagaaacgauauaaaggauggggacgacucucaaagaaacuuuuaaccggaauaguagacgagaacggacaaagaauuauugauuugauguggaacacugaucaaaacuuuaugcaaaucgugaaucaaccaguguuuaaagaacaaauagaucaacuaaaccaaaaugcaaucacaaaugacggaaugacucuaagagagagaguugaaagcguccucgaugacgccuauacaagcccgcaaaauaagaaagcaauauggcaagugguccgagucgucgaagacauuguaaaagcaguaggaaaugcaccaaaaagcaucucuaucgaguucgcuaggaaugaggguaauaaaggugaaauaacaagaucccgaaggacccaacuacaaaaacuauucgaagaucaggcacacgagcuaguaaaagauaccagucuaaccgaagaacuagaaaaagcacucgaucucucagauagauacuaucuuuauuucacacaaggaggcaaagacauguacacuggcgauccuauaaauuucgacgaaauaaguacuaaauaugacauagaucauauacuaccacaaucauucguuaaagacgacucucuugacaacagaguucuaguaagcagagcagaaaauaacaagaaaucagaccgggucccugcaaaauuauacgcagcaaaaaugaaaccuuauuggaaucaauuauuaaaacaaggacuaauaacacaaagaaaauuugaaaacuugacuauggacguagaucaaaauauaaaauacagaagucuaggcuucgucaagcgucaauuaguugaaacaagacaagugauuaaauugacugccaacauacuagguucaauguaccaagaagcuggaacagacauaauagagacccgcgcaggccuaacuaaacaauuaagagaagaguucgaccucccaaaagugagagaaguuaacgauuaucaccaugccguugaugcauauuuaacuacuuucgcaggucaauacuuaaacagaagauauccaaaacuaagaaguuucuuugucuauggagaauauaugaaauuuaaaaggggcucagauuuaaaauuaagaaauuucaacuuuuuccacgaacucauggaaggagacaaaucacaaggaaaaguaguagaccaacaaaccggcgaacuaaucacaaccagagacgaaguugcgaaaucuuucgacagacuuuuaaacaugaaauauauguuagucucaaaggaaguccacgacaggucagaucaacuauauggagcaaccauuguuacagcaaaagaaucaggaaaacuaacuagccccauagaaaucaaaaagaaucgaccaguggaccuauauggggcuuacaccaacgguacaagcgccuucaugacuauuaucaaauuuacugggaacaagccuaaauacaaaguaauagguguaccgacuacgagugcaguaggacuaaagagagucgggaaaccugguucugaaucauauaaucaagaacugcaucgaauaaucaaaucaaauccuaaaguaaagaaagacuuugaaauaguuguaccucacguauccuauagucaauuaauuguagacggugauuguaaauucacuuuagccucagacacauaucaacacccugcaacccaauuaguacucagcaaagagucaauggaaauaauagcagaugacuuuaaauuugugaaagaaaauccagcaaccgcagaugaacaauugguccgagucuuugacgaaauaguaaaucaaaugaaccacuacuuuaccauauuugaucaacgaucaaauaggcagaagguaaccaaagcuagagauaaauucguaucucuuccaacugaaagugaauaugaaggagccaagaaaacucaaguaggaaaaacagaaguaauaaccaauuugcucaugggacuacaugccaaugccgcccaaggagaccuaaaaguauuaggacuaucuaccuucggauuuuuccaaaguaguggcggacuaaacuuauccgaagaugcgaugauugucuaccaaaguccgaccggauuguuugaacgacgaauaugcuugaaagauauauga

SEQ ID NO: 9011 - RNA, 4146 nt, Artificial Sequence
  Cas9 variant
augaaacaaauacuaaagaaagugcagggauacaacauaggacuugacauuggaacaaacagcguagguugggugguuacugacgaaaaugcuaaccugcugcaguuuagaaagaaaaacauguggggugcacgacuuuucgaaaaaggagauaccgcucaaggaagaagguuaucaagaucaaccagacgaagauacgacagacgucggcaaagaauacauuaucuccaagaaauguuagcuacaaugguguuaccaauagaugaauccuucuuuauaagacugaacgaagcauuuuuauggaaagaagacaagaguguacaaagagacuacauccucuucgcagauaaacaauucaccgacagagacuucuacaaacaauucaaaacaauauaccaccuaagaaaauuucuucuagauacgaaagaaaaagcagauccgagauuuauauaucuagcccuucaccauaugauuaaauaucgaggaaacuuucucuaccaaggacaaucauucgauguuguagaaaacgugcaagagagcuucagaguacuccuagaagaaauguacgaacaacuuggaaaagaaugggaauacggugaacauuucgacgauauucaaagaauacuugaaaacaccacaauagggaagaaauccaaacaagaacaaauagcagccauacuaacagaacaauacggaaacaagaaacuugcaaacgaaguaacaagagcaugccuaggauacagcuucgaccuaacgguaguaauggaaaacgaaaauuuauuagaugaaucggggaagaaaauaaaaauuucauucagugacaguaaauaugaagaacaagaauuagaauugcaaaaccgacuagaagaaaaauucgcagucauagaagcacuaaaaagaauauacaacugguugguauuaaaagauacacuaagaggcaagaaauauaucucagaggcgaugguaaacaaauaugaagcucaucacgaggacuuaguaaaacuaaaaagacuauuuaggaccuaucuaucaacugaggaauacaguuguuucuuucgaaaagaaaaacaaaaagauaaauacauaucaaauuauguaaauuaccgcaaaggagcagaaaggugcagcaaagaaaaacuauauaaagcuauacaugaauuauucgacacaguggcgaaagacgacguaguuuaccaagaaauaguagagaaaauggaccaaggagaauuucuaaccaaacaaaacgaaguuagcaaugcauauauaccauaccaaugcaacgaaguugaaaugaaaagaauacuaaaacaacaaggugaguucuacccagaacuaaaagaaaacgcagauaaaauacugcaacuacugcuauuucgaauaccauauuauguaggaccccuaguggacgaaaaacaaagcaaauuugcauggaugaaaagaagaacagguauggaacaagucaaaauauacccauggaauuucgaacaaguagucgauauagaucaaacagcagaagcauuuauuaccagaaugacaaauuauuguacuuaccuaccggaagaaaaaguacuaccuaaacaaucacugcuauacucagaauaugaacuucuacaagaacuaaacaaaauaaaaauuaauggaaaauucagccuagaaacacgaaacaaaaucaucgaacaacuuuuuaagaaacagaagaaagucacagaaaaacaacucaagaaauggcuaguuagagaacaauauugcacgacaaaagugacagagaaaaugguaaaauuagaugaaaaugcauauuauauaaccggauuucaaaaagaaaaugaauuugcaagcagucuaaccuccuacauagacuucacaaaaauacuuggagaaaucacugaacgcaaccguaaaaugauagaagaaauaauauacuggcuaaccguauuugaagaaaaaucaaucguaaaaagaaaaauacagaagaaauaugggaacgaaauaaacgauaaacaacucgcacaaauacuaaaacuaaacuauaguggguggggacgauucuccgaaaaauuccuaaacggcaucaaaggauuugacagacaaggacaaaagaaaacaauaauggaauuacugcgggaagauucacgacuauuaaauauaaugcaaauaauaaauaacgaagaaauggguuuuugcaaaauuauagaagccaaccagaagaaacuauacggcaacgaaaaucuacuagauguaguccaggaauuacacggaaguccagcaaucaaaagaggaauauggcaaagccugaaaauuguagaagaaauaauaaguauuaugggaggggugccucaaaacauauucauagaguucgcaagagaagacgaugacagagugagaaccaauucaaggguaaaacaaauugaacgucuauacaagaaauucaaagaagaagugaacgacuucaacgaacaugcggcaaacgaacugaaagagaaaagguaucaaaacagaauugacgaagagaaaguauuccuauauuuuaugcaaaacggcaaaagucuauauagcggaguaacucucgauauagacagauuaaacgaauaugaaguggaccacauuauuccaagaacacuuguuaaagaugauaguuuagaaaauaaagcccuaguauuaaaaggggaaaaccaacgaaaaggagaaggacucaucccccacgaauggcaaaacagacaaaaagaggucuggaagaaacuacuaaguugcggccuuaugggcaagaagaaauaugcuaaucugugcaaagagagcuucggaaacgaaaaagaacaaaaacacuucauagcgagacaaauuguggaaacacgucaaauaaucaaacagguggcaaauauacuggcucaauacuaccaaggaguaaacguggcagcagugaaagcaucacuaggaagugaauuaagggaaaauuacacuauugagaagaaagaugauaacggauucuucauggaaaacaaaucguauacuauguuaaaaucccgaaagauaaacgauuuccaucaugcgcaagaugcuuaccuagccugugcagucggauuauacaucaaagcagcuuuucccaaauacgagaaggaaauugauuacgaaggauaucggaaauauuaccagaagaaaaaccagcaaaaagacggaguaagaaacgaaaagagacaguucuuuuccuauguaaugaguagauuuuccgaacaaauaguagacaaagaaacaggagaaauacugugggacggcacucaaaaguuggcauauauuaagaaaauuuuuggcuacagagacugccuuauuaccaagaaacuagaagaaaacaccggagaauuuuacaaacaaacaauuaacgcaaaaccagaaaaaggaaaggaaaauaauacaaaacuacugccaaucaagaaaggccugucaguggaaaaauaugguggauaccaaggaggagaagcagccuacucauguuuaguaagauaucaacaaggaagaaagacaaaauuaaguuuagagaaaauaucuguuauaauugcaaagaaaauagccgaaaaagaaguaucuuuagacagauaucuuaaagaaaaguuaggaguugaagaaaucguuauauuaagaaagaaaguuaugaaaaaucaauuaauagaagauagugacggaaaucguuucuacuuaacugcagccacagaaguuguuaaugccaaacaauucauccuggacggaaaacaccaacaucuacuaagaacuauagcaauaauggagaaaggcgaguacuauggauacagacuagacgaauuagaaaauucaauggaugaauuauaugcauauuauagaaugaaaauacaacaacaauauccagcauaugaaaguauagucaagaaaauaguugaaagucaugucuacgagagucuucacguagaagagaaaauaaaggcaguccaagaaaaaggaaaauuucuaauccaacuuuuaagauuaacggaagcgaacgcugaauguauagaucuaaaaacaauaucggaugguagauuagcugacaggaucggaaggaaaaaccacuauacuauuaaagaaggaauaaaguucauagaucaauccauaacaggccucuacgaaagauacaugacaguguga

SEQ ID NO: 9012 - RNA, 4146 nt, Artificial Sequence
  Cas9 variant
auggauuacguaaaagaauaccauauaggucuagacauagggaccucaucaauagguugggcaguuacagacagucaauuuaaacugaugagaauaaagggaaaaacugcuauaggagucagacuguucgaagaaggaaaaacagcagcggaaagaagaacauucagaacaaccagaagaagauuaaaaagaaggaaauggagauugcauuaucucgacaaaaucuuugccccccaucuccaagaaguagaugaaaauuucuuacgaagguugaaacaaucuaacauacauccugaagacccagcaaaaaaucaagcauucauaggaaaauugcucuuuccggacuugcuaaaaaaaaaugagagaggauaucccaccuuaauaaaaaugcgggaugaacucccagucgaacagcgugcucauuacccugucacaaauauuuacaaacuaagagaggccaugauaaaugaggaccgacaauucgacuuacgggaaguauaccuagcugugcaucauauaguaaaauaccgaggacacuucuuaaacaaugcuagcguagacaaguucaaaguagggagaauagacuuugauaaaucguuuaauguauuaaaugaagcguaugaagagcuacaaaacggugaaggaucauuuacaauagaaccaaguaagguagaaaaaauaggacaauugcuccuugacaccaaaaugaggaagcuugauaggcaaaaagcaguagccaaacuacuagaaguuaaaguagcggauaaagaagaaacaaaaagaaauaaacaaauagcaacagcaaugaguaagcucguauuaggcuauaaagcagauuuugccaccguagcaauggcgaaugguaacgaauggaaaauugauuuauccucugagacgucagaagaugaaauagaaaaauuccgcgaagaauuaagugacgcacaaaacgacauucuuacugaaauaacaagucuuuuuagccaaauaauguuaaacgcaauaguuccaaauggaaugaguauaagugaaucaaugauggacagauauuggacacaugaaagacaacuagcagaaguaaaagaauaucuugcuacucaacccgcaagcgcacgaaaagaauucgaucaaguuuauaauaaauauauaggccaagucccgaaagaaaaaggauucgacuuagaaaaaggacuaaaaaaaauauugucaaaaaaagagaacuggaaagagaucgaugaacuacuaaaagcaggcgacuuucuacccaaacaacgaacaagugcaaauggaguaauaccacaucaaaugcaucaacaagaguuagacaggaucauagaaaaacaagcaaaauauuauccaugguuagcaacggaaaauccagccacgggcgagcgugaucgacaucaagcaaaauaugaacuagaucaauugguauccuuucgaauaccauauuauguaggcccgcugguaacucccgaaguacaaaaagcuacaucaggagcaaaauucgcuugggccaaacgcaaagaagauggugaaauuacgccauggaaccuuugggauaaaauagaccgagcagagagcgcggaagcauuuauaaaaagaaugacaguaaaagauacguauuuguuaaacgaagaugugcuaccagcuaauagucugcuauaccaaaaguauaacguuuuaaaugaauugaauaacguuagaguaaaugguaggagauuauccguuggcauaaaacaagacauauauacagaauuauucaaaaaaaaaaaaacagugaaagcaggggaugucgcaucauuagucauggcuaagacccggggaguuaauaaacccaguguugaaggcuuaagugauccuaaaaaauuuaacaguaaccuagcaacauaccuagaucuaaaaucaaucaugggggacaaaguagaugacaauagauaccagauggaccuagaaaacauaauagaauggaggucaguuuuugaggacggagaaauuuucgcagauaaacucacagaaguagaguggcuaacagacgaacaaaggucagccuuggugaaaaaaagauauaaaggaugggggcgcuugaguaaaaaacuucuaacaggaauuguggaugaaaauggacaaagaauuauugaccuuauguggaacaccgaccaaaauuuuaugcaaauuguaaaucaaccagucuucaaggaacaaauugaccaacucaaccaaaaagcuaucacaaaugauggaaugacauugagggaacgaguagaaagcguccuugaugaugcauacacuagcccacagaauaaaaaagcaauauggcaagucguaagggucguggaagacaucguuaaagcuguaggaaaugcaccgaaaucgaucaguauugaauucgcaagaaaugagggcaauaaaggugaaauuacacguagcaggagaacccaacugcaaaaauuauucgaggaccaagcccacgaacuuguaaaagauacaucuuuaacugaggaacuagagaaagcucccgaccuaucugaucgauacuauuuuuauuuuacacaagguggcaaagauauguacacaggugacccgauaaacuucgacgaaauaaguacuaaauaugauaucgaucauauacuuccacaaucguucgugaaagaugacucucuagacaauagaguacuaguaucccgugcagaaaauaacaaaaaaagcgauaggguccccgcaaaacuauaugcagccaaaaugaaaccuuacuggaaucagcuucuaaaacaaggacuaauaacacaacgaaaauuugaaaaccuaacgauggauguagaucagaacauaaaauauagaucccucggauuuguaaaaaggcaacuagucgagacaagacaaguaauaaaauuaacugcaaauauacuaggauccauguaucaagaagccgguacggauauaauagaaacaagagcaggacuaacuaaacaauuaagagaagaauucgaucuaccaaaagugagagaaguuaaugacuaucaccaugcuguagaugcguaccuaacuacauuugcuggacaauauuuaaaucgucgauauccaaaacuaagauccuucuucguuuauggcgaauauaugaaauuuaaacacgggagugaucuuaagcuuagaaauuuuaauuuuuuucacgaauuaauggaaggagauaaaucgcagggaaaaguaguugaucaacagacuggugaauuaauuacuacaagagacgaaguugcaaaaaguuucgaucgauuacugaacaugaaauacauguuaguaucaaaagaaguacacgauagaagugaucaacuauacggagcuacuauaguuacugcgaaagaaagcggaaaauuaacaucuccaauagagauuaaaaaaaaucgaccaguagauuuauauggagcuuauaccaacgggacaucggcauucaugaccauaaucaaauucacaggaaacaagccaaaauauaaaguaauaggcgucccaacgacaucugcgguaggguuaaaacgagugggcaaaccagguuccgaaucauacaaccaagagcuacauagaauaauaaaaaguaauccaaagguaaaaaaagauuuugaaauaguaguuccacauguaucauauucccaacucauagucgauggagauugcaaauuuacacuagcuagugacaccuaccaacauccugcaacgcaacuuguauuaucgaaagaaucuauggaaauaauugcagaugauuuuaaauuugucaaagagaauccagcuacagccgacgaacaacuugugcgaguauuugaugaaauugucaaucaaaugaaccauuauuucacuaucuuugaucaacgaucaaaccgacaaaaaguaacgaaagcaagagacaaauucgugaguuuaccaacugaaucagaauacgaaggcgcaaagaaaacucaagucgguaaaacugaagucauaacgaaccuacugaugggacuacacgcaaaugcggcacaaggcgaccugaaaguuuugggccuaagcaccuuugguuuuuuccaauccucuggcggguuaaaucuaucagaagacgcaaugauaguauaucaaucgccuaccggacuauucgaacgaaggauauguuuaaaagacauuuga

SEQ ID NO: 9013 - RNA, 4146 nt, Artificial Sequence
  Cas9 variant
augaagaaaaguuacgccauagguauugacauugggacaaauucaguaggccacugcguaauguacacagaaaauuauaaaguuccgucgaagaaaaugaaaguauucgguaacacagaaaaacgauacauuaagaaaaaccucuuagguacccuacuguucgaugaaggaaauacagcagaaaaccggagacuuaaaagaacagcaagacgacgauacacacgcagacguaacaggauucuguaccuacaagaaauauucgccgaggagaucaauaaaauugacgacucauucuuccaaagauuagacgacagcuucuuaauaguugaagauaaacaaggaaguaaacacccgauauuuggaacgcuacaagaagaaaaagaauaccauaaacaauucccaacaauauaucauuuacgaaaacaacuugcagauuccagccaaaaagcagacauaagauuaauuuacuuagcacuagcacacauaauaaaauacagaggccauuucuuguucgaaggcgaccugaaaagcgaaaacaaagauguacaacaccucuuuaaugacuucguugaaauguucgacaaaacaguugaaggcagcuaccuaucugaaaaccuccccaacguagcugaugucuuaguagaaaaagucagcaaaucuagacguuuagaaaacauucuacacuacuuuccgaacgaaaagaaaaacggauuauucggaaacuuucuugcucuagcccuaggauuacaaccaaauuucaaaacuaauuucgaacuggcggaagacgcaaaaauacaauucaguaaagaaacauacgaagaagaccucgaagaacuacuuggcaaaauaggagaugauuacgcagaucuuuucauagcgacaaaaucacuauaugauggaauauuauuagcaggaauacucuccacuacggauagcaccacaaaagcaccccuaagcagcagcaugguuaaucgcuacgaagaacaucaaaaagauuuagcccuacuuaaagacuuuauaagacaaaauuugagcgacuccuacaaagaguucuuuaaugacacacuaaaagauggauaugcuggauauauugaaggaaaaacaacacaggaaaacuucuaccgauucaucaagaaagcuauagagaaaauagaaggaucaaauuauuuuaucgacaaaauagaccgagaagacuuucuuagaaaacagcguacauuugacaacggaucaauaccucaccaaauacacuuacaagaaaugcaugcaauuauaagaagacaggcugaguucuacccauuucuagucgaaaaucaagauaaaauugagaaaauacuaaccuucaggauuccguacuacguagguccucuugcuagaggcaaaagugaguucgcauggcuaaaacguaaaagugaugagaaaauaagacccuggaacuucgaugaaaugguagacaaagaaacaagcgcagaaaacuucauaacaagaaugaccaauuaugaccaauaccuaccagaccaaaaaguacuaccuaaacauucgcuacuauacgaaaaauuugcgguauauaacgaacuaacuaaaguacgguacguaacagaacagggaaaaucuuucuucuucgaugccaacaugaaacaagaaauauuugauggaguauuuaaaguauacagaaaaguaacaaaagaaaaauuaauggauuuccuaggaaaagaauuugacgaauuucgaauaguugaccuaaugggacuagacaaagacaacaaaucuuucaaugcgagcuuaggaacauaucacgaucuaaagaaaauugucucaaaagauuuauuagauaaccccgaaaaugaagauauacuagaaaauguaguauuaacacucacuuuauucgaagauagggaaaugauuagaaaacgcuuggaaaaguauaaagacgucuuaacugaagaacaaaggaagaaacuagaaagaagacauuacacaggauggggacgacuaagcgcaaaauuaauuaacggaaucagaaauaaaaccaccagaaaaacaauuuuagauuaucuaauugacgauggaaccucaaauagaaauuucaugcaauuaauacaugaugauacuuuaaguuuuguugacgaaauaagacuagcacaaggaucaggagaagcagaagauuaccgaaccgaagugcaaaauuuggcugguucaccagcaaucaagaaaggaauuuuacaaucauuaaaaauuguagacgaauuaauaggcguaaugggauauaacccagaacaugucguagucgaaauggccagagaaaaccaauuuacaaaccagggaagaagaucaucacaacaacgauauaagaaaauagaaaaugccaucaaaaacuuagauucaaauuuaaacucuaaaauccuuaaagaauacccaacaaauaaccaagcacuucaaaaugaucgcuuauuuuuauauuacuuacaaaacggaaaagauauguacacugacgaagaacuagacaucgaccaacuaagucaauaugacauugaucauaucaucccgcaggcuuucauaaaagaugauucacucgacaacaaaguacugacaaaaucggcgaaaaaucgaggaaaaagugacgauguaccaucauuagaaaucguacauaagaagaaaaauuucuggaaacaacuauuagacucccaacuuauaucacaaagaaaauuugauaacuuaaccaaagcagaaagagggggacugaccaacgaagauaaagcgcgcuuuauacaacgacaauugguugaaacccgacaaauaaccaagcaugucgcuagaauacuagauacgagauuuaacacaaaauuagaugacgcgggaaacagaauaagagacccuaaaguuaauauuauaacacuuaagaguagccugguaucacaauuccgaaaggauuaucagcuauacaaagucagggaaaucaauaauuaucaucacgcacaugacgcauauuuaaaugcaguagucgcaacugcauuacuaaagaaauauccucaauuagcaccagaauuuguauauggugauuacccaaaauauaacaguuacaagucaagaaagagugcaacugaacgcguucuauucuauucaaauauaaugaauuucuucaaaagaguagucaaaucgagcaaaacugggacaguaaaaauaagaccaaucauagaagugaauaaagaaacaggcgaaaucguaugggacaagaaaagcgauuucagaacuguacgcaagguacuaagcuacccacaaguaaacguaguaaagaaaaccgaaguacaaaaccauggucucgaucgaggaaaacccaaaggcuucuacaacgcuaaccucucccccagaccaaaagaagggagcguagaaaacuuaguaccggcuaaacaauccuucgacaccaaaagauauggaggauaugcaggcauaaguaacucauaugcaguuuuaguuaacgguaucaucgaaaaaggaaagaagaaaagcaaagccgaagucacagaguuccaagguauuucaauucucgcaagaaaagauuucgagaaaaauccgaaacaauacuuacuaaauuugggauauaaagauauaaaaucaauaauuaaauugccaaaauacagcuuauuugaacuagaaaacggaagucgaagaaugcuagcaucaauuuugaguaccaauaacaaaagaggagaaauccacaaaggaaaugaaauguaucuaccagacaaauuugucacccuacucuaccacgcgaugagaguaaacagaacacuugaaccuggccauaagaaauauguugagacucaucggcaugucuucgacgaauuacuuacauauauccuagaauacaaugagaaaauagucggagcaaaagcaaacggaaaaagaaucguagaagcauacagcgcucgaaaagacacagauaaucuugaggagcuaugcaauucauucauuaaccuccuaaauuugacagcccuagguucagcaguagacuucgaguuccuaggcacuaaaauaccacgauacagagauuacacucccagcucauuauuaaaagccacccuaauacaucaaaguguuacuggcuuguaugaaacaagaauugaucuaucaaaacucggaggagauuga

SEQ ID NO: 9014 - RNA, 4146 nt, Artificial Sequence
  Cas9 variant
augaagaaaauaauaggucuagaucuaggaacuacaagcauaggcugggcuuacguacaugaggcagaaagugcacaagaaagaucugaaauagugagacuuggagccagaguaguaccuuuaacaaccgacgaacaagacgaauuuaagaaagggaaaucaaucacaaccaacgcagccagacucagcaaaaggucucuaagacgaaacgcugaccgguuucagcuaagacgagaugaacuagcgggagucaugaaggaagcaggauggauagaugaaacaacgguauuagccgaacagggaccaagaucgacauucgaaacauuaagacuaagagcaaaggcagcgucagaggaaguaacguuggccgaauuugcuaggaucuuauuacaaauaaaccgaaaaagaggauacaagucaaauaggaaaacugauggugaugaagagggagcauuaaucgaugguauggauguaucaaaacaauuaaaugccagcggacaaacuccgggagaauggguucuagcuagaaugcaagaaggaaaugcuguaauaccggcuuuuuauugcagugacuugucugaggaacuugaucgaauauggagaaaacaacaagcaucacaucaagcauggaugacagaagaauugcauacaguccuaaggcacgcagauggaaggucagcaauuaggcuaauggauaaagcaggggugguccccgacuccguuaauguaaaagaaagacgaagaguaauguacgaauggcgcgccgcagcagugagggacugucuaccagccgggcgaguagcagcugcauugaugcaaguaucgaaggaaauaggcagagccgacagcuaucuuggaagaauaggggauagaagcaaagaacuguacuuucacaggcaaacaguaggucaauaucucuggagacuaauaugugauaacccgaaccagagcuugaaaaacuuaguauucuaucgacaagacuaucaacacgaguucgaaacacucuggucaauacagacaaaauaccacgucgaacuuacugaagauuuaagaaaaagaguuggcagaaucauauucuuucaaagaccauuaaaaagcaagaaaggauuagugaauaggugcgaauugguacacuacuccguuugugaaaauaguggggacgacuuaacugaaaaaguagauguggggccaaaaguaugcccuaaaucaagccccuuauuucaagaguucaaaguauggcaaguguuaaauaauguagaaguaauacacccaucgacucaagaagcaagaagacuggaaauggaagaaaaggaauuacuagcaucagagcuauuguuucgagauagaaugaagaaaaucgauguguugaaauugcuauuuagcaauuggagagaucuagacuuaaacuacaaagaacuagaaggaaaccgaacuauggcugcauuuuauagaguauacgaacaaguaauagcacaaacaggacauggagacuacgauuucgcaaaaaugagagcagcaaagguaaaagaacucgcagaaggaguguucgcuggauuagguuuugaagugggguuauuaacuuucgacgcugaguuagauagcccugccuaugaacaacaaccuuguuacagacuauggcauuuacuuuacucauacgaaggugacaaaagcgcuacaggaaacaaauguuuacuuaagaaacuauguagacuuacaggaaugaaugcagaauugguaggucuauucaugcaaauacgguucagcggagauuacggguccuuaucuacgaaagcgaugcggcgaauacuucccuaucuaaaagcgggaaauacuuacgacguggcuugcgaauacgcaggauuuagacauuccgcuagaucauugacaagagaggagcuugcccagaaagaguauaaggauuacuuagaucucuuaccgcggaacuccuugaggaauccaguuguagagaaaaucuugaaucaaaugauucacgugguuaauggauugucgagcacauacgguaagccagacgaaauaaggguagaaauggcgagagagcuaaagaaaagugcuagagaaagggaagaaaugacaucagcaauaaguaaaacaaccaaagaaaaugcagaaaucacagcgauauugcaaagagacuucggacuuagauacguuuccagaaaugauauacuacgauauaaacuuuauugcgaauuacgaauaaaagggaauggauguaggacacuuuauagcaauacuuauauaaauccaaaugaacuauuuucaagagaguuugacaucgaacauauaauaccacaaaguagacucuuugacgacaguuucagcaauaaaacccuggaaaguagaacagcaaacuuagaaaaaggagauaggaccgcaugggacuauguaaacgaaaaauauggagcagaacgugcagaugaguauagagcacagguagaggcauuauacagagauggaacuauuucaaaagcaaaaagagacaaauuguuaaugccuggagacaaaauacccgaggacuuuauagacagagacauaagaaacacccaauauauagcgaagaaagcccuggaaauauuugaagacuuuguuccaaguguuguugcaacgucuggaaauguaaccgccagauugagagaagauuggggacucguagauguaaugaaagaacuaaauuggucuaaauacgaaucacaaggcaugguacauauagaauacgacagagauggucgaccaaucaggagaauuguagauuggacuaaaaggaacgaccauagacaucaugcaauggaugcacuagcaguagcuuucacuaaaagaucauauauccaguaucuuaaucauuugaacgcaaggaaagaagcaacaagcguugccuacgcaauucagcauaaagaaauggaguuggaugggaguaacagauggagauuuaaaugucccuucggugaucgaucagcauuuagaagggaagcgaaagcacaacuagaaagaauccuggugucaauaaaaucuaagaauaaaguucugaccccaagcguaaauagaacaaagaaaaggggaggguucaauaagaaaguggaauggacuccuagaggagcccuucacaacgaaacuguuuaugggagaauaagaagauacgauguaaaagaacuaagaguuggaucaucauuuacggcagaaguaaucggaaaaguagcugauagccgauacagggcagccuuaaugcacaggcuugccgaguucgguggagauccgaagaaagcauuuacaggcaaaaacagucuugagaaaaauccacuguauacagaugaagcccauacggcauguguaccaaguaguguuaaagucguaaguuucguugaaauuggaacaauacgaaaaggcguagacccaaaucuaaauguagacaaaguaguagacacucauaucaaaaauauauuacuagcuagacuaagcgcauauggaggggaugcuaaaaaggcuuuuucuaaccuugaugcagacccaauaugguuaaacaaagagaaagguauagcuauaaaacgaguuacaauuucugacgauucggagguaaggcccauccauguuaaaagagacaugagagguagacugguaugcgaugagcauggacgcccugugccaucugauuacgugcaauuaaggaacaaucaucauguagcgauuuuuagagacgcuaauggagaacuuaaagaaaggguuguaacauucuuugaagcaguggaacgaguaaggcaguugagaucagaaggacgggcuguagagguuauagacaaaaacuacaaaugcgaagaaggauggacauuuuuauucaguaugaaaauaaaugaauacuuugucuuucccgaugcagcauccggcuuugauccaagagaaauagacuuaacagauccagccaacuaugcguuaauaucuccacaucuauuuagaguacaaaaacuuaguagcaaagauuauuauuucaggcaucacuuagagacuacaguaaacgaugucaaacaauuaagagacaucacauggaagagaauaagcaguuuacaggaucuagcaggaaccguaaaaguuaggguaaaucauauuggacaaauaguugcgguaggagaauauuga

SEQ ID NO: 9015 - RNA, 4146 nt, Artificial Sequence
  Cas9 variant
auggugaaaaagaaauaugcaauagguauagacauaggaaccaauucaguaggguggucaauaguaacagacgauuacaaaguaccaaguaagaaaaugaaaguauucggaaacacagagaaaagauauaucaagaaaaaucuauuagggaccuuacuuuucgaugaaggaaauacugcugaaaaccgaagacuaaaaagaacagcuagacgaagauacacaagaagaagaaaccgcauucuauaucuacaagagauauucgcagaagaaaucaacaaaauagaugacagcuucuuccaacgacuagaugauagcuuuuuaauagucgaagacaaacaaggcucaaaacauccgauauucggaacuuuacaagaagaaaaagaauaccauaaacaauucccaacuauuuaucaucuucgaaaacaacuugcagacaguagccaaaaagcagauauucgguuaauauaccuugcccucgcacauauaauuaaauacagaggacauuuccucuuugaaggagaccucaaaucagaaaacaaagacguacagcaccuauucaaugacuucguggaaauguuugauaaaaccguagaaggaucauacuuaucugaaaaucucccaaauguugcagacguuuuagucgaaaaagucagcaaaagucgacgacuugaaaacauauuacacuauuuucccaaugagaagaaaaaugggcuauucgguaacuuuuuagcuuuggcacuagguuuacaaccaaauuucaaaacaaauuucgaacuugcugaagaugccaaaauacaauuuucaaaagaaacguaugaagaagauuuagaagaacuacuaggaaaaaucggcgaugacuaugcagacuuauuuauagccacaaaauccuuauaugacggaauacuucuugcuggaauacuaaguaccacugacucuacaacaaaagcaccacuaaguucuagcauggucaauagguacgaagaacaccaaaaagacuuagcacuacucaaaaacuuuauucaccaaaaucuuucagauaguuauaaagaagucuucaacgacaaacuaaaagaugguuacgcaggauauauagaaggcaaaacuacacaagaaaacuuuuauagauuuaucaagaaagcaauagagaaaauagaaggaucaaacuauuuuauagauaaaauagaccgagaagacuuccugagaaaacaacgaacauucgauaauggaucaauaccccaucaaauccaccuccaagaaaugcaugcuauaauaaggcgccaagcagaauuuuacccuuuccugguagaaaaccaagacaaaauagagaaaauauuaacuuuccgcaucccauacuacgucggcccauuagcacgcggaaaauccgaauuugcauggcuuaaucgaaaaagcgacgagaaaauacgacccuggaacuucgaugaaaugguugacaaagaaacuucagcagaaaacuucaucacacgaaugacuaacuacgaccaauacuuaccggaucaaaaaguacuuccaaaacauagccuguuauaugaaaaauucgccguguauaaugaacucacaaaaguaagguauguuacagaacagggaaaaucauuuuucuucgaugcaaacaugaaacaagaaaucuuugaccgcacuuucaaaguguacagaaaaguaacaaaagaaaaacuaauggauuuucuuagcaaagaauuugacgaauuuagaauaguagacuuauuaggacuagacaaagauaacaaauccuucaacgcaucauuagguacauaccaugaucucaagaaaauaguuagugaagacuuucuagauaacucugaaaacgaagauauacuugaaaacgucguacuaacauuaacucuauuugaagacagagaaaugauaaggaaaaggcuugaaaaauauaaagacguacuaacagaagaacaacgcaagaaacuagaaagacgacacuacacgggauggggacgacuaucagcaaaauugaucaacggcauacgagauaaaguuacccguaaaaccauccuggacuaucucaucgacgauggaacaagcaaccguaacuucaugcaacuaauuaacgacgacacuuuaaguuuuguagaugaaauucgccuagcacagggcagcggaaaagccgaagauuacagagcggaaguacaaaaucucgcuggcuccccagcaauuaagaaaggaauuuuacagucauuaaaaaucguagaugaacuaauagaagugaugggauaugacccagaacacauaguuguagaaauggcaagagaaaaccaguuuaccaaccaaggaagacgaaauucucaacagagauacaagaaaauagaaaacgcaaucaaaaauuuagauaguaaucuaaauaguaaaauacuaaaagaauacccgacaaauaaccaagcacuucaaaaugaucgauuauuucuauauuacuuacaaaauggaaaagauauguauacagacgaagaacuagauauagaucaacuaagucaauacgauauugaucacauuauaccacaagcauuuauuaaagaugauagcuuagacaauaaaguacuuacaaaauccgccaaaaaucgagguaaaucagacgacguuccaucacucgaaauaguauauaaaaagaaaaacuuuuggcaacaauuauuggacagucaauuaaucagucaaaggaaauucgacaacuugacaaaagccgagcgaggcggauuaacuaacgaggauaaagcgagauuuauacaaagacaauuagucgaaaccaggcaaauaacuaaacacguugcuagaauacuagauacuagguucaacacaaaauuagacgaagcaggaaacaggaucagagacccuaaagucaacauuauaauucuaaaaucaaaccuuguaagucaauuccgaaaagacuaccaacuauauaaagugcgugagauaaacaacuaccaccaugcacacgaugccuaccuaaaugcaguaguggcuacagcguuacucaagaaauacccccaacuugcuccggaauuuguuuauggagaauacccuaccuacaauucauacaauucgagaaaaagugcaaccgaaaaagucuuauuuuauuccaacauaaugaacuuuuucaaaagaauaguuguacauucaaaaacaggcgaaguaagaaucagaccuguaauagaagugaacaaagaaacaggagaaauuguuugggauaagaaaaguaacuuuagaacaguaagaaaaguccuaucauauccccaaguaaacgucgucaagaaaacagaaguccaaaaucacggauuagauagagguaaaccaaaagguuucuauaaugcaaacuuaagcccccgaccaaaagaagguagcgucgaaaaccugguaccagcaaaacaauccuucgacaccaaacgcuauggaggguaugccggaauaucaaacucguaugcuguccuagugaauggaaucauagaaaaaggcaaaaagaaaucaaaggcugaaguaacagaguuccaaggaaucaguauucuagcccgaaaagacuuugacaaaaacccaaaacaauacuuacucaauuuaggauauaaagacauaaaauccauuauuaaauuacccaaguauaguuuauucgagcuagagaaugguucaaggcggaugcucgcuagcauacuuucaacgaauaacaaacgcggagaaauucacaaaggcaacgaaauguaccucccugacaaauucguaaccuuacucuaccaugcgaugcguguuaauaggacacuagaaccaggucauaagaaauacguggaggcccacagacauguguucgaugaauuacuuacauauauacucgaguacaaugagaaaauuguaggugccaaagcaaaugguaaaaggaucguugaagccuacuccgcaagaaaagacacagacaaucucgaagaacucugcaacucauuuauuaaucuacuaaauuuaacagcuuugggaagugccguagauuuugaauuucuaggcacaaaaaucccucgcuauagagauuauacaccuucgucacuguuaaaagcuacacugauacaccaauccguaacaggcuuauaugaaacaaggauugaucuauccaaauuaggaggagacuga

SEQ ID NO: 9016 - RNA, 4146 nt, Artificial Sequence
  Cas9 variant
augguaaagaagaaauaugcgauaggcaucgacauaggaacaaauagcguaggauggagugugguaacagaugacuacaaaguaccaagcaagaaaaugaaaguauucggaaauacagaaaaacgcuauauaaagaaaaauuuguuagggacuuuacuuuucgacgaagguaauacagcagaaaaucgacgacuaaaacgaacagcaagaagaagguacacacgaaggcggaauaggauacuauaucuacaagaaauuuucgcagaagaaauaaacaaaauugaugauagcuuuuuccaaagacuggacgacagcuuucuuauaguugaagauaaacaaggaucaaaacacccaauauucggaacccuucaagaagaaaaagaguaccacaaacaauuuccgacuauauaccauuuaagaaaacaauuagcggacucuucacaaaaagcagacauaagauuaaucuaccuggccuuagcccauauaauaaaauaucgcggacauuucuuauuugaaggagaccuaaaaagugacaauaaagacgugcaacacuuauuuaacgaauuuguagaaauguucgauaaaacugucgaaggaucauaccuauccgaaaacauaccugacguagcagacauauuaguggaaaaaguaucaaaaucucgucgacuggaaaauguacuacaauauuuuccgaaugagaagaaaaauggacuacuggguaauuucuuauccuuagcacuaggucuucagccuaauuuuaaaaccaacuucgaacuagcagaagaugcuaaaauacaauucucuaaagaaacauaugaagaagaucuugaagaacuauuaggcaaaauaggcgacgacuacgcagauuuauucauugcaacaaaaucgcuauacgacggaaucuugcuagccgguauucuuagcacuaccgauucgacgacaaaagcaccucuaucaucuagcauggucaacagguaugaagaacaucaaaaagaccuagcccuauuaaaagacuucaucaggcagaaucuaucagacagcuauaaagaaguuuuuaacgaugcccuaaaagauggguacgcaggauacauagaaggcaaaacaacacaagaagacuuuuauaaauuugucaagaaaacuauagagaaaauagaaggaagugauuauuucauugauaaaauugauagagaagauuucuuacggaaacaaagaacauucgauaauggaagcaucccacaucaaauccaucuuaaagaaaugcaggcuaucauuauuagacaagcaaaauucuauccauuuuuagaagaaaaccaggacaaaauugagaaaauccugacauuucguauaccguacuacguaggaccuuuggcccgaggcaacucagaauuugcaugguuaaacagaaaaagugacgagaaaauacgcccuuggaauuucgacgaaauuguugauaaagaaaccucugcggaaaauuucaucacuagaaugacgaauuaugaccaauacuuaccagaucaaaaagucuuaccgaaacauucacuacuauacgaaaaauuugcuguauacaacgaauuaacuaaagucagauacguaacagaacaagguaaaucuuucuucuucgacgcuaauaugaaacaggaaauauucgauggaguguuuaaagucuauagaaaagugacaaaagaaaaacucauggacuuucuagggaaagaauuugacgaguuccgaauaguagauuuacuaggacuagauaaagacaacaaaucauucaaugcaaguuuaggcacauaccacgauuuaaagaaaauaguuagcaaagacuuacucgacaacccagaaaacgaagacauucucgaaaauguaguauuaacucuaacucuauuugaagacagagaaaugauaagaaaaaggcucgaaaaauacaaagaaguacuuacagaagaacagagaaagaaacuggaacguaggcacuacacaggaugggguaggcuauccgcaaaauugauaaacggaauuagagacaaaguaaccagaaaaacaauccuagauuacuuaauagaugauggcacgagcaauagaaacuuuaugcaacuaauaaacgacgauaccuugaguuucguagacgaaauaagguuagcccaaggaagcggcgaagcagaagacuauagagcggaaguacaaaaucuugcagguucuccagccaucaagaaaggcauauuacagucauuaaaaauaguagaugaauuaauagaaguuaugggauaugaaccugaacacauaguagucgaaauggcaagagaaaaucaauucacaaaccaaggacgcagaaacagucaacagcguuacaagaaaauagaaaaugccauuaaaaaucuggacucaaaucugaacucaaaaauucuaaaggaauacccaacaaacaaucaagcacuucaaaacgaccgauuauuucuauauuaccuacaaaacggaaaagauauguauacagacgaagaacuagacauagaucaacuaagccaauacgacauagaccacauuauaccacaagcguucaucaaagacgauucuuuagauaacaaaguucuaacaaaaucggccaaaaaucgaggaaaaagcgaugacgucccuucgcuagaaauaguauauaagaaaaagagcuucuggaaacaacuacuagacagccagcuaaucucacaacguaaauuugacaacuugacaaaagcagaacgcggcggccuaacaaaugaagacaaagcacguuuuauucaaaggcaacuuguugaaacaagacaaaucacgaaacacguggcucgaauguuagauacuagauuuaacaccaaacuggacgaagcuggaaacagaauacgugacccaaaaguaaacauaauaacacuaaaaucaaaucuugucagccaauucagaaaagacuaccaauuauauaaaguaagagaaauaaacaacuaccaccacgcccacgaugcauauuuaaacgcggugguagcaacagcgcuucucaagaaauauccccaguuagcuccagaauuuguauauggugaauacccaaccuacaacuccuacaacucuagaaaaucugcaacagaaaaaguauuauuuuacucaaacauaaugaacuuuuucaaaagaauuguaguccacagcaaaaccggcgaaguacggauaagaccaguaaucgaaguaaauaaagaaacaggagaaauuguaugggauaagaaaucagacuucagaacagugcggaaaguacugaguuacccccagguaaaugucguuaagaaaacagaaguccaaaaucacgguuuagauagggguaaacauaaaggcuuuuacaacgcaaaccuuucaccgagaccuaaagaaggaucaguggaaaauuuagugccagcaaagcaaaguuuugauacaaagagauauggaggauacgcaggaauaucuaacagcuacgcaguccuaguaaacggaaucauagaaaaaggcaagaagaaaaguaaagcugaaguaacugaguuccaaggcaucucaauacucgcaagaaaagacuuugauaaaaauccgaaacaauacuuacuaaaucuaggauacaaagacaucaaaagcauaauaaaauuaccaaaauauucauuguucgaguuagaaaauggaagucguagaaugcuagcaucuauauuaucaacaaacaauaaacgaggagagauccauaaaggcaaugaaauguaccucccagacaaguuuguuacauuauuauaccacgcgaugcgaguuaauagaacauuagaaccaggccauaagaaauauguagaaacccaccgacacgucuuugaugaauugcuaauauacauacuugaauacaacgagaaaauugucggagccaaggcaaacgguaaaagaauagucgaagcguauagcgcuaggaaagacacagauaaccuagaagaguuaugcaauuccuuuauuaaucuauugaacuuaaccgcucuugguuccgcaguagacuucgaguuccuagguacaaaaauaccacgcuaucgagacuacacaccaagcucacuacuuaaggccacacucauacaucaaaguguuacagggcuuuaugaaacaagaauagacuuaucgaaauuaggcggugauuga

SEQ ID NO: 9017 - RNA, 4146 nt, Artificial Sequence
  Cas9 variant
augguuaaaaagaaauacgcaauaggaauagauauuggaaccaauuccguaggauggucaguagugaccgacgauuacaaagucccgagcaagaaaaugaaaguauucggcaauacugagaaaagauauaucaagaaaaaucuacucgguacacuacuuuucgacgaaggaaacacagcagaaaaccgacgacuaaaacgaacagccagacgaagauauacuaggcgacgaaaccgcauucucuacuuacaagaaauauucgcagaagaaaucaauaaaauagaugacagcuucuuccaaagacuagaugauucguuccuaauaguagaagauaagcaaggcuccaagcacccgauauucggcacccuacaagaagaaaaagaguaucacaaacaauucccaacaauauaucacuuaagaaaacaacuggcagacucgucacaaaaagcagacauaagauuaauauaccuagcacuagcacauauaaucaaauaccgaggacauuuccuauucgaaggagaccuaaaaagcgaaaacaaagacguacaacauuuguucaaugauuucguagaaauguuugauaaaacgguugaagguucauaucuaagcgaaaacuuaccaaaugucgcggacguccuaguggaaaaagucucaaaaucccgacaccuagaaaacauacuacauuauuuuccaaaugagaagaaaaauggacuauucggaaauuuucuagcucuagccuuaggauugcaacccaacuucaaaacaaauuucgaacuugcagaagacgcaaaaauacaauuuucuaaagaaacguaugaagaagaucuagaagaauuguuagguaaaauaggugacgauuacgcagaucuguucauugcaaccaaaagccucuaugacggcauucuauuagcaggcauacucucaacuacaaauucaaccacaaaagcaccacuauccaguagcaugguuaaccgauaugaagaacaccaaaaagaucuugcccuccucaaaaacuuuauccaucaaaauuuaagugacagcuacaaagaagucuuuaacgauaaacuaaaagacggauaugccggguacauugaaggaaaaacaacacaggaaaacuuuuacagauuuaucaagaaagccaucgagaaaauagaugggucuaauuacuuuauagagaaaauagaaagagaagacuucuuaaggaaacaacguaccuuugauaauggaagcauuccacaccaaauucaccuacaagaaaugcaagcaauaauaagaagacaagcaaaauuuuacccauuucuagaagaaaaccaagauaaaaucgagaaaauacuaacauuuagaaucccauauuaugucggccccuuagcccgcggaaaaucugaauuugcauggcuaaaccgaaaaagugacgagaaaauacggcccuggaauuuugaugaaaugguagauaaagaaacuucagccaaaaacuuuaucacacgaaugacuaauuacgaucaauacuuaccggaucagaaaguucuccccaaacacucccuccuauaugaaaaauucgcaguguauaacgaacuaacaaaagucagauacguuacagaacaagguaaaucauuuuucuuugaugcaaauaugaaacaagaaauauuugacggaguauucaaaguauacaggaaagucacaaaagaaaaauuaauggauuuccuagguaaagaguucgacgaguucagaauaguagaccuguuaggauuagauaaagaaaauaaaucauucaacgcaaguuuaggcaccuaccacgacuuaaagaaaauaguaucuaaagacuuucuagauaauucagaaaaugaagacauccuagaaaaugucguguuaacauuaacauuguuugaagacagggaaaugauacguaaaagauuagaaaaauacaaagauauucucacagaagaacaaaggaagaaauuagaaaggagacauuauaccggguggggaagacuaucugcaaaacuuauaaauggaauuagagacaaaguuaccagaaaaacaauucuagauuaucugaucgacgacggaaccucuaauuguaauuucaugcaacucaucaacgacgauacacucagcuucguagacgaaauccgccuagcccaaggaaguggugaagcagaagauuaccgcgcagaaguacagaaccuugcagggagcccagcaaucaagaaaggaauacuccagagcuuaaaaauuguagaugaacucauagaaguaaugggauaugauccagaacauauuguuguagaaauggcaagagaaaaccaguucacaaaccagggcagaagaaacagccaacaacgauacaagaaaauagaaaacgcaaucaaaaauuuagauagcaaccucaacucaaaaauucuaaaagaauauccaacgaauaaccaagcacuucaaaaugauagauuauuucuauacuaccuucaaaacggaaaagacauguauacagacgaagaacuagauauagaccaauuaucacaauaugauauagaucacaucauaccccaagcauucauaaaagaugauucgcuugauaacaaaguauuaacgaaaagcgccaaaaauagagguaaaagugacgacguaccuucucuugaaauaguauacaagaagaaaucuuuuuggaaacaacugcuagacagucaauuaaucagccaaagaaaauuugacaaucuuacaaaagcagaaagggguggucucacaaaugaggacaaagcacgauuuauacaaaggcaacuuguagaaacuagacaaauuacuaaacauguggccaggauguuagacacuagauucaacacuaaauuagaugaagcuggaaauagaauuagagauccuaaaguaaacaucauaacacuaaaaucaaacuuaguaucacaauuucgcaaagauuaucaguuauauaaagucagagaaauaaacaacuaucaccaugcucaugaugcauaucuaaacgcaguuguugccaccgcacucuuaaagaaauacccucaauuagcuccggaguucguguacggagaauauccuacauauaauuccuacaacuccagaaaaagcgccacagaaaaaguacuuuucuauucaaauauaaugaauuucuuuaaacgaauaguaguucacagcaaaacuggugaaguccgaauccgaccagucauagaagugaauaaagaaacaggcgaaauagucugggauaagaaaagugacuuuagaacaguacgaaaagugcuaaguuauccccaaguaaacguagucaagaaaacagaagugcagaaccacggacuagacaggggaaaaccaaaaggauuuuauaacgcuaaucuaucaccacgaccaaaagaagguucagucgaaaaccuagucccagcaaaacaaucguuugauacaaaacgauacggaggauaugccggaauaucuaauucauaugcaguccuaguaaauggcauuaucgagaaagguaagaagaaaucaaaagcagaagucaccgaguuccaaggaauaaguauacuugcaagaaaagauuucgauaaaaaucccaaacaauaucuauuaaaccuaggcuacaaagacaucaaaaguaucauuaaauuaccuaaauacuccuuauuugaauuagaaaacggaagucguagaaugcuagcuaguauacuaaguacaaauaauaaacgaggagaaauacacaaaggaaacgaaauguaucuacccgauaaauucguaacacuucucuaccacgcuaugcgagucaauagaacgcuagaaccaggccacaagaaauauguugaaacucauagacacguauuugacgaauuguuaauuuacauacuugaauauaaugagaaaauugucggagccaaagcgaacggaaaaagaaucguagaagccuauucagcaagaaaagauacagauaaccuagaagaauuaugcaacucuuucauaaaucuacuaaaucucaccgcauuaggaucagcagucgauuucgaauuucuuggaacaaaaauaccacgauaccgagauuacacaccaagcucacuacuuaaagcaacucucauccaccaaucaguuacaggauuauaugaaacuagaaucgaucucaguaaacuagggggcgacuga

SEQ ID NO: 9018 - RNA, 4149 nt, Artificial Sequence
  Cas9 variant
augaagaaaauaguaaacuacaaucucggcuuagauauaggaacaagcagcauaggauaugccgcaauugacgaucaaggacgaccaguacgucaucaaaacaaaaccgugaugggaguuagacucuuuaaagaagggaaaacggcugaaucaacaagaauauuuagaggaacccgaagaagacucucacacaggcacuggagacuaggcuaucuagacagaauauuugauaaugaaauugcuaaaguugaugaaaacuucuuaccaagacuaaaagccaguaaaagagcacgcagcgaugaaaaacgauccuucaggggaagccuuuuauuccccgaaacaggagaugaugcuuacuaccaaaaauauccuaccauauaccaccuacgauacgcacuuauaacccaaaagaaacaguuugacauacgacuaauuuaccuagcacuacaccacaugauuaaauauagaggaaacuuccuagacacaacaccuguuucagcuuucaacauccaugacaucgaccuaacagaucaauucgccucacuaaaugacuguuaucaauuacucgacauggauuucgaauuucaauucgaccuaaacaacauagaacaaguacagaaauuacuauuagacgaaacauuaucaaaaacuaaacgacaggcagcuguuucaaagguauuagugaugucuacaggcaauaaggcuuucgacgaccaacaaaauggaauagccagugaauuuauaaaagcccuacuaggaggaccauuugaucuaucaaaaauucuaaaccuuagcguagcagauguuaaaucauggaaguuacacaugacagacaaggauguagacgauaccuuaaacucccucguugaagaauuggaugagaaucacaagcagauugucaauuuacuacaaaugauuuauucacaaguaaugaugcuaggccuacuaaauggucaacaaaguaucucugccucaaugauagaaagauaugaugaucacgcgaaacauugggcggcauuaaagaaacuucuaccagcauuaggggaacaagaacaauccacaaucauacaugcauacacagccuauacuggucauucccggacuaaacaacuuucccgagcagaguucuacacaaaaguaaauagcauccucaagaaacacgaaaauauagcagaagccaccggccuaauagaacuuaucgacagaaacgaguucaugccgaaacagagggacgccguuaacggcguuauuccgcaucagcuccaccaaagagaauuacaacucaucauccaaaaccaacaaaaauauuaucccuuucuggcagccaaggcuuauccagaugcugaugaaaccaugaucgaacaauuacucuccuuccgaguccccuauuacgcaggaccacucguugaucgagacuucauaaaugaaagcuccgaccaggagcaagcaaugcaaaacaccaaauuuaguugguugaaacgacgcgaagcuggggaaauaacaccauggaacuucgaacaaaaaguagacgugcaggaaacagcaaacagauucauaaaacgccuaacaacuaaagacaccuacuugaugaccgaagacguauuaccaaaagaaucccuaaucuaucaaagauuugaaguauuaaaugaauuaaacgcgaucaggauaaacgaccgaaggcuuaccgccgaaaacaaacaacuagccuuucaacaacucuucauggcgggcaacacuaaaaacguaucaaucaagaaauuccgcaacuucguguucgauucucucaaauucccggaaaaaguuaaaauuacaggauuugcaggacaacacaacuuccuagcaaaacuuucaacauaucacgacuucaagaaaauauuuggagaaagaguagaccacacugacuuacaaccugacuuugagcgaauaguagaaugguguacaauauucgaagauagacacauuuauagagaaaaacuuaaagagauccaaugguugagucaaagcgaaaucgaccagcucguauuaauaagaaaucaugguugggggcguuuaaguaaacgauuauuaacaggaauccgagacucagauggcagaacaguuauggaccaacuaugguucggaacggacaauuucaugagaaucaucucccagucugauuuugcugcagccaucgcuaacgaaaacaggacacagcuaaaccaacauggacuagaagacgucuuagauuccgcauuuaugaguccacaaaauaagaaagcaauacgacaaguacuaaaagucguagaugauauagaacaaacauuaggaugcccaccaaagaaagucaugaucgaguucacaagaucaccagacaaaaagaaacaacgcaccgugaccagacuagaaaaaguucaacaggcuuacaaagcaguagccgaucaauuggccggacaaucaauaguauccgaacuagaucaauacgcuaauacucauuccaaacuauccgacacguauuauuuauauuuuaugcaacuagggcgagaccucuacucuggcaaaccaaucgauaucgauucacccaugcucgacgaugaccacauacuaccccgugcauucaugaaagacaauucauuggauaaccgagcacuaacagaaaaaccaauaaacaauaccaaagcggccaaauucccgucgaaaguuuucggacaacaaaaagaaguaacagacuucuggaaauuauuaagaagaugcggauugaugucaaacauaaaagaaaaacaccuuuacuuagacccugauaacguagauaaauggacgcgcagaggauuuauacaccgacaauuaguagaaacaucacaaguaauaaaaauuguagccaacauucucaaugauagauaccaacaaucacaaaccgaagucuuagaagugccagcaagacucggaacugaacuuagagaaugcuucggaugguacaaaguaagagaaguaaaugacuaccaucacguuuuugaugcauacuuggcagcguuuauaggcaauuauuuauaucguagauaucccaaacuacaaccuuacuucguauacggcaacuuugcagaacuaaauaaagcacaacucaaaaacauuaagagcuucaauuuccuauauaacauaacagacaacaaacgcguagucaaagauauagaaacaggacaaacccuaugggacgaccaaauccggcagcagauucaacacaucuacgaauacaaauauaugcuuacaucacaugaggcauuuacacaacacaaagaguuauacggccagaccauauacccaagacgagaguucaaaccugguacguugaaagcaauuaaacaagaucaaccacaagaacuuuaugguggauacaaaaaccuuacugccgcauacaugugcauaguaaaaauacaagcaagaaaacggagagcagcugaauauagaguaguaagagucgcaacagagucacuaagugcgcuacaacaagccaaaagacuaggaguacaagcauaugaacgauguuuacgucaagagcuagucagaaacaaugaaauacuacgcacgaaugcagacccuaacagcgccccaagagaguucgaaguccuacucgauagaguucuaugccaucaaaugauaauaagugacggacaaaaauacuuacuaggaucacaugcuuauaaaauaaacugcaugcaacucguacuuucaaauaauucuaugaaaauacugucuaccucuauuguaaaauugaaacaaaugacgaacgaaccacuuguccaaguauaucgagaaauauuagauguaguaaacaaauauuucacccuuuaugauguaaauucauucagagaaaacuugaaccaauucuuugauaaauuuagaacuuugccuaucacaaacgaauacgaaucaagcaaaucagguaagaaacucauacacagaggacaauuagaaacacuuaccuuaauccuaaggggacuacacgccaacagcgacaaaguacaauacggagaucagucaacacugcuaggugguuuccaaacaaaagacggaauaaaacuaagcaaagacuccguaauucaauauacauccccggccggucuuaauguuagaacaguaaaauuaagggacuuggaacagaaggaagcccaaaaauga

SEQ ID NO: 9019 - RNA, 4149 nt, Artificial Sequence
  Cas9 variant
augguagacgagaaaauauuuuggggccuagacauaggaaccgauagcguuggaugggcgguuacaaacucugaauauaaacuaaaaaaauauaaaaacaaccuuauguggggcguccacuuguuugaugaagcaaaacaaagugcggaaagaagaaguuuccguacugcacgcagacgucuagaccgcagaaagcaaagaauuauccuacuacaagaauuuuuuguuagagcaguaugcgaaaaagaugaaaauuuuuucagaagacugaaagaaucagcuuuauuaccggaagaugccgaacauagaacaaauaauaucuucuucgaugauccagacuacacagauaaagacuauuucgaagaauacccgaccauacaucacuuaaucugcgaacuaauggaaucaaaagaaccacacgacguacgauuaguauaucucgcaugcguauaucuacuagcgcaccgaggucauuuccuccuacccguaucagaagaugauauuaguaaaguuacagaauucgaaccuuuauacgaaucuuucuauaaagcucuagaagaaaagcuagaugacgaaccaccauucgauagaucggcagacgacuuugccgaaauucuaaaaagucauaagacaguaucagcaaaaaacaaagauuucgauaagcuauuauucggaggaaaaguaaaaaccuacgacaacgaaaauauaucauacagugcccuuauaaaguuacucucagguggaacagaaaaacuauccaaguucuucgcuaacgaagaauacacugacuuagaaaaagacuccguaugcguacgaaaugcugacuucggagacacucuggaaaugcuagaaggucaaauagacgaacuagauuucgcauuacuaaaaagcguaaaguccuuauacgauuggucacuacuaguugacauucuagaaggaaaaucccuuauaucggaagcaaaaaaagauaaauacgacgaacaugguuaugauuuagaugcauuaaaguaucuuuuuagagaauauuuaacuaaagaugauuacaacgaaauguucaaagaagucucaggaaagcaaaacuacgccucauacguuuacaacgcaucuagcgacaagacaagagacucaaaauacaaaaaauguucacaaaaagauuucugcaaauucacaaaaaaauuccuaagcaaaaucaaaccaaacgaaaaagacaaacccugccuggauaaacuuuuagaaaaaugugaacaaaauuccuuaugcccaaaacaaguaacuaccgacaacagagucauuccauaccaacuauacuacguagaguuaaaaaagauauuagaaaacgcaugcggauacuuaccuuuucuaaaugaaagagaugaauacggaacgguugcagauaaaauauuaagcauuaugaaguuuagaguacccuauuacgugggaccacuaguugacucuaagaaaucgccuaaugcuuggcugguacgaaaacuagacgguaaaauaacaccguggaacuucacagacauggugaaugaagacgaaucagagaacgcauuuauacgaagaaugacgugcaaaugcacauauguagcugggcaagauguacuacccaaguauucgcuucuauauucaaaguucaguguuuuaaacgaaauaaacaacaucaaacuuaacggcgaaccaauuagcguacaaacaaaacaagaaauauacacagaauuauuugaaagaaacaagucaagaguaucaaaaaagaaaauucgcgauugccuaauuucccaugguuaugcugccgacagcgaugaaguuacaggcauugaugacauagcuaaaucagcccugagaaguuaucacgacuuuaaaaagaugcuaaguaacggaauccuaacggaacaacaaguugaagaaauaauugaacauauuacaguaaccaccgauaauauacgcuuaaaaaaaugguuaaaaacccaauucccaaugcuagcugaugaggacguaaaguauauaacaaaacuaaaauauaaagauuauggaagacuaucaagaugcuuccuagaggacgucuuaccaguggauacaaaaaccggagaagcugaauccgauaagaacauaaucacgaugcuaugggagacaaaugaaaacauaaugcaacucuuaucaucaaaauauagauacucagagaauaucgaacacaugaauagacaauacuaugcacuacccgaaaaccauaaaucuaugucagaacgcuugaaagacauguauguuccaacugcuguccgaagggcaguaacgcguacguucgauauaguuaaagaacuaaaaaagauacaaggacgagacccagauaaaauauuuauagaaauggcgcgaggaacuggagagacaccaaaaggaaaaagaacuaacagcagaaaagaucagauccuagaacacuggcauggacuggauaacaaagacaucaaugaucugaaaaaaucaggaauaugggaacacuuagauacuauugacgacgcaaaacuaagaucggacaaauauuuccuauauuucaugcaauuaggucgaugcauguauaccgaaaaacccaucccuuuugaagaaguagaaaacgaacacaaauggaacauugaccacaucuggccucaagcaaagauuaaagacgacucauuggauaauaaaguuuuaguaucaucuaaugaaaauggaaaaaaaagcgacagcuauccaauuagcgaugauauacgacauuccauggcaggacuuuggcauagcuuauacaagaaaggacuaauauccgaaaaaaaauaccagcguuuaaccagauccacaccguucacagaugaugaacuuuccggauuuaucgcuagacaacuuguagaaacaagacagagcaccaaagcaguagccacccuuuuaaaagaacaauuuccaaacacagaaauagucuacguuaaagcaggccuagugagcgauuuccgacaagaaaugggcaugcuaaaaugcagagaaguuaaugauuuacaccaugccaaagaugcauaccuuaacauaguacugggcaacguauauaauacacgauuuaccaaagacccccucaacuucgugaaaaauaacgaaaaauacucaauaaaaauuuuccagaaaaacagugacggaaaaaaaacuggaguaauaacacgcaagguugaaagaggcggagaaguugcaugggacccggaaacaucauucgcaaucguccguaagaugaugucuaaaaacaguauaagauauguaagauacgcauacaugcguaaaaguggucaaaauggagguuucuucgaucagaaucccuuaagaaaagguaaaggcaugguaucuaucaaacauaaccuuucaauagaaaaauaugguggcuacgauaaugcaacaaucuccuucuuuagucugguaaguauaaaagauuuuggcguaauauuacuagcaguugaacuauuaagcgccaauaaauuccuaaagaauauaagugaagcaaaagaauacgccgcagauaaacuaagcaaagaacuaaacguaaaaauaguuccaaaugacguagcauuuccucuaaauaauagauacaacguaguuaaaaucaacgcaguacuugaacuagauggcuacagagucaugauugccgccaaacagaacaguucaaucaaauucgucaguaaugaaucauuaauauuaaguagucaacacauggcguacguaaaaaaaauuaccaaauucauagagaaaagaaaacaagacaaagucugcaugauuaaugccuuuagcggaauaaguauagaagacaauaucgaauuauacgacguuuuagugucaaaauguaacauuaaaccauuuaauauaauguaugaaaacuugggaaucaaauuaagugacaauagagauaacuuuauuaaaaaaaguguagaaaaucaaguucuuauucuaucagaaaugguuagauuauucaaaacaggaaggaaagcaggaguaaacuuagaagaagucggaggccgaaagaauucuggaguaaagacccucaacaccugccucuacaaaguaaaagauuacagcaauaucuucuuagucgaucaaucuccaacagguuuaauagaacauaaaucaccaaacuuauuggaccuauga

SEQ ID NO: 9020 - RNA, 4155 nt, Artificial Sequence
  Cas9 variant
augaauaaaccauauucaaucggcuuagacaucgggacaaacuccgugggauggagcauuauaacggacgauuauaagguaccagcaaagaaaaugcgcguacucggaaauacugacaaggaauacauuaagaaaaauuugauaggagcauuguuguuugacggagggaacaccgcugcagaucgacgauuaaaaagaaccgcaagaaggagauauaccaggcgcagaaauaggauucuauauuuacaagaaauauuugcagaagaaaugucaaaaguagacgacucguucuuccacagacuagaagauucauucuuagucgaagaagauaaaagaggaucgaaauaccccauauucgccacauuacaagaagaaaaagauuaccaugaaaaauuuaguacaauauaucaccuuagaaaagaacucgccgauaagaaagaaaaagcagaccuaagauugauauacauagcacuagcucacauuauuaaauucagaggacacuuuuuaauagaagaugauagcuucgauguucgaaauacagacauaucaaaacaauaccaagacuuccuugaaaucuucaauaccaccuuugaaaacaaugaccuacucucacaaaacguagauguagaagcaauacuaacagauaaaauuucaaaaagugcaaagaaagaccggauuuuggcacaguaucccaaccaaaaaucaacaggaauauuugcagaauuucuuaaauuaauagucggaaaucaagcugacuuuaagaaauacuucaauuuagaagacaaaacaccccuacaauuugcuaaagauucuuaugacgaagaucuugaaaaucuucuagggcaaauaggagaugaauuugcagauuuguucucagcggccaagaaauuauacgauuccguacuauuaucggguauacuaaccguaauagaucucucaaccaaagcaccacuuucagcauccaugauccaacgauaugaugaacaucgcgaagauuuaaaacaacuaaaacaauuugucaaagccucacuucccgagaaauaccaagaaauauuugcugauucaucaaaagauggauacgcuggauauauugaaggaaaaaccaaccaagaagcauuuuauaaauaccuaucuaaacucuuaaccaaacaagaagacagcgaaaauuucuuagagaaaaucaaaaaugaagacuuuuugagaaaacaacgcacauucgacaauggaagcauaccacaccaaguucacuugacagaauuaaaagcaauaauaagacgucagucagaauacuaccccuucuuaaaagaaaaccaagaucgcauugagaaaauauuaacuuucagaauaccuuauuacaucggcccacuggcuagagaaaaaucagauuuugcguggaugacaagaaaaacagacgacagcauacggccuuggaacuuugaagaucuaguagacaaagaaaaaucagcggaagcauucauacauagaaugacaaauaaugacuuuuaccuaccugaagaaaaagugcuaccuaaacauagccuaauauaugaaaaauucacgguauauaaugaacuuacaaaaguuagauauaaaaaugaacaaggagaaacauauuucuuugauaguaauauuaaacaagaaauauuugauggcguuuuuaaagaacauagaaaagucuccaaaaagaaacuucucgacuucuuagcaaaagaauaugaagaguuccgaauuguagacgucauaggccuggacaaagagaacaaagcguucaacgcaagccuaggaaccuaccaugauuuagagaaaauacuggacaaagacuuucuugauaauccagauaacgagucaauauuagaagauauaguacagacacuaacguuauucgaagaucgugaaaugauaaagaaaaggcucgaaaauuauaaagacuuauucacagaaucacaacuuaagaaauuauauagacgacacuacacagguuggggcagacuaucggcgaaacuaauaaauggaauaagagacaaagaaucacagaaaacaaucuuagacuaucucauugaugacggccgaaguaacagaaauuuuaugcaacuaauuaaugaugauggacggucaaauagaaauuuuaugcaacuaauaaaugaugauggacucucauuuaaaaguauaauaaguaaagcacaagcagguucacacuccgacaaucuaaaagaaguaguaggggaacucgcuggaucaccagcgauaaagaaaggaauauuacaauccuuaaaaauagucgaugagcuaguaaaaguaauggguuacgaaccugaacaaauuguuguagaaauggcaagagaaaaucaaaccaccaaccaaggacgaagaaauagcagacaacgcuacaaacuacuugaugauggagucaaaaacuuggccucagaucuuaauggaaauauacuaaaagaauacccgacagauaaucaggcauuacaaaacgaaagauuauuccuauauuaccuacagaacggaagggauauguauacaggcgaagcauuagauauagauaaucuuucccaauacgacaucgaucauauuauaccacaggcuuuuauuaaagacgacucaauugauaauaggguccuaguaagcagcgcuaaaaacagaggcaaaucagaugaugucccaucauuagaaaucguaaaagauugcaaaguuuucuggaagaaauuacucgacgcaaaacuaaugagccaaagaaaauacgauaaucuuacaaaagcagaacgaggaggucuuacgucugaugauaaagccagauucauccaacgucaauuagucgaaacaaggcaaaucacuaaacauguagcacgaauacuagacgaacgauuuaacaacgaacuggauucaaaaggaagacggauaagaaaagugaaaauaguaaccuuaaaaucuaaucuagugucuaauuuucgaaaagaguucggcuuuuauaaaauacgagaaguaaauaacuaucaccacgcacacgacgcauauuuaaacgcagucguugcaaaagcaauacuaacaaaauauccucaacuugaaccggaauuuguauacggagauuauccuaaauauaacagcuauaaaacacgaaaaagcgcaacagaaaaauuauucuuuuacuccaauauaaugaauuucuucaaaacaaaagucacacucgcugacggaacuguaguugucaaagaugauaucgaaguaaacaacgauacgggagaaauaguaugggacaaaaagaaacauuucgcuacaguaagaaaaguguugucuuacccgcaaaauaacauaguaaagaaaacagaaauacaaacaggaggauucucaaaagaaagcauacucgcccacggaaacucagacaaacucauaccgcggaaaacaaaagacauauaucuagaucccaagaaauacggaggcuucgauagccccaucgucgcauauucaguucuagucgucgcagauauaaagaaaggaaaagcacagaaauuaaaaacaguaacugaauuacuaggaauuacuauaauggaaaggucaagguucgagaaaaacccauccgcuuuucuagaaagcaaagguuaucuaaacauccgcgcagauaaacucauuauccugccaaaauauucucuauucgaacuggaaaacgggcgaagacggcuauuggcuagugcaggagaacuacagaaaggaaacgagcucgcauuacccacacaauucaugaaauucuuauauuuagcaagccguuauaaugaguccaaagguaaaccggaagaaauagagaagaaacaggaguucguaaaucaacauguaucauacuuugacgacauacuacaauuaauaaacgauuucucgaaacguguaauacuagcagaugcaaaucucgagaaaauaaacaaauuauaccaagacaacaaagaaaauauaucgguagacgaauuagcgaauaacauaauuaaucuauuuacuuucacaucacuuggcgccccagcugcauuuaaauucuucgauaaaauagucgacaggaaacguuauacaucaacuaaagaaguacuaaacuccacacuaauacaucaaucuauaacuggccuuuaugaaacacgaauagacuuaggaaaacuaggagaagacuga

SEQ ID NO: 9021 - RNA, 4155 nt, Artificial Sequence
  Cas9 variant
augaagcuccgugggaucgaagaugauuauucgauuggguuagacaugggcacaagcucagucggcugggcaguuacugaugaaagaggcacauuagcgcauuuuaaacguaagccaacgugggguucuaggcuauuuagggaagcacaaacggcugcgguagcaagaaugccaaggggccaacgaagaagauauguaagaagaagauggagguuagauuuauuacagaaacuuuuugaacagcaaauggaacaggcagaccccgacuuuuucauccgcuuaaggcaaucuagacucuuacgagaugaccgugcugaagaacacgcagauuauagauggccacuuuuuaacgacugcaaauuuacagaaagggacuauuaucagcgcuuucccacaauauaccauguaagaucuugguuaauggaaacagaugaacaagcagauauaagacuaauauauuuagcauugcauaauauugucaaacacagagguaauuucuuaagggaaggucagagccugagcgcaaaaucagcaagaccagaugaggccuuaaaccaucugcgagagacacuucgagucuggucuucagaaaggggauucgaauguucgaucgcugauaauggaucuauuuuggcaaugcuaacacauccagacuuaucgccaagcgauaggcgcaagaaaauagcaccacuauuugauguaaaaucggaugaugcagcagccgacaagaaauugggaaucgcacucgcaggagccguuauaggauuaaaaacagaguucaaaaacauauuuggagauuuuccaugcgaagacucuucaauauaucuuaguaaugaugaagcaguagaugcugugagaucagcaugcccugacgacugugccgaacuauucgacagauuaugugaaguauauucagcauacguccuccagggauuauuaagcuaugcaccaggacaaacuauuagcgcaaacauggucgaaaaauauagaagauauggagaagaccuugcacuauugaagaaauuaguaaaaauuuacgcaccagaucaauacagaauguucuuuaguggagcuacuuaccccgguaccgguaucuaugacgcugcucaagcaagaggguauaccaaauacaauuugggaccaaagaaaucugaauauaaaccaagugaaagcaugcaguaugacgauuucagaaaagcugucgaaaaauuauuugcaaaaacagaugcccgagcagaugaaagauaucgaaugaugauggacagauuugauaaacaacaguuuuuacgaagacuaaaaaccucagacaacgguucaauauaucaccaauuacacuuagaagaauuaaaagcaaucguggaaaaucagggacgauuuuaccccuuucuaaaaagagaugcugacaagcuaguaagucuugugagcuucagaauaccauauuacguaggaccucucucaacacgcaaugcuagaacagaucaacacggugaaaaucgguuugcguggucagaaaggaaaccggggaugcaagaugaaccaauauuuccguggaacugggaaucaauaauagaucgaucaaaaucugcugaaaaauuuauauuacggaugacagguauguguaccuacuugcaacaagaaccgguauugccuaaaagcagucuauuauaugaagaauuuugcguccuaaacgaauuaaauggugcacauuggaguauugacggggacgaugaacaucguuucgaugcugcggacagggaaggaauuauugaagaauuauuccgaagaaaaaggacuguaagcuauggugaugucgcgggauggauggaacgugaacgcaaucaaauaggcgcacauguauguggaggacagggagagaaaggauucgaauccaaauuagguagcuauaucuucuuuuguaaagauguauuuaaaguugaaagacuagaacaaagcgacuauccuaugauagaacgaauaauucucuggaauacacuauuugaagauaggaaaauuuuaucacaacgacuaaaagaagaauacgguagcagacuaucagccgaacaaauaaagacaauauguaaaaagagauucacaggcuggggaagguuaucagaaaaauuuuuaaccgguauaaccguacaaguagaugaagauucaguaucaauaauggauguuuuaagagaaggaugccccguaagcggaaagagagguagagcaaugguaaugauggaaauacuuagagaugaagaauuaggauuucaaaagaaaguagacgauuuuaaccgagccuucuuugcagaaaacgcucaagcucuaggagucaaugaauuaccagggucaccggcugugcguaggucauuaaaucaaucaaucagaauuguugacgaaauugcaucuaucgcugguaaagcaccggcuaauauauuuauagaaguaacacgagacgaagauccaaagaagaaagggcgucguacaaaaagaagauacaaugauuuaaaagacgcauuagaggcuuuuaagaaagaagauccagaauuauggagggaacuuugcgaaacagcaccuaaugauauggacgagagauuaucacuuuauuuuaugcagagaggcaaaugcuuauacucagguagagcuauagauauacaccaacuuucgaaugcagguauauaugaaguggaccacauaauaccacgaacuuacguaaaagaugauagucuagaaaacaaagccuuaguauacagggaagaaaaucaaagaaaaacagacaugcuauugaucgaccccgaaauaagacgaaggaugucuggauauuggagaauguuacacgaagcaaaauuaauaggagauaagaaauuuaggaaucuauuaagaaguaggauagacgacaaagccuuaaaaggguucauagcgagacaacucgucgaaacaggacaaauggugaaauuaguaaggaguuuauuagaagcacgauauccagaaacuaauauaauaucggucaaagccucuauaucacaugaucuacgcacugcugcagaauuagucaaauguagagaagcaaaugauuuucaccacgcucaugaugcuuuucuggcgugccgagucggguuauucauacagaaaagacauccaugugucuaugaaaaccccauaggauuaagccaagugguuagaaacuauguaagacagcaagcagauauauucaaaagaugucgaacaauacccggaagcucaggauuuauuguaaauucauuuaugacaagcggauucgacaaggaaacaggggaaauuuuuaaagacgacugggacgcugaagcagaagucgaagguauaagacgaucauuaaauuuuagacaauguuuuauaucacguaugccauuugaagaucacgguguauuuugggaugccacuauauauucuccaagagcuaagaaaacggcggcauuaccacuuaaacaaggucucaauccaucacgauaugggucauucagcagggaacaauuugcuuacuuuuucauuuauaaagcaagaaauccacguaaagaacagacauuauuugaauuugcgcagguuccagugagauuaucugcucaaaucagacaagaugaaaacgccuuagaaagauaugcgagagaauuagcgaaagaucaaggacuugaguucauaagaauagaacgauccaaaaucuugaaaaaccaauuaauugaaauagacggagauagauuaugcauaacagguaaagaagaggugagaaaugcaugugaacuggcguuugcccaagacgagaugagaguuauaagaauguuaguauccgaaaaacccguaucaagagaguguguuaucucauuauuuaacagaauauuauuacauggagaccaagcaaguaggagauuaaguaaacaacugaaacuagcacuauuaucugaggcuuuuuccgaggcuucugacaacguacaaagaaauguaguauugggauuaauagccaucuuuaaugggucaacaaauaugguuaaucuaagugacauaggagguaguaaauuugcuggaaacguacgcauaaaguauaaaaaggaacuagcauccccaaaaguuaacguacaucuuaucgaucaaucugugacaggaauguucgaaagaagaacuaaaauuggacuauga

SEQ ID NO: 9022 - RNA, 4158 nt, Artificial Sequence
  Cas9 variant
augacaaaaccuuacaguaucggucucgauauuggcacaaacuccguuggcugggccguuauaaccgacgauuacaaaguaccaucuaaaaagaugaaaguacuuggcaauaccuccaaaaaauauauaaagaagaaccucuuaggugcacuccuuuucgacaguggaauaacagcagaaggaagacguuuaaaacgaacagcaagacgucgauauacccgacggcgaaauaggauacuuuaccugcaagagauauucucaacagaaauggcaacucuugacgacgcuuuuuuucaacgacuagaugacaguuucuuagucccagacgacaaaagagacucaaaauacccaauuuucggcaaccucguggaagaaaaaguguaccacgaugaauuuccaacuauauaccaucucagaaaacacuuagcagacucaucaaaaaaggcagaccuaagacucguuuaucuagcccuagcccauaugaucaaauauagaggacacuuucuaauagaaggagauuucaauucaaaaaacaacgaccuacaaaaaaacuuucaagacuuccuagacacguacaaugcaauauucgaaucugauuugucacuagaaaacagcaaacaacuagaggaaauuguaaaagacaaaauaucaaaaagcgccaaaaaagacagaauauuaaaacucuuucccggagagaaaaacucuggaauauuuagugaauucuuaaaauugauuguaggaaaccaagcggacuuuagaaaauacuucaauuuagacgaaaaaacaucccuacaauuuaguaaagaaucuuaugaugaagaccuagaaacauuauuagggcacauaggugacgacuauucagacguauuuuuaaaagcuaaaaaauuguacgaugcuauauugcuaaguggaauuuuaacagucacugauaaugguacggaagcaccacuuucuucagcaaugauaaugagauacaaagaacacgaagaagaccuagcccuacuuaaggcuuauauaagaaacauuucauuggaaacauauaacgaaguauuuaaagauaauacuaaaaacgguuacgcaggguauauugacggaaaaacuagccaagaagauuucuacguuuaccucaaacgauuguuggcaggccuugaaggagcagauuauuucuuagaaaagauagaccgagaagauuuccucaggaaacaacgaacguuugacaacgguucuauucccuaucaaauauaucuacaagaaaugagagcaauauuagauaaacaagcgaaauuuuaucccuucuuagcaaagaauaaagaaagaauugaaaaaauucuuacauuccgaauaccauacuacguaggaccccuagcccgagggaauucagauuuugcguggucaauuagaaagagaaacgaaaaaauaacaccauggaacuuugaagacgucaucgauaaagaaagcagcgcugaagcauucauaaacagaaugacaucuuucgaccucuaccuaccugaagaaaaaguacuaccaaaacacuccuuauuauaugaaaauuucacuguauacaacgaacuaacaaaaguccgauuuauagcagaaggaaugcgagacuaucaguucuuagauagcaaacagaaaaaagacauaguaagacuauauuuuaaaggaaaaagaaaaguaacggauaaagacauuauugaguacuugcaugccauagauggauacgacggcauugaacuaaagggaauagaaaaacaauucaacucgucccuaucaacauaccaugaucuccuuaacauaauaaaugacaaagaauuuuuagacgacucuagcaaugaaacaauuauagaagaaauaauacauacuuuaacuauguucgaagaccgugaaaugauaaaacagcgacuaagcaaauucgacaacauauuugacaaaucaguccuuaagaaacuaucaagaagacacuacaccggauggggaaaacuuucagcaaaacugauaaacggaauccgcgacgaaaaauccgguaauacaauucuagacuaccuuaucgaugaugggguaagcaaucguaacuucaugcaauuaauucacgaugaugcacucaguuuuaagaaaaaaauaaagaaggcacaaauaaucggagacaaagacaauauaaaacaaguaguaaaaagcuuaccaggcucaccagcaauaaagaagggaauccuucaaaguauaaaaauaguagaugaauuaguaaaaguaaugggacgagaaccugaaucaauuguaguagaaauggcaagagaaaaccaauacacaaaucaaggcaaaaguaauucacaacaacgacugaagagauuggaggaaucccuaaaaggacuagguaguaaaauacuaaaagaaaacgugccaacucgacuaucgaaaauagauaacaacgcacuacagaaugaccgauuauaucuuuauuaccuucaaaacgguaaggacauguacaccggcgaagaauuagauaucgauagguugucaaacuacgauauagaucacauuauuccccaagcguuccuuaaagacgacagcauugacaauaaagugcuuguaucaucagcaucuaauagaggaaaaucagaugacgucccaucacucgaaguaguaaagaaaagaaaaacguuaugguaccaacuccuaaaaucaaaacuaauaucccaaagaaaauucgacaacuuaacaaaagcagagcgaggaggguuaagucaagaggaaaaagcuggauuuauccaaagacaacucguagaaacacgacaaauaacaaaacacguagcccggcuacuagaugaacgguucaacaacaaaaaagaugaaaacaacagaacacuucgcacagugaaaauaauaacucuaaaaaguucgcuaguuucucaauuccgcaaagauuuugaauuguacaaagucagagaaaucaacgacuuccaccacgcacaugaugcauaucuaaaugcagugguagcuuccgcacucuuaaagaaguauccuaaacuggaaccugaauucguauacggagacuauccuaaauacaacucuuuucgagaaagaaaaucagcaacagagaaaguauacuucuauaguaauauaaugaauauauuuaaaaaaucaauaccauuggcagauggaacaguaauagaccgaccacuaauagaagucaacgaagaaaccggagaaucaguauggaacaaaguagcagaucuaaacacaguacgcaaaguguuaucauacagccaaguaaauauuguaaaaaaagucgaagaacaaaaccacggacuugacagggggaaaccgaaaggcuuguuuaaugcaaaucucaguagcaaaccaaaaccaaacaguaaagaaaaccuuguaggcgccaaagaauaucuagauccuaaaaaauauggcggcuaugcggguauaucaaauuccuuugcaauuuuaguaaaaggaacgauagaaaaaggcgcgaaaaaaaaaauuaccaacguccuagaauuccaaggaauuucaauauuagaccguaucuauuacagaaaagauaaauuaaacuuccuccucgaaaaaggauacaaagauaucgaauuaauaauugaacucccuaaauacucccuauuugagcucagcgaugguagcagaagaaugcuagcuucaauuuuaucaacgaauaauaaaagaggggaaauacacaaaggaaaccaaauauucauuagccaaaaauuuguaaaacuacuguaccacgcaaaacguauuagcucaacauucaaugaaaaccauagaaaauacguagaaaaccacaaaaaagaauuugaagaacuauuuuauuauauuuuagaauucaaugaaaauuacguuggugccaaaaaaaauggggaauugcugaaaucagcguuucagaguuggcaaaaucacuccauugacgagcucugcaguucauucauaggaccaaccggcucagaaagaaaaggucuguuugaacuaacaagcaggggaggagccgcagacuucgaauucuuagggguuaaaauaccucgguauagagacuacacaccuuccucccuacuaaaagacgcaacgcugauucaucaaagcguaaccggauuauacgaaacaagaauugauuuaggaaaacuaggagaagacuga

SEQ ID NO: 9023 - RNA, 4158 nt, Artificial Sequence
  Cas9 variant
augcaaacauacuucgguaugaaaaaaauauuagguuuggaucuaggaacaaacuccauaggcugggcccugguaaacgaagcuaaugaugauaacgaaaaaaguucaaucauuaaacucggaguacgugugaacccauuaacaguagacgaacagagcaacuucgaaaaagguaaaaguauaacaacaaaugcggagaggacgauaaaaagauccauucgaaggucacuucaaagauacaaauuacgcagagaaaaucuaauagaaauacucaaggaacacaauuuuaucacugaugacacaauacugagcgaagacggaaacgcuucuacauuugaaacuuauagacuaagagcaaaagcggcaagugaaaaaauaagccucgaagaauuagggcgugugcuguuaaugauaaauaaaaaaagaggcuacaaaagcucacguaaagcaaaaaaccaagaggaaggacaacuuaucgaugguauggaaguggccaaggaacuauaugaaaaaaauauaacaccugggcaauucguauuccaauuacucaagcaagggggaaaauucauuccagauuucuaccguuccgacuugcaagcagaauucgauaaaauuugggaauuucaaaaauuauuucaugcagaaauucuaguagacgacuuuaaaaaacaacuagaacguaaaggcaaacuaaacuccucaaagauauucuuaggaagauuuggaauuuacacagccgaaaacaaaggaaaugacaaacgauuacaagccuaucaauggagagucgacgcacuaaccaaagaacucacuaaagaagaauuagccuauguaaucucugaccuuaacggaauaauaagcagcaguuccggcuacuuaggaagcauauccgacagaucaaaagaauuauacuucaacaaucaaacugucggacaauuucuaauggcacaauuagaccacucaccacauacaucccuuaaaaaccaaguuuucuaccgacaagauuacuuagacgaauuuaacacauuaugggaaaaucaagcacacuaucacaaaguucuaaccagcgaccucaaaucagaaaucagagauguaauaauauucuaccagagaagacuaaaaacucaaaaaggcuuaauaucauuuugugaguucgaguccagaaaaauagaaguggaaaucgacggaaaaaaaaaaaucaaaaaugugggaaguagaguaugcccgaaaagcucaccgaucuuucaagaauucaaaauauggcaaauauuaaacaacauugaacuauuagagaaauccagcaaagcaaaaagauucuuggaccaagaagagaaagaacuucuauucaaagaauugucuauaaaaagcaagaucucgaaaucugaugcauuaaaauugcucuuuaaaaauuccagggaauuagauuuaaacuauaaagaaauagagggaaacaggacacaaagugcucuuuuugacgcuuauagcaaaauaauagaauuauccggucauggagaauaugauuuuaguaagauggaagcuagcaacaucauagaacucguucaagaaguuuuuacaggccuaaacuacaacacggaaauacuauacuucgacagcucacuagaaggaaaagacuuugaaaaucaaccaauguaccguuuguggcaucuacucuauagcuucgagggagaugacucuaaaaccggaaacgaaaaauuaaucaacaaauuaucagaacuuuacggcuucgaaaaaaaauacagcauaguauuagcaaacguaucuuuccaagaagauuacggaucacuuaguacuaaagccauaaggaaaauacacccauauuuaaaagagggcauacaauaugacguggccugugaauucgcagguuacaggcauagcaaaucaucccugacgaaagaagaaaucgaaaacaaaauauuaaaggaccaauuagaaauuuuaccaaaaaauucuuuacgaaauccuguagucgaaaaaauauuaaaccaaaugauaaaugucgucaacgcucucaaugaaucuuacggcaaaccugacgaaauccgaauagaacuagccagagaauuaaagaaaucagcaaaagaaagagaggaacuaacggcuagcauaggagagacaacuauaaagcacgaaaaauacagagcgauuuuagaaaaugaguucggaauaagucacguaagccgaaaugacauaauaagauacaaacuuuaccuagaacuugaaaauaggggauauaaaacauuauacucuaauacuuauguaucgcaagaaaagcuauucucaaaggaauucgacaucgaucauaucaucccacagucuugcuuauuugaugauaguuucucaaacaaaacccuggaaucaaaaagcgucaauauagaaaaagguaaugauaccgcauucgacuacguauuugccaaauacggcgaagccggauuauccgacuauauaauacauauagaagaacuuuuuaaagacgguaaaauaucaaaaaccaaauuaaacaaacuaaaaaugaaaggcaacgaaauaccaucagauuucauagcacgagauauacgagacacacaguauauagcaagaaucgcaaaaaacauauuagaagaaacgguaagaaacguggucucaacgagcggaucaaucacagacagauuacgagaagacuggcaacuaauagacguaaugcaagaacuuaauugggaaaaguauucugcacuaggucuaaccgagaucuaugaaaaucgagaaggacacacaauaagaagaaucaaagauuggacaaagagaaacgaucaccgacaccaugcaauggacgcauugaccauagccuucacaaaacgcucgcauauacaauaucucaacaauuugaacgcacgcucugauaaauccggaaguauauacggaauugaaaccaaagagcucuaucgugaugaccauggaaaacuaaaauuuaaacccccaauaccauuaaaugaauuccgagcagaagcuaaaaaacaccuagaaaacacacuaauaucgauaaaagccaaaaauaaaguagcaaccauaaacauaaacacgacgucaaccaaagaaggcaaaaacaaaaaaagacaauugacaccccgaggccaacuacaccuugaaacaauauacgggucaauacaacaauauguuacaaagcaagaaaaagucggugcuucauuuaacgaagaacaaauaucaaaaguagcaaaacagaaguauagacaggcauugcuaaaccgauuacgcgaauucgauaacgauccuaaaaaagcauucacuggaaauaauuccuucgaaaaaaaucccauauaccuugacguacuacaaacgcagaaaguaccagacaaaguagaaacaguaaguaaagaaaucaucuacacuauucgaaaagacauaaccccagaauugaaaauagaaaaaguaauugacaaaaagauaaaaacgauacuccaaucacgacugaacgaauauucaggagauucaaagagggccuuuaguaaccuuaaagaaaacccuauuuggcuaaaccaagagaagggaauagaaauaaaacggguaacaauaucuggaauauccaacgcaguugcuauucacgauaaaaaagauaaaaacgguaauuuaauccucgauaaugaggguagcacucaagcaguagacuucguaaacacagguaauaaccaccacguagcaauauauaaagacgaacguggaaauuugcaugaaucaguugucucauucuucgaagccuguacacgaguuaaccuaggagguccaguaauauuuaaaaacuacaacaaauccgauggcugggaauuccuauuuagcaugaaacaaaaugaauauuuuguauuuccaaacgagaagaccggcuucaaucccaaugaaauagaccuacucgaccccgauaauuacagauuaauaagcccuaauuuauucagaguccaaaaaauuucauccaagaauuaugucuucaaucaucaccucgaaacaucagcaauuacuggagaaacccuaaaaaacaagaaacaauuaaguagcgucacauaccauuucauacaaucauuaccaccuaucaaagacauaguaaaaguaaggauaaacaacaucggccaaauagugugggugggagaauauuga

SEQ ID NO: 9024 - RNA, 4158 nt, Artificial Sequence
  Cas9 variant
auggacgaacuacaaaauuuugaaaaaggaaaaucaauaacaacaaaugcagaucgaacugcgggacguucaaugagaagaaaucuucaacgauauaaauuaagacgugaaaaccuaauugaaguguuaaaagaauacaacuucauaacagaugaaaugauauuaagugaaaauggaaaucguacaacauucgaaacguauagauuaagggcaaaagcagcaguagaagaaauaucauuagaacaguuugcacgaguacuacuaaugauaaacaagaaaagaggauacaaaagcucaaggaaagcgaaaggggcagaaaauggaacacuuauugacggaauggaaguagccaagaaaauguaugaugaagguauuaccccgggugaauuauguuuacaacuacuaaccgcagggaaaagauacuucccugauuucuaucgcucagauuugcaagcugaauuugacagaauuuggaauuuucagaaacaauucuauccagacagccuuauugauaaagugaaagacgaaguacgaggcaaaaacaaaagucagacgugggccauccuagcgaaauauuuugucuggaaagaaguagaaaauagcuggaaugaagaagaagcucaaaccagacgcguagaaaaagaauaucggcuaguaggaaucaaaagaggaguaaaaagagaagaacuuaaauuagaaaauuuucaauggagaguaaaagccuuaagugaaagaaugaauccagaagaauuagcaauaguauuacaagaaaucaacgaacaaaucucaaacucaaguggcuacuuaggagccauauccgaccguucaaaagaacuauacuucaacaggcaaacugucggccaauaucaaauggcaguccuagauaacaacccaaacauuggauuaagaaauaugguauuuuauagacagggguaccugggagaguucaauacaauaugggaaaaacaagccgaguuccauaaagaacuaacagaagaucuuaagaaagagaucagagauauagucauuuucuaccaacggcgccuaaaaucccaaaaaggcuugauaaacauaugcgaguucgaaagaagacagauagaaguagaaauagauggcaaaaagaaaauuaaaacuaucgguagcagagucaucccaagauccagcccacucuuucaagaguucaaaauauggcaaacauuaaaugacauagaaguuaguguucuagguguuaaaaacaaaagaaagaaacaggaugauaauaguaccacucuguuagauucggcagaaaauauagacagccugaaacuaaacguaaguagaccacuagacgcugaugaaaaaucacugcuagcaaaagagcuauuuauuagagauaaauuaacaaaaucagauguacuaaaauuauuauucaauaacccucaaaacuuaaaucugaacuuuaaaaauauagacggaaaccggacaggauccgcacuauaucaagcauuuucaaaaauacuagaaauaucaggacacgaaaguauaaacuuuaagaaaucggcagacgaaauaguagaacaaguaaaaacaauauucagugcccuggguuggaauaccgagguauuauguuuugacucggaaaaagaacuugacaaacaaccguauuucaaacuauggcaucuacuauacucauuugaaggggauagcacaccaacuggugauggaaacuuaauacagaaaaucgcggaucucuguggguuugaaaaagacuaugcuucaauauuggcaaacauaacauuucaagaagauuacgguaguuuaagcacgaaagcaauaaggaaaauacuaccacaucuaaaagauggcaaccaauaugacguagcaugcgaguaugcuggauacaaacacaguaaaucaucacuuaagaaagaagaaaucaaaaauaaaguacugaaagacaaacuagaacuuuuacccaaaaauagucucagaaauccugucguagagaaaauauuaaaccaaauggucaacguaauaaacgcgauaauuacaacauauggaaagccagaugaaauuaggauagaauuggcaagggaacucaagaagaaagcuaagaaaagagaagaauuaacuaaaacgauaguugauacaacuaaaacacacgaagguauuagagcuauacuccaaaaugauuuugguaugucacaugucucaaggaacgccauuauacgauacaaacuuuaugaggaacuaaaagacaauggauauaaaacauuauacagcaauacauacauaccuaaagaaaaacuauuuaguaaagacuuugauauagagcacaucauaccacaagcuagauuguuugacgauucauuuucuaauaaaacccuagaaguuaaauccauaaacauagaaaaaggaagcaaaacagcauacgacuucguagaagaaaaauauggugaacaaggguuacaagaauaccuaaacagaugcgaaguacuauuuagagacaagaaaacaaaacuuagaaaacuaaaaaugcaagaauccgaaauuccagaaggauuuauugauagggauuuaaggaacacacaauacaucgccaagaaagcauuaaguaugcucaacgaaauaugcagacgagucguugcaacaacuggugcaauaacagacgaacuacgagaagauuggcagcuaguagauguaaugaaagaacuaaauugggaaaaauauaaaguacuagggcuggucgaauacuucgaagacaacgacgguagauuaauuggaagaauaaaagauuggacgaaaagaaacgaucacagacaccacgcgauggacgcauuaacaguagcauucacaaaagauguauucauacaauauuuuaacaauaaaaacgccucgcuaaaacccgacacaaacgaagcugcaauaagaaauaaauacuuucaaaauggaaaagcaaucccaccaaugagcuuagacgaguucagggcugaagcgaaaaagcaucuaaaugauacccuaaucuccauuaaaaccaaaaauaaagucguaacaauuaauuuaaaucgaacaaagaagaaaaaugguaucaauaagaaacagcaacaaacgccaaggggacaacuucacuuagaaaccguuuacggaagccauaaacaauacguugucaaagaagagaagguaaacgccucauuugaugcggccaaaauagccacaguaaacaaaccagcguacagggaugccuuacuacggaggcuccaagaaaauggaaaugauuccaagaaagcauucacaggcaaaaauagucuugauaaacagccaguaugguuggacgccaaacaaaaugaaugugugccagaaaaaguuaaaacuguaaugcuagaaacaguuuauacgguuaggaagccaauagacgaaaaacugaacguagauaaaguaguugacgccaggauaagaaaacuauuacaagacagaauaaaagaauacggaaacgcaaaaucagcauucgcaaacuuagaugaaaauccuauauggcuuaacaaagagaaggggauuacaauuaaaagagucuccguaucuggaauaucgaaggcacaaagucuucaugagaagaaagauaaagacgguaacuuuauccucgacaaagauucaagaagaauacccgucgauuucguaaacacuggaaauaaucaccauguagcaauauauaggaaaccgguacucgauaagaaaggacaagcuguguuugacgaaaacggagaacuaaaauucgaacuagaagaaguagugguuagcuuuuucgaugcaguaacgcgaguaaacuuaagucaaccuauuauugacaaagauuacaaaaggagcgaaggauggaaauuucuauuuucaaugaaacaaaacgaauacuuugucuuuccaaaugagaaaacgggauucgacccgaaagagauugaccuacuaaaucccgaaaauuaugccuuaauaucucccaaucucuuucguguucagaaaauagcaucaaaagacuacguauuucgccaucaccuagaaacgguagucgcagauagaaaagagcuccaagaaaucacauggaaaagaauuagcucccuuucaaucuuaaaucgaauuauuaaaguacgaguaaaucauauaggucaaaucgucaugauaggagaguauuga

SEQ ID NO: 9025 - RNA, 4158 nt, Artificial Sequence
  Cas9 variant
augacaaaacccuauucuauaggcuuagauaucgguacuaacucagucggaugggcgguaauaacagaugauuauaaaguaccaucgaaaaagaugaaaguacuagguaacacuucaaaaaaauauauaaaaaaaaaucuccuuggggcccugcuauucgacucuggaauuacagcagaagguagaagacucaaaagaacagccagacgacgauauacacgaagacgcaauagaaucuuauauuuacaagaaauauucucaacugaaauggccacuuuagaugaugcauuuuuccaaagguuagaugacuccuucuuagucccagacgacaaaagagacucuaaauaucccauauucggaaaccuuguugaggaaaaagcauaucaugacgaauuuccaaccaucuaccaccuucgcaaauaucuugcagauagcaccaaaaaagcggaccuacgccugguguaucuagcucuagcacauaugauaaaauacagaggacacuuuuuaaucgaaggggaauuuaauucaaaaaacaacgacauccaaaaaaacuuucaagauuucuuggacacauauaacgcaauauucgagucagaucuauccuuagaaaauucuaaacaguuagaagaaauaguaaaagauaaaauuucaaaaucugcuaaaaaagacagaauauuaaaauuauuuccaggcgaaaaaaacaguggaaucuuuagcgaauuuuuaaaacuuaucguaggcaaccaagcagacuucaaaaaauacuucaaucuagacgaaaaagcaccccuucacuucucaaaagaaucauaugaugaagaccuagaaacauuacuaggauacauaggagaugacuacucugacguuuuuuuaaaagcaaaaaaauuauaugaugcaauccugcuuucuggaauauugacaguuacagacaacgguaccgaagccccacuuucaucagcaaugaucaugagauacaaggaacacgaagaagaucuagcuuuacuaaaagcguauauaagaaacaucagucucgaaaccuauaacgaagucuuuaaagacgacacuaaaaacggauaugcagguuacauagaugguaaaacaagucaagaagacuucuacgugcaucugaagaaacuacuagugggccuugaaggagcggauuacuucuuagaaaaaauagaucgagaagacuuccuaagaaaacaaagaacuuucgauaauggaucaauuccauaucaaauacaucuccaagaaaugcgcgcuauacucgacaaacaagcaaaauucuacccuuuccuagcgaaaaauaaagaacgaauagagaaaauccucacauuccgcauaccauacuacgucgggccccucgcuagagggaacuccgauuucgcauggagcaucagaaaaagaaacgaaaaaauaacacccuggaauuucgaagacguaauugacaaagaaaguagcgcggaagcauucaucaacagaaugacuucauucgaccuauaccuaccagaggaaaaaguauuacccaaacauucacuuuuauaugaaacauuuaauguauacaaugagcuaacaaaaguccgcuucauagcugaaagcaugagggacuaccaauuucuagacaguaaacagaaaaaagacauaguaagauuauacuuuaaaaacaagcgcagagucacugauaaagauaucauagaauaccuacacgcuauugacggcuaugacggaauagaauugaaaggcaucgaaaaacaauucaacucaucucuuucaacauaccacgaucugcucaacauaauuaaugauaaagaauuucuagacgacuccucaaacgaagcuaucauugaagaaaucauacauaccuuaacaauauucgaagaucgagaaaugauaaagcaacgauuaucuaaauucgaaaauauauucgacaaaucuguucuuaaaaagcucagccggcgacacuacacaggauggggaaaauugucagcaaaauuaauaaauggaauucgagaugaaaaauccgggaacacaaucuuagauuacuuaauagaugacgguguuaguaacagaaauuuuaugcaacuaauacaugacgaugcucuaucauuuaaaaaaaaaauuaaaaaggcccaaauaauaggagacaaagacaauauaaaacagguaguacaagcuuuaccagguagacccgcuauaaaaaaaggaauauugcaaaguauaaaaauaguugaugaauuaguaaaaguuaugggacgcagaccagaaaguauaguaguugaaauggcuagggaaaaucaguauacuaaucagggcaaaagcaacagucaacagagacuaaagagacuugaggaaagucuaaaagaauuagguucaaaaauucuuaaagaaaauaucccugcuaaauuaagcaaaauagauaauaaugcauuacaaaacgauagacucuaccuguacuauuugcaaaaugguaaagacauguauaccggugaagaauuagacauugaccgucuaucaaauuaugauauagaucauauuaucccccaggccuuccuaaaagauaauaguauagacaauaaaguguuaguaucaagcgccucaaaucguggaaaaucagacgaugugcccucauuggaaguaguaaaaaaacgaaaaacgcuaugguaucaacuacuaaaauccaaauuaauaagucaaagaaaauucgauaaucucacaaaagcagaacgaggcggacucaguccagaagcuaaagccggauuuauacaaaggcaauuaguugagacacgacaaauaacaaaacauguugcaaggcuccuggaugaaagauucaacaauaaaaaggacgaagauaacaaaacacuuagaacuguaaaaauaauuacacuaaaaucaucacucgugucacaauuuagaaaagauuuugaauuauauaaaguaagagagaucaaugacuuucaccaugcacacgaugcuuaucuaaaugcagucguugcaagcgcauuacuaaaaaaauacccuaaauuagaaccugaguuuguuuacggagacuacccgaaauauaacuccuucagagagcgaaaaagcgcuaccgaaaaaguguauuucuauuccaacauuaugaacauuuuuaaaaaaucaauaucacuagcugacggaacugucauagaacgaccacuaauagaagucaacgaggaaaccggagaaucaguauggaauaaaguugcagauuuaaacacaguaagaaaaguacuaucuuacucacagguaaauaucgugaaaaaagucgaagaacaaaaucauggauuagauagaggaaaaccuaaaggacuuuucaaugcaaaccuaaguucaaaacccaaaccgaacagcaaggaaaauuugguaggggcaaaagaauacuuagacccaaaaaaauaugguggcuacgcaggcauaagcaacucauuugccgugcucguaaaggguaccauagaaaaaggagccaaaaagaaaauuaccaacaucuuggaauuccaaggcauaucaauauuagauagaauaacauaucgaaaagacaaauuuaauuuucuacuagaaaaaggauacaaagacaucgacuuaauuaucgaacuaccaaaauacucacuuuuugaauuaagcgaugguucacggcgaaugcuagccagcauucuaaguacaaacaacaaacgaggugaaauacacaagggaaaccaaauauuuauuagccaaaaauauguuaaguugcucuaucaugcaaaaagaauauccaacacuuucaaugauaaucacagaaaauauguagagaaucauaaaaaagaauucgaggagcuguuuuauuauauacuagaauucaacgaaaauuacguaggagcgaaaaaaaauggcgaguuacucaaaagcgcauuccaauccuggcaaaaccauucgauagaugaauuauguucgaguuuuaucggaccaacuggcucagaacgcaaaggacuuuuugaguuaacuagccgcggaggagcagcagacuucgauuuucuaggcgucaaaauaccuagauacagagacuacaccccaagcucucuccuaaaggacgccacccuuauucaucaaagugucacaggccuuuaugaaacucguauagauuuaggcaaacuaggcgaagacuga

SEQ ID NO: 9026 - RNA, 4158 nt, Artificial Sequence
  Cas9 variant
augaaaaacaaaacaugguaucuuggccuaggcguaggcccuacaagcauaggcugggcagcaaccgacucaaacuacaaacuuuuacgaaaaaacaaaaaacgacuguggggagugaggcuauucgaagaagccaaaacagccguagaccgaaggaccuuuagagcagaaagaagaagacucgccagaaggaaauggaggauauccuuacuagaagaauuauuugcaaaagaaguuucaaaaaacgaccccaacuucuuccuucgccuaaaagaaagcaaauaucauuucgaagauaaaucauuaaugaacgaauauauauuauuuaacgauaaagauuacacagacaaagacuacuacaaagaauaucccacaaucuaucaccuuagauuaucguuaacaacugaagaaaauccagauauacgcaaaguuuacuuagcuguacacuccaugcucaagaaucgaggccacuuccucuuacaaggacaaagcuuuaaugauucuaacauagacucagucauaaaagaacuacuagaacucgagaccguaaaaauaaacuucgaaguaaccgacgaaguaauccauucgcuaaaaaaaauugcccuagaaaaaaaaaaucuguccgauaaaaauaaugaugucaaaaaauuauacccaaaagaaaaacaacuacaggaaauauuuaaauuagucuucggaggcaaaacaucgcucgauaaacuauaugauaucgaagaauauaaagaauuagauaauucugugaaaucaauaucauucaaagaaaaagucuaugaagaaguacguccagacuaugaacaaauacugagcaacuacauagaauuauuagauuuagcaaagcucguauaugacagcauagucuuagcugacaucaaaaaggaagguaaaacgauaagcgagucgaagguagaacuuuauaacaaacacaaagacgaucuggccaaccuuaaaaaauuagucaaaauagauaguaagcucucagaagacaaaaaaaaagaaguuuauuuuaccauauuuaaagaggauaaagaaaaaggaacuaacuaugucaauuauacacacagaucacaggaagguaagucauguucauaugaagacuucaaaaaguuccugaaaaaagaacuagaaaaacuagaagacucaccaacuaaaacaaccauacucgaggaauuagaccuagaaacauucuuaccacuacaaaggacaaaagauaacucaguagugccauaccaaauacacaaagaagaacucgucaaaauacucgauaaugcagcaaaauaucacaguuuccuggcugaaaaagaugacucaggauacagcacgcgagaaaaaguaguacaauuauucgaauuuagaaucccauacuacaucggaccacuaaacgcacaccacaauacagaaaauggcggcuauucaugggcuauaagaaaaaaagguauggaaaguguuccaguaacaccguggaauuuuaaagacguuauugacgaaucugcgucagcggaagcauucgucaauaacuuaaaaaauaaaugugcauacuuaucuggcgaagacgugcuacccaaaaacucacuucuauauagugaguacgcucucuuaaacgaacuaaacgccuuacgauacgaaggaaacagaauaucaguagaggcacgagacguaauaguuacuaaacuuuucaaagaacagggaaaaaagguaacaaagaaaacaauaaaagaacugcucaaaacagaaggauucauagacgguaaaggagaaauaguaggcauagauaauauaguuaaaaaugacuuaaaaucauauagagacuuuaaaaaaauacuagcggauaaauucgacaaagaacgaguggaaaacauuauauuauggauaacacuauacggagaaaguagaaaacuaauaaaagaaaaaauaacaaaaguauauggagacuucuauacuguagacgaaaucgaaaaaaugucgagauuaacauauaaagacuggggaaucuuaucacgcaagcuauuaacagaauuaguaucagaaaagcuauacaaugaagaaacuggugaaugucucaauauaaucggagcaaugagacaaggaaccauuuuauuuauggaacuauuagccgauaaauucgauuacaugucccaaaucaaaaaccacaacaaagaaaauaaagacgacauaacugaaauaacaccagauauauuagaaaaccugcacgcaucuccagcgguaaaacgaucaauauggcagacaguaaggaucguugaagaacuuaaaacaaucauaggaugcguccccacuaaaaucuucauagaaaccacaaagcgaaacaacgcaccauacaaaguacccacacuaaacagaaacgacuuagucacaaaguacaaaacaauccgggaacaugaaauauuugaacucgagaaagaacuaaagaacacgcuugauuucacauuaaacaaaaaucgacucauaaaugaggaacccucaaaauuaaaagccacaaaauuauaucuauauuacacacaauuaggaagaugcauguacaccgguaaaaaaauagauuuaggcgagcuuuuugauaacaauaacaaauacgacauagaccauaucuacccacaaucgaaaguaaaagaugguucauuuaauaauauuguguuagucacaaaagcaucuaacgauaugaaagcagauguauuuccauuaaaaucaaaguuccaaacaaaagaaaauaaaauauucuggcguuuccugaaagaaaaaaaacuaauuacagaagaaaaauacaauagacuuguacgaacggaagaauucagcaauggcgaauuaaccgguuuuaucacccgacaauuggucgagacaucgcaagcuaucaaaguaauaagcaacguauuaagagaauuaaacccagaaacaaccauaugcuauuccaaagcugaaaacgugucauccuuuagacaaucauuugggaaaauuaaagaagcaaacagaaaagcagagaacaaugaaaaguuaauaagaguacaagaaauaaacgauuacuacaacgcaaaagaugcauaccugucaauuguaguggggaauguguacgacguaaaauucacgagaaacguacacaauuucauaaaaaauaacaaagaugcacgaagauacagccuaaaugggcucuucuauaccgacguuaagaacgcaaauaccauagcgugggaaauggauaaaacaguccacguaguagaaaaaaccaugaacaauaauaauauccugauaacaagacgaacuagcgagcaaaaaggcgcucuuuacgacgcgacauuauauaaagcuaaaguugcagaaaaagcgaaggaaggaacauacuacccgcuuaaaaccacagacucgaaaauaaaagauguaggcaaauauggcgguuuuacaaaaauuaagauagcauacuacucaaucuucgaauacacgcuggauggaaagaaaggaaaacaaaagauaacuaggaucguacccauaccgauuuacauuagucagaacaucaaagacgacaaagcguuacuugaauacgcacaaacaagacuacccgggaaagaccugaaaauaaaauauaggaaacuaugcauagggucccucguuaaaauaaacaacuuuaauuauuacauaggaggaaaaacgaauaacaacuucaccuucgacagugccguacaaguaauacucgauaaggacucagaaagcuauauuaaagaacuagccaaauaucuaaauuggaaaaaagaaaacaaggaugguaaguuaugggaauccauaacagaagauaaaaauauccaacuauaugauaguuuaguuaaaaaaaugaacacgggcauauucauuagaaaaacuccaaacaaauacaccgaacuacuaacgcuagaagucaaaaauaaauucaucaacauagauauugacgaacaagugaaacuauuacuggaaaucuuaaacuuacucacaaauaaaaaauucacuuccaaacuaaaugagauaggaauaacagccucacgaggaguauguuccuucaaccuaagcaaccaaucgcaauuuucaauuauagaacaaucaguaaccggaguguaugagaaagaaaaacucaucauugagaaaaaaaaggaaggaauacuauga

SEQ ID NO: 9027 - RNA, 4161 nt, Artificial Sequence
  Cas9 variant
augaaucagaaauauuccauaggacuugacauaggaacaaacucaguuggaugggcuguuauaacugacgacuacaaaguaccagccaagaaaaugaaagugcuugggaauacagacaaacaaucgaucaagaaaaauuuacuuggugcacuacucuuugacucaggagaaacugcagaagcuacaagacugaaaagaacggcaagaagaagauacacccgcagaagaaauagacugagauaucuccaagaaaucuuugccgaagaaaugaugcaaguugaugaaucauucuuucaacgauuagacgauagcuuuuugguagaugaagacaaaagaggggaaagacacccaauauuuggcaacauagcagcagaaguaaaauaccaugacgaauuuccaacuauauaccaucuacgaaaacaucuagcagauauuucacaaaaagccgaccuaagguuaguauaccuggcguuagcacauaugaucaaauuccgcggccacuuucucauagaaggacaacuuaaagcagaaaacacaaacgugcaagcacuuuucaaagauuucguagaagucuaugauaaaacuguagaagaaagccaccuaagugaaauuacgguagacgcauuaagcauacuaacggaaaaaguaucaaaaagcagacgauuagaaaacuuaauagcucauuauccagcagagaagaaaaacacccuguucggaaauuuaaucgcauuauuccucgggcuccagccgaauuuuaaaacaaauuuucaacuauccgaagacgcuaaauuacaauuuaguaaagauaccuacgaagaagaucucgaaggauugcuaggagagguaggugaugaauacgcagaccuuuuugcaagugccaaaaaccucuaugaugcaauacuauuaagcggcauauugacaguagacgacaauuccacaaaagcaccgcuuagcgcaucaauggucaaaagauaugaagaacaccaaaaagaucucaagaaauuugaggauuucauaaaagucaacgcuuuagaucaauacaacgccaucuucaaagacaaaaauaagaaaggauacgcuggauauauugaaucaggggugaaacaagaugaauuuuauaaauaucucaaaggaauacuacuacaaaucaacggaagcggagacuuucucgauaaaauagauagagaagacuuccuaagaaaacaaagaaccuuugacaacggaucuauaccacaccaaauacaccuacaagaaaugcaugcgauacuuagaagacaaggagaacauuaccccuuucuaaaagaaaaucaagauaaaauagagaaaauccuaacauucaggauuccauacuacguuggcccccucgcccggaaaggaagucgauucgcuugggcagaauauaaagcagaugagaaaauaaccccauggaauuuugaugauauacuagacaaagagaaaagugccgaaaaauucauuacucgcaugaccuuaaacgaccuuuaccucccagaagaaaaaguuuuaccuaaacauagucuacuauacgaaacuuucacagucuacaaugaacuaacaaaaguaaaauauguaaacgaacaaggagaagcuaaauuuuucgacgccaacaugaaacaagaaauauuugaccauguauuuaaagaaaacagaaaaguaacaaaagauaaacuacucaauuacuuaaacaaagaguucgaagaauuuagaaucguaaauuuaacagggcucgacaaagaaaacaaaguauucaacucgucacuuggaacauaucacgauuugcgaaaaaucuuaaacaaaucauuucuugacaauaaagaaaacgcacagauaaucgaagacauaauccaaacucuaacauuauuugaagauagagaaaugauaagacaaagauuacagaaauauagcgacauauuuacuaaagcacaacuaaagaaacuagaacgaagacauuauacagguugggguagacuuagcuacaaacuaauuaaugguauacgcaauaaagaaaacaagaaaacaauacuugacuaucuaauagacgauggauacgcaaauagaaacuucaugcaauuaauuaaugaugacgcccuauccuucaaagaagagauugcaaaagcccaaauuauuggagacguugaugauauagcuaacgugguucacgacuuaccaggcaguccugcuaucaagaaagguauauuacaaucaguaaaaauugucgacgaguuaguuaaaguuauggggcacaauccagcgaauauaauaauagaaauggccagagaaaaccaaaccaccgauagaggcaggcguaauagccagcaacgacucaaacuacuacaagacucacuaaagaacuuagacaacccagucaacaucaaaaauguagagaaucaacaauuacagaacgaccgacuauuccucuauuauauccaaaacggcaaagauauguauacaggagaaacucuugacaucaacaauuuaucacaauaugauaucgaucauauaauaccucaggccuauauuaaagaugacaguuucgauaauagaguauuaacauccucaagugagaacagaggcaaaucagauaauguuccaucgauugaaguaguaugugcuaggaaagcagauuggaugcgacuacgaaaagcaggauuaauuucacaaagaaaauucgacaacuuaacuaaagcagagcgcggagggcuuacagaaaaugauaaagccggauuuauuaaacgacaacucguggaaacacgacaaauaacgaaacacguagcacaaguauuagaugcccgauuuaacgcuaaacacgacgaaaauaagaaaguaauucgagauguuaaaauaauaacucuaaaaucgaaucuaguaucccaauuucgaaaagacuucaaauuuuauaaaguacgagaaauaaacgauuaccaccacgcacacgaugcauaucuaaacgccguaauaggaacagcucugcucaagaaauacccaaaacuagccagcgaguucguuuacggagaauuuaagaaauaugacguaagaaaauucaucgccaaaucagauaaagaaaucggaaaagcaacggcgaaauacuucuucuauucuaaccuaaugaauuucuuuaagaaagaagugaaauucgcugacgguacagucguagaaaggccagauaucgaaacaagugaagacggagaaauagccuggaacaaacaaaccgacuucaaaaucguucgaaaaguacucucuuacccacaaguaaauauaguuaagaaaacagaaguccaaacacauggcuuagacagaggcaaaccaagaggccuguuuaaugcuaauccaucuccaaaacccaaaccagauagcucagaaaacuugguagggguaaaacgaaaucuagaccccaagaaauacggaggcuacgcaggaauaucgaacaguuaugccguacucguaaaagcgauaauagaaaaaggagucaagaagaaagaaaccauggugcuagaguuccaagguauaucaauacuagauaggauaaccuuugaaaaagauaaacgcgcuuucuuacucgguaaaggcuacaaagacaucaagaaaauuauugagcucccuaaauauucccuauuugaauuaaaagauggaucgaggagaauguuggcaaguauacuaucaacuaacaacaaacguggagaaauacacaaaggcaacgaauuguuuguaccacaaaaauucacgacgcuacucuaucacgcaaaaaggauaaacaauccgauuaauaaagaucacauagaauacguaaagaaacacagagacgacuuuaaagaauuauuaaacuacguuuuagaauuuaaugaaaaauacguaggagcaaccaaaaauggagaaagacucaaagaagcuguagccgacuuugauagcaaaagcaacgaagaaauaugcacaucauuucuaggagccgucaauucuaaaaaugcaggucuguuugaacuuaccucccucggaucagcaucagacuuugaauuuuuagguguaaaaauaccaagauauagggauuauacaccaucguccuuauuaaaagauagcacacuuauccaccaaaguaucacagguuuauacgaaacaagaaucgaucuaucuaaauuaggagaagauuga

SEQ ID NO: 9028 - RNA, 4161 nt, Artificial Sequence
  Cas9 variant
augacgaaaauaaccgaagacuacaucguagguuuagacaucggaacgaacucuugcggcugggucgccauggacucaaaaaacacuauauugcgaaugcacggcaagacugccauaggaucacaccuauucgacgcaggaaacucugccgcagaccgaagagcauuucggacaacuagaagaagaauaaaaagaagaaaauggagacuaaaguuauuagaagaaauauuugacucacacuuagcgaaaguugaccccuauuuuuuugcacgauuaaaagaaaguggacugagcccauuggauacucgcaaaaaugucucaucaaucauauauccuaccucauuagaagacaaaaaauuuuauguugacaaccccaccauauaucaucuuagauacaagcuaaugacagaagacagaaaauuugaccuaagagaagucuauuuggcaauacaccacauagucaaauaccgaggaaauuuucuauacaacacaccugucaaggcauucgaagcaucaaaaauagacguaaaagguagcuuaaaaaaacuaaacgaacuauacgaagggcucgauagcgaauucaauguagagcuggauaguaauaacgcgcuggagauagagaacauaauccgugacaaaaaaauauuuaagauaaacaaaguaaaagaaauaaaccaauugcuaucacuaaaaaccgaagacaaagaaagaacaaaacuuaugaaggaugucucaaaacaaauaguaaacgcaauauuaggcuauaaaaccaaauuugaaaccauauugcucaaagauguaucaaaggacgaagcggacgauugggaauuuaaauuaacagacguggacgcagacaauaaguucgaaaaccuaauaggagaucuuaaugaaaacgaacaagaaauauuacuuguaauaagaaagcuagccaacgccauuaccuuaucaaacauuguagaagaaggaaaaacucuaucagaaucaaugaaagauaaauacaaaaaacacuccgaugaucuuaaacuacuuaaacaaguaaucucugaccauccagacagagacaaggccaaaaaacuagcccuugcauaugacuuauacguaaauaacagacauggaaaaauacuacaagccaaagacauacuugaaaagaaaaaaacgcuaagcaaagaagacuuuuacaaagaaauaaaaaaaaacuuggaugacaguaaagagucacaagaaauauuagaugcaauaucacuagacucauuuaugccaaaacaacgaacgaacgaaaaugggguaaucccguaucaacuucaucaacuagaauuagauaaaaucauagaaaaccagggaaaauauuacccguuucuaaaagaaguaaacccaguauccagccaucuaaaacaagcaccauacaaauuagaugaauuaauaagauuccgcgucccauauuacguuggcccacucauaucaccuaaugaaucaacuaaaaauaaacagacaaaaaaaaaccaaaauuuugccuggaugauaaggaaagaacaaggacaaauuacgccauggaauuucgaucagaaaguagauagaauggccagcgcuaacaaauuuauaaaaagaaugaccacaauagacacauaccuccugggggaagacguacuaccagcaaacucacuauuauaucaaaaauucacaguacucaacgaacuaaacaauguaaaaauuaacggaaagaggauuucaguaccccuaaaacaagaauuauacaauaauuuauucaaaaaaaacucgacugucacaacaaauaaauuaaaaucguauuuaaaagaaaauuacaaauuaaucaaaguagaaauaaaaggacuaagugacgaaaagaaauucaacucuggccuaacaacuuauaacaaacuaaaaaacuuaaaaauauucgaucagcaaauagacgacccuaauuacaauaaagauuucgagcgcauaauagaguggucuacaauauuugaagacaaagcaauuuauaaagaaaaauuaaaaacuauugacuggcuaucagaccgacaaaucgacaaacuaucaaaaaucagaaugcaagguuggggacaacuaagcaagaaacuacuaagucaacuuacagacaauaauggccagacaaucaucgaacaauuaugggacucacaaaauaauuucaugcaaaucguaaaucaagcugauuucaaagaugcaauugcagucgcaaaucaaaaccucuuaguagauacguccgucgaggacauacucaacgaggcguauacaagccccgccaacaaaaaagcaauucgacaaguaguaaaagugguagaugacauaguaaaagcgacaagcggaaaaguaccuaaacaaauagcaauagaguucaccagagacgcugaugauaacgccaaaauaucgcaaucacgagccaauaaauuacgaaaagucuacaaagaaaugagcaaugaacuagcguccgaaacuauaagaaacgaacuugaaagaguugcaaaagaucaaaaauuauuaaaagauaaacacuaucucuacuuuaugcaauuagggagagacgccuacaccggagaacuaauagacauugauaacuuagaacaguacgauauugaccacguacuaccccaaucauucauaaaggaugauucauuggaaaacagaguacuaguaaaaaaagccguaaauaacggcaaaucugauaauguuccaguaaaacuauacggaaacaggauggcaacagaccuaggaaugaccauuagacauaugugggaaaaauggaaggaacaaggcuuaauaacaaaaacaaaguacaacaacuuaaucaucgaccccgauaaaauuaacaaauaugaaucauccgguuucauccauagacaacuaguagaaacgucccaaauaauaaaacuaguuucuacgauacuacaaagcaaauauccagauacagaaaucauugucguaaaagcacgauacaaccacuaucuacgcaagagacucaaucucuauaaaagcagggaagucaacgauuaucaucaugcuauagacgcauauuuaucagcaauaugcgguaauuuauuguaucaaguauauccauacuugagaccauucuucguauacggacaauauaaaaaauucucgucagaaccagagaaagaaaaaauuauauaugauaagacaagacgguacaacuucauaagucaaaucuuugagaacaaagacaacgacaucauaagccgcgagacaaagaaaaaaguuuuugacaaaaaagauaucauagaaaaacuuaaacgagccuauaauuauaaauacauguuaguaagccgcgaaacagaaacacacgaccaagaaauguucaaaaugacuguauacccccgacuaucaagggauacaaaaaaaucacgaaaucucauaccuaaaaaaaaagacaugccaacugaaauauacggcggauauacaaauaauucagacgcauauaugauaauugcuagaauaaauaaaaaaaaaggcccagaauacagaguauuuggaguaccuaugcgagaguuaguuaauuuaaggaaagcugaaaaaaauggacacuauaaagcauacuuaaaacagguacuugaacccgaaauaauguauucaaaaaacggaaaaaaaaacaaaacaaucucaagcuucgaaauuguaaaagcgaaaguacccuacaaacaaguaauucuugacggagacaaaaaauuuaugcucgccucuucuacuuauguccaaaacgccaaacaacuuacacucucacaauauucaaugcaagccauaacagacaauugcgaaaacgacacagaagaagaaaaagcacuaguagaagcauacgaugaaauacucaccaauauagauaaauauuugccacuauucgauauaaauaaauuucgggaaaaauuacacgccggacgcgaaaaauuuguagaccuaccacuagcggagaaaaaagaaacaauacugcaaguauuaaacggacuucaugauaaugcagucaugccaaaaauuaaaucucucggauuaucaaccccacucggauucaugcaguuucauaccggggucucacuaagcgagaacgcaaaauugauauaucaauccccaacugggcuauuugaaaagaggcuaaaaauaagcgaccucuga

SEQ ID NO: 9029 - RNA, 4164 nt, Artificial Sequence
  Cas9 variant
augucggacucaaaaaaauuugaaggcgaaaauguaaaaagcggagauaaaaaaacaaacaaaaaucauggcaaaguucuaaaaaguucaccaaaagaaauaagaaaaaacaccgaauauuuuaucggucuagauauaggaaccagcucaguaggaugggccguaaccaauacagauuacgaaauacuaaaauuuaacggcaaacgcaugugggguucaagauuauucaaugaagcuuccaccgcagaagaaagaagaggacaucgugucaacagaagacguauccaaagaagaagagacagauugaacuuacuagaggagauauuuucugaggaaauggcaaaaguagauccggaauuuuucaugagacuaaaagagaguaaguuccacuuagaagacaaggacgaacgaauauuaggagaaucaaauauaaucuucaaaggaagugaagacggcgacaaaaaauacuacgaaaaauauccaacaaucuaccaccuacgccacaaacuuaugcaaucgugcgaggaugucgacauacgcgaacuauauauggcacuacaucauauaaucaaauaccguggacauuucuuauucaaaggagauuucgaagaaacugguacuucaauagaaaacauaauuauagaguuauuagagcugauaaacaauaaucuuggagucaaaaaauucgaauacaaugaaucacuuauaaacgaauuaaaaaacauaguaucaaacacaucuaacacaauaaccaauaaaaaaaaacuccugggagaauuuuucaauaaaaaagaguauaaagcgcauaagucacucuucauacuaucaauaggggccucaguaaaaccugucgaccucuuccuagaagaagaauauaaagacauagaugacauaaaaaauauaucauuuaaaaaccuagaauaugaccaaguacgagauacauaugaaucgauauuccuagacaaaaucgaauucaucgauguagcaaaacgacuauaugaugcaacuauacuauuaucaauaaaaccggaggguaaaacacuaagugaggccaaaguggauauauacaacaaacaccauaacgacuuagaauugcugaaaaagguauuaaaaacagacaaagaaaaauaugacuccauauuaaaacuagacauuaagaaagggaauaacuaugugaauuacgugaagaagagcaaaaauggcauaagcugcagcaaggaagaauuccauaaugcauugaaaaaaguacuaguuaaaauugaaaaaaccgacgauaucaaauacauacuaaaugaaauagaacuagaaagguuucuuccucugcaaagggucaaagauaacucaguaauccccuaccagauacaucgauacgaacuaaaaaaaauacuugaaaacgcaucaaaaaaauuuaccuuucuaaaugaagaauccgacggacacacaaacaucgaaaaaauaaucaaaauuauggaauaccgcaucccuuacuauguuggaccccucaaugaccaccacucaguauacaacaacggcuucgcauggguuuccagaaaaagaucaggaagaaucacaccguggaauuuugaugaaaugguggacaaagaagagagugcagaacgauucauagaaaaucucacaaauaaaugcucauaucuuauaggcgaagauguccuaccaaaagaaucuuuacuuuauucugaauuuagucuacuaaacgaacucaacaauauaaaauacgauggaauaagucucccaaucgauauaaagaaaucaauaguugaaaaaauauucagaguagagaagaaaagaguaacuaaaaaauauauaaaagaguucuuaaaacaagagggauauucugauggaaaaggagaaguuucaggaaucgacauagauauaaaaucagaccuuaaaaguuacagagacauggucaaaaucuucgggacugagauugauuaucguauggcugaaaauauaauaaaauggguaacccuauuuggcgacuccaaagaccuacuaaaaacuaaaaucaacaaagaauauggcgaaaaaguauccaaagaucaauuaaaaaaaguauguaaacugaaauauagagauuggggacgacugucaaaaaaauuccugaccggaauccgcagcucaguacuuguaaacgaugcaacaggagaaggcuauacaauaauagaagcaaugagaaauacagauaauaacuugaugcaacuacuucguaacgaguaugacuaccuaaaaaagauugaucaaauaaacaugcuaagcagaaaagacauugacgagaucagccaugauauauuagacgacuuauacuguucacccgcaguaaaacgaucuuuauggcagacuauuaaaauaguggaggagaucaaaaaaauuaugggucacgagccaaaaaaaguauucguagaaguaacacgaacaaauaaggcagauaaaaaaacaacaauaacaagaaagaacagacuacucgaacuauacagcgccauaaaugcagaauccagagauuggguuaaugaacuaaauuccacagaaguauccaaauuuaacucuaaaaaacuauaucuauauuacacacaaaugggcaaaugcauguacaccgggaaaaacauagacauagagagccuauucacggauauguaugauauagaccacauauucccccgaucaaagacaaaagacaacucauucgaaaaccuaguccuaguuacccgaaaagcuaacgcagacaaaagagacguauauccaauagauccuaaaauacaaacugaaagaaaaagccuaugggauauguuacacgauaagaaacuaauaggagacaaaaaauaugauagacuuacacgaacaacaggauucacagaugaugaaaugucaggauuuaucgcacgacaacuuguagaaacuucacaggcgagcaaagcggccgcagaaaugcuaaaacuaauaaacaaugacagcgaaauagucuacguaaaagcagaaaauguuagugacuucaggcaugaaaaugaauucauaaaggugagagaaaucaacgaccaccaucacgccaaagaugccuacuuaaacauagucguuggaaacguguauaaugaaaaauucacaaaaaacccagcaaauuacauaaagaaaggagggggaaauaauuacagucuaaauuguauuuucaacaggaaccuagacagaaauggcaaaagaauaugggacgaaaaaaagagcauugauacugucaaccgaaugaugaaaucaaacgauguacgaguaacauucaaaaauagaguagauaaaggcccuauccuuaauaaagucacaauacacaaagcaagugaauucauggaugacggaaaaaaaaacaaaaaagguuuuccaauaaaaucaucagaaaaaaauggaaacaacagauuaugcaaccuauacaaauauggugguuauaaagaucuaaacuauagccacuauaccaucgugagauacaauguguacgaaaagaaaggauuagacaucaaauauuacaugauaccgauaccguacuaccucugucuauguaauauaaaccagcacgauuauguauaugacuacauuucaaaccgaagcaaaaaagauguaaacaacauagaaauaauaguaaaugaauuaaaaauggggucacuaauaaauauagaugguuauaacuauuacuuagguggaucgaaaccuaaaacauucuacguugacccagcguaccaaauaauauuagacaaggaaauagaaaggugcauaaaagaaaucguaaaagcaaaaaacaacgaauauagauuuauaaauacggauaaaauaaauaaaaaccucaauaugaaaauauacaaauacauuguuaauaagaaaauuauaggagucuuccgaaaucgaaaaugggacaaaggggaauaccuaaacuccucagagacuauagaaaaauucuccgggcuuucagucgaaucacaaugcaauguaauauugcggcuaauaaaugauaugcgaggaucaaauaaaggcggggccaauagcaaguuugacgaacuagaaaugacaauaagucgagcagagauaccacaaacccucuccaacguuucaucauucaaaauaauuaaccaauccauuacaggauuguucgaaaaugaaguaacaauaguauga

SEQ ID NO: 9030 - RNA, 4167 nt, Artificial Sequence
  Cas9 variant
augacuaagccauacagcauuggacuagacaucggaaccaauucaguaggaugggcgguaaucacugacgacuacaaagugccuagcaaaaagaugaaaguccuaggaaacacaucuaagaaauauauaaaaaaaaaccucuugggugcauuauuguucgacagcgguauaacagcggaagggagacgacucaaaagaacagcaagaagaagauacacucgccgaagaaaucgaauucuauaucuacaagaaauauucaguacagaaauggcaacacuagacgaugccuucuuucaaagacuugacgacagcuuucugguaccagaugacaaaagggauucaaaauacccaauauuuggcaauuugguagaagaaaaagcauaucacgacgaauucccuaccaucuaucaucuaagaaaauaucucgcagauucuacaaaaaaagcugauuugagauuaguauaccuggcccuugcacauaugaucaaauauagaggucauuuuuuaauagaaggagaauucaacaguaaaaacaaugacauacaaaaaaacuuucaagacuuccuggauacuuacaaugcuauuuucgaaagcgaccucagccucgaaaauaguaaacaacuagaagaaauagucaaagauaaaauaucgaaacuagagaaaaaagacaggauccuaaaacuuuuuccuggugaaaaaaauucaggcauuuucucagaauuucuaaaauuaauaguuggaaaccaagcugauuuuaaaaaguacuucaaucuggaugaaaaagcaucuuuacauuuuuccaaagaaagcuacgacgaagauuuagagacucuacuaggcuauauuggagaugacuacucagauguauuucuaaaagcuaaaaaacuauaugaugccauauuauuaagcggaaucuuaacagucacagacaacggcacagaagcaccauuaaguagcgcaaugauaaugcguuauaaagagcacgaagaagaccuuggacuacuaaaggcauacauuagaaauauaucccuagaaaccuacaacgaagucuuuaaagacaacucaaaaaacggauaugcaggauauauagaugguaaaaccaaccaagaagauuuuuacguauacuuaaaaaaccugcugucaaauuucgaaggagcugacuauuuucucgaaaaaauagauagggaagacuuccuuagaaaacagagaacauuugauaacgguucuauaccauaccaaauacaucuacaggaaaugagagcaauaauagauaaacaagccaaguucuauccuuuucuagcuaacaacaaagaaagaauagagaaaauauuaacauuccgcauccccuacuaugucggaccacuagccagaggcaacucagacuuugcauggucuauacgaaagcgaaacgaaaagauaaccccauggaacuucgaagacguaauagauaaagaauccucugcagaagcuuucaucaauaggaugacauccuuugaccuauaccuaccugaagaaaaaguucuaccuaagcauagucuacuguaugaaacauucaacgucuauaacgaacuuacaaaaguccgauuuaucgcugaaucaaugucaaaauaucaauuuuuagauuccaaacaaaaaaaagauauaguuagacuuuauuucaaagacaaaaggaaaguaacugauaaagacauaauugaauacuugcaugcuauugacggauaugaugguauagaacuaaaaggaauugagaaacaauuuaauagcagccuaucuacauaucacgaccuccuaaauauaauaaaugacaaagaauuucuugacgacucaucaaacgaagcuauaauagaagaaauaauucacacgcuaacaauauucgaagacagagaaaugauaaaacaaagacucagcaaauuugaaaacaucuucgacaaaucuguacuaaaaaaguuaucacgcagacacuacacaggcugggggaaacuauccgcaaaacuuauuaauggaaucagagaugaaaaaaguggcaacacuauccuggacuaccuuaucgaugacgguauuagcaacagaaauuuuaugcaacuaauacaugacgaugcacuauccuuuaaaaaaaagauacaaaaagcgcagauuauuggagacgaagacaaaggcaacauuaaagaaguaguuaaaagccucccuggauccccagcaauaaaaaaaggaauccugcaaucaauaaaaauaguugacgaacuaguaaaaguaaugggaggaaggaaaccagaaucaauaguugucgaaauggcaagagaaaaucaauacacaaaccaaggaaaaucaaauagucagcaacgacucaaaagacuagaaaaaucucuaaaagaauuaggcaguaaaauacuaaaagaaaacauaccggcaaagcuaucaaaaauagauaacaaugcgcugcagaaugacagauuauaccuauauuacuuacaaaauggaaaagacauguacacuggggaugauuuagacauagauagacuaucaaauuacgauauagaucauauuauaccacaagcauuccuaaaagacaacucaauagauaauaaaguacuugucagcagcgcauccaacagaggaaaaagugacgacguacccucccuagaaguaguaaaaaagagaaaaacacuuugguaucaacucuuaaaaucaaagcuuauaucacaacgaaaguuugacaaccucacuaaagcagaaagaggagggcuuucacgagaagauaaagcguccuuuauacaaagacaacuaguggaaaccagacaaaucacaaagcacguagcccgucuauuggaugaaaaauucaauaauaaaaaggaugaaaacaacagagcugucagaaccguaaaaauaauaacccuaaaaucaacgcuuguaucccaauucagaaaagacuucgaacuauauaaaguuagagaaauaaacgacuuacaucaugcacacgacgcauacuuaaacgcagucguagcaagcgcccugcuaaaaaaauacccaaagcucgaaccugaauucguguauggagacuacccgaaauauaauagcuuccgagaacgcaaaucagcaacagaaaaaguauauuucuauaguaacaucaugaacauauuuaaaaaguccauaagccuagcagauggcacagugauugaaaaacccuuaauagagguaaaugaggaaacuggagaaaguguuuggaauaaagaaucugaccuagcaaccguacgacgaguacuaucauacccucaaguaaacguuguaaaaaaaguagaaaaacaaaaccacggccuggaccguggaaagccgaagggauuauuuaaugcgaaucucucgagcaaaccuaaaccaaacagcaaugaaaauuuagucggcgcaaaagaauacuuggacccgaaaaaauauggagguuacgccggaaucucaaacagcuuugcuguauuagucaaagguacaauagaaaaaggcgccaagaagaaaauaacaaacguacucgaauuucaaggaaucagcaucuuagacagaauaaacuacagaaaagauaaacuuaacuuccuucucgaaaaaggcuauaaggacauugaacuaauuauagaauugccgaaguauucccuauuugagcuuagcgacggaucaaggagaaugcuagccagcauauuaucaacuaauaacaaaagaggugagauccauaaaggcaaucaaauauuucucucccaaaaauuuguaaaauuguuauaucacgccaaaagaauaucuaacacgauaaacgaaaaucauagaaaguauguagaaaaucacaaaaaggaauuugaagaauuauucuacuauauacuagaauuuaacgaaaauuauguuggugcaaaaaaaaauggcaaacuauuaaauagcgcuuuccaguccuggcaaaaucauucuaucgacgaacuguguaguucuuucauaggaccaacaggauccgaacgaaaaggucuauuugaacuaacaaguagagguuccgcugcugauuucgaauuccuggggguaaaaauaccacgcuaccgagauuacacgcccucguccuuacuaaaagacgcaacauuaauccaccaaagcguuacuggucuauacgagacaagaaucgauuuagcaaaacuaggagaagguuga

SEQ ID NO: 9031 - RNA, 4167 nt, Artificial Sequence
  Cas9 variant
augacaaaaccauauucuauuggacuagacauaggaacuaauucagugggaugggcaguaauuacggauaacuacaaaguaccaagcaagaaaaugaaaguauuaggaaacacaucaaagaaauauaucaagaaaaacuuauuagguguucuacuuuucgacucaggaauuacagccgaaggccgaagauuaaaaaggacagcacgccggcgauauacuagaagacguaacagaauccucuaccuacaagaaauauuuagcacugaaauggcaacucuugaugacgcauuuuuccaaaggcuugacgacuccuuuuuaguaccugacgacaaacgagauuccaaauaccccauauuugguaauuuaguagaagaaaaagucuaccacgaugaauuuccaaccauauaccaucucagaaaauaccuagcggacucuacuaagaaagcagaccuacgauuaguauaucuggcuuuagcacauaugauaaaauauagaggucacuuuuuaauagaaggagaguucaauagcaaaaauaacgacauacagaaaaacuuucaagacuuucuagacaccuauaaugccauauucgaaucugaccugucccuagaaaacucaaaacaacuagaagaaauaguaaaagauaaaauaucaaaacuugagaagaaagaucguauauugaaauuauucccaggggagaaaaacucagguauauuuagcgaauuucuaaaacuaauuguaggcaaccaagcugauuuucgcaaaugcuucaaccuagaugaaaaagcaucuuugcauuuuagcaaagaaucauacgaugaagaucuugaaacccuacucggauauauaggagaugauuauuccgacguuuuucuaaaagcaaagaaacuguacgaugcaauucuacugagcggauuuuuaaccguaacagauaacgaaacugaagcaccacuuucuucagcgaugauuaaaagauacaaugaacacaaagaagaccucgcucuacuaaaagaauacauaagaaauauaucucuuaaaacauauaacgaaguguucaaagacgacaccaaaaacggauacgcagguuauaucgacgggaaaacaaaucaagaagauuuuuacguauaccucaaaaaccuucuagccgaauuugaaggcgcagacuacuucuuagagaaaauagauagggaagauuuccuaagaaaacaaagaacauucgacaacggaucaauacccuaucaaauacauuugcaagaaaugagagccauauuagauaaacaagcgaaauuuuacccauuccuggccaaaaauaaagaaagaaucgagaaaauucucacuuucagaauacccuacuacguagggccucucgcucgagggaacucagauuuugcauggaguauacggaaacguaaugagaaaauuacaccuuggaauuuugaagauguaauagauaaagaaaguagcgccgaagcauuuauaaaucgaaugacaaguuuugacuuauaccuuccagaagaaaaaguacuuccuaaacauagucuacuauacgaaacauuuaacguuuacaacgaacugacaaaaguuagauuuauagcagaaucaaugcgggauuaccaauucuuagacagcaaacagaagaaagacauaguaaggcuauauuuuaaagauaaaagaaaaguaacagauaaagacauaauagaauaccuacaugcgaucuacggauacgacggcauagaauuaaaagguauagaaaaacaauuuaauucaucauuaucaacauaccacgaucuguuaaacauuauaaacgacaaagaguucuuagacgauagcaguaaugaagcuauaaucgaagaaauaauacacaccuuaacaauauucgaagaucgcgaaaugauaaaacaacgacuaagcaaauucgaaaauauauucgacaaaaguguacucaagaaacucucaagacgccacuauacagguuggggaaaacugucggccaaacuaauaaacggaaucagagaugaaaaauccggaaauacaauacuugauuaccuaauagacgauggaauuagcaaucggaacuuuaugcaacucauacaugaugaugcucuaucauucaaaaagaaaauacaaaaagcccaaaucaucggagacgaagacaaaggaaacauaaaagaaguagucaaaucucuucccgggucaccagcaaucaagaaagggauauuacaaagcauuaaaauaguggaugaauuaguaaaagucauggguggacgaaaaccagaaagcaucguaguagaaauggcccgcgaaaaucaauauacuaaucaagggaaaagcaacucucaacaacgauuaaaacggcucgaaaaaucacuaaaagaauuagguaguaaaauacucaaagaaaauaucccugcuaaauuauccaaaauagauaacaacgcacuacaaaacgaucguuuauaccuauauuauuugcaaaauggcaaagacauguacacaggugaugaccuugacauugaccguuuaucaaauuaugacauagaucacauaauuccacaagcauuccuaaaagacaacucaauagacaacaaagugcuagucucauccgcaucuaacagaggaaaaucagacgauuuuccuucacucgaagugguaaagaaaagaaaaacuuucugguaucaacuucuaaaaagcaaauuaaucucacaaagaaaauucgauaaucucacaaaagcugaaagaggaggccuacugcccgaagauaaggcaggauuuauccaaagacaacuuguagaaaccaggcaaauaacaaaacacguagcccgacuccuugacgaaaaauucaacaauaagaaagaugaaaauaaccgagcagugaggacagucaagauaauuaccuuaaaaucaacacugguaucacaauuccgaaaggacuuugaauuauacaaaguacgagaaauaaacgacuuccaucacgcucacgacgccuaucucaacgcggucauagcuucagccuuacucaagaaauacccaaaauuagaaccagaguucguauacggugacuauccaaaauauaauagcuucagagaaagaaaaucugcuacagaaaaaguauacuucuacucaaacaucaugaauauauuuaaaaagucaauaucacuugcagacggccgaguuaucgaacgaccacuuauagagguuaaugaagaaacaggagaaucaguauggaauaaagaaucagaccuagcaacagucagacgaguucuaaguuauccacaaguaaauguagucaagaaaguagaagaacaaaaccacggauuagacagagggaaacccaaaggacuuuuuaaugcaaacuuaaguucaaaaccaaaaccaaacuccaacgaaaaucuaguaggagcgaaagaauaccuagaucccaagaaauauggaggcuacgcaggaauuagcaacucauucgcuguccuuguaaaaggaacaaucgaaaaaggggcuaagaagaaaauaacaaauguucuagaguuccaaggaauaucaaucuuagauagaaucaacuauagaaaagauaaacuaaacuuucucuuagaaaaaggauacaaagacauagaauuaauaaucgaacucccuaaauacaguuuauucgaacuaucagauggaucccgacgcaugcuagcaucuauucuaaguacuaacaacaaacgaggagaaauccacaaaggaaaucaaaucuuccuaucacaaaaauuuguaaaacucuuauaucacgcaaagagaauaaguaauacaauuaacgaaaaucauagaaaauacgucgaaaaucauaagaaagaguucgaagaacuauuuuauuauauacuggaguucaacgaaaauuaugucggcgcuaagaaaaauggcaaauuacucaauagcgcauuccaauccuggcaaaaucacuccauagacgaauugugcagcucauuuauaggaccaacaggcuccgagagaaaaggucucuucgaacuaacaucaagaggcucggcagccgauuucgaguuccuaggcgucaaaauacccagauauagagauuauaccccuucuucacuacugaaagacgccacccuaauccaucaaucaguaaccggauuguaugaaacgcgaauugaccuugcaaaacuaggagaaggcuga

SEQ ID NO: 9032 - RNA, 4167 nt, Artificial Sequence
  Cas9 variant
augacuaaaccuuacucaaucggacuagauauuggaacgaauucaguagggugggcuguaaucacagauaacuacaaaguccccuccaaaaaaaugaaaguccuaggcaauacuucuaaaaaauacauaaaaaaaaaccuccucggaguauuguuauuugauuccggaauaacagcagaaggaagaagacuaaaacggacagcgagacggcgauacacacgcagaagaaaucgcauucuguacuuacaagaaauuuucuccacugaaauggcaacauuagaugaugcauucuuccaacgucuagaugacucauuccuaguucccgacgacaaacgugauucuaaauacccuauauuuggaaaccuaguugaagaaaaagcauaccaugacgaauuccccacaauuuaccaccucagaaaauaccuagcagacucgacaaaaaaagccgacuuaaggcuuguauauuuagcucuugcccauaugauaaaauacaggggacacuuccuuauagaaggugaauucaauuccaaaaauaaugauauacaaaaaaacuuccaagacuuuuuagacacuuacaaugcaaucuucgaaagcgacuuaagccuugaaaacucaaagcaauuagaagaaauagucaaagacaaaaucucuaaauuagaaaaaaaagaccguauccuaaaacuauucccaggcgaaaaaaacucagggauauucucagaauucuuaaaauuaauagucgguaaccaagccgacuuuagaaaaugcuuuaaucucgacgaaaaagcaucauuacauuuuucaaaagaaucauacgacgaagaucuagaaacacugcuuggcuauauaggagaugacuacagcgacguauucaucaaagcaaaaaaauuauaugaugcuauucuguuaucgggcuuucucacaguaacagacaaugaaacagaagccccucuuucaucugccaugauaaaaagauacaacgaacacaaagaagaccuugcucuauuaaaagaauacaucaggaauauuucccuaaaaacguauaacgaaguauucaaagacgauacaaaaaacggauacgcaggauacaucgacggaaaaacuaaccaagaagacuucuauguauaucuaaaaaacuuauuagcagaauucgaaggagccgacuacuuuuuagagaaaauugaccgagaagacuuucuucgaaaacaaagaacauuugauaaugguagcauaccuuaucaaauacacuuacaagaaaugagagcgauccuagacaaacaagccaaguucuauccauuccucgcaaagaauaaagaaagaauagaaaaaauauuaacuuuuaggauacccuauuauguaggaccucuagcgagaggaaacucagauuucgcguggagcauaagaaagcgaaaugaaaaaauuacucccuggaacuuugaagacguaauagacaaagaaucaagugccgaagcauuuauaaauagaaugaccucauucgaucuauaucuaccagaagaaaaaguuuuaccaaaacauucacuacucuacgaaacguuuaacguuuauaaugaacuaaccaaaguucgauuuaucgcagagagcaugagggacuaucaauuuuuagacucaaaacaaaaaaaagauauugucagacuauauuucaaagauaagcgaaagguaacagacaaagacauaaucgaauauuuacacgcaauauacggguacgacggaauagaacuaaaaggaauagaaaaacaauuuaacucauccuuaucuacuuaucacgaccuauuaaauaucaucaaugauaaggaauuccuagacgacucaagcaaugaagcgauaauugaagaaauaauucauacacuaacuauauucgaagacagagaaaugauaaaacagagauuaagcaaauucgagaauauauuugauaaaucgguauuaaaaaaacuuaguagaaggcacuacacaggaugggggaaacucuccgcgaaauuaauaaacgguauaagagacgaaaaaucuggcaauacuauucuagauuauuuaauagaugacggcauaucaaauagaaauuuuaugcaacucauucaugacgaugcucuaucauucaaaaaaaaaauucagaaagcccaaauuauuggagacgaagauaagggaaauaucaaggagguaguuaaaucacuuccugggucccccgcaaucaagaaggggauccuucaauccauuaaaaucguagaugaacuaguaaaaguuaugggaggaagaaaacccgaaucuauagucgucgaaauggcuagagagaaccaauauacuaaccagggaaaaagcaacucucaacaacgacuaaaaagacuagaaaaauccuuaaaagaacuugguaguaagauacuuaaagaaaacauaccagcuaaacuaucaaaaauagacaacaacgcacuacagaaugaucgacuuuaccuauauuaccugcaaaacggcaaagauauguacacuggagacgaccuggauauagauagacugucuaacuaugacauagaucauauaauaccucaagcguuucuaaaagacaauucaaucgauaacaaaguccucguaaguagugcuuccaacagaggaaaaucagaugauuucccuagucuagaaguagugaaaaaaagaaaaaccuucugguaucaacuacuaaaaucaaaauugaucagccaacgaaaauucgacaaucuuacaaaagcagagcgugguggcuuauuaccugaagauaaagcuggcuucauccaaagacaauuaguugaaaccagacaaaucacgaaacauguagcccgcuuacuugacgaaaaauucaauaacaaaaaagaugaaaacaacagagcaguaaggacaguaaaaauaauaacccugaaaaguacguuaguaagucaauuucguaaagauuucgagcuuuacaaagucagagaaaucaaugauuuucaccacgcacacgaugcauaccuuaacgcaguuauagcaucagcacucuuaaaaaaauauccaaaauuagagccugaguuuguuuauggagacuauccaaaauauaauagcuuccgcgaaagaaaaucagcaacagaaaagguguacuuuuauucgaauaucaugaauauuuuuaaaaaaucaauaagucucgcggauggaagaguaauagaaaggccauuaauagaaguuaacgaagaaacaggcgaaagcguuuggaacaaagaaucagacuuagcaacaguacgacgaguccuuuccuacccacaagucaacguaguaaaaaaaguagaagagcaaaaccacggcuuagaucgagguaaacccaaaggauuauucaaugcaaaccucaguucaaaaccgaaaccaaacucaaacgaaaaccuaguuggagccaaagaauaccucgacccaaaaaaauaugguggauaugcagguauaagcaauuccuuugcaguacuuguuaaaggaacaauugaaaagggagcaaaaaaaaaaauaacaaacguacuagaauuccaagggauaucaauacuugauagaauuaacuaccgaaaagauaaguuaaacuuccuacuagaaaaaggauacaaagacaucgaacuaaucauagaacucccaaaauauucccuauucgagcuuuccgacggaaguagacgaauguuagcaagcauauuaucaacuaacaacaaaagaggagagauacacaaaggaaaccaaaucuuucuaucacaaaaauucguaaaauuacuauaccaugcaaaaagaaucagcaacacaauaaacgaaaaucauagaaaguacguagaaaaucacaaaaaagaauuugaagaacuuuucuauuacauacuagaauucaaugaaaauuacgucggagccaaaaaaaacggcaaacuacuuaauucugccuuccaaagcuggcaaaaucacucaauagaugaacuuugcucuaguuucaucggaccaacagguucagaacguaaggggcucuucgaacuuacuucaagaggaucagcugcggauuucgaguucuuaggagucaaaauucaacgauaccgugauuacaccccaucauccuugcugaaagaugcaacauuaauccaucaaagcgucacuggacuauaugaaacaagaauagaucuagcuaaauuaggagaagguuga

SEQ ID NO: 9033 - RNA, 4167 nt, Artificial Sequence
  Cas9 variant
augaaaagaaucuugggccuagaucugggaacaaacagcauagguugggcccucguaaacgaagcagaaaaugaaaaagaaauuucaaaaauaauuaaacugggaguaagaguaaauccccucacgauugacgaaaaaacaaacuucgaaaaaggaaggccacuauccaccaaugcggacagaacacuuaaaagaggagcaaggagaaauuuacaacgauauaaauuacggcgagaaaacuuaauagagauauuaauugauaaccauauuauaacuaaagaaaccccauuaaccgaaaucggaaaaggaacaacauaccaaacauuaagccuuagagcuaaagcaguacgagaaagaauagaucuugaagauuucgcaaaaguauuacuagcuauuaauaaaaaaagagguuauaaaaguagcagaaaagcaucuaaugaugaggaaggucaagcaauugaugggauggcgauugcaaaagaacuuuacgaacgcggaaucacaccaggucaguauguccuagaauuauuagaaaacgauagaaaguacaucccggauuuuuacaggucagauuuaaaacaagaguucaacaaaauauggaauaaucaaaaaacuuuuuaccccgaaauccucacagacgaacucuuuaaagaacuagauggaaagaacaaaagucagaccugggcaauaugccaaaaaccauucaauauuaaaggaaucaaacgaauaacuaaaggccgugaaaagacaauagagaauuaccauuggcgagugaaaggccucuccggaaaacuaaauuuagaaaaacuagccauuauacugcaagaaauaaauaacgacauaaaucaaucuaguggcuacuuaggggggauuuccgacaaaucuaaaaaacuauaccuuaacaaagaaaccgucggcgaauuccuauauaaacagauagcaaaaaacccccauacaagccuaaagaaucaaguauuuuaccgucaugacuaccuggaugaauucgagcaaauauggaagacgcaaagcaauuucaaugcaaaucucaccgacgaauuaaaacaggaaauaagggauguuauuauauucuaccaaagaaaaaucaaaagccaaaaaucauuaauaucauucugucaauuugaaagcugggaacaagaauacuuugauaaagaaacuggaaaaacaaaaacacgaacaguaggacgccgcguuauaccaaagucgaguccauuauuucaagaauuuaaaauauggcaaaaccucaaucaccucguauucacuaacagcgaaacugacgaaaagaucgaaauaaaagaaguagaacaggaaauccgaaaagaacuuuucgaagaguuaaaccuccggggugaccuaaacccgaaugaccuauugaaaaucuuaaggagucaauuuaaaauagggaaguuaagcaacuggaaauguaacuucgagaaaauugaaggaaacagaacaaacgcagcguuauuuaacauauaccaaaaaaucucagauuuugaagguuauggaaucgauuggaauaaaagcaacgccaagaaaauucgcaaagaauugaaagcaacauuuccugaaauaggaauugaugccucaauucuagaauuugacgcauacaaaaagcaacucacgaaccaaagcucauacgaacucuggcaucuauuauacuccgcagaagaagacuuuaaaauaucagaacaagacaaacuuaucuaugguaauucuagcgucaguuuaaaaaagaaacuacauuuaaaauuuggauuuaacccagaguaugccaaaauguuagcaaaccuaucucuuaugucagacuauggcaacuugucagccaaggcaauuaaaaaaauacuucccuaucuagaagauggccaccuauauucagaagcuugccgauuagcaggauauaaccauagcaaaagucuaacagccgaggaauuagaaaaauucgaacccaaagccaaacucgacuuauuaaaaaaaaauucacuuagaaauccaguagucgagaagauuuuaaaucaaaugguaaauguagucaaccaagucaucgacacauacggaaaaccagacggagugcggauagaacuagccagagagcucaagaagucagcaaaggaaagggccgaaaugaccaaaggcaucgcagacggaacuaggcgaaacgaagaaauaaagaaaauaauaacacaaaaauucggaauaccaaauccaacaaaaagcgaccuaguuagauacagacucuggcaagaacucgaaagcagaggauauaaagacauauucacagacaaauacauaagcccggauaaaauuuucuccucagaaaucgacauagagcauauaauaccuaaagcgcucuuauuugaugacucauucagcaauaaaacacuaaguuucagaaauguaaaccucaaaaaggcaaaucggacagcuuuagacuuuaucacacaagacuaccaguccaauguagaagcauauaaagaacgaguggaaacguggaacaaagauaaucauauuucaaaaggcaaaagaaacaaauuauuaaugucauugaaagacauaccggacggcuucauagaaagagaucuccguaauagccaauauauagcuagaaaggccaaaagaaugcuuuacgaagucuucccaaaugaaguacuagcaacuagcgggagcauaaccgacaaacucagaagcgauugggaccugaucaacguaaugaaggaacucaaucugccaaaauacaaagcuuuaggauuaacugaauacgaagaacgccucgacaaagguacggaagaauuauuuaaacacgaaguaauaaaagacuggacaaaaagaaacgaucaucgccaccacgcgauggacgcccuggcuguagcauucacuacccacaaucauauacaauacauaaacaauuuaaaugcacgcaaagacauaacacaggacaaucacccaauaauuaaaaacauugaaaaccuuauaacagaaguaaauagcaaaggcaaaagaguauucaaagcacccaugagcucuuucagagaaucagccaaggaacagauagaagccauacugguaagcuuuaaaaauaaaaacaaaguugucaccaaaaauauaaaccaaaccaaaaaagaaggcggguuuaacuaucaaaacgcaaaaacaccuagaggacaacuccacaaagaaacaauuuauggcaaaucaaaacaacccuuagaaaaaccagugaaaauaaacaauagguucugcaaaaagcaaguaggauuaaucauaaauuucaaagaacaagaagcaguccuccaucaccucaaaaaauaugacaauaacgaaaaaauagcauuuucaaauaaaacuuuaaagagugaccccauacaaguuaauggguccccauuacgagaaguaaaaauuuuugaagaaauauuuacaauaagaaaagacaucaaucccgauaauuucaaaacgcagaaacaccuagacaaaauaauagacaaaggaauaaaagaaguuaugaaaaaaagacuagaagaauacaauggcgacuuuaaaacagcuuucagcgauuuagacaaaaauccgauuuggcuaaaucagucaaaaggaauaacaaucaaacgggcuacaauuucgggagugacaaaugcagaaccauuacaccaagccaaagaccauuuaggaaacaucauuuuagacgacaacggcaaggaaauaccaauagauuacguaagcaccggaaauaaucaucacguggcaauauaccaagaugaaaguggaaauuuacaagaagaagucguaaguuucuaugaagcaguaauacgaaaaaaccaagaucagccaauuauuaaaaaaagacauccaaaagguuggaaauuuuuauuuacgaugaaacaaaacgaaauguucguauucucaucagaaaacuucaacccaagugaaauagaccuacuggaugaaaaaaaugcagcuaucauaucaccuaaccuguuccgagugcaaaaaauagcaacuaaaaacuauauguuuagacaucaucuagaaacagaaguaacuaauaaccuugauuuuacguaccgacacuuucaggcaacagaauggcuaagaaaucuaugcaaagugagaauagaucacauagggagaauaguacaaauaggugaauacuga

SEQ ID NO: 9034 - RNA, 4170 nt, Artificial Sequence
  Cas9 variant
augaucauaagaaccuaugaacuuaaaacaauaacaaccauagcuauucuaaaaauguuccaacuacuaacuggcggacuauccaugacaaaacuuggaaaaccauauggcauagguguagacauagggagcaauagcaucggcuuugcagcagucgacgaaaauagucaucuuauaagacuaaaaggcaaaacugucauuggugcuagacuauuugaagaaggaaaagccgcggccgaucggagagccucuagaacaacacgacgaagacuaagcagaaacagauggagguugagcuuucuacgagauuucuuugaaucacauauaacaccuacuggaccaaacuuuuucaugagacaaaaauauucagaaauaucgccuaaagacaaagcgagauacaaauacgaaaagagauuauuuaacgacagaacagacgcagaguucuaucaacaauaccccacuauguaucaucuucgaaaccgauuauuaacggauccaagcaaagcugacguuagggaaauuuacuuugccauccaucauauauuaaaaucacgaggacacuuucuuacgucaggauacgcaaaagauuucaauacuaauaaaguagcauuaaaugaaauauucccugcauuacaagaugcuuaugcucaaguauacccagacuuagauauaaccuucgaugaaaacaaaguuaaugaguucaaaacaguacuucuaaacgaaaaagcaacaccuagcgauacacaaagggcucuagucaaucuauuacuugcagaggauggcgauaaagauauauuaaaacaacaaaaacaaguccuuacagaauuugcuaaagccgucgucgguuugaaaaccaaacugaaugucgcucucggaacagaaguugacucaucugaagcaaccguauggaauuuuucacuuggacaacuagaugauaaaugggcuggaaucgagucagcaaugacagacgagggcacagaaauacuugaucagauucgugaccuguauagggcgcgccuacuaaacggaauuguaccugcaggaaagacauuaucacaagcgaaaguagaugacuaugcacaacaccacgaagacuuagagcuauucaaagacuaccuaaaacaacuagaagaugacggaacagccaaagccauacggcaacuauacgaucgauacauagauggagacgacgcaaaaccuuuugucagagaagauuuuguaaaagcgcuaacaaaagaaguaacagcccaucccaaugcuaaaucacccgaacugcuagaaaggcuagcccaaccagacuuuaugcuaaaacaaagaaauaaagcaaacggagcaauuccaguacaaaugcagcagagagaacuagaucaaauaauuaaaaaccaaaguguauauuaugauuggcuggcagcaccuaauccgguagaaaaacauagaaaaaguaugccauaccaacucgacgaacuacucaauuuucguauaccauauuacguaggaccacuuguaacagccaaagaacagaaagcagcacaaggcggagucuucgcauggaugguaagaaaagaucccgacggcaauauaacaccauauaauuuugaugaaaaagucgauagggaagcgucagccaacacauucauccaacgaaugaaaacaacagacacauaccuaauuggcgaagacguacuaccgaaacaaaguuugcuuuaucaaagauacgaaguauuaaaugaacuaaacaacguucgagucaacaaugagaaacuaucuauagaacaaaaacaacaaguaauacgcgaauuauuugaaaggcauaauucuguaaccauaaaacaguuugccgaaaauuuaagagcacauggggauuacgcccauauaccagaaauacgaggccuugcagacgagaaaagauuuuuaucuucacuuaguacauaucgacaauuaaaaagccuauuaccugaugcgauagaugauccugcaaaacaagcggauaucgaaaacauaauagcauggaguacuguauucgaagaugcagcaauauucaagacaaaacuaaaagaaauaaacuggcuagacucacagacaauuaccaaacuaucaaacauccgauauagagguuggggccaauucagccacaaauuucucaacggguuaacucuaggcaauggacauacaauaauucaagaacuauuuuuaaguaacaacaauuuaaugcaaauucugacagaugaaacccuacaaaagaaaaugacagaauuaaacgcagauaaacuuaaagcagcaaauauaaacgaugccauagaugacgcuuacacgagcccaucaaauaaaaaggcuuuaaggcaaguacugcggguaauagaagauauaaaaagagcugcagauggccaagauccauccugguuauacguggaaaccgcagacggcggagguacacccgguaaaagaacacgagcacggcaacaccagcuccaagaaaucuaugccaaugcugcgcacgaacuaaucgauucugcaguaagaggagaauuagaagauaaaauagcagacaaagcagauuucaaugacagacuuguauuauacuuuaugcagggaggcagagacaucuauacaggaacaccccugaacaucgaccaacuaaguuccuacgauauagaccauaucuugccccagucacuaaucaaagauaacucauuagacaacagaguucuagugcaugcuauuauaaauagagagaaaaaugcaacguucgcauccacuauuuacgcucagaaaaugaaugcaacguggagacaauggcacgaagcaggucuuauaagcggaagaaaauuaagaaaucuacaaaugagaccagaccaaauugacaaauaugcuucgggauuuguugcccgacaguuaguagaaacaagacaaauaauuaaauuaacugaacaaaucguagcagcucaauauccagaaaccaaaauaauugcugucaaagcgggccucucacaucaacuacgagaagaacuagaauuuccgaaaaacagggacgucaaccauuaucaccaugccuucgaugcauuucuggcugcaagaauuggcacauaucuacucaaaagauuuccaaauuuacaagcauucuuuacauacggcaaauuuaagaaagcugauguaaagaaauuaagaggauuuaauuucauaagagacauuacacaugcagaagauaaaaucgucguaaaagacacuggagaagucauuugggauaagaaacgugauguugaugaauuagaucguauauauaauuuuaaaagaaugcuuaucacacaugaaguacacuucgaaaaagcagaucuauuuaaacaaaccguuuauggggcaaaagauucuaaagaagcaggcggaaagaaacagcuaauaagcaagaagaaaggcuauccaguugacaucuaugguggcuacacccaagaaacagguucauaccucucaguaguacggcuaaccaagaaagccauguacgcaguuguaaaaguguccaccagagaugcugcaaaacuugccguagcgaaaucaauuuccgaacaaaaagaaaaugaaacccuuaacgauauuauagacgaaaaacuuucuaaaauuagcaaaaacggaaaaaucacacacgaacuuuuugaagucguauuaccuagggucggacagaaaacacuuuucaaaaacucaaaauauaauuuguuccugguaaauucugacacauauaugcauaauuaucaagaauuguggaugcccagagaauaccagaaaauguggaaagauauaucacucucuaaauauggagacgcccaaacggaagaucaacuagaucaaauauuugguuuuauuguaucacaagugaauagcuacuuuaaccuguaugacaucaaccaauucaggaagaaacuaaaugacgcagcagacaaauucgcuacccuaccaaugagagauacagaugauaugcaaggcaaaauagcaacuaucggacaacugcuaauuggccuacaagcaaacgcagcuagaucagaccuucgcaaucucgauauaaaaacacccuuaggacuacuccaaauuccgaacgguauaucacuagauucagauaccagugucguuuaccaaagcccaacaggacuacucgaacgagaaguacauuuaagugacuuauga

SEQ ID NO: 9035 - RNA, 4170 nt, Artificial Sequence
  Cas9 variant
auggccagggacuauucuguaggauuagacauugguacauccucaguaggaugggcugcuaucgacaauaaauaccaccucauaagagcuaaaagcaaaaacuuaauuggcgucagacucuuugauucagcggucacagcagaaaaacgccgggguuacagaacgacgagaagacgacucucuagaaggcauuggagacuaagacuauuaaacgauauauuugcugguccuuuaaccgacuuuggagacgagaacuuucuugcuaggcugaaguauucauggguucacccacaagaucaaagcaaccaagcccauuuugcagccggcuuacuauuugacucaaaggaacaagauaaggacuuuuacaggaaauaucccacaauuuaccaucuuagauuagcccucaugaacgacgaccaaaagcaugaccuacgagaaguauacuuagcaauacaucaccucguaaaauauagaggucacuucuuaauugaaggagauguaaaagcagauucagcauuugacgugcacacauucgccgacgcaauacaacgauacgcugaaagcaacaauucagacgaaaaucuccuugguaagauugacgaaaaaaaauuaucagccgcucuaacugauaaacacggaucuaaaucacagcgagcagaaacugcagaaacugcuuuugacauacuagauuuacaaaguaaaaaacaaauacaagcuauucuaaaaucuguaguuggaaaucaagcaaaucuuauggcaauauuuggucuggauucaagcgcuauaagcaaagacgaacaaaaaaacuacaaauuuuccuucgacgacgcagacauagacgaaaaaauugcugauuccgaagcauuguuaucggacacugaauucgaauucuuaugugaucuaaaagcagcauucgauggacuaacccucaaaaugcuacuaggggaugacaaaacaguaucugcagcaaugguaagacgauucaacgagcaucaaaaagacugggaauacauaaaaucccauaucagaaacgcuaaaaacgcaggaaaugggcucuacgagaaaaguaaaaaguuugauggaauaaacgcugcauacuuagcacuccaaucagacaaugaagacgacagaaaaaaagcaaagaaaauuuuccaagaugagauauccucugcagacauaccagacgacguaaaagcagacuucuuaaaaaaaaucgaugaugaccaauuucucccaauacaacguacaaaaaauaacggaacaauuccacaucaacuacacagaaaugaacuagaacaaauaauagaaaaacaaggaauauacuauccauuuuuaaaagauaccuaccaagagaauucacacgaauuaaacaaaauuacugcucuaauuaacuucagaguaccauauuacguuggaccguuaguggaggaagaacaaaaaaucgcagaugauggaaaaaacauaccugauccaacuaaucauuggaugguacgaaagaguaaugauacaauaacaccauggaauuuaagucaagucgucgacuuagauaaaucaggacgaagguucauagaacguuuaacaggaacagauacauacuuaauaggcgagcccacauuaccaaaaaauucauuacuauaucaaaaauuugauguacuucaagaacucaauaacauaagaguuuccggcagacgacuagacauuagagcaaaacaagacgccuucgaacaccuauuuaaaguccaaaaaaccguaucugccacgaauuuaaaagauuuucugguacaagcaggauauaucucugaagacacucaaauagaaggauuagcggauguuaaugguaaaaauuucaacaacgcacucacgaccuauaauuaccuaguaucaguccuaggcagagaauuuguggaaaacccuucaaacgaagaacuauuagaagaaauaacagaauuacaaacaguauuugaagauaagaaaguccuuagaagacaacuagaucaacucgacggacuuucagaccacaaucgcgaaaaacuaucccgaaaacauuacacaggauggggaagaauaucaaaaaaacuacucacaacaaaaauaguacaaaaugccgacaaaaucgacaaccaaacauucgacguuccgaggaugaaccagucuaucauugacacacuauauaacacuaaaaugaaucugauggaaauaauaaacaaugcagaggacgacuuuggagucagagcguggauagauaaacaaaacacaaccgacggagacgaacaagaugucuauagccuaauagacgaacuugcaggcccuaaagaaauaaaaagaggcaucguacaaucguucaggauauuagaugauauaacuaaagcagucgguuaugccccaaaaagaguauaucucgaauucgcaagaaaaacucaggaaucacaccuaaccaacagcaggaaaaaucaauuaaguacauuacuuaaaaaugcgggacucagcgagcucguuacacaaguaucccaauacgacgccgccgcauuacaaaacgaccgccucuacuuauacuuccuccagcaaggaaaagacauguacuccggcgaaaaauuaaauuuagauaaucuaagcaacuaugacauagaucauauaaucccacaagcuuauacaaaggauaacucccucgauaacagaguacuugucagcaauaucacaaaccgcagaaaaagcgacucaaguaacuacuugccagcauuaauugacaaaaugagaccauucuggucuguacuaagcaaacaaggucuguuaucaaaacauaaauucgcaaaucuaacacguacuagagacuuugacgauauggagaaagaacgguucauagcaagaagucuuguagagacacgacaaauuauaaagaacgucgccucucuuauagauucccacuucgguggcgaaacgaaagcaguagcaauucguucgucacuaacagccgacaugcgaagauaugucgacauaccaaaaaauagagacauaaaugacuaccaucacgccuucgacgcgcuacuauucuccacaguaggacaauauacagaaaacucaggucuaaugaaaaaaggucaacuaucagacagugccggcaaucaauauaacagauacaucaaagaguggauucacgcagcucgcuuaaaugcccaaagccaacgaguuaaucccuucgguuucgucguaggauccaugagaaacgccgcacccgguaaacuuaauccugaaacuggcgaaauaacuccugaagaaaaugcagauuggagcauagcugacuuagacuaccuacacaaaguaaugaauuuucgaaaaauaacggucacaagaagguuaaaagaccagaagggccagcuauacgacgaaucacguuaucccuccguccuucaugaugcuaaaucaaaagcauccauaaauuuugacaaacacaaaccuguagaccuauauggcgguuucucuucagcaaaaccagcuuacgcagcgcucaucaaauucaaaaacaaauuccgucuugucaauguccuuagacaauggaccuacuccgauaaaaacucagaagauuauauacucgaacaaaucagagguaaauaccccaaggcugaaaugguacuaucacacauaccauacggccagcuagucaaaaaagacggagcacucgucaccaucaguagugcaacagaguuacauaacuuugaacaauuauggcugccauuggcugauuacaagcuaauaaauaccuuauuaaaaacaaaagaagacaaucugguagacauccugcacaauagacuagaucuaccagaaaugaccauagaauccgccuucuacaaagccuucgauuccauccuuagcuuugcauucaauagauacgccuuacaccaaaaugcauuaguuaaacuucaagcccaccgagaugacuuuaacgcuuuaaacuacgaagacaaacaacaaacgcuugaaagaauccuagaugcuuuacacgcaaguccagcaucuucagacuuaaaaaaaauaaaccucuccagugguuuuggccgacuauuuagccccucccacuucacacuagccgauacagaugaauuuaucuuucaaucaguaacuggacuauuuucaacgcagaaaaccguugcacaacuauaccaggaaacgaaauga

SEQ ID NO: 9036 - RNA, 4170 nt, Artificial Sequence
  Cas9 variant
augaagaauuacaacaucagccucgucccaagucccuccggaguuggauacgcugugacagacgacaacuuaaacauaauaaaaccaguacaccauguaaguggaauagguaguagacuauuuaacgaaggaucaucaaaacaagauagaagaaacagucgaagcgcgcguagaagccgacacagacaacaaggaagaauaaaagcauuaaauucaauuaugaaagaugagauaauaaaagucgacccuaccuucuucgaccgccuuuaucagucagaauuaagcccacuagacaaaaacaaaaaauauagaaauauaauauucgauaaaccauccguugaauccuacuacuacaagaaauuuccaacgauuuaucaucuagagaaauacuugauaaauacggacggaaaagcugacauaagacuaauauacugggcacuacauucauuauuaacucaucgaggacauuucuacaauacgaccccgguaucccaauucaaaccuggcgcacuaaacauaaaagacaaauuuauagaacuaaaucaacucaaccaaguaaaaacauuugaauucucuguagcaaacacccccgaaauagaacacauacuaaaagaccgauacaucagcaaacaaaacaaaaucaaucaauuagcagaacuuuuauucgaacaagaacccgaaaaagacauucaaaaagcaaauaccaaagucgcuaaaacaauugcuaaagccauauuagguaacaaauuccaacuagacgaaauaauaggacuagauguuaauaaauccgaaaaaaaagaauggucacuucaacuuucagaccuaaacuuagacagcaaaaucgaugaacugucagacucacuaacugaucagcaauugagaauccuugaaauuuugcaagaaauguacgcagcaacuacacuccuagauauacuacaaggcucagacagccucuuagacgcaaaaauaaaaucuuacaacgaauacaaacaaaaccgacuguuguucuuugacuuauuaaaaacccuaccggauaagaaagcacacuuacucagacaagguuauacauuauaccuuaacaaccaccaucgggaccuagcgucugcaagaaaagaucuuggaauaguagcugcuacaaacuucuccaaaacagaccuauaugcacuaauuaaaaaaacauuaaaagaugaaccagaaacaccugaauccaagaagguccuaggacuaauagauaaaggugaauuccuaaacaaacaaagaacugauuuaaauaccuauaucccauaccaacuaaacgcacuaauuuuaaacaaaauucucaaaaaucagggcaaacauuacccauuuuuaauuaaagaaaaucccgccgaaccugaccgaaaagaagcucccuacgaaauaucacaauuaaugcaauuuacaauuccauacuacugugguccacucgcuacuccggaagaacaaaaaaaucucccugaaucgagccgguucggcuggcuaguaagaaaagaagaaggccgaaucaccccauggaauuucuacaacaaaaucaauguaauagaaacagcaaacgccuucauaaagagaaguauuggaaaagauacauaccuuuuaagugaaccuguacuaccagauaacaguuuacuauaccagaaauauaagguucucaacgaauuaagcucaauaucacuaguagaugccaauacgaaaaaggaaaagaaauuaacugcaaaaauaaaacaacuacuauauaaagaaggguuuaaaaaacauguaacagucucuaagaccauggcuuuaaaaauacucaacgacaacaauguaccaacguccgauauacuaggccuaaguacagguaaaaaauucgauaacucacugucuacauauaauucauggaagaaagcguuucccgagcaaaucgacaacccacacuaccgacaagauuuagaauacaugauagaauggucaaccguguuuacugacaggaaaauacucguagaaaaacuuaaggaaauagaauggcuuaggccugaacaaauaaaauucgugcuagaacauagguuaacaggcuggggcaaguugagcaaacgccuucucguggaacucaaagacaacaaaggcaaaucgaauaucgauaaccucuucaacacaaaaaaaaacuuuaugcaaauagucucccaacaaguuuacaauacacaaauagaagcaauagccuuaaaaacaacaaaaaaucaaucgcuagauaacauauuagaggcagcauauacuucuccagcuaaccgaaaagcaauacgacaaacaaugaaaguuguaaacgaaauaguuacccucgcaggaaaaggaacacaucccgacaaaauauuuuuaacuuuccaacgaagcaaagaacaagaaggaaaacuaacaaccgaccgagccagcagucuacuaaaaauauaccgagguauaaaagauccacuuugcacaaaagagcucguggaugaacuaucgaaaaacgucagagcuaauuuaaucaaaacaaaagaauaucucuauuaucaacaauuaggacgcgacgcacuaaccggagaaauaauugacaaaaccgacuuacgaaauuaugcagugcuacauaucauaccacgcuccguaguaguagaugacucaauuaacaaccucguacuaacaaaaguaaaaaaugcaaaagaaucaauuguuguacaauauggaagcaaaaauaucuccgacauuagcaugagcgugaaagauuucuggaaccgacuacagaaacuuggccucuuuucaaagggaaaacuucgaaaccuaaccacugaucucacagaacuaaaccaauacgaaaaacaagguuucaucgcaagacagcucguggaaacuaaucaaauaguaaaguuacuggcgacaauacuacaagggcaauucccucauacaaagauuauagaaguucgacaagagcaaaucgcaaacaucagguaucaacuagacauauacagacuacgcgacuuaaauguuuacuaccggggcauggaugcauacuuagcugcaguuguaggaacauaccuguacacggucuaucccaaagcccgaagauucuucguauauggcaaauaccuaaaacaggacaaaaacaacagagaagaaggacaguucaaaacgucaggucacucauucaauuuccucuggaagcuauucuacgguggugaagacgaaauauauguucagggaacaaacaacaucgcauucaauaaaaaggaucuucuacagaaaauuaaagaagugaacaauuacaaauuccaaaacgugucacuagcuacaggaacgagacgaucugaccuuuucaaacaaacuauuuauccucgccaagagcgggacgugaaaaaaucaagaacccuaauaacaaaaaaaaacggacuauucacagauauauacggaggauacacaggaaacguaaauaguuacuuuguacuuguucagacaaaauacaagaaagauccagauaaauucaaucuguacggcguaccaaacagauauguugcgauguuagaacaaucaaaaucaaaaggaaauuacgaaacaaaguuaaaagaagucauggaacccauaaucaaaaacucuaacaaacgaaugauaggcuauaaaauacucaaagauagaauacucuacaaucaaaucauagaagacaacggguauaaauucuuuauaacaucaucgcaauaucgacauaacuuuagacaaaugauacuaucggaccaaagcaagaaaauacucauggauuacguauuugaccccaauuuuuaucgacacaaaaaaacggaagacguuaacaacgauaaagaugcaaaacuaauaaaaguauaugaugaaauuuuauaccaaauugaucauuacuuacaaauauuuacaauaggacaucacaucgauaaacucaaaaaagcccgaccucuauuugaaaaguguacacuagcagaaaaagcccagguacuuaaugacauacuaauaauagcagggucaaaccaaacugaacuggcguuaaaaccgcuuaaaacaacaaaauuaacauucucaaaacaaaauugcccauuaaccaaagacgcaauauuuuacuaccaaucuccaaccgggaugauaacaagaaaagaaucaauaaaagacauccuaaaacaaaacauauga

SEQ ID NO: 9037 - RNA, 4173 nt, Artificial Sequence
  Cas9 variant
augaguaggaaaaauauaguugaagauuaugcaaucagucuagauauagguaaugcaagcguaggguggguagcauuuacaccuaauuaucguuugguacgugcuaaaggacaugaauuaauaggagcaagauuauuugaaccagcaucaacagcugaagaaagaagaauggcgagaacaacaagacgacgauacucacgaagaagauggcggcuacgaauguuagauucuauguucgaucaagcccuauccgaaguagauccauccuuuuuaaugagaagaaaauacucaugggugcauccagaagauaaaaauaaugaagcucacugguuuggaggcguacuauucgauucaaaugaacaagauaaacguuuuuaugaaaaauauccaacgaucuaccaccucagaaaaucacuaauggaagaugaugaaagacaugacauacgagaaguauacuuagcaauacaucauaugaugaaauacagaggaaacuuuuuaacugaaggagaauuagcaccaucaucaguuuuugacguagaagacuuuuuaaaacuacuuacggaaauucuucaauacgcagacgaaggugaaacggacgaagacuuagaacuacaagccgacgcaaacggccugacagaagcgcucuguacgacuaaaggaucaagaagcauaagagccaaaaaugcaaucucgaucuugaaagaaggugcagcacuuucgaaaagacaggaagcaauaauaagcgcaguauuugccggacuggaaggaaauaaacuugaccuaacaaaaguauuuccaaauaaagaauacacaccagaagacaagaaaacucuggcuuuauauuucaauaaagcagacuacgacgagaaaagaguugcaauaggcgacaguggacuacuagaagauaacgaaugugauuuccuagauuguauacgaagacaauauucagcuauagcauuaaaacaauuacuaggugauuucacuucuaucucggaaucgaugugcgcccgauacgagcaacaucaacgaaacugggauuuaaucaaacgguacugccgagaagaaagcaaugcagaaaauauuaauaaaaauuacggggcuuuaguaggaugggaaauuguaggaggccagagacgaucuauuagaggagcaaaagauuaugaaaauaaacgaaaagccgccaacaaauucuuugaggaguuaauuaaagggucugcuuuaccggaccaagaaaaagaaagacuacuacacgacauagaaaaugaugaauuauuuccaguacaaagagauaguggaaacggaguuauuccuuaccagcuccaucuaaacgagcuaaagaaaauaauucaaaaacaaggaagauacuauccauuuuuauuagaaaccuacauaaaagauggcaaagaagugaacaaacuugaaggguuacuagcauuuagaguaccuuauuauguaggaccucuagugagucgagacgacaugcagucaucagauaaccgugaaaaucauuggaugauacgaaggaagaaagguguuauuaccccauggaauuucgaugaaaugguagauaaagauaaaagugggcaugaauuuauaaaaagucucgucgguacugauucauauuuacuaggugaaacaacuuuaccgaaaaauagccuuuuauaucaagaauuugaaguauuaaacgaacuaaauaauguacgacuuucuauaaggacagguaaccacugggcugacaagagacgaguucgacuuggacacaacgagaagaaacucuuacuagaagaacucuucgcaaaacaggcaaccguaaccaagaaagcagcggaaaaucuauuaaggcgcacauacggaaacacuuaugaaauuaguggucuagccgaugagaagaaauuugucagcucauuaaguucauauggaaaaaugugcagaaccuuaaaagcaagcuacguaaacagccauaaagauguaguugagaaaauaauagaacuacaaacaguauuugaagauaagaaaacccuuaaacaccaauuacaguuauuaggagaacuagcagaaacaaacugugaacuccucaguaauacacauuauacaggcuggggcaaacuuagucgaaaacuacuaacuagcaaaguggugguuugcaaaauuggcaaugacuuugcaccagcaaagcacagcauaauagaaaucaugcgagaaacagauaggaauuucauggaaauaauaacagauaaagauuugggagucggagaauggauaaaucaacaaaacguuggcgcugaagauggaaacagcuaucaagauauaauagaugaucuuagaguaagcccaaaagucaaaagagggauaaaccaagcaauaaggguaauagaugacauuucaaaagcgguaggaaaggaaccaucgaggauauuucucgaauuggcaggagacgugcaacaaucggcaagaacuguuuccaggaaaucgagauuacagggacuauacaaguccgcaggauuacaaaaagaauuuagagaucuugcagaaaguuuaaacgaaugcagugauaacgaucuaagagaugaccgacucuuccuauacuacacacaacuaggaaaagacauguauacaggcgaaccccuaaauuuagaucgucucuccagugauuacgacauugaucauauaauaccacaggcagucacacaaaaugacucauuagauaauagagucuuaguugcacgaguugcaaacgcuagaaaaaccgauucauuccaguaccuaccagaaauagcaaaccggaugcgaaauuuuuggcaagaacuacucgaugcaggucuaauuagucgcgucaaauuugaccgucucaaucgacaaaacgauuucaguucccaugaaaaagaaagauuuguacaacgaucacuugucgaaacaagacaaauaaugaaaaacguagcaacaauuaugagaaaacgauacggaaauucagccgccgucauaggauuaaacagugaauuaacaaaggaaaugagacaauacuuaggguuuagucacaaaaaccgggauauuaacgacuaccaucaugcccaagacgcgcuaugcuuaggcauagcaggacaauucgcagugaaucguggauucuuugcaaacggcaugguauccgacggagcaguaaauucguauaaccuauauuuacaagauuaucuaagagguuacagagaaaagaugucagcaggagaaagaagaagaaacaaagcauucggguuuauaguugguaguaugaacucucaagacuccgauaaaagaauuaacccaaaaacuggagaaauagcaugggaugacgaagauaaaguguaccugaggaagguaaugaauuauagaaaaauguuaauuacacaaaaaguaggagauucauuuggagcucuauauaaugaaacgcgauacgggacaagugcuaaagaaggaguuaaugggauaccauuugacaagcauaaacaagauacugcuuuauacggagguuucucgagugcaaaaacuguauaugucguacuaauagaagcaaagaagaaaaccaggcuaguaaacauaacaaugcaagaauaugcggaauugggagaucauccuagcgacgaugcacugagagcuguuuuagcuaagaagaaaccagaguacgguaaagcuagaauccuacuuagacauauacccccaaugcaacucauacgauauggaggugcauuaguuacaguaaagagugccaccgaauuaaauaacgcacaacaauuguggcuuccauacaaagaauauuguuuguuugaugacguuauaucuagcgcgauagacguagacgaagccaggcucugucaaaugcuagacguaauuuuagacgcuauucaaaaauacuauccaaaacaaagguuugacgagacaggacuauccgcauuccacaacgcuuuuaaugaaguuagugcagaagauaagaaaagaauaguaggugaaaugguaggaauguuacaugcugaugccaaaaaugcaaaucuuaaagcgcuaggaaugucaggaagauggggccguauguccaaucaaucaggauauacuuuugcggacucugaugaauuuauauuccaaaguccaaguggacuauucgagaaaaggauaagugucggggaacuuaagaaaagaagggccagguga

SEQ ID NO: 9038 - RNA, 4173 nt, Artificial Sequence
  Cas9 variant
augaaagagguaaaagacuacauaauaggccuagacauaggcaccaauucaugcggauauguaguaaccgacaaacaaaauaauauacuaaaguuaaaaggaaaaacagcaauaggcgcaagauuauuuaaagaaggggaagcagccgcagauagaagagcuuuuaggacaacaagacgacgacucgcucgacgucgauggcguuuagguuuacuugaggaaauauucgacgaagagauggcaaaaguagauucauccuuuuuucgacgcuuaaaagaaagugacuauucaccuaaagauucgcguaaacaauuuaacucaauaguauuugaaucaucagaagcagauaaagacuucuacgacaaguacccaaccauauaccaccuacgcaaugcacucaugcacgacgaccagaaacacgacuuaagggaaauuuuucuagcagugcaccauauuguaaaguauagaggcaauuuucuucgcgaagauucggucaaggcauucaaagcggcgaaguuuacgcuucaaggagaagacgguauuggccccguugacaaacucaacgaccuccuuaaagaaauuuacauugaagcugcaccugagcuagcuacagacaaccuaaguaaaauagaagaaauaauaaaagacaagaaauuauacaaacaagacaagcuaaaacaaguagcaacacuauugacuaaagaagccgauacaaaggauaaagcuaaacucaauaaagauguagccaaacaaguagcaaaugcauuuaugggauacaugaucauauucgacacaauauuuaaucuaucagauguagacaguaaagauuacaagguaaaauucagcgaugcaaacauugaugaaaaauuagauaccuugacaagcuuauugacugauaagcaaacagaauucguacuugaacuccaaaacauuuacaauaccaucguacuaaacgaaauuguuccagaugguaagagccuuucugaaaguaugguaaaaaaauacgacgaucauaaagaagaucuaaaauuauuuaaagcuuaucuaaacaguuuaaccgacguaaaaaaaguaaaagaacugaaagcugcauacguacuauacguaaacaacagaaaagcuaacuuauuagcugcuaaaaaauuacuugggaagaaggcagacaauaugaauaacuucgaaauauucucuaaguucguagccgacaauuuagacgacagugaauuagcuaacaaaauucgggcaagacuagaccuuggagaauuuuuacccaaacaaagaacuaaucaaaacggagucauaccauaucaacuacaucaaguagaacugacacaaauauuagaaaaacaaggaaaauacuauccauuucuuauugcgccuaaccccgucgaaucucaccguaauaaugccccauacaggaucagcgaacucguaaguuuccgaguaccauacuacguuggccccuuaauugauccaaacaacgcugaaagugaacaagauaaagccaauaguucauucgcuuggaugguccgucaaaaacaaggacaaaucacaccauggaacuuugaagaaaugguagacacaaccgaaucagccaacaaauuuauaaaaagaaugacaacuaaagacacauaccuccuaggagaagacguuuuaccagccagcucacuuauauaucagaaauucguuauacucaacgaacuaaacaacauaaaaguuaacggcauaaaacucaccagugaagaaaaacaccaaauauucgaugaauuauucaaagugcaaaaaucagugagucuaaaaaacuuaguaaacuuucuaacggcccauggcuguguagcuccuaauguaacaggcuuauccgacggaaccaaauuuaauucuucuuacuccaccuauauagauuaccguaaaaucuuuggagcagaaauagacaacaaagacaaacaagcagacuucgagaaaaugauagaaugguccaccguuuucgaagaucgaaaaauuuucaaaagaaagcuagaagaaauuacauggcuuacaccagaccaaauaaaacaaguaaguuccaaacgauacuccggaugggguagauuaaguaaaaaauuacuaacacaaaucacagacgaaaaugggguaaacauacuucaacgacuauggaacgagucugaaaaucugaugcaaauacucagcgaucccguaaucaaagaaaaaauaguagcagcuaacuccaguuuuaccaaagcaaccgacauggaggacauauuagcagaagcauacacaucaccacagaacaaaaaagcaauaaggcaaguaaugagaguaguagaugacauaaucgccgcagcacaugguaaaaaacccagucaaaucgccauagaauucgcaagagaagaucaagacaacccacaaaugacaaaaucacgaaaagcccaauuagaucaaaucuacgccaaaauaucagacgaauucuuagacaaugcggucaagaacgaauuaaaaaauaugaaagacaauaaaccacuagcaaaagacaagguauuucuauacuucaaacagaugggaagagaugcauacacaggcgaaaaauuaagucuagacaaucuccaagacuaugacauagaccacauauacccacaauccuuuauaaaagacgauucauucgacaacaggguccuaguucaacgugcaguuaacaacgggaaaucggauaacguacccguacugcuauuuggaaacaagcaagcagccgacuuaggaaugacaaucaggcaaauguggaaaaaauggcuugaauuaggguuaauaaguaaaagaaaauucaacaaucuaaucacugaucccgaaaaaauaucaaguuacauggcauccggauucguaaaucgacaacuagucgaaacuagccaaguaauuaagcuaguugccaacauuuuacaagccaaacuaccugauacagaaauaauagaaguuaaagcaaguuacaauaguauauuaagaaaagaauuuaaucuuuacaaaagcagagaagucaaugacuaucaucacgcaauugacgcauaucucacaacaauuguugguaacuauuuguaucaaguuuauccuaagcuaagaccguauuucgucuauggccaauuuaaaaaauucggaaaggcugaaucaaaagaagaugacccaguuaaaaaaauaaaacaguucaauuuuaucuaucaguuacuauggggaaaagacgaugcaauauguauuucacauaccgaucaacaaguguuuagccgauccgacauaauaaacaaacuaacgacugcauacaauuucaaauauaugaacgugucacaagaaguauauaccaacucaaacaacguuuucaaacaaacagucuucccaauaaucgaacgagauacugcuaaaagcagaagccuaauuccgaagaaauuagaccgaccaacagacaucuacggcggguauucaaacaauaacgacgccuauuuggcacuuguaaaaguagauaaaaagaagggaagugaguacagagugguagguaucccgaugagagcagcagcaaugcuaaaagcaucaaaaaacuaugacgaagaccugcgaaaaguuauagaaccaauggucauguuagacaaaaacggcaaagcaaaacgcggaauugaagguuuccggguacucguggguaaaaugcccuuuaaacaagcaguucuugacggugacaaaaaauucaugcucacaggcacaaaugauaugccaaaccuaaaacaauuaguccuaucccaacaaaacaugaaauauauacuagacuauauagacgacauagauugcagaaaacauaaauuuggaaauaagacgcaagacggaaauaaauguuuacuagaaguauucgaugaaaucauacaaauaguagacaaacauuuugaacucuucgacaaccggucauuuagagaaaaacuccgcaauagucgaguaaacuuuauuaaccuagcccuuaguaaaaaagcagaagcuuuacucgcaauacuaaacggguuacaugcaaacuccaugagaacaacgaucaaggaacucaaaauuagcgacuuagguagaauccaauccucaguaauaucuccagaagcacaguugaucuaccaauccccaacaggacucuuugaaaggcgaguaaaagucaaagauuuauga

SEQ ID NO: 9039 - RNA, 4176 nt, Artificial Sequence
  Cas9 variant
auggaaaacaaacaauauuauaucggccuagacguaggcaccaacagcgucggaugggcaguaacagauacaucuuacaaccucuugagagcgaaggggaaagacauguggggagcgcgauuauuugaaaaagcgaauacagcagcagaaagaaggaccaaaagaacuagucgaagaagaucugaacgcgaaaaagcacguaaagcaaugcuaaaagaacuauuugcagacgaaauaaaccgaguagauccgagcuucuucauacggcuagaagagagcaaauucuuuuuagacgauaggagugaaaauaaccgucagagauauacccucuucaacgacgcaacauucacagacaaagauuauuaugagaaguacaaaacaauuuuccacuuaagaagcgcccuuauaaacucggaugaaaaguuugacgucaggcuaguuuucuuagccauacuuaacuuauuuagccacagaggacauuuccuaaaugcgaguuuaaaaggagauggagauauacaagggauggauguauucuauaacgaucuaguugaaucaugugaauacuuugaaauagaacuuccuaggauuacuaacaucgauaacuucgaaaagauacucucacaaaaaggcaaaagucgaacaaaaauauuagaagagcuuagugaagaacucaguauaagcaaaaaggauaaaaguaaauacaacuugauuaaacuaauaucaggucuagaggcuucaguaguagagcuauacaacaucgaagacauucaagaugaaaacaaaaaaauaaaaaucggcuucagagagagugacuacgaagagucgucacuaaaagugaaagaaauuauaggagaugaauauuucgaucuaguagaacgagcaaaaucaguucacgauaugggacuucuauccaacauuauaggaaauucuaaauaccuuugugaagcaagaguugaggcauaugaaaaccaccauaaagaccuucucaaaauuaaagaauuguuaaaaaaauaugacaaaaaagcauauaaugacauguuuagaaaaaugacagauaaaaacuacucugcguaugucggcucaguuaauucaaacauagcgaaagaaagaagaagcgucgacaaaagaaaaaucgaagaccuuuauaaauauaucgaagauacugcauuaaaaaauauaccagacgauaacaaagacaaaauagaaauauuggaaaagauaaagcuaggcgaauuccucaaaaaacaacugaccgcaucaaauggagucauaccuaaccaacuacaaagccgagaauuaagagcaauccuaaaaaaagcggagaacuauuugccuuuccuuaaagagaaaggagaaaaaaaucuaacaguaucagaaaugauuauacaauuauuugaauuccaaaucccauauuacguaggacccuuagacaaaaacccaaaaaaagacaacaaagcaaauaguugggcgaaaauaaaacaggguggaagaauucuaccauggaacuuugaagacaagguagaugugaaaggaucaagaaaagaauuuauugaaaaaaugguaagaaaguguacauauauaucagaugaacacacacuaccaaaacaaagucuguuauaugaaaaauucaugguucuaaacgaaauaaacaacauuaaaauagauggugaaaagauuucaguagaagcaaaacaaaaaaucuacaaugaccuuuucguuaagggaaagaaagucucacaaaaagacauaaaaaaagaauuaauaagucugaauauaauggacaaggacagcguccuaagugggacggacaccguaugcaaugcauauuuaucgaguauaggaaaauucacuggagucuuuaaagaggaaauaaauaaacaaagcaucguagauaugauagaagauauaauauucuuaaaaaccguguauggcgaugaaaaaagauuuguaaaagaagagauaguagaaaaauacggcgaugaaaucgauaaggacaaaauuaaaagaauacucggcuucaaauucagcaauugggggaauuuaagcaaaucuuuccucgaauuagaaggagcagacguagguacgggagaggucagaucaauaauacaaucauuaugggagacuaauuuuaaccuaauggaacuguuaucgagccgguuuacauacauggaugaauuagagaaaaggguaaaaaaauuagagaaaccuuugucugaauggacgauugaagauuuagaugauauguaccuaucaucaccugucaaaagaaugaucuggcagaguaugaaaauaguagaugaaauacaaaccguaaucggauacgcuccaaaaagaauauuuguagaaaugacgagaucugagggcgaaaaaguacguacaaagaguaggaaagaccgucugaaagaauuauauaauggaaucaaggaagauucaaaacaauggguaaaagaauuagauaguaaagaugaaucauauuuuaggucgaaaaaaauguacuuauacuaccuucaaaaagguaggugcauguauucaggcgagguaaucgaauuagauaaauuaauggaugauaaucuauacgauauagaucacaucuauccacgaucguuuguaaaagaugacucacucgacaaucuaguuuuaguuaaaaaagaaaucaauaauagaaaacaaaaugacccaaucacaccacaaauccaagcuaguugccaaggauucuggaaaauucuacaugaucaagguuucauguccaaugagaaguauuccagauuaacucgaaaaacacaagaauucucggacgaagagaaacucaguuucauaaauagacaaauaguugaaacuggacaagcaacuaagugcauggcacagauauuacaaaaaucaaugggcgaagacgucgauguagucuucuccaaagcaagacucguaucggaguuccgacacaaauucgaacuauuuaaaucgaggcuaauaaacgacuuucaucaugcaaacgacgcguaucugaacauuguaguaggaaauucauauuuuguaaaauucacacgcaauccugcaaauuuuauaaaagaugcacgcaaaaacccggacaaucccguguacaaauaucacauggacagauuuuucgaaagagacgucaagucaaaaagugaaguagccuggaucggucaaucagaaggaaauaguggaacaauaguaauaguaaaaaaaacaauggcaaaaaauucgccauuaauaacuaaaaagguagaggaggggcaugguaguauaacaaaagaaacaauagugggaguaaaagaaaucaaauuugguaggaacaaagucgaaaaagcggauaaaacaccaaagaaaccgaacuuacaggcguauagaccaauaaaaacgagcgaugaaagacuauguaauauauuaagguauggugguagaacaagcaucaguauuucgggauauugucugguagaauauguuaaaaagagaaaaacgauccgaucauuagaggcaauuccaguauaccuuggaaggaaagacagccugucagaagaaaaacuccuaaacuacuuccguuauaacuuaaacgacggagggaaggauaguguauccgacauccgucuaugccucccauucauaucaacaaauuccuugguuaaaauagauggcuauuuauacuacuuaggaggcaaaaaugaugauagaauacaauuauacaaugcauaucagcuaaaaaugaaaaaagaagaaguagaauauauacgcaaaauagagaaagccguauccaugaguaaauucgacgaaauugaucgcgaaaaaaauccaguccuaacggaagaaaaaaacauagaauuauauaauaaaauacaagacaaauucgaaaacacaguuuuuagcaagagaaugucuuuaguaaaauacaauaagaaagaucugagcuucggagacuuucuaaaaaacaaaaaaucaaaauucgaggaaaucgacuuagaaaaacaaugcaaaguauuauauaacauaauauuuaacuuaagcaaccugaaagaaguagauuuaagugacauagguggaucaaaaucgacaggaaaauguagaugcaaaaagaauauaacuaacuauaaagaauucaaacucauacaacaaaguauaacaggauuauauaguugugagaaagauuuaaugacaaucuga

SEQ ID NO: 9040 - RNA, 4176 nt, Artificial Sequence
  Cas9 variant
augaaagaaauaaaagauuauauuauuggauuagacaucgguacaaacucauguggauacguuguuacagacaaacaaaacaauauuuuaaaacuuaaaggaaaaacugcgauaggcgcacgucucuucaaagaaggcgaagcagcagcagauagaagggccuucagaacaacacgaagacgauuggccagaagaagauggagguuaucuuuguuagaagaaauauucgaugaagaaaugaauaagguagacccaagcuuuuucagaagacuaaaagaaucagacuacuccccaaaagaucgacgaaaacaauucaacagcauaguguucgaaaguucagaagcugauaaagcauucuacgagaaauacccaaccauauaccaucuaagaaacgcauuaaugcacgauaaucagaaacacgaccuucgagaaauauuccuagccguacaccauauaguaaaauacagaggaaacuuucuccgcgaagauagcgucaaagcauuuaaagcagccaaauuuacguugcaaggcgaagacggaauaggaccaguagauaaacuaaacgacuuacuaaaagaaauauauauugaagcggcacccgaacuagcuacagauaaucuaagcaaaauagaagacauuauuaaagauaaaaaacuauauaagcaagauaaauuaaaacaaaucgccaaucuacuaccaaaagcggucgacucaaaagacaaagcuaaauuaaacaaggauauugcaaaacaaguugcgaacgcuuuaaugggauacauguuccgauuagauaccuuauucucauucaccgacguagauguaaaggauuauaagcucaaauuuucagacgcgaacaucgaugaaucacuugacgcccuaacuucgcuucucacugacgcucaaaucgaauuuguacuugaacuacaaagcaucuacaacacuauuguacuuaacgaaauaguaccagauggaaugagucucagugaaaguaugguuaaaaaauacgacgaccacaaaaaagaucucaaacuauauaaagaauauauagacucccuaagcgaccagaaaaaagcaaaacaacuagaggcggcauacgcacucuacguaaauuaccgaaaagcagaucuacuagcagcaaaaaaacuauucgaaaaaaaaaaaauuggugauaaaaaauucguggauguaaucagcaauuuugaagucuuuggaaaauucguuucggacaaccucgaugauagcgaauuagccaauaaaaucaaagcaagacuggacuuaggcgaauuccuaccaaaacaaaggacaaaccaaaauggaguaauaccauaccaacugcaucaaguugaacuaacgcaaauccucgagaaacaagguaaauacuacccguuccuaaucacaccuaacccaguagaaagccaccgaaacaaugcgccuuaugagauaucagaacucguaagcuuuagaguccccuacuauguuggaccgcucauagacaaccaaucaaucaaagauaagcagaacaagaauaaauuugccuggaugguuagacaaaaacaaggccaaauuaccccauggaauuuugaggaaaugguugacaccaccgaaagcgcaaaucaauucauuaaaagaaugacuagaaaagauacauacuuacucgccgaagacguccuaccaaaaaguagccuaaucuaccaaaaauuuaugauucucgacgaacuaaacagaauuaaaaucgacgguaaaaaacucacuucaaaacuuaaacaugauauauucgaaaaacuauucaaaaaacaaaagucaauaaaccucgauaauuuaaaaaauuacuuacucgccgaggggaauaucccagggcugauagaaggacuaucagacggcauaaauuucaauaauucauuuucaacuuacauagacuacagaaauaucuucggagaugaaauagacaauccaaacaagcaggcggacuuugaaaaaaugauugaauggucaacaguauucgaagauagaaaaauuuuuaaaagaaaauuaaaagaaauaaccuggcucacaccagaacaaauuaaacaaguauccucaaaaagguacagcggcuggggaagauuaucuaaaaaguuacuaacacaaauaacugacgaaaauggagucaacauauugcaaagauuauggaacgaaccagaaacacuaacggagguccuagcuaaccccguaauaaaaagaaaaauaucagaagccaauagccucuucguccaaauaaauaaaguagaaaacauucuugaugaugcauacacauccccccagaauaaaaaagcaauacgacaaguaauccgcguggucgacgauauaauagcugcagcgcacgguaaaaaacccagccaaauagccauugaauuugcuaggaguucacaaaacaaagcgaaagucccagacacacgaaaaaagcaacuugacaagaucuauaacaaaauaucaucagaaauacuugacagcuccauaaaaaacgaauuaaaaaacuuaaaaucaaauaaauacuuaucaaaagauaagcucuuccuauacuuuaagcaaaugggucgagacgccuauaccggcgauaagcuaagccuugaucaauuacaaaauuacgacauagaccacauauuuccacguuccuucauuaaagacgacucacuagacaaucgaguucuaacucagaaaccaaucaaugcaaaaaaaucggauuacggcauaccagcacuagaguuuggcaacaaauacguuccagauuuaggaaucacaguaaaagaaauguggaaacuguggcaagaaaauggacucauaucaaaaucaaaauuaauuaaccucugcacaaacccaaaaaaaaucggcagcaaaagggcuucgggauuuauaaaucgccaacucguggaaacgucacaagugauaaaacuuguagcuaucauacuacaggcagaauucccugacacugaaauaauagaaguaaaagcauuacaaaauacuacacugcgagagucauuucaucucuacaaaaaucguagcgucaaugauuaccaucacgcaaucgaugcauaucucacaaccauaguugguaacuauuuauaucaggucuacccgaaauuacgaccuuacuuuguauacggacaguuuaaaaaguucaaccaagaaaaaaauauugauauauuaaaaagacuaaaaaacuuuaauuucuuaagacaauuaauauuuaacacagacgauaacauauacauaucaggcacaaaagaaaucguauuuaacaaaaaggacauuauucauaaauuagagacugcauauggguauaaauacaugaacaucucacgagaauguuaccaagaaacgagcucgcuauuuaaccaaaccuuauacgcucacaauuccucgguaaaaaauucacucauuccaaaaaaaaaagggcucccaacggaaauuuaugguggauauaguggcaacaaagacuccuucuucguccuaguaaaaaucgucaaaaaaagaaccaaccucuacagaauugucggaauuccgacacgugaacuugcaaaacuaaauucaaguaauaacuauaaccaagcuuuaaacaaaauaguagaaucuaaacuaugccuuaaagaaacagagucauucaaaauucugauaaaaagacuauuauacggaacauuaauaguagacaauggacagaaauuuagaauugguucuuuuaaagaaaaacauaacguacaacaacuuguacuucaacuaaaaagcaugaaauacaucaaauucuauauagauggaggacaaaacuacuuuacggacguugaaaggaaaaaauuagaaaaacaagacagggauaaaugcuuauuauacguauucgacgacauaaugaauguaguaaauaaacgcuuuacacuauucgacaugaguaaauacgaaaaagacggagacucauuaagagaaaaauucaauugccucgauuucaacgacaaaguaaguauuuuaucugauuuacucaaagcauuccacgcaaacucagauagaacaucaaucaccaaauuaaaaauaacaaaccuaggaaggcaucaagcaggaaaaaauggaauaacauuaacuacaaacgcacaaauaaucuaucaaucccccacuggguuauucgaacgacguaucaagaucaaagauuuguga

SEQ ID NO: 9041 - RNA, 4176 nt, Artificial Sequence
  Cas9 variant
augaaaaagauacucgggcuggacuuaggaacuaauucaauaggaugggccuuaguuaacgaagcagaacacgaacaugagcaaucaaguauuguaaaauuagggguaagaguaaauccacuaaguguagaugaaaaaaccaauuucgagaaaggcagaccacuuucgauaaacgccgaccgaacaucaaaaagaagcgcaagacgcaaucuccaacguuuuaaauuaagaagaaaaaacuugauuaaccuacuacugaagcaccacauaauaagcaaugaaaccauccuuaccgaagucgguaaaaauacaacacaccagacacuaaaauuaaggucaaaagcuacccaagaaaaaauaucuuuagaagaauuugcccgaauauuauuauccauaaauaaaaaacgaggauacaaaagcagucgcaaagaaaagaaugaagaugagggauuuaccaucgauggcauggcaauagcuaaagaauuauacgauaaccaauuaaccccgggccaauauguuuacaauauacuacaagacgggaaaaauuacauaccagauuucuaccgcagcgaucugcaagccgaguucgaugauguauggcaauuccaaaaaaaauucuauagcagcauauuaacugaugaauuuuacuuaaagcugaaaggacaagguaaagaaaauacacguaaauuauuccuagccauucaccaagucuauacagccgaaaacaaagguaaaagagacgcggucaaacuacaauauuauaaguggaggagugaagcaguaaaaaaacaauuauccaucgaagagguugcuuacguccucguagaaauuaauaauaauauuaacaagagcagcggcuaccuaggugcaaucagcgacagaagcaaagcacuauauuucaacaacgaaacagucggcgaauacuuauacggacaacuaguaaaaaacagacauaacucuuuacgaaaccaaguuuucuaccgacaagacuaucuagaugaauuugaaaaaauaugggagacucaagcaaaauuuuaugaugaacugacaaacgaacucaagcaagaaauacgggacgucgucauauucuaccaaagaaaauuaaagucccaaaagcauuuaaucucugauugccuauucgaaaaacaccauaaagcuauucccaaaucgagcccucuauuucaggaauucaaaauauggcaaaauuuaaacuacuuagaauuuguccauacacaaucaaaagaaaaaauauucuucucagaacucgacgaugaaacacgacaguuuguguucgcagaauuaaauauuaggggaacgcuaaaaauaaaagaaauaaaaaaacucaucggguuagaaacacccguauauuggaaaucgaauuuugacgaaauagaagggaacagaacaaaccaaguacucuacaaugucuaccaaaacaucgcagacgaucucggguauggcuucgauugguccaaaaaacaugccuucgaaauaaaugccgaacuacaagcuauauuuaaagacguaggaaucgacacagcaauacucaauuucgaugcuaguaucgaagaaaacgacuucgacaaacagaaaucuuaucaacuguggcaucuucucuacucagcugaagauaccgacaaagccacagaagaagacaaacucauauacggaaacauaaacacaaaacugaaaaaacaacuucaucaaaaauauggauuugaagcaaaguacggaaaccuacuagcuaauauuucacuccaacaagacuauggcaaccuuucagcaaaagcuauaaaaaaaauauuaccuuauuuagaaucaggcaacucauucuacgaagcuuguacaauaguugguuacaacccaucaaacucauuaacaaaagagcaacagcaaaaccgcaaacucaaagauaaacuugagcuacuuccgaaaaacucacucagaaacccaguaguagaaaagauucuaaaccaaaaaguaaaccuaauaaaucaauuaauagacgaauacggcaaacccgacgaagucagaauagaauuagccagagaacuuaagaaaagcgcaaaacaacgagcagauuuaucaaaacacaucaacgacgcaacuuuaaaaaaccagaacauaagaaagacccuacaaaaagauuucggaauucaaaauccaagcaaaaacgauguaauacgauacaaacuauacgacgaauuaaaagacaacggauauaaaacucuauuuacgaauaaauacauacccaaagagcaauuauucagcaaagauguugauauagaacauauaauuccuaaagccauacucuucgacgacucuuuuucaaauaaaacgcucgcauacagaaacguaaaccuagcuaaagccgaugcaaccgccuuugacuucaucaguucuaaacauuuagacgaucuugauaacuacaaagcaagaguagaaacauuauuccaaucaaaacggauauccaaaggcaaauacaaaaaacuacuaaugacaaggcaaaaccuaccagaagauuucauugaacgagaccuccgaaauucacaguauauugcuaaaaaagcuacagccauguuaaaagaagucuuccgaucaguuguucccacaagcggacgaaucacggacaaauugagagaagacugggacuuaguaaauguaaugaaggaacuaaaccuaccaaaauaucggacgcuaggacucacagaauuuauagagcguaaaaacggcaauaaaauagaacaaauuauagacuggacaaagagaaaugaccacagacaucacgccauggacgcauuaacaguagcuuuuacaacacacaaucacauacaauacuuaaacaaucuaaacguaacgcacggguuaaacggcgucgacacagaucacgaaaagucgcgacuauacgccauaaaacaggccauaaccaaagucuacauaguaggaaaaacaaaaaaaagaaaauucauucccccaauggaaaacuuuagaucccacgcaaaaaaucaccucgagggcauccucauaagcuucaaaaauaaaaauaaaguugugaccaaaaauaaaaacagaacaaaaaccaagacaaaagggguguuuaacgaaaaaauacaacucacaccuagaggacaacuucauaaagaaacaauauauggccacgcuaaaaaaguaaucguaacaaaagagaaagugagcucuaaauucacacaugaaaaaauccuacaaguaacaaaacccgccuaucgggaagcauuauuaaaacgauuagcuaguuuuaaaaaugaccccaagaaagcuuucagcggcaaaaacgcgcuguccaaaaaucccuuguauuucgauauaacgagcgggaaaaaaguaccggauacgguaaaacucucuuauuucgaaaacucauacguaaucagaaaagaaguaaauucagacaacuucaagaacgaaaaaagccuacaaaaaguccuugauguuggaauaagacgaauauuagaaaaacgauuagcagacuauaauggcaacgcaaaagaagccuucuccaaccuagaaaaaaauccgauuuggaaagauaaagaaaaaggcguaugcaucaaaaaaguucguauugaggccuuaaaaaacgccgaaccacuucacguuaaaaaagaccauuuaggcaaaauaauccuagacgaugaaaauaaaucaacaccagucgauuucauaucuacuggcaacaaccaccacguagcaauauacgaagacaaagacggcaaauuacaugauaaaguagucuccuuuuacgaagucguuaguagaguaaacuuaggcuuaccaauaauagacaaauccuucaacucucauuuagauuggaaauuuuuauucaguaugaaacaaaacgaaauguucgucuuuccauccgaagauuucaauccaaaagaaauagacauuggaaacccaaagaacaacgaacuuauaagcaaauacuuguuuagaguccagaaauucucaaaaguaacauacgguaauuccgcgguccgcgacuauguuuuuagacaccaccuagaaacagaacuaauugauaaaaaggaacucaaaggcauuacauacuaucaauuaaaaaguaucgguaugcuagaaaaauuaguaaaagugcgcauaaaccacauuggaaaaauuguacauauuggcgaauauuga

SEQ ID NO: 9042 - RNA, 4176 nt, Artificial Sequence
  Cas9 variant
augaaaacaauccugggacuagaucuaggaacgaauagcauaggaugggccuuagucaaagaagcagaaaacgaaaaugaaguuucagacauaauaaaacuaggaguaagaguaaauccucucacuguagacgaacuaacaaacuuugaagguggaaaagcauacuccaauaaugcagaaagaacauuaaaaagaggugcacgacggaaccuacaaagguauaaauuacgcagagaaaaucugauagaaauauuacucaaaaacggguuaauuaacaaagacacugcauugacagaaguaggcaaagaaacaacacaucaaacacugaaacuaagaucaaaaucagcuaaugaaaaagugaguuuggaagaccuagcaaaaauacuacuuuccauaaauaagaaaagaggcuacaaaucuucaagaaaagucaaugcagaagaugauggaguagcuauugauggaauggaagucgccaaacuccuguaugaugaaaacaugacaccaggagaauacgugcuacgacuccuagaaucagguaagaaacacuuacccgauuucuauagaagcgacuuacaagaagaauuuaaucuaguuuggaagaaacaaucagaauuuuauccacuaaucuuaacaaaagaacuauucuucgaauuacacggcaaaaauaaaucacaaacaugggcaauaugcaaagaaccacucgguauaguuggcguuaaacucaaaggaucagcaaaagaacaaaaauucgcucgauauagauuaagaaaagaagcccugacacaacaaauugagcuggagcaccuagcuaucguauuacaagauauuaauaaugacucgaacaaaucauccggcuaucucggcgcaauaucagauagaaguaaagaauuauucuucaacaaagaaacagucgggcaauaucaauacaaacaauuacaaaaagacccaaacaccucgcucaaaaaucaaguguucuauaggcaagacuaccucgaugaguucgaaguaauauggagaaaccaagcaaaauucuauccacaguuaacaaaugaacuaaaacaagaaauaagagacguaguaauauuuuaccagagaaaacuaaaaucgcagaaaaacuuaauuucauuuugccaauucgaaaguacccaacagaauuacguagaaaaagagacuggcaaaaccaaaaucagaacgauagggagaagaguaauuccacgcucaagcccacuauuccaagaguucaaaaucuggcaaucccuaaauaaccuuaaguuuguaaauucugaguccaaccaaauaauucaauuuauagaacuagaagaugacgucaagaaaguagucuucgacgaacucaacuugagaggagaucucaaaccaaaccaagugcuuaaaauucugagcaaauauaugaaaauaggaaaacuaacccaauggaaaugcaacuuggaagaaaucgaagguaaccgcacaaauucagcguuauauaauguauuccaaaugauugcagaagaggaaggcuauggauucaacuggggcaagaaaagcgcauuagaaauaaaauccgaauuaaaagcuaucuucucuagcauaggcauuaacgauucgauacuugauuuugacuucuccaagaaacucgaccaacaacuaucuuaccaacuauggcauuuauuauacucagcagaggaagguaacuccaaaaucaccgaagaagauaaauuuacguacggcaauacagguguagcucucaaaaagaaacuacaccuaaaauucggcuucaaaccagaguacaguacacugaucaguaaccuaagauuuacauccgacuacggaaacuuaucaucgaaagcuauuucaaaaauacuucccuucuuacgugauggaucggauuacaguaaagcaugccaguaugccggauacaaccacucaaacaguuuaucagcagacgaacuagauaauagggaauuaaaaccuaaauuagaacuauuaaagaaaaauucucuaagaaauccaguagucgagaaaaucuuaaaccaaaugguaaacguagucaaccaaguaaucgacaacuacggaaaaccggacgaaguacgaauagaauuagccagagaacucaagaaaagcgcuaaagagagaucgcaaaugaccaagaacauaagcgacgcuacgcgcagaaacgccgagauuaaaaaguaccuuaguaaggaguucggaauaccaaacccgacuaaaggcgaugucauaagauacagacuuugggaagaguuagcuucaaauggcuauaaagaucuauucagagacaaauauauaccaaaagaaaaauuguucucaaaugaaaucgauauagaacauaucauaccuaaagcucugcuauuugaugauucuuuuucgaacaagacucuagcauucaaaguugauaaccugaaaaaggcugacaggacagcuuuugacuuuaugagcacggauuucucaaaagauguugacucguauauaggccggauagaaacucugcauaaagauggaaaaauaucaucaucaaaauauaagaaacuaaugauaccaaaauccaaauuaguagauggauucauagaaagagaccugaggaacacccaauauauugcuaaacaagcacguaaaauguuacucgaaguguuuaagacgguugugccaaccacuggcaaaauaacagauaaacuacgcgaagacugggacuuaauaaauguaaugaaagaauuaaauuucccuaaauacaaagcacucggccucacuaagaaaauagaacguuucgacguaggcuccgagaaaauuaaaucaauaaacguaaucgaaggcuggucaaaaagaaaugaccacaggcaccacgcgauggacgcccuagcaguagccuucaccacacauaaucacauccaauaucuaaacuauuuaaacgcaaggaaagacauucaucacgaaaugcacggaacaauaaaaucaauagaaaaccaaauaauagguaaagauguaaugggaaaaaggcgguuuaucccaccuauuucagauuuaagaaugaaggccaaacuacaaauagaaaguauauuaauaucauuuaaaaacaaaaacaaagucgucacauggucgguuaauaaaacuaaacuuaaaggaaaagauaauuacaacaaaaggagacaauugacaccgcgggggcaauuacacaaagaaacagucuauggcaaaaucaaacuaauagacccaaaaccacuaaaguuaaauaacaaauucacccucguaagagccucaaugaucguagacaaaguacauagagaaauaguucuccagcaucuaucaaaauaugacaacaacagcgaaguagcuuucgacuccaaaacaauaaaaauagauccaaucuugaucgaaggaauaggauuaaaagaaguaguuuguuacgaagauguauuuaaaauaaggaagaaaauaucuggagauaacuuuaaaaaugaaaaacacuuagaaaaagugaucgacgagaaaguaaaacaaauacucaaagauagaguaauaaaguuucaaggaaauuuuaaagaggcauucucaaaucuagaagaaaauccuauaugguuaaacaaauccaaagguauagccgugaaaaguguugcgaucaaagguguaaauaacgcagaaucauuacaugagggcaaagaucauuuuggagaucaaauccuggacaaaaauaagaaacaaauaccaguagacuucguaagcacuggaaacaaccaucauguaggaaucuacgaagacaaagacgggaacuuacaagaaagaguagucucguucuuugaagccguaacaagaguuaaugaaggcuuaccuauaauagacaaaacauauaacagcgacaucggguggaaauuuaaauuuacaaugaaacaaaacgaaauguucguauuuccaagcgacgacuucgacccuaaugaguucgaucuaacagacgggaaaaacgcagccaaaauaagcccaaaucuuuaccgcgugcagaaaaucgcuaccaaaaauuauauguuccgucaccacuuagagacugugguaacaaaugaucuagaguuuacauauaagucaauacguucuaccggaugguugcgaaaccuuguuaagguacgaauaaaucaccuaggugaaauaguuuauguuggagaguacuga

SEQ ID NO: 9043 - RNA, 4176 nt, Artificial Sequence
  Cas9 variant
augaaaaaaauccuaggcuuagacuuaggcacuaccagcauaggaugggcucugguaaacgagaaagaaaacaacgaagaguuaaguucaaucauaaggcugggagugcgaguaaaucccuuaaccguagaugaaaaaucaaacuuugaaaagggcaaagacauaacuacaaacgcagaccgcacuaaauguagaagcgcaagaagaaaucuacaaagauuuaaacuccgaagagaagcacuagccgauugcuuaaaaaggcauggacucaugacugacgaaacaccacuaugugaaacaaauaauaguauaauauuuaaaacauacagcaauagggcgaaagcuguaugcgaaaaaauagcucuggaugacuuuguaagaguucuuuucaugauaaauaaaaaaagaggguacaaaaguaguagaaaacuaaauacugaugacgaaggcacacuaguugacgguauggauguagcuaaacucuuguacaaugaacagauaacaccaggcgaguaucugcuaagacuauucaaaaaaggaaaaaaaacccgcccagauuucuaucuuucagaccuuaaagcagaauuagaacgcauuugggauuuucagagaaccuucuauccagaaaucuuaugcaaugcacuuaaagaagaccuaaaaggaaaaucaaggacgcaaaguagugcgaucuuuuacgcuaaauauaaaguaucaacugccaaaauagcagggaaagauaaaagacuacaagaacuaacauggagaacugaugccuuacguaaacaacuuacaauagacgagguagcauauguaauuugcaguauaaauggagaaguuaacggaucaucucaacgauuauccaugauaagugauaggucaaaauuauuguauuucaaccaccaaaccauaggucaauaucucaugcaaagacucgaagaaaaucccaaugcagguuuaaagaauauaauuuuuuaccgacaggacuacgaagaugaauuuaacgacauuuggaacucgcaagcaacauaucacaaagaacuaacgccagaacugaaaaaagaaguaaaagacauuauuuucuaccaaaggggacuaaaaucgugcaaauggcuaaucaacuacugcgaauuagaacacgaagaaauugaaguaaaaacaccugaagggaaauuaagaaaaauaacuauaggcucaaaaacaugucccaaaaguagccccuuauuccaagaauuuaaaaucuggcaagucuuaaauaacuuacaaguuucaccccuaaacucaagacgaaaagcaaaaagaaaaaaagacgaggaaccaucucucuucagcgacgaagacaugaacacugcaugccguuauuuaaaugaggaagaaaaauuaacccuguucaaagaacucucaauaaaaaaagaauuaaagaaaaaagaugccuuaaaacucuuauuugaaaacuacaaggaacuagaucuaaauuauaagguaaucucaggcaacguuacuauggcaaaccuauacagagcauuucaagacaucauaaguuuaacuggcaauggagaauucgauuuccaagcuaugcccgcagaagaagcugaaaaaacaguagaagaaauauuugguggauuaggcuauaaaacggcauuccugcauuucgaugcaucauuacaugacaaagaauuugaacggcaaccugcauauagauuauggcaucuacucuacucuuaugcaggugaccaaucgaaaacaggcauagaagcacuaguaaaaagaauccaagaacucuguggguuugaaccagaauaugcaagaauucuggcaaauauaagcuucauaccagacuauggaaaccuaagcagcaaagccaugagaaaaauacuaccauacaugcaagaugguuaugaauauucagaagcaugcuccaaagcaggauacagacacagugcaagcagccuaacaaaagaagaaauaaauaaaaaaaauuacaaaacucaucuagacgaaauaaaaaggaauucgcuacgcaaucccauaguagaaaaaaucuuaaaccaaauggugaauguaguaaacagcguaauagauaccuacagcaauaucgacgaaauucgaaucgaaauggcaagagaacuaaaaaaauccaagccugaaagagaagauaugucguuugcaauaaguaaagccacaaaagaaacagagagaauaaaaggaauacuagaacaagaauuuaaaauacaacauguuacuagaaacgacauuaucagguacagacuuuacgaagaacuaaagccuaauggauauaagacacuauacucaaacaccuacauaccacgagaagacuuauucuccaaaaaauucgacaucgaacauauaauacccaaagcccgucuauucgacgacucauauucaaacaagacauuagaauuacgagacauaaauaucgaaaaaggaaaucaaacagccuacgauuuuguacuaucaaaguauggggaagagggacucuacaaauaugaacaacgaguggaagaauucaaaaagaauaaugagcaagcgggcacuaaaugccgaaagcuccugaugagggaagcagacauuccaucagauuuucuaaaucgcgaccuaaacgacucacaauauauagcaaaaaaagcacacgaacuacuccgggaaauaguuccaaccguaacagcaacaacaggaucgaucacaaacagacugagagaagauuggaaauuaguuaacguaaugaaagaguuaaacugggaaaaauacgauaaacuaggacucacugaagaauauaaagauaaagaugguaacacuguaagacauauuaaagacuggaccaaaagaaacgaccaucgacaccaugcuauggaugcacuuacaaucgcauucacaaaaccuaguuucauccaauacuuaaauaauuuaaacgcaagaagcaaccgaggugguuccauauauggaauagaacaaaaggaacucgaacgagaaaauaauaaacuaguauucauuccaccaauugacccaaagauauuuagaaagcaagccaaagaacaccugagcaauauauuaauaagcauaaaggcaaagaacaaaguagugaccaaaaacguaaauaaaacuaaaagcaaauccggaacaaaucgaaagguacaauuaacuccuagaggacaauuacaucuagagacuguguacggaaaaauucgcacauacaaaacagaggaaauuaaaguagguacaaaacuaaccgaagaauuaauagcaaaaguugcagauaaaaaaauaagggaagcccuaaugcaaagacucagugaauacggcggcaauaucaaaaaagcauuucaaaauaucucaaaacacccuaucugguuaaauggcucacauacaaaacacgugccagagaaaguuaaaauuguauucuucgaagauguuuucacaauaagaaaagccauuacaccugauauaaaaauagacaaagugaucgauagcaaaauccgccgaauuuuacaagaaagguuaaacgaauuugggggugaagccucuaaagccuucucaaaucuagacgaaaauccaauaugguuuaauagagacaaaggaauagcaauaaaaucgguaaaaauaagaggaaucgcaaagggaaccgcuauuaggguuaaaaaagacauacaugggaagaccauaauagggaacaaugguuacccaguagcuaaugauuauguaaacaccgguaacaaucaccacgucgcuauauuuagagacaaggacggcaaccuucaagagcauauagucuccuucuacgaagccacagcacgugcaauccaaaauuuacccaucguagaucgaaauuacaacagcgaaaaagauuggaaauuucuauucucuaugaaacaaaaugaauauuuuguuuucccgaauccaaauacagguuucaacccgucagaaaucucgcucaaggacgaaaaaaacuacgcucuaauaagucccaacuuguuuaggguccaaaaacuaucacauuauuacuauguauuccgucaucaccucgaaaccaacguugauacaaaccuccaguuaaaagauauaaccuggaaaagaaucacagccguaaauaacuuaacaggugcaguuaaaguacgaauagaucacuuaggacgaauuguagacguaggagaauauaaauga

SEQ ID NO: 9044 - RNA, 4176 nt, Artificial Sequence
  Cas9 variant
augaaaaacuaccacaucggauuagacauagguacaagcucuguaggauucgcagcccgcgacgacgacaacaaccuaauuagaguaaaaggcaaaaacgugauuggagcacgucuauuuuccgaaggacaaacagcccaagaacgaagaauggcuagaacgucacgccgacgguacaauagacgaaaauggcgucuacgacuacuagacgaaauuuuccacgacgaaauaauacacaaagacgcagaauuuuucaauagacucaaacaaucauuuuuauccccaaaagaugaacgaaaacaauauuuuggaucauuacuauuuccggaaaccggggacucagaauacuaucacaauggaaaucaaaccaucuaccaucuuagacacaggcuaauaacacaagaugaaaaagcagacauacgagaaauuuaucuagcacuacgacauauuauaaaauaccgaggaaacuucuuagacgauacuccaguaagcagcuuugaagcaucagaccucaaacuagcuaguuuuguaccaacaaucaacgaccuuuucgaaaccauagacgucaauuacgaguucagcauggacaacauaaacgagaucgaagauaucuuauugaauaauaaacuuaggaacucagauaaaaguaaacaacucacggauuugcucaccgaaccgauagucaacauagacgauaaaucucucgaaaaacaguuuaauaaagaaaggacagacauaucaaaagaaauugcaaaaucuguugucgguucaaaaaugaacguuaacaaacuccuaucauucgaaucuuccgagggcucaaaaaucgcauuuuccuucucagacgcaucuuccgaggauaaaaugauggaacuaucagauaucuuggaugauucaagaaugaacauauuaaauauauuaaaaguuaucuacucgcgagucagacuaaaucaaaucauaccauccggcaugggacuuagcgaaagcauggucgccgcguacgacagucacaaacaacaauugaaagaucuaaaaacgcuucuaaauguacuaccauuuaacgaacgauacgcgguaaaaaucgcauacgcagccuacaucggaaauauugauaaacaaaaauuuacuaaaagugaaauuaaagcaaucgauaaacucaaagaaaaaucagccauuaugaauguccuagacuucaaaucuggccauauaacaaaugaagaacuuagcaaugucauaaaagcaguuauaguggacaaauaccuaaaugaugaagauuuugaauaccacggaauaguagagaaaauaaaucaagacauaucaaacgguucauacuuacuuaaacaacgaaauaaccaaaacgguaacauuccacaccaauuacaucaaauggaauuagaccaaauaauagaaaaucagagcaaauacuaucauuuccucggagaacuaaauccaaacagcaacagaaaucauaucgcgaaauauaaaauaagugaauuaguugcuuucagaguaccauacuacguagggccucuaauaacacccgaagaacaagagaaaacaucaggugcaucguucgcguggaugaagagaaagaaagacggagcaauaacaccuuggaauuuugaagaaaaagucgauaaggaagaaacugcaagucgauuuauaaaaagacuaacaguaaaagacacauacuuauuaaaugaagacguauuacccgacaauucucuacuauaugaaaaauuuaaaguccuaaacgaauuaaacguaguaaaagccaauaauaaacgacucacaguagaagaaaaacaaggugcauucgacaaccuauucaagaaaaugaaaacuguaaccgcaaaacgauuaaagaacuaccuggugucaaaucauaaccauaucaacucagucgaaaucacaggcuuaucagauggagacaaguuuaacaacagucuaagcacuuacauagacuucaagaaaaucuuuggugauaaaauagacaaucccggccugcuagacgacuucgaagacauaauugaaugguccaccguauuugaagacaggaaaauauucgaagaaaaaguacgaaaagacauaaguuggauaucugaguccgaaauuaaaaguguuguaagcaaaagauacagcggcuggggcagacuaucaaagaaauuacuaaauugcauaacgaauaacgaaggucgaaacauaauagaugaacuaugggaagagagcgaaacuuucauggaagcaguauccaaaccugaaguaaaagaacaaauagacgguauaaacucagacuuuauuaaaaauacagauauugaaagcgucuuagccgacgcguacacguccccacaaaacaagaaagcaauacgcgaaacacauaaauuaguuaaagauauacaaaaagcaaugggaggacaagcacccgccucgauaaguaucgaauuuacaagaaacccacaagauaaaggacaacucacacgauccagacacagcgaaguuagucguaaauacaaagagauauccaaagaaauaucaaaaacucuaaacgaugaauuaaagucaaagaaaaauucaauggauguugacaaauauuauuuauacuuuaugcaaaugggcauagaccuuuacgauggaaguuccauagacauagaugauuuaaacaacuaucaaauagaucacauaauaccacagagcuucuacaaagacgauucuuuugacaacaggguccuaacccauuauaguaacaaccagaagaaaggcaauaacacaccgcuaaacgggcuaaacauuaacgacaaaacaagagccauauggaaccaccuacgagaccuaggucuaauuaccaaaaagaaauacaacggacuaacacuaaaaggaauggaucaacuaagcaaauacaccaaacacggauucaucagaagacaacuuguagaaacaagccaagugaucaaauuaguggcaaauauccuuuccgacgaauuuucaacagacgacacaaaaauaauagaggucaaagcuaaaaugaacucccaaauaagacaaguuuucaaucuuuauaaaguacgagaacuaaacgacuaucaccaugcagucgacgcuuacuuaaccacauucauaggagguuauuuauauaacagauacccgaaucuccgaaacauguucguauauggagauuuuaagaaauucucagcagacgucgacaaccuaaaaacauuuaacuuucuccacgaaaucaccaaucccucugacaaauuugaagacagaaucuucgaugaaaaaucaggagaauuaauacuugacagaaaacacgcaauagaaacaauuaaaaagauauaccaauauaaauauaugcuaauaacaagagaaguaucaacgaaaaacggucaauuaucagaucaaacaguauauuccgcaaaacgaaucaauaauguaaaggccccaauaccagucaagaaagauuucaauccggaacuguacggcuucaggacggguaacgucgaccaccacaugguaauugucaaauaucccaagaaagauucauacgacuauaaagucguaggcauaccucuacgguucguucaaaaacuaaaagaaacaaaagacaauaaagacuacgaaaaucucuuaaaccaaauaguccaaaugaaauuaaacagaaagaaacaagacuuuauaguaguuguggacaacgugauguacggacaacuaauacaagacggaggucaaaaauucacucugggauccuccacauauagauacaaugcuaaacaacuugugauagacaauggauacuuaaaacuuauagcagacgaacgcuauaaaaauaguuuaacggacgaagagaaaagcaaucaauauauaacgcuuuauaacgaaauacuaaaaguaguaaacggacgguucgacgucuucgacguaaauagcuuuaggaagaaacuuaacaacggagucgauaaauuuauaaaacuuaacacaguagauaaacgaauaauaauaaugaaaauauuaucaggccugcacugugggcccucaauaguaccacuaaaagaacuaggccuaacaacaccucuaggacagcuccaaucaacgucaggaauaucacuuucagaaaacacaaucauuauuuaccaaucuccauccggacuauucgaaagaaaagucagacucggcgaccuauga

SEQ ID NO: 9045 - RNA, 4176 nt, Artificial Sequence
  Cas9 variant
augaaaaauuaccauauagggcuggacauaggaaccucaucaguuggcuuugcggccagagaugacgacaauaaccuuauucgagucaaagggaaaaacguaaucggcgccagauuauucagcgaaggcaaaacagcccaagaaagaagaauaucaagaacaucaagacgucgauacaauagacgaaaauggagacuccgccuccuagacgaaauauuccacgaugccauaguacacaaagacgcagaguucuucaacagacuaaaacaguccucacuaucaccaaaagaugaacgaaaacaguauuucggaucacuacuauuuccagaagucggagacggagacuacuuuagagaugguaaccaaacaauauaucacuuaagacaucgacuaaugacgcaggaugaaaaagccgacauucgagaaguauaccuagcauugagacacauaauuaaauacagaggcaacuuccuagaugauacacccgucucauccuuugaagccagugaccuuaaacuagccucguuuguacccacacuaaacgacuuauuugaaacuauuaacgugaauuacgaacuaaguauugauaauguaaaccaaauugaaaauauauuauuaaauaacaaacuccguaacucagauaaaagcaaacaacuuacugaucuaauagcugaaccuguaacaaacaucgacgacaagagucucaagaaacaguucgauaaggaacgcaaagauaucaguaaagaaaucgccaaagccguaguaggcagcaagaugaacguaaauaaacuguuauccuucgaaucaagugacggaucuaaaauuucauucucauuuuccgacgcaucguccgaagacaagauguuagaacuauccgauaucuuagacgacaguagaaugaauauacugaacguauuaaaaguaauauacucacgaguucgauuaaaucaaauaauaccuucagguaugggccuauccgaaagcaugaucgcagccuacgaccugcacaaacaacaacuuaaggacuuaaaaacauuacucgacgucguacccuucaacgaaaaauaugcuguaaaaaucgcauacgcggccuacauaggaaauauagacaaacaacgcuucacuaaagcugaaguaaaaacaauugauaaauuacgagacaaaaagucaauuaccucaguauuagauuuuaaaucuggacacauaacaaaugaagaacuaaauaauguaauuaaagaaguaauaguagacaaauaccucaaugacgaaacguucgaauaccaugauauaguagagaaaauaaaccaagacauaucgaauggcaacuaucucuuaaaacagagaaauaaucaaaauggcaacauuccacaucaacuacaucaaauggaacuagaccaaaucauagaaaaacaaucaaaauacuacccauuucucgguaaauuaaacccuaacucaaagcguucacacaucgcuaaguacaaaauaucagaauugguugccuucagaguccccuauuauguaggcccauuaauuacgccugaagaacaagagaaaacuagcggugcuucauuugcauggaugaaacgaaaggaagauggugcgaucacacccuggaacuuugagaaaaugguagacaaggaaucaaccgcgucacgauucauaaaacgccugaccguaaaggauacauauuuacuaaacgaagacguauuaccagacaacagcuuacuauacgaaaaauuuaaaguacuuaaugaauugaauguaguuaaagccaauaacaaaagacucacaguagaagaaaaacaaggugcauucgacaaccucuucaaacaaaugaaaacaguuacagcaaagagacucaaaaauuacuuaguaucaaaccauaaccauauuaacucaguuaaaaucacuggucuauccgacggagaaaaauucaacaauucucuaucuguauacauagauuuuaagaaaauauuuggagauaaaauagacgacucaaaacucuuugacgauuucgaaaacaucauagaaugguccacaguuuuugaagauagagacaucuuugaagaaaaagucagaaaagacauuucauggaucucagaaucagaaauaaacgcuguaguaucaaaaagauacucaggauggggucgacuuuccaagaaacuccuaaaugguauaacaaacgaugaaggccgaaacauaauagaugaacuaugggaagaaucagaaacguuuauggaagcaguaucaaaaccagaaguuaaagagaaaauagacgaaaucaauuccaacuuuaucaaaaauacagacauagaaucaguccuugcagacgcauauacaucaccgcaaaacaagaaagccauaagagaaaccuacaaacuuguaaaagauauacaaaaagcgaugggagggcaagcaccaucaaguauuuccauugaguucacaagaaauccacaagauaaaggagaauuaacccgauccagacacagcgaaauagcuaagaaauauaaagaacuaaguaaagaaguaagcaagaaauuaaaugaugaacuaaaaucaaagaaaaacuccauggacgucgacaaauauuaccucuacuucaugcaaaugggaaucgaccucuacgacggcaccucaaucgacaucgacgaucuaaauaacuaucaaauugaccacaucgucccucaaaguuucuacaaagaugauuccuucgauaacaggguacucacucacuauucaaacaaccaaaagaaaggaaauaacacaccacuaaacggauuaaacauagauucaaauacacgagaaguuuggaaccaccuaauuggacuuggccuaauaacaaaacgaaaauauaauaaccuuacccuaaaagguauggaccaacuuucaaaauacacgaaacacggauuuauucggcgacaacucguggaaacgucucaagucauuaaauuaguagccaacauauuaagcgacgaauauucaaaagacgauacaaaaauuauagaagugaaagcaaaacuaaacucucaaauccgucaaguuuucaaucuauacaaaauuagagaauuaaacgacuaucaucacgcuuuagaugcauauuuaacuaccuucaucgguggcuaccucuacaauagauauccaaauuuacgaaauauguucguauauggagauuuuaagaaauucagcgcuaaaauugauaacuuagaaacuuuuaacuuccuccacgacauuaccaacccaagugauaaauucgaagaucgcauuauagaugaaaaauccggugaagucauacucgauagacgacacgcaauagaaacaauaaagaaaaucuaccaauacaacuauaugcugauaacaagagaaguaagcacuaaaaacggacagcuaucagaucaaacaguuuauucagcacgucgcauaaauaaagucaacucacccauucccgucaagaaagacucgaauccugaacuauacggauuuaggacagguaacguagaccaucacauggucauaguaaaauaccuuaacaaagauaaauacgauuacaaaaucauagguauaccacucagauuuguacaaguucuaaagaacucgaaugacaauacagaauacaaaaacauuuuaaauaaaauuguacaaucaaaacuaaaaggcaaaucaacagauuucagaguuauauuagacaacgugauguacggucaguuaauucaagacggaggacaaaaauucacccuaggaaguucaacauauaaauauaaugcaaaacaacuuguaaucaauauggacgauauccgaauauuaguagacaacagauauuuuaacucgcuaagugacgacgaugcuucgggagaguucauaaaaauuuauaaugaaauacuaaaaguaauuaaugcaagauuugaccuauucgacauaaauaaauuuagagaaaaauuaaacaauggaaaagaauauuuugaaaaccuuucaauugacgagaaaaaccaaguacugcucaaaaugcucagcgggcuacacuguggaagcgcaaauguaccuauaaaagaacuuggacuaacuacaccgcuagguaaacuccaaaucccaucaggcauaguauuauccgaagaugcuaucguuauauaucaaucaccaucaggcuuauucgaaagaaaaauccgauuaaaagacauauga

SEQ ID NO: 9046 - RNA, 4176 nt, Artificial Sequence
  Cas9 variant
augaaccuuagaaacuauccaggggaauacaguauuggucucgauauggggacaggcaguguaggauggucgguaguagacgaaaaaggaaaucugcuccacuucaaaaagaaaccaaccugggguaguagacuauuugacucaguaaugccagcaucugaagcuagaguucacagaggacaaaggagaagauaugaaagacguagauggagauuagaucuauugcaagguuuauuuaaaaaugaaaugaacaaaguagauccugaauuuuucaugagauuaaaccaaaguagaaccauagaaggagauccaauuuucacaaaaaguuuuacaaaagcggacuacuaugauagauucccaacgauauaccaccuuagagcauaucuuauggaaagcaaugaaccagcugauuuacgauuaauauaucuugcuaugcauaauaucauuaaacauagagguaacuuccuacgagaagaagaaaaauccuugucagcuaaacaugcagauucaaagaaagcuguuacucaauucguagaugccuugaaagaauggugcuucucuagaggauacgaauuugggaaagacccagccaaaucaaucgaaaaauguuuaagugacucaaaauccaguagaagccaauuagcgagugaaauagcaaaagcacucgcagugagcacagaugcugcugcggcugauaagaaauuagcagauaaucucgcaaaagcaauggucggacugcaaugugaauuuaaauacguauuuggggaauuugauugugaaagcacuaaauuagcacugucagaugacgaaaaauuagaauuauuaagggcagcuugcccugaugauagcguagaacuccuagaugcguuaugcgcaguauacagcgcauauguuuuacaggguuuguuaucauacgcaccagggcaaacaauaucacacaauaugauagcaaaauacgauuuauauaaaacagaucuaaaaaccuuacgugcauuaguuagagaauaugcuccgggagccuaugacgaguucuucagaggcgcaacauaucaugaugcgaauccagaugauuccaguaaagauuauagcuaugcggacgcagaaggauauacugcauauaaucuacauaaauuaaguuacgaugacuuugcuaaagccgucaagaaauuacuagguggcacugaugcagucacugacgaacgcuaucucaacaugauggaacgauuugaaaaacaacaauuuuugagaagacuaaaaacauccgacaacggagccauauacuaccaguuacauuuagaagaacuaacagcaauuauuaaaaaucaaggcagauuuuauagcuuuuuaaaagaauacgaggguaaauucgaaagucuagugagcuucagaauaccuuauuauguaggaccguuaacuucaguaaacgcagcacaagacagccacaaccauaauagauuucaauggucagaaagaaaaccagguauggaaagagaaguaauaacaccauggaauugggauacaaucauagauaaaaauaaaagcgcagaaaauuuuauaaugcgaaugacaggagacugcacguaucuggcaggagaaaaaguacuacccaaacaaagucuuuuauacgaagaauuuugcguacuaaacgaauuaaauggcguaagauggagcgacgacggugaugacuggcaacguuuugaugcggcacaaagagaaggaauaguaagggaacuguuucauaaauaccgaagaguaaccuauaaaauguuagaagacuggcuuguaagagagggcgaugcaaaucauccaauaguuaaaggaggacagggggaaacaggucuagaaaguaaaaugggcaguuaucuuuucuuugcgaaaggaauauuuggucugggagaacuuucuccggcggaguauccugcuaucgagaaaaugauaaaauggaauacacuauucgaagauagauccauauuaaaagaaaaauuagaagaugaauuuggugaaagaggcaacgggaugcuugacgcaagccaaauaaaagcaaucugcaagaaaagguucacugguuggggacgucuaucggaacaauuucuaacgggauugaaagucgaaucuccggcaggcagagcagucucaauaauggauguucuuagagaaggaaauccgugcagugaaagaaggcaaggagaaacagucguaaugauggaggcuuuaagggaugaaggacuaggauuccaaaagaaaauagacgaacauaauagaaacuacuauggucaacauggaaaagauuuaggaguaaaugaacuaccaggaucuccugcuauccgaagaucauuaaaccaggccauaagaauaguugaggaaauagcaucaauagccggacacgcaccagcaaauaucuucauagaagugacccggggcgaagaugcuggaaagaaaggaaaaagaaccguaaaaaggugggauaaaauaggggaggccuugaagaaauuaaaagaagaggggguagccguagaaguuauggaugauuuuaaagaacaaaaagcaauaaacgcuaaucuggaugaaagacuuagucuauauuuaaugcaaaacggaaaaugcuuauauucggguaaagcaauaaacuuagaaaaacuauuagccggaaguggugaauaugaaguagaucauauaauuccuagagcauacauaaaagacgauagcauugagaauaaagcccuaguguuacgugaagagaaucagcauaaaacagaccaguuacuaauagacaaaucuauaagauggaaaaugagagaaaccuggucccaauuacaugacgcaggauuaauuggagauaagaaauaucauaaucuacuacgaaguaacauuaacgaaaaccaauugaggggcuucauagcaaggcagcuaguagaaacaucccagaugguaaaauuagcacaagcacuauuagaagcuagauuugcaaaugaggaaacacgaauagugccaguuaaagcaucuaugucccacaacuuaagagaagcggcggaucuagcaaaaugccgagaagcuaacgacuuccaucacgcacacgaugcauuucucgcuaguagaauaggacucuuuguacaaaugcgucauccagguauauacgaaaauccuauugguuacagccacguaaucaagaaauacguacaagaacaaagugaaguauuuaagaaaacacauaggaugcccggaucagcaggcuuugugauaaauucauuuaugagcagcggguucgauaaagauacaggagaaguguuuaaagauucaugggacgcugaagccgaaguagauggaauacgaaaagcauuaaauuauaggcaauguuacauaagccggaugccccagcaagacaccggcgcauucuggaacgcgacuguauacucaccaagagauccgaaaaugggucccaaauuagcucuaaguacaaagcaaggcuuagauccaaaacuuuauggaggcuuuaguagccagcaguuugcauacuucuuuauauaugaagcuaagaagaaaggaaaaccaacuuuuagauuuagucaaguaccagucugguuagcagcacguauagaagcaaacccacuugcccuggaagaauaugcaagaggacucgcgaaaggugaaggacuagaauuuguaucaauccaaagacccaaaaucuacaagaaacaacuaauagagguaaauggugacaaacuaauaauaacuggggcaaaagaaguuagaaguggagcugaacuagcuuuuaaucaagaugaaauaagcgcaaucucgauguguaguaaacuacgugcagcagaagcaggcuuagauggagccuucucggaggaagucucagcgauuuggaauagaaucucaaacgcaccuguacaaucaugcgguagacuacuaagacaauugacauuaccaaaauaucaaaguaauuuugauaguuccagcaacgaagagaaagcugcaguuguguugggauuaaucgcacuccuaaauggaaauaauagaauaguagacuuaagcggaguagguggaaguucucaugcuggagcaaugaugaugucguauccaaaacuucuagacgauccaaaagugccguucuuuauaauagaccaaaguguaacagggauguuugagagaaaaaccagaguaggcuuauga

SEQ ID NO: 9047 - RNA, 4176 nt, Artificial Sequence
  Cas9 variant
augaagaaaaucuuagggcuagacuuagguaccacaucgaucgguugggcacugguaaaugagaaagaaaauaaugaagaacaaucuuccauaauuagacuaggagugcgaguaaacccguuaacaguagaugaaaaaucaaauuuugaaaaaggaaaagauauaacuacaaacgcagaucgaacaaaaugucguucagcaagacggaauuuacaacgcuucaaacuacgaagagaagcacuagcagacugcuuaaaaagacauggacucaugacagacgaaaccccauuaugcgaaaccaauaacaguauuauuuucaaaacauauagcaacagagcaaaagcaguaugugagaaaauagcauuagaugauuuuguccgaguucuuuucaugauaaauaagaaacguggauauaaaucgucaaggaaacucaacaccgacgacgaaggcacuuuaguagacgggauggacguagcgaaacuuuuguacaacgaacaaauaacaccuggugaauaccuacuacgacuuuuuaagaaaggaaagaaaacucguccagauuuuuauuugucagaucuuaaagcagaacuagaaagaauaugggauuuccaacgaacauucuauccagagauacuuugugaugcccucaaagaagacuuaaaagggaaaagccgaacacaauccucagcaauuuucuaugccaaauacaaaguuuccacugccaaaaucgcuggcaaagauaaaagauuacaagaacucacuuggcgaaccgaugcgcuaagaaaacaauugacaaucgacgaaguagccuacguaaucuguucuauuaacggcgagauaaaugguagcucacaacgauuaaguaugaucucagaccgcagcaaauuacuuuauuuuaaucaucaaacaaucggacaguacuugaugcaacgauuagaagaaaauccuaaugcagggcuuaaaaauaucaucuucuacagacaagacuacgaagaugaguucaacgacauauggaacucacaagccacauaccacaaagaauuaacaccagaacuaaagaaagaauuaaaagacauaauauuuuaucaaagaggauugaaaagcugcaaguggcuaauuaacuacugcgaauuagaacacgaagaaauugagguaaagacacccgaagggaaacuaagaaaaaucacaauagguaguaaaacgugucccaagagcucuccacuuuuucaagaauuuaaaauauggcaaguccucaacaaucugcaaguaucaccacuaaacaguagaagaaaagcaaaacgaaagaaagaugaggaacccagccuuuucucugacgaagacaugaacaccgccugucgauaucuuaaugaggaggaaaaacuaacuuuauuuaaagaacuaagcauuaagaaagaacuaaagaagaaagacgcguuaaaauuauuauucgaaaacuacaaagaacuagauuuaaauuacaaagucauaagugggaauguaacuauggcaagucucuaucgagcauuucaagacauuaucagccugacaggaaauggugaauuugauuuccaagcuaugccagcagaagaagcugagaaaacuguugaagaaauauucggaggucugggauauaaaacugcauuucuacauuucgacgccucucuacacggaaaagaauuugaaagacaaccagcauaucgccuauggcacuuauuauacucauacgcaggagaccaaucaaaaacaggaauagaagcauuaguaaaacgcauccaagaacuuugugguuucgaaccugaguacgcaagaauacuagcgaauauuagcuucaucccagacuauggaaaccuuucaucaaaagcgaugagaaaaauucuuccauacaugcaagauggauaugaauauucagaggcuuguagcaaagcaggauauaggcacucagcaucauccuuaacaaaagaagaaauaaacaagaaaacauacaaaacacauuuagaugaaaucaaaagaaacucccugcggaaucccauaguagagaaaauauuaaaccaaaugguuaacguuguaaacucuguaauugauacauauggaucaaucgaugaaauacguauugaaauggcuagagaacucaagaaaucaaaaccugaaagagaagacaugagcuucgcaauaaacaaagccacgaaagaaacagaacguauaaaaggcauacuagaacaagaguucaaaauacaacaugucaccagaaacgacauaauaagauaucgauuauacgaagaacuaaaaccaaauggauauaaaacccuuuacuccaauacauauaucccacgagaagacuuguuuagcaagaaauuugacauugaacauauaaucccuaaagcgcgucucuucgaugauucauacucaaauaaaacacuugaauuaagagacauuaacauagaaaaaggaaaccaaacagccuaugacuuuguacucaguaaauacggcgaagaaggccuauauaaauacgaacagaggguagaagaguucaagaaaaacaaugaacaagcaggaucuaaaugcagaaaauuacuuaugcgcgaagcagacauaccaucagauuuucugaauagagaucuaaaugacucacaauacauugcuaagaaagcacaugaacuucuacgagaaauaguucccaccguaacagcaacaacaggaagcauaacaaaccguuuacgagaagauuggaaauugguaaacguaaugaaagaacuaaauugggaaaaauaugauaaauuaggucuaaccgaagaauacaaagacaaagauggaaauacugugagacacaucaaagauuggacaaaaagaaaugaccacagacaucacgcuauggacgcccucaccaucgcauuuacaaaaccauccuuuauccaauaccuaaauaaucuaaaugcaaggagcaauaaaggaggaucaauauacgggaucgaacaaaaagaauuagaaagggagaacaacaaauugguauucauaccuccaaucgauccaaaaauauucagaaaacaagcaaaagaacauuugucaaacauucuuaucaguaucaaagcuaaaaacaaagucguuacuaaaaaugucaacaaaacaaaaagcaaaagugguaccaaccguaaaguucagcuaacacccagaggacaacuacacuuagaaacagucuauggaaaaaucaggacuuauaaaaccgaagaaauaaaaguaggcacgaaacucaccgaagaacuaauugcuaaaguagcagauaaaaagaucagagaagcacuuaugcagagacuuucagaauauggaggaaacauaaagaaagcauuccaaaauauuagcaaacacccaauuugguuaaacaguucucacaccaaacacguuccagagaaaguaaaaauaguguucuucgaagacguauucacaauccguaaagcaauaaccccagacaucaaaauagacaaagucauuaacagcaagauucgaaacaucuuacaggagagacuaaacgaauuugguggggaagcagcaaaagcguucucaaaucuagaucagaacccuauuugguucaacaaggacaagggaauagcaauaaaaucaguaaaaauuagaggaauagcaaacgggacagcuauaaggguuaagaaggauauccauggaaauacaauuauugguaauaaugguuaccccauaccgaacgacuacguaaauacaggaaacaaccaucacguagcaauauuuagagauagagauggaaaccuacaagaacacauagucagcuucuacgaagcgacagcaagagcuauccaaaaccucccaauaguagaccgcaacuacaacucugaaaaagacugggaauuucuauuuaguaugaagcaaaacgaguacuucguauucccuaauccaaauaccgguuuuaauccauuagaaauagaucuaagaaacgaagaaaauuaugcucucauaucccccaaucuuuuucgcguacagaagcuaucccacuacuauuauguuuucagacaccaccuugaaacaaacgucgacaccaauuuacagcucaaagauauaacuuggaaaagaauuaaggcaauuaauaauuuaaccggaguagugaaaguaagaauagaccauuuagguagaauaguagacgugggagaauacaaauga

SEQ ID NO: 9048 - RNA, 4176 nt, Artificial Sequence
  Cas9 variant
augaagaaaagaauagaugacuauaucuuaggcuuagauaucggaacaaauaguugugguugggcagugacugacaagaaaaacaaucuacucaaacuuagagguaaaacagcaauaggaagucacuuauuugaagaaggacacacagcagcagaucgacgaggcuucagaacaacaagacgaagacugaaacgccgaaaauggcgacuacgccuccucgaagaaauauucgcagaacccauggcagaggucgaccccggauuuuucguucgacuacaucaaucuugggucagcccacucgauaaaucacggaagaaauaccaagcuauaguauucccaacagcaaaagaagaccaagaauacuaucaaaaauauccaacaaucuaccaccuaagagaugccuuaaugacacaagacagacaauucgauuuacgcgaaauauuucuagcaauacaccacauaguaaaauaccgcggaaauuuucuacaagacacugcaguaaaagacuucgaagcaaguaagauagagguaggacccauccuaacuaauauaaacaacgcauuugccgauaaaauaguagaggggcaggauuuaauagaacuaaauguagcuaacgcagccgagaucgaagccgucauaagagggaaagaugcagacaagacccucuacaaaauggacaaaguaaagaaaauugcgaaauuauuaaccgacucaacagcuaaagaacagaaaaacguugcaaaacaaauagcgaaugcgauaaugggauacaaaacucaauuagaaacaauauuagguaaagaaauugauaaaaaugauaaagcccaaugggaguuuaaacuaagcgacgccgaugacaaacuagacgcacuacuccccgaucucgacgaaucugaccaaaccgugguagcugaaauagaaaaacuauucuccgcaauuacacucuccaccaucguagacgaaaacaaaucucuaucucaaagcaugguugaaaaguacaauaagcaccaccaagacuauaaacuuuuaaaggcuuacauugagagucugccagaccgugcacaagcuaagaaacuuuuacuggcauacgauuuauacguaaacaauagacacggucacuuacuagaagcuaaaacagaauuuaaacaagacagcacccuaacuaaagaagacuuuuauaaaacaguuaaagauaauuuagacgacagugaacuggcacauaaaauagcacaagaaauagcagcugauaacuuuaugccaaaacagcguaccaauucaaacggcguuauacccuuucaacuccaccaaauugaacucgauaaaauaauagcaaaucaaagcaaauauuauccauuuuuagcagcagaaaacccaguagaagaucaccgaaaacaagcaccuuacaaauuagaugaauugguaagauuuaggguuccauauuacguuggucccaugauaacagccgaugaacaagagaaaacgagcggcaagagcuucgcauggaugguucgaaaagaacaagggcaaaucacaccauggaacuucgaacaaaaagucgauagacaagaaucagccaacaaauucaucaaacgcaugacaauaaaagacaccuaccuacuaggcgaagacguacuacccgcaaauagucuacuauaucaaagauuugaaguacuaaacgaacuuaacaauaucagagucaauggauccagaauuuccguagauuuaaaacaacaaauauucaaugaucuauucgaagaaaagaaaaccgucaccgaaaaagcccucaucucuuacuuaaaacaaaaccuccaccuuccaacugucgaaauuaaaggauuagcagaccccacaaaauuuaauuccucauuagcaagcuacuaucaccucaaaaaucuacacguuuucgacaaagaacuagcugacccacaguaccaaaaagaguucgagaaaauaauagaauauagcucaaucuucgaagacaagaaaauauuccaagacaaacuccacgccgaguucaaauggcuaacccccgcacaauuuaaagccauaucuacuuggagauuacaaggauggggcagauuaagccgcaaacuucuaguggaacuacaugacaccaacggacaaaacaucauagaacaacuuugggacagucagaaaaauuucaugcaaauaguuacagaaccagauuucaaagaagcaauugcgaaagaaaaucaaaacauaacacaagaaaacggagucgaagaaauacuggcagacgcauacacuucaccagccaauaagaaagcuauaagacaaguaguaaaaguagucgccgacguaguuaaagcagcauccggaaaagcccccgcacaauuugcaaucgaauuuacacgcgauccggauaaaaauccccaacucagucacaucagagguacaaaacuccucaaagcauaucaagaaacugcaggagaauuaguagaucaaaacuuaaccaauaguuuaaaagaagcaaugacaagcagaaaauuauuaaaagauaaauacuuucuauacuucaugcaaacaggcagagaugcauacacagguaagaaaauuaacauagacgaagucucuacaaacuaucaaauugaccauauacugccacagucauucauaaaagacgauucuuucgacaaccguguccuaacagcaacaccacuaaacgcagaaaaaucagaugacguuccuuacaaaagauucgccaauaauuacguuucugacuuaaaaaugacaguaggugaaauguggaaacacuggcagaaggcagggauaauuaacaaacacaaacugggaaauuugcucuuagaccccgaccgacuaucaaaauuucagaaaaguggauuuaucaaccgacaauuaguagaaaccagucaaaucguaaaacucgucuccgucauacuccaaaauaaauacccagacgcagaaauaaucacaguuaaagcaggcgacaauagugcauuacgccaacgccucgacuuauauaaaucucgugacgucaacgauuaccaucaugccauugaugcauauuuaucaauaguuugcgguaacuuuuuauaucaaguuuaccccaaauaucgcccauacuucguauacggucaguucaagaaauuuagccaagauccugacuugcaaaaagauuuaauaaaacauuuuaaaggauucacguuuauguggccacuacuacaaaaggacaacuccgaaagaaaagcucuagaagaaaucaaagaaaacaacagcgaccgaaucguuuucuacaaacacccagacauauucgacaaauuaagaaaagcauacaacuauaaauauaugcuaguuucuagagaaaccucaacugagucaucaucuauguuuaauaugacaauauacccacgaggcgaaagagauaggaaaaagacaagaaaacuaauaccuaaaggcaacggucuggauccaaaaaucuacggaggauacucaggaaauacagacgcauacaugguaauaguuaaaauugaaaaagcaaaggaguccauauauaaagucauagggauaccaaugagagcauuggcgggacuuaaacaagcuaaaaaucaagguaauuauaaagaggaacuccauaaaguagucgaaccacagauaaugcucgacaaaaaugguaaaccaaagagaggaguagaaggauucagaguugugaaagaucacgucccauucaagcaagucguacuugacggagacaagaaauuuaugcuauacagcgcuaaauaugaaacgaaugcaaaacaacuuacucugucacaggaaacaaugcgcauuguaacugacaaccuaaagaaaucagaagaccaagacaaacuauuagugaaggcuuacgaugagaucuuacagaaaguagaccaauaucuaccauuauucgacguuaacaaauuuagaaacagucuucaucuagguagagcaaaauucuuagacuuagcagugaaugauaagaaaaucacacuuucaaauauccuaaauggauuacaugacaaccuaguuguaccaaaccucaaaaacauagguauaaaaacaccuuucggauugaugcaaaguccgagcgguaucacauugucaaguaacgcaauauuaaucuuccaaucacccacuggacuguuugagaaaagaguaagaaucgcagauuuauga

SEQ ID NO: 9049 - RNA, 4176 nt, Artificial Sequence
  Cas9 variant
auggaaaauaaacaauauuauauaggcuuagauguaggaacaaacucagucggaugggcaguaacagauacguccuacaaccuacuaagagcuaagggaaaagacauguggggagcgcgccucuucgacgaagcaaaaacggcugucgaaagacggacgaagagaacgucucgaagacggucagaaagagaaaaagcacggaaggcgauguugaaagaauuauuugcagaugagauuaauaagguugacccaaacuucuucauuagacucgaagagaguaaauuuuuccuagaugacagaagugaaaacaacagacaaagguauacacuauuuaaugacgcaaaguucacugacaaagauuacuaugaaaaauacaaaacaaucuuccaucuacgaucagcauuaauaaauucagacgaaaaauuugacguucgacucguuuuucuugcaauauuaaaccuauucagucaccgagggcauuuuuugaacgcaucacuaaagggagacggagaaauacaagguguagacauauuuuauaaugauuuguacgagguaugcgaagaguucgaaauagauuuaccacaaauaaguaauauagacaacuuugaaaaaauacuaagucaaaaaggaaaaaguagaacuaaaauccuagaagaguuaucagaagagcuaaguauuucaaaaaaagaaaagauuaaauacagucuacugaaacucaucugcggaaugaaaauuaaaguaguagauaucuaugcagacgaagacauacaagaagaugauaaaaaaaaagacuuaggauuucgugagagugacuaugagaaaucaagcuuagagguaaaagaaauuauuggcgacgaucauuuugaacuuauagaacgggcaaaagcaguccaugacauaggcuuguuagccaacauaauuggaaacaguaaauauuuaugcgaagcgagaguagaagcauacgacaaccaccauaaagaccugcagaagaucaaggaacuucuaaaaaaauacgacauaaaagcguacacggauauguuccgaaaaaugaccgauaaaaauuacucagcauacguagguucuguaaauaguaacauugcaaaagaacgaagaagcguagacaauagaaaaauagaagaccuuuaugaauacaucaaaaagaucgcacuaaaaaacauaucggaugauaaugaagauaaaauagaaauacuaaaaaaaauagaaacaggcgaauuuuuaaaaaaacaauuaacagcaucuaacggaguaauaccuaaccagcuucaaucaagggaacuacgagcaauauuaaaaaaggcugaaaacuauuuaccauucuuaaaagaaaaaggugaaaaaaaucuaacaguaucagagaugaucauacagcuauuugaauuucaaauaccauacuaugugggacccuuagauaagaaucccaaaaaagacaaaaaugcgaacaguugggcuguaauaccaagcggcggaagaauccuacccuggaacuuugaagacaaaguugacguaaaaggcagcaggaaagaauucauagagaaaaugguaagaaaaugcacauaccuaagugaggaacauacacuacccaagcaaucauuauuauacgaaaaauuuaugguauuaaacgaaauaaacaauaucaagauagacggcgaaaaaauaagcguagaagcuaaacaaaaaauauacaacgaccuauuuaugaaaggcaaaaaaguuagccagaaggcaauaaaacaggaguuaauuucacuaaacauaauguccaaagauagcgugcuaagcggaaucgacacaguauguaaugcauauuuaaguaguauagcuaaauuuagaggaguuuuugacgaaaacguuaauaaucagucaacaauugauaugauagaagauauaauauuuuuaaagacaguauauucagaugaaaagcgguuugucaaggaagaaauaguggaaaaauauggagacgaaauugacaaagauaaaauaaaacguauucuagguuucaaguuuagcaacuggggaaauauauccaaaucuuucuuagaacuugaaggugcagauguuggaacaggugagauccgaucaauaauacaaucauuaugggagaccaauuuuaacuuaauggaacucuuaucuucacgauuuacauacauggacgaacuagaaaaaagggugaaaaaauuagaaaaaccuuugucggaauggacaauagaagauuuagacgacauguaccuauccaguccaguuaaacgaaugauauggcagucaaugaaaauaguagacgaaauacaaacuguaauaggauacgcaccuaaaagaaucuuuguagagaugacucgaagugaaggagagaaaguacggaccaaaagcagaaaagauagacuaaaggaacuauauagugcgaucaaagaagacuccaaacaauggguuaaagaacuugaugcaaaagacgaaagcuacuuuagaaguaaaaagauguacuuguauuaucuccaaaaaggacggugcauguacucaggcgaaguaauagaacuugacaaacuaauggaugauaaccucuacgacauagaccacauauacccaagaagcuucguaaaagacgacucauuagacaaucucguauuaguaaaaaaagaaauaaacaaucguaaacaaaacgacccaauuacaccucaaauccaagcaucaugccaaggauucuggaaaguccuacacgagcagggcuuuaucuccaacgagaaauacucucgccuaacgcgaaaaacgcaagaauucucagaugaggaaaaacugagcuucauuaauagacaaauaguagaaacaggacaagcgacuaaauguauggcacaaauacuacagaaaucaaugggcgaagauguugacguaguauuuaguaaagcaaggcucguaagcgaauucagacauaaauuugaauuauucaaaagcagacuaauuaaugauuuucaucacgcaaacgacgcauacuugaacaucguagucgguaacaguuacuuuguaaaauuuacccggaauccagccaauuucauaaaagacgcaagaaaaaauccagauaauccggcauacaaauaccacauggauagauucuuugaaagggauguaaagaguaaaagugagguugcuuggauuggacaaucggagggaaaugcaggaacaaucgcaauaguaaaaaaaacaaugagcaaaaacucaccacuuaucaccaaaaaagucgaagaaggucacgggucuaucacaaaagaaacaauagucggaguaaaagagauaaaauuuggaagaaacaaaguagaaaaagcagauaagacacccaaaaaggcaaacuuacaagcauauagaccaaucaaaaccucugacgaaaggcuaugcaauauuuuacgauaugguggcagaacauccauauccauaucagguuauugcuuaguggaauauguaaaaaagagaaaaacaauacgaucacucgaagcaauaccuguauauuuaggaagaaaagauucacuuagugaagaaaaacuccuaaauuacuucagauauaauuugaacgaugggggcaaagauagcguguccgauauuagauuaugucuaccguuuauaucaacaaauucauuaguaaaaaucgauggauauuuguacuacuuagguggaaaaaaugaugauagaauacaacuauacaacgcauaccaacuuaaaaugaaaaaagaagaaguggaauacauuagaaagauagaaaaagcugucaguaugaguaaguuugacgaaaucgaccgagaaaaaaacccgguauuaacagaagaaaagaauauugagcuuuauaacaaaauucaagauaaguucgagaauacugucuuuaguaaaagaaugucauuaguuaaauacaauaaaaaagaccuaucauuuggggauuucuuaaaaaacaaaaaaaguaaauucgaagaaauugauuuagagaaacaauguaaagucuuauauaacauaauauuuaacuuaucaaaucuuaaagaaguugauuuaagugacauaggaggaucaaagucaacuggaaaaugccgauguaaaaaaaacauaacuaacuacaaagaguuuaaacucauacagcaauccauaaccggcuuauauagcugcgaaaaagauuugaugacaauauga

SEQ ID NO: 9050 - RNA, 4176 nt, Artificial Sequence
  Cas9 variant
augaaaagaaauaacgacuauuauauuggauuagauaugggaacuaacagcgugggaugggcuacuacaaacccucaaggacgauuauuacgcuucaacaagaaagacauguggggaagccguuuauucgaagaagcaaaaacagcagccaaaacgaggacauucagaaccagucgaagaagauaugaccgcguaaggcaaagaauagaauuucuccaagauaucuucgcaccaauuaucgccaagaaagauuucgaguucuuuaugagacuaaaagaaucaaaauuucauuuagaagauaagaaaacagacggaaaauucgcacuauucaacgacgcagauuuuacggauguagaauauuucgauagauaucccacaauauaccaucucagagcugcauuaaucaaaccaaaucauauaacagacccaagacuguuauauuuagccauacaucacauaauuaaaaauagaggucauuuucuguucgcaggaacagauauggaaagcauaagaucuuuucaaauagucuauacacaauuaagugaacacuugaaaucgauaaauuuagacuucgaacuaccagucgaugcccaagauaaauucgcugcaauccuacucaaugaaaaacuaaauaaaagggauaaaaagaaacagcucaaagaacucugcccacauaaagacaaaagacuagaauacgcauuuaaugccauaauuggagggaaaacaaaauuaaaagacaucuuuggaguugaagaauacgaugaagggacaaagaaagcuguagauuucgaaaaagcagacuaugaugaagacaaagaugaaauagaaagcguuauuaaagaaaacauucauguccuuaacgcgcuaaaagccgucuacgauuggacaauucuaacgaauauauuaggugauuaugcauauauaagugaaucacaaguagcacuuuaugaggcucacaagaaagauuuaaggauccuuaaaucacucauaaagaaauaugcaaaaucacaauacgcugacgcauuuagacaugaaaauguuaaaggaaacuaugcaaauuauguagguaguacuaacuaugauaacaaacaacccguaaucgauaauccuagugugacgcaagaagauauaaauaaauauuuugcggacauacuacuaucaauaaccccugaugaaucagaucgagaaaguuaucaauacauaacugaacgacuucauaaaggugaagcauuaccuaaauuacgaacaaaagccaacucgguccuaccacaucaaauacauaaaauagagcucgagaaaauuuuagcgaacgcagccaaaaacuuccccuuccuacaagaaaaagacaguaguggcuacacagcagcacagaaaauaguaaaaauuaugauguuuagaauagaauauuauguggguccucucaauacauaucaucacguagaccaaggcggacaugcguggauggucaggaaagcagaaggaaaaauaacgcccuggaacuuugaugaaaaaguagacaaagaagcaucagcagaaaaauuuauaagaaacaugaccaauaaaugcacauaucucaucgggaaagacguaaucccuaaacaaagucuucucuauucccguuauaaaguccuaaacgaacugaacaaucuaaaaguaaauggugcaccuauaucaguagcgcucaaacagaaaaucuaugaagaacuauuuaagaaacaaguuaauguuacauuuaaucaacuaaaaacuuuucuaaaaacccaaggcgaggacgcugacgaaaucauuuuaucaggaguugacgaggcugcgcauaaauucacaaacaacuuacaaacauaucauaaauuuagagcgauacuacgggacaaaaucgaguucgaaccacaaagaaguauggucgaagauauaauuagauggaaaugccuaaugggugaugacauaacuauguggaaacacaaaauugaaaaagaauacggagaucaacuaucugaagaacaacuaaagaaaaucacacgauugaacuucaaugguuggucacgccuaagucaagaauuucuaacggauguaccaggggucgauauagaaagcggugaaguauacucuggcaucauggaugcacuauggcgcacgaacgaaaauauuaugcaauuacucaguucacgcuucacuuucgccgccgaaguaaagaaacaaaaccaaggaacuggaagaauagagaaaauaacuuaugacgaagucaugaaagacaccuauuuaaguccugcuguuaaaagaaguguauggcaagccauuacccuaguagaagaaauucgcaaaauacgaaaagcugacccuaaaagaauauucgucgagaugacaagacaaccagacgcaaagaaagaaaggaaguuaucaagacguacccaacuacuaaaugcguaucgagccauaggcaaugauauugccgaauacgaaaaagaacacguauccacacuaauaacccaacuggaaucaaagaaagaugaagacuuaaggaggaagaaacucuauuuauauuuuacacaaaugggcagaugcauguauacaggagagcgcauagaucuuuccucguuacuaagggacaccaacaguaauauauacgauauugaucauauauacccaaggagcuuaacgaaagaugauucacuggauaacacgguacuauguaagaaagagauaaaccucaagaaaggcaauaaauacauacaccgaguauuuacagacaaagaauuaaagaaacaauauggauauuggaaagcccuaaaagaaaagaaacuaauaucagagagaaaauucagccguuuaaugagaacgacagaccuaaccgcugaugaauuagcuggauucauaucaagacaauuaguagaaacaagccaaauggugaaagcaaccgcugacauacucgagaaaauauauccaaauguuaccauagucuauguaaaagccagaacagucagcgauuuccgacacgauuacgaacuaccuaaaguaagagcuuuaaaugauugucaccacgcucacgaugccuaucuaaacauagucguuggcaacguauauuacgaaaaauuuacaaaaucaccauucagauuuauagcaaaccaaaaaggaaaaggagacauuaaauacaauuuauauagauuauucgacaaagacguuaaaguaggagaucgaauaauauggaaugccaaagaagaucuugcuagaguaaaagccaccuuagaaagagacacaguaaauguaguccggaugccaguugaacaaagagggcaauuuuucgaugccacaauccaaaagaaaggaacgaccaaaaauaugcuuguccuaccguuaaaaggcucagacgaacgacuacaagacacaaguaaauauggauauuauguuagaccaucugguaugucauuuaugguuguacaacaugaagucaaaggaaaaucaagaguuacaauugaaccagcauuauuaguauauaaaaacaaacuaaaaagcgaagacgacuacgcaaaauauugugaagacguauuaaaacuacaaaaaccgaaagugcuguucaaaaacauuaaauuuggaucaaaaauccuauucgauggauauccuuucuuguuaaaaggaagaacagaaaaucggauaauaauggccgacgcccaaucacuauuccuaggaaaucaagaacucaaaauauuaaaaagaguuacaaaaaucuccgaugauauugaccacaaaguugaaagccgaaucaaaauaacagacgaagaauggacaacacuauggaaaagugugguugaacaaauagugacaggaaaauuuagaaauagacuaggaacacucaacggaauuuuacaaggaaggaaaauaaaacuaucuaaagacgaagaagcaaggcugaacgagcuagauucaaaagaccaagaaacuuuccucagccaaauauuauuagaacgauucuuacaauucagcacugaagagaaaacgaggcuacuacuacaaguaauuagcuucucaggaaauacaacaggagucgaccuccgacucauaggagguucuuccgguacuggaaccauaaaaacgaacaaaaauauaacugaccacucaguaauacuaauuaacgaaagcccaacaggacucuucaccaacagaaccguucucaaucaaccauga

SEQ ID NO: 9051 - RNA, 4176 nt, Artificial Sequence
  Cas9 variant
augaaaagaaauaaugacuacuauaucggccuagauaugggaacaaacucagucgguugggcgaccaccaauccacagggacgacuccuacgauuuaacaaaaaagacauguggggaaguagacuauucgaagaagcaaaaacagcagcaaagacacguacguucagaacuagucgccggcgauaugacagagucaggcaaagaauugaauuucugcaagauaucuucgccccgauaauagcuaaaaaagauuuugaauuuuuuaugagacuaaaagaauccaaauuucaucuugaagauaaaaaaacagacggaaaauuugcacuauuuaaugaugcagacuucacugauguugaauauuuugauagauauccuacuauauaucauuugcgagcggccuuaaucaaacccaaccauauaacugacccgcgauuauuauaccuagccauucaccauauuauaaaaaaccgcggccauuuucuauuugcagggacugauauggaaucaauuagaucauuucaaauuguauauacgcaauuaucugaacaucuaaaauccauaaaucuagauuuugaacuaccagucgacgcacaagauaaauuugcagccauucuauuaaaugaaaaacuaaacaaaagagauaaaaaaaaacagcuaaaagaacuaugcccacacaaggauaaaagauuagaguaugcguuuaaugcaauaauuggcgggaaaacgaaauugaaagauauauuuggaguagaagaauaugaugagggaacaaaaaaagcaguagauuuugaaaaagcagacuacgaugaagacaaagacgagauagaaagcguaauaaaagagaauauacacguccuaaacgcauugaaagcaguauacgauuggacgauauuaacaaacauacucggagauuaugcauauaucuccgaaagccaaguagcccuauacgaagcacauaaaaaagaucuuagaauucuaaaaaguuuaauuaaaaaauaugccaaaagucaauacgcugaugcauucagacaugaaaacgucaaaggaaacuaugcaaacuauguugguucaaccaauuacgauaacaaacagccaguaauugauaauccgagcguuacccaggaagacauaaauaaauauuucgccgacaucuuauuaucaauuacaccugaugaaucugaucgcgaaucauaccaauauauaacagaaagauuacacaaaggagaagcguuaccaaaauuaagaaccaaagcaaauucaguccuaccacaccagauucacaaaaucgaguuagaaaaaauuuuagccaaugcggcgaaaaacuuucccuuccuacaagaaaaagauucaucagguuauacugcagcucaaaaaauaguaaaaauaaugauguuuaggaucgaauauuacguugggcccuuaaacacauaccaccacguagaucaaggaggccacgcauggauggucagaaaagccgaggggaagaucacgcccuggaauuucgaugaaaaaguagauaaagaagcuucagcagaaaaauuuaucagaaacaugacuaacaaaugcacauaucucauaggcaaagaugucauacccaaacaaucacuacucuacucaagauauaaaguuuuaaacgaacuuaauaacuuaaaaguaaaugguguaccaauaucaguagccuuaaaacaaaaaauuuaugaagaauuauucaaaaaacaaguuaacgucacauuuaaucaacuaaaaacauuccugaaaacgcaaggagaagaugcagaugaaaucauacucucuggaguugaugaggcagcucauaaauuuacuaacaauuugcaaacauaccauaaauuccgagcaauauuaagagacaaaauagaauucgaaccgcaaagaucaaugguugaggauaucauacgcuggaaaugccuaaugggagaugacauuacaauguggaagcauaaaaucgagaaagaauauggagaucaacuuucagaggaacaauuaaagaaaauaacuagacuaaauuucaaugguuggucuagacucucacaagaauuuuuaacugauguaccaggaguagauauagagaguggagagguguacaguggaaucauggaugcccuuuggcgaacaaaugagaauauaaugcaauuauuaucaagccgauucacuuucgcagcagaagugaaaaaacaaaaucagggaacuggucgcauagagaaaauaacauacgacgaaguaaugaaggacacguauuuaaguccagcagucaaacgaucaguauggcaagccauuaccuugguagaggaaauaaggaaaauaagaaaagcagacccaaaacguauauuuguagaaaugacaagacaaccagacgcaaaaaaagaacguaaauuaagcagaaggacgcaacuauuaaaugcauauagagccauagguaacgauauagcagaauacgaaaaagagcaugugucaacacucauaacacaacuagaaagcaaaaaagacgaagaucuaaggagaaaaaaguuauaucuauauuucacacaaaugggcaggugcauguauacgggagaacgaauagaccucagcucacuucuaagagauacaaauucaaacauauacgacauagaucacaucuaccccagaucccuaacaaaagaugacucgcuagacaauacaguucuuugcaaaaaagagauaaaucuaaaaaaagguaacaaauauauucaucguguguucacagacaaagaacuaaaaaaacaauauggauauuggaaagcucuaaaagaaaagaaauuaaucagcgaacguaaguucucucguuugaugaggacaacagacuuaacagcagacgaacuagcaggauuuauaaguaggcaauuaguggaaacaucccaaaugguuaaagcaacagcggauauauuagagaaaauauacccuaauguuaccauaguauacguaaaagcaagaaccguaucugauuuuaggcaugauuacgaauuaccuaaaguacgagcguugaacgacugccaccacgcacaugacgcuuacuugaacauagucguaggcaaugucuauuacgagaaauuuacgaagaguccuuucagauuuauagcaaaucaaaaaggcaaaggagauaucaaauauaaucuauacaggcuauucgacaaagacgugaaaguaggugauaggauaauauggaaugcaaaagaagaccuagcacgaguuaaagcuacccuagaaagagacacaguaaacguaguaagaaugccaguagaacaacguggccaauuuuucgacgcuacaauacagaaaaagggcacaacuaaaaacaugcuagucuuaccucuaaagggguccgacgaacgacuucaagacacauccaaauauggauacuaugugcggccaaguggaaugucauucaugguaguacaacaugaaguuaaagggaaaagcagagugaccauugagccugcauuacucguauacaaaaacaaacucaaauccgaagaugacuaugcaaaauacugcgaagacguauuaaaauuacaaaaaccaaaaguauuauuuaaaaauauuaaauucggcucaaagaucuuauuugacggcuacccuuuuuuacuuaaaggucguacagaaaauagaauaauaauggcugaugcccaaucccuauucuuaggcaaccaagaacuuaaaauuuuaaaaagaguaacaaaaauuucugaugauauagaccauaaaguugagucuagaauaaaaaucacagaugaagaauggacaacacuauggaaaagcguaguagaacaaaucguaacuggaaaauuccgaaaucgacuagguacacugaacgggaucuuacaaggaagaaaaauaaaauugagcaaagaugaagaggccagacuuaacgaacuugacuccaaagaucaagaaacauuucuuucacaaauauuacuagagagauucuuacaauuuagcaccgaagagaaaacccgccuauuacuacaagucaucagcuucucagggaauacaacggggguugaccuuagguuaauugguggaucauccggaacagguacaauaaagacaaauaaaaacauaacagaucauuccguuauacuaaucaacgaaaguccaacaggcuuauuuacaaacagaacaguucugaaucaacccuga

SEQ ID NO: 9052 - RNA, 4179 nt, Artificial Sequence
  Cas9 variant
augaaauccauacuaggacuagaucuagggacgacaagcauaggcugggcgcuaguaaaagaaucagaaaaugauaaugaaaaaucagaaauaguaaaacucggaguaagauuaguuccacucacuacagaugaacgaacagauuuugaaaaaggaaaaagcauaacaacaaacgcagauaggacaucaaaaagaucaaugcgucgaaauuuacagagauauaaguuaagaagagaagcucuaguaagugaauuaaagaaggaacacuggauagacgaaggauaccgauuuagugaagacgguccaggaaguacauucucgacgcuacgacuccgcgcaaaagccgcugaagaagaaauuagucuacaggacuuagcuaaaguacuucuucaaauaaauaagaaaagaggauacaaaucaucuaggaaauuaaauucagcugaagauggacaagcgauagauggcaugucgguagcuaaagucuuguacgauagagggcuuacuccaggagaauaugucuaucaaagaaugcuugauggccaauacgcaauuccagaauuuuauaaaucagauuuacaagcagaauuugacaaaauauggaacuuacagaaaaguuauuauccagaauugaccgcugagcuauaugacaaacuaacagauaaaaauaaaagucaaacaugggcaauuuguagggacgagcuugguguacagggauucaaaagcaguuucaccggaaaagaacgguuaaaagaggcuuauuuuaacagacaacaagcaucuaaacagaaagucgauuuagaaguccucacaugcguauuacaagauauaaauggacaaaaagccagucuuucgggacuacuaagcgcaauuucggacagaagcaaagaauuauauuucaauagaaugacuguaggacaaaugcuugugagacaaauccaagaagaucccaacagaucauuacguaacacaguauuuuacagacaagauuacauugacgaguucgagaaaaucuggucaguacaaagcagauuucacccagaauugacacaagaaagaaagaagaaauuaaaagacauuauaauauuuuaucaacgaccauuaaaaucccaaaaaggacucauaucauuaugugaauuugaaagucgcgaaguggauauaaguguagauggaguaaucaagaagaagaaaauagggccacgagucuguccaagaaguucaccacuauuccaggaauuuaaagucuaccaaacaguaaacaauauucuagucaacggagaaccauuggacgacaaugauagagaaaaauuagucggugaacuggcauuccgagagaaaaugaaaggacaagauguucuaaaauugcuauacaaaacaucuaaaggcaugagaauaaauuucgaagaaguagaaggaaauagaacgauggcgacaauacuaaaggcuugugagaaaauaguugaaggcuuagguuacgacacaagagauuugaguaaaauaaccgcuucagaaaaaguaucaagaauugaagaaauuuucgcaaaagaagguuuuaaaagugacuuuuuacauuucgauucaagucuuccaucaccggaauuugaaucucaagcaucauacaguuuguggcauuuacuuuauaguuacgaaaacgauaaaaguguauccggaaaugaaucacugguagagaaaauuaaaaaguuaugcucgauggaugaggcuucagcaaaaauauugagcggauguacauucuuaucagacuaugguagucuaucugcccgagcgaugagaaaaauacugccguacaugaaggacggacuagaauauuccgcagcgugugcaauggcaggauauagacacaguaaaagauccuugacaaaagaagaauuggauucccgaguguauguugaccgucuugaacuacuaccgaaaaauucccuaagaaacccagucguagagaaaaucuuaaaccaaaugauaaauguagugaacucaguaguagauaccuaugguaaaccagacgaaauuagaauagaaauggcuagggaacuaaagaaaagcgccucagaacgagaaaaagcacaaaaagacauugcagcagcuagcaaaguaaaugaaagcauaguggcaacuuuaaaaggaagucccuuuuucauagacucuccaagcagaaacgauaucauuagauacagacuuugggaagaacucaaaccaaauggauauaaaacacuauauucggggacauauauuccaaaagaaaggcuguuuucuaaagauuucgacaucgaacauauaauuccacaggcacuucuuuuugaugacucauucgcaaauaaaacaauagaaucgcgacaauguaauaucgaaaagucaaauagaaccgcaauggacuacgucaaaaguaaauacgacaguuucggagugcaagcauacauagacagagugaaagggcucacagguguaaguaaaacuaaaauaacacgacuacuuauggaaucgaaagauauuccagaagauuuuauaaacagagaauugcgggacagccaauacauagcaagaaaagcacgugaaauuuuagaaaguaugguuaaauuuguaguaccaacaacggggagugucacugcaagguuaagagaagacuggcaauuaguaaacguaaugagggaauuaaauugggacaaguacgaaaaacuaggauuaacaucauuucgggaagauagagacggcagagaaauuccuguaauugaagauuggacaaaaagaaaugaccaucgacaucaugccauggacgcauuaacaauagcauucacaaggcgacaauucauacaauauuuaaaucacuuaaacgcuaaaauagacacgguagauaaaacagacaucgauuuacgagauuauaaucucgaagauauuuccuuugauggcuuaagagauggggauaaguucggcauaguaaaagcacuacaaaagaaauaccuauauaaagacgacaaacaaaaauacagguuuguuccaccuaugccacuagacgaguucagaauagaagcgaaacgccaaauagaagacguuuugguuaguuuuaaagcuaagaauaaaguauguacuaaaaacguaaauacaacaaaggugaggggaggacaacaacgaaaaauacaauugacgccuaggggacccuuacacgaagauacuauauacggaaaaagacuucaauauguaacaaaagaagaaaaagucggagggucauucgaugaagccaagaucgcuagugugugcaagaaaaguuauagagaagcguuaaugaggagauuaauggaaugcggcggugacccaaagaaagcauuuacagguaaaaauagccuagagaaaaacccaguauggguagacgaguuccacaguggagaagucccccuaaggguaaggacagugagcauggcaucaguuuacacaguuagaaaaaguguuggacaaaguuuaaauauagaaaaaguauuagacaaacacauaaaagaaauacuacgugcccgauuagaagaauauggagguaacgcuaguaaagccuucucaaaccuugacgaaaauccaauaugguuaaacaaagaaaaaggaauugcaguaaaacgaguaacaauugacagcgggaaaaauccaauuccccugagaagcaaacucgacaaggauggacaaauaauuuauggagaaggacaaaacccccaagaaucggauuuuguuguaccaggcggaaaucaccaugcagcgaucuauagaacuccgagcgguaaauuacaagauguaguuguaucauuuuaugaagcaguaucaaggaaaaauuuaggauuagaaguaauugauagaaauuucaaaaaggaugaaggcugggaguucuuauuuacauuaaaacaaaaugaauauuucguuuuuccaaacccagcuacaggguucuccccggaagauuacgauuuaacagauccagccaacaaugcuauaauaucaccaaaccuauaucgcguucaaacagugucaguaggcgacuauagauucagacaccacuuagaaacaacugucgaagacaaugaaaaacuucgagauaucgcauggaaaaggaucgggccaucaggucucguaggagccguuaaaguacguaucgacaauuuaggaagaauauuggcaguaggcgaauaugauuga

SEQ ID NO: 9053 - RNA, 4179 nt, Artificial Sequence
  Cas9 variant
auggaaaacaaaaauuauuccauaggguuagauauagguacaaauucaguaggaugggccguaauaacggaugacuacaaaguaccauccaagaaaaugaaaguuuuuggcaauacagacaaacauuuuaucaagaaaaaucuaauuggugcacuucuauucgaugaaggugcuacagcagaagauaggcgacuaaaaaggaccgccagaagacgauauaccagacgcaaaaaucguuuaagauacuuacaagaaauuuucuccgaagaaauuaguaaacuagacucguccuucuuucauagguuagacgacaguuuucuaguuccaaaagacaaacgcggcucaaaauacccuauauuugcaacccuagaagaagaaaaagaauaccacaaaaaguuucccacaauauaucaucuacggaaacaccuugcggauuccaaagagaaaacugaccuacgacuaauauaucuggcguuagcccacaugauaaaauaucgcggccacuuuuuauaugaagaaucauuugacaucaaaaauaacgauauacagaaaauauucaacgaauuuaucaguauauacgauaacacauucgaaggcucaaguuuauccgggcaaaaugcccaagucgaagcaauauucaccgacaaaauaucaaaaagcgcaaaacgcgaaagaguauuaaaauuauucagcgacgaaaaaucaacaucacuauucucagaguuccuaaaauuaauaguaggaaaucaagcugauuuuaagaaacauuucgaucucgaagaaaaagcaccauuacaauucucaaaagauacauaugaugaagaccucgaaaaccuacuaggucaaaucggugacggauuuaccgaucuauuccucguagccaagaaauuauacgacgcuauacuacuuucaggcauacuaacggucacagacccgucuacaaaagccccauuaucagccucgaugauagaaagauaugaaucucaccaaaaagaccuagcagcacuuaaacaauucaucaaaaacaaucuuccaaaaagauacaacgaaguuuucucugaucaaucaaaagauggauacgcaggguauauugauggcaaaacuacacaagaggcuuucuacaaauacauuaaaaacuuacuauccaaauucgaaggagccgacuauuuccuagauaaaauagaaagagaagacuuccuacguaaacaaaggacauuugacaauggaaguauaccacaccaaauacaucugcaggaaaugaacgccauacuaagaagacaaggcgaacauuauccauuccuuaaagaaaaccgagagaaaauugaaaagauacuuacauucagaaucccuuacuaugucggaccucuagcacgaggaaacagagauuucgcaugguuaacaagaaauuccgaucaagcuauucgaccuuggaacuucgaagaaauaguugacaaagcuaguagcgccgaagaauuuaucaauaaaaugaccaacuacgaccuauacuuaccagaagaaaaaguauuacccaaacauucucucuuauacgaaacauucgcugucuacaacgaacuuacaaaaguaaaauuuauagcugaaggacuacgugacuaccaauucuuagacuccggucagaagaaacaaaucgucaaucaacuauucaaagaaaagagaaaaguaacugaaaaagacauuauacauuaucuccauaacguugauggauacgacggaauagaauuaaaaggaaucgaaaaacaauuuaacgcaucauuauccacguaccacgaccuuuuaaaaauaauaaaagauaaagaauuuauggacgaccccaaaaacgaagaaauucuagaaaauauuguacauacccuaacaauauuugaagauagagaaaugauaaaacaacgacuugcgcaauacgauucaauuuucgacgaaaaagucauaaaagcauuaacaagaagacauuacacgggcugggguaaacuguccgcaaaacucauaaauggaaucugcgacaaacaaacaggugacacuauuuuggacuaucuaauagacgauggaaaaauaaaccgaaauuucaugcagcugauuaaugaugauggacuaucauuuaaagaaauaauacaaaaggcacaaguaguuggaaaaacagaugacgucaaacaagucguccaagaacuaccaggcucaccagcaaucaagaaaggcaucuuacaaucuaucaaaauagucgaugaacucgucaaagucaugggauacgcucccgaaaguaucguaauagaaauggcaagagaaaaccaaaccacugcucgaggcaagaaaaauucacaacaacgauacaaaagaauugaagacucucucaaaaaccuggcccccggauuagauaguaauauacuaaaagaaaacccaaccgacaacauacaacuacaaaaugacagauuauuccucuauuauuuacaaaauggcaaagauauguacacggggaaaccccucgauauagaucaacuaagcucuuacgacauagaccauauuaucccccaagccuucaucaaagacgacucaaucgauaaccgaguauuaacaaguuccaaagacaauaggggaaaaucugacaacguucccagcuuagaaguaguacagaaaagaaaagcauuuuggcaacaacuucucgacaguaaacucauaucagaaagaaaauucaauaacuuaaccaaagccgaaagagguggauuagaugaaagggacaaagucggauucauaagaagacaauuaguggaaacaagacaaauaacaaaacauguagcgcaaauauuagacgccucguucaauaccgaaguuaacgagaaaaaucagaaaauacgaacugugaaaauuauaacacuaaaauccaaccucguaagcaauuucaggaaagaauuugaacuauacaaaguuagagaaauuaaugauuaucaccacgcacaugacgcauaccuaaacgcaguaguggcaaaagcaauacucaagaaauacccaaaacucgaacccgaguucguuuacggugacuaucaaaaguaugauuugaagagauacauuucaagguucaaaccaucaaaagaaauugaaaaagccaccgaaaaauacuucuucuauucgaaccuucuaaacuucuuuaaagaagaaguacacuaugcagauggcaucauuguaaagagagaaaacauagaauauucaaaagauacaggagaaauagccuggaauaaagagaaggacuuugcuacaauuaaaaagguacuaaguuacccacaaguaaacauaguaaagaaaacagaaauacaaacccauggcuuggaccgaggcaaacccaaaggacucuuuaacaguaacccgucaccaaagccaucugaagacucaaaagaaaaccucgucccuauaaagcaagguuuagauccucgaaaauacggaggauacgcuggaaucuccaacuccuacgccguacucguuaaagcaauagucgagaaaggagccaagaaacaacagaaaacgauacuagaguuucaaggcaucagcauucuugauaagauuaauuucgaaaacaauaaagaaaacuacuuacuaaagaaaagguauauagaaauacuaagcaccauuacacucccuaaguacucauuauuugaauuuccagauggaaccagaagaagacucgcaucaauauuaucaacaaacaacaaaagaggcgaaauccacaaagguaaugaguuaguucucccuggcaaauauacaacacuauuauaccacgcuaaaaauaucaauaagaaacuagagccagaacaccuagaauaugucgaaaaacaccguaacgacuuugcaaaacuacuagaaugcgucuuaaauuuuaaugauaaguauguaggagccuugaagaacggugaacguauccgacaagcauuuacugauugggaaaccguugacauagagaaacuuugcuucucauucauaggaccagaaaacuccaaaaacgccggccuauuugaauuaacaucacagggaucagcuucugacuuugaauuucucggaguaaaaauuccucgcuaccgugauuaugccccauccucacucuuaaaagcaacauuaauacaucaaaguauuacaggucuauacgagacacgcauagaccugucaaaacuaggagaggacuga

SEQ ID NO: 9054 - RNA, 4179 nt, Artificial Sequence
  Cas9 variant
augaacaauaauaauuauucaauaggccuggacauaggaaccaauuccguaggcugggcaguaauaacagaugacuacaaaguuccaagcaagaaaaugaaagugcuaggcaauacagacaaacacuuuauuaaaaaaaacuuaauaggugcccucuuguuugacgaaggcgcgacagcugaagaccggagauucaaaagaacugccagaagaagauacacaagaagaaaaaauagacugcgcuaucuacaggaaauauucucagaggagaugucgaaagucgacucaucauuuuuccauagauuagacgacucuuuccuaguacccgaagauaagcggggaaguaaauauccaauauucgcaacacuugcugaagagaaagaauaucacaaaaaauuuccuacuauuuaucaccugagaaaacaucuugcugauuccaaagaaaaaacagaccucagacuaauuuauuuagcccuugcacacaugauaaaauaucggggucacuuucuauaugaagaaucguucgauauaaaaaacaacgauauacaaaaaauauuuucagaguuuauauccauauaugauaauacauucgaaggaaguagccuuaguggccaaaaugcucagguggaagcgauauucacagauaaaauaucuaaauccgcaaaaagagaacgaauauuaaaacuauuugccuaugagaaaucaacagacuuauucagcgaauuccugaaacuuauagugggaaaccaagcagauuucaaaaaacauuuugacuuagaagaaaaagcuccacuucaguuuagcaaagacacauacgacgaagaccuagaaaaucuucuaggucaaauaggugacgauuuugcagaccuauuucuagucgcaaagaaauuguaugacgcaauauuacuuaguggaauacuaaccguaacagacagcucaacgaaagcaccacucagugcauccaugaucgagcgauacgaaaaccaccaaaaggaucucgcagcccuaaaacaauuuauacaaaacaaucuacaggaaaaauaugacgagguauuuucagaccaaucaaaagacggauacgcgcgguauaucaauggcaagaccacacaagaagcguuuuauaaguacauaaaaaauuuacuuucuaaguuugaaggcagcgacuacuuccuagacaaaauugaaagagaagauuuucuaagaaaacagagaaccuuugacaauggaucaauaccacaucaaauacaucuacaagaaaugaacgcuauaauuagaagacaaggagaacauuacccguuucuuaaagaauacaaagaaaaaauugaaaccauccugacuuuuagaauaccauacuaugugggcccacuugcuaggggcaacagaaauuuugcauggcucacuagaaacagugaucaagcaauaagaccauggaauuucgaagaaauaguagaccaagcaucaagugcagaagaauuuauaaacaaaaugacuaauuacgacuuauacuuaccugaggaaaagguauuaccaaaacauucauuacuuuacgaaacauucgcaguauacaacgaacucacgaaaguaaaauuuauaucagaaggcuuaagagauuaucaauuucuagauagcggucaaaaaaaacaaauaguaaaucagcucuuuaaagaaaaacgaaaagucacggaaaaagauauuauacaauauuuacacaaugucgauggcuaugacggaaucgaacuaaaaggaauugaaaaacaauuuaaugccucucuaucaacauaucacgaccuucuaaaaauaauaaaagauaaagaauuuauggaugacccaaaaaaugaagaaaucuuagaaaacauaguacacacgcuaaccauuuuugaagacagagaaaugaucaaacaaagauuggcucaauacgcuucaaucuuugauaaaaaagucauaaaagcccuaacgagacgacauuauacaggaugggguaaauuaucagcaaaauuaauaaacggaauaugugauaaaaaaacuggaaaaacaauauuagauuaucuaauagaugacggauauucaaacaggaacuucaugcagcugauaaacgacgauggacucucuuucaaagacauaauucaaaaagcucaaguaguaggcaaaacaaacgacgugaaacaagucguccaagaacuaccagguucccccgcaauuaaaaaagggauauuacagagcauaaaacuugucgacgaacuaguuaaaguaauggggcacgcacccgaaaguauaguaauagaaauugcacgggaaaaccaaacaacagcccgagguaaaaaaaauagccagcaacguuacaaaagaaucgaagacgcacucaaaaacuuagcacccggguuagacuccaacauacuaaaggaacacccaacagacaauauccaauuacaaaacgaccgacucuucuuauacuaucuucagaacggaaaagauauguacacaggagaagcauuagauaucaaccagcuaagcaguuacgacauagaccacaucguuccgcaagcguuuauaaaagaugacucacucgauaauagaguucugacaucuaguaaagauaacagagguaaaucagauaauguuccgucccuagaagucguacaaaaacgcaaagcauuuuggcaacaacuauuagauaguaaacuaauuagcgaacacaaguucaauaaucucacaaaagccgaaagaggaggacuugaugaaagagauaaaguaggauucauacgacgacaauuaguugaaacaagacaaaucacaaaacacgucgcacaaauauuagaugcucgauucaacacggagguaaacgagaaggauaaaaaaaaccgaaccguaaaaauaauaacguuaaaaucaaacuuagucucaaacuuucgaaaagaauucaaacuguauaaaguaagggagauaaaugacuaccaccaugcccacgaugcauaucuuaaugccguugucgcaaaagcuauacuuaaaaaauacccaaaacuagaaccaggcuuuguauauggagauuaccaaaaauaugacauuaaaagauauaucagcagguccaaagacccgaaagaaguagaaaaagcaacugagaaauacuucuuuuacagcaaucuacuaaauuuuuucaaagaagaaguacauuaugccgacggaacaaucguaaaaagggaaaauaucgaauacagcaaagauacaggggaaauugcauggaauaaagagaaagacuucgcaacaauaaaaaagguccuuagccuaccccaaguaaauauugugaaaaaaacagaaauucaaacacacggauuagaccgaggaaagcccagggguuuauucaacucaaauccuucgccaaaacccagugaagacagaaaagaaaaucuaguaccaaucaaacaaggacuagacccaagaaaauacggaggcuaugcuggaauaucaaauuccuaugcaguucuagucaaagcaaucauagaaaaaggagcaaaaaaacagcaaaaaaccgugcuugaauuucaaggaauauccauacuugauaaaauaaauuucgaaaaaaauaaagaaaauuaccuucucgaaaagggcuacaucaaaauauuaucaacaauaacacugcccaaauauucccuauucgaauucccagacggaacaagaagaagauuagcaucaauacuuuccacaaauaacaaaaggggcgaaauacauaaaggcaacgaguuaguuauucccgaaaaauauacaacauugcucuaccaugcuaaaaauauuaauaaaaccuuagaacccgaacaucuugaauacguugaaaaacaccguaacgauuuugcaaaacucuuggaauacguacuaaauuucaacgauaaauacguaggagcguuaaaaaauggagaaaggauacgacaagcuuucauugacugggagaccgucgacaucgaaaaacuaugcuucucguucauaggaccuagaaauucaaaaaacgcagguuuauuugaauuaacgucacaaggcagcgcaucagauuuugaauuccuuggcgugaaaauaccgagauauagagauuauacaccuucuuccuuacuaaacgccacccuaauacaccaauccauaacaggauuguacgaaacgcguauagaucuaucaaagcuaggagaagauuga

SEQ ID NO: 9055 - RNA, 4179 nt, Artificial Sequence
  Cas9 variant
augaagaacuaccauauaggacuagacaucggaaccucauccguaggauucgcagcacgagacgaugaaaacaauuuaauuagaguaaaagguaaaaaugucauaggagcgcgacuauuugccgaaggcaaaacagcacaagaacguagaauggcucgaacgucaagacggagauacaaucggagaaaauggagauuacgacuacuuaaugauauauuucaugacgaaauaguacacaaagacaaagauuucuuuaaucgccuaaagcaaucuucaaucucuccaaaagacgaccgaaagaaauauuuugggagccuacuuuucccagaacugucagacucugaguucuaucauaacggaaaucaaacaauuuaccaucuccgacauagacuaaugacuucgaaugaaaaagccgauauacgugaaauauaucucgcacuaagacauauaguuaaauauagaggcaacuuuuuagaugacacaccaguaucgucguucgaggcuucagacuuaaaacuagggagcuucauacccacucuaaacgaccuauucgaaacaauugacguaaacuacguauucaauucugaaaacacaaaucagauagagucaauacugcuaaauaacgaucuuagaaacucagacaaaagcaaacaauuaguugacuuacuauaccggaacguauccgauguugaugauaagagcuuagaaaaacaauuuaacaaguuucgcaaggauauuucuaaggaaauugcaaagagcuucgugggaucaaaauucaacguaaacaaacuucuugccuaugaaacagaugauggaagcaaaaucagucugagcuuuagcgacgccagcagcgacgauaaaauguuagaauuagccgauaaucuagaugaugaaagaauaaacauuuuaaacgcucuaaaaguaauauauucacguguaagauuaaaucagauaauaccaaauggcaugggauugucagaaagcaugauagcauccuaugaauuacacaagaaacaacucaaugaccuaaagaaacuccucaacguuuuaccuuuucacgaaaaauacgccguaaaaguugccuaugcagcuuauauagggaauauggaugcucaaaaauuuacucaagccgaacuuaguacaaucgagaguuugaaagaaaaagauucuauaaagaaaguaauagauugcaaaacaggccacauaacaaaugaaucgcuaauaucuguuauaaaccaaauaguuguaaacccauaucuagaaaauucagacuucgaguuaauagacaucguuaagaaaauagaccaagacauuaaaaacggcgaauaucuauuaaaacaaagaaauaaucaaaauggaaauauuccccaccaacuccaucaaauggaaauggaucaaauaauagaaaaacaaucaaaauauuaucccuuccuaggagaacuaaauccaaacgaaaacagacgccauauagcaaaauauaaaauuuccgaacuuguagcuuuuaggguaccauacuacgucggaccacuuauaaccccugaagaacaggcuaaaacuuccggagcaucauucgcauggaugaaaaggaaagaagacggugaaaucacaccauggaauuucgaucagaaaguugaucgcgaagcaaccgcaucucgcuuuauaaaacgccuaaccgugaaagacaccuaucuauuuaaugaagacguccuaccagacaacucauuacucuaucaacaauuuaaagucuuaaacgaacuaaacguuguaaaaguuaacaauaaacgcuuaucacaagcagaaaaacagggcgcauucaaugaucuauucaaaguaacaaagacuguaacagcuaaaagguuaaagaauuacuuaguuucaaacuucaaccauuuagacacaauagaaauaaccggauuaucugauggagaaaaauucaauaacggacuaaccucauacguugauuuccaaaagauauucggagacaaaauuaacaauuuggaauuaauggaugacuuugaaucuuuaaucgaaugguccaccguauucgaagaccgacacauuuucgaagaaaaagugcguaacgagaucaacuggaucagcgaaagugaauugaaacagcuaguugcuaaaagguacucaggauggggcagauuauccucaaaacuauuaguaggaauaaacaacgacgaaggccgaaacaucaucgaacaauuauucgagacuucagaaacauuuauggaagcaauuucaagaccagaagucaagaaacaaaucgaugaaauaaacucagauuucauuaaaaauacagacauagaaucaguuuuagcagacgccuauaccaguccacaaaacaagaaagccauaagagaaacauauaaaaucguaaaagauauacaaaaagccaugggaggaaaagcacccgagagcaucucuauagaguucacuagaaauccagaagacaaaggagaacuaacaagaagcagacauagugaaauuuccagaaaauacaaagaacuaucuaaagaaaucagcaaagaauuaaacgaugaguuaaaaucgaagaaaaacuccauggacauagauaaauauuacuuauauuuuaugcaaaugggaaaagaccuauacgacggaaaaagcaucgauauagacgacuuaaacaauuaucaaaucgaucacaucgucccccagagcuuuuauaaagaugacagcuuugacaacagaguacuaaccuauuacacaaauaaucaaaagaaaggaaacaacacuccccuaaauggauuaaauauuucuaaugaaacacgaaaauuauggucccaucuccacgacuuaggacuuauauccaaacgcaaauaccuuaacuuaacgaugcagggacuagacagucucuccaaauacaccaaacacggcuucaucagacgacagcuaguagaaacaagccaaguaauaaagcuaguagcaaauauacucucagaugaguucucagcagauaauacgaaaauaauugaaguuaaagcaaaaaugaacucacaaaugcgccacucuuucaacuuauauaagauccgagaacuuaacgacuaucaccacgcccucgaugcauaccuaaccacauuuauuggaggcuaucuauauaacagauaucccaaacuucguggaauguuuguauauggugacuucaagaaauuugacguaaacgacgcuaauaauguaaaaacacuaaauuuccuacaugacauaacuaauccuucagacaaauuugugaaccagaucuacgacgagcaaagcggcgaauuaauacuugauagaaaacaugcaauugaaacaaucaaaaagauauaccaauauaaauuuaugcucauaacuagagaaguaaguacaaaagaugacaaacucucggaccaaacaguauacuccgcaaaacguauaaauaaugucgcuucaccuauacccguaaagaaagauucaaauccagaacuauacggcuucaggacaggaaacgucgaccaccacaugguaauaguuaaauacccgaagaaagacagcuuuguauauaaaguaguaggaauaccaauacgauucaugcaagaacuaaggucaaguaaaaaucaaucagaauacgaaaauacuuugaaccagauaguacaagcuaaacucaaucgcaagaaauucgauuuuagagucguaguagacaacgucauguauggacaauuaauacaagacggaggccaaaaauucacgcuugguucgucaacauauagguauaaugcuaaacaacucguauuggacauggauucauuaagaauccugucugaugaaaaauaccgaaauucccuaaccgacgaugagaaaaauucagaguucauaaacauauaccaacaaguucuaaauguggucaaugaaaaauucgacguauucgauguaagaggaacucgagacaaacuuacaaaaggacuugacaaauuucucaacauaacaucaaaugauaaagaaauaguauuauuaaaaauacuaucaggccuacacugcaacgcugcaagaguaaaaaucaaugaaaucggaauaaacaccagcuuuggagaacuacaaacaacccauggaauuguacuaagcgaaaacagcuauaucauuuaccaaagcccgagugguuuauucgaacguaaaguuagauuaaaagauuuauga

SEQ ID NO: 9056 - RNA, 4179 nt, Artificial Sequence
  Cas9 variant
auggcgaauaaaaccugguaccuaggccuagauaucggaucagcaagcguaggaugggccgcaacagacacuggcuauaagaucauaagaaaaaauaaaaaacgacucuggggaguuagacuauucgaagaagcgaaaaccgcggaagacagacgaggcuauaggucaucucguagaagauuagcaagaagaaaauggagacuaaaucuacuagaggagcuauucaccagugaaguaaaaaaaguagacgaaaacuucuucuuacgccuuaaagagucucaauaucacuacgaggauaaaacacacaaaguaccauacgcaauuuucaacgauaaagauuacacggauaaagacuacuauaaagacuauccaacgauauaccaccuaagaucuaaauuaaugaccgaagaaaauccagacauaagaaaaguguuccuagcaauacaucacauaauaaaaaauagagggcauuuuuuauuacagggacaauccuuuaaagacgguaaucuaaauaaccuaauaaaagaacuacuagaauuagauauauuacaugugggguuugaagugaccgaagaaguaguagacaaaauagccgacauaagccuggaaaagaaaacaaguaaagauaaguugaacgauauaaaagaauuguauccuaaagagaaacaauuguuggaaguauuucgauugauauuugggggcaaaacgagccuugacaaacuauucgcaauagaugaauacaaagaauuagaugcagcaauaaaaucuguaagcuuuaaagagaaaauuuacgaagaaguccgacacgacuaugaacaaguccuauccaacuauaucgaacuucuagaccuagcaaaacuagucuaugauucaauuauucucagcgacauaaaaaaggaaggaaaaacacuaucagaaucaaaaguagaguuauucgaaaaacauagagaugaccuauuaaaacuaaaaaaucugguaaagaacgacaguaaacuaucagaagacaaaaaaguagaacuauaugcgcuaauuuucaaagaagauaaagauaaaggaaccaauuacguaaauuacauacggaaaagcgaagagggcaaagguuguaauuacgaagacuuuaaaaaauucuuagucaaagaacuugcaaaacuagaagagagcaguguaaaaacggaaaucauaaaagacuuagaauuagaacaauuccuaccauuacaacgaacaaaagauaauucaguagucccauaucagauucacaaagaagaacuaguaaaaauacuagauaaugcagcacgguaccauagcuucuuaaaugaaaaggacgaaucaggauacaauguaagagaaaaagugauacaauugcuagaauuuagaaucccauauuacgucgggccauuaaacaguucaaaaaaggccaaagaagguggauuugccuggaguguaagaaauacagguuaugaaaacacgcccguuacgccuuggaauuauucaaaggucauagacgaaucagcaagugccgaaaaauucauuacaaauuuaacaaacaaaugcaccuaccucaagggggaagauguauuaccaaaaagcucacucuuauacucagaauucgcacuacugaaugaacuaaacgcacuaaaauaugaugggaacagaauauccuuagaggcaagaaauaccauaauagagaaauuauucaaacaacaaggaaagaaagucacaaaaacaucaauaaaaaaucuacuaaaagcggaagguuauaucgacggcaaaggggaaauaaccggaauagacauuaccguuaaaaaugaccuuaagucauaccgugauuucaaaaagauauuaggaaauaaguuuaacagcgaacacguugaaaauaucauauuguggauaacgcuauacggcgaaagccgaaaguuaaucaaagcaaagauagaaagcgucuacggagaaguuuacaguaaagaugaaauaacaaaaaugucaagacuaguuuacaaagauuggggucgcuuuucacgaaaacuacuaacugaacuuguaucuaaaaaauuauauaaugaagaaacuggggagugccucaauauaauaggagcaaugcgucagaauaauauucuauucauggaauuacuagcugauagauucgauuacaguaaacaaauugucgaguucaacaaagaacuacaagaagacgucacagagaucgcacccgaaauccuagacgaccuauauguuuccccagccgucaagcgcagcauauggcaaacaguaagaauagucgaagaacuuaaaaaaaucauaggaugcgccccagcaaaaauauuugucgagacuacacguaguaaccaagaaaaaaaaaaaccaacagacuccagaaaaaaacaauuagaacuagcauacaaagcaguuaaaaaagauguaaaggaacuagagaaagagauaggcacgaucaauuucgacguguuaaacgaccgccuaaguucgguugaaccaucaaagcuaaaagcaaaaaaauuauaccuguacuacacucaacucggaagauguauguacuccgaggaaccgauaaacauuucagaguuauuugacaauaacaaauacgacauagaccacauauauccacaauccaaaauaaaagacgauagcuuuacuaacaccguccuagucaagcgagaaucaaacgcggccaaaaccgaucgauauccacuuggaagcgacauacaaacaccuucaaaccgucgcuuuuggaaguuuuuaaaagagaaggggcucauuagcgacgaaaaauacaauagacuaguaagaacagaagaauucagcgaugaagaacuuucaggguuuauagcuaggcaauuaguugaaacaagccaaagugucaaagcaguagcuagcauuuuaggagaauugaauccagaaacaucgauuuguuacucuaaagcagaaaacgugucaaguuuucgccaaaauuuuggaaagaucaaaaagggcgaccgagauagcaaaaauaacgaccaguuaaucaaaguacgcgaaaucaacgacuaucaccaugcuaaagacgcauaucugaaugucguaguuggaaauguuuacgauacaaaauucacacgaaacguauuuaacuucauuaaagacaaaaaagacgggagaaaauauucacugaauaagguauuuuaugaaaaugucagugacucaaaaacaguugcaugggagauggauaaaacaauucaccaagucgaaaaaguuaugaacaacaauaacauaaugguaacacguagaacaucagaacagaaaggaggauuguucgaugccacaguguauaaagcuaaggucgcugccaaagcuaaagauggaguauacuaucccuuaaagaccucaaacucaguaguaaaagauguagcuaaauaugguggauauacaagcauaggaauagcauacuacucgauauucgaauauaccauaguaaauaaaaaaggagaagaaaaaauaacaagaaucauaccaauacccauauauauaucacaaaacauaaaggacuccaccgcacuaaucgaauucggcaaaucacaaauauucugcagggcguacgaaaaaaucaaagacuuuaaacuccuauauagaaaacuauguauaggaagcaaaauaaauauaaacaacuaucaauauuauauaggaggaaaaagcgacgaacguuucuacuacgauucagcaauccaaguaacccuugacaaaaaauccgaaaaauauuuaaaaauucugucaaaguaucaaaauuggaaaaaagaaaacaaagauggcgaauuaugggagaacauaacaaaagaaaauaauauagaacuuuacaauaaauugguagaaaagaugaacagugagauuuucaccaaaaagaaaagcaauaaauacaaugaacuaaacagcgaagaaauacgaaacaauuucauaaaaauaucgguagaagagcaagcgaaagugcuacuagagaucuuaaaccuucuuacaaacaaaaaauccauuuucgacuuaaagucaauugauauaaaagcagcacgaggaaaaauuaguuuuaauuuaacaagcuugauacaauucaguaucauagaacaaaguauaaccggauuuuaugaaaaagaaauaacuauuauuggagauaaaggaaaugauauggaaaacaacaacaguuga

SEQ ID NO: 9057 - RNA, 4179 nt, Artificial Sequence
  Cas9 variant
augaauaauaauaacuauaguauaggacuggacauagggacaaauaguguagguugggcggucauuacugacgauuacaaaguacccucuaaaaaaaugaagguauuagggaacaccgacaaacacuuuauuaaaaaaaaccuaauaggagcgcuacuauuugaugagggcacaacagccgaagauagacgacuuaagcgcacagcaagaagaagauacacaagaagaaaaaauagacuucgcuacuuacaagaaauauuuuccccggagaucucaaaggucgacucuaguuuuuuucaucgauuagacgacucuuuucuaguacccgaagacaaacguggaagcaaauacccaauuuucgccaccuuagcagaagagaaagaauaucacaaaaauuuuccaaccauauaucaccuaagaaaacaacucgcagauuccaaggaaaaagccgacuuaaggcuaauauauuuagcacuagcccacaugaucaaauauagaggccacuucuuauacgaagaaagcuucgacauuaaaaacaaugauauacaaaaaauauuuaaugaauuuauuucaauauaugauaacacauuugaaggaagcagccuaaguggucaaaacgcccagguggaagcaauauucacagauaaaaucucaaaauccgccaaaagagaaagaguucucaaacuauuucccgacgaaaaaucaacuggucuauucagugaauuuuuaaaacucauagugggaaaucaagcagaauuuaaaaaacauuucgaccuugaagaaaaagcaccacuccaauuuagcaaagauaccuacgacgacgaucuagaaaaccuguuaggucaaauuggugauggauuugccgaacuauucguagcagcaaaaaaacucuaugacgcaauacuauuaagcggaauccucaccgucacugacccuucaaccaaagccccauuaagcgccucaaugauagaaagguaugaaaaccaccaaaaagaucuggcugcacugaaacaauucauccagaacaaccuacaagaaaaauacgacgaaguuuuuucggaccaauccaaagacggauaugcaggauacauuaacggaaaaaccacacaagaagcauuuuauaaauauauaaaaaauuuacuaaguaaauuugaagguucagauuauuuucuagacaaaaucgaacgugaagauuucuuaaaaaaacaacgcacauuugauaauggauccaucccacaucaaauacaccuucaagaaaugaacgcaauaauacggagacagggugaacacuacccauuccuacaagagaauaaggaaaagauaaagaaaauauuaacauuuagaaucccauauuauguaggcccucuugcaagaggaaacggagauuucgcauggcuaacaagaaacagugaccaagcaauacgaccguggaacuucgaggaaauaguugaccaagcaucuucagcugaagacuuuauaaacaaaaugacaaacuacgaucucuaucuaccagaagaaaagguacuaccaaaacacucacuacuauacgaaacauuugcaguauacaaugaacuaacgaaaguaaaauucauugcagaaggacuaagagacuaccaauuuuuagauaguggacagaaaaaacagauagucaaucagcuuuucaaagaaaaaagaaagguaacugaaaaagacauuacacaauauuuacacaaugucgacggauacgacgguauagaacugaaaggaauagagaaacaauuuaacgcuagccucagcacauaccaugauuuauugaaaauuaucaaagauaaagcauuuauggacgaugcggaaaacgaggcaaccuuagaaaacauaauucacacccucacuauuuucgaagauagagaaaugauaaaacaacgauuagcacaauaugacucccuguucgacgagaaagucaucaaagcucucauccgaagacauuacacagguugggguaaacuuagugcgaaauuaaucaacggaauuugcgauaaaaaaaccgguaaaacaauauuagacuacuuaauagaugacggcuacucaaaccguaauuucaugcaacuaauaaaugaugacggacucucauuuaaagauauuauccagaaagcacaagugguuggaagaaccaacgaugugaagcaaauaguccaugaauuaccagggucaccagcaauaaaaaaagguauccuacaauccauuaaaaucguagaugaacuaguaaagauaaugggacacacaccugaaucaauuguaaucgaaauggccagagaaaaucaaacaacugcacgagguaaaaaaaauucacaacaaagauauaaaagaauagaagacgcucuaaagaauuuagcaccaggacuagacucaaauauacuaaaagaguacccaacagacaauauacaauuacaaaacgaucgcuuauuccucuacuaccuacaaaauggcaaagauauguacacaggagaaccauuagauauaaaccaacuaaguuccuacgacaucgaccacauaguaccucaagccuuuauaaaagaugacucccucgacaaucgaguacuaaccagcucgaaagacaauagaggaaaaagcgacaacguacccucacuagaggucguucaaaagagaaaagccuucuggcagcaauugcucgauucaaaacuaauaucagaaagaaaauucaacaaucugacaaaggcagaaagagggggguuggaugaaagggacaaagucggcuucauacgccgacaacuaguggaaacccgucagaucacaaaacacguagcucaaauuuuagacgcaagauucaauacagaaguaaccgaaaaagacaaaaagaaucgaaacguaaaaauaaucacgcuaaaaagcaacuuaguaagcaacuucagaaaagaauucaaacuauacaaaguaagagaaauaaaugauuaucaccaugcucaugacgcauaucugaaugcaguaguagcaaaagcaauccuuaaaaaauacccaaaacuggaaccagaauucguauacggugauuaccaaaaauacgauuuaaaacgcuacauaucaagaucaaaggacccaaaagauguugaaaaagcaacggaaaaauauuucuuuuacuccaaucuacuaaauuuuuucaaagaagaaguacacuacgcggacgguacaauaguuaaacgcgaaaacauagaauacaguaaagacaccggcgaaauagcuuggaauaaagaaaaagauuuugcuacuauaaaaaaaguauuaucauuaccacaagucaauauaguaaaaaaaaccgagauacagacacauggccuagauagggguaaaccccgaggucuauuuaauagcaacccuucaccaaaaccaucagaggauaguaaagaaaaucuugugccaaucaaacaaggauuagauccaaggaaauaugguggauaugccgguauuaguaauucauacgcaguacuagucaaagcaauaauagaaaaaggcgcuaaaaagcaacaaaaaacaguacuggaauuucaaggcaucuccauacuugacaaaauuaauuucgaaaaaaauaaagaaaacuaucuauuagaaaaaggauacauaaaaaucuuaucaacuauaacacuaccaaaauauagcuuauuugaauucccagaugguacacgccgacgacuagccucaauacugaguacuaacaacaaaagaggagaaauccauaaagguaacgagcuaguaauaucagaaaaauauacgacgcuacuuuaccacgcaaaaaacauaaacaaaacauuagaacccgaacaucuugaauauguagaaaaacaucgcaaugacuuugccaaauuacuugaauccguccuagauuuuaacgauaaauacguaggcgcucugaagaacggagaacgaauaagacaagccuuuauagacugggaaaccguagauaucgagaaacuuuguuuuuccuucaucggaccuagaaacuccaaaaaugcaggacuuuucgaacuaacaagccaagguucagcuucugauuuugaauuccuagguguuaaaaucccuagguaucgugacuauacccccucaucauuguuaaaugcaacucucauacaccagaguauaaccggcuuauaugaaacacgaauugaucuaaguaaauuaggagaagacuga

SEQ ID NO: 9058 - RNA, 4179 nt, Artificial Sequence
  Cas9 variant
augaacaauaacaauuacaguauaggucuagauauaggaacaaacaguguugguugggcaguuauaacagacgauuauaaaguaccgagcaagaaaaugaaaguauuagguaauacagauaaacauuuuauaaagaaaaacuugauuggagcucuacuguuugaugaaggcgcaacagcagaagauagaagauucaaaagaaccgcaagacgaagguauaccagacgcaaaaauagacuacgauaccuccaagagaucuucagugaagaaaugaguaaaguagacagcaguuucuuccaccgacuugacgauagcuucuuaguuccugaagacaaaagggguaguaaauacccaauauucgcaaccuuagcagaagagaaagaauaccacaagaaauucccaacaauauaucacuuacgcaaacaccuagcugacuccaaagagaaaaccgaucuuagauuaauauaucucgcccuugcgcacaugauaaaauacagaggacauuuucuauacgaagaaucauucgauaucaaaaauaacgacauacagaaaauauucucggaauuuauaucaauauacgacaacacuuucgaaggauccucccuaagcggccaaaaugcacaaguagaagccauuuuuacugauaaaauaucaaaaagcgcaaaaagagaaaggauacuaaaacuuuuugccuaugaaaaaucuacugacuuauucucugaauuucugaaacucauaguaggaaaccaagcagacuuuaagaaacacuucgacuuagaagaaaaagcaccauugcaauucaguaaagauacauacgacgaagaccuagaaaaucucuugggccaaauaggugacgauuuugcagaucuauuuuuaguagccaagaaacuauaugaugcaauuuuacugagcggaauauuaacagugacagauucaagcacaaaagccccucuaucagcuagcaugauagaaagguaugaaaaucaccaaaaagaccuagcagcgcugaaacaauucauacaaaauaaccugcaggaaaaauaugacgaaguauuuuccgaccaauccaaagacggcuaugcccguuacauaaauggaaaaacuacacaagaggcuuucuacaaauacaucaaaaauuuauugagcaaauuugaagggucagacuacuuuuuagauaaaauugaaagagaagacuucuuacgcaaacaacgcaccuuugacaacggaagcauaccgcaccaaauucacuuacaagaaaugaacgccauaaucagaagacaaggagaacauuauccauucuuaaaagaauacaaagagaaaauugaaacaauauuaacauucaggauaccuuacuacguaggcccacuagcuagaggaaaccgcaacuuugcauggcuaacacgaaauucugaccaagcaauuagaccauggaauuucgaagaaaucguagaccaagcaucguccgcagaagaauuuauaaacaaaaugaccaacuacgacuuauaccugcccgaagaaaaaguauuaccaaaacacucacuauuguaugaaacauucgcaguauauaacgaauuaacaaaaguaaaauuuauuagcgaaggacuacgagauuaucaguuuuuagauucuggacaaaagaagcaaauuguaaaucaauuauucaaagagaaaaggaaagugacagaaaaagacauaauccaauacuuacacaauguagacggauacgaugguauagaauugaaaggaauagaaaaacaauuuaaugccaguuugucaacuuaccacgaccuauuaaaaauuauuaaagauaaagaguucauggacgaucccaaaaacgaagaaauauuagaaaacauuguacauacacugacaauauuugaagacagagaaaugaucaaacaacgacuugcccaguacgcaucaauauuugacaagaaagucauaaaagcucuuacacgaagacacuacacagguugggguaaacucucagcaaaauuaauaaacggcauuugcgauaagaaaaccggaaaaacuaucuuagauuaccucauagaugaugguuacagcaauagaaauuucaugcaacuaauaaacgacgauggacuaucauucaaagacauaauucaaaaagcucaagugguaggaaaaacaaaugauguaaaacaaguaguacaagaacugccaggaaguccagcaauaaagaaaggaauacuacaaucaauaaaauuaguagaugagcuaguaaaaguuaugggacacgcaccugaauccaucgucauagaaauagccagagaaaaccaaacaaccgcgagaggcaagaaaaauucucaacagcgauauaaaagaauagaagacgcucuuaaaaaccuagcaccaggauuagacucaaauauucuaaaagaacacccaacagauaauauucaauuacaaaacgacaggcuauuucuuuacuaucuacaaaauggcaaagauauguauaccggcgaagcgcuugacaucaaccaacuuaguucuuaugacauagaucauauaguaccacaggcauucauaaaagacgacucuuuagacaaucgaguucugacguccaguaaagacaacagaggcaaaagugacaacguaccaucuuuagaagucguacaaaaacguaaagcauucuggcaacaacuacuugacucaaaacucauaucagaacauaaauuuaacaauuuaaccaaagccgaaagaggaggccucgacgaacgagauaaaguaggauucauuaggcgccagcuaguugaaacuagacaaauaacuaaacacguugcacaaauauuagaugcacgauucaauacugaagugaaugaaaaagacaagaaaaacaggaccguaaaaaucauaacccuuaaaucuaaucuaguuaguaacuucagaaaagaauuuaaacuauacaaaguaagagaaauaaacgauuaccaucacgcccacgacgcauaccucaaugcuguagucgccaaagcaauacucaagaaauacccgaaauuagaaccagaauuuguauauggugauuaccaaaaauacgauauuaaaagguauauaucaagaucaaaagaucccaaagaaguagaaaaagcaacagaaaaauacuucuuuuacucaaaccucuuaaacuucuuuaaagaagagguccacuacgcggacggcacaauagucaaaagagaaaacauagaauacagcaaagauacgggcgaaauagcauggaacaaagaaaaagauuuugcaacuaucaagaaagucuuaucucugccacaagucaacaucgucaagaaaacagaaauacaaacacaugguuuggaucgaggaaaacccagaggccucuucaauagcaacccaagcccgaaaccuucagaagaccgcaaagaaaacuuggucccaauuaaacaaggccuagacccaagaaaauaugggggauaugccggcauaucgaacuccuacgcagucuuaguaaaagcaauuauagaaaaaggagcuaagaaacaacaaaagacaguucuggaauuucaaggaauaucgauauuagacaaaaucaauuucgagaaaaacaaagaaaacuaucuacuggaaaaaggguacaucaaaauauuaucuacuaucacacuaccaaaauacucccuauucgaguucccagauggaacaagacgaagacucgcaucuaucuuaagcaccaacaauaaaagaggugaaauucauaaaggaaacgaacuuguaauuccagaaaaauauacaacucuauuauaucaugccaaaaacauaaauaaaacgcucgaaccugaacaccucgaguauguugaaaaacaucgaaaugacuuugcuaaauugcuugaauacguacuaaacuucaacgacaaauauguaggcgcacuuaaaaacggagagaggauaagacaagcauucauagauugggaaaccgucgacauagaaaaacuuuguuucagcuuuauaggaccgagaaacagcaaaaacgcaggauuauucgaauuaaccucgcaaggaucugccucagauuuugaauuucuagguguaaaaaucccacgauaccgugauuacaccccauccucauuauuaaacgcaacucuaauacaccaaagcauuacaggacuauacgaaacccgaaucgauuuaucaaagcuaggagaggacuga

SEQ ID NO: 9059 - RNA, 4182 nt, Artificial Sequence
  Cas9 variant
augaaaagaguaacagaggacuauauccuaggauuggacauaggcaccaauucaugugguugggcuguuacagacaagaaaaauaauuuguugaagcuacgaggaaagaccgcaauuggaucacauuuauuugaagaaggacacacugccgcagauaggagaggauuccguacuacaagaagaagacuaaaaagaagaaaauggagacuucgccuacuagaagaaaucuucgcugaaccaauggcaaaaguagacccuggauuuuuuguuagauuacaccaaucuuggguaagcccuuuagauaagagccggaaaaaauaccaugcaauuguauucccuacugccaaagaagauaaagcauucuaccaaaaguacccaacgauuuaccaucuacgagaugcauugaugacacaagaucggcaauucgacuuacgcgaaauuuucuuagcaauacaucacauaguuaaauuucgaggaaauuuucuacaagauacaccaguaaaagacuucgaagcaaguaaaaucgaaguaggaccuauacuaucgaaaauaaacggggcauucgcagaaaaaauaguagaagaucaagacccaauagaauugaauguagccaacgccgcagaaauagaagcagucauaaggggcaaagaugccgacaaaacucuguacaaaauggauaaaguuaaaaaaauagcaaaauuacucacagacucaacggcuaaggaagaaaaaaauguugccaaacaaauagcaaaugccgugaugggauacaaaacucaauucgaaaccauccuugguaaagaaauagacaaaagcgacaaagcccaaugggaauucaaacuaacagauggagacgcagaugacaaacucgaagcacucuuaccggaccuugaugaaaacgaccagaccauaaucgcagagaucaaaaagcuauucucagcaauaacauuaucaacaauagucgacgaaaacaaaucuuuaucccaauccaugguagcuaaguacaacaaacaucaucaagauuauaaauuacuaaaagcguacaucgacacuuuacaagauagguccaucgcgaagaaacuacuccuagcguacgaucucuauguaaauaauaggcauggaaggcuguuagaagcgaaaacagaauucaaacaagaugguacguuaacaaaagaagauuucuacaaaaccguaaaagacaauuuagaugacucagaauuagcuagaaaaauagcccaaaaaauugccgcagacaauuuuaugccaaaacagagaacaaauaguaacggaguaauucccuuucaacugcaccaaaucgaauuagacaaaauuauagcaaaucaaagcaaauacuacccauucuuagccgcggaaaaccccguagaagaccaccgaaaacaagcaccauauaaacuagacgaacuagugcgcuuucggguaccauauuauguaggucccaugaucacaccugaugaacaagaaaaaacuucagggaaauccuucgcauggaugguacgcaaagaagacggccaaauuaccccauggaacuuugaacagaaaguagacagacaggaaagugcuaauaaauuuauuaaaagaaugacaauaaaagacacuuaucuacuaggagaagacguauuaccggcuaauucuuuauuauaccaaagguucgaagucuuaaacgaauuaaacaacauacguauuaauggaucacguaucucaaucgaccucaaacagcaaauauuuaaugaucuauucgaagaaaagaaaaccgugacagaaaaaagucuaacauccuaccuaaaacaaaaccugcacuuaccaacaguagaaauaaaaggguuggcagauccaacaaaguucaacaguucacuagcauccuauuaccauuuaaaaucguuacauguauuugacaaagaacuagcagauccgcaguaccagaaagauuucgaaaaaaucauagaauacagcucuauauucgaagauaaaaaaauuuaccaagacaaauugcacgcugaauucaaauggcuaacacccgaacaauuuaaagcuauaagcaccuggaggcuucaagguuggggaagacuuagcugccguuuacucguugaacuccacgauaccaaugggcaaaauauuauggagcaacucugggacucacaaaaaaacuucaugcaaauaguaacagaaccggacuucaaagaugcuaucgcaaaagaaaaucaaaacguaacccaagugaaugguguagaagaaauauuagccgaugccuacacaaguccagcaaacaaaaaagcaaucaggcaaguaguaaaaguugucgcagacguaguaaaagcagccggagguaaaaaacccgcgcaauuugcuauagaauucacacgagacccagacaaaaacccacaacuaucccauauccggggaacgaagcuauuaaaagcauaucaagaaacugcaggcgaacuagucgaccaaaaacugacagacagucucaaagaagcaaugaccagcagaaaacuacuaaaagauaaauacuuucuauacuuuaugcaaacugguagggaugcauauacaggcaaaaaaaucaauauagaugaaguuacaaccaauuaucaaauagaccacauauuaccacagucauuuaucaaagacgauucauucgacaacagaguucuuacggcaaccccccucaacgcugaaaaaucagacgauguucccuacaaacgguucgccaacaauuacgugucagaucuuaaaaugacuguaggugagauguggaaacauuggcaaaaggcaggaaucauaaauaaacacaaauuagguaacuuauuauuagaccccgaccgacuuaauaaauuccaaaaaaguggcuuuauaaacaggcaacuuguagaaaccucccaaauagucaaacuaguaucuguaauacuacaaaacaaauaccccgaugccgaaauaaucacagugaaagccggagacaacucagcuuuacgacagagacucaaccuuuauaaaagcagagacguaaacgauuaccaucacgccauagaugcauaucuaucgaucaucugcggaaacuuuuuauaucaaguauacccgaaauauagaccauacuucguuuauggaaaauauaaaaaauuuucacaagacccugacuugcaaaaagauuuaauaaaacacuuuaaaggauuuacauuuauguggccccuccuacaaaaagacaacucggaaagaaaagcuccugaagaaauaaaagaaaacaacucagaacguaucguuuuuuauaaacaccccgauauauucgauaaacuacgaaaagcauauaauuacaaauacauguuaguaaguagagaaaccacaacagaaucaucaucaauguucaaaaugacaaucuucccgagaggagaaagagaucggaaaaaaacaagaaaauuaaucccgaaaggaaauggcuuagauccaaaaauuuacggagguuauucagguaauacugacgcauauauggucauuguaaaaauagacaaagcaaaagagucaauauauaaaguuaucggaguucccaugagagccuuaacucgucuaaaccaggcaaagaaacaagggaauuaccaagaagaacuacaccaaguuuuagaaccccaaaucauguuagacaaaaauggaaaacccaaacgcggcguaaaagguuuucgugugauaaaggaccauguaccauuuaaacaagucguacuugauggagauaaaaaauuuaugcuguacucagcucaauacaaaacaaacgcaaaacaacuagcacucagucaagaaacaaugcgaauaguaacugacaaucuaaaaaaaggugaagaucaagacaaacuacuagucaaagcauacgaugaaauacuacaaaaaguggacuguuaucuaucguuauuugacacaucaaacuuucgcaauggacuacaucuaggccguaacaaauucauugacuuagaagucaacgauaaaaaaauaacacuaucgaauauacuaaacggacuacaugacaauaugguuuuaggaaauuuaaaaaacauagggauuggcacaccucuaggucaaaugcaggaaaaaucaggcaucacuuuaagcccagaagcaguuuuaauauuucaaucacccacuggauuauucgagaaacgcgucaaaaucgccgaucuauga

SEQ ID NO: 9060 - RNA, 4188 nt, Artificial Sequence
  Cas9 variant
augaagaaagaaauuaaagacuauuuucuaggauuagacguuggaacagguucuguaggaugggcugucaccgauaccgauuacaaauugcuuaaagcaaaccguaaagaccuauggggaaugcgaugcuucgaaacagcagaaacugcagaaguacgacggcuacaccguggagcucgccgccgaauagaaagaagaaagaaacgaauaaaacuauuacaagaacuauuuucccaagaaaucgcaaaaauugacgaaggauucuuucaacgaaugaaagaauccccauucuacgccgaagacaaaacaaucuuacaagaaaaugcucuauucaaugauaaagacuucacagauaaaacauaccacaaagcguacccgacaauaaaccauuuaauuaaagccuggauugaaaacaaaguaaaaccagauccucgguuguuauauuuagccugccacaacaucaucaagaaacgaggacacuuccuauucgaaggagacuucgacagcgaaaaucaauuugauacauccauacaagcucuuuucgaauaccuacgagaagacauggaaguagacauagacgccgacucacaaaaaguaaaagaaauccugaaagauaguucacucaaaaacagugaaaaacaaucuagacuuaacaaaauucuuggacucaaaccuucggacaaacagaagaaagcuaucacaaaccuuauaucgggaaauaaaauuaauuucgcagaccuauacgacaacccagauuuaaaagaugcggagaaaaacagcaucuccuucucaaaagaugacuuugaugcccuaucugacgaccuagcgucaauccuaggagacucauucgaauuauugcuaaaagccaaagcuguguacaacugcucgguacugagcaaaguuauaggagacgaacaauaccucagcuuugcgaaaguaaaaauauaugaaaaacauaaaaccgaucuaacaaaacuaaaagcugucaucaagaaacacuuccccaacaacuacaagaaaguauucgguuauaaccaagauaaugaaaguaaaaauaacuacagcggauauguugguguuugcaaaaccaaaaacaagaagcuagucauaaauaauagcgucaaccaagaagauuucuacaaauucuuaaaaccaauccucucggccaaaagugaaaucaaagaagucaaugacauauuagccgaaauagaaacugguaacuuccucccaaaacaaauuuccaaaucuaacgccgaaauaccuuaucaacuacgaaaaauggaacuagagaaaauauuaucgaaugcagaaaaacacuuuucauucuuaaaacaaaaagacgaaaaaggccucagccauucagagaaaaucauuaugcuacugacauucaaaaucccauauuauaucgguccaaucaacgacaaucacaagaaaucuuucccugaucgaugcuggguaguuaagaaagaaaaaucaccaagcggcaaaaccacacccuggaacuucuuugaccacaucgacaaagagaaaaccgcggaagaguucauaacuucacguacgaacuuuugcacauaccuaaucggugaaagcguauuacccaaaaauucacucuuauacagugaauauacugugcugaacgaaauaaauaauuuacaaaucauaaucgauggcaaaaacaucugugauacaaaacuaaaacagaaaauauaugaagauuuguucaagaaauacaagaaaauaacacaaaaacaaauuucaaccuucauaaaacaugaaggaaucuguaauaaaacagacgaagucauaauacucggaauagacaaagaauguacaucgucguuaaaauccuacaucgaacucaagaacauuuuugguaaacaagucgacgaaauaucuacgaaaaauaugcuagaagaaaucauccgaugggccacuaucuaugacgaaggcgaaggaaaaaccauacugaaaacgaaaaucaaagcugaauacggaaaauacugcagugacgaacaaaucaagaaaauacugaaccugaaauucucaggauggggaagacuuucaagaaaauuccuugaaacuguaacaagcgaaaugccaggcuucuccgaacccguaaacauaauaacagcaaugcgcgaaacacaaaacaaucuaauggaauuacuaaguucugaguucaaauucacagaaaacaucaagaaaauaaacucaggauucgaggaugcagaaaaacaauuuagcuaugacggucugguaaaacccuuauuccuaaguccaucaguaaagaaaauguuauggcaaacacuaaaguugguaaaagaaauaucacauaucacucaagcaccucccaagaaaauauucauagaaauggcaaaaggugcugaacuugagccagcaagaacaaaaacaagauuaaaaauucuacaagaccuauacagcucuugcaaaaacgaugcggacgcauucucauccgagauucaauaccuauccgggaaaauagaaaaugaagacaacuuacgacuaagaucagacaaacuauaccucuacuacacacaauuagguaaauguauguacugcggaaaaccaauugaaauaggucacguuuuugacacaucuaacuacgauauagaucacauuuauccacaaagcaaaaucaaagaugacucgauaucaaacagaguucuaguauguuccucgugcaacaaaaacaaagaagauaaauauccucuaaaaagugaaauccaaagcaaacagaggggauucuggaacuuucuacagagaaauaauuucauaaguuuagaaaaacuaaauagauuaacaagaaccacacccaucucagaugacgaaacagcaaaauucauugcuagacaauuaguagaaacacgucaagcaacgaaaguagccgcaaaaguucuagagaaaauguucccagaaacgaaaaucguauacuccaaagccgaaacagugucaauguuuagaaauaaguucgacauaauaaagugccgagagaucaacgauuuccaccaugcucaugacgcauacuuaaauaucgucgucggaaacguuuacaacacaaaauucacaaacaacccuuggaacuuuauaaaagagaaacgggacaacccuaaaauagcagacacauacaacuacuacaaaguauuugacuaugacgucaaacguaauaauauaacggcuugggaaaaaggcaaaacuaucauaacuguaaaagauaugcuuaaaagaaacaccccaauuuauacccgacaggcagcaugcaagaaagguggacuauuugaccaaacaauuaugaagaaaggccucggacaacacccgcuaaagaaagaaggaccauucuccaauauaucaaaauacgguggcuacaauaaaguaucagcagcauauuauaccuuaaucgaauaugaggaaaaaggaaauaaaauacgaucauuagaaaccauccccuuauaucuagucaaagauauacaaaaagaccaagacguucuaaaaucuuauuuaacugaccuucugggcaagaaagaauuuaaaauauuagugccaaaaauuaaaauaaauuccuuacuuaaaauaaauggcuucccaugccacauaacaggaaaaacaaaugauucuuuucuucuucgacccgccgugcaauuuuguugcucaaacgacgaaguauuauacuuuaagaaaauaauaagauuuucagaaauaagaucccaaagggagaaaauaggcaaaacaauuucucccuacgaagaucuaucauuucgcucauacaucaaagaaaacuuauguaagaaaacaaagaaugaugaaaucggagaaaaagaauuuuaugacuuacuacagaagaaaaaccucgaaauauacgacaugcuacucaccaaacacaaagacaccauuuacaagaaaagacccaauuccgcaaccauagauauccuaguuaaaggcaaagaaaaauucaaaucacuaaucauagaaaaccaauuugaagucauuuuagaaauacuaaaacuauucucggcaaccagaaaugucagugaacuacaacacauugguggaucaaaauauucuggcguagcaaaaauugguaauaagauaucgucacuugacaacugcauauuaaucuaccaauccauaacaggaauuuucgaaaaacguaucgaucuucucaaagucuga

SEQ ID NO: 9061 - RNA, 4188 nt, Artificial Sequence
  Cas9 variant
augaaaaaagaaauaaaagauuauuuucucggguuagauguaggaacaggguccguaggcugggcaguuacagacacagacuacaaacuacuaaaagcaaauagaaaagacuuauggggaaugcggugcuucgaaacagcugagaccgcggagguacgaagacuacaccgaggagcgagaaggcguauugaaaggagaaagaaaagaauuaaacugcuacaggaacuauuuucacaagaaaucgcgaaaauagaugaaggauucuuccaaagaaugaaagaaagucccuuuuaugcagaagauaaaacuauacuucaagagaacacucucuuuaaugauaaagacuuuacagauaaaacauaccacaaagcauacccaacgaucaaccacuuaauaaaagcauggauagaaaacaaaguuaagccagauccccgucucuuauaucuagcaugucauaauauuauaaaaaaaagaggacauuuuuuauucgaaggugauuuugacagugaaaaucaauuugacacaucaauccaagcacuauuugaauaccucagagaagacauggaaguagacauugacgcagauucacaaaaagucaaagaaauauuaaaagacucaagcuuaaagaacucggagaaacaaucaagguuaaauaaaauauuaggccuuaaaccuucugacaaacaaaaaaaagcaauuacuaauuuaauauccggcaacaaaauuaacuuugcagaccuauaugauaaucccgauuuaaaggacgcugaaaaaaacucuauaucauucucaaaagaugauuucgacgcauuaucugacgaccuagcaucaauacuaggcgauuccuucgaacucuuauuaaaagcgaaagcaguauacaacugcuccgugcuuucgaaaguaauuggggaugaacaauauuuaagcuuugccaagguaaaaauauacgaaaaacauaaaacggaucuuacaaaguuaaaaaauguuauaaaaaaacacuucccuaaagauuauaaaaaaguauucggauacaacaaaaaugaaaaaaacaacaauaauuauucuggauacguuggagucuguaaaacgaaaucaaaaaaacuuauaauaaauaacucuguaaaucaagaggacuuuuauaaauuuuuaaaaaccauacuaagugcaaaauccgaaauaaaagaagucaacgacauauuaacagagaucgaaaccggcacauucuuaccaaaacaaauuaguaaaucaaacgcagaaauccccuaucaauuacguaaaauggaauuagaaaaaauauuaagcaacgccgagaagcacuuuucguuucuaaaacaaaaagacgagaaagguuuaucacacucugaaaaaauaauaauguuacuaacauuuaaaauucccuacuacauaggcccaauaaaugacaaucacaaaaaauccuucccagaccgcuguugggucaucaaaaaagaaaaaucaccaucaggaaaaaccaccccuuggaacuuuuuugaucauauugacaaggacaaaacagccgaagcauuuaucacuucccgaacgaauuuuugcacauaucuagucggggagaguguacuuccaaagaguucacuacuauacucagaauacacaguuuuaaacgaaauuaacaaccugcaaauuaucaucgacggcaaaaacaucugcgauaucaaacuaaaacaaaaaauauacgaagagcuauucaaaaaauacaaaaagauaacccaaaaacaaaucuccacauuuauaaaacaugaaggaauauguaauaaaacagacgaaguaauaauauuagggauugacaaagaaugcacaaguagccuaaaaagcuacaucgaguuaaagaauauuuucgguaaacaagucgacgaaauaaguacaaaaaacaugcuugaagaaauaauaagaugggcaacaauauaugaugaaggagaaggaaaaacgauucuaaaaacuaaaauuaaagcugaauacggaaaauacugcagugaugaacaaaucaaaaaaauacuuaacuuaaaauuuucugguuggggacgacugagcagaaaguucuuagaaacgguaacuagugagaugccaggauucucugaaccuguuaacauaauaacggcuaugcgagaaacccaaaacaacuuaauggaacuacucagcucagaguuuaaauuuacggaaaauauaaaaaaaaucaauucuggauucgaagaugcagaaaaacaauuuucauacaacggacucgugaaaccauuauuuuugagcccaagcguuaaaaaaaugcucuggcaaacccuaaaauuaguaaaagaaauaucacacauuacacaggcuccaccuaaaaagauauuuauagaaauggcaaaaggugcagaacuagagccugccagaacgaaaacucgauuaaagauacuacaagaucuauacaauaauugcaaaaaugaugcagacgcuuuuaguucagaaaucaaagaccuaagcgguaaaauagaaaacgaagauaacuuaagauugcguucagacaaacuguaucuauacuauacacaauuaggaaaauguauguauuguggaaaaccuauugaaauaggucacguauucgacacaagcaacuacgauauagaucauauauacccacaaucaaaaauaaaagaugauaguaucaguaacagaguacugguauguagcaguugcaacaaaaauaaagaagacaaauacccauuaaaaucagaaauacaaucaaaacaaagaggcuucuggaauuucuuacaaagaaacaacuuuauuucgcucgaaaaauuaaauagguuaaccagaacaacaccaauuagcgacgaugaaacagcgaaauuuauagcacgacaacucguggaaacccgucaagcaacaaagguagcagcaaaaguauuagaaaaaauguuuccugaaacgaagaucguauacaguaaagcugaaacaguaucaauguuuagaaauaaguucgacaucaucaaauguagagaaauaaacgauuuccaccacgcacaugacgccuacuuaaacaucgucgucggaaauguuuauaacacaaaauuuacaaauaacccauggaacuuuauaaaagaaaaaagggacaacccuaagauagcggacacauacaacuacuacaaagucuucgauuacgauguaaaacgaaacaacauaacagcuugggaaaaagguaagacuauuauaaccgucaaagauaugcuaaaacgcaacacacccauuuauacccggcaagcagccuguaaaaaaggcggauuauuugaccaaacgaucaugaagaaaggacuaggacaacacccgcucaaaaaagaaggggcuuuuagcaauauaucaaaauacggagguuacaacaagguaagcgccgcuuauuauacgcuaaucgaguacgaagaaaaagggaacaaaauucgcagccuggagacaaucccgcucuaucucgucaaagacauacagaaagaccaagacguacuaaaaucuuaccuaacagaucuccucgguaaaaaggaaauuaaaauauuaguaccuaaaauaaaaauaaacucacuauuaaaaauaaacgguuucccaugucacauuacaggcaagacaggagacagcuucguacuucgaccugcaguacaguucugcuguagcaacgaugagguacuauacuucaaaaaaauaaucagauucaaugaaauaagaagucaacgagaaaaaaugggaaaaacuauaagcccauacgaagaccuuaguuuuagaagcuauauaaaagaaaaccuaugcaagaaaacaaaagcagaugaaauaggcgaaaaagaauucuaugaccucuugcaaaaaaaaaaucuggaaauauacgacaugcuacugaccaaacacaaagauacaauauacaauaaacgaccaaacucaaccaccuuagguauguuaacaaaaggccguuacgaauucauaaaucuaaaaccaaaagaccaaauaauuguaaugcuagaaauauuaaaacuguucugcacaacacgagaagcuauagaucucggauugauaaaaggcaaaccagcagcaggcguagcaaccuuagguaaaaagauaagcaauccugauaacugcaucuuaauauaccaaucaaucacgggaauauuugaaaaacgaaucgaucuauuaaaaguauga

SEQ ID NO: 9062 - RNA, 4188 nt, Artificial Sequence
  Cas9 variant
augggagauaccguaaaaaacuaccacauagggcucgauauaggaacaucuucaguaggguucgcagcuagagacgaugacaacaacuuaaucagaguaaaaggaaagaacgucaucgguacccgacuauucucugaaggacaaaccgcucaagaaaggcgaauggcaagagcuucacggagacgcuacaaccggagaaaauggagauuaagauuauuagacgagauauuccaugacgaaauaauucauaaagacgcggaauuuuuuaauagacuuaaacaaucauccuuaucaccuaaagaugaaagaaaacaguacuuuggaucucuacuauuccccgaagucggugacucagaauauuaucaugacgguaaucaaacaauuuaucauuuaagacaccguuuaaugacgcaagacgaaaaagcggauauucgagaaauauaccuagcacuuagacacaucaucaaauacagaggcaauuuccuagacgauacgcccguaucauccuuugaagcuagugacuuaaaacuagcguccuucgucccaacacuuaacgaucucuuugaaaccaucgacguuaacuacgaguucaguauggacaauauaaacgaaauagaagacauacuacuaaauaauaaacuacguaauuccgauaaaucgaaacaacuuccggacuugcuaacugaaccaauugucaacauugacgauaaaucauuagaaaaacaauucaacaaagaacgaacagauauauccaaggagaucgcaaaaucagucgucggaagcaaaaugaauguaaacaaauuacuaagcuuugaaucaucaggaggcuacaaaaucgccuucucuuucucugaugcgucaucagaagauaaaaugauggagcuaucugacgugcuggaugacuccagaaugaacauauuaaacauauugaagguuaucuacaguagaguccgacugaaccaaauaaucccauccggaaugggcuuaucagaaucuaugguugcugcguaugauuuacacaaacaacaauuaaaagaccugaaaaagcuuuuaaacguucugccuuuuaaugagcguuacgcgguaaaaaucgcauacgccgcauauauagguaauaucgauaaacaaaaauuuaccaaaucugaaguaaagacaauagacaaacucaaagagaaauccgcaauuaugaauguacucgacuuuaaaaguggacauaucacaaaugaagagcuuucaaauguaauuaaagucguuauuguagacaaguacuugaaugaugaaaacuuugaauaccacagcauaguugaaaaaauaaaucaagacauaucuaauggcucauaccuucuaaaacaaagaaauaaucaaaacggaaauaucccacaucaacuucaucaaauggagcucgaccaaauuauugaaaaccaaucaaaauauuaccccuuuuuaggagaacucaaccccaauucaaacagaaaucauauagcaaaauauaaaaucagugaacuagucgccuucagaguacccuacuauguaggcccauuaauuacaccagaagaacaagaaaaaacuagcggagccaguuucgccuggaugaagagaaaagaagauggcgcaauaacacccuggaacuuugaagaaaaaguagacaaagaagaaacagcaagccgauucauaaaacgauuaacaguuaaagauacauaccugcucaacgaagacgucuuacccgacaauucacuccuauacgaaaaauucaaaguacucaacgaacuaaacguaguaaaagccaauaacaaacgauuaacagucgaggaaaaacaaggcgcauucgauaaucuauucaaaaaaaugaaaaccguaacugcaaaaaaacuaaaaaacuauuuggucaguaaucacaaccacauaaacaguguagaaauaacuggauuauccgacguagacaaauucaacaauucacuaaguacuuacauugacuuuaagaaaaucuucgaugauaaaauagauaauccagacuuauuagaugauuuugaagauauaauagaguggucaacaguauucgaagauagaaagauuuucgaagaaaagguacgaaaagauauaucuuggauaucagaaucagaaauaaaagcaguaguaucaaaaagauauuccggauggggaagacuaucaaaaaaacuauuaaacggaauaacaaauaacgaaggaagaaacauaauagacgaacugugggaagaaucagaaaccuuuauggaagcaguaaguaaacccgaaguuaaggaacaaauagacggaaucaauucagacuuuauaaaaaacacggauauugaaaguguauuagcagaugcauauacuucuccgcaaaacaaaaaagcaaucagagaaacccacaaacuuguaaaagacauacaaaaagcuauggguggacaagcacccgccagcaucucgauugaauuuaccaggaauccccaagauaaaggacaacucacaagaucacgacauucagaaguaucaaggaaauauaaagaaauaucaaaagaaguuucaaaaacccucaaugaugaauugaaaagcaaaaaaaacagcauggacguggauaaauauuacuuauacuucaugcaaaugggaaucgaccuauacgacggcucgucgauagacauagacgaucuuaacaacuaucaaauugaccauauaauuccccaaaguuucuauaaagacgauaguuuugacaauagaguacuaacucacuacuccaacaaccagaaaaagggaaauaacacaccccucaacggucuaaauaucgacgauaagacaagagccauauggaaucauuugcgagacuuaggucuuauaacaaaaaaaaaauauaacggacugacccugaaagguauggaucaacuaucuaaauauacgaaacacggcuucauacgaagacaacuaguugaaaccucacagguaauaaaacuagucgccaacauccuaucugaugaauuuucaaccgaugauacaaaaauaaucgaaguaaaagcuaaaaugaacagccaaauaagacaaguguuuaacuuauauaaaguuagagaauuaaacgauuaccaucaugccguagaugcauaucuaacaacauucauaggaggauaccuauauaaucgguauccaaaccuaagaaauauguuuguauacggagacuucaagaaauucucagcagaugucgacaaccucaaaacuuucaacuuccuacacgacauuacaaacccgucugauaaauuugaagaucgcauauucgaugaaaaaaguggagaacuaauauuagaccgaaaacaugcgauagaaacaauuaaaaaaauauaccaauacaaauacauguuaauaacucgagagguuagcacgaaaaauggacaacucucagaccaaacaguuuauucagccaaaagaauaaacaauguuaaagcacccauacccgucaaaaaagacucaaauccugaauuauauggauucagaaccggaaauguagaccaccacaugguaaucgucaaauauccaaaaaaagacagcuaugacuauaaaguuguaggaaucccucugcgauuuguccaaaaauuaaaagaaacaaaagacaacaaagacuacgaaaaccugcuaaaccaaauaguacagaugaaacuaaacagaaaaaaacaagacuucauuguuguaguagauaaugucauguauggccaauuaauccaagauggaggcgaaaaauauacucuaggcucgagcaccuauaaauacaacgcaaaacaacuaguaauaaauauggacaaaacacgaauauuagaagacaaccgguacuuaaauucuuuagaugaaggagaaguaagugaaaaauuaguuaacauauauaacgacauaaugaaaguaguuaacucccgauuugaccuauucgacaucaauaaauuuagagaaaaacugaaugacggucuaaauaaauuuaaaaacauuaguaacgagcaaaaagaagaaacucuccuuaaaauacuaucaggucuacauugugguagugcaaaugugccuaucaaggaauuaggccucacuacaccacuaggcaaacuacaauuacccagugggaucguacuuucagaagaagccguaguaaucuaccaaucaccuucuggacuauucgaaaacaaagugagguuaaaagaucuauga

SEQ ID NO: 9063 - RNA, 4188 nt, Artificial Sequence
  Cas9 variant
augaagaaagaaaucaaagauuacuuuuuggggcuagauguaggaacaggaaguguuggaugggcuguaacagauacagauuauaaacuacuuaaagcuaauaggaaagacuuauggggaaugcgauguuuugaaacagccgaaacugcugaaguuagaagacuacauagaggagcuagaagacgcauagaacgaagaaagaaaagaaucaaauugcuacaagaacuauuuagucaagaaaucgcaaaaaccgacgaaggauucuuucaacgaaugaaagaaucucccuucuaugcagaagauaaaacuauacuucaagaaaauacauuauuuaaugauaaagauuucgccgacaaaacuuaucauaaagcauauccuacaauaaaucaucuaaucaaagcguggauagaaaacaaaguaaaaccagauccccgauuacuauaccuagcuugccacaacauuaucaagaaaagagggcacuuuuuauuugaaggagacuucgacagugaaaaucaauucgauaccaguauccaagcauuguuugaauaucuacgagaagacauggaaguagauaucgaugcugacagucaaaaaguuaaagaaauccuaaaagauucuagucugaaaaauucagaaaaacaaagcagacuaaauaaaauucuaggacuaaaaccaucagauaaacagaagaaagcaauuacaaaccuaauauccggaaauaaaauaaacuucgcagauuuguacgacaacccugaucuuaaagaugcagaaaagaacuccaucucuuuuuccaaagacgauuucgaugcacuaucagaugaccuugcaucaauauuaggagacucuuuugaacuucugcuaaaagcaaaagcaguauacaauugcagcguucuaaguaaaguaaucggagaugaacaguaucuaucuuucgcaaaaguaaaaauauacgaaaaacauaaaacugaccuaacgaaacucaaaaauguuaucaagaaacacuuucccaaagauuauaagaaagucuucggauacaauaaaaaugagaaaaauaauaauaauuacucagguuauguaggcguaugcaaaacuaaaucaaagaaacucauaauaaauaacucuguaaaccaagaagacuuuuacaaauuccuaaaaacuauccucucagcuaaaucagaaauaaaagaaguaaacgauauccucacagaaauagaaacaggaacauuucuaccaaaacaaaucagcaaaucuaacgcagagauaccauaccagcuacguaaaauggaacuagagaaaauucuaaguaaugcagaaaaacacuucagcuuuuuaaaacaaaaagaugaaaaaggacuuucacacagcgagaaaaucauaaugcuccuuacauuuaaaauaccauacuacauaggcccuauaaaugacaaucacaaaaaguuuuuccccgauagaugcuggguagucaagaaagaaaaaucacccagcgguaaaacaacacccuggaacuucuuugaucacauagacaaagagaaaaccgcugaagcauuuauaacuucacgcacaaacuuuuguaccuauuuagugggcgaaagcguccucccaaaaaguucacuacuauacagugaauauaccgucuuaaaugaaauaaacaaccuacaaauuauuauagacgguaaaaauauaugcgacaucaaacucaaacagaaaauauaugaagacuuauuuaagaaauacaagaaaauuacacaaaaacaaauuagcaccuuuaucaaacaugaaggaauaugcaacaaaacagaugaggucauuauuuuaggcauagauaaagaauguaccuccagucucaaaucauacauagaacucaaaaauauauuuggaaaacaaguagacgaaauaaguaccaaaaacaugcuagaagaaauaauacgaugggcaacaauauacgacgaaggagaaggcaaaacaauacuaaaaacaaaaaucaaagcugaauacggcaaauauugcagcgaugaacaaaucaagaaaauauuaaauuuaaaauuuuccggcuggggcagacuaucacguaaauuccuggaaacaguaacaagcgaaaugcccggauucagcgaaccagucaacauaauuacagccaugcgcgaaacccaaaauaaccuuauggaguuacuuucuagcgaauuuacauuuacagaaaauaucaagaaaauaaacucaggauuugaagacgcugagaaacaauuuagcuaugauggccuaguaaaaccauuauuccuaucacccucaguaaagaaaaugcuauggcaaacacuuaaauuagucaaagaaauaagccauaucacccaagcaccacccaagaaaauauucauugaaauggcuaaaggcgcagaacucgaaccagccagaacaaaaacacgacucaagauauuacaagaccuauacaacaacuguaaaaaugaugcagaugcauucucaucagaaauaaaagacuuaucaggaaaaauagaaaacgaagacaaccuuagacuuagaucagacaaauuauauuuauacuacacacaacuuggaaaaugcauguauugugguaaaccaauagaaauaggccacguauuugacacaaguaauuaugauauagaucacauauacccacaaucuaaaauuaaagacgacaguauaagcaacagaguacucguauguucaucuugcaacaaaaacaaagaagauaaauaucccuuaaaaucagaaauccagagcaaacaaagagguuucuggaacuuucugcaaaggaacaauuucauaagccuagagaaauuaaauagauuaacacgugccacgccaauuucagaugacgaaacagcaaaauucauagcucgacaacucguugaaacucgacaagcaacaaaaguagccgccaaaguauuagagaaaauguucccagaaacaaaaauaguauacucaaaggcagaaacuguuagcauguuuagaaauaaauucgacauaguuaaaugccgagaaaucaacgauuuccaccaugcucaugacgcauaucugaacauaguggucggaaauguauauaauacaaaauucacaaacaacccguggaacuuuauaaaggaaaaacgcgauaauccaaaaauagcagacacauauaauuauuacaaaguauucgauuacgacgucaagagaaacaacauaaccgccugggaaaaaggaaaaacuauaauuacgguaaaagacauguuaaaacgaaacacacccauuuauaccagacaagccgccugcaaaaagggagaacucuuuaaccaaacuauuaugaagaaaggacuaggacaacacccccucaagaaagaaggucccuuuuccaauaucuccaaauaugguggcuacaauaaagucagugcagcauacuauacacugauagaauacgaagaaaaaggaaauaagaucagaagucuugaaaccauacccuuauaucucguuaaagacauacaaaaagaccaagauguacugaaauccuaccuaacagaucuauugggcaagaaagaauuuaaaauauuaguaccuaaaauaaaaauaaacagccuccuuaaaauaaacggauuccccugccauauuacaggaaaaacaaaugauaguuuucuacuacgcccagcaguccaauucugcuguuccaacaacgaaguucuuuauuuuaagaaaauaauacgauuuagugaaauacguucacagagagagaaaauaggaaaaaccauaagcccauacgaagauuugucauuccgaucauauauaaaagaaaaucuuuggaagaaaaccaaaaacgaugaaaucggugaaaaagaauuuuaugaccuauuacagaaaaagaaucuagagauauaugacauguuacucacuaaacacaaagauacuauauauaagaaacgaccaaacucagcaacaauagacauucugguaaaaggcaaagagaaauucaaaagucucauuauagagaaucaauuugaaguaauccuagaaauccuaaaacuguuuucagcuacaagaaaugucucugacuuacaacacauuggcggcucaaaauacucaggaguagcuaaaauaggcaauaaaauuucuucccuagauaacuguauacucauauaccaaagcauaaccggaauauuugaaaagagaauugauuuauuaaaaguauga

SEQ ID NO: 9064 - RNA, 4188 nt, Artificial Sequence
  Cas9 variant
augaaugcaaauagagaaauggcauacuacauagguauagauauggguacggguuccgucggcauggcaaucacagaugaaaacuacaaucucuuaaaaguuaaaggacaagacuacugguucguaagagaauucgaaaccgcgaauacacaaauaaaaagaagaaugcaccguauaucaaaaaggagauuacggcgacaucaaguuagaguagcuuuaauaagaucuuauuuugcugaagaaauacucaaaaaugacccuuuauuuuuuaucaggcaagauaacucaauauacuaccucgaagacaaagauucuguacuaaaaacaaaagacugccucuucgcggacuauaauuaccacgauaagaacuauuacaaagauuacccaacuaucuuucaccuaagacaagccuucauaaaagauacaguaaaagaugacgaaaaucacacaagauacgcaagacuccuauaccucgcaaucauaaacauguucgaacacagaggucacuuuuuauuaaacagcgugagcgaagacauaaacaaagaaaugguaaaagaugcaggagaaggcuucacacuauaucuucaagaaagaaucaaagaaauaaaaccagucucauacucagacauauuagauguacuaguugaaaaaaauaucagcaggucugaaaaaaaagaaagaaucgucgaauuauucggaaucaaaaaaagcugcaaaaauggaauggaaauaaucaaaugucucugugguuuagaggcaaacguagccauaauguucaaucuagaugauaucgaaaacaaauuaacgaucgugguaucgaaagaugauuaugaagacaaacuugcagaaguucagccucuuguagaugaagaauccuuugaauuacuuucccguauuaaacaacuauaugacuauagucaacuacagucgauauuaaaaggauacaaggaaaaagaagacggugaagauaaauaccuaagcgacguaagaguggaacuuuaugaaaaacauaaagcagauuuaaaauuacugaaaaaaguauacaaaagagaucuugauaaaaaaggaaaaauaugugaagguaaaaauauccaacggagcucaaaguauaauuucauguuuagaucuggaaaagacgggacuuauagugcauauaccaacagccuuaacagcuucugcucaaaaacaauagaaaacaaauacagaagaaacaugaaaaaccgagauagagcaaguuuauaugauacuauaaaaaaagaccuaaguggcauagaaaacgaugacgucaaaaaaauuuuacgagacauagaaacagaaaaauuucuuccaaaacaaauaacaggagaaaaugguguaauaccaaaccagauccacgcaaaagaauugaaagcaauucuuaaaaacgcagaaaaacaccuaccuuuccuuacagaaaaagacgauaguggauuaacgguaucugaaaggauaauaagucuguucagguauuguauuccauacuacauaggaccagucggaaaagacucgagaacagggugggcuucaauaaaagaagaaggacaaauauucccuuggaacaucgaacaaaaaaucgauguggacaaaacuucagaagaauuuauaaccagauuaauaaaaacauguacauaucucagcaacgaaaaaguagucccuaaacaaucccuaguauacgaaagauacugcguacuaaaugaaauuaauaauauuaagauaagggguaagagaauagacccacaacucaaacaagagaucuucaaagaacuguacauaggaaguaagugcggaaaaaaaguaacaagaaaaaaucuuugucaauacuuaguaaacaaaggagcaauagaagaagauagcgagaucuccggcauagauaaagaucuaaauacauacaugaguuccuauggcaaaauguaucaaauauuuggcgacaaaauaaaaagagacgauauaaaagaaguagccgaagaaauaaucuauuacgguacgauauacgguggagcaaaagagauguucaagaagaaaauagaacaauauguaagugaagacaucuuagaugaagcucaaaugaauaggauauuaggauuuaaauuuaaggacugggcacgauuaucuaaaaaauuccuauaccuggaaggauacgacaaagguaaccaaaaccaacuuacaacacuaaugcaagcucuaugggacuacaaucuaaacacaauggaguuaaugaauaguccgauguuuaccuucaaagaaacacucgaaaaacaaaaaaacaaaauggaaaaaguccuaugcgauuuugaauacgaagaccuagaugaguacuauuucucugcuccaguaaaacggaugguauggcaaacgauagcuugccucaaagaaguaguucaaauaaugggacacaauccaaaaagaauauuuauagaaaugccgagagcagacgaagaaaaaggcgaacaaggccgaaaggcaucccgaaaaaauagauuauugucccucuacgaagaaauagaagacgaaagaccauggaaaaaagagauugagaacgccgcagaaucugguagauuaaauucaaaaagaauguauuuauacuaucuacaaaugggaaaagaugcauauaccggggaagauauugacaucgaagauuuauucgauaauucaaaauacgauauagaccacauauauccaagaagccuaacugaugauaacucacucgaaaacaaccuaguacuaguaagcgcuaccaucaaucaagacguuaaaaaaaaugacuaccccauaccauacgauaaaauacgaggaaauuccaaggugcgagaauuauggagauuucuccaugaaaaaaaauuuaugaacgacgaaaaauauaaucgacuaaugagcgauguaccacuaacacaagaacaguuagcuggauacauagcaagacagcucguugaaacugcccaaggaacaaaaggaaucgcugauauaauaaagagcguuaucccagacgccgacauaauuuacucgaaagcuaaaaacguuucggauuuuagaaagagauacggaauguuaaaaagcagacugaccaacgauuuucaucacgcaaaagacgccuauuuaaauguaguuguaggaaacguauauuuuaccaaguucacacaaaaccccagaaaguauaucaaggaugaaaaugauauagaaaauaaaaaauauaacuauaaccuaucaaaaauguaugauaaagauguaaucagaaacgggaaaguggccuggauugcucaaaacgggaagaaagcaggaaccauacaaacaauaaaaaaagucauggaccgcaacacacccauuauuacacgccaggcauuugaacaacguggagaguuauacgaccuacaaccaauaucaaaacacaaagccaaaaaagaaaacuacguaccaauuaaagccacaaacgaaaagaugaaagacguuacaaaauacggaggauucacaagucuaaacccugcguauuuuguguuuguagaauacgggagcgcaaagaaacgacagagguguuuugccgucguucauucuuauugggccaguucaaucaaaaauaacgaagaucucguaacacaucuaaaagauagaggguaugaaaauccaauugucaucgccgacaaaaucaaaaagaacucuuuaauuaaauacaauggauacuuucucuacauagucgguauggacgcccgaaaacaaguagaauuuagcaaugcaaccuccaugugucuuaacaacaacuucauacaguauauucaaaaaauugaaaaggcaaacacacugauagcagaagcuaagaaacgacgacccuacauugaugaaucaaucacagcagaaagaaauauagcauuauauaacgaacucaaaaagaaacacuuagacuccauauucaaaaaucacccaaaaggaaucggaucuguccuggaaucaggcgaaggugcguucguccaacuaagcuuagaacaacaaauaggcauacucuacucaaucauacaauucucaucauuuaaaaaagggacauucagucuuacccuaauaggagggcccaaggaaguaggucguauaagaauaucagguaauaugccaaaagcucgagaacucaaacuuauacacuacucaauaacuggcauguacaaaaaagaaaucaaucuacucgacuga

SEQ ID NO: 9065 - RNA, 4188 nt, Artificial Sequence
  Cas9 variant
auggaaacccaagccucaaaucaacuaauuucaucacacuuaaaaggauacccuauaaaagacuauuuuguaggcuuggauauaggaaccucaaguguaggaugggcuguaaccaacaaagcauaugaauuacuaaaauuuagaucacauaaaaugugggguucaagauuauuugaugaaggugaaagugcugucgcucggcgagguuuucgaaguaugcguagacgacuagaacgaagaaaauuaagauuaaaacuucuagaagaacuuuucgcggacgcaauggcgcaaguugauccaaccuucuuuaugcgccugagagaaucaaaauaucauuacgaagacaaaacuacaggacacaguucaaaacauauucuauucauagacaaaaacuauacagaucaagauuacuauaaagaauacccgaccauauaucaucugcgaguagcauuaaugaaaucaggaaccgacgacauucgaaaacuguuuuuggcaguucaucauauacuuaaauaucgaggaaauuuccucuaugaaggggcaacauuugacagcaacgccucaacuuuagacgacguauugaaacaagcgcuagaaaacauaacauuuaacugcuuugauucaagugccgcuauaggcagcauaggacaaauuuuaauggaauuggguaaaacaaaaagcgauaaagccaaagcuaucgaaagguuaguagacacuuauaucauuaccgaugaaguggauacaaguggaaaaacacagaaagaacaagucaaagaagauaagaaacgcuugaaaucguucgcaaaccuaguauuagggcucucagcgagccuuacagaucuauucggaaguguagaagaucuagacgaggaccucaagaaacuucaaaucaucggagauacuuaugacgaaaggagagaugaucuagcuaaaguuuggggagaugagauccauauuauagacgauuguaaaagugucuacgacgcaauaauacuaaugucaauaaaagaaccaggacuaacaauaucagaaucuaaaguaaaagccuuuaagaaacauaaagaugaccuagcaauacuaaaaucacuauuaaaaagcgauagaucuaucuauaauacaauguucaaagucgacgaaaaaggcuuacacaauuacguccauuauauaaaacaaggaagaacagaagagacaucguguaauagagaagauuuuuacaaauauacuaagaaaguaguugaaggguuaccagacucaaaagauaaagaauauauauuaucugaaauugaacuacaaacccucuuaccauuacaaagaauaaaagacaacgguguuauuccauaccaacuucaucucgaagaauuaaaaguaaucuuggcgaaauguggaccaaaauucccauuucugaaugaaguugccgauggauucucuguagcagaaaaacuaauaaaaaugcuugaauuucgaauaccuuacuauguuggaccauuaaacacacaucauaauguugacaauggcgguuucgcaugggcgguaagaaaagcaucuggccgaguaacuccauggaauuucgacgacaaaauagacagagagaaaucagcagcggcuuuuaucaaaaacuugaccaauaaauguacguacuuacuaggcgaggauguauuaccgaaaucaucauugcuauacucagaauuuauguuacucaaugaacuaaauaauguacgcauagauggaaaaccacucgaaaaagcaguuaaagaacaccuuauagaagcaguguuuaaacaagaccacaagaaaaugaccaaaaauaggauugaacaauuccugaaagacaacaauuauauaccugagaaacacaaaccugaaauaacaggacuggauggugaaauuaaaaacgaccuugcaagcuaucgagacaugguccgaauauuaggaaacaacuucgaccuaucgauggcugaagagauaaucacagacaucaccauauuuggagaaagcaagaaaauguuacgcgaaacacucagaaacaaauucagcagccggcuggacgacgaagcuaucaagaaacugucgaaauuacgauauagagauuggggacguuuaagccgaaaacuauuaaacguaauagaagguugcgacaaagcaggcgacggaaccccagaaacuauuauaauccugaugagaaacuucucauauaauuuaauggaauuacuuggcgacaaauucaguuucauggaaaggauacaagaaauuaaugccaaacucauagaaggacaaaucguaaauccacaugacauaauagacgaccuagcauuaagcccugcgguaaaacgugcaguauggcaggcuuuaagaauaguugacgaaaucguucacaucaagaaaacacugccagcucgaauuuuuguagagguaaccagauccaauaaagcagagaaaaagaagaaagauuccagacaaaaacggcuauccgacuuauaugcagcaaucaagaaagaugacgcauuacuaagcggacucaccaaugaagaguucggaggacuaaaaucaggcuuagcaaaauaugacgaugccgcgcucagaagcaagaaacuauaccuauacuauacucaaauggggcguugugcuuacacaggagaaguaauugauuuaucacaauuaaauacagacaauuaugauaucgaucacauuuacccaagaucacuaacaaaagaugauuccuucgauaacuuaguccuauguaaaaggaccgccaacgcacaaaaaucagacacuuacccuauaagcaaagaaauacaaaaagcgcaaaaagcauuuuggauauucuuaaaacaacaaggacugaucagugaaagaaaauaugaacgcuuaacgcgaauaacaccauugacugcagacgacuuaucuggcuuuauagcucgucaguuaguagaaacaaaucaaagcguaaaagcugcaacaacauugcuuagacgacucuauccgggcguagauguaguauuugucaaagcugaaaacguuacggacuucagacaugacaacgauuucauaaaaguacgaagucuaaaucaccaucaucaugcuaaagaugcauacuuaaacauaguaguaggcaauguguaccaugaacgauucaccagaaacuuucgagcauucuuuaagaaaaacggugcuaaccguacguacaacuuagcaaaaauguuuaauuacgauguaaaaugcacaaaugcgaaagacggaaaagcaugggccguaaaaacaucaauggacaccgucaagaaaaugauggauagcaacgacguacguguaacaaaacgagucuacgaacagaaaggacaacugucugauauuaaccuuacaaaagcaucgaaaguaaaagcagauauauaccuacccauuaaagcgaacgacccaauaaugagccaaaacaugaaauacggaggauauagcgauauuaaaaaugccuauuauacuauuauugaauauucagauaagaaaaauaacaguauaaaagcauuuauacccauuccuauuuuuauugcuaccaaaacccuuacgaaacaagcauuauuagaauacaucaaaacaguccuaccgaaagcaaacaaucuaagaaucauuuauaagaaaguuuacaaugaucaauuacuaaaaaucgauggauuuaauuacuaccuaggcgguagaagcaacgauagauucuguauugacaaugcaauucaguugauaguaccucucgaaauacaauucuacauaaaacucguggaaaaauucacagcuauaaucucagaaaauaaaaauauagcccuaaaagcgaguagcgugaaaucaagaaacccaauaaacaaccagguagagaacauuacauuagaauacacccaaaaauuauuugauuaucucgucagcaaauucaacgaauuaauauaccuaaaaaugagagguaacaaauuaaccgacguaaauaauaucggaagaaaacaauuuauaaaauuaucccuagaagaaagauguaaagcccuagcagaacuauugaacauauucacaaauaugaacaagaaacuaucucucucaacaauaaauguaagcgcaagcagaaaaguaguuaacuuuaaaauaucaucauuagaugaauuuaaaaucgucaaugaaaguauaacaggacucuacagucacgaaauaacuauaguauga

SEQ ID NO: 9066 - RNA, 4188 nt, Artificial Sequence
  Cas9 variant
augaaccuucgaaauacuacagaugaguacaauauaggauuagauaugggaacaaauucuguaggaugggcaguaacagacaaaguaggagccauagcacacuuuaaaggaaugccaacauuaggaucacgacuauucgacgcagcucaaacagcagcagaagcgcgagcacaccgaggucaacgaaggcgguaugucagaagacgguggagauuagauuuacuacagagucuauuucaagaugaaaucgauaaaguagauuccgaguucuucauccggcuucgacaaucuagguuacacguggaagauagagaagauggacaugcggauuauaaauggccaauauuuaaugauuccgacuuuacugaaguagauuacuacaaaagauucccaacaauauaccaucuaagaaaaugguuaauagaaacugaccaaaaagccgacauacgcuuaauauauuuagccguucacaauauaguuaaacaccgaggaaacuuuuuacgagaaaauaauaaaaaucuaagcucgcggaaugcagacccagcagaagcggucggacacuuacguuuagcucuaaauaauugguguuuggaaagaggguaugaaugugcauggaaaaguggaggaaacgauaaugcaauuuuaaauguacuuauugauggagagaaaagaagaagugaccaaguuagagaaauagcaaaauugacagguaucgauuguggagaugcaaaacaaucaagacaauguaacgaagcaauagcaaaagccaucguaggauuaaaagcagaaaugaaaaacauauuuggcgaguucccggcagaaaagacacuaauauacuuaucaucagaugaugauguugaaguaguaagagaugcauguccagacgauaguguagaacuuuuccaagcucucugugaauuauacgcugcuuacauauuacaaggauuauugaguuacgcaccagggcaaacaauuucugugaauauggugaagaaauacgacagauacggagaagaccuccauuuacuaaaagaacugacuagaacauacgcgucaaaaagauaugaugcuuucuuuagaggugaaaccuaugaaggaucgucugacuacguaguagauaaggcacaagguuauacuagauauaaucuggggacuacucaacuuucauacgaugauuuucaaaaagcgguaaaagaauuauuuaaaggaacagaugcauuacaagacgaaagauaccaaggaaugaugguugcuuuuggcgagcaacgauuucuuagaagacuaaaaaccucagacaaugguaguauuuauuaucaguuacaucucgaagaacugcaugcuauauuagaaaaccagggaaaacacuacccguuucuguuagcagaagaagauaaaaucgaaagccuaguuucauucaggauucccuauuacguugggcccuuaaccagagagaacgcggcaguaggucaugaugggaaagaaagauucgcauggucgucuagaagagacggaauggaacaugcagucauaacaccauggaauugggaagaaaucaucgaccgggauaaaagcgcggaagacuucaucauacggaugacaggugauugcacuuacuugcaaggcgaaccgguacuuccaaaaugcagccuacuauacgaagaauuuugugcucucaaugaauuaaacggagcacauuggacaaucgacgaagaugacgaacggcguuucgaugccgcacaaagagaacgaauaaugugcgaucucuuccguagcacuaggaaaguuacuuauaagaaaguuucugauuggcucgaaagagaagauuccuuuguaggagcaagaguucauggaggccagggagaacauggcuuugaaucacaauuagguucauauauauuuuucuguaaagauguuuuuaaaacagauucauuagaugaagcugacuaucccaugauugaacaaauaauauuauggucaacacuuuuugaagaucgcgacauacuccggagaaaaauagaagaagcauacggcgauagguugacuacugagcaaauaaaagugauauguaagaaaagguuugcagguuggggucgauuaucaaagaaacuacucaccgguauaaaagucgacacugauacuggacguaaaaguauaauugacgucuuaagagaaggcaaucccaaugauggacaaagaucucgaacuaugguuuucauggagguacuacgagacgaaggacuaggauuccaaaaagcaguugaugauuuuaaccgggauuauuuuagcgaacauaacaacggauuaauggauguuaaugaucuacccggaucaccagccauacgucggaguauaaaccaagcaguaagaauaguagacgaaauaguaaguauagcaaagaaagaaccugcuaauauuuuuauugaaguaacacgggaagaagaugauccacguaagaaagguaaaaggacaaaaagacgauaugacgcaauuaaaucggcuuuagaaguauucaagaaagaugauccccaacuuuggaaagaacuaacaaagaaagauucaaacaauauggacgagagauuaagccuauauuucaugcaaagagggaaaugcauguauuccggucggccaauaaaaauugaagaguuacauaccgggaaauacgaagucgaucacaucauaccacgcucuuacaucaaagaugauagccuagagaacaaaguauuaguuuacagagaagaaaaccagcauaaaacagauacauuauuaauagauucuucuauacgcagaaaaaugggaaaauauuggcgaauguuacacaaugcaaaacuaauaggcgauaagaaauuuagaaauuuauucagggaucacauagaugauaaaaccaugaaagguuucguagccagacaaaucguagaaaccucgcaaaugguuaaauugguacaaacucuacuagaggcgcgcuacccgggugcgcgaauaguaccaguaaaagcaaauauaagccacgacuuaagagacgcugccggauuagucaaaugcagagaggcuaacgacuuccaucaugcacaugaugcauuucuagcgugucguguaggauuauuuauacagaaaagacauccaaguguauaugauaauccaaucggucuagcacacauuaugcgagacuacgccagagcccaagcuagagaauacaagaaaucgcauuauuuagcucauaccaaagguuucauagugaacaguuuucuuucaagcggauucgacaaagaaaccggagagguauucaaagaugauugggaugcggaggccgaaguggaaggcauacgaagggugcuuaauuaucgacaauguuucauuucaagaaugcccguagaagcaaccgggacuuucugggaccaaacaauuuauaguccaaaaugcggaaagaaauuaacacuacccuuaaaaagaggcuuggaucccgauagguacgguucauauagcagagaacaauucgcauacuuuuucauauacgaggcaagagacuugaaacaugagcgacauauccuucaauuugcacaaguaccaguaagaguggccgcacauauagcaaaagacccaucacaacuagaaucauaugcaguaaaacuagcaggacaagcaaaccucgccuucguaagaauaguaaggagaagaauauuaaagaaacaacuuuuggaauuaaauggagauagguuaauuauaacaggcguuagagaaguaagaaacgcuacagaguucgcauucaguuuagacgaagaaacauuaauagaaagauguguucagauugcgaaaguaggaucucuuauuggcguaguaaacgaugaagaugaagaacaacuaucugcagacuuaaaugaacuguucucaagccuagucaaaagaggcccgaaacuaugcaauagguuauaugcacaguuaaaauuagauaaauaccuuucgaaauuugacgaauugacuuugacagauaaagcaaaaguuguauuacaacuaauugcaauaacaaauggcucuauaaacauggcggauuuaucagcguugggaucaagcaaauaugcaggauguaugcaaguuucuuauuuuaaacaauuaaaugcaccaauaggagaaguaaacauaaucgaucaaucgguuacuggaauguuugaaaggagaacacauauagggcuauga

SEQ ID NO: 9067 - RNA, 4188 nt, Artificial Sequence
  Cas9 variant
augaaggaaauuaaagauuacauaauaggccuagacauaggaacaaauuccugugguuacguagugacggacaaacaaaacaacauauuaaaauuaaaaggaaaaacugccaucggcgccaggcuauuuaaagagggccaagcugcagcagaucgacgaucguuucguacaaccaggcgaagauuagcccgaagacauuggagacuaggucuauuagaagaaauauuugaccccgaaauggaaaaaauugaccccaauuucuucaggagacuaaaagaaagugacuauucgccaaaagauagccgaaagcaauucaacgcuauaguuuuuaaauccauuaaagcggauaaacgauucuacaaaaaguaccccacaaucuaucacuuaagaaaugcguuaaugcaugacaaucaaaaacaugaccuaagggaaauauucauggcaguccaccacauaguuaaauauagaggaaacuuucuaagagaagauucuguaaacgcauuuaaggcagcaaaauucucauuaagaggagaagaugggaucgguccaguagauaaacuaaaugaucuacuaaaagaaauuuauucagaauauucaccagagcuagcgacuaauaaucuauccaaaauagaagauauaauaaaagacaaaaauuuauacaaacaagauaaacuaaaacaaguagccacuuuacucauuaaagaggcagacagcaaagacaaggcaaaauuaaacaaagacaucgcaaaacaaguagcuaacuccuucaugggauacauguuuagauuagacacacuguucucuuuaacugaugucgacguaaaagacuacaaacuaaaauuuagcgacgccaauauagaugaaucacuagacgaucuaacaagccucuuaacggacgcccaaauagaauucguacuugaauuacaaucaaucuacaacacgauaguauuaaacgaaauagugccugaugguaugagucuaucagagucaaugaucaaaaaauaugaugaucacaaagaagacuuaaagauauucaaagaauacauugacagccuuucagaucaaaaaaaagcaaaaaaacugcuuagugcauacaaucucuauguuaauuacagaaaaucagaccuuguggaagcuaaaaacuuguucaaaaacaaaaagguaggcgauaaaaacuucgccgacguaauuuccaacuucgaaguauucggaaaauucgucagugacaaccucgacgauagcgaacuagcaaauaaaauaaaagcaagauuagacuugggagaauuucucccgaaacaacgaaccaaucaaaacggcguuauucccuaucaauuacaccaggucgaauuaacacagauucuugaaaaacaaggaaaauauuaccccuuccucaucacacccaauccagucgaaagccacagaaauaacgcgccauacgaaauaagcgaacucguaucauuuagagucccauauuacguaggaccacugauagacaaccaaaguauaaaagauaaacaaaauaaaaacaaguuugcauggaugguuagacaaaaacagggccaaauaacaccauggaaucucgaagaaaugguggacacuacagagagcgcaaaccaauucauaaaacgaaugacucgaaaagacacauaccugcuagcugaagacguauuaccaaaaucaucauuaguauaccaaaaauucaugauccucgaugaacuaaacagaauaaaaaucgacggaaaaaaacucacauccgaacuaaagcaugauauauuugaaaaacucuuuaaaaaacaaaaauccaucaaccuagacaauuugaaaaacuauuuacuuguugaaggaaacauacccggacuaauagaaggauuauccgacggaauaaacuucaacaacucauucagcacauacauagacuacaggaacauauucggcgacgaaauugauaacccaaauaaacaagcagauuucgaaaaaaugauagaauggaguacagucuucgaagaccguaaaauauucaaacguaagcuuaaagaaauaacauggcuuacuucagaacaaaucaagcaaguuuccucaaaacgauauuccggcuggggcagacucagcaaaaaacuucuuacacaaaucacagacgaaaacggagucaacauucuccaacgacuauggaacgaaccagaaacacuaacagaaguacuugcaaacccaguuauaaaaagaaaaauaguugaggcaaacuccuccuuuacgaaagcgaaagauaugaaagacaucuuaguagaagcuuacaccuccccacagaacaaaaaagcaauuagacaaguaaugagaguagucgacgauaucaucgcugcggcacauggaaaaaaacccucacagauugcuauagaauucgcuagagaagaccaagacaacccacaaaugacgaaaucucguaaagcacaauuagaucaaauauacgcuaaaauaagugaugaauuccuugacgacgcagucaagaaugaacuaaaaaauaugaaagauaauaaaccauuagcaaaagauaaaguauuuuuauacuucaaacaaaugggaagagaugcauauucaggagaaaaacucucccuagauaaccuucaagauuaugacauugaucauaucuacccccagucuuuuauaaaagaugacaguuucgauaacaggguccuaguacaaagggcuuacaauaauggaaaaucagacaauguaccaguguuauuauucggaaauaaaauagcagccggauugggaauaacaauaagacagauguggaaaaaauggcuugaacucggacuaauaucaaaaagaaaguuuaauaaccuuauaacagauccugaaaagaucagcagaaacauggcaagcggauuuguaaacagacaacucguugagacgucacaaguaauuaaauuaguggcaaauauccuccaagcaaagcucccggacacagaaauaaucgaggugaaagccuccuacaauucaauauuaagaaaagaauuuaaccuauacaaaagccgagaggugaacgauuaccaccacgcaauagacgcauaccucacaaccauaguagggaacuacuuauaccaaguauauccaaaacucagacccuacuucguguacggacaauuuaaaaaauuuggcaaagcagaaaaucaagaagaugauccuguaaaaaaaauuaaaaaauuuaauuucauauaccaacucauauggggaaaagaugaugcgauauguauaagccauaccaaccagcaaguguucagcaaaaaagauauaaucgacaaauuaacaacagccuauaacuuuaaauauaugaacauuucacacgcaguuuacaccaggaacaauaacauguuuaaacaaacauuguuucccauaauugaaagaacgaccgcgaaaaccaagagucuaaucccgaaaaaacuugaccgacccacugacauauauggaggcuauagcaacaacaacgaugccuauuuggcuuuaguaaaaguugauaaaaaaagaggauccgaguaccgcguaguaggaaucccuaugagagcagcggccaugcuaaaagcguccaaaaauuaugacgaagaccuaagaaaaguaauagaaccaaugguaauguuugauaaaaacggcaaagcaaaaagagguauugaaggcuucagaguccuugucggcaaaaugccauuuaaacaggccguccuagauggcaauaaaaaauuuaugcucacaggaacaguugacacacccaaccugaagcaacucguauuaagccaacaaaacaugaaauacaucuuagacuacaucgaggauguagacugucggaaacauaaauuuggagauaaaguucaaaacccugacaagugucuuuuagagguauucgacgaaauuauagaaauaguggacaaauauuuugaacuauucgacucucgcgacuuuagagaaaaauuaagaaauagccgaaacaaauuuauuaaauuagaggcuaguaaaaaagcggauacaauauuagcaauacuaaaaggcuuacaagccaaaagcaccagggcuaccauaaaagaacucaacauaucagacuuugguagaaucauaacuucaaguauaucaccagaagcacaacucaucuaucagucuccuacaggacuuuuugaacguagaguuaaaguuaaggacuuauga

SEQ ID NO: 9068 - RNA, 4188 nt, Artificial Sequence
  Cas9 variant
augucaaaaaaauaccaaaauacaaaauauuacguaggauuagauauuggaacauccucaguaggaugggcaguaacagacgccaauuacgaauuacuaaaagucaacggacauaagacuugggggucaagauuauuuacggaagcagaaacagcacuagagaggcgaacacauagggcaacgcgaagacguuuacaacgcaggaaacagcgccuagaccuacuugacgaacuauucgcagaagaacucgcaaaaguagacccacaauuccucuuacgauuaaaggaaagucaauaucauauggaagauaaaucaaccgaugacaaauacguucuauucaacgaccaaaaucgaacagacggagaauucuucacagaauauccaacaauuuaucaucuaagauccgaacuaaugcaaggaaaaaaagaggacauaagagcggucuaccucgcauuacaccacaucgucaaguauagaggacacuuucuacuaccuggcgauaacuaugacaugcaagguaaucuauccgaacucauaaaaagacucuuuaaauucauagaagaaacgcuuuucauugaagauuuaggguuaacagacgaaauacagucaaaaauugaagaaauccuacuaaccaagacaaaaacaagauuggauagacaaaaggaaauaguaaaauuauucaacacaaaacaucaaaaguuagaugacaaacaaaaaaaauuacuggaagccauuuucaaacuuugccuaggauuaaaaggcaacaugguaaauauauuuggagacaaaggcgaauacggaauugauuucacagacguagaggauaagaaaaagaaaguagaguucagcgcggauuacgacaauaauauaaacgacuaugucgauuucuuuggugaauauuucgaauuacuugaaauaacaaagaagaucaacgauacuguaauauuuucagaaauacuaguugauggcaaaggcuuuucggaaaguaaaguaauaagcuacgagaaacaccaacaagacuuacgaaaacugaaaaccuuacuaaaaagccuugauaaaacacuaggcuauaaauauggagaagguuuauaucaaaaaauauuacuagacgacguaaaaagcaauuacgucaauuauucaggcaacucacaaaaacuaaaaaaaugcacaaaagaugaguuuuacggcuucauaaaaagcaaacucaauucgguaacuaaaaaagaaaaaguuagugaagcccaacaaaaagaaauagcacaaauacuagcagauauggaauucggagacuaucucccacuccagcgaacaaccgauaacgguguaauaccaaaucaacugcacaagaaggaacugauugaaauaauagaacaacagacuaaauaucaugauuuuuucaacgauguagaugaaaaugggcuaacaauaaaagacaaaauuauaucacuaaugacauuucgcauaccuuacuauguagguccacuuaaugauuaccacaaaguugccgauggaacaggacacgccuggauagaaaaaaaaaaagacggcaaaauauacccauggaauuuugacgaaaugguagauacugaagccacugcagaaaaauuuauaaagaaccucacuaacaagugcacauaccuuaaaggggaagauguauuaccaaaagagagcaaacuauauagugaauuuauguuauugaacgaacucaacaacauaaaaauugauaaccaaaaauuagacccaaaauuaaaaaugaaaaugguuagcgaacuuuucaugaaaaagaaugaaaaaauaaccaaaaaaaagauaguggauuaccuaagaaguauaggccaagccaacggaaacgaaaugguaucaggaauagaucgggaaauaaaaucggaccuaaagacuauacacaaaauacaacauuauuaccaagacgcuuccuuagaaauggcggagaauauaauaagauggaauacaauauuuaacgacagcaccucagauauacuaaaagacaaaauaacaaaagcauauggagauguccuaacgccaggccagaucaaaggacuaucgaaccuagcgugcaaagauuggggaaaacucuccgaaaaauucuuaacaggcaucagaugcgauguuggugaauucaaaaauauaucgauuauacaagccaugcgagauacaaacaacaaccuuauggaauuacugucaaauaaauacgaauucauggacaaaauacaagaauacaacaaagaguacuacggagacuucacauuuaaagcggaacccaguauaauggaugaccucuauguaggaccaggaccaaaaagagcgauuuggcaggcuguaagaaucguagaagaaaucaaaagaauaaugggacaugacccagagaaaauauuccuagaaacuacaagaacuaacagagccccaaaggucaaaaauacaaaaagauaugacgcuuuagaaaaaaaguacgaaucagucaaagaacaugaauacgcugaagucaaaaaagaauuugaaaucgaaaaaaaugacucucuaaacauaaaaaaacuauuccuauauuuuacacaauuaggucacuguauguauagugaugaaaaaauuccauauaacgagcuauuuacgaauagguaugacaucgaccauaucuacccgcguucaaaaacaagagauaacagcauggacaaccugguacucguaaaagcugaaugcaacagagacaaaaaagauaauuacccaauaaaacuaaaaaccaauauacaacagaaaugccagguuagaugggcauaccuuagggauaagaaauuaauaacagaagaaaaauacaacagacuaguuaggaaaacaccauugacagaggaugaacuuucucaauucauagcaagacaacuaguuuucacuucucaauccgugaaggcgacggccgaaguuuuuaaaagguuauacgaagacucaaaaauauguuacguaaaagcagaaaacguaucagauuucagauacggaucuacccguaagauguccaaagacgaccaaccucaacccuucaucaaaaaucgcgacguaaacgauuuucaucacgcaaaagacgcauacuuaaacauagucgucggaaauguauacgaugucaaauuuacacagaauccaacccguuucaucaaagcuaacaaagauuauucauuaaacuacauauucagauaucccguaaacaaaaaaggugaaaauguaugggauccagaacaaucaaugaaaaucguggaaaaaaccuuaaaaucaaacgacguaagagucaccaaguuaguuaagccuauuacgucaccgauuucuaacgaaacacuacacaaagcacuaaaaugcaaaccuggcucuuauuuaccaagaaaaagcucuaaaggcaccccucuagcugacguuacaaaguaugguggauacgaaaaaauaaaaaacgcauauuauucaaucuauaaauauacauauaugaaaaaaaaagaaugcauggaagaauuucuucucgucccaauuccaauccauuuaguaaauaacgaugaagaauuaccgaaauacauaaaugauaagauugccgaaagagcaaaaaaaaaaaaguuagaaacagucgaaugcaucguaaaagaacuuuaucaaggaacauuaguaagaauuaacggauacgauuaccgcauugcaggcucaucaggaaaacaauucgaauuacauaauggaauaaacuuaauaguagaaccauggguggaaaaaguucucaaagaaaccgacaaauuugugagaaaaaguaacuccaaacuagacaaaaaacaacaaaaagaaaauaccacggaaacucuaauagagaaacaauuaaaugacguuuucgaauaucuuugcagaaaauuaaaucaagguaucuuuaaaaauaauaaacauacacuaccagcaaagcuucucggagacuccauucaaaaaagguuugaagacgcgaguauagaagaugaauucgaaguaauaaaagagcuaaucagugcgauagcaaaaaacccacaaaacuucaaaacuauacaaaaaguccuagacauauccggcucaaguaucccaagauucaacuuaaaacucaccaaaaacaacguagaugaguucauaauuaaaaacgaaagugucacaggacuauucacacaugaaaaagucaucuucagaaaauga

SEQ ID NO: 9069 - RNA, 4188 nt, Artificial Sequence
  Cas9 variant
augaagaaagaaauaaaagauuacuuucuaggccuggauguugguacuggcucaguugguugggcuguaacagauacggauuauaaauuacuuaaagcaaacaggaaagaccucuggggcaugcgauguuuugaaaccgcagaaaccgcagaaguaagaagacugcaucgaggagcucgaagaagaauugaaagaagaaagaaacgaauaaaacuccuacaagaacuuuuuagucaagaaauagcaaaaauugaugaaggauucuuucaaagaaugaaagaaucaccacuauaugcagaagacaaaacaauauuacaagaaaauacacuuuucaacgauaaagacuuuacagacaaaaccuaccacaaagcauacccaacaaucaaucauuuaaucaaagcauggauagaaaauaaaguaaaaccagacccaagacuucuauaucuagccugccacaacauaaucaagaaacggggacacuuucuauucgaaggcgacuuugacagcgaaaaucaauuugauacuagcauacaagcauuauuugaauauuugagggaagacauggaauuagauauagacgcagauucgcaaaaaguaaaagaaauacuaaaagauucaagccucaaaaauagugaaaaacaaucaaggcuaaacaaaauguuaggauuaaaaccaagugacaaacaaaagaaagccauaacaaaccuuauauccggaaacaaaauaaauuuugcagauuuauaugauaauccagaccuaaaagacgcagagaaaaacucaaucucuuucagcaaagacgauuucgacgcgcuaagugaugauuuagccucaauccuuggcgacagcuucgaacuauuguuaaaagcgaaagcaguauauaacuguucaguacucagcaaaguuauaggugaugaacaauauuuaucauucgcuaaaguaaaaaucuacgaaaaacauaaaaccgauuuaacaaaacuuaaaaauguaauuaagaaacauuucccaaaagauuauaagaaagucuucggcuauaacaaaaaugagaaaaauaacaacaacuauucugcauacgucggaguuuguaaaaucacacacaagaaauuaguuaucaaaaacucggcuucacaagaagacuucuacaaauuccuuaaaacuauacuaucagcuaaaucagaaauaaaagaagucaacgauauacucaccgaaauagaaacaggaacauuccuuccaaaacaaauaucuaaaucaaacgcagaaaucccuuaccaauugcguaaaauggaauuagagaaaauacucagcaacgccgaaaaacacuucucuuuucuuaaacaaaaagaugaaaaaggacugucacacucugagaaaauaauaaugcuacuaaccuucaaaaucccauacuacaucgguccaauaaacgauaaccacaagaaaucguucccagauagauguugggucguuaagaaagaaaaaucaccaucagggaaaacaacaccauggaacuucuuugaccacauugacaaggagaaaacugcugaagaauuuauaacaagcaggacaaacuucugcacauaccucauaggagaaucaguacuaccaaaaagcagcuuacuauacagcgaauacaccguacuaaaugaaauaaacaacuuacaaauaauaauagacgggaaaaacauaugcgacauaaaacuuaaacaaaagauauacgaagaacuauucaaaaaguacaagaaaauaacucaaaagcaaaucucuaccuucauaaagcacgaaggaauaugcaauaaaacggacgaaguaauaauucuugguaucgacaaagaaugcacaucaucuuuaaagaguuauauugaauuaaagaacauuuucggcaaacaaguagacgaaaucucuacuaaaaacaugcuagaagaaaucauaaggugggcuaccaucuacgaugaaggagaaggaaaaacgauucuaaaaacaaaaauaaaagcugaauauggaaaguauuguagcgacgaacaaauuaagaaaauacugaaccucaaguucucaggcuggggcagacucucuagaaaauuucuagaaacaguuacaucagaaaugccaggauucagcgaacccguaaauauuaucacagcuaugcgugagacacaaaacaaccuuauggaacuacuaucgucagaauuuaaauuuacugaaaauaucaagaaaauaaacaguggcuucgaagacgcggagaaacaauuuucauacaacggacuugucaaaccucuauuccucagcccuuccguuaagaaaaugcuauggcaaacccuaaagcuaguaaaagaaaucucgcauauaacacaagccccacccaagaaaauauucauugaaauggcuaaaggagcugagcuggaaccugcucgcacgaaaacaagacucaaaauacugcaagaccuauauucuuccuguaaaaaugaugcagacgccuucucaagcgaaauacaauaccuaucaggcaaaauagaaaaugaagacaaucuacgucuaagguccgauaaacuuuaccuauauuacacucaacuaggcaaaugcauguauuguggaaaaccaauagaaauaggacacguauuugacacaagcaacuaugacauugaccauauuuacccccaaagcaaaauuaaagaugauucaauaagcaacagaguccuaguuugcucaagcuguaauaaaaauaaagaagacaaauacccacuaaaagccgaaauacaaucaaaacaacgaggguuuuggaacuucuuacaacguaauaacuucauuucacuagaaaaauugaacaggcuaacacgcaccucuccuauaucagacgacgaaacugcaaaauuuauagcaagacagcuaguagaaaccagacaagccaccaaagucgcagcaaaaguauuagagaaaauguuuccggaaaccaaaauaguauauaguaaagcagaaacagucucaauguuucgaaacaaauuugauauuauaaaaugccgagaaauaaacgauuuccaccaugcacacgacgcguacuuaaacauaguuguuggaaacguuuacaacacaaaauuuacaaauaacccauggaacuuuauaaaagagaaaagagauaacccuaaaauagcagacacuuacaacuauuauaagguguucgacuacgacguaaaacguaacaacauaacagcgugggaaaagggaaaaacaauuaucacaguuaaagacaugcuaaaaagaaacacuccuauauauacccgacaagcagcuuguaagaaaggcgaacucuucaaccaaacaaucaugaagaaaggucucggucaacauccucuaaagaaagaagguccauuaucaaauauaaguaaauauggaggauauaacaaagucagcgccgcauauuacacacuaauugaauacgaagaaaaaggaucgaaaauaagaucacucgaaacaauaccacucuaccuuguaaaagacauucagaaaaacaaagacggacuaaaaaguuaccucacagaccaaauuggaaagaaagaaauaaaaauauuaaucccaaaaauaaaaauaaacagcuuacuaaaaauaaacgguuuuccgugccacauaacaggcaaaaugggagaagccuucguccuccgacccgccguacaauucugcuguuccaaugacgaagcacuauacuucaagaaaauaauaagauucaaugaaauccggaaacaaagagagaaaaugggaaaaacuauaucacccuaugaagaucuuucauucagaagcuacauuaaagauaauuuauguaagaaaacaaaagcagacgaaaucgaggaaaaagaguucuacgaucuauuacaaaagaaaaauuuagaaauauaugacaugcuacuaaccaaacauaaagacacgauuuauaagaaacguccaaacagugcuacuauugauaucuuagugaagggcaaagaaaaauuuaaaagucucaucauagaaaaucaauuugaagugauccuagagauacuaaaguuauucagugcuacaaggaauguuucagaucuccaacauaucggagguucaaagaaugccgguaaugcucgaguaggaaacaaaauuagcucgcuggauaacuguauacucaucuaccaaucaauaacugggauauucgaaaaacgcaucgaccuauugaaaaucuga

SEQ ID NO: 9070 - RNA, 4188 nt, Artificial Sequence
  Cas9 variant
augaguuuuaaaaaaaucuuaggccuugacguaggugucgccucaauaggaugggcugucguaagagaaaaugaagaaaacccgaacuuuaacacaauaaccaaacuaggaguucguguaguaccaaucaccucggacgaaaaacuaaauuuugagaaaggcaaaucgauaacaagcaacgcugaacgcacauuagcaagaucaucgagaagaaaucuacaacgauuccgacucaggagaaaaaaccuaauagcaauacuacuccaaaaucagauuauaaccccuacuaccccuuuaacagagaaagguaaauuuacaacauuugagacacucaaaauaagggcaaaagcaacuaaagagaaaauagaacucgaagaacuagcaagaguauuguuacauauaaauaaaaaacgaggauauaagucaucucgcaaaguaaaaaacucagaagacgguaaagcgauagacgggauggaagcagcgaaaauacuguaugaaaacaagcuaacaccaggccaauacacguaucaacuccucgaaaaagguucuaauaaaauaccagauuuuuauugcagugacuuacaaaucgaaugggaaguuauauggaacuuccagaaacaauuuuacccuaaccuucuaacggaagauuuuaaaaaagagcuaaaaggcauaggacaacgcgcuaccgcagcucuauuucuuaaaaaauauggcauauacaccgcacuaaacaaaggaaaaagggaggaaaaaaaauuacaggccuacaaauggcgcuccaaaucgguauccgaaaaaauuccaguggaagaacuagccuacgugaucgccgaaaucaacagucacauaacuaauaguucaggcuaccuaggaaccauaucagaucgcucaaaggaacuauacuucaaccaacaaacaauaggagaaaacuuauaugcacaaguagccaaaaauacgcacgcaaaacuaaagaaucaaguauucuuaaggcaggacuauucagcagaauucgaacaaauaugggaaacucaagcgaaguuccauccccaacuaacacccgaauugaaaaaaaaaauaagagacuccauaauauucuaucaacgaaaacuacgaucacaaaagcgccuaauauccauaugugaguucgaaaaucgugaaaucgaaauuauuaaaaacgggaaaaaaaaaaaaaaaaaaauaggccuaaaagcagcaccgaaaucaucaccgcuuuuucaagaauuuaagauauggcaaguacuuaauaacauagucauaaaacaagaaggcaaagaccguuugcuuacaugggaagaaaaagaacugcuuuuuacagaauuaaacauaaaaggaaacauauccggccagaaagcauuagcacuacucaaacuaucaccaaaggacaccaaaauaaauguuacaauauuggaagguaaucacacgcaagaacaacucuacagagucuaucuccgaauccucgguauggaaggcuacgacguauuugauuuauuaaaaauaccagaaaaccaagaugaaauuaaacccgcagauucgaaaauuagugcugcagaaaucaaagaaacaguaaaaucaguauucaaaaccugcucaaucuccccauccauacuagauuuugauccacuucuccccaacccagaauucgagaaucaaaguuccuaucaacuuuggcaccuacuauacucauacgaaggugacucuaguccaucaggcaacgaaaaacuucuagaacuccuuaaaaauaaauuuggcuucaaaaaagaacaugccuuauuacucgcgucaaucucuuauaccuacauauauggcaacuuaagcucaaaagcgaugagaaaaaucuacccauacaguaaagaaaacaccuacagugaagccugcaugcuagcaggauacaggcauucuaaaaacgccuuacccagggaagaauuagugaaauaccaacuaaaagacagacuugaaauccuucccaaaaacucucuaagaaaccccguaguagaaaaagugcuaaaucagcuaauaaaccuaguuaauucacuuauggacgaauauggagcauuugacgagauuagauuagagauggccagagaacucaaaaagaaugcaaaagaacgcgaaaaauggucaaaaaauauugcagaugcuaccucgagaaaccaaaaacaugccgaaauucucaaaaaagacuucaaaaucagcaacccuuccaaaaacgaccuaauaagauaccgauuguaccucgaacuuaaagccaacggcuauaacgauuuauacaccaauaccuauaucgauauaaauuacuuauucacacacagauaugauauagaccacaucauaccacaaagcaagguuuuggacgauucauucagcaacaaagucuuagucccacgacaagcaaaucuugaaaaauccaauuuaacugcauucgacuauaucucucaccaaggaaaagaaaaagaagaacauuauuuaaacguaauaacugaacuauacaaaagaggaucaauaucugaaacaaaguacaaaaaucugcaaaaaaaaggcaacgaaauaggagaaggauucaucaaucgagaucugaagaacacccaauacauaguccgaaaagcucgagaaauacucucuuuaaucacccccaacgucgugacaacuacuggcgaaauaacggcaaaauuacgaaaagauuggaaucucauaaauagcaugaaagaauugaacauggacaaguuccgaaaugcuagauuaacugaacuaguagaaaacagcaggggggaaaaaaaagaaauaauaaucgacuggaacaaacguaaugaccagagacaccacgcaauugacgcccuagucgucgccuuuaccacccgaaaucacguacaauaccucaauuacaugaaugccagagaagaugaaucacauaaacaacauucccauauacuaucaauagaaaaaaaaauaaaguacgacaaauuccacgaaaaugguucaagacaaucacgauuuaucuacccaacaucuaauuuccgagaagaagcaaaaaaaaaacuaaaagaaauccuaguuucguacaaaacaaaaaauaaggucgucacggugaacauaaauaaaccaaaaaagaaaggaggauacucaccgaaacaugaacuaacgcccagaggaccacuccacaaagaaacaaucuacggaaugauaagaauauuacacaccaaagaaauaaaagucuccaguaagcuuaauuucgaaacaguuguuagaauccaaaacccgagauaucgcaaugcacucuuagaaagacuuaaagacaauuuuaacgacccuaaaaaggccuucaguggaacaaacagucuaacaaaaaaucccgucuuccuuaccgcgaacaguacagaaacaguaccagaaaaagucacaauccaaugguucgaaaaaguauacacaaucagaaaacccauaaauccuacaaauuucaagaaugaaaaaaacauagaaaaaguacuagaucccaccauaagaacacuucuaaagaaaagacuccaggaauacaacggaaacgcgaaagaagcauucagugaccuugaaaaaaacccaauuuggcuaaaccaagaaaaagguauaugcauaaaaacaguaacuaucacaggcauuucuaacguagaaucacuccacaccaaaaaagaucacuucggaaaagaauuacuagauaucaacggaaaucccauacccgucgauuuuguaucuacuggaaacaaucaucaugucgcaaucuaugaagauucagaagggaaccuacaagaaaaaguaguuuccuucuaugaagcaguagaacggguaaaccaaggacuaccaguaauugauacacucuauaaccuagaucuggguuggaaguuccuauuuacgaugaaacaaaacgaaauguuuuuauucccagcggaugauuuugacccaaacgauauagacauauacgaugaaaaaaaucucauuuuaauaagcaaacacuuguuucgaguacagaaauuaagcuccaaagauuacugcuuuaggcaucauuuagaaacaaguaucaauuucaacgauccugcacuaaaaggaauaaccuggcgccgcgaauccccaaacggccuuagaaaucuaguaaagguuagauuaaaucauuuaggaaaaaucguacacaucggagaauga

SEQ ID NO: 9071 - RNA, 4188 nt, Artificial Sequence
  Cas9 variant
augaagaaagaaaucaaagauuauuuccuaggacucgauguaggaacaggaucagucggcugggcaguuacagauacggacuauaaacuacuaaaagcaaaccacaaagaccugugggguaugcgcugcuucgaaacagcugaaacagcagaaaaacggagacuauuccgcggagcgagaaggcgcauagaacguagacgaaaaagaauuaaacuacuacaagaacuauuuucgcaagaaauagcgaaaauagacgaagacuuuuuccaacgaauggaagaauccccauucuacgcagaagauaaaacaauauuacaagaaaacacauuguuuaaugaucgugacuucacggacaaaacauaccauaaagcauacccaacuauaaaccaccuaaucaaagcauggauagaaaacaaagugaaaccugacccuagacuccucuaucuagcuugccacaauauuaucaagaaaagaggacacuucuuauuugaaggagauuuugacucagaaaaucaauucgacaccaguguacaagcacuauucgaauacuuacgcgaagauauggaacuggacauagaugcggacuccaagaaaauaaaagaaauuuuaaaagauucagcacuuaaaaauucugauaaacaaaaccgauuaaacaaauuacuaggcuuaaaaucgucagacaaacagaagaaagcacuaaccaaccucauaucuggcaacaaagcaaacuuugccgacuuauacgauaaccccgauuuaaaagacgcugagaaaaacucaaucucauucuccaaagaugauuucgacgcauuaucagaugaacucgcaaguguauuaggagacucuuuugaacuauuacuaagagcaaaagccgucuauaauugcucaguauuaucuaaaguaauaggagacgaacaauaccucucuuucgcaaaagucaaaauauaugaaaaacacaaaaacgaucucacgaaauuaaaagaaguugucaagaaauauuucccaauagaauacagaaacauauucggauauaaacaaucagaaaacaacaauuguaauuauucaagauauguaggaguaugcaaaucaggcagcaaaaagaaaguuauaaacaaaaccgcgucccaagaagauuucuacaaauuccuuaaagacauuuuauuaaaacgaagugacguuccagaagccaacggaauccuaacagaaauagaaacaggaaccuuuuuacccaaacaaauaagcaaaaacaacgccgaaauuccauaucaauuaagaaaaauagaacuagagaaaauacucacgaaugcagaaaaauucuuuuccuuccugaaacaaaaagacgaaaauggacuaucucauucagagaaaauaauaaugcuauugacauuuaaaauacccuacuacauuggacccauaaauacuucucauaaacaauauuuccccgauagauccuggguaauaaagaaagaaaacgcuccgcaagagaaaauaaccccauggaauuucuuugaccauauagauaaagagaaaacugccgaagccuucaucacaagucguacgaauuucuguacuuaccuaauaggagaauccguacuacccaaaaacucccuacucuauucagaauacacaguacuuaacgaaauaaacaacuuacagauaaucauagauggcaaaaacauaugugaugucaaauuaaaacagaaaauauacgaagaacuuuucaaaaaguacaagaaaguaacacaaaaacaaauaucaacuuuuaucaagcaugaaggaaucugcaauaaaacugaugaaguaaucauacuaggaaucgacaaagaaugcaccucaagucuaaaaucauacauugaacuuaaaaacauauucggaaaacaaguggacgaaauaucaaccaaaaauaugcuagaagacauaauccgaugggcaaccauauaugaugaaggcgaaggaaaaacaauccuaaaaacuaaaaucaaagcagaauaugaaaaauauuacucugacgaacaaauuaagaaaauauuaaaccuaaagcuaaguggauggggaagacuuagccgcaaauucuuagaaucaaucacaucagaaauaccaggcuuuauagaaccuguuaacaucauuacugccaugagagaaacccaaaacaaucuuauggaauugcuaucaaguaaauucaaauuuaacgaaaacauuaagaaaaucaacucaggcuucgaagauacagacaaacgguucucauacaacagccuagucaaaccccucuuucugucgcccuccguaaagaaaauguuauggcaaacauuaaagcuaguaaaagaaaucucucacauaacucaagcacccccuaagaaaaucuucauagaaauggcaaaaggugccgaauuagaaccagcucguacaaaaacaagacuuaaaauauuacaagaccuauauaacaguuguaaaaaugaugccgacgccuuuucaucugaaauacaauacuuacugggaaaaauagaaaaugaagacaaccuaagacucagaucagauaaauuauauuuauauuacacgcaacuaggcaaaugcauguacugcgguaaacccauagaaauaggacaugucuucgauacaucuaaauaugacauagaucauauauauccgcaaucaaaaauaaaagacgacagcaucaacaacagaguauuaguaugcucaucauguaacaaaaacaaagaagacaaauacccuuuaaaacccgagauacaauuaaaacaaaagaaauucuggaacuuucuacaaagaaacaacuuuauaucaauagaaaaguucaaucgucugacaaggacgacucccauaagugacgaugaaacagccaaauucaucgcacgccaauuaguggaaacccgacaagccacaaaaguagcagcaaaagugcuagagaaaaucuuuccugaaacaaauauuguauacuccaaggcugaaacagucuccauguuccgaaauaaguucgacauaauaaaaugucgagaaauaaacgauuuccaucacgcccaugacgcauaucuuaacaucguuguaggaaacguauacaacacuaaauucacaaacaacccuuggaacuuuauaaaagagaaaagagacaaccccaagauuggagacacauauaacuauuacaaaguauucgauuacgauguaaaaaggaacaauauaaccgcaugggagaaagagaaaacaaucauaaccguaaaaacaaugcuaaaacgaaacacucccauuuacacaagacaagcagccugcaagaaaggugaauuauuuaaccaaacuauaaugaagaaaggauuaggccaacaccccuugaagaaagaaugucccuucagcaacauaucaaaauaugggggcuauaauaaaguauccgccgcguauuacaccuucauagaauacgaggaaaaaggaaacaaaauacgaucguuagaaacaauacccuuauauuuagaaaaagacauacaaaaaucacaagauggacucaaaggauacuuaacggaucaacuaggcaagaaagaaaucaaaauacucguacccaaaaucaaaauaaacucauuauugaaaaucaaugguuuuccaugccauaucacugguaaaacuggugcuucauuuguucuacgaccagcaguucaauucuguugcuccaaugacgaggugcuauacuucaagaaaauaauaagauuuaacgaaauaagaucacaaagagagaaaaugggcaaaacaauuaguccauaugaagaucuaucauuccgaucguacaucaaagaaaauuuauguaagaaaaccaaaaacgacgaaauaggagaaaaagaauuuuacgguuuccuacaaaagaaaaaccuugaaaucuacgacaugcuucuuauaaaacacaaagauacgauauacucaaaacgacccaacagcacuacacuagacaugcuaauaaaaggccgcuacgaauuuauaaaucuaaaaccagaagaccaaauucgugucaugcuagagauuuuaaaacuauucuguacaacccgggaaguaauugaucucggacuaauuaaaggaaaaucagaagccggaguuacaaccuuaggcaagaaaauaucaaaccuagacucauguauacuaauauaccaaucuauuacaggaauauucgaaaaacgaaucgauuuacuuaaaaucuga

SEQ ID NO: 9072 - RNA, 4188 nt, Artificial Sequence
  Cas9 variant
augaaaaaagaaauuaaagauuacuuucucggccuagacguuggaacuggcucuguagguugggccgugaccgauacagauuacaaauuacucaaagcaaaccgaaaagaucuauggggaaugcgcugcuucgaaacugcagaaacagccgaaguacgacggcuccauagaggagcaagacgacgaaucgaacgcaggaagaaaagaauaaagcuauuacaagaacuuuucagucaagaaauagcaaagaccgacgaaggauucuuucagagaaugaaagaaucaccauuuuaugccgaagauaaaaccauccuccaagaaaacgcauuauuuaacgauagagacuuuacagauaagacuuaccacaaagcauauccaacaauaaaccaucucauaaaagccuggauugaaaacaaaguaaaaccggauccuagauuacucuauuuagcaugccauaauaucauaaaaaaacgaggacacuuucucuucgaaggggacuuugacagugaaaaucaauuugauacauccauacaagcacuguucgaauaucuaagagaagacauggaaguagacauagacgcagauucacagaaagucaaagaaauccugaaagauaguucauuaaagaacucugaaaaacaauccagacuaaauaaaauguugggauugaaaccaucagacaaacaaaagaaagcaauaaccaaucucauaucaggcaauaaaauuaacuuugcagacuuauacgauaacccagacuuaaaagacgcugagaaaaauucuauaucuuuuuccaaagaugauuuugacgcauuaucagacgaucucgcaucaauucucggagauucuuuugagcuuuuacuuaaagcuaaagcaguauauaauuguucaguacuauccaaaguaauaggagaugaacaguauuuaucguuugcuaagguaaaaaucuacgaaaaacauaaaacagaucucacaaaacugaagaauguaauaaaaaaacacuuuccaaacgauuauaaaaaagucuuuggguauaacaaaaacgaaaaaaauaauaacaacuauucagcauaugucgguguaugcaaaaccaaaucaaaaaaacuaguuauuaacaacacaguaaaccaagaagacuuuuacaaauuuuuaaaaccaauacuuuuagcuaaaagcgagauaaaagaaguaaaugauauauugacggaaaucgaaacaggaacguuccuacccaaacaaauaucuaaaaguaaugccgaaauaccauaccaacuaagaaaaauggagcuugaaaaaauucuauccaacgcagaaaaacauuucuccuuucucaaacaaaaggacgaaaagggucugucacauucagagaaaauaauaauguuauuaacauucaaaauccccuacuauauagggccgauaaacgauaaucauaagaaauccuuuccagacagauguuggguaaucaagaaagaaaaauccccuaguggaaaaacaacaccauggaauuucuuugaccacauagacaaagauaaaacagcagaagccuuuaucacaagucguacuaauuuuuguacauaccuaguaggagaaucuguauugccaaaaaauucucuacuauacagcgaauacacgguguuaaaugaaauaaacaacuuacaaaucauaauugacggcaaaaacauaugugacauaaaacuaaaacaaaaaauauaugaagaacuauucaaaaaauacaaaaaaauaacacaaaaacaaauaaguacuuuuauaaaacacgagggaauauguaacaaaaccgaugaaguuauaauauuaggaauagacaaagaaugcacuagcaguuuaaaaucuuacauagaacuaaagaacauauuugggaaacaagucgaugaaauaucaacaaaaaacaugcuagaggaaaucauaagaugggcaaccauauacgaugaaggcgaaggaaaaacaauucuaaaaaccaaaauaaaagcugaauacggaaaauauugcuccgacgaacaaauaaaaaaaauacucaaucuaaaguucucaggauggggcagauuaucuagaaaauuccuagaaaccguaacaagugaaaugcccgguuuuuccgaaccaguaaauauuaucacugcaaugagagaaacacaaaauaaccuaauggaacuccuaagcucagaguuuaaauucacagaaaacaucaaaaaaaucaacucaggcuucgaggauguagaaaaacaauucuccuacgauucccugguaaaaccacuauuuuuauccccuuccguaaaaaaaaugcucuggcagacuuuaaaauugguuaaagagauaagucacauaacccaagcaccaccuaaaaagauauucauagaaauggcaaaaggggcugaguuagauccagugagaaccaaaacaagacucaaaauccuacaggaccuauacaauaauuguaaaaacgacgcggaugcauucagcucugaaauaaaagaccuaucaggaaaaauugaaaacgaagauaaccuacgauuaagaucugacaaacuguaccuauacuauacacaacuaggaaaaugcauguacugcggaaaaccaauugaaauaggccacguuuucgacacuucgaacuaugauaucgaccacauauacccccagagcaaaauaaaagacgauucaauaucuaacagaguacuaguuugcagcuccuguaacaaaaauaaagaagacaaauauccacuaaaagcagaaauucaaucaaaacaacgagguuucuggaacuucuuacaaagaaacaacuuuauuuccuuagaaaaacuaaaccggcuaacgcgaacaagcccaauuucagaugaugaaacagcaaaauuuauagccagacagcucguagaaacacgacaagcaaccaaaguugcggcaaaaguacuagaaaaaauguuuccagaaacaaaaauagucuauagcaaagcugaaacagugagcauguucagaaauaaauucgauauaauaaaaugcagagaaaucaaugacuuccaccaugcgcacgacgccuaccucaacaucguaguaggaaacguuuauaacacaaaauucacaaacaauccauggaacuuuauaaaagaaaaaagagacaacccaaaaaucgcagacacauacaacuauuauaaaguuuucgacuaugaugucaaaagaaacaauauaacagccugggaaaaaggcaagacaauaaucacaguaaaggauauguuaaaaagaaacacuccaaucuacaccaggcaagccgccugcaaaaaaggugaacuauucaaucaaacuaucaugaaaaaaggccuaggacaacacccucucaaaaaagagggcccauuaucaaauauaagcaaauauggaggauauaacaaaguauccgcugcguauuauacauuaauagaauacgaagaaaaaggaaguaagauacgcagucucgaaaccaucccacuauaccuuguaaaggauauccaaaaaaauaaggauggucuuaaaucguaucuuacggaucaaaucggcaaaaaagagauaaaaauucuaauaccaaaaaucaaaauuaauucuuuacuaaaaauaaacggauuuccuugccauauuacgggaaaaaugggagaagcauucguauuaagacccgcaguccaauuuuguuguaguaacgaugaggcacucuauuucaaaaaaauaauacgauucaaugagauccgcaagcaaagagaaaaaaugggaaaaacaauaucaccguaugaggaccuaucuuucagauccuacauuaaagacaauuuaugcaaaaaaacuaaagcagacgaaauagaagaaaaagaauuuuacgaucugcugcaaaaaaaaaaccuagaaauauaugacaugcuacuaacaaaacacaaagauaccauauauaaaaagagaccaaacucggcaacaauugauauacuaguaaaaggcaaagaaaaauuuaaaucccuaaucauagaaaaccaauucgaagucauacuugaaaucuuaaaacuauucagugcgacaagaaacguaucagaccuacaacacauuggcggcucaaaaaacgcagguaaugcucgaguagguaauaaaauaucuagccuagacaauugcauacucaucuaucagucaauuacgggaauuuucgaaaaacgaaucgacuuauuaaaaauuuga

SEQ ID NO: 9073 - RNA, 4188 nt, Artificial Sequence
  Cas9 variant
augaaaaaagagauuaaagacuauuuccuaggacuagaugucggaacaggaucuguaggaugggcaguaaccgauacagacuacaaacucuuaaaagcaaaucgaaaggaucuuuggggcaugagguguuucgaaacagccgaaacagccgaaguaaggagacuacauaggggcgcacgaagaagaauugaaaggcgaaagaaacgaauaaagcuccuacaagaauuauucucccaagaaauagcgaaaauagacgaggguuucuuucaaagaaugaaagaaaguccuuucuaugccgaagacaaaacaauauuacaagaaaacgccuuauucaacgauaaggacuucacagacaaaacauaccauaaggcauaucccacaauuaaccaucucauaaaagcauggauagaaaacaaaguaaagccugacccucgauuacuauaucuggccugucauaacauaauuaaaaaacgugggcauuuccuauuugagggcgacuuugauucagaaaaccaauucgacacauccauucaagcucuauuugaauaccuccgugaagacauggaaguagauauagaugccgacucacaaaaagucaaagaaauccucaaagauucuucacuaaaaaacuccgaaaaacaaagcagauugaacaagauccuaggcuuaaaaccaagcgacaaacaaaaaaaagcaaucacaaaccuaauaucaggaaacaagaucaacuuugcggaccuauaugacaacccagaucuaaaagaugcugaaaaaaacagcauaucauuuuccaaggacgacuuugaugcccugucagacgaucuagcaucgauacuaggagauagcuucgaauuacuccugaaagcaaaggcaguauauaauugcuccguucucucuaaggucauaggagacgaacaauaucucaguuuugcuaaagugaaaauauacgaaaaacauaaaaccgacuuaacuaaacuaaaagcaguaauaaaaaaacacuuuccaaacaauuacaaaaaaguuuucggauacaaucaagauaaugaaucaaaaaauaauuacucaggcuacgucggagucuguaaaacaaagaauaaaaaauuaguuauuaacaacaguguaaaccaagaggacuuuuacaaguuuuuaaaaccgauucugucggcaaaaucagaaauaaaagaagucaaugacauucucgcagaaauagaaacagggaacuuuuuaccaaaacaaaucucuaaaucuaacgcugaaauaccauaucaacuaagaaaaauggaacuugaaaaaauacucucaaaugcagaaaagcacuucagcuucuuaaaacaaaaagacgaaaaaggauuaucccacucagaaaaaauaauaaugcuacugacuuuuaaaauaccauauuacauuggaccuauaaacgacaaccacaagaagaguuuuccugauagauguuggguugucaaaaaagagaaaagcccaagcggaaaaacaacuccauggaacuucuucgaccacauagacaaggaaaaaaccgcagaagaguucauaacaucaaggacaaacuucuguacauauuuaauaggugaaucuguccucccuaaaaauagucugcuuuacagcgaguacaccguacuaaacgaaaucaauaaccuacaaauaauaauagauggaaaaaacauaugugacacaaaauuaaaacagaaaauauaugaagaccuauuuaaaaaguauaaaaaaauaacccaaaaacaaauuuccacauucauaaaacaugaaggcauaugcaacaagaccgacgaaguaaucauauuagguaucgacaaagaaugcacaucaagcuuaaagucauauauagaauuaaaaaacauuuucggaaaacagguugaugagauaucaacuaaaaacaugcuagaagaaauaauaagaugggcgacaauauacgacgaaggugaagguaaaacaauacuaaaaaccaaaauaaaagcugaauauggaaaauacuguagugacgaacaaauaaaaaaaauacugaaccuaaaauuuaguggauggggucgauuaucaagaaaguucuuggagacggucacaagcgaaaugccaggauucuccgaaccagugaauaucaucaccgccaugagagagacacaaaacaauuuaauggaauuacucaguucagaauuuaaauucacugaaaauauuaagaaaauaaacucaggauucgaggacgccgaaaaacaauucuccuaugauggacuaguaaaaccgcuuuuccuaucaccaucagucaaaaaaauguuauggcaaacacucaaauuaguaaaagaaauuagucauauaacacaagcacccccuaaaaaaauauucauugaaauggccaaaggcgccgaauuagaaccagcaagaacaaaaaccaggcuuaaaauacuacaagauuuauacuccaguugcaaaaacgaugccgaugccuucagcucugaaauacaguauuuaagcggcaaaauagaaaaugaagacaacuuacgauuacgaucagauaaguuauaccucuauuacacacaacuagggaaauguauguacugcgguaagcccauagaaauaggacacguauuugacaccagcaauuacgacauagaccacauauacccacaaaguaaaauuaaagaugacaguauaucuaauagaguucuaguuugcucuagcugcaauaaaaacaaagaagacaaauauccuuugaaaucagaaauccaaucaaaacaacgaggauucuggaauuuucuacaacguaacaauuucauaucacuagaaaaacuaaauagacuuaccagaacaaccccaauuucagaugaugaaaccgcaaaguucauugcuagacaacucgucgaaacucgccaagcaaccaaaguugcagcaaaaguccucgaaaaaauguuuccggaaacaaaaauuguauacagcaaagcugaaacaguaucaauguuucgaaauaaauuugacauaauaaaauguagagaaauaaacgauuuucaucaugcacaugacgcauauuuaaacauaguagucggcaacguuuauaacacaaaauucacaaacaaccccuggaacuuuauaaaagaaaaacgagacaacccaaaaauugcugacacauacaacuacuacaaaguguuugauuaugauguuaaacgaaauaacaucaccgcuugggaaaaaggaaaaaccaucauaaccguaaaagauaugcuaaaacguaauaccccaauauacacaagacaggcagcaugcaaaaagggagaauuauucaaucagaccauaaugaaaaaaggacucggacaacacccauuaaaaaaagaaggcccauucucaaauauaucuaaauauggaggauacaacaagguuucagcagcuuauuacacccuaauagaauaugaagaaaaagucaacaaaauccguagucucgaaaccauaccccuauaccuuguaaaggacauccaaaaagaucaagacguacucaaaucguaccuaacagaccucuuagguaaaaaagaaaucaagauacuuguaccaaaaaucaagauaaacagccuuuuaaaaauuaacggauuuccuugccauauaacaggcaaaacgggagacucauuuguauuaaggccagccguccaguuuugcugcucgaacgacgaaguccuauacuucaaaaaaaucauccgauucaacgaaauucggucacagagggagaaaaugggaaaaacaaucaguccuuacgaagaccuuucuuuucgcuccuauauuaaagaaaaucuuuguaaaaaaacgaaggcggacgaaaucggagaaaaagaauuuuaugaucuacuucagaaaaagaacuuagaaauauaugacaugcuauuaaccaagcauaaagauacuauauauaacaaacggccaaacaguacaacauugggaauguuaaccaaaggacgauacgaauucauaaaccuaaaaccaaaagaucaaauuauagucaugcucgaaauacuaaaacuauucugcaccacccgcgaagcaaucgacuuagggcuaaucaaaggaaaaccagcagcggguguagcaacucuaggaaaaaaaauaagcaaccucgacaauugcauuuuaauuuaccaaagcauaacuggcaucuucgaaaaaaggauugaccuacuaaaagucuga

SEQ ID NO: 9074 - RNA, 4188 nt, Artificial Sequence
  Cas9 variant
augaaaaaagaaauaaaagacuacuuuuugggacuagacguaggaacuggaucuguuggcugggcagucaccgauacagauuacaaacuacuaaaagcuaaucgcaaagaucuauggggaaugagauguuuugaaaccgcagaaacagccgagguaaggaggcuucacagaggagcacgcagaagaauagaacggcgaaaaaaaagaaucaaacucuuacaggagcuauuuagucaagaaaucgcaaaaauagaugaaggauuuuuccaaagaaugaaagagagccccuuauacgcugaagacaaaaccauuuuacaggagaauacccuuuuuaaugacaaagacuucacugauaagacauaccauaaagcauauccaacaauaaaucaucucaucaaagcauggauugaaaauaaagucaaaccugacccacgacuauuauaccuagccugucauaauauaauuaaaaaaagaggacauuucuuauuugaaggagacuuugacuccgagaaucaauuugacacuagcauacaggcacuuuucgaguauuuaagggaagacauggaaguagauauagaugcagacagucaaaaaguuaaagaaauacuaaaagacucauccuuaaagaacucugagaaacagucccggcuaaauaaaaugcuuggccuaaaaccgagcgacaaacaaaaaaaagccauaacuaaccuaauuaguggaaacaaaaucaauuucgccgauuuauacgauaauccagauuuaaaagacgcagaaaaaaauucaauaagcuucaguaaagaugacuucgaugcucuaucugaugaccuugcuucaauacuuggggacagcuucgagcucuuauuaaaagcaaaagcagucuacaauugcagcgucuugucaaaaguaauuggcgaugaacaauacuuaaguuuugcaaaaguaaaaaucuacgaaaaacacaaaaccgacuuaacuaaacucaaaaacguaauaaaaaagcacuuuccaaaagacuacaaaaaaguauuugguuacaauaaaaacgaaaaaaacaacaacaacuacucgggauauguaggaguaugcaaaacgaaaucaaaaaaauuaaucauaaacaauucgguuaaccaggaggauuucuacaaauuucuaaagacaauucuuagcgcuaaaucagaaauaaaagaagugaacgauauacuaaccgaaauagagaccggcacauucuugccaaaacagaucucuaaaucgaacgcagagaucccauaccaacugcgcaagauggaacuagaaaaaauauugucaaacgcugaaaaacauuucaguuuccuaaagcaaaaagacgagaaaggacuaucccacagugaaaaaauuauaaugcuauuaacuuuuaaaauacccuacuacauagguccaauaaacgauaaucauaaaaaaucauuuccggaucgauguuggguagugaaaaaagaaaaaaguccaucaggaaaaaccacuccauggaacuucuucgaccauauagacaaagaaaaaaccgcugaagaauuuaucacuuccagaacaaacuuuuguacuuaucuaauaggagaaucaguccugccuaaaaauucacuccuauauagcgaguacacaguacuaaacgaaaucaacaaccuccaaauuauuaucgacgggaaaaauauuugcgauacaaaacuaaaacaaaagauuuacgaagaacucuucaaaaaauacaaaaaaaucacgcaaaaacaaauaaguaccuucauuaaacaugaaggcauuugcaauaaaaccgaugagguaaucauccuuggcauagacaaagaaugcacuucuucacugaaaucuuauauugaacuaaaaaauauuuucggaaaacaaguugacgaaauuucaaccaaaaauaugcuagaagaaauuauacgaugggcaacaaucuacgacgaaggugaaggaaaaacgauauugaagacaaaaauaaaagcagaguaugguaaguacugcagcgaugaacaaaucaaaaaaauacuuaauuuaaaguuuagcggaugggguagacugucccggaaauuccucgaaacaguuaccagcgagaugccaggauucagugaacccguuaacauaauaacagcgaugcgagaaacacagaacaaccuuauggaacuuuuaucaagugaauucaaauucacagaaaacauaaaaaaaaucaacagcggguuugaagacguagaaaaacaauucaguuaugauggccuaguaaaaccauuauuccuuucacccagcgucaaaaaaauguuauggcaaacacucaaacugguuaaagaaauaucucacauuacacaagcacccccaaaaaaaauauucauagaaauggcaaaaggagcugaacuagacccgguaagaacaaaaacaagacucaaaauccuacaagaccuauacaauaacuguaaaaacgaugcagaugcauucaguucugaaauaaaagaccuaagugguaaaaucgaaaaugaagacaaucuccgucucagaucugauaaacuauauuuauacuacacacagcuaggaaaaugcauguauuguggaaaaccuauagaaauagggcacguauuugacaccaguaacuacgauauugaccacauauauccacaaucaaaaauaaaagacgauucaaucucaaauaggguuuuaguauguucguccugcaacaaaaacaaagaagacaaauauccguuaaaagcagaaauacaaagcaaacaaagaggauucuggaauuuucuccaaaggaacaauuucauaucauuagaaaaauucaacagacucacaagagcaacacccauaagcgacgaugaaacagcuaaauuuauugcaagacaacuaguagaaaccagacaagccacaaaaguagcagcaagaguucuagaaaaaauguuuccagaaacaaaaaucguauauucaaaagccgaaacaguaucaauguucagaaacaaauuugauauagugaaaugcagagaaauuaacgacuuucaccaugcacacgacgccuaccuuaacaucguagucggaaauguguauaacaccaaauucaccaacaaccucuggaacuuuauaaaagaaaaaagagauaauccgaaaaucgccgacacauauaacuacuacaaggucuuugauuaugauguaaaaagaaacaacauaaccgcuugggaaaaaggcaaaacaauaauaaccgucaaagauaugcuaaaaaggaacacaccaaucuauacgagacaagcagccugcaaaaaaggcggacuauucgaccaaacgauaaugaagaaaggauuaggccaacauccacuaaaaaaagaagguccauuuagcaacauaucuaaauaugggggguauaacaaaguaucugccgcauacuauacacuaauagaauacgaagaaaaagguaauaaaauaagaagccuugaaaccauucccuuauacuugguuaaagauauacagaaagaucaagauguucuaaaaucauaucuaacagacuuacuagggaaaaaagaauuuaaaauauuagucccaaaaauaaaaauuaauucccuacucaaaauuaacggcuuuccaugucacaucacuggaaaaacaaacgauuccuuuuuauuacgccccgcgguccaauuuuguuguagcaaugaugaagucuuauauuuuaaaaaaauaaucagauuuagcgagauccgaagucaaagagaaaaaauugguaaaacaaucucucccuacgaagaccuaagcuuccguucauacauaaaagaaaaccugugcaaaaaaacuaaaaaugacgaaauaggcgaaaaggaauuuuaugaccuacuacaaaaaaaaaaucucgaaaucuaugauaugcuauuaaccaaacauaaagacacaauauacaaaaaacguccuaauucagcuacgauagacauacuuguaaaaggaaaagaaaaauuuaaaucacugaucauagaaaaccaauuugaaguuaucuuagaaauacucaagcuuuuuagugcgacccgaaauguaucggaccuacaacauauugguggaucgaaauacagcggaguagcaaagauagguaacaaaauaucuucuuuagauaacugcauauuaauuuaucaaucaauaacaggaauauucgaaaaacgaauagacuuacuaaagguuuga

SEQ ID NO: 9075 - RNA, 4191 nt, Artificial Sequence
  Cas9 variant
auggauagcucaaaacaaggccuacgacgguaccauuuagggcuugauauaggaacaaauucuauuggauggacagcaauugaugaccacuucagccuacuucgaguaaaaggcaaaaacgcuauugguguacgaacguucaaagaaggagaaacugccgcagacagacggggcuuccggacagcacgacgccgacugagcagaagaagauggagacuacaauuucuggaugaauuuuucgcaccuuaucuggcagaaguagauccaaacuuucuugcccgcuuaaaacaaucagacauauccgcuaaagauccagcgaaaaaccaagaauacaugggaaaacuacucuucccagaucaagaagcagcauccgacggcaauggauauccaacacuuauccaaaugagaaaagcaaugccagcggaaaaagcugcagauuucccaguauucaacauauaucagcucagauaugcucugaugaacgagaaaagaaaauuugaucuccgggaaauauacuuggcgguccaucauaucguaaaauaucgcgguaauuuccuaaauaacaccagcguagauaaauuuaaagcagaucagauagacuucaacaaaucauuugaaacacuaaacgaccucuucagacaaguccagccaauagcaccguuucaaaucgauuuaacaaaagucgaugaacuagguaaauuauuauuagacacaaaacagaaaaaguuagacagacaaaaagcaguagccaaacuauuaccucucauagaagauggcaccgacaaagaaauuguuaaagcucaucaacaaacagcacgcgaaauaucuaaacuaauacuaggauacaaagcgaaaguagguuuaauauuacaaaacaauuuagaccaaaccuuagacaugaguacagagaacuccgacgaucaacugaugcaaauugcagaagaauuagacgauuaucaaauggaauuaauaaaccaauuaucucuacuauacucacaaauaaugcucaacgaaauaguaccuaauggagaaacuguuagcgccaguaugcuaaaucguuacuauaaacauagaugucaacuuaaagagcuuaaagauuauggugcagcgcaagacaaaaagacaagagaacaauuagaucaccucuaugcagaauauauaggccaaauaccgaaggacaguaaauucgacuucacaaaagaccucaagaaacugauggauaaaagugaucuuggucagaaaauuaaagaugaaaucgaagcaggagacuaucucccuaaacaacggacuucugcgaacgggguuaucccacaucaaaugcaccaacaagaacuagaccaaauuauagaaaaccaaaaagaauauuaccccugguuagcugagcccaauccuguagagaaaaauauaaagaacgcaaaauauaaacuagaccaauuaguaucauucagaguaccauauuauguuggaccuaugauaacauuagcagaccaacaaaagaccaguaaagcaaguuuugccugggccguucgaaagaaagcuggcaaaauaacucccuggaacuuuuaugacaugauagacagagaaaaaucagccaauaauuuuauuaaacgaaugacuaacaaagacacuuacuugcuaucagaagacguacuacccgcuucaucucuuuuauaccaaaaauuuacaguccuuaacgaacuaaacaacauaagaguaaacggaagaaaauuacaaccagcucugaagcaagcaauauacacagaccuauuucagaaaagaaaaacaguaaauuuaaaaacacucacaaacuuucuagcaauccacgaaccaacacuuacgaagccaaaaauagaagggcuaucaaaugggagaaguuuuaauucgagccucggcaccuauauugacaugucaaaaauuuuaggcgacagccuggaugauuugaauuauagagacgauauagaaaagauaauugagugguccacggucuuugaagacagcgaaaucuauggaguaaaacuucaagagauccaauggcuaacaaaugaacaaagagaaaagcuaguaagaaaacguuaccaaggaugggggaggcuaucaaagaaauuacuaacaggcaucacagacgaaaauggacaacguauaaucgaucugaugugggauacaaguaaaaauuucaugcaaauuguccaccaacccguauucgaagaacaaaucgcugaguuaaaucaacaauuacuacaagacgccgauaaagcaccacuugaagucgucgaugacauuuuagcagacgcauacacaucaccccaaaauaagaaagcuauacggcaaguaguaaaaguuguagcagacguuguaaaagcuguaggaaacgcaccagcaucaauuagcaucgaauuugcacgcaaugaagauagaaauaaagaacucaaaaacucacgacgacacucaauagaaaaauuauaucacgaaacagcugagaaauuaguaaaacaaacuaauuugcuugaggaacuagggaacguuaaggaucuaaacgauagguacuaucuauauuucacucaagcagguagagacauguacgacggaacaccuauaaacauagacgaaauuaguacacauuacgaaauagaucacauacugccacaaucauucuuaaaagauaacucauuggauaaccgaguucuaguaaagaaaucagaaaaugcggccaaauccgaucgaguaccagccaaauuauauggggccaaaaugcgagccuucuggaaacaacuaaaagagagccaacuuauaucaaauagaaaauacuuaaaucucacgacugauccagaacaagucgauaaauaucaaaugcagggauuuguacaccgacaacucguagaaacccgacaaauaauaaaacuugcagcaaauaucuucgggagucuauauccagauagcgcuguaauagagacaagagcggaacuaacgaaacaauuaagagaaaaauuuucauuauacaaaguuagagacguaaaugacuaucaccaugcaguugaugcauauuuaacggcguucgcgggucacuaucuuuaccaaagauacccaaaacuaaggccaauguuugucuacggagacuacgccaaaauauacgcagaugaccucaaaagacuaagaucaguaaaucuguuucacgaucuagaaaaagaccaauacaacaguggaacugcggucaauccagaaaccaaagagaaaauaguagauguagacuggcuuucagacuauguuucuaaaauacaacacuucaaauauaugcuaauuagcaaagccgucuauacacaacauggucaauuguacggugcaaccauacuaccagucgcacaaguugacaaaauaucugcacccauaggaaucaaagacgacaaaccaguggauauauacggcgcauauacuaacgaaguagcugcauacauggcaauaguaagaguuaacgguaaaaagccgaaauauaaaguugucagcguaccaguaagaauguuacagagacuaaaaauggcagaacagaaaggccaugaucaauauaugcaaacucuacaugauguacuccuuagaaacuuuacaagccugaagaaaaacagaaaaacuggacuaaaagaagccguaguuaaagauuuugauguucuuguacccugcguaagauauaaccagcuaguaauagacggagacaccaaauuuaccuuaggcucagccacauaucaacauaacgcaaaacaauugguccuaugcaaccauucacuagaaacucuagccaacaacuucgaauauguaagaaaacacccagaugaagcagaugaaagaaugauuauguuauaugacgauauauuagaccaaguuaaccauuacuuuacccucuacgacaaaaacaaauuucgcgaaaaacuaaaugcaggccgggacaaauaccuaaaacuaccuaccuuuucacaguuugaaaauaacaaaaagacugccauuggaaaaucugaggccauaauaaauauacuuagaggacuacaugcgaaugcugcaauuacaaaucuaaaaugucuaggcguaucuacccccuucggacaauuacaaucaccaaguggaauugaauuaucggaaaacgcaaaauuaguauaccaaaguccgacaggacuauucuccagagaaguauuacucaaagauuuauga

SEQ ID NO: 9076 - RNA, 4191 nt, Artificial Sequence
  Cas9 variant
auggcaaacuugcgcaacuauaaaggagauuauaacauuggauuagauaugggaacugggucaguuggcugggcgguaacugauagcgaaggaaaauuguuacauuuuaagaaacaaccuacgugggggagcagacuuuuugauucagcugagacagccgccucagcccggauuccacgaggucaaaggagaagauacguuagaagacgauggagguuagacuuauuacaacaauuguuucaggaugaaguaucaaaagcugauccugaguucuucauucggcuacgacaaucuagacuuuuaaaagaagauagagaagaaggucauagagacuacaaucacccacuguuuaacgacucugauuucacagaaacagauuacuauaauagauuuccuacaauuuaucacuuaagaaaauggcuaauggaaacggaugagaaagccgauauaagauuaguauaucuugcagcacauaauauaguaaaacaccguggaaacuuuuuaagacaagaaaauacaucauuaucggcgaaaaaugcaagaccacucgaugcacugagagaauuuaggucugcauuaguagacuggugugcagaauuaggauacgaaugcaauccagacgaaaguggggaaauaaguaacgaaauauugaguguguuagaagaagaacauguagccaauucagauaaaaagaaacggauuaguaguuuaauuggaguugcaaugaacgaaggugcaaaagaaagcaaagcauguaaugaugcacuugcuggagccaugguaggauuaaaagcagaguucaaaaacguauucggagaaaucucagcagaacaaacaaguaucuaucuaucaaaugaugaagcaguagaugcuuuacgugaaggaauaccagaugaaggacuagagcuguucgggaaauugugcucggucuauuccgcauauguauuacaagggcuacuuucauaugcaccuggacaaaccaucagcguaaacaugguggcgaaauacgaaaaauauggaaaugauuugaaaacccuuaaagccuuaguaugugaauacgcucgagcugaauaugauucauuuuucagaggagaauuuuauagagaucaagauggacaugaacuuaacauauacaaugccucuaaagcgcaaggauauacaagauacaaucuagguacaucaaaaaugucguaugaagacuuugaaaaagcgguuaagaaacuauucgcgggcacagccgcugaagaggacggacgauacuuacaaaugaugaaagaguucggcgaacaaagauuucuucgaagauuaaaaacaucugauaauggaagcauauauuaucaacuacauuuggaagaacucacugccauauuaucaaaccaggguaaacacuacccauuuuuaguugaagacgcagagaaaauaaaaagccugguaucuuuuagaauaccguacuauguagggccccugacagauagaaaugcaaggaaagauaaacacggcaaaaauagauucgcauggucggaaagaaaauccggaauggaagaugcaguaauaacucccuggaauugggaugaaguaauagauagaggcaaaagugcagaagcguuuauaaccagaaugacggggauguguaccuaucugcagggggaagacguacuaccuaaaugcagucuauuguacgaggaguucugcgugcugaacgaacuaaacggaaguagauggggaauggauggugauaaagaacauagauuugaugcggcagaucgugaagcaaucauugaggaacuauuuaaaaagaagaaaacugucaaauauaaagauguagcaaauuggcuagagagagaagcagguagaaugaacgugcauguuauggguggacaaggcgaaacaggguacgagagcaaauugaguaguuauuauuucuuucgaagggauauuuuugauguugaggaauuagaccgagcggacuacccaaugauagaacaaaucauucuuuggaacacucuguuugaagaccgaagaauauuaaaagaaaaacuagaagacgcguauggcccuaaaggaaauggaagauuagaugacgaccaaauaaagaaaauaugcagaaaacgcuuuacaggauggggccgucuaaguaagaaauuuuuaacagggauaaaaguagauacugauugugguccucgaucaauaauggacguguugagggaaggcgacccaaaugcaggauuuagagguaaaacaaugguaaugauggaaguucugagagacgaaaacuuaggauuucaacaaaaagucgaugaguucaacaaaaauuauuuugggcagaaaggaaaagcguuggaagucaaugaacuacccggauccccagccauaaggcggucuuuaaaccaagcuauaagaauuguagacgaaauagcuaaaauagcuggaaaagauccggaaucuauauuuauugaaguuacaagagaugaugaacuagacaagcgaggaaaacgcacgaaacgucgauaugaugcauuaaaggaagcucuaacaguauucaagaaagaagacccagaaaucugggcagagcuacaagcuacgaguccgagugauuuggacgaacgauuaacauuauacuucaugcaaagaggcaaauguuuauauuccggggaaccaauagauaucaauaaauugaguagcggagaauacgaaguggaccauauaauaccaaggagcuauauaaaagacgauaguuuagaaaauaaagcauuaguaugcagaaaauauaaccaaucaaaaacugaugcuaugcuauuagacccaagcauccguagaaaaaugagaucauauugggauaugcuacuggacgcaaaauuaauagguccaaagaaacaccguaacuuauuaagggaccacauugacgagaaagccaugaaagguuucgucgcaagacagcuaguagagacaucacaauccguuaaauuagcaggaucauuacuaucugucagguacccaaaugcaaauauaguuccagucaaggccaguaugucccaugaucuaagagaagcagcaggauucguaaaaugucgcgaagcaaacgauuuucaucaugcucaugacgcauauuuggcaugucgaaugggguuauuuauacaaaugcgacacccaaaagucuacgaaaacccaauugcuaugacaagagugaugcaaaaauaugcacaacaacagucgaaagaguuuaauagaaaucaucgaguccccggaacuagcggauucauuguaaacagcuucaugagcaguggauuugacaaagaaacuggagaaaucuuuaaagauacuuggaacgcugaaacagaaauagaagggauccgaaaagcauuaaauuauagacagugcuacauuucaagaaugccaauggaagauacgggcgcauuuuggaaugcaacaguguauucuccaagagaccccaaaauggggcccaaauuggccuuaccauuaaagaaagguuuagauccuaagaaauaugggggauuuucaucccaacaauucgcuuacuucuuuguuuacgaagcuagggauaagaaagacaaacaaguguucagauucgcagaaguuccaguauggcuagcgucacaaauagaaagcgauaaaauagcauuggaaagguacgccacgggcuuagcagaagcagaaaaacuaaaauucguuagaauugaaagggcaaaaauacuuaagaaacaauuaauagaaauagauggcgauagauucauccucacaggaaagaaagaaaugaggaauggaagagaacuagcacuuagucaaaaagagacauugaaucuaauaguagccggagacgaaaaugcuucacuugaugauagaggaaaugcauccgaugcgguauuugacgcaauaguuagacagggagaugaaauuggacuuagacuauauaaacaguuaaaaauagcagaaauagcugagagauaucgaucaguaggagcagacgcaaaaguaggggcaguaaugucguuguuaaguucaauuaaugcaucauccaacaugguaaacuuaucaaugguuggaggaucaaaauacgcugguaaucugcagccuaauuacuccaauuuacugucagauccagaaacuaauuuuguaaucaucgaucaaagcguaacuggaauguuugaaaggagaacaagaauaggauuguga

SEQ ID NO: 9077 - RNA, 4191 nt, Artificial Sequence
  Cas9 variant
augacgaaaccauauucgauaggccuagacauagggacuaacucaguaggaugggcaguaauaacagaugacuauaaaguacccgccaagaaaaugaaaguacuagguaauacaaaccgagacuauaucaagaaaaaucuacucggugcucucuuauuugacggaggagaaacagcugaaggcagaagacuuaaaagaacugcuagaagaagauacacacgacguaaaaauagacuuagauacuuacaagaaauauuugccgaggaaaugaugcaaguggaugaaucauucuuucaacgguuagacgacaguuucuuagucgaagaagacaaacaaggaaguaaauauccaauauuuggaacacucaaagaagagaaagaauaucauaaaaaguuuaaaaccauauaucaucuucgugaagaauuagcaaacuccaaagaaaaagcugauuugagauuaguauauuuagcacuagcacauaugauaaaauuccgaggacauuuccuguaugaaggagaucuuaaagcugaaaauacagauguacaagcccucuuuaaagacuuuguagaagaauacgacaaaacaauugaagaaagucaucucuccgaaauaacaguagacgcacuuagcauacugaccgaaaaagugagcaaaagcucccguuuagaaaaccugauagcacauuauccuacagagaagaaaaacaccuuguuuggaaaccugauugcauuaucucuuggucuacaagcaaauuuuaaaacaaauuuccaauuaucagaagacgccaaauuacaauuuaguaaagauacauaugaagaagaccuagaaggauugcuaggugaaguaggugacgaauaugcagaucuuuucguauccgccaaaaaccuuuaugacgcuauacuacuaucaggaauacuuacaguugacgauaauucaacaaaagcaccucuuucagccagcauggucaaaagauacaaagaacacaaagaagaacuggccgcauuuaaaagauuuauaaaagaaaaauuaccaaagaaauacgaagaaauauuuaaagacgauacuaaaaacgguuacgcaggauaugugggagccgacaagaaacuaagaaaaagaaguggaaaauuagcaacagaagaagaauuuuauaaauacgucaaagguauucuuaacaaagucgaaggugccgacuacuuucuagacaaaauugacagagaagacuuccuaagaaaacaacgcacauuugauaacggaaguauaccacaccaaauacacuuacaagaaaugcacgcaauauuaaggagacaaggugaacauuacccguuucuaaaagaaaaucaagacaaaauagagaaaauuuuaaccuuuaggauuccuuauuauguuggaccacuggcuaggaaaggaagcagauucgccugggcagaauacaaagcugacgaaaagauaacaccauggaacuuugaugauauucuugauaaagagaaaagugccgaaaaauucauuacucgaaugacauuaaaugauuuguauuuacccgaagaaaaaguauugccaaaacauucaccccucuaugaaacauuuaccguguacaacgaacuaaccaaaguaaaauauguaaacgaacaaggcgaagccaaauucuuugacacaaacaugaaacaagaaauauucgaccacguauuuaaagaaaaucgaaaaguuacaaaagacaaacuauuaaacuauuuaaacaaagaguucgaagaauuuagaauagugaaucugacuggauuagacaaagaaaauaaagccuucaaugccagucugggaacuuaccaugaucuccggaaaauucuggacaaaucauuucuagacgauaaagucaaugagaaaauuaucgaagacauuauccaaaccuuaacacucuucgaagaccgagaaaugauaagacaaagauuacaaaaauacagugauauauucacaacucaacaauuaaaagaacuggaaaggagacacuacacaggauggggacgguuauccuacaaauuaaucaauggaaucagaaauaaagaaaacaagaaaacaauauuagacuaccuaauagacgacggcuacgccaauagaaauuucaugcaacuaauaaacgaugaugcucuaucauucaaagaagaaauagcaagagcucaaaucauaggugacguagaugacauagcaaauguaguccacgacuuaccaggcagcccagcuaucaagaaaggaauccuacaaaguguuaaaauaguagacgagcuaguaaaaguaaugggacacaacccuacaaacauaauuaucgaaauggcuagggaaaaucaaacaacugacaaaggucgaagaaacagccaacaaagacuaaaacuuuuacaagauucacucaaaaaucuagauaaccccguaaacaucaaaaacguggagaaccaacaauuacagaaugauagacuauucuuauauuacauacaaaacggaaaagacauguacacaggcgagacauuagacauaaacaaccuaucacaauaugauauagaccauauaauaccacaagcauucauaaaagauaauucacuagauaaucggguacuuacuagaucugacaaaaauagaggaaaaagcgaugacguuccuagcauagaaguaguccacgaaaugaaaucauuuuggucaaaacuacucucaguuaaacuaauaacucaaagaaaauucgauaauuuaacuaaagcagaaagagguggauugacagaaaaugacaaagcaggauuuauaaaaaggcaguuaguagaaacaaggcaaauaacuaaacauguagcgcaaguucuagaugcaagauucaaugcuaaacacgaugaaaacaagaaagucauuagggacguaaaaaucauaacucuaaaaucaaauuuagucucccaauuccgaaaagauuuuaaauuuuauaaaguucgugaaauaaaugacuaccaccaugcucaugacgcauacuuaaaugcgguaauagguacugcccugcuaaagaaauacccaaaauuggcauccgaguucguauauggagaguucaagaaauaugaugucagaaaauucauagcaaaaucagauaaagaaauagguaaagcaaccgcaaaauacuucuuuuauucgaaccuaaugaacuuuuucaagaaagaaguaaaauucgcagacggcacaguagucgaaagacccgauauagagacuucagaagacggcgaaauugccuggaauaaacagacagacuucaaaauugugcguaagguacuaucuuacccacaaguaaauaucgucaagaaaacagagguccaaacccacggucuagaucgcggaaaaccuagagguuuguuuaaugcaaacccaucaccuaaaccaaaaccagauucaucugaaaaucuaguaggaaucaaaagaaauuuggaccccaagaaauacgguggauaugcagggaucucaaauagcuacgcuguauuagucaaggccauaaucgaaaaaggagugaagaagaaagagaccaugguacuugaauuucaaggaauaucuauacuagauagaauaacauucgaaaaagacaaaagagcauucuuauuagguaaaggauacaaagauaucaagaaaauaauagaacuacccaaauauucauuauucgaauugaaggauggaagcaggaggauguuagcaagcauauuaaguacaaauaauaaacgaggagaaauucauaaaggcaacgaacuauuuguuccccaaaaguuuacaacuuuacuuuaccaugcaaaacgcaucaauaacccuauaaauaaagaccacauagaguacgucaagaaacauagagacgacuucaaagaacuacuaaacuacguucuggaauuuaacgagaaauauguaggugcaaccaaaaauggcgagagacuuaaagaagccguugccgacuucgauucuaaaucuaacgaagaaauauguacaucguucuugggcgcagucaacuccaaaaacgcaggauuauucgaacuaacaucuuuggggagcgcuucugauuucgaguuccuuggcgucaagaucccaagauacagagacuacacgcccaguucuuuauuaaaggacucaauauugauccaucaaagcaucacaggucucuacgaaacaaggauugaccuaagcaaacuaggcgaagauuga

SEQ ID NO: 9078 - RNA, 4191 nt, Artificial Sequence
  Cas9 variant
augaaacgaguaaaugaagacuauauucuaggauuagauauaggcacuaacuccugcgguugggccgucacugauaaaaaaaauaaccuacuaaaacugagagguaaaacugccauaggcucacaucucuuugaagaaggacauacggcagcagauagaagaggguucagaaccacaagaagaagauuaaaaaggaggaaauggagacuacgacucuuagaagaaauauucgccgagccgauggcaaaaguagauccuggauucuucguaagacuccaccaaucauggguaucacccuuagacaaagaccgaaaaaaauacaacgcuauaguauucccgacagcaaaagaagaccaagcauuuuauaaacauuaugccacaauuuaucaccuucgagacgaacucaugacgcaagaccgacaauucgaccuucgagaaauauuuuuagccauacaccacauaguaaaauauagaggaaacuuccuacaagacacacccguaaaagauuucgaagcuucaaagauagaggugggaccaauacugucucauauuaauaacgcuuucgcugaaaaaauagucgaggaucaagacccuauugaauuaaaugucgccaaugcagcagacaucgaagauguaauaagaggaaaagaugcagaaaaaaccgucuacaaguuagacaaaguaaaaaaaauugcaaaguuauuaacugacagcacggccaaagaagaaaagaacguagcaaaacaaauagcgaaugcaaucaugggcuauaagacccaauuugaaacaauccuugacaaagagauagacaaaagcgacaaggcccaaugggaguucaagcucagugaugcagaugccgacgacaaacuugacgccuuacuaccagaucucgacgaaacugaucaaacaguugucgcagaaauagaaaaacucuucuccgccauaacccuaucgacaaucguggaugaaaauaaauccuuaucccaaucaaugguagaaaaauauaaaaaacacaaaaaagacuacaagaaacuaaaaaaguacauaaauacguuacaagaucaaacaaaagcaaaaaaacuacuauuagccuacgaucuuuauguaaauaaccgccauggaagacuacuagaggcuaaaaaaacuuucgaagacaaaaaaaaaaaaaaagcgcucacaaaagaugaauuuuacaaaauaguuaaagauaauuuagacgauuccgacuuagcacaugaaauacaacaagaaauagcagcagacaauuuuaugccgaaacagagaaccaacagcaacgggguuauccccuuucaacuccaccaaaucgaauuagacaaaauuauugcaaaucaaggaaaauacuaucccuuucuagcagcagaaaauccagucgaggaccacagaaaacaagcaccuuauaaacuagaugaacuagucagauuuagaguacccuacuauguaggaccaaugauaacugcagacgaacaagaaaaaacuucaggcaaaagcuuugcuuggaugguuagaaaagaagacggacagauuacaccauggaacuucgaacaaaaaguagacaggcaagaaucagcuaacaaguuuauuaaacgaaugacaauaaaagauaccuaucuccuaucugaagauguacuaccagcuaacucccuuuuauaccaacgauuugaagugcuaaacgagcuuaacaauauccgcauaaauggaucacgaauaucuguagaccuaaagcagcaaaucuucaacgaccuauuugaagaaaaaaagacgguaacagaaaaaagccuuacaucuuaucuaaaacaaaaccuccauuuaccuacaguagaaauaaaaggucuagccgauccuacaaaauuuaacucuagccucgccuccuauuaccaccuuaaaucauuacacguauucgacaaagaacuagcagauccccaguaccaaaaagacuucgaaaaaauaaucgaauacucaucaauauuugaagacaaaaaaauauuccaagauaaacuacacgccgaauuuaaaugguuaacccccgaacaauuuaaagccauuucaaccuggcgauuacaaggaugggggagacuaucgcgaaaauuauuaguagaacuacaugacacaaacggacaaaauaucauggagcaauuaugggauucccaaaagaauuucaugcagauagugaccgaaccagacuucaaagaugccauagccaaagaaaaccaaaacguaacaagagcaaauggagucgaagaaauacucgccgacgccuacacuucaccagcaaauaaaaaagcuauucgucagguagugaaagucguagcagacguuguaaaagccgcagggggaaaaaaacccgcacaauucgcuauagaauucacacgcgaucccgacaaaaacccacaacuaucccacauacgaggcacuaaacuccucaaagcuuaucaggaaacagccggagaacuaguugaucaaaaauuaacugauucccuuaaagaagccaugacaaguagaaaacuccuaaaagacaaauacuuccucuacuucaugcaagcgggacgugaugcguacaccggccaaaaaaucaauaucgacgaaguuagcaccaacuaccaaauagaccauauacuuccucaauccuucauaaaagaugacagcuucgauaaucgcguauuaacagcaacgccccucaaugcagaaaagucagacgauguuccauauaaacgauucgccaauaacuacguuuccgauaugaaaaugacaguaggagaaauguggaaacacuggcaaaaagcuggaauaauaaauaagcacaaauuagguaaucuacuauuagauccagauaggcuaaauaaauuucaaaaaucuggauucauaaaccgacaauuaguugaaacuucacagauaauuaaauuaguaucaguaauacuccaaaauaaauauccagacgcagaaaucauuacaguaaaggcaggggauaauuccgcacuacggcaaagguuaaacuuguacaaaucaagagauguaaacgacuaucaccacgccauugaugccuaccuaaguauaauaugugguaauuucuuauaccaagucuaccccaaauauagaccauauuucguuuauggcaaauacaaaaaauucucccaggaccccgauuuacagaaagaaguuauaaagcacuuuaaaggcuuuaccuuuauguggccacuuuugcagaaagacaauucagaaagaaaagcuccugaaaaaaucaaagaaaauaacucagauagaaucguuuucuauaaacacccagacaucuucgacaagcucagaaaagccuauaauuauaaauauauguuagucucgagagaaacaacgaccgaaaacucggguuuauuugaugucacaaucuauccaagaggggaacgugauuuagcuaaaacaagaaaacuaauuccuaaaucgaauggacuagauccaaagauauaugguggauacaguggcaacaccgacgcauacaugguaaucguuaaaauagauaaaggaaaagagucuaucuacaaagucauaggagucccaaugagagcacuagcaagccugaaucgggccaaaaaacaagguaauuauaaagaagaauuacaccaaguucuagaaccacagauaauguuugacaaaaacgguaaaccuaaacgaucaguaaaaggauuucggauuauaaaagaucaugucccuuuuaaacagguuguccucgacggagacaaaaaauuuaugcuaaauuccucuacauaugaaauaaaugcuaaacaauuaacacugacgccggaaaccaugagaauagucaccgauaacuuaaaaaaaggagaagaucaagaucaacuacuaguuaaagcguacgacgaaauccuacaaaaagucgaucaauauuuacccuuauucgacgucaacaaauuucgaaauucgcuacacuuaggaagagcuaaauuccuagacuuggcuguaaacgacaaaaaaauaacgcuuacaaauauccucaauggauuacacgacaacuuagucacuccagauuuaaaaaacauuggaauaaaaacaccguuaggcaaauuacaaguaccgucuggaauaguauuaucgucagaagccauucuaauauuccaaucccccacuggacuguuugaaaaaagaguccgaaucgcugauuuauga

SEQ ID NO: 9079 - RNA, 4194 nt, Artificial Sequence
  Cas9 variant
augaaggauuauaauauaggauuagauauagguacaucaucaauaggcuuugccgcaaucgaugaugacaauaauuuaauaagggucaaggggaaaaaugugaucgguucaagguuauuugccgaaggaaaaacagcggcagaaagacgaggauuucgaaccgccagacgcagauacaaucgacgaaaauggcgucuaaaacuacuugaugaaauauucuacgaagaaauuauacauauagacccagaauucuuuaaucgacuuaagcaaaguucaauuucacccaaagacgaaucaaaaaaauauuucggaucucuauuauucccagacaaaacagauagcgcguauuaccaugacgguaaccaaacaauauaccaccuaagaaacagauuaguccaccaaaaagaaaaagcugauauccgcgaaauauauuuagcacuacgacauaucguaaaguacagaggaaauuuccuagauucgacaccaguaaguucuuuugaagcugauaauuuaaaauuagacgagcuaguacccgucauuaaugauauguacgaaaacauagauaucgacuuuagcauaaauguagacaacauaucugagauagaaaaagucuuauuagacaaucaccucaagucagcagauaaacaagacagacuaaaagaauuacuguaugacaauccggaauacccagaugacaaaguaaaacaaaaagaaauuaguaaauuucggaaagaucuggacaaagaaaucauuaaaguaauugucggauauaaauucaacgcauacaaaauaguaaacuacauacccgacgacggaucaaaauucucauucucuuuuucagaugaaucaucagacgacaaacuagacgaucugucggaaguacuugaugauagucaaauggaaauucuaaauacauuaaaaguaauauauucuagaguaagacuaaaucaaaucaucccuaacggcaugggacuaucagaaagcaugguagcgaaauacaauagacaucaugaacaacuagaagaccuaaaagaauuacuagacguacugccaaaugacgaaaaaagaagcauagaauacgcauacaccgcauauaucggcaacguagauaagcaaaaauacaauaauaaccuaguagcaagucucaaagaccucccaauuaaaggagacauaaacaaaaaaauacaagccguauucgaguacgcaaaaggucacauaucaucacaagaccuauaugauguaauaaagacaaucauaauagacaaauacuuagaagacgaaucauucgaauaccaugaucuagucgaaaggauaucuaaugacauugauaacaaagacuaucuauuaaaacaacgcucaagccaaaaugguaacauuccccaccaagugcaucaaauggaaauggauaaaaucauagcuaaccaaucucaauacuaucccuuuuugggcgucuuaaacccaaacgagagcagaaggcauaucgcaaaauauaaaauaucugaacucguaaguuuuagagucccauauuacgugggaccccuaauaacuccagaggaacaagaaaaaaccagcggaaagcauuucgcauggaugaaacguaaagaagcaggaaaaauaaccccguggaacuucgaagaaaaagucgacaaagaagcgacagccgcuaaauucauaaaaagauuaacagugaaagauacuuacuuacuuaacgaggacgugcuaccugacaacagcuuauuauaucaacaauucaaaguauuaaacgaauuaaacauuguaaaagugaacaacaaaagacugacccuaagugaaaaacaaggaguauauaacgacuuauucaaaaauaccaaaagcauaaccguaaaaagacuaaaaaauuauuugauaucaaauuacaaacacuuagaaaacauagaaauaaccggcuuaagugacggggauaaauucaauaacagucuuggaacauacaacgacuuuaaaaagauuuuuggggcaagaauugaugaugugaauuacucagcagacuuugaaaacauaauugaguggucaacaguauuugaagaucgguccaucuugaaagagaaauuagaaaaagauauugacuggauaacuccagaagagauaaaagcuguugucgcaaaacguuacagcggcugggggcgguuaucagcuaaacuacuaacugagcuauuagacgacgacggacaaaggauaauagauauauuauggaacgacucaaucacauuuauggaagcaguaucaaaaccagaaauaaaagcccaaauccaaaauauaaaccgagacuucauaaaagcuacagauauugaaacagugcuagacgaagccuacacaagcccucaaaauaaaaaagccauuagagaaguuuauaaauuaguuaaagauauccaaaaagcaaugggaggaaaagcaccaagcaguaucagcauugaguucacacgcucacccgaagacaaugguucugugacaaaaaccagauauaauaacaugcaaaacaaauauaaagaacuuggcaaagaacuuagcgaugaucucuccgcccaauuaaaagaauacaaaggacgcauggaccaagacaaauucuaucuauauuucaugcaaauggguaaagaccucuaugacggaagcacaauaaaucuagaugaccuaaacucauaccaaauugaccacauaguuccacaaagcuucuauaaagacgauucaaucgacaaccgaguauugacacacuacaccaauaaucagaaaaaaggcaaccauacaccacuaaacggauuaaacauagacgcccagacucaaaacuuauggaaacacuuaaauaaacuaggacuaaucagcaaaaaaaagcuacagaacuuauguuuuaaagacauaaaccagcuaucaaaauacacaaaacauggauuugucagaagacaacuaguagaaaccucgcaaguaauaaaguuaguagcaaauauccuuagugaugaauuugcaaaugacgguacuaaaauaaucgaagucaaagccaaaaugaacucacuaaugcgcgacacuuuuaauuuauauaaagucaggcaauuaaacgacuaccaucaugcagucgacgccuacuuaaccacguuugucggaaaauacuuauacaaacgauacccaaaacuuagaaguauguuuguuuacggugauuucaaaaaauuuucggcggaagacgaucuaaaagauauuaaaacuuuuaauuuucuucaugacauaacuaaccccaaagaaaguaacaaagagaaaaucuaugacgagaaaaguggagaacucauauuagaccgaaaacacgcuaucgaaaccaucaaaaaaauauaccaauauaaauuuaugcucauaguacgcgaaguaucgaccaaaucuggucaguuauuuaaacagacgaucuacucagcaaaaaaaacaaacggccuuaaaucggccauaccuguaaaaagcaaucuagaacccagcauauauggauauagaucaggaaacguagaucaccacaugguuaucguaaaaauuaaaaaaggaacaaaauauagcuucaaaguaauaggaaucucugcucgggcuauacaagaauuagaaaucgcaaaaaaaaucggaaacuacagagacaaacuuuacgaggucgucucugaccgauuaucacaaaguaugaaaucaguagaaagcuucagaauaauccuagauaauaucauguauggacaacucauaguagacggaaaugauaaauuuacuuuaggaagcgcugauuaccgaaaaaauucaagacaacuaguauuguguaccaacucacuaaaaauauuaaaagaugaagacuacaugaauagacuaucagacauucaaagaagcaaacucaugguacagguauacgaugaaauaauuaagauaaugaaaaauaaauacucacuauuuauuucaaauacagaaaaacuacucgaaaaaagagauauuuuuugcggacucucauucgaugaacaaaaaauuguuauuuggaaaauuauaauagacuuacacaauggaccauuuacaaaaauacaagaacuaggaaucaacaauaaaaugggaacauuucaaacaaaacauggcauuauacucaccgaaaaugcgauuguaauauaccaaucaccuucaggccuuuuugaacggaagguucgacugaaggauuuauga

SEQ ID NO: 9080 - RNA, 4194 nt, Artificial Sequence
  Cas9 variant
augaaaaaaguacuaggacuagaccuuggaacaaauaguauaggaugggcgcuaguaaacgaagcuacaaaagaagaaaaaaaagaaggaaaauccucagaaauuauaaagcuaggcguccgaguaaauccauuaacaguagacgaaaaaacaaauuucgaaaaaggacgucccuuaagcaccaaugcagauagaacucuaaaaagaagugcccguagaaaucuacaaagauauaaauuacgacggcguaauuugaucgaaauccuuauuaaaaaugguuucauuacuaaagauacgccauuaacagaaacaggcaaagacacaacucaucaaacacucaaacuacgagcaaaaucagcaaaggaaaagguagaccucaaagauuuugcaaaaauacuacucacaauaaauaaaaaaaggggauauaaaagcagcagaaaaguuaacagugaugaagacggauuagccauugacggaauggcagucgccaaacacuuauaugaacaaaaucuaacaccaggacaguacguauugaauuuacuacaaaaaaacaaaaaauacguaccagacuuuuauagaucagaucuccaagaggaguucaaaaauauauggaacaaucaaaaaaccuauuacuucgacauucugacagauacacucuuugaggaacucaaagacaaaaacaaaagccaaaccugggcaauuugcaaaaaaccauucgacauugcaggaauuaaacaaaucgguaaagcgagcgacaagagacucgaaagauacaaauggagaacagaaggacuaacucagaaauuaaauuuagaauaucuagcaaucgcccuucaagaaaucaacaacgauauaaauaaaagcucaggcuaucugggagcaauauccgauagaaguaaagaacucuuuuucaauaaagaaaccguaggugagaaccuauauagacaacuuguaaaaaccccacacacaucacuacgcaaucaaguguuuuaccgccaagauuaccucgacgaguucgaaacuaucugggaaacucaagcaaaauuuuacccgcaguuaacacauacccuaaaagaagaaauaagagacgugauaaucuucuaccaaagaaaauuaaaaucacaaaaaagucuuauaaguuuuugucaauuugaaagcugggaacaaaccuacauagaaaaagaaaccggcaaaagcaaaacuaggacagucggcaggaaaguaauccccaaaucaagcccucuauuccaagaauuuaaaauauggcaaaaccucaacagucuugaauuccguaacagcgacgaaggagaaauaauagaauucaucaaacuagacgaagacauccgacaaaccgucuucgaagaauugaaccuaagagggaacuuaaagccaaacgauguacucaaaauucuaggaaauuauauaucucuaggaaaaguuucccaauggaaaugcaauuuugaagaaauagaaggaaaccggacaaaugcagcacuauacaacguauaucaaauuauagcagaaaaugaaggauauggauucgauugggcaaaaaaaaccgcuucagaaaucaacaaagaacuaaaaaacaucuuuccacaacuuggcauagaugcaagcauacuugacuucgacuucacccaagcaaacuuugauaaacagacaucauaucaacucuggcaccuacucuacuccgccgaagaagauuuuaaaaucagugaagaagauaaagucuuguauggaaacucgagugucagccuaaaaaagaaacuacaucaaaaguaugguuucaagccagaauauacaaaauuauuaacuaacauaagccuacaaccugacuacgguaaccuauccgccaaagccauuuguaacauacuacccuaccuuaaagaaaauaauguauacucagaagccugcgacuuaacagguuauaaucauuccaauuucuugacagcagaagaacaagcaaaaagacccuuaaaaccuauucuugaacuacuaaaaaaaaacagucuaagaaacccaguaguugagaaaauacucaaucaaauggucaauguaguaaaucaagugauagaaacuuauggaaaacccgaugaaauacgcaucgaauuaacuagggaacuaaaaaaaagugcaaaagaaagagcaaacaugaccaaaucaauagcugacgcaacaagacgaaaugacgacuauagaaaaacaauaauaaaagaauuuggaaucccuaauccuacaaaaucugauguaguaagauacagauuauggcaagaacucgcauccagaggauacaaggacauauuuaccgauaccgagaucaaaccacaagaauuauuuucaaauaaaaucgauauugagcacauaauaccaaaagcacuacuauucgacgauucauucuccaacaaaacucuagcauuuaaaaaggauaacuugaaaaaagcaaaucguacagccuaugauuuuauugcuaaugacuacgcacccaacuuggagaacuacauugaacgcguugaaucucuacauaaagaucgcaaaauaacaagggccaaacgaaacaaacuauuaaugcuccaaaguaaacuaccggauggguucaucgaacgagaccuccgaaacagucaguacaucacaaaggaagcuaaaaaaauguuauaugaagucugcaggaccguaguaagcacaucagggucgauaaccgacaagcugagagaagauugggaucucauuaauguaaugaaagaacuuaauuuuccuaaauauaaagcacuaggacuaacggaaaaaaucgaaagguaugacauaggggcugaaaaaaugaaagaagucgaaaucaucgaagacuggaacaaacguaacgaccauagacaccacgcaauagaugcucugacaguagcguuuuccacccauucacacauacaauaccugaaccaccuuaacgcccgccgagacgaaggucacaaaaaacaugcagcaauaauagcuaucgaaaguacaauaaccgaaaaagaaggaaacaaaaaacgcagauucauagcaccacuuccaaacuuuagacuacaagccaaagaacacauugaauccauacuaguaucauuuaaaaauaaaaacaagguaguuacuaauaacauaaauaaaaccaaacggauaaaaaaggacaaauucaauacgaagguacagcuaaccccaaggggacaacuccacaaagaaacgauauauggaaagauaaaacaaccacuagaaaaacauauaaaauuaaacaagucauuuacccucgaacaagcaaaauugauaauagauaaaagacaacgagaaaaaguauuaaaccaccuagaaaaauacgcacauaacucggauauagcauucaacucaaaaacacuaaaaaaaaacccacugcucauaucagaugaaccacuaaaagaaguacuuuguuuugaagagguuuucacuauccguaaggauaucucauacgauaauuuuaaaaaugagaaacaguuagacaaaguaauugacgagaaagugaaacaagcacuaaaagaacgaauaaaucaguauaacggagacuuuagagaagcauuuucugacauagaaagaaacccgauauggcuuaauaaagcaaaaggcaucugcgugaaacgagcuaccauuaaagguguaaguaacgcggaaccacuucauacagccaagaaccaucuaggagaagaaguauuaacagaaaauaaagagcaaauuccgguagacuaugucagcacaggcaauaaccaucacguagccauauacgaagaugaagauggaaaccuacaagaaaaagucguuucauuuuaugaagcaguuauccgcguuaaugaaggccuaccaauaauagacaaggaauacaacaaaagucuaggauggacauucaaauucacaaugaaacaaaaugaaauguucgucuucccaucggaggauuucaauccaacagaaauagaccuauuagaucaaaaaaacgcaucgcucaucucuccaaaucuauuccgaguccagaaauuuacaauaaaagauuauuucuuccgacaccaucuugagacaacuguggaaaacaacaauacgcucaaaaacacaacauggaggcgugaggguuuauccggcaucuaugggaucauaaaaaucagauugaaccaucuaggagaaaucguucaaguaggagaguauuga

SEQ ID NO: 9081 - RNA, 4194 nt, Artificial Sequence
  Cas9 variant
augaaugaaaacaaagaaugguucuuagggcuagacauagguacagcauccgugggaugggcggcaacagacacaaauuacaaccuacuaaaauuaaaaggcaagaaaucguggggaguacgacuguucgaugaagcccaaacugcaaaagaaagaagagauugcagaucuaaaagaagacgucuagccagaagaaaauggagacuaggauuacuagaagaauuauuugccgaagaaauaaacaaaaucgauccaaacuucuucaugagacuacgcgaaaguaaguacaaaguaucggacaagacagguaacguacccagcauauuguuuaaugagaaaaauuacacugacaaagaauacuauagaaacuacaaaacaaucuaccauuuaagagcugauuuaauacacaaaaacaauccagauauccgcgaauuauuccuugccauacaccauauauuaaaauacagaggccacuuuuuauucgcaggccaacaauucaaaggcagcgaaaucaaagacaauaucagagaauuguuacaauacaacucacuaaauauaaaaauagacauaacagaugaacuaaucaauaacauagcugaaauucuucucaagaagaaaaacaguacagacaaaaucauagaauuuaagaaauuauuugcagaugaaaaacaauuaaucgaagcacuacgccuugcacugggaaacaaaacacaacuugcuaaauuauucgacauagaagcauacaaagaacuagacauaagcauuaaaacuaucucuuuuaaagagaaaauauaugaagauguuagauccaauuacgaagaaauccuaggcgaauacauaaucguuuuagauacggcgaaauuaauauacgaugcaauaauauuaucaaaaauuaaaaucaaaaauaugacuaucagcgaaucaaaaguugucagcuaugaaaaacauggaaaagacuugaaacaauuaaaacacuugauuaaagaagauuguaaacuaucgaagaaagaaaaacgacaacuauucgaaaauauauucgucaaagaagaugaaaaaggggccaauuauguaaauuauauuggcaaaaauaacgcaggauccucaaaauccucuugcucuuacgaagacuuuaagaaauuccuaacuaaagaacuaaaauguugugaagaauccaaauuaaaacaagacauauuagcagaacuugaauuagagacuuuccuaccaagacaaagaacgaaagacaauucaguaauacucuaucaaauacauaaagaagaauuagaaaagauacuaaauaacgcaguacaauaucauccauuucuaaacaacaccgacgaauacggcauuucaauaaaagagaaaauaauacaauuacuagaguucagaauaccuuauuacgucgguccacugaauacaucucacaaaguaggagacggaggauuuucauggucaguaagaaacaaaggguaugaacacaucgcuguaacucccuggaauuucaacaaaguuauuaacaaagaagaaucagccaaaaacuuuauagaaaaccuaacaaaucaauguacauauuuacuauacgaggacgugcuaccaaaacacucauuauuauauucugaguuugcccuacuaaacgagcuaaacuccauaaacuacggaggcaaaagauuaacagucgaacaucgaaaucucauaaucgaaagauucuuuaaacaaagcgcucccaaagcgacaggaaaagaacuuaagaaguuccuaaugagugaaggagugauagaugguaaagaugaacuuagcggcuucgaugugucaaucaaaaacgaccuaaaaucauacagagauuuuaagaaaauacuuggugauaaauucgacuccgaaaaaguagagaaaaugauaagauggaucacucuauuuggcgagagcaagcaauuacuuguagacaaaauaacaaaggaauauggagacauauacagucuagaagaaaucaagaaaauaucgggacuuacuuacaaagauuggggaagauuaagcgaaaaacuacucaccgaaauagucagcagccaacuauaugaugaaaguacuggagaaugcuucaacauaauaaaugccaugcgaaacaacacgcuauuauuuauggaauuacugggcaccaauuacgacuacuucgagaaaauaaauauauauaaccgaagacuaagaaaagaaauaacagaaauaacaccccauauacucgaugaucuauaugugucacccgccguaaaacgaucaauauggcaaguaguaaggaucgucgaagaacuaaagaaaauaauagggagugaaccaaaaagaauuuucguugaaaccacuagauccaacaaagagaagaaaggagaugauggacgcaaagacucgaggaagaaagcacuucuugaacucuauaaaaagauuaaaaccuccgauauaguugaacuagagaaagcucugggacacacaguagauuucgacaagaagaaacaggauuuaaccgacaucgacaauaacaaacuuaaagcccggaaacuauaccuauacuacacacaacuaggucgauguuuauacacaggcaaagcaauagaucuaaauaauuugcuuuccucgaacagcgaauaugaugucgaucacauauacccacagucaaaaacaaaagauggaaguuggaacaaucuaguccuagucaauaaaaccgaaaacagcaagaaauccaacggauuaauuuccgaaucaauacaaaggaaaaacaaacacuuuuggagauuccuaaaagccaaaaaccuaauuucagaagaaaaauacaaaagauuaacacgaacagaagauuuuaccgacgacgaauuaucaggguucauagcucgacagcugauagaaacaucacaaucaguuaaagcaguaucacaaauacuacaaaaccuaaacccaacaaccgaaauaugcuuuucuaaagcagaaaaugugcacgacuuuagacaagaauuuggaaagaucaaaguaggaaaaaggagaaaucuuaccgaagaacaacaaaaagaagcaaaagaaggacaacuuauaaaaguaagagacuuaaaugaucuacaccacgcaaaagacgcauaucuuaauaucguaguaggaaacgucuaccauauaaaguucacaaggaacccgaaaaacuuuauaaggaaaaacaguaagaaccgcgaauacacacugaacacuuuguuuuauuccgauaaaauagaacgaaauggugaaguagcaugggaaaaaggaaaaaccgagaaaauuguuucaucgguaauguguaacaauuuaauaaacguaacaagaaggaccucugaacaaaaaggggcacuauacgaugcaacgauuuacaaagccaacgcagcaaaagaaggaaguuacuaucccguaaaaacaaagaauaagaacuuaaaagacgucacaagauacggagguuucacaucaauaaaaauugcauacuauucaaucuucaaguaugacauaagaaauaaagauaaaguaaaggaaaauauaaaaauuauuccgauaccaauauacauaucgcaaaauauuaaaaccgauuuagaccuaauaaacuuugcagaaaaacaaauuaagcuaaagaaaggugagaauauagagaacuugcaacuaauauacaagaaacuaaacauaggcgcacugguaaaaauagacuauuaucccuauuacguagguggcaaaacaaaugauaacuuuuacaucgacggcgcuguccaagugcuacuaagcucagacauugagagguaccuaaaagaagucguaaaauuuguaaacuuucagagagaaaauaaagaagccaagguaucuaaggaacacauaucaucugaagaaaauauagaacuuuacaacacauuacuuuguaagaugacagcaaagaucuucacacacaccaaaaauaauaaauacaaugaucuugcacaagacaaagcaaagaacacuuucaaaaaccuuucauuagaagaacaauguaaaguguuacuggaaauauuaaaucuauuaacaaauaagaaaacaacuuucgacuuaagccuaauaaacgaaaaagcgucuaggguaaaaugcggauuuaaccuacuaaaucaaaaacaauucucaauaauagagcaaucuguaaccggacuuuacgagaaagaaauaaaaauaauugaagauuga

SEQ ID NO: 9082 - RNA, 4197 nt, Artificial Sequence
  Cas9 variant
auggaaacacaagcaaguaaucaacucauaucaucccacuuaaaaggauaucccauuaaggacuauuuuguagguuuagacauaggaacguccucuguagggugggcagugaccaacaaggcuuaugaacuucucaaauuuagaucacauaaaaugugggguagcagacuauuugaugagggugaaucggccguagcucgucgagguuucagaucaaugagacgacgacucgaaagaagaaaacugagauuaaaacuauuagaagaauuguuugcagacgcaauggcacaagucgauccgacguucuuuaugagauuaagagaauccaaauaucauuacgaagacaaaaccacagggcacucaagcaaacacauuuuauuuauagacaaaaauuacaaugaccaagauuacuuuaaagaauauccuaccguauaccaccuacgaagcgaguuaaugaaaaguggcacagaugacauacgaaaacuauuucuagcaguucaccauauuuuaaaauauaggggaaacuuuuuauaugaaggagcaaccuuugacaguaaugccaguacauuagaugacgugauaaaacaagcccuugaaaauauaacauucaacugcuucgacugcaacucagcuauaucuuccaucggacaaauacuuauggaagccggaaaaacaaaaagcgacaaggcaaaagcuaucgaacaucucgucgauacuuauauagcaacagacacaguagacacaucgaguaaaacucagaaagaucagguaaaagaagauaagaaacgucuuaaggcuuucgcaaaccuaguacuuggacucaaugcaucucuaaucgacuuauuuggaucaguugaagaacuagaagaagaccuuaagaaacuucaaauaacaggugacacauaugaugacaaacgagacgagcucgcaaaagcauggucagacgaaauuuacauuaucgaugauugcaaauccgucuacgacgcaaucauccugcuaaguauaaaagaaccaggauuaaccauaucagaaucaaaagugaaagcauucaauaaacacaaagacgacuuggcaauuuuaaaaaguuuacuaaaauccgaccgauccauauacaacacaauguuuaaaguugaugaaaaaggucuacauaauuacguccacuacauaaaacaaggucgaacggaagagacaaguuguaaccgagaagacuucuacaaauacacuaagaaaauaguugaaggcuuaagugauaguaaagauaaagaauauauacucucacaaauagaacuacaaauucuacucccacuacaacgaaucaaagauaacggcguaauacccuaccaacuacauuuggaagaauuaaaagcaauacucgcaaaaugcgggccuaaauuuccguucuuaaacgaaguugcagacggcuucucuguugccgaaaaacucaucaaaauguuagaguuccggauuccauacuacguuggaccccugaauacccaccacaauguugacaauggcggauuugcgugggcaguaagaaaagcauccggacgugugacgcccuggaauuucgacgauaaaauagacagagaaaaaucggcagcggcauuuaucaagaaccuaaccaauaaaugcacauacuuauuaggcgaagauguacuuccaaaaaguagccuccucuauucagaauuuauguuauuaaacgaauuaaacaauguaagaauagaugggaaaccucuagaaaaaguaguaaaagaacaucuuauagaggcaguuuucaaacaggaucacaagaaaaugaccaaaaaucgaaucgaacaauuuuuaaaagauaacggauauauaucugaaacacauaaacaugaaauaaccggccuagacggugaaauaaagaaugaccuugcauccuauagagacaugguucgcauauuaggagauggauucgacagaaguauggcggaagaaauaauaacugacauaacuauauucggagagucaaagaaaauguuacgcgaaaccuuacguaagaaauucgcaucauguuuagaugacgaagcaauuaagaaacuaacaaaacuaagauaucgagauuggggucgucuaucacaaaaauuacuaaaugguauagaaggcugcgauaaagccggagacggcacacccgaaacgauaauuauccucaugagaaauuuuucuuauaaccuaauggagcuuuuaggugacaaauuuagcuucauggaacgaauacaagaaauaaacgccaaauuaacagagggacaaauagucaacccucacgacauuauagaugacuuagcguuaagcccagcagucaaaagagcagucuggcaagccuuaaggaucguagaugaaguagcucacauuaagaaagcgcuuccugcacguauauucguagaaguaacuagaucaaacaaaaacgaaaagaaaaagaaagauuccagacagaaaagauugucugacuuauacgcagcaauaaagaaagaugauguacuauuaaauggauugaauaaugaaauuuucggagaacuaaaauccagucuugccaaauacgaugacgcagcacuaagaucaaagaaauuauaucuauauuauacacaaaugggucggugugcauacacgggagaaauaauagaauuaucacuacuuaauacagacaacuaugacauagaccauauuuaccccaggucucucacaaaagacgacagcuuugauaaucuuguguuauguaaaagaaccgcaaacgcccaaaaaucagacgcuuacccaaucucagaagaaauacagaaaacacaaaaaccauuuuggacauuucuuaaacaacaaggacuaauuagugaaagaaaauacgaaagauuaacaagaauaacaccacucacagcugaugaucuaucaggauucaucgccagacaacuuguugaaacaaaucaaaguguaaaagcugcaaccaccuuacucagaagacuauauccaggugucgauguaguuuuuguaaaagcagaaaacgugacagauuuucgacacgauaacaacuucauaaaaguaaggucuuuaaaucaucaccaucacgcaaaagaugcauacuuaaauauuguaguuggcaauguauaucaugaacgcuuuacaagaaauuuucgagcauuuuucaagaaaaauggugccaaccguaccuacaacuuagcuaaaauguucaacuacgacguaaauuguacuaacgccaaagacggaaaagcaugggacgugaaaacuucuauggauacagugaagaaaaugauggauucaaacgauguaagaguaacaaaacgacuacuugaacaaacuggagcguuagccgaugcaacuauauacaaagcaacaguggcaggaaaagccaaagacggugccuauauagguaugaaaacaaaaucauccguauuugcugauguaucaaaauacggcggaaugacaaaaauuaaaaaugcauauaguauaauagugcaauacacagguaaaaagggagaaguuauaaaagaaauaguaccauuaccuauauaccucacaaauagaaauacgacugaucaagaucuaaucaacuacguagccucaauaauaccacaagcaaaagacauaucaauuauuuauggaaaauuguguauuaaccaacucgucaaaguaaacggauuuuauuacuaucuaggaggaaagacuaacagcaaguucuguaucgauaaugcaauucaaguaaucgucaguaacgaauggaucccauacuugaaaguucucgaaaaauuuaacaacaugcgaaaagacaacaaagaucucaaagcaaaugucguaaguacaagggcucuagauaauaaacacacaauagaaguacgcauagucgaagagaaaaauauugaguucuucgauuaucuaguuuccaaauuaaaaaugccaauauaucagaaaaugaaaggcaauaaagcugcggaauuaagcgaaaaaggauauggauuauuuaagaaaaugagcuuagaagaacaaucaauacaucucauugaacuucuaaauuuacuaaccaaccagaaaacaaccuucgaagucaaaccacuuggaauuacggcuagcagaagcacuguggguucaaaaauaucaaaucaagacgaguucaagguaauaaaugaaaguaucacaggccuauacucuaacgaagugacaauuguauga

SEQ ID NO: 9083 - RNA, 4197 nt, Artificial Sequence
  Cas9 variant
auggaaaaaucauacaguauaggccucgauauaggaacaaacaguguaggauggucaguuauuacagaugauuauaaaguaccagcaaagaaaaugagaguauuaggaaauaccgauaagaaauauauuaagaaaaaucuacuaggagcacuuuuauuugauagcggugaaacagcagaagccaccagacuaaaacgaaccgccaggagacgauacacacgacgcaaaaacagguugcgcuaccuacaagaaauauucgccaaagaaauggcaaaaguagaugaaucauuuuuccaaagacuugaugaaucuuuccucacagacgacgacaaaacauuugauucucacccaauauucgggaauaaagcugaagaagacgccuaucaucaaaaauuuccaacaauauaccaccugagaaaacauuuagcagauucccaagaaaaagcugacuuaagacuaaucuaccuagcucuagcccauaugauuaaauuuagaggacauuuucucuacgacaacuuuaacgaugacaacuuugauuggagaaauaucgacauacagaaaagguacgaagaauuuauagaaacauacgauaguacguuaggugaaagcuauuuagcagauauaucaguagacgccgcaucgauacuagaagaaaaaguaucaaaaacagaacgacuagaaaacuuacuaaaauacuacccaacagaaaagaaaacgacauucuuuggaaaucuaauaaaauugauacugggacaacaagcaaaauucaaagcaauauuuaaccuagaagaugaaauaagccuucaauucgcgacuccaaccuaugacgaagaucuagaagaacuauuaggaaaaauagacaauggagacaguuauucagaguuauucguagccgcacaaaaccuauauaauacuauacuacuagcaaguuucuuaaaaacagacaauaaaagcgcaaaagccccacuaucgacaucaaugauagaaagguaugaaaaucacaagaaagauuuagccaaacucaaagacuucgucaagaaaaauuguccugaccaauaccaugacaucuuccgugauaaaaguaaaaacgguuaugcgggauauauagacaacggaguaucacaaaaugacuucuacacauucauaggcaaaugccuagaggaauccuugaagaaagacaaaggagcccaauauuuucuagauaaaauagaccgcgaugacuuuuugcgaaaacaaagaacauuugauaacggggcguuuccauaccagauacaccuucaagaaaugcacgcaauauuaaggcgucaaggcgacuauuauccauuuuuaaaagaaaaccaagauaaaauugagaaaauacuuacguuucgaaucccauacuauguaggaccucuagcacguaaagacucacguuuugcaugggcuaacuacagaucagacgaagccauaacuccuuggaacuucgaugaaguaguagauaaagagaaaagcgcagaaaaauuuauuacgcgaaugacucuaaacgaccuauaccuuccagaagagaaaguucucccaaaacauucauuaauauaugaaacuuuuacagucuauaacgagcugacaaauauaaaauauguuaacgaccaaggaaacgcuauacauuuugacucagaacugaaagagaaaauauucaaucaacucuucaaagaaaacagaaaaguaaguaagaaaacccuaaucgauuucuuaaacaacucagaaggcauauauacagacaaauuaguaggaaucgacgaagaaguaaaauauuuaaacgcaucucucggaaccuaccaugaucuaaagaaaauauuagaauccuuuauggaugaugaaauaaacgagaaaauaauagaagacaucauucaaaccuuaaccuuauucgaagauauagaaaugaaaagacaaagacuacaaaaauacgaugauauauuuacuccaaaacaacuaaaagaauuagcccgaaggaacuauacggguugggguagacuaagcuacaaauuaaucaauggaauaagaaacaaagagaauaauaaaacaaucuuagauuaucugaaaaauggaaaucggaacuuuaugcaauuaauaaacgaugauagauugagcuucaaacaaauaauaaucgaugcccguaaaauagaaaaauuagauaauauagaaucaguaguauacaauuuacccggaucaccagcaauuaagaaagguauacuucaauccauaaaaauaguagaugagcucguuaaaguaaugggacauaacccagacaauauaguaauagagauggcucgagaaaaucaaacaacaaaccaggggaaaaauagaagccaacagcgacucaaaagacuacaagacagcaugucuaacuucaaagacagcucaaucagcuuaaaagaugucgauaacagcgaucuccaaaacgacagacuauuuuuauacuacauacaaaacggaaaagauauguauacaggcgaagaacuagacauagaucaccuuucagacuacgauauagaccacauuaucccccaaucuuuuauaaaagacaacagcauagauaacagggucuuaacaagcucagccaaaaaucgaggaaaaucugacgauguuccuggacgagauguaguucuaaaaaugaaaccauuuuggaagaaacuauaugacguaaaauuaauaucuaaacguaaauuugacaacuuaaccaaaagcgaacacggaggacuuacagaaucugacaaagcagguuuuauuaagcgacaacuuguagaaacaagacaaauaacaaaauacguggcucaaaucuuagacggaagguucaauaccaagcgcgaugauaacaauaagguaauacgcgaugucaaagucauaacucuaaaaagcagcuuaguaucacaauucagaaaagacuuuggauuuuacaaaguacgagaaaucaacgauuaccaccacgcucaugaugcauauuuaaaugcaguaguagguacugcuauacuaaagaaguauccaaaauuagccccagaguucguuuauggagaauauaagaaaugcgauguccgaaaguugaucgcaaaauccggagauaaaucugaaaucggaaaagcuacagcaaaauauuucuucuacagcaauuuaaugaacuucuuuaaaagaguaauuagauauuccaacggcaugaucgucguacgacccgucaucgaauacucaaaagauacuggcgaaauagcaugggacaaagaaaaagacuuuaaaacggucuguaaaguacucaguugcccccaagucaacaucgucaaaaagguagaaaagcaaucccauggacuagauagaggaaagccaaagggauucuauaacgccaauccaagccccaaacccaagaaaggauccaaaguaaauuuaguaccuaucaaagccaaccuuaaccccaaaaacuacggcggauaugcagggauaucaaauaguuaugcaguuuuaguagaugcuacuauugaaaaaggugccaagaagaaacugacaagaauacaagaauuucaaggcauuuccauaauagaccgggagaaguacgagaaaaacaaaguagaguuucuuaaaggauuaggauauaaagaaauuuauucaauuaucacacuacccaaauacucacucuuugaauuagcagacgguagccgaaggaugcuagcaagcauacuauccacaaauaauaaaaggggagaaauacauaaaggaaaugaauuaguacucccggcgaaauauauaccauuauuauaucacgcaaacagaauacauaacacguucgaaaccggacaccgcgaguacguugaaaaacacauagcagaguucaaggaaauagcagaaauaauccuagaguucaauaacaaauauguuaacgccaagaaaaacagcagcauuauagaaaaagcgcuagagucuuuugauucuuuuucucuagaugaaauaugugacagcuuugucggaaaacuaaagaaaaauaacaccaagaaaaacaguggauuauucgagcuaguaucccugggauccgcaucugauuucgaauuucuagaaacuaaagucccccgauacagagauuacacaccaucaucucuacuaaacgcaacauuaauucaucaaucaauuaccggauuguacgaaacaagaaucgaccuaagcaaacuuggagaagaguga

SEQ ID NO: 9084 - RNA, 4197 nt, Artificial Sequence
  Cas9 variant
auggaaacacaagccucuaaccaauuaauaaguucgcaccuaaagggauacccaaucaaggacuauuuugucgguuuagacaucggaaccucaucaguaggcugggccgucacaaauaaagccuacgaacuccuaaaguuucggagccauaaaaugugggguagcagacuauuugaugaaggagaaagugcagucgccagacgaggguuucguuccaugagacguagacuagaacguagaaaacucagacucaaacuucuagaggagcuauucgcggaugcaauggcucaaguagacccaacuuucuuuaugcgacuaagagagucaaaauaccauuaugaagauaagaccacaggacacucaucgaagcauauccuauuuauugauaaaaauuauacagaucaagacuacuacaaagccuacccaacuauauaccaccuaagggcagaacuaaugaaagauggaacauaugacauaagaaaauuauuuuuagcagugcaccauauccuaaaauacagaggaaacuucuuauaugaaggcgccuccuucgacaguaacgcuucaacauuagaugacguacuuaaacaagcacuagaaaauauuacuuuuaauugcuucgauucaucagcugccauaggaucaauuggacaaauauuaauggaaaccgguaagacgaaaagcgauaaggcaaaaacuaucgaaagacuuguggauacauacauuauaacagacgaagucaaugcaucagguaagacgcaaaaagaccaagugaaagaagacaagaaacgauuaaaagcauucgccaacuuaguuuuaggucugaacgcaucccuuauagaucuauucggaaguguugaagaacuugaagaagaucuuaagaaacuucaaaucacaggcgauacauaugaugauaaacgagaugaacuagcaaaagcguggagugaugaaauuuauaucauagaugacugcaaaagcguauacgaugcuauaauacuauuaucaaucaaagaaccuggauuaacaauuucagaguccaaaguaaaagcguucaacaaacacaaagacgaccuggcuauauuaaaaagucuacuaaaaucugauagaucaauauauaacgcaauguucaaaguagacgaaaaaggacuacacaacuacguccauuauauuaaacaaggaagaacagaagaaacaucaugcaauagagaggacuucuauaaauacacaaagaaaguggucgaaggccuaccugauucaaaagacaaagaguauauacuuagcgagaucgaguuacaaacacuguuacccuuacaaaggauaaaagacaacggagucaucccguaccaacuacaucuagaggaacuaaaaguuauccuugcaaaauguggucccaaauuccccuuccuaaacgaaguugcagacggauuuagcgucgcagaaaaacuuauaaaaauguuagaguuccgaauaccuuauuaugucggacccuuaaauacgagccauaauguagacaauggaggcuucgcaugggcaguaagaaaagccucaggacguguaacacccuggaacuucgacgauaaaauugacagagaaaaaucagcugcagcguuuaucaaaaacuugacaaacaaauguacauaccuucuuggagaagauguuuuacccaaaucauccuuacuauauucugaguucauguuacuaaacgaauuaaacaacguacgcauagauggaaaaccauuagaaacaaaagucaaagcccaucuaauuaaagcaguauucaaacaagaccacaagaaaaugaccaaaaacagaauagaacaauuuuuaaaagauaauaauuacauaccagaaaaacacaaacccgaaauaacaggacuugacggagaaauuaaaaacgacuuagcaagcuaccgagauaugguacgaauauuaggaaauaacuucgaucuuucaauggcugaagaaauuauaacagauauaaccauauuuggggaaucaaagaaaaugcuacgcgaaacuuuacggaagaaauuugccaguuguuuagaugacgaagcgauaaagaaacuauccaaauuaagauauagagacuggggucgacuaucaaagaaauuacuaaauggaauagauggaugcgauaaagccggugacgggacaagcguaaccaucauagaagcaaugagagauuucaguuacaaccugauggagcuucuaggcgaccgcuuccuguuuauggaaagaauacaagaaauaaacgacaaacucacugaaggucaaauugucaauccucaugacauaauagacgaucucgcucuaucgccagcaguaaaacgcgcaguauggcaagcauuacguauagucgacgaaauaguccacauaaagaaagcucuaccagcaagaauuuucguggaaguuaccagauccaauaaagcagaaaagaagaagaaagauucacgacagaaaagauuaucugaucucuacgcagccauaaagaaagacgacgcucuauuaucaggacuaacuaaugaagaauuugguggacucaaaagcgaacuagcaaaauaugacgacgcagccuuacguucgaagaaauuauauuuauauuauacacaaaugggaagaugugcauauacaggagaaguaauagauuugucccaauuaaauacagacaauuaugacauagaccacauauacccacggagccuaaccaaagacgauagcuucgacaaccuaguacuaugcaaaagaacugccaacgcacagaaaagugauacuuaccccauaagcaaagaaauccaaaaagcucaaaaagccuucuggauuuuccugaaacaacaaggccuaauaucagaaagaaaauaugagagacucacacgcaucacaccacuuacagcagaugaucuaucuggauuuauagcaagacaauuagucgaaacaaaccaaagcgugaaagccgcaacuacgcuauuaagaaggcuguacccagauauagaugucgucuucguaaaagccgagaauguaacagauuuucgucaugauaacaacuuuauaaaaguccguucccuaaaucaccaucaccacgccaaagaugccuauuugaauauaguaguagguaacguuuaccacgaaaaauucacacgcaacuuuagagcuuucuucaagaaaaauggagcaaaucgcacguauaaccuagccaaaauguucaauuaugaugucaaaugcacaaaugcaaaagauggaaaagcaugggauguaaaaacuucaauggauacagucaauaaaaugaugacuucaaaugacguaaggguaacaaaaagacuauuagaacaaucaggcgcccuagcagaugccacaguauauaaagccacuguagcugcaaaagcaaaagauggagcauauauaggaaugaaaaccaaaucaucaguauuugcugacguaaccaaauacggcggaaugaccaaaauuaaaaaugcauacaguauaaucguucaauacaucggcaagaaaggcgaaguuguaaaagaaauaguaccccuaccaauauacuuaaccaaucgcaacauaacugaucaagaccuaauagauuauguagcaaguauuacuccucaagcaaaagauauaaguaucauauacagaaaauuauguauaaaccaauuaguaaaaguuaauggauuuuacuacuauuuagggggaaaaacaaauucaaacauauacauugauaacgccguagaaguagugguaccggccaacaucgccguauauauaaaaguacuagagaaauuugcacuguuacauaaagacaacaauaauauaaaagcgaguacgguuaccacacguauauacaaugaaggcaguacaaauauuguauccauuacugauaaagacggcuuaauaguguaugauuaccuaaugucaaaacugagaacgccacuuuacaugaaaaugaaaggaaacaaaguugacgaauuaucaacugucgggcguagcaaauuuaugaacaugacacuagaagaacaaucaauauacuuauuagaaguucuaaauuuacuaacaaauucuaaaacgacuuuugauguaaaagcguuaggaauuacagcaucgagaagcacuauaggaguuaaaauacauacccuugacgaauuuaaaauaauaaaucaaagcauaacaggcuuauauaguaacgaaauaacuauaguauga

SEQ ID NO: 9085 - RNA, 4197 nt, Artificial Sequence
  Cas9 variant
auggaaacccaaacgaguaaucaacuuauaacuucgcacuuaaaagauuauccaaaacaagauuacuucgucggcuuagacauaggaacuaacuccgucgggugggcaguaaccaacacauccuacgaauuauuaaaguuucauucacauaagaugugggggagccggcuauuugaagaaggagaaagcgcaguaacacggaggggcuuucgcaguaugcgcagacgccuagaaagaaggaaauuaagacuaaaauuacucgaagaauuauucgcagacgcaauggcccaaguagauucgacauucuucauuagacuucaugaaucaaaauaucauuacgaagauaaaaccacgggacauucaucgaaacacauauuauucauagacgaggacuacacugaucaagacuacuuuacugaauacccaacuauuuaccaccuacgcaaagacuugauggagaacggaacagacgacauaaggaaauuauuccuugccguacaccacauacucaaauaucgaggcaacuuucuauaugaaggagcaacauucaauucaaacgcauucaccuuugaagacgucuuaaaacaagcacuaguuaacauuacauucaauuguuuugauacuaacucagcaauaucgaguauaucgaauauauuaauggaaucuggaaaaacuaaaagcgacaaagcuaaagcaaucgagagacuaguugacacuuacaccguauucgacgaaguaaauacgccugauaagccgcagaaagaacaagucaaagaagacaaaaaaacauuaaaagccuucgcaaauuuagugcuuggucugagcgccaaucugaucgaccuguuuggaucagucgaagauauagacgaugaucuuaaaaaauuacaaauaguaggugacacauaugacgagaaaagagaugaauuggcgaagguauggggagacgagauacauauuauagaugauugcaaaucagucuacgacgcaauaauuuuaaugucuauaaaagaacccggauuaacaauaucacaaucaaaaguaaaagccuucgauaagcauaaagaagaccuugugauauuaaaaucucuauuaaaacuagaccgaaauguguacaacgaaauguuuaaaucggauaagaaaggauuacauaacuaugugcacuauauaaaacagggaagaacagaagaaacaucaugcucaagagaagauuucuauaaauacacaaaaaagauagucgaaggacuagccgacaguaaagacaaagaauacauucuaaacgaaauagaauuacaaacauuacuaccacuacaaagaaucaaggacaacgggguaauaccuuaucaacuacaccucgaagaauugaaaguaauacuagacaaaugugggccuaaauuccccuuucuacacaccgugucagauggauuuucugucacugagaaauuaauuaaaaugcuggaauuuaggauucccuacuaugucggcccguuaaacacacaucauaauauugacaacgguggauucucuugggcaguaagaaaacaagcuggaagaguuacaccuuggaauuuugaagaaaaaauagauagagaaaaaucagcagcagcauucauaaaaaaccuaacaaauaaauguacuuauuuauucggagaagauguuuuaccgaaaucaagucuuuuauacuccgaauucaugcuacuuaacgaacuaaacaacguacgaaucgacggaaaagcacuagcucaaggaguuaaacaacaucuaauagacucuauauuuaaacaagaucauaaaaagaugacaaaaaacagaauugaacuauuucuaaaagacaacaauuauauaacaaaaaaacacaagccggaaaucacgggacuagacggagaaaucaagaacgauuuaacaucauauagagauaugguaagaauacuuggcaacaauuucgacguaagcauggcugaagacauuauaacagacauaacaauuuuuggggaaucaaaaaagaugcuacgacaaacauuaagaaacaaauuuggaucacaacugaaugacgaaacaaucaaaaaauuguccaaauugcgauacagagauugggguagacucaguaagaaacuauuaaaaggaaucgauggaugugauaaagcaggaaacggagcaccaaaaacaauuaucgaacucaugagaaacgacucuuauaaccuaauggaaauacuaggagauaaauucucguuuauggaauguauugaggaagaaaacgcaaaacuagcacaaggacaagucguaaacccucacgacauaauagaugaacuagcacuaucaccugcuguaaaaagagcaguauggcaagcguuaagaauaguggacgaaguugcgcauauuaaaaaggcacuaccuagccgcauauuuguagagguagcaaggacaaacaaauccgaaaaaaagaaaaaagauucuagacaaaaaaggcuauccgacuuguauucagcaauaaaaaaggaugauguauuacaaaguggacuacaagauaaagaauuuggagcacuaaaaagcggauuagcaaauuaugaugaugcggcccuuagaucaaaaaaacuuuaucucuacuacacacagaugggaagaugcgcauauacaggaaauauaauagaccucaaucaauuaaauacugacaacuaugacauugaucacauuuaccccagaaguuuaacaaaagaugauaguuuugauaauuuggucuuaugcgaaaggacagccaaugcuaaaaaauccgacauauacccuaucgauaauagaauacagacuaaacagaaaccauuuugggcauuuuuaaaacaccaaggauuaauaucagaaagaaaauacgaaagacucacccgaauugcgccacugacugcagacgaucuaagcggcuuuauagcgagacaacuaguggaaacaaaccaaucuguaaaagccacuacaacgcucuuaagaagacuauacccugacauagacguaguauucguaaaggcggagaacgucagugacuuccgacacaacaacaacuuuauaaaaguacgaucauuaaaccaccaucaucacgccaaggacgcauaccuaaacauaguuguagguaauguauaccacgaaaaauucacaagaaacuuucgcuuauucuuuaaaaagaacggcgcaaauagaacauauaaccuagcgaagauguucaauuacgauguaauaugcacaaacgcacaagacggaaaagcgugggacguaaaaaccagcaugaauacaguaaaaaagaugauggcuucaaaugacguuaggguaaccaggcgcuuacucgagcaaucaggugcauuagcagaugcaaccauauacaaagcaucaguagcagccaaggcaaaggauggagcauauauugguaugaagacaaaauacucaguauucgcagaugucacaaaauacggaggaaugacaaaaaucaaaaacgcauacaguaucauaguacaauauacugguaaaaagggugaagaaauaaaggaaaucgucccacucccuauauacuuaaucaauagaaacgcaacugacauagaauugauagauuaugugaaaucgguaaucccaaaagcaaaagacauaucaauaaaauaucgcaaauuaugcauaaaccaauuaguaaaagucaacggauuuuacuauuacuuaggugggaaaacuaaugauaaaauauauauagauaacgcuauagaacugguagucccucacgauaucgccaccuacauaaaacuccuugacaaauaugauuuguuacgaaaagaaaacaaaacacucaaagccagcucaaucacuacaagcauauacaauaucaacacaucaacuguaguaagccucucaaauaaaguugguauagauguauucgacuacuucaugagcaaauuaagaacccccuuauauaugaaaaugaaagggaauaaagucgacgaauuaagcucgacugguagaucaaaguuuauaaaaaugaccuuagaggaacaaagcauuuaucuauuggaaguuuuaaaccuacuaacaaauucaaaaacaacauuugacguaaaaccacuagguauaacaggaucacguucaacaaucggaguaaagauccacaaccuugaugaauucaaaaucauaaacgagucuauaacaggacuauacuccaacgaagugacaauaguguga

SEQ ID NO: 9086 - RNA, 4200 nt, Artificial Sequence
  Cas9 variant
augaaaacaauacuaggguuagacuuaggaacaacaucaauagguugggcacucgugaaagaagcagaacccuucucugacgaaaaaucugaaaucguucgacucggcguaagaguaauaccuuuaacaguagacgaaaggacuucauucgaaaaugggaaaaguauaaccacuaaugcgcuacguacacaaaaacgcggaaugcgaaggaaucuacaacgauauaaacuccgucgucaagcacuaauagaagaguuaaagaguaccggcuggauaggaaacgauuuuauauucagugaaaccggacccggaaguaccuuuaggacacuaaggcuaagagcuaagucagcgucagaagaaguaacucuuggagaucuagcccgaauauuacuccaaauaaauaagaagcgaggauauaaaucuagucgaaaaaugguaagcagugacgauggucaagcaauagaugggauggcuguugcgaaagaaauguacgauaaaggcuuaaccccuggagaauacguauaucaaagaauguuagaaggcaaguaugcuauaccggaauuuuauaaaagcgacuuacaagaagaauuugauagaauaugggcgcuucagaaaucguuucacauagaacuuacagaugagcuauaccgaaaauuaagugaucgaaauaaaagucagacuugggcaaucugcagagaugaauuaggaauacaaggauuaaaaucuagcuuuauaggaaaagaacggcuaaaagaagcauauagguauaggcaucuagcggcaacacaagaaguaaauauggagguacuaacaugcgcacuacaagaaauaaauggucaaaaagcuagccuauccggccuauuaucaaaaauaucggaccgaaguaaggaacucuacuugaacaacuuaaccguaggacaaaugcuauuaaaaagaauagaagauaacccaaauaacucauuaaagaauaucguauuuuacaggcaggauuacuuagacgaguucgaacgaaucuggacgguacaauccaaauaccacacugaauugacucaugaacugaagaaaagauuacgagacauaauaauauuuuaucaaagaccuuuaaaaagucagaaaggauuaauaucacucugugaauuagaaacaaaagacauugaaguagcaauugauggcgugaagaaaaugaagaacauaggaccacggguauguccgagaaguucaccauuauuccaagaguucaagauauggcaaacaauaaacaauauauuuguaaacggagcagcccuagaugacgaagauaaauccguaauagcgaaggaacucauguucaaagacaaguuaaaagacagcgauuuacuuaaauuguuauuuaaaacaacaaaagggcaaaguguuaacuucaaagaaguagaugggaacaggaccauggcgacauugaugaaagcaugcuuuaaaaucgcugaaaaccuaggauacgaugacaucggauuaagcaaauuaucaucugaagaccaaauggugagaaucgaaggaauuuuuaaagaacaaggauucaaaacuggauuucugcauuucgacagcucacuagcgucaccagaauuugaaaaccaagauucauacagguuauggcaucuacuauauucauacgaaggagacaagucugccucagguaaugaauccuuaguaaaauguauaauggaucuauguaguauggacgaagggucggcaaaaauacuugcgagcuguacauucuuaccagacuacggaagucuuucggcaaaagcaaugagaaaaauacugccauacaugaaagacggacuugaauacacagcugcaugugcgauggcaggcuaucgacacucgaaaagguccuuaacaaaggaagaacuagacaccaaagaauacagugaccgacucagccucuugcccaagaauagcuuaagaaacccaguaguagagaaaauucuaaaccaaaugauaaacguaguaaacucuguaauagauguuuacggaaaacccgaugaaauaagaauagaaauggccagagaacuaaagaaaagcgcaaaagaacgugaagaagcucaaagagacaucgcaucauccacagcugaaucucaaaaaguaauagaaauacuaaaaggcgaaccauucuuccuacaguuuccuacacgaaaugacauuauacgcuauagauuauaccaggaauuagcccaaaauggauucaaaacccuauacaguaauacuuacauaccuaaagacaaacuauuuuccaaagaguucgacauagaacauauaauuccccaagcacuaauauuuaacgauuccuuugcaaacaaaacauuggaaucacgacaauguaaucuagaaaaaggaaaagaaacagcaauggauuaugugaaaagcaaauaugaugaaacaggcguacagacauacugcgauagaguaaacggcuuaauagggaaagguauuucaaaaacaaaagccaaauggcuacuuauggaaggaaaagacauaccugaagacuuuaucaacagagaauugagagauagccaauacauagccaaaaaggcgcgugaaaucuuagaaagccuuguuaaauuuguuguuccaaccaccgguaguguuacugcucggcuuagggaagauuggcagcugguaaauguaaugcaagaacuaaauugggaaaaauacgcacgacuuggccuaacugguguaagggaagauaaagaugguagaagaauaccauuuauucaagauuggacaaaacgcaaugaucacagacaccaugcaauggaugcauugacaauugcauucacacguagacaauuuauacaauaccuuaaucaccuaaauucaaaaauagacguuguuaguugggacaagaaagauuuagauuuacgcgauuaugaucucgaagacaucaaauucggcaacuuaucagcuggugacagguauggcauagugaaagcguuacaagacaaauuucuauacaaagacggaaacgauaaauauagauucguaccacccauuccccucgaugaguucaggagacaagcaaaagaacaacugucagacauccuaauaucauucaaagccaaaaauaaaguuuguacacgaaacgucaauguaacuaaaaacaaaggaggagcaaauagaaaagcacaguuaacaccuagaggaccacuccauaaugaaacgaucuauggaaguucuuuggaauacguuacgaaggaaaaugagaaaauaggaucaucauuugauacugaaagaauaaccacuguaugcaaaaagaaauucagggacgccuuagcaagaagacucgaagaauuuggcggagaucccaagaaagcauucacagguaaaaacaguccugagaaaaauccuaucugggucgaugaacaucacagcgaacaaguuccagcaaaaguacgaacaguaacaaugggacaaagauuuacaggaagaaaacccauugaugcuacauuaaaaauagaaaaaguaaucgacaaaagaauuagagaaauucuacaagcucgccuagaugaguucgauggaaaagcagcgaaagcauuuucgaaucuugacgaaaauccaauuuggcuaaacaaagaaaaaggaauugcaauaaaaagaguaacaguaucuggcccagcaaauccagugccggugcguuucaaacgagacaaagacggcaaacccauaaucgaugaugcgggcaaaacaaucggcgcggacuuuguuacgccaggaaauaaccaucacauugcaaucuuccgcgacaguucaggaaaacuccaggaacacccagucuccuucuuagaagcaaccauugcuaaaucacaugguuuagaugucauugacaggaacuacaacaaagaugaaggaugggaauuuuuauuuacucucaagcaaaaugaauacuuuguauuuccaaauucagaaacugguuuuaauccacuagauuaugacuuaaccgauccucgaaacuacgcagaaauuucacccaaccucuauaggguccaaucaaucagcacaaacgauuacuuuuucagacaucaucuagaaacuacgagcgagaaaaauaacucucuauaugggauaacauggaaaagaauacguaaugcaagugccuuagaaggacuuguuaaaguucggauagauaaucucgguagaauaguagcagugggagaauaugauuga

SEQ ID NO: 9087 - RNA, 4200 nt, Artificial Sequence
  Cas9 variant
auggagacacaagcaacagcacaacucauaagcggccaccucaaaggauauccaauauaugauuauuucguuggacuggacauagggacaaauaguguuggcugggcaguaacuaauaggauauacgaacuucuuaaauuuagaucccacaaaaugugggguagucgucuauucgaagaaggacaaacugcuguaguaagaagagguuuucgaagcauacgaaggcgacuugaaagacgaagguuacgauuaaaauuacuggaagcacucuucgcagaugcuauggcuagggucgauuccacauucuucauaagauugcgagaauccaaauaucauuaugaagacaaaacgaccggccacaaaucaaaacauauccuauucauagaugacaacuacacagaccaagauuacuucgcagaauacccaacaauuuaucauuuacgcgcagauuuaauggagaauggcacgucagauauccggaaacuauucuuagccguccaccauauccuaaaauacagaggaaauuuucuauaugagggcgcaacuuuugacucaaauucaagccuagauaccguauugaaaagggcuuuagaacaaauagaauuucauauauuuaaugcgacaagugaagacgcacuccauuccauacuagacaucguaaaauuacaagauaaaacgaagucagauaaagcgaaagcgauagaaucccuaguagacaccuauauaacugacaaaguagagagcucaugcaccgacaaggaaaaaaaagauuuguugaaagcagauaaaaaaagacuucgcgcauucgcaaaccuaauacuaggacuaaacgccaaucuaacagaucuauucggaacaauagaagaaauagaagaagacuucgucaagcuacagauuacuggugauacauacgaagaaaagcgagacgacuacgcaaaaguauggggugacacaauaagaauuauagaugacugcaaaaguguuuaugacaguaucauauuaaugaguauaaaagaaccaggauuaacaauaucccagaguaaaguaaaagcauuuaacaaacauaaagaagauuuagccauacuaaaaagacuguuaaaaucagacaaauauaucuacaaaaacauguuuaaagcggacgaaaaaggcuuggccaauuacguacacuacaucaaacagggaagaaaaaacgaaaccggauguaguugugaagacuucuauaaauacacaaaaaaaguagucgaaagucucccagauagcucagauaaagcauacauccucaacgaaauugaacuccaaaaacugcucccgcuccagagaaucaaagauaacggaguuauaccauaccaacuacaucuagaggaacucaaagcaaucuuagaaaaauguaaagauacuuuuccuuucuuaaacacugucucugauggauuuacagucgcggaaaaacucauaaagaugcuugaauuuagaauaccauauuacgucggaccacuaaacccaagucacaguauugacaaaggcggcuucgcguggguugaacgaaaagaaccuggucaaguuacacccuggaauuucgaagacaaaauagauagagaaaaaucagcagaagccuucaucaaaaaucugaccaauaaauguaccuaccucauaggagaggauguauuaccaaaaucaaguuuacuauauuccgaauuuaugcuucugaacgaacuuaauaacuuacggauagauggcaaaccucuugaacaagcuguaaaaaugcacuuaauagacgcaguuuuuaaaaaagaacacaaaaagcaaacaaaaaauaggauuauagaauuucucaaagauaacaauuauauccuaggaaaacacaaacccgaaguagacggucuagaugagucaauaaaaggagaucuagcgagcuacagagauaugaaaagaauccuaggagacgacuucgacguaucaauggcagagucaaucauuacuucaauaacaauauuuggggaaagcaaaaacauguuaagagaaacacuucgcaaaaaauucggcucgauccuuagcgaagaucaaauaagaagccuagcaaaacuaagauaccgagauuggggacgauuaucuaaaaaauuuuuaauaggcauugacggcugcgugaaaggagaggacggcacucccggaacaauaauagauaugaugagaaacaccagucacaaucuaauggaacuccucggcgacacuuuuaguuucauggauguaauaaucgaagaaaaugacaaacuaaccaaaggucaaguagucgacccucacgagauuauagaagaacuaggauuaucaccagcagucaaaagagcugucuggcaggcguugcgaauuguagacgaagugauucacauaaagaaagcauuaccauccagaauauucguugagguagcucgaacaaacaaggaugaaaaaaaaaaaaaagauagcagaaaaaaaagacuucaagaauuauauaaaucaauacaaaaagaaucaccggaauggcucucuguaacacgagacgaaucagauaaacuuauaaguaaccuggacagagccgacgacaguucccugcgaaguaaaaaauuauauuuauacuauacacagauggguagauguauguacagcggaagaguaauagacuuagaccaauugaauacagauaaauaugauauugaccacaucuacccgaggucacuaacaaaagaugauucauucgacaauuuaguacucugugaaagacaggaaaaugcuaagaaaucagauaauuauccaaucgacccagacauucaaaaugcacgaaaaccauuuuggacauucuuaaaagaucaaaaucuaauuagcucuagaaaguacgaaagacuaacaagaguacuuccauuagaagcagaugaucuuaccgguuucauugcaagacaauuaguugaaaccaaccaaucugugaaagccgugacaacccuacuacgaagauuauacccagggguagacguuguauucguaaaagccgaaaauguaaccgauuuuagacacgauaacgacuucauuaaaguacguucguuaaaccaucaccaucacgcaaaggaugcauaucuaaacauaguagucggcaauguauaucacgaaaaguucacaagaaacuucagaaaauuucuaaagaagaacggcgccaaaagaaccuacaaccucgccagaauguucgauuucgacgucaugucuacgaaugcgaaagauggcaaagccugggacauaaaaacaagcaugaacauuguaaaaaaaaugauggcuucaaacgacguaaggguuacaaaacgauuaauggaacaaaagggagcgcuaucagaugcuacaguuuauaaagcaucaguagcaggaaaagcaaaaggaggugcauauauaggaaugaaaacaaaagauagcgucuuuucagauguuucgaaauacggaggacgaaccuccauaaaaaacgcauauaguauaguuguagaauauacgggaaaaaaaaacgagauaauaaaagaaauugucccacuaccaguuuaucucauuaauagaaauaaaacugaucaagaauugauccauuauauaguaucuauaauuccucaagccaagaaugugucuauaauauauaaaaagcuaugcauaaaccaacuugucaaaguaaacggauuuuauuacuacuuaggagguaaaacaaacaauuauuuuuggauugacagcgcaauccaaguagucaucgcugacgaauggauaccauaccucaaaguauuagaaaaauuugacgucaugcguaaacagaauaaagaacuaaaaguuggaacaguaucaacuucuauacagaaccaaggaaaaaaaguagucaucaaaauucuugaagaaagaaacguggaauucuucaguuaccuaguagguaaauuacacuccaguauuuacagcaaaaugaaaggaaauaaagcaggcgaacuggcaacuaaaucacuagagauauucguaaacaugucacuagaaaaucaauguaucuauuuaauggaacuucuaaacuuacuuacaaacaaaaaagcaccugacgucaaaccccuaggaaucacagccagucgugggacaauagguucaaaaguaagcaaccaagaugaauuuaaaauaauuaaugaauccauaacuggucuuuacucuaaugaagugacuauaguauga

SEQ ID NO: 9088 - RNA, 4200 nt, Artificial Sequence
  Cas9 variant
augaacuuacguaacacaacagaugaauauaacauaggucuagacauggguacaaauucaguaggaugggcaguaacagacaaagcaggcgccaucgcucauuuuaaaggcaaaccaacccuaggaagcaggcucuuugaugcggcucaaacggcagcaggagccagaauccaccgaucacaacgaagaagauacguaagaagaagauggagacuagaccugcuacaaagccucuuccaagaugagguaaguaaaguugauagcgaauuuuucuguagauuaagacaaagcagauuauauguaggcgacagagagaaaggacaugcugauuacacguggccaauuuuuaaugauucagauuuuaacgaagucgauuauuauaaaagauuuccaacgauauaucaccuaagaaaauggcuaauggaaacagaugaaaaagccgauauacgauugauuuaucuagcgacacacaacauagugaagcaccggggaaacuuucuuagagaaaacaauaaaucauuaaguaguagagacgccaacccagcccaagcggugaaauccuugcgacuugcacucaacgauugguguagcgaaagagauuaugagugugcauggaaaggagaagaagaugauggagcaauagaugaagccauucucaauguccuagcugauggugagaaagggagaucagaccaagcuaaggaaauagcaaaacuaacuggcguugauuguggagaugcgaaacaaaguaaacaaugcaaugaagcaauagcaaaagcaaucguaggauuaaaaguagaaaugaaaaauauauuuggcgaauuuccggccgagaaaaccagcuauaucuaucuauccucugacgaagauguagaagcagucagagaaucauguccagaugauaguggagagcuauuucaagcgcugugcaaacuauauagugcuuacauacuacaagaacugcuuucauacgcagaucccucuggacagacaauaucagccaacaugguugcgaaguacaagcaauacgguagagauuuaagacugcuaaaagaacucacuagaacuuacgcaccacaaaaauacgaucuuuucuuuagaggagaaaccuaugcagguagcagcgauuauguaguugacgaagcaagaggauacacacgauauaacuuaggaacuacaaaggcaaacuaugacgauuuucaaaaaucaguuaaagaacuauuuaaaggaaccgaugcucuccaagaugagagauaccaagaaaugaugguagccuucggugaacagaaauucuuaagaagacugaaaacuuccgacaacggaaguauauacuaucaacugcaccuagaagaacuccauacgauauuagaaaaccaaggaaaacacuauccuuuucuauuaucagaagaggacaaaauagaaagucuagucaguuuccgaaucccuuauuacgugggcccauuaacacgaaagaacgcugcgauaggucacgacggaaaagagagauucgcuuggucaaguagaaaagacgguauggaacaugcaguaauaacaccauggaacugggaggagauaauugaucgcgacaaauccgcagaagauuucaucaugaggaugacgggagauuguacauauuuacaaggugagccaguauuaccaaaaugcaguuuauuauacgaggaguucugugcauuaaacgaauuuaacggcgcgcauuggacaguggacggugacgaugagcgucgcuucgacgcagcacaaagagaaaggauaaugugcgauuuauucaggagaacacguucaguuacauauaauaaaguuuccgacugguuagaaagaaaauauaacuuuaccggagcaagagucagaggcggacagggcgaacauggauuugagucaaaacuaggaagcuauauauucuuuugcaaagauguauuuaaaacagauggcuuagacgaggccgauuacaccaugauagaacaaauaauacuuuggucaacacucuuugaagacagagauauacugaaacgaaaaauagaagaggcuuauggaggugacagauuaacaucagaacaaaucaaaguuauaugcaagaaaagauuuacaggguggggaaggcuuucaaaacgacuccuuacagauauuaaaguaaacacagauacugggagaaaaagcauaauggauguauuaagagaaggaaacccaaauaacgggcaaagauccaggacuaugguauucauggaaguauuaagagaugaagacuuaggauuucagaaagcaauagauggauuaaacagggacuauuuucgagaacacaauaaugguuugauggauguuaacgauuugccgggaucucccgcuaucagaaggucgauaaaucaagcaguacguauaguagaugaaauugcauccauagcaagaaaagaaccaacuaauaucuucauagaggucacaagagaggaagacgauccacgaaagaaaggcaaaagaacuaagcgaagguacgaugcgaucaaaucagcauuagaaaaauucaagaaagaugacccuagucuguggaaagaacuaugcgaaaaagcaccaggagacauggaugaaagacuaagucuauauuucaugcaaagaggaaaaugcauguauaguggacgaccaauaaaaaucgaggaacuucauacggggaaauaugaaguagaucacauaauaccaagaaguuacauaaaagaugacaguuuugaaaauaaaguccuaguauaucgagaagaaaaucaacauaaaaccgacgcuuuauugauagauagcuccauaagacagaaaaugggcgguuauuggcguauguugcaugaugcaaagcuaguaggugacaagaaauuccgaaacuuauuucgcaaucacauagacgauaaagcgaugaaagguuuuguagcaagacaaaucgucgaaacaucgcaaaugguuaaauuaguccaaacucuauucgaagcuagguacccuaacacacgaauaguaccugucaaagcaggaauaucacacgauuuaagagaggcagcgggucuaguaaaauguagagaagcaaaugauuuucaccacgcacacgaugccuucuuagcuugccgaauaggauuauuuauacaaaaacgacauccaucaguguacgauaauccuauaggacuagcaaggauaaugagagauuaugcgcgaaugcaagcaagagaauauaagaaaucacacuguuuagcacauacacaagguuuuauagugaacucauuuuuauccagcggauuugaugaagaaaccggugagauauuuaaagaugauugggacgcaaaagcagagguagaagguauaagaagaguauuaaacugcagacaauguuuuaucucuaggaugccaguagaaggcgacacccgauacggaggacgauauuggggugaaacaauauauucuccuaaaggaaaacauaaacaugaaaucccacuuaaacaaggacuagaucccaacuuauaugguggauacucugacuugcuuuacuccuacuuuuugauauaugaagcaagcgauguaucuucuggugaacguguacucagauuuauaggcauaccgacaaguaucgccgcaaggauggcuaaccaaaaacgacucgaggaauacguuucuagacucgcacuucaagaaaauuuagaacacguaaggaugguuaggaaaauaaugaagaaacaauuaaucgaaguagauaauugcagauuauuaguaacugcugcagaugcaguaacuaaugcaacugaacuugcguuuagucuagaugaaaugaaaaucaucucuacgugugcuaaauguauaaauggggcugauccauccgccauugauaaaauaggcaaugcucaagauaguuucuuugauaaccuaaaaagaagaggaagcgacagaugcgcucuacuauucucucaguuaaaauuagauaaauugagccaaaauuucuacaugauaucaucagaugacaaauccaaaauuuugaucaguauacuugacagaauaagagcaaaaucaaauucaguagaucugucguugguuggaggggcaaaacacgcggcccaaaugaaauucgauuucaacgcuaagcuaaauaauccagcaagcaguuucguuuuaauagaccaaaguguuacagguauguuugaacgaaggacuagaauagguuuauga

SEQ ID NO: 9089 - RNA, 4203 nt, Artificial Sequence
  Cas9 variant
augaaucuaagaaaugccacuggagacuacucaauagguuuagauuuagggacaaauucaguggggugggcagucacagauuccaauggaucaauggcacauuuuaaagguaagccaacuuuagguucaagguuauuugacgcagcugaaacagcagcaggagcaagacagcaucgagggcaaagacgacgauauguacggagaagauggagauuagacuuauugcaagguuuauuucaggaugaaguaaacaaggucgauucugaguucuuuauaagacuuagacagucaagacuccauguagaagauagagccgaaggacaugccgguuacagauggccuuuauuuaaugacacugacuuuacugaaaaagacuauuauaaaagauuuccaacuaucuaucauuuaagaaaaugguugauggaaacagaugaaaaagcagacauacgacuaauuuauuuagcagcacauaauauagugaaacauagagguaauuuucugcgugaagauaauaaaaaccuaagcagucacaacgcaaauccagcagaagccguuaggaguuuaaggcaagcacuggacgauuggugugcggaacgaggcuauguuugcgcuuggacaagugucgacgauuuagccgaggcugacucacacaucuuggauauacuaacaaacagcaaagagagacgagcagaccaagcuaaagaacuagcgaaacuuuuuggaguugauuguggagauacaaaacagucuaaaagcugcaacucagcauuagccaaagccgucguaggauuaaaaacagaacuaaaagacguuuuuggugaguuuugcgcagagaaaacagcuauccaccuaaguagcgacgacgauguagaagcuauaagagacgcaauuccggaugacucaggcgaacuauuccaaguuuuaugcgcaguuuauagugcauauguauuacaagaacuauuauccuaugcgccgggacaaacuauaucagcaaauaugguagcaaaauaugaucaauacgggaaagaucucaaacuucucaaaaaucuagcaagaaccuacguaucucgggaaaacuacgaugcauucuuuagagggcagaccuacgaggauucgaaugauuacaacgucgauaaagcacaaggcuacacuagguauaauuugggaacaaccaaggcguccuacgaugacuuuaaaaagaguguagaaaaacuauuuaaagguacacaagcugagcaagacaaacgauaucaagguaugaugaagagauuugcagaagaaaaauuuuuaagacgucugaaaaccagugacaaugguucaaucuacuaucaauuacaccuagaagaacuacgggccauacuuaaaaaccaaggaaaacaucacccguuucucuuagaagaagaaaagaaaauagagagucuaguaaguuuuaggauuccguacuauguagggccccucucaucuaaaaaugcaucauuagaucacaaaggaaaacaaagauuugccuggagugaaagacgaccaggaaugaaagauacuguuauaacaccuuggaacugggaucagauuauagauugugaucagucugccgaaaaauuuauacuuagaaugacaggugacuguaccuacuuacaaggugaacccguauuaccaaaaugcucauuacuauacgaagaauauuguguguuaaacgaauuaaauggagcaagauggacuauugacggagaugacuggagaagauucgacguggcacagagagagggcauauuacaugaucucuuuaggaaaacucgaucgguagcuuauaauaaaguagcggacuggcuugaaagagaagaaaauugggcaaacgcacauguccgugggggacaaggagaaaauucauuugaaucaaaauuggguagcuauauuuucuuuugcaaagauguauucaaaacugccgcgcuagacgaggcugauuauccaaugauugagcaaauaauacuuuggaauacucuauucgaagauagagcaauuuuaaaaagaaagauagaacaagccuauggagaacaucacggaggaaaauuaaccgacgaacaaauaaaagucauuuguaagaaaagauuuacaggcuggggcagauuaucaagaaaacuacuaacaggaauaaaggucgaugcagacacagggcgcguuucaauaauggauguguuaagagaaggaaauccaaaugaaggucagcgaagcagaaccaugguccuaauggaaguacugagggacgaagaccuaggauuucagaagaaaauagaugauuuuaauaaggcauauuuugcaggacaaggggaaggauuaaugucagucaaugaucucccagggucuccagcaauaagacgaucaauaaaucaagcaauacgaaucguagacgaaauagcaucaaucgcaggaaaagccccaagcaacguuuuuauagagguaacaagggaggaagaugauccaaggaaaaagggaagaagaaccaauaggagguaugaagauauuaaaaacgcauuagaaaauuuuaaaacagaagaucaggaacuuuggagcgaacuauuaggaaaagcaccaaaugaucuagaugaacgacucagucuuuauuucaugcaacgaggcaaauguauguacagugguagaccaauuaaauuggaagaauuacauacaggaaaauaugaaguagaucauauaauuccgaggucauauauaaaggaugacuccuuugaaaacaaaguuuugguauguagggaagaaaaucaaaggaaaacaaaugaaauguuaauagacccagcaauucgucguagaaugggagauuauuggcgaauguuacacaaagcaaaauuaauaggggacaagaaauuuaauaaccuauucaugagggauagaaucgacgacaaaacauuaaagggcuucguugccagacagcuaguugaaacaagucaaucaguuaaauugguacaaaccuugcuagaaguacgauauccaaacacaaaaauugugccuguaaaagcuaauauaagucaugaucuaagggaagcagccgacuuagucaagugccgugaagcaaacgacuuucaccaugcucaugacgcauaucuggcaugucgaguggggcuauuuauucaaaaacgccauccaagcguauacgcaaaucccauuggccuaucgcgaguaaugagggauuacgcacgaaaacaagcaggcgaguucaauaagacacauucaauggcacacacaaaaggguuuauaguaaauaguuuuaugacuucugaauuugacaaagaaacaggagaaauauucugggaugcagaggcugcaguagaagacaucagaagagucuuaaauuaucgacaauguuuuaucucacguaugccuguagaagacacaggagcauuuugggaucagacaauauauuccccucgaagcaacaaaagguuagaauugccccuaaaagacgaucuagauccaaauaaauaugguucauacucaagagaacaauuugcauacuuuuucauauaugaagcaagagacgcaaagaaaucaaaaacaguauuaagauuugcacaaguaccaguacgaguaacaagcgcaaucgcaagggauagcucaaaauuagaugaguaugccagcgguuuagcaguacaagaaggauuagaguucaccaaaauaauaagaagaaggauacuaaagaaacaauuacuugaauuaaauggagauaggcucguaauaacgggugcaaaagaaguaaggaacgcgacagaauuugcauuuacucucgaagaaacagcuuuaguggcaaugugcucagaaauagcuagagaaggagucccaagugaaauugcauccgauguucaaagcauuagcucccaauuaucugaccuauuuuuagcacuuauugaaagaggauuaacaauaggaguucgacuccauggucaauuaaaauugggacaauaucuuagacaguuugaagacgcagcacuaagagacaaagcaaaagucauaauagggauuauaaguauuacuaauggggcaacuaacacucuagaucuaagcagcuuaaacgguaguaagaacguaggacaaguaagaauaacucauaacaaguuauuaaacgauaaaucaacauccuacgugcugauagaucaaagugucacuggaauguucgagagacgaacacggaucgguuuauga

SEQ ID NO: 9090 - RNA, 4203 nt, Artificial Sequence
  Cas9 variant
augaaaacuauuaccgaagauuacaucuuaggacuggacauaggaaccaauuccuguggaugggcaguaauggauaagaaaaaucgccuacuucgacuacgagggaaaagagcaauuggaagccaccuauucgaagaaggacauucggccgccgauagacgcucauucagaacaacuagaagacgccuaaaacgaagaaaauggagacuacgacuucucgaagaguucuucgcagaaccaauggcuaaagucgacccagccuuuuucguaagauuacaccaaucauggguaucacccuuagauaaagacaggaagaaauaccacgcaauaguauuccccacugcaaaagaagaucaugaguucuaccaugacuacccaacaauauaccaccuaagagaugccuuaaugagagaagaccgacaauucgacuugagagaaauauuuuuggcgauccaccacaucguaaaauaccguggaaauuucuugcaggacacacccguaaauagcuucguagcuagcaaaauagauguagcaucauuucucacaaauguuaaccaagcauacgcugauaaauacggagaagaacaaaauuuuauugaauuaaaugaaaacaacgcugcugcuaucgaagcaguaauccgcggaaaagacaaagauaaaacaacaaaacaacuagauaaagcuaagaaaauaacuaaauuacuacaaagcaguacaaacaaauaugagaaaaaugucacacgacaaauagccaacgcuauaauaggguacaaaacucaauucgaaacuauuuuaggaaaagauauagacaaaaaugauaaagcugacugggaauuuaaacuuucggacggagacgccgacgacaaacuugaaaaccuacuuccagaguucgacgacaacgaccaauauauuguagccgaaauaaagaaacucuucggaaguauugcacucucacagauagucuacgaaaauaugacacuuagccagucaaugaaaugcaaauacaaagaccacggagaagacuaugaucuacuaaaacaguauauagcaacacuuagugaccacucucagguuagaaaacuucuacucgcauacgaccuguacgucaauaacagacacggaagacuauuagaagcuaagaaagaauuuaaacaagacaaagcgcuuacgcaggacgaauuuuacaaaauaguaaaagaaaacuuagacgauagccaauuggcacagaaaauauugcagaaaauugacgaaggcaaauucaugccaaaacaaagagucaacaaaaacggcuauauacccuaucaacuucaccaaauagaauuagaucaaauaauagcaaaccaauccaaauacuauccauucuuagcggaagaaaaccccguuaaagaacaccgaaaacaagcgccauacaaacuagaugaauuaguucgguucagagugccauauuauguaggaccguuaaucaguccggaugacaaaagaaaagacgaacaacagaacaaaaaucaugaaauguucaaauucgcuuggaugaaaagaaaagacgacaacggggcaauaacacccuggaauuucgcccagaaagucgaccgagaaaccagcgcaaauagauuuauaaaacgcaugacgguuaaagacacauaucuaaucggggaagaugugcuucccgcuagaucacuauuauaccaaaaauucgaaguucucaaugaacucaauaauauacgaguaaaugggaaaaggcuugaaccaaaauucaaacaaaaaguuuucaaugaacucuuuaaacagaaaaauaaaguaacuaagaaagccuuuaaagaauuuauucuucaaaauacaggcaugaaaacagcugaaaucgauggacuagcagacccaacaaaauuuaacucaucuuugucaucuuauuaccauuuaaaaucuaccaaagucuuugacaaacaacuagacgauccgcaauaccaagcagauuucgagaaaaucauugaauauagcaguauuuuugaagacgcagaaauauaccaagaaaaacuacacaaagaaauaaaaugguuaacgccugcccaguuuaaagcaauugcuaacuggcgccuacagggaugggggagauuauccagaaaacucuuagucgaauuaaaaggcaaaggcggagaaaauaucaucuaucaauuauggaccacacagaaaaauuucaugcaaauagucaaugaaccagaacuaaagaaagcuauaguaaaagaaaaccaccaggcuaccgaagaaaaaggaauugagaaaauauuagaugauucauucaccagcccagcuaauaagaaagccauacgucagguuauuaaaguuguagaugacguaguaaaagcggcagggggcaagaaaccagcacaguuugcaauugaauuuacaagggaaccaaaauggaauccacaucucagcaacauccguggaacaaaacuacuucaaguauacgaagacacagccaaaaaguuaguagaucaauccuuaacagacucauuacgagaaaacaugacaaauagaaaucuacucaaagacgaauauuucuuauacuuuauacaagggggaagggaugcauacacaggaaagaaaauagacaucgaugauauacccaagaaauaccaaauagaccauaucuuaccccaauccuucauuaccgacgacagcuuagacaacagaguacuaacggaaauagaaaucaaccagaaaaaggguaagaaauaugcaucucaccuauucgcgccaaagccagccuuuggacuuaaucaauccauaucagaaauguggaagacauggcaaaaggcugguuuaaucucccaacgcaaacuaaauaaccuucuauucgacccagaccuaguaaaggacaaacaaaagaaaggauucauaaauagacagcuaguagaaacaagccaaauuauuaagcuagucaguauuauacuucaggauaaauuucccgacacagaaauaauaacaguaaaagcgggcuacaauacagcacuucgcaaagaauugaaauuauacaaaucuagagaagccaacgauuaccaccaugcaaucgacgcguacuuaacugcaauuugugauaacuuuuuguaucaaguauauccaaacuuucguccauuuuucguguacggacaauucaagaaauucucccaagacacagauaaacagaagaaagccgugaaauacuacggucuuaaaaauuuucuacuaccacuauuagaugacuccacuggagaugaagugaugguaaaucacacgaagcacguagucuuccacaaacaaagagauauauuuaacagauuaauacaagcauacaacuacaaauacaugcuagucagcagagaaaccacaacagaaaacagcaauauguucaacaugacuauauauccacguggagaaagagaccgcaaaaagacaaggaaacuuauaccaaaaggaaaagaucuagauccagccauauacggcggauauagcggaaauacagaugcauacauggucauagucaaaauagagaaaacuaaagaaacauuauauaaagucguaggaguucccaugcgcgcccuagcuucccucaagaaagcacaaaaagaagguaauuacgaucaagaacucaacaaaguauuagaaccacuaauaauguucaauaaaaauggaaaaaguaaagcagggauaaaaggcuuuacagugguaaaagaucacguacauuucaaacaaguugugauagacggugacuccaaauucauguuauauucugcucaauacagagcaaaugccaaacaacugacacuaucacaagaaaccaugaaagugguaacagauaacacagaugauauggaccagaaaaaugcagacaaagaccaauugcuauuaaaugcuuaugaugaaauucuugaaaaaguagaccaauaccuuccuuuauuugacauaaauggcuucaggcagggccuacaugacggucgagcuaaauucgcugcucucaagacaucugagaagaaauacacucucaaaaauguuuuaaauggccuacaugauaaccugguaacaccaaaccuaaagaacauagguauaaaaacaccauucggacuaaugcaaaguucaagcgguauaacauuaagcccaaaugcaaaacuuguauuccagucaccaacuggauuauucgaaaaacguguaaaauuaacaaaccucuga

SEQ ID NO: 9091 - RNA, 4203 nt, Artificial Sequence
  Cas9 variant
augggcaaacaaaaauuuaaugacuauuaucuaggcuuugacauaggaacaaacagugccggaugggcugucacagacuugcaauacaaauuacuacgauuuaacaaaaaagacauguggggaagcagauuauucgacgaagcacaaaccagcaaagaacgccgcguuuaucgcaauaguagacgacguuuggaucgacgaaaaaaaagacuuaaacuauuagaagaacuauuccuagacgaaauaucuaaaaucgacaacacuuuuuuuaagagacuaaaagaauccaacuuauauaacgaagacaaaagcauuaaauuuaacuacccccucuuuaacgauaaagacuacacagauaucgacuucuacaaugaauauaaaacaauauaucaucuaagaaaagauuuaauauuugaagauaaaaaauucgauauaagacuaguauucauugcccugcaucacauuuugaaauacagagggcauuucauauuugaaggacaaagcuucgaagaaauuaaaaguuuugauuccauauucacacaacuauccucauauuuccuagagaacuucgacuucaacauagauguuucuauaaaagaaaaauuagaagaaaucauucuuagugacaacaccaaaaguaucaaaaaaaccgaauucaagaaaauauuuagcgacaacaaaguacuaaguguucuaaacauggccaucgguucaaaaguaucauugaaggauguauucaauaacgaagaauuaaaagaacaaaaaaucucauuuagcgagaucgauuacgaaaacgaaaagagagaugaauucuaucaacuauuaggggaagauauuuuccuaaucgaucuagcaaaaaaaauuuacgauuucaugguucuuaaaaaaauccugaaaaauacagacaguuucucagcaucgaaagucgcauuauacugcgagcauaaaaaggaccuugaugacuuaaaauacaucuucaaaaaauaccuuacgaaagaagacuacuuuaaauucuuuagaucuaacguagaaaaaauaaacuaucccaguuacauaggcuugaauaaaauuaaaucuaaaaaaauaauuaaagaaaauaaaugcucaaucuccgacaucaacaaagaauuaaaaaacaaauacuuaaaagacauaaagcuagaagcuaaagacaaagagcuguucaaccgcaucuucaacaagcucgaugaauucaaauuucuggagaaacuaaaaucaucagagaauucgacaguccccuaccagguucaugaaauagaacuaaaaaaaauacuagacaaucaaagaaaauacuacccauuccuaaacgaaaaaauugacggaaaaaguguuuacgaaaaaauuauacaacuuuucgaauucaaaaucccuuacuacaucgggccacuaaacacugacccaaauguaaagggaaaaaacacauggguuguaaggaaggacgaaaauaacaaaacaccuauaacacccuggaacuuugaacaaaaagucgauaugcagaaaucagcagaagaauucauaaaacgaaugacaaauagaugcacauacuuaaaagcagaagacgucauagccaaaaauucauugcuguacgaagaauucauacucuugaaugaauuaaacaaaguaacuguugacaacgaaauauugcacccaacccucaagaccgaaauaaucaaugaacucuucaaaacgacaguaaaaguaacaaagaaaaaguucauagaauuccuaaaaaagaaacaagcaguuaacgacguagaaucaauaaccggcauaggaguugaauuuaauugcaaacuacaagguuacaacacauucagaaaaauauuagguaaaaagauagaaaauguuaacgucaaaaacuucgucgaaaaauguauugaacuaaaaugccuauauggaucugacaagaaauuauucgaaaacgccauuggaaagauauaccgagaguacaacauaacagacgaggaauuuaauaaaauaaaucgucuaaauuucaacaagugggcucgccugucuaaaaaauuucuaaccgaaauaucauucgaaaaaacagacggcacaaaaagguucgaaucaguuauagaagcauuaagaucuacaaauuacaaccucauggaacuucucucagacaaauucaaccuccaaaguaaaauagaugagauaaacggagaagaugacuucucgaauauagacaucaaagaauauguugacaaacuauauguaucaccuucaguaaaacgcaguauaauccaaacauacaagauagccauggaaauaaaaaaaauaaccaaaaaagacccuaagaaaaucuucaucgaaauggcaaaagauaaaggagaaaaaggcaaaacaacagaaaaacggaaagauaaaauaaaaaaauuauauaaaaacauaaaagacacucuaucggacuacugcaacaacuuacaagaccucacgcuacaaguagagaaauaugaugauaacagacugcgacaaaaaaaauuguuccuauauuucaugcaaaugggcaaaagcauguacacgggucgauguauugaccucgaagacuuauucaacaacaauguuuaugauauagaccauauuuacccacagagcaaagucaaagaugacucauucgacaacaucguguuaguagagaaagaagagaaucacagaaaauccaacgaacuacuaaaagaagaaauccaaucacgaaugaauaacuauuggauuuuucuacgggaaaacaaauucauaucaaaagaaaaauacaauagacuaacaagaaaaaaagacuucacugaugaagaacuaggagacuucguagccaggcaacuaguaacaacacgucaaaguaccaaagaaauugccaaauucuucgagaaaauuuucgaaaaaacaacgguaguguacagcaaagcaucacuuguaucugaauuucgugagaaauacgauauaauaaagguccgagaaguuaacgaugcacaucacgcacaagacgcauacuuaaacauaguaguaggcaacguauucaacacaaaauuuacaaaaaauuauuggaaauuuacaaaagacauaaaacgacaaaacgaagaaaacccaaacgaaaaaaaaggauacaaccugagaaaaauauacgagucagauguauucugcaaugauuccguugcguggguauacucaaaagaaaaucccaaauauaacacaauaaacacagucaaagacauggucuacagaaaaaccgcaaauauaacuagaauguuaguagaaggcaaaggucaacuauucaacuugacgauaaaagacaaaacacagcucaaaaaaaauguaggaaacauugucgcaaacaccccaaucucacuaaaaaacagaaaacuucaccuuaauagcguagaaauugcaaaaaaauacggauacuuugacaguuuaaacaaugcuuacuucguacucuucaaauaugaagagaaagguaaagaaaaaaucggguuugacucaauaaccauagcuuauaaagaaagacuaaaaaagaaccuagauaucgaaaaauuucuggaaaauaaaggguacaaaaauucuaaauuaauuaggaaaauauuuaaaaaccaaaaaguucuuaucaacgguuaucccuacuuauuaaaaucauucaauaaacaaucacaaauuaaauucaacaauuuuaaaauauuauauuuaaaugaaaacaaucuaaaauuugccaaagacgccaucaaguucgaaaagaacaacgcaaacguggaccucaaaaaacaaaaauacauagucucauuuuuaaaaaaaaaaaaacaaaaugagauuaaugaaacauaugaggaaugcaucgauagacucaacgacgaauucgacacacuguuuuuaaaacuuugcgauauacaaaaaagcagcauauacacuaacuacaaacuucaagauuucucaagcaacaaaaaaucgauagagauaaaagacaaauuugauaucuuuaaaucccucgacuuauauaaaaaaagcaaacucauaaaagaauucuuaaacuauuauaaauaugaaaaaaaugaucuagacuuuaguuugauagacaucgacaaaaaggcaaauugcauacagaaacacuucacagaagaccuagugaaagacuucguaauuguagaugaaagugucacuggccuuuuugucaaaaaagaaaggcuaaaguga

SEQ ID NO: 9092 - RNA, 4203 nt, Artificial Sequence
  Cas9 variant
augaaaacaaucacagaagauuauauuuuaggcuuagacauaggcacaaauucaugcggaugggcuguaauggauaagaaaaauagacuauuacgucuaagaggaaaaagagcaauaggcucacaccuauucgaagaaggccauucagccgccgacaggcggucuuuccggacuacacgaagaagacuaaaaagaaggaaauggaggcuaagacuacuagaagaaauauuugcugaaccaauggccaaaguagauccugccuuuuucgugagauuacaccaaaguuggguaucaccgcuagacaaagacaggaagaaauaucacgcaaucguauuuccaacagccaaagaagaccacgaguucuaccaugauuauccaacuauauaccaucuacgagaugcccuaaugcgagaagaccgacaauuugacuuacgcgaaaucuuccuagcuauacaucauauagugaaauauagagggaauuuccuacaagacacuccaguaaacucauuuguagcaucaaaaauagacguggccaguuuucuuacaaaugucaaccaggcuuaugcagacaaauacggagaagaacaaaacuucauagaacuaaacgaaaacaacgcagcagcuaucgaagcuguuauacgcggcaaagacaaagauaaaacaaccaaacaacuagacaaagccaagaaaaucacaaaauuauuacaauccucaacaaacaaauacgagaaaaacguaacaagacaaauugcaaacgccauaaucgguuauaaaacgcaauuugaaacgauacuaggaaaagacaucgauaaaaacgacaaagcugauugggaauuuaaacuaucagauggagacgcugaugacaaacuggaaaauuuauuaccagaguucgacgacaacgaccaauacauaguugccgagauaaagaaauuauuuggaucaauagcuuuaagccaaaucgucuaugaaaauaugacuuuaucccaauccaugaaauguaaauacaaagaccacggagaugacuaccaccuacugaaacaauacaucgcaacacucucagaccauggucaagugagaaaacuccuacucgcauacgaucucuacguaaauaaccgacacggaagauuauuagaagccaagaaagaauuuaaacaagacaaagcauuaacucaagaugaauuuuacaaaauaguccgagaaaaucuagauaauucccaacuugcccagaaaauuuuacagaaaauagaagaagaaaaauuuaugcccaaacaaagaguuaacaaaaauggguuuauaccguaccaacuacaccaaaucgaacuagaccaaauaauugccaaucaaaguaaauacuacccguucuuagcagaagaaaauccuguaaaagaacaccgaaaacaagcacccuacaaauuagacgagcuaguaagauuccgcguacccuacuacguggguccccuaauuucgccugacgauaaacgcaaagacaaacaacaaaauaaaaaucaugaaauguuuaaauuugcauggaugaaacgcaaagauaacaacggagcaauuacaccauggaauuuugcacaaaaaguagauagagaaacuucagcuaacagauucauaaaaagaaugacuguaaaagauacauaccucauaggagaagauguacuaccagcaagaucucugcuuuaucaaaaauucgaaguacuaaaugaacuuaacaacauacgcguuaauggaaaacgcuuagaaccaaaauuuaaacaaaaaguguuuaacgaacuauucaaacagaaaaauaaagucacuaaaaaggcuuucaaagaauuuauauuacaaaacacgggaaugaaaacagcggaaaucgauggacuagcagauccaaccaaauucaauucuagucuuagcucuuacuaucacuuaaaaucaacaaaaguauuugauaaacaacuagaugacccagaauaccaagccgauuucgagaaaauuauugaauauucaaguauauuugaagacgcagaaauuuaccaagaaaaacuccacaaggaaaucaaaugguuaauaccggcacaauuuaaagcaauugcaaauuggagacuacagggcugggguagauuaaguagaaagcuacugguugaacuaaaaggcaaaggaggcgaaaacauuauauaccaacuauggacaacacaaaagaacuucaugcagauaguaaacgaacccgaacuuaagaaagcuauaguaaaagaaaaucaccaagcuacagaagaaaaaggaaucgagaaaauacuugacgacuccuucacauccccugcaaauaagaaagcaauucgucaagucauaaaaguuguagacgauguaguaaaagcagccggaggaaagaaacccgcgcaauucgcaauugaguucacccgagaaccgaaauggaacccacaauuaucucauauuagaggaacaaaacuacuucaaguauaugaagacacagcgaaaaagcuaguagaccaaagucuuacagauucauugaaagaaaauaugacuaaccgcaauuuacuaaaagaugaauacuuccuauauuucauucaaugcgggagagacgcauauacagguaagaaaaucgauauugcagacauacacaagaaauaccagauagaccacauuuuaccgcagucauucauaacugacgacuccuuagacaauaggguuuuaaccgaaauagaaauuaaucagaagaaacacaagaaauacgccucccacuuauucgccacaaaaccugcauucggauuaaaccaauccauuagugaaauguggaaaacuuggcaaaaagccggacuaauaagucaaaggaaauuaaacaacuuguuauucgacccagacuuaguaaaagauaaacagaagaaaggauucaucaacagacaauugguagaaaccucccaaauaaucaaacucgucaguauaauacuucaagauaaauuuccagacacugaaauaauaacaguaaaagcgggcuacaacaccgcacuccguaaagaacuaaaacucuacaaaagcagggaagccaacgauuaccaucacgccauagacgccuaucuaacagccauaaacgacaacuuccuauaucaaguuuaccccaauuuuagaccauucuucguguacggccaauuuaagaaauuuucgcaagacaccgacaaacagaaagaagcaauaaaauauuacggucucaaaaacuucuuggaaccccuucuugacgauucaacaggagaugaagugauggucaaccacacgaaacacguagucuuucauaaacaacgugacauauuuaaucgacucauucaagcauacaacuacaaauacaugcuaguaagcagagaaaccacuacagaaaauucaaacauguuuaauaugaccauauacccuagaggggaaagagauaggaagaaaacaagaaaauuaauacccaaaggaaaggacuuagacccagcaaucuauggagguuauucaggaaauacagaugcuuacauggucaucgucaaaauagaaaagaccaaagaaacauuauauaaaguaguaggcguuccgaugagagcacuagcuagccuaaagaaagcccaaaaagaaggaaacuaugaccaagaacugaauaaaguacucgaaccucuaauaauguucaauaaaaacggaaaaaguaaagccggaauaaaaggauucacaguugucaaagaucacguacacuucaaacaaguaguaaucgauggugacucaaaguuuaugcuauacucagcacaauauagagcaaaugcaaaacaacuaacgcugucccaagaaacuaugaaagucguaacugacaacacagacgacauggaccagaaaaacgcagauaaagaucaacuacuguuaaaugcauaugacgaaauacuagaaaagguggaccaauaucugccccuauucgacaucaacgguuuuaggcaaggauuacacgacggcagagccaaauucgcagcccugaaaacaucagaaaagaaauauacacucaaaaacaucuugaacggauugcacgacaaccuugucacacccaaccucaaaaacauaggaauuaaaacaccauuugggcucaugcaaucaucgucaggaauaacccuaucaccaaacgcaaaguuaguuuuccaauccccaacaggauuguucgagaaaagaguaaaacucacaaauuuauga

SEQ ID NO: 9093 - RNA, 4203 nt, Artificial Sequence
  Cas9 variant
augaaaacuauuuuaggacuagaccuaggaacuaacucaauaggaugggcucuaguaaaagaaacagaaaauucaaacgaaaaaucagaaauuauaaaacuggguguaagaguaaauccacuaacgguagacgagaaaacgaacuucgaagcaggaagaccucuaucaacuaaugcagaccgaacagcuaaaagaagugcaagaaggaaucuacagagauauaaauuaaggcguaaaaauuuaauagaucuacuuaucaaacacaggcugauagacaaagacacaccuuuaacagaaaucggcaaaaauacaacacaccaaacauuagaauuaagagcaaaagcggcaagggaaagaaucgaacuagaagauuuggcucgaguauucuuggcaauaaacaagaaacgcgguuacagauccucacgcaaagugaacaacgaagaagaaggacaagucguggauggaauggcgguagcuaagaaauuauaugacgaaaaccucacaccgggacaauaugccuacgaacuacucaguaaaggaaagaaauauguuccagacuuuuaucgaucagaucuacaagcagaguucgacucuauuugggaauaccaaaaacaauuuuacgcagacauacuugacgacgaacuuuacaacgcccuaaaaggacaagggcaacaaaacucaagaaaacgauuccuagcaauaaaaggugucuacacagcugaaaacaaaggaaaaagagacgaaguaaaacuucaacacuauaaauggcgauccgaagcuauaacacaaaaacugaguauagaagaagucgcauacgucuuaguagaaauaaacaaugacuuaaauaaaucaucugguuacuuaggagcaauaucagacagauccaaagaacucuauuuuaauaaagaaacaguaggagagaacuuauggaaacaaauacagaaaaacccgcauacuagcuugaaaaaccaaguauuuuacagacaagacuacuuagacgaauuugaacaaauuugggaaacucaagcucaauuucacccacaacuuacauuagccuugaaagaacaaauacgagacguuguaauuuucuaccagcgcaaacucaaaucucaaaaaggacuguuaucauucugccaauuugaaagcugggaaaucgaaaggaaagacgaaaaugggaauguuauuuuaaacaaaacaacacagcuaccaaaacgucaaacaguaggccggagaguugccccaaaaaguucgccacuauuccaagaguucaaaaucuggcaaaacauaaacaaccuagaaaucgcuaaaauuagcgauggaaacagcaaaaacaagaaagaaacggaagcacuaucagaugacgaaagaaaacuacuauuugaagaguuaaaucuaagaggaaaucuaucacaaaaagagguauuacaaauacuuggguuaaaagacaaagaauacaaaacaaauuuuccagagggacuagaaggaaacagaacuaaugcagcgcuauucaacauauaucaacaaauagcugaaaaugaaggcuacggagacuggaccaagaaaagugcacaggagaucaaagaagaauugaaagccguauucccccagauaggaauacaagcggauauacucgacuuuaaugcagaacuagauggaaaagaguucgaaaaucaagccucauaucaauuauggcaucuacuuuauagcgcagaagaggaugauaaaauaaacgaggaggaccaaauaauauaugguaacuccgcaguaucucucaagaagaaacuaugcgaaaaauucgguuuuacaccagaguaugcaaaauggauagcaaacgucagucuacaagaugacuacgguaaccugucuacgaaagccaugagaaaaaucaucccauaccuaauagauggcaacgauuacucagaagcaugugcccucgcaggauacaaucauagcaauucguuaacgaaagaagaaaacgacaacagagaaagacuaaauaaacuugaguuacuccccaaaaacucguuaagaaauccagucgucgagaaaauauuaaaccaaaugguuaauguaguaaaucaaguaaucgaaacauacggaaaaccagacgaaguccgcauagaauuagcgagagaauugaaaaagucagcggaagaacgugccgaaaugacaaaagguauaaaugaagcuacaagaagaaacgaagacaucaagaaauuaauuaccaaaaauuucggcauucccaacccaaccaaaaacgauguaguaagauauagguugugggaagaacuagcuccccuggcguauaaagaugucuucacaggccggcaaaucaagaaagaagaucuauuuucaucaaaaaucgacauugaacauauaaucccaaaagcccugcuuuucgaugacaguuucaguaauaaaacgcuagcuuuucgagagacuaaccuaaagaaggcugauagaacagcauacgguuucaucgaaucagacuauaaugcaacacuagacgacuauauucagcgaguagagacacuauauaacaacgcaaaaggaacgauaucaaaaggcaaacgcaacaaauuguuaauggcucagaaaaaucuaccagacggauuuauagaacgggauuuaagaaauucccaauauauagccaagaaagcaaaaucaaugauagagaaaguuuucaaugacguaaauguaacaaguggaagcauuacagauagauuacgugaagacugggaccuaauaaaugucaugaaagaacucaauuuuccaaaauauaaagcacuaggacuaacggaaauagaagaacgauacgacauaggacaagagaaaacuaagaaaguugaagucauuacagacuggaccaaacgaaaugaccauagacaucacgcuauggacgcauuaacagucgccuucacaacuaaaagccauguacaauaucucaacaaccuuaacaccauacacaguuuaaaaggggaugaaguagaccuagaacugucuaaacuauauggccuuaaaaacacaauuacagagguaguaaacaagaaaagaaaauucauaccaccaaugccaaauuuucgcgaggaggccaagaaacacauagaaaccauccuaguuucgaucaaaaauaaaaauaaaguauacacuaaaaauauuaauaaaaccaagaaagaaagcgguuaucauacaaaagagcaacuaacaccacguggacagcuacacaaagaaacaguauacgguaaaagcaaaagaccuaugaauaaaccgacaaaaaucaacaaaaacuucucauuagagcaagcacaacuaauaauaaacguacaagaaaaagaguuaguacuacgucacuuagcacaauuugacaauaauccagcaguugcauucgacaccaaaacccucaagaaaaugccccuacucaaaaacggagaaccacucaaggaaguucucuguuucgaagaaauauuuacaauacgaaaagauauaacacccgaccucaaaauagaaaaaguuguagaugagaaaauaaaagcaauauuagaacaacgaaagaaagacuuuggaggaaaugcaaaagaagcauucucagacuuagacaaaaauccaauauggcuaaauaaagaaaaagggauauguauaaaaaggguaacaaucacaggcguauccaaugccgaagccuugcaucaccaaaaagaucaccuaggacgcgaaauacuagaugacaacggaaauccaauaccugcagacuucguaaguacgggaaacaaucaucauguagccauauaugaagaugaaaaaggaaaauuacaggagaaaguagucuccuuauacgaagcaguugcgagagcaaaucaaggacugcccgucguagauaagggucuaaaugaagaucucgguuggaaauucuuauuuacgaugaaacaaaaugaaauguucguauuucccaacgaugacuucgacguaaaugacauugacuuacuagacgaaaauaaugcgaagaucauuagucaacaccuauuccggguacagaaauuggccaccaaaaauuacauguucagacaucaccuggaaacaaauguacaagaaguaaaagaauuaaacgacauagcauacaagucaauuagguccacagagccgcucaaaaacaucaagaaaguccgaauaaaccacauaggcaagauuguacaagucggagaauacuga

SEQ ID NO: 9094 - RNA, 4209 nt, Artificial Sequence
  Cas9 variant
auggcuaagaaagacuauacgaucgguuuagacauaggaaccaauagcguaggcugggcaauaaucgaugauaaccucaaacuccuaaaacguaauaugaccaucaaaggaaacacagacaagaaaaguguaaaaagagacuuauggggaucuuuacuuuacagugggaacucagauaaaacaacaagugcagccgaugcaagaucgaaacgcggacucagaagacgauuacgacgacgaaaauauagacuugaucgucuaaaacaaaucuuuagcgaaauaauaaaugauaaagcucccaacuuuuucgacaaauuaaacgaaucauucuuaaacccuaaagauaagaaauacggaaaauaucaaauauuugauacagaaaaagaagaaaaagauuacuauagaagauacccuaccaucuaccaucuaagaaaagaccuaauagaaagcucaaagaaacaagacauccgauuaguauaccuagcacuugcgcauauauuaaaaucucgcggaaauuuucucuucgaaggcaacauagaugaccugaaaaacgacuuugcuggaauauaugaagagguagucgaauuauguaugacaauaaaugcugaagacgucgaccuagaguuugaggaagucgacaaacaaagucugaauagcaucauuaaaaaugaagauauauccgagauagaacaaggccuugaaaacuucgcggacgaacacguuauauuuaaagagcaaaauaaaaagaaaaacgacuuauucucaaacuguugcaaaauaauaugcggacauacaguaaaagcaaauaaauucgcaucagaacuagauucagaacuuuuuauaaguuucaaaagcgaugauuacgucgacguaaucgauguaauacaauccggaaacgagaauauagccaaccugcuucucgcuugccgcaaagcauacgauuacauaauguucaauagacuggucgaccuaaauauagacucaccagcuaaacugagcucaaauaugguaagccucuacaaucaacacgaaaaagaccucaaagcauacaagaaauugauaaaagaauuuaacaaauuuaaacgcucaaaugguuguaaagaucucgagaugauaauacuaacagcagacgauaucgacucuuucagaaagaaaguagacaagaaagagggcaaacuaaacggaauaaacaagaaaaucacccacgaacaggcacuaaagaaacaguuaaaagacaugaagaaaauacuugaagacaaaaacacugaggcggaagauaaacaaauaaacgauauacugaaaaugauaacaaguauagaagaaagaguaaacaaaaguuguuucuugaaaaaccuacgaaguacagacaacgcaagcauaccgaaccaaauacaacgacaagaaauggaagcuauccucgacaaacaagccaaauucuacccauuccucaacgaacacaaagacgaauuacuccaacuacucucauuucggauucccuacuacgucggaccacugguaaacaagaaauacagccgcuucgcuuggcuaguaagaaaagaaggucaaguccagaaaauaacgccaaccaacuucgauggcgugguugacaaacauaaaacggcugaaaaauuuauggaaagacuaauaggaaaagacguauauuuaccaaaugaaagaguacuaccaaaagcaagucucuuauaucaagaguacuguaucuucaaugaacuaacaaaaguggcauacauagauucaacagguaaaaagaacaacuucagcagcgaagaaaaauuaaauauauucgaaaaacucuuuaaaacuaagcgagaaguaacuaaaacagaucuauguaaaugcuuaaauaacguaugcaagcugaaagaaaaaguaaaagaaacagaaauuauuggaauaaaggcaaaauuuaacgcuaaauacuccaccuaucaugacuuaaagaaaauaaauggaauggaacaauuaauagccgacgaggagggaaaaccucuaugcgaagauaucauuucaauacucacuauauucgaagacaaggauauacgacuggucagacuaaaagaauuacuaugccaaaacaaggacuuaaucaauaaauuuagucuuagcgcagaaaaauuagcaaaaguguuaucaacaaaacauuacaaaggauucggcaauguaucggcuaaauuaaucaaugguauaagagauaaaaauugcaaaacaauucuugauuaucucauagaagacgauaaagaagccuauuauggacgaaauaacccaaaucgaaaucucaugcaacugguaaaugacucgcgucuagccuuuaagggacaaauugacagggaacaaaauacacaccucgaagaucucagccuagacgaguuuuuggaugaccuguacgugucaccaagcauuagacgcgguauuagauuaacaauccgauuaguagacgaacucguagaaauaaugggcuaccuaccaaagaauauaguaauagaaaugcccagagaagacggagaaaaaggaaagauagcagauacgagauacucuaaacuugagaaaauguugaaaaaggaugcagcauuagaagaucuuuauagaguauuaaaaacauacgagaaaaacaagaaagcauuagcaaaugacgcucuuuaucuauauuuccuccaaaacggaagagacauguauacuggaaaagaaauuaauuuauccgaauuacauucguaugacaucgaccacauaauaccuaaauccuucaaauacgaugauagcuuagauaacaaaguacugacagcaaagaaaaugaauauggauaaaagaaccggagccuuagaccacaauauaaucgaaaaucaaugcggauuuuggaggguacucuuacaacaagauaaaauaucacuagaaaaauauacaaacuuaaugaaaacagaguucaccgaagcugacaaagcggguuucauuaugagacagcuaguagaaaccagacaaauuacgaaauuuguugcacgcuacuuagacaacaaauucaauggacuuauaagcgauccaaacgacaaagucaacauuuuacuuccucgagcuagcuuaugccaucaauuucgcgaaacauucggcuucuacaaaguucgagaauuaaacgauaugcaucacgcacacgaugcauaucuaaacgcaguaauagccaauacccuaaauaaaaacgcauaccuaagcgaucuauuaaaauacggagcuuacucaaaauauaagaaaaacggguuuaauaacagcaaugguauuauggacuacuuugguaacacgcaauucaacugcuuauucguagucgaaagaacccuagauaaaugcagagucaauauagucaaacacccagaaacagcaaguggggaguucuauaaugaaacaauacagaaaaauaaaguaaauggaggcucgucaacaagaucacuaaaaagcucaguaaagguccuacaaaauacagaacaauacggugguuuuacaaauguuaauaacgcauacuuuauauuauucgauuauaaagcaaaaaguaaacuaaaaagaaaauuaaucggaguaccaauaguagaucgacaaaaauucgaacaagacccaguaacauacuuagaagccaaagguuucgaugaaccuaaauuagugcaaaaauuacuaaaauauacucuauuagaauacgaagauggaaaacggcgcuacuugacuggagugacaggaaaaagaugugaauuaguaagggcuaaucaacuccugcucccacgaaauaugauggcacuucugcaccaccuacaagaguggcaaaagcacgauuucgggauaaaagagaugacaaaaguuauuaaaaacaccaacaacaucgaagcuaaauucgauaaacuauucgaacacaugaugaaguuuauagauaaauauagcgaaccacccaaaauaguaucaucaaaaaucucagaggaguaucauaaacucagggaaaguuuaugccaagaugacaacaaaauaaaaauauacgcagaaaucgggaaagcgcuacuuagcuuacuacauuuagucgauuccaaaagcgccugcguauuuaaauucucuggccuagaaauaaacagaaucagauaucaaucaaucaacgaaaagaaagaaccaguaaucauauuccaaucucuaagcggauuaagagagucacgauauaaauacaaucaauga

SEQ ID NO: 9095 - RNA, 4209 nt, Artificial Sequence
  Cas9 variant
augaaacuccgaaaugcgaaagacuacagcauagguuuagacguagguacuggaaguaccgggugggcaguuaccacauuagauggagaccuuuuuacauucaaucacagaccaacauuagggagcagauuauuugaaagugcgaguacagcacaagaaacaagagaagcaagaggugcucgacgaagauuaaaaaggcgucgauggcgcaucucacuauuacaagaacaguuugcugcagaaauggaaucaugugacaguaacuuuuucauacgauuaaaccaaucacgauuauggcaagaagaucgcaccgaacagggaaaaggcuaccuuuucggaggaaaacccauuuuaugcggagcucaaauauucgccaaugaacaagaauauuaccaacaauuuccaacaaucuuucacuuacgcaaauuucuuguggaaugcuccgaacaaguugaucuaagacuaauuuaucuggcgcuucauaauauagucaaauauagagggaauuucuuauaccaagauaacaaaacacuuaacguccguaauuucaauuuagacucccaaauagcugacuuccucgaucaauuacaacuauggugcgaaaauaacgacuuaugcuuccaugaaaucgacgguacaacaacacucgccucccaacuaaauacuuguuuucaccaacaauccaaucaacaaaagaaagacacauuaaaaacuuucuucgcuacauguauagaaaacgauaaaaucgcaggcgaacucacaaaagcacuacuaggauacaaaacagauuuuaaaauuauauuuaauauugaaggagaaaaagaugaauacaaagccaaaugcaacgaagaggagaaaauucuuaaauuacaagaaacuauagaugaugccaaccagguucuuuuacaaucaauauugaacuuauacuccggaauaauaguagaaaagauauuaaacaauacagcugucaaaaaugaaucagcucaaugcacccuaucggcauaccauugcuauaguuacgcucucuauucgaaacaguuaagaacuuuaaagaaacuuguccgcaaauauaauccacaacguuauaacgaaugcuuuaaccuuucagcugaagacccaaaagcaaagaaacaauuaugcacauaugcacgauacaacgcacaacacucaacugauuacgaugaguucaagaaauacauaaaagaccuauucgaaaauacagacgccguaaacgacgccgcuuaucaacaaaugaaacaagauuuugaugaagaaaaauucuuaagaagacagaaaacauccgacaauggagucuacccauaccaauuucaucuagaagaaaugcaacuaauaaucgaaaaucaagcacaacacuaccccuuucucacaaaaauuaaaccuaaacucgagucacucgucacauuccgaaucccauauuauguuggacccuuaacccaaaaaggaauccaaaggaaugguagaaaauuugccuggagcaaacgcaacaaagaugccgaaaaccaaagaauauacccauggaauugggauagcaucauagauaaaucugcgucagccgaagcauucauccucaggaugacaggaaaaugcacuuaccuauacggagaagauguacucccuaaagaaucauuacuauaucaagaguucugcguacuaaacgaauuaaacggugcaagauggaauugcgacggugaacgaagaaugccauuaucaaacaaagacuguaaagcaauauacagacaauuauuccuaaagaaacaaaaaguaagcuacgcagacguuaguaauuacuugaaagcacaaggucauaucaacaacaguguagccgggggacaaggugaacacgguuucgaaagcacgcuaucaagccaccacuucuuuagaaaacuauuuaauguagacgcagccaaugauuuaaccgcgcaacaaaucgaaacugcagaacaacucauacuauggggcacuauauuugaagauaaagaaauauuugaacagaaaauaaaagaaagauuuggagauauguuuucuaaagacgaaauaaaaacgauagcuagaagaaaauuuucugguuggggaaaauguaguaaacaacuauuaagcggucuuacuguugaaacaccacgaggaagagaaucaauuaucgacguacucagaaauggacauccugaaaacggacgaacccuagucuucaugcaaguaauaacagacaagaaacucgaguuugauaagaaaaucgaggaauacaauaaugaacauuuagcaaaaacaaacgaaucgguccucgauaccgcuauaauguccccggccaucaaacgaggaguaaaucaggcucuccauauagucggugaaauaagaaggauaacaaaacacgauccaacaugcauauauauugaaaccaccagagacgagaaagauggaaaacauaacacacgaacauccagucgcuacucuucauuaaagaaaaaccuagaaacuuuaaaauccauagacaaagcaaacgcucccgcaauuaaacacucacuagaacucuuagaaacauacaagaaacaaaacauagaugauaaacuuuucuuauauuucacucaaaacggaaaaugcauguacuccgguaaaucacuagacauaaauaaucuaagcagcuaccaaauagaucaugugauaccacaaucauacaucacugacaauucuuucgacaacagaguacuggucuacgcaucagagaaucagagaaaaucugacaguuuacuuuuauccucaguuauccaagcaaaacaagaaccauucuggaccagccucgaaaaagcaggccuaauuucagagaagaaacacaauaaccuaaaaagaaaaucacuaucagacgcacaaauuaaaggauucauaaacagacaauuagucgaaacaucacaaaucguuaaaguacuacgagaugaacucagccgaauacuccccgauaccaaaauuaucccaguaaaagccagccuaucucacgacguuagaauagccugcaaucucuacaaaucacguacagccaauucauuccaccacgcgcaugacgcucuacuugccagcacaaugggucgauucguacaaacaagauucccagauauguacgaaaauccaguccgauacguaaaaauauugagagccuauauagcacaaagcaaauuacagcauagugcucaaacacgaaacuuugauucacgcagcuuuauggcccauucuuucuuuugugacuacucaaaugaaaacggcgauaccaucuggaacucagcuagugaaauagaaagacucagacgagccuuaaguuauaaaaauuuauacuuaacaagacgaccauucauugacgcaggacaauuuugggaccagaccauuuauucgccccacgauaaaaagaaaacuccagauucccuaauuccucucaagaaaaaccuagauacacaaaaauauggaggauauucaggcaaagacuacgcacacuucuucauauauucaguuuuaaacaaacaaggcgacgucgaauaucguuucgacggaguaccacucuauauagcggccaauaucaaccgcgacgaucguggggccuuagcccaguaugcuaaacagcucguagagcacgaaaauguaccuaaugcuaaacgaaaaaccaaagacuuggucuuccaacgaaucgaacgcgcaugcguaccaaaauaccaauuaauauguauuucucaaugcaguggagauuccgaucguucaguuucggauuacuacuacaucaccgguaagaaagaggugcguaaugcuuuacaacuagcauuuccaaugcaucuauauggagcuauaaacgcgaucgaagauaagaaagaauuagaugauagcgcguuagaggaacucguagucuauauacuacgaaacgcaccucguauagcuccagauguguuccggagacuaaaucuaaccgaaaaauuagccgacugcuuagacauccccgauagaauagaacuccaaaauucaauuuauggucuauucaauuuaaucaaugcagaaucaaacgucgugaaccuacaaauauuugggggcgcaaaaacagccggagugaaauuaauaaaccuaaacagucucuuaaaugauccagcuaccacggucacauuuaucgaucagucuguaacaggcauguuugaaaggaaagaaacgauaggaauuucuuga
